United States Patent 12,569,549 (FLAVIVIRUS VACCINE) - sequence listing, part 73

SEQ ID NO: 24948 - RNA, 9876 nt, synthetic construct
  misc_feature 1..9876: note = derived and/or modified CDS sequence (opt11) from DENV-2__GU131899__SS-prME
  source 1..9876: mol_type = other RNA
agcgcgggcatgatcatcatgctaatccccaccgtgatggccttccacctcaccacccggaacggggagccccacatgatcgtcggcatccaggagaaggggaagtcgctgctgttcaagaccgaggacggcgtgaacatgtgcaccctcatggcaatggacctgggggagctgtgcgaggacaccataacctataagtgccccctcctacggcagaacgaacccgaggacatcgattgctggtgcaacagcaccagcacctgggtgacatacgggacctgtaccaccaccggcgagcaccgccgggagaagcgctctgtcgcactggttccccacgtggggatgggcctcgagacccggacagagacctggatgtccagcgagggggcctggaagcacgcccagcgcatcgagacctggatcctgcggcacccgggctttaccataatggctgcgatcctggcctacaccatcgggaccacccactttcagcgcgtgctcatttttatcctgctcacggccgtcgctccctccatgaccatgcggtgcataggcattagcaaccgcgacttcgtggagggagtctccgggggcagctgggtcgacatcgtgctcgagcatgggtcctgcgtaacgaccatggcgaagaacaaacccacgctagactttgagcttatcaagaccgaggccaagcagcccgcgaccctccggaagtactgcatcgaggccaagctgacgaacacgaccactgagagccggtgccccactcagggagaacccagcctgaaagaggagcaggataagcggttcgtttgcaagcatagcatggtggaccgcggctgggggaacggctgcggcctgttcgggaagggtgggatcgtgacgtgcgccatgttcacgtgcaagaagaatatggagggcaaaatcgtgcagcccgagaacctggagtacaccatcgtggtgacaccccacagcggggaggagcacgcggtgggtaacgacaccgggaagcacggcaaggagataaaagtgaccccgcagagttccatcaccgaggcggagctaaccgggtatggcacagtcacgatggagtgcagcccccggaccggcctcgatttcaacgaaatggtgctgctgcagatggaaaacaaggcctggctcgtgcaccgtcagtggttcctggacctgcccctcccctggctgcccggggccgacaagcaggagtccaactggatccagaaggaaaccctggtcacgttcaagaacccgcacgccaagaagcaggacgtggtcgtgctcggcagccaggagggggctatgcacacggccctgaccggcgccaccgagatccagatgagctcagggaacttattgtttaccggccacctgaagtgccggctgcgcatggacaagcttcagttgaagggcatgtcgtactccatgtgtacggggaagttcaaagtggttaaggagatcgccgaaacccaacacggaacaatcgtgatccgggtgcagtatgagggggacggctctccctgcaagattccattcgaaatcatggacctggagaagcgctacgtcctcggccggctgatcaccgtgaatccgatcgtgacggaaaaagactccccagtcaacatcgaggccgagccgcccttcggggacagctacatcattatcggcgttgagccggggcagctgaagctcaactggtttaagaaaggctccagcatcggacagatgttcgaaaccacaatgcgcggagctaagcgcatggccatcctaggcgacaccgcctgggacttcgggtccctgggcggagtgttcacgagcataggcaaggccctccaccaggtgttcggggccatctatggcgcggccttcagtggcgtgagctggaccatgaagatcctgataggcgtgatcatcacctggattggcatgaactcccggagcacctccctgagcgtgtcactggtactcgtgggcatcgtcacgctgtacctcggagtcatggtgcaggccgacagcggctgtgtagtgtcctggaagaacaaggagctcaagtgcgggtcagggatcttcatcaccgataacgttcacacctggacggagcagtacaagttccaacccgagtccccctccaaattggcgagcgcgatccagaaggcccaggaagaggggatctgcggcatccgcagcgtcacgcggctggagaacctaatgtggaaacagatcacccccgagctgaaccacatcctggccgagaacgaggtgaagctcacaattatgaccggggacatcaagggcatcatgcaggcgggtaagcgcagtctgcggccgcagcccacggagctgaagtactcctggaagacctggggcaaagctaagatgcttagcaccgaatcctacaaccaaaccttcctgatcgatgggcctgagacggccgagtgcccgaatactaaccgcgcctggaactcgctggaggtggaggactacgggttcggcgtcttcacgaccaacatatggctcaagttgaaggagaagcaagacgccttttgtgactccaagctgatgagcgccgccattaaggacaacagagcggtgcacgctgacatggggtactggatagagtccgccctcaatgacacctggaagatagagaaggccagcttcatagaagtgaagaattgccactggcccaagtcccacaccctatggagcaacggcgtcctggagtccgaaatgatcatccccaagaacttggccggaccggtgagccagcacaactaccgacctggttaccacacccaaatcgcgggcccctggcatcttggaaagctggagatggacttcgacttctgcgacggcaccaccgtgatcgtcacggaggactgcgggaaccggggcccctcccttcgtaccaccaccgcctcaggcaagctgatcacggagtggtgctgccggagctgcaccttgcccccactgcgctaccgcggagaggacggctgctggtacgggatggagatccgccccctgaaagagaaggaggaaaatttggtgaactccctcgtgaccgctggccacggccaggtcgacaacttcagcctaggcgtactggggatggccctcttcctggaagagatgctgcggacccgcgtggggaccaagcacgcgatcctcctggtggccgtttcattcgtgaccctgatcaccggcaacatgagcttcaaagacctcgggcgggtcgtggtgatggtcggcgcaaccatggccgacgatatcgggatgggcgttacttacctggccctgctcgcagctttcaaggtgcgccccaccttcgccgcggggctgctactccggaaattaacgtccaaggagctgatgatgaccacgatcgggatcgtcctcctgagccagtcgacgatccccgagacagtgttagagctcaccgacgccctggcgttgggcatgatggtcctcaagatcgtaaggaacatggagaagtaccagctggccgtgacgatcatggccatcctgtgcgtcccgaacgcggtcattctccagaatgcctggaaggtgagctgtaccatcctggccgtcgtgtctgtgagccccctgttactgacctccagccagcagaagaccgactggatcccactggccctcacgatcaagggcctgaatcccaccgccatcttcttgaccacgctctcccgcacgaacaagaagcggagctggccattgaacgaggccatcatggccgtgggcatggtgtcgatcctggcgagttccctcctgaagaacgatatccccatgaccggccccctggtggcagggggcctcctgactgtctgctacgtgttgaccgggcggagcgccgacctcgagctggagcgggccacggatgtgaaatgggaggaccaggctgaaatatcgggcagcagccccatcttaagtatcaccataagcgaggacgggtccatgagcatcaagaacgaggaggaagagcagaccctcaccatcctgatccgcacgggcctgctcgtcatctcaggcctgttcccgataagcatccccgtgaccgccgccgcctggtacctttgggaggtgaagaagcagcgggccggtgtcctctgggacgttcccagcccgccgcccatgggcaaggcggagctggaggatggggcctaccgcatcaagcagaagggtatcctagggtacagccagattggcgccggcgtgtataaggaggggaccttccacaccatgtggcacgtcacgcggggcgccgtgctcatgcacaaggggaagcgcatcgagccatcctgggccgatgttaagaaagacttaatctcctacggcggtggctggaagctggaaggcgagtggaaggagggggaggaggtccaggtgctcgcactcgagcccggcaagaaccctcgggccgtgcaaacaaagcccgggctgttcaagaccaacactggcaccatcggggcagtcagcctcgacttcagccctggtacgtccggctcccccatcatcgacaagaaggggaaggtagtggggctctacgggaacggggtcgtgacccgctcaggcgcctacgtgagcgccatagcgcagaccgaaaagtcgatagaggataaccccgagatagaggacgacatcttccggaagcgccggctgaccatcatggacctgcaccccggggcaggtaaaacgaagcgctacttgcccgccatcgtccgggaggccataaagcgcgggctgcggaccctgattctagccccgacgcgcgtggtggctgccgagatggaggaggccctgcggggcctgcccatccgctatcagacccccgcgatccgggccgaacacacagggcgcgagatcgttgacctaatgtgccacgccaccttcaccatgcgcctgctcagcccggtgcgggtgccgaactacaacctgatcatcatggacgaggctcacttcaccgatccagcgagtatcgccgctagaggctacattagcacgcgtgtggagatgggtgaggccgccgggatattcatgaccgctacgccgcccggcagcagagatccgttcccccagtccaacgcccccatcatcgacgaagagcgtgagatccccgaacgctcctggaattccgggcacgagtgggtgaccgatttcaagggcaagacggtgtggtttgtcccgagcatcaaggcggggaacgacatcgcggcctgcctcaggaaaaatggcaagaaagtgatccagctgagtcgcaagaccttcgactctgagtacgtgaagacacggacaaacgactgggacttcgtagtgacgacggacatctccgagatgggtgcgaacttcaaggcggagcgcgtgatcgacccccggagatgtatgaagcccgtcatcctaactgacggggaggagagagtgattctggcgggacccatgccggtgacccactcttctgcagcgcagcgacggggtcgcattggccggaatcccaaaaacgaaaacgaccagtacatctacatgggagagcccttagagaacgacgaggactgcgcgcactggaaggaggcgaagatgctcctggataatatcaatacgccggagggcatcatcccgagcatgtttgaacccgagcgcgagaaagtcgacgccatcgacggtgagtaccggctccgcggagaggcacgcaagaccttcgtggacctcatgcggcgcggcgacctgcccgtgtggctggcctataaggtggccgcggaaggaataaactacgccgaccggcgctggtgcttcgacggcattaagaacaaccagatcctcgaggagaacatggaagtagagatctggaccaaggaaggggagcggaagaagttgaagccgcggtggctggacgcccggatctactctgaccccctcgccctgaaggagttcaaagaattcgccgcgggccgcaagtccctgaccctcaatctgatcacggagatgggccgtcttcccaccttcatgacccagaagacccgcgatgctctcgacaacctggccgtacttcacactgccgaagccggtgggcgggcctacaaccacgccctctccgagctgcccgagaccctggaaacgctcctgctgttgaccctgctagccacggtgaccgggggtatctttctattcctgatgagcgggagagggataggcaagatgaccctaggaatgtgctgcatcatcaccgcctccatcctcctgtggtacgcgcagatccagcctcactggatcgccgccagcatcatcctggagttttttctcattgtgctgctgatccccgagcccgagaaacagcggaccccccaggataaccagctcacgtacgtcgtgatcgccatattaactgttgtcgccgcgaccatggccaacgaaatgggcttcttagagaagaccaagaaggatctggggctgggctccatcgccactcagcagcccgagagcaacatcttggatatcgatctccgccccgcctccgcctggaccctgtacgcggtggccaccaccttcgtgacgcccatgttgcggcactctatcgagaacagctcggtcaacgtatccttgactgccatcgccaaccaggccaccgtgctgatgggcctggggaaaggctggcccctctccaagatggacatcggggtcccgctgctggccatcggttgctacagccaggtgaaccccatcaccctaacggcagccctgctgctcctggtggcccactacgcaattatcggccccggcctgcaggcgaaggccaccagagaagcccagaagcgggccgcggccggcataatgaagaaccccaccgttgacggtatcacggtgatcgacctcgacccgatcccatacgatcccaagttcgagaagcagctgggccaggttatgctactaattctgtgcgtcacccaagtcctgatgatgcgcactacctgggccctctgtgaggcccttaccctggccacgggtcccatctcaaccctctgggaaggaaacccggggcggttctggaacacgaccatcgcggtgagcatggctaacatcttccgcggctcctacctggccggcgctgggctcctgttctcgatcatgaaaaacactaccaacacccggcgcggcacagggaacatgggcgagacgctgggtgagaagtggaagtccagactgaacgccctcgggaaatccgagtttcagatctacaagcggtcaggcatacaggaggtcgaccgcaccctggcgaaagaggggatcaagcggggcgagaccgaccaccacgcggtgtcacgagggtcggcaaagctgcggtggttcgtggagcgcaacatggtcaccccagaaggcaaggtggtggatctcggctgcggccggggcgggtggtcgtactactgcggggggttaaagaacgtcagggaagtgaagggactgacgaagggcgggcccggacacgaggagcccatcccgatgtccacctacgggtggaacctcgtgcggctgcaatcaggcgtcgacgtgttctttatccctcccgagaaatgcgatactttactctgtgacatcggggaatccagccccaacccgaccgtggaggccggcaggacacttagggtcctgaacctcgtggagaactggctgaataacaatacccagttctgcatcaaggtgctgaacccctacatgccctccgtcatcgagaaaatggaggcgctgcagaggaagtacggtggggccttggtgcggaacccgctgagccgcaactcgacccacgagatgtactgggtctccaacgccagcggtaacatcgtctccagtgtaaacatgatctccaggatgctgatcaatcgcttcaccatgcggcacaagaaggccacctacgagcccgacgtggacctcgggagcggcacgcgcaacatcgggattgagtccgagatacccaacctggacatcatagggaaacggatcgagaagatcaagcaagagcatgaaaccagctggcactacgaccaggatcacccgtacaagacctgggcctaccatggctcctatgagaccaagcaaacggggtctgcgtcctcgatggtcaacggggtggtgcgactgctcaccaaaccgtgggacgtcctgccgaccgtgacccaaatggccatgactgacaccacccccttcgggcagcagagagtgttcaaagagaaggttgacacacggacgcaggagcccaaggaaggcaccaagaagctgatgaagatcacagccgagtggctctggaaggagctgggaaaaaagaagacgccacgcatgtgtacaagagaggagttcacccgcaaggtgcggtccaacgccgccctgggggcaatttttaccgatgagaacaagtggaagtccgcccgcgaggccgtggaggactctcgtttctgggagctcgtcgacaaagagcgcaacctgcacctggagggcaagtgcgaaacgtgcgtgtacaacatgatggggaagagggagaagaagctcggcgaattcgggaaggccaagggtagccgcgccatctggtacatgtggctgggcgcacggttcctcgagtttgaggccttagggttcctgaacgaggaccattggttctctcgcgagaacagcttatcaggcgtcgagggagagggcctccacaagctggggtacatcctgcgggacgtgtcaaagaaggaaggcggcgccatgtacgcagacgacacggcgggctgggacacccgaatcacactcgaggacctgaagaatgaggagatggtaaccaaccacatgaagggcgagcacaagaagttggctgaagccattttcaagctcacgtatcagaacaaggtcgttcgggtgcagcgccccacgccccgggggaccgtcatggacatcatcagccgtcgtgaccagcgcggttccggacaggtagggacctacggcctgaacactttcaccaacatggaggcccaactgatcagacagatggaaggagagggcgtgttcaagaacattcagcacctcaccgtcaccgaggaggtagccgtgcaaaactggctggcgcgcgttgggcgcgagcggctgagccgcatggccatctctggcgacgactgcgttgtgaaacccctcgatgaccggttcgccaacgccctgacggccctcaatgacatgggcaagatcaggaaggacatccagcagtgggagccgagcaaagggtggaacgactggacacaggtcccgttctgctcccaccacttccatgagctcatcatgaaggacggtcgggtgctcgtggttccctgccgcaaccaggatgaattaattggacgtgcgcggatcagccagggcgctgggtggtccctacgggagaccgcctgcctgggcaagagctatgcccagatgtggtccctgatgtatttccaccgacgggacctccgcttggccgcgaatgccatctgctccgcagtcccatcccactgggtgccaaccagccggacaacctggtcaatccacgccaagcatgagtggatgaccaccgaggatatgctaacggtctggaaccgcgtgtggatccgggagaatccctggatggaagacaaaacgcccgtggagagctgggaggagataccgtacctcggcaagcgggaggatcagtggtgcggttccttaatcggcctaaccagccgggccacctgggctaagaacatccaggccgccatcaaccaggtgcgcagcctcatcgggaacgaagagtataccgactacatgccgagcatgaagaggttccgccgcgaggaggaggaggccggcgtgctgtggtga

SEQ ID NO: 24949 - RNA, 9876 nt, synthetic construct
  misc_feature 1..9876: note = derived and/or modified CDS sequence (opt11) from DENV-2__GU131900__SS-prME
  source 1..9876: mol_type = other RNA
agcgcggggatgatcatcatgttaattcctaccgttatggccttccacctcactacccgcaatggggagcctcacatgatcgtcggcatccaggagaaggggaagtccttactgttcaaaaccgaggacggcgtgaacatgtgcaccctcatggcgatggacctgggagaactgtgcgaagacactatcacctacaagtgccccctcctacggcagaacgagcccgaggacatcgactgctggtgcaacagcaccagcacctgggtgacttacgggacctgcaccaccaccggcgagcaccgccgcgaaaagcgcagcgtcgccctggtgccccatgtggggatgggcctcgaaaccagaaccgaaacctggatgtccagcgagggggcctggaaacacgcccaacgcatcgagacctggatcctgagacacccgggctttactatcatggccgcgatcctggcttacaccatcggcactacccacttccagagggtgcttatattcatcctgctgacagctgtggcccccagcatgaccatgcggtgcatcggcatcagcaacagagactttgtggagggtgtctccgggggctcatgggtggacatagtgctcgagcacgggtcgtgcgttaccaccatggcgaagaacaagcccacgctggactttgagctgataaagactgaagcgaagcaacccgccaccctccggaagtactgcatcgaggcaaagctgaccaacaccaccaccgagagccgctgccccacccagggcgagccctccctgaaagaagaacaggacaagcggttcgtgtgcaagcacagcatggtggacaggggctgggggaacggttgcggcctgttcggcaagggggggatcgttacgtgcgccatgttcacgtgcaagaagaacatggagggtaagattgtgcagccggagaatctcgagtacaccatcgtagtaacgccccactccggggaggagcacgcagtgggcaacgacacggggaagcacggcatggaaatcaaggtgaccccgcagagctccatcaccgaggccgaactgaccgggtacggcactgtcacgatggagtgcagcccccggacgggtctcgacttcaatgaaatggtgctgctacagatggagaacaaggcgtggctcgtacaccgccagtggttcctggacctgcccctcccctggctgccgggtgccgacaagcaggagtccaactggattcagaaggagaccttagtaaccttcaagaacccccacgctaagaagcaggacgtcgtcgtgttaggcagccaggaaggggcgatgcacacagccctgaccggcgccaccgagatccaaatgtcttccgggaacctcctgttcaccggccacctgaagtgccggctgcgcatggataagctccagctgaagggcatgtcttactctatgtgtacgggaaagttcaaggtggttaaggagatagccgagacccagcacgggactatcgtgatacgggtccagtacgagggggacggcagcccatgtaagatccccttcgagatcatggatctcgagaagcgatacgtcctcggccggctgatcaccgtgaaccccatcgtcacggagaaggactcccccgtcaacatcgaggcggagcccccattcggggacagctacatcatcatcggagtggagccggggcaactgaagctcaactggttcaagaagggctcttcgattgggcagatgtttgagacaacgatgcgcggcgcgaagcgcatggcgatcctgggagacaccgcctgggacttcgggtccctgggcggggtgttcacgagcataggcaaggccctccatcaggtattcggggccatctacggcgcagccttctccggcgtgagctggacaatgaagatcctgatcggggtgattattacctggatcggtatgaactcccgtagcacctccctttctgtctccctggtgctcgtggggatagtcaccctgtacctgggcgtgatggtacaggccgacagcgggtgcgtggtgtcctggaagaacaaggagctcaaatgcggcagtggcatctttatcaccgacaacgtgcacacttggaccgagcagtacaagttccagcccgagagcccctccaagctggccagcgcgatccagaaggcccaggaggaggggatctgcggcatccggtccgtgacccggctggagaacctcatgtggaagcagatcaccccggagctgaaccacatcttagccgagaacgaggtaaagctcaccatcatgaccggggacataaagggaataatgcaggccgggaagcgcagcctgcggccgcagcccacggagctgaagtactcctggaagacctggggtaaagccaagatgctcagcactgagtcctacaaccagaccttcctgatcgatggtcctgagacagcggagtgcccgaacaccaatagggcctggaacagcttggaggtggaggactacggcttcggagtcttcaccaccaacatctggctcaagctgaaggagaagcaggacgctttctgcgactccaagctgatgagcgcggccatcaaggacaacagagcggtgcacgccgacatggggtactggattgagtccgccctcaacgacacgtggaaaatcgagaaagccagcttcatcgaggtgaagaactgccattggcccaagtcccacaccctctggagcaacggcgtcctggagtccgagatgataataccgaagaacctcgcgggccccgtgagccagcataactatcgtccggggtaccacacccagatcgcgggcccctggcaccttgggaagctggaaatggatttcgacttttgcgatggcacaacagtgatcgtcacggaggattgcgggaatagaggcccctctctccgtaccaccaccgccagcggcaagctgatcacagagtggtgctgccggagctgcaccctgccccctcttaggtaccgcggcgaggacggctgctggtacgggatggagatccgaccgctgaaggagaaggaggagaatcttgtcaactccctcgtgactgcgggccacgggcaggtcgacaacttcagcctgggtgtgctgggcatggccctcttcctagaggagatgctgcgaacccgcgtcggaactaagcacgctatcctcctggtcgccgtgtctttcgtgacacttatcacgggaaacatgtccttcaaggacctcggacgggtcgtggttatggtcggcgcgacaatggccgacgatatcgggatgggagtgacttacttagccctgctggcggccttcaaggtgcgcccaactttcgccgctggattacttctacggaaattaacctcaaaagagttgatgatgaccacgatcgggatcgttctcctgagccaatccaccattccagagaccgttttggagctcaccgacgccctggcgctgggtatgatggtgctcaagatcgttcgtaacatggagaagtaccagctggccgtgacgatcatggccatcctgtgcgtcccgaatgccgtgatcctccagaacgcctggaaggtgagctgcacaatcctggctgtcgtgtccgtgagccccctgcttctgacgtccagccagcagaagactgactggatccctctggcactcacgatcaaaggcctgaatcccaccgccatctttctgaccacattgtcccgcacgaacaagaagcgtagctggcctctgaacgaggccatcatggcggtcgggatggtatcaatcctggcctcgtccctcctgaaggacgacataccgatgaccggacccctggtagccgggggcctcttaaccgtctgttacgtgctgacggggcgcagcgccgacttggagctggagagggccacggacgtgaaatgggaggaccaggcggagatctccggtagctcaccgatcctctcgatcaccatttctgaggacgggtccatgtcgatcaagaacgaggaggaagagcagaccctcacaatcttgatccgcacaggcctgctcgtcatctccggcttattcccaatcagcatcccaattaccgctgcagcgtggtacctgtgggaagtgaagaaacagcgggctggggtgctctgggacgtccccagtccgcctcccatgggaaaggcggaattagaagacggggcttaccgcatcaagcagaagggcattctggggtactcgcagatcggcgccggcgtgtacaaggaagggacttttcacaccatgtggcacgtaacccggggcgccgtcttaatgcacaaggggaagcgcatcgagccctcctgggccgacgtgaagaaggacctgatcagctacggcgggggctggaagctggagggcgagtggaaagagggggaggaggtgcaggtcctcgccctggagcccggcaagaaccccagggcggtacaaacgaaacccgggctgttcaagaccaacaccggcactatcggggccgtgagtcttgactttagccccgggacgagcggcagccccatcatcgacaagaaggggaaggtcgtgggcctgtacggtaacggcgtagtgacccgctccggagcctatgtatccgctatcgcgcagaccgagaagtccattgaggacaaccccgaaattgaggacgatatattccggaagcgccggctgaccataatggacctgcaccccggggccggcaagacgaagcgctacctccccgccatcgtccgtgaggccatcaagcgcgggctgcggaccctgatcctcgcgccgacgcgtgtagtggccgccgagatggaggaggcgctgcggggcctgcccatccgctaccagacccccgccatccgggcagagcacacggggcgcgagatcgtagacctcatgtgccacgcgaccttcactatgcgcctactgagccccgtcagagtgccgaactacaacctcatcatcatggacgaggcccactttaccgatcctgcctccatcgccgcgaggggctacataagcacgcgggtggagatgggggaggcagctgggattttcatgaccgccacgccgcccggcagccgcgacccgttcccccagtccaacgcccccatcatcgacgaggagcgggagataccggagcgcagctggaactccgggcacgagtgggtgaccgactttaagggtaagacggtgtggttcgtgccgagtatcaaggcggggaacgacatcgccgcctgcctgcggaagaacggtaagaaggtcatccagctgtcccggaagacctttgacagcgagtacgtgaagacccggaccaacgactgggacttcgtagtcacgaccgatatctcggagatgggcgcgaacttcaaggctgagcgcgttatagacccccggcggtgcatgaagcccgtgatcctcaccgacggggaggagcgagttatcctggccggccccatgccggtgacccattcgtccgccgcccagcgccgggggcgcatcggccggaatcctaaaaatgagaatgaccagtacatctacatgggcgaacccctggagaatgacgaagactgcgcccactggaaggaggcgaagatgctcctggataacatcaacacgcccgagggtatcatcccgagcatgtttgagcccgagcgcgagaaagtggacgccatagacggcgagtatcggctgcgcggggaggcccgcaagaccttcgttgatctgatgcggcgcggcgaccttccggtgtggctggcctacaaggtggccgcggaggggatcaactatgccgatcggcgctggtgcttcgacggtatcaaaaataaccagattctcgaggagaacgtcgaagttgagatctggaccaaggagggggagcggaagaagttaaagccacgctggctggacgccaggatctactccgaccccctcgccctgaaggagttcaaggagttcgccgcgggccgcaagagcctgaccctcaacctgatcacggaaatgggcaggttaccgaccttcatgacccagaagacccgtgacgccctcgacaacctggccgtcttgcacacggccgaggccggcggccgcgcctacaaccacgccttatccgagctccctgagaccctcgagacactcttgcttctaacactgctagcaacggtgacagggggcatcttcctcttcctgatgagcgggcgcggcattggcaagatgaccctggggatgtgctgcataatcaccgcctctatcctcttatggtacgcgcagatccagccgcactggatcgcggccagcatcatcctagaattcttcctcatcgtgctgctcatccccgagcccgaaaagcagcggacccctcaggataaccagttgacgtatgttgtgatcgctatccttaccgtggtcgccgcaaccatggccaacgagatggggtttcttgagaagaccaagaaggacctcggcctgggctccatcgccacgcagcagccggagtccaacatcctggacatcgatcttcgcccggcctccgcctggaccctgtacgcggtggccactaccttcgtgacgcccatgctgcggcacagcatcgaaaacagctccgtcaacgtttcgcttaccgctatcgccaatcaggccaccgtgctgatgggcctagggaagggctggcccttgtccaaaatggacatcggggtccctctgctggcgattggctgctacagccaggtgaacccgattaccctcacggccgcactgctgcttctggtggcccactacgcgatcatcgggcccggcttacaggccaaggccacgcgcgaggcccagaagcgggccgcagccggcatcatgaaaaatcctaccgtcgacgggatcaccgtgatcgacctagacccgatcccctacgacccgaagtttgagaagcagttgggtcaggtgatgcttcttatcttatgcgtcacccaggtgctgatgatgcgaaccacctgggccctctgcgaggcccttaccctggcaactggtcccatctctaccctctgggagggcaacccggggcggttctggaacaccacaatcgctgtgtcgatggcaaacatcttccgcgggagctacctagccggtgccgggttactcttttcgatcatgaaaaacacgaccaacacccggcgcggcaccgggaacataggcgaaacgctgggagagaaatggaaatcccgcctcaacgccctcgggaagtccgagttccagatttacaagaagtccggtatccaggaagtcgaccggaccctggcgaaggaggggattaagcgcggcgagaccgaccaccatgccgtctcccgcgggagtgccaagctgcgctggttcgtggaacgtaacatggtcacccccgaaggcaaggtggtcgacctgggctgtggccgcggcgggtggagctactactgtggagggctgaagaacgtacgggaggtgaagggtctaacgaagggcggccctggacacgaggagcccatcccgatgtccacctacggctggaacctcgtgcgcctgcagtcgggcgttgacgtgttcttcatcccccccgagaagtgcgacaccctactctgcgacatcggggagtcgagccccaacccgaccgtggaggctggccggacgttgcgcgtcctaaacctcgtggagaactggctaaacaacaatacccagttctgtatcaaggtgctgaatccttacatgccgtccgtcatcgagaagatggaggccctgcaacggaaatacggaggggcccttgtacgcaacccgctgtcgagaaacagcacgcacgagatgtactgggtgtccaacgccagcggtaacatcgtctcctcagtgaacatgataagccgcatgctgataaaccggttcactatgcgccataagaaggccacctatgaacccgacgtggacctcggttcaggcacacgtaacatcggaatcgaatccgagatccccaaccttgacatcatcggcaagcgtatcgagaagatcaaggaggagcacgagaccagctggcactacgaccaggaccatccctacaagacctgggcctaccatggctcctacgagaccaagcagacggggagcgcgtccagcatggtcaatggggtggtgcggctgctcaccaaaccgtgggacgtcctgcccaccgtaacccagatggccatgacggacaccaccccattcggtcaacagagagtgttcaaagagaaggttgacacccggacgcaggagcccaaagaggggaccaagaagttgatgaagatcaccgctgagtggctctggaaggaattaggcaagaagaagaccccgcggatgtgtacgcgcgaggagtttacccgtaaggtccgctccaacgccgctctaggggcaatctttaccgacgagaacaaatggaaatccgcccgggaggccgtggaagactccaggttctgggagctcgtcgacaaggaacggaacctgcacctggaggggaagtgcgagacctgtgtgtacaacatgatggggaaacgcgagaagaagctcggcgagtttgggaaggccaagggtagccgggccatctggtatatgtggttgggcgcccggttcttagagttcgaggccctagggttcctgaacgaggaccactggttctcccgggagaacagcctctccggcgttgagggcgagggcctccacaagctggggtatatcctgcgcgacgtcagcaagaaagaaggcggtgccatgtacgccgacgatacggcgggttgggacacacggatcaccctcgaggacctgaagaacgaggagatggtcaccaaccacatggagggcgagcataagaagctggcggaggccatcttcaagctcacttaccagaacaaggtcgtgcgagtccaacggcccactccccggggaaccgtcatggatatcatctcgcggcgcgaccagcggggttctggacaggttgggacgtacggccttaatacgtttaccaacatggaggcccagctgattcgccaaatggagggggagggcgtgttcaaaaatatccagcacctcaccgtaaccgaggaggcggcagtgcagaactggttagcccgggtggggcgcgagcgcctgtcacggatggccatctccggagatgactgcgtcgtgaagcccctcgacgaccgcttcgccaacgcactgactgcgctgaacgacatgggtaagatccgaaaggacatccagcaatgggagccgagcaaggggtggaacgactggacccaggtgcccttttgttcccaccactttcacgaattgatcatgaaagacggccgcgtcctggttgtgccctgccgtaaccaggacgagctgatcggccgcgcccggatctctcagggcgctgggtggtccctcagagagacggcctgcctgggcaagagctacgcccagatgtggtccctgatgtacttccaccggcgcgacttacggctggctgccaacgccatctgtagcgccgtcccctcccactgggtgccgaccagtcgaacgacctggtccatccacgccaagcacgagtggatgaccaccgaggacatgctgacggtgtggaaccgggtgtggatccgcgagaacccctggatggaagataagacgcccgtggagagctgggaggagatcccctatctcggcaagcgggaggaccagtggtgcgggtccctgatcggtctgaccagccgcgcgacatgggccaagaacatccaggctgccattaaccaggtgcggtccctcatcgggaacgaagagtacaccgactacatgccgagcatgaaacgcttccggcgcgaggaggaggaggcgggcgtcctttggtga

SEQ ID NO: 24950 - RNA, 9876 nt, synthetic construct
  misc_feature 1..9876: note = derived and/or modified CDS sequence (opt11) from DENV-2__GU131901__SS-prME
  source 1..9876: mol_type = other RNA
agcgccggcatgattattatgctgatccccactgtgatggcattccacctcaccacccgcaacggggagccacacatgatcgtcggcatccaggagaaggggaaatccctgctgttcaagaccgaggacggagtgaatatgtgcaccctcatggcgatggatctgggggagctgtgcgaagacaccatcacatacaagtgccccttgctgcggcagaacgagcccgaggatatagactgctggtgcaatagcaccagcacctgggtgacatacgggacctgcaccaccaccggcgagcaccgccgggaaaagcgcagcgtcgcgctggtgccccacgtggggatgggcctcgagacccggaccgaaacctggatgtccagcgagggagcgtggaagcacgcgcagcgcatcgagacgtggatcctccggcaccctggcttcacgatcatggcggcaatcctggcctacactatcggcaccacgcacttccagcgcgtcctcattttcatcctgctgactgccgtggcaccgtccatgacgatgcgttgcatcggcatcagcaaccgcgacttcgtagagggcgtctccggtggtagctgggtggacatcgtgctagagcatggctcctgcgtcaccaccatggcaaagaacaagcccacgctagacttcgagctgatcaagacagaggccaagcaacccgccacactccggaagtactgcatcgaggccaagctgacaaacacgaccactgagtcgcgctgcccgacccagggcgagccctccctgaaggaggagcaagacaagcggttcgtgtgcaagcacagcatggtggaccgcggctggggcaacggctgcggcctgttcggcaagggcgggatcgtcacgtgcgccatgtttacgtgcaagaaaaacatggagggcaagatcgtgcaacccgagaacctggagtacacgatcgtggtcacgccccactccggggaggaacatgcggtgggcaacgacacggggaagcacggcatggagatcaaggtgacgcctcagagctccatcaccgaggccgaactgaccgggtacggcaccgtcacgatggagtgcagcccacggaccggcctcgacttcaacgagatggtgcttctgcagatggagaacaaggcctggctcgtgcaccgccagtggttcctggacctgcccctcccctggctgccgggggccgacaaacaggagtccaattggatccagaaggagaccctggtcaccttcaaaaatccccatgccaagaagcaggacgtcgtcgtcctcggctcacaggagggggcgatgcacacggccctaacaggcgccaccgagatccagatgagttccgggaacctcctgttcaccggccacctgaagtgccgcctccgcatggacaagctccaactgaagggcatgtcatattccatgtgtacggggaagttcaaggtcgtcaaggaaatcgccgagacccagcacggcaccatcgttatcagggtgcagtacgagggggacggcagcccctgcaagatccccttcgagattatggacctggaaaagcgctacgtcctcggccggctgatcaccgtgaacccgatcgttacggagaaggattcccccgtcaacatcgaagctgagccccccttcggggacagctacataatcataggcgtggagccgggccagctgaagctcaactggttcaagaagggctccagcatagggcagatgttcgagacgaccatgcgcggcgcgaagagaatggccatactaggcgacaccgcctgggattttggatccctggggggggtgttcacgagcatcggcaaggccctccaccaagtcttcggggccatttacggcgcggcattctccggcgtgtcgtggaccatgaagattctgatcggggtgatcatcacctggatcggcatgaattccagaagcacctccctaagtgtctccctggtcctcgtggggatcgtcacactgtaccttggcgtgatggttcaggccgacagcgggtgcgtcgtttcctggaagaacaaggagttgaaatgcgggagcggcatcttcatcaccgacaacgtgcacacctggaccgaacagtacaagttccagccggaaagccccagtaagctggctagcgccatccagaaggcccaggaagaagggatatgcggcattcgctccgtcacacgactcgagaacctcatgtggaaacagattacccccgaactgaaccacatactggccgagaatgaggtgaaattaaccatcatgaccggggacattaaaggcatcatgcaggccggtaagcgctctctacggccgcagcccacggagctgaagtactcctggaagacgtggggaaaggccaagatgctcagcaccgagtcctacaaccagacctttctgatcgacggcccggagacggcggagtgcccaaacacgaaccgcgcctggaacagtctggaggtggaagattacggattcggcgtcttcaccaccaacatatggttaaagctgaaggagaaacaggatgcattctgcgactccaagttgatgagcgccgccatcaaggacaaccgggcggtgcatgccgacatggggtactggatcgagtccgccctcaacgacacttggaagatagaaaaggccagctttatcgaggtgaagaactgccactggcccaaatcccacacgctgtggagcaacggcgtgctggaatccgagatgatcatccctaagaacctcgcaggcccagtgagccaacataactaccgcccggggtaccatacccaaattgcgggtccctggcacctgggaaaactggaaatggacttcgacttctgcgacggcaccactgtgatcgttacggaggactgcggaaaccgggggccctccctcagaactaccaccgccagcggaaagctgattacggagtggtgctgccgtagctgcactctgccaccgctccgttatagaggcgaggacggctgctggtacggaatggagatccgccccctgaaagagaaggaggagaacctcgttaactccttggtgaccgccggccacgggcaagtcgacaacttcagcctgggcgttctggggatggccctcttcctggaagagatgctgcgtacccgcgtggggacgaagcacgctatcttgctggtcgcggtctcgttcgtgactctgatcaccggcaacatgagctttaaagacctcgggcgggtcgtggtgatggtcggcgccacgatggccgacgacatcgggatgggtgtgacctacctggccctgctggcggccttcaaggtacgccccactttcgccgctggcctgctgctccggaagctgacgtccaaggaactgatgatgacaacgatcgggatcgtcctccttagccagtctaccatccccgagactgtcctggagttgaccgatgccctggcactgggcatgatggtgcttaagatcgtccgcaacatggagaagtaccagttggcggtgacgatcatggccatcctgtgcgtaccgaacgccgtaatcctccaaaacgcctggaaggtgagctgcaccatcctggcggtcgtgtccgtgagccccctgctcctgaccagttcacagcagaagaccgactggatccccctagccctcacgatcaagggtctgaatcccacggccatcttcttgaccaccctctcccgcacgaacaagaagcggagctggcctctgaacgaggctatcatggcggtcggcatggtgtcgatcctggcctcttccctccttaaaaacgacatccccatgaccggccccctggtagcaggggggctcttaaccgtctgttacgtgctgactggacgcagcgccgacttggagctggagcgggccacggacgtcaagtgggaggaccaggcggagatctccggctcctcccccatcctgagtatcactataagcgaagacgggtccatgagcatcaagaacgaggaggaggagcagaccttaactatcctcataaggacgggcttgttagttatatccggtctgtttccgatctcaattcccatcaccgccgcggcatggtacctgtgggaggtgaaaaagcagcgggccggagtgctctgggacgtcccgagcccgccgccgatgggcaaggccgagttggaagacggggcctaccgcatcaagcagaagggcatcctggggtacagccaaatcggcgccggggtgtacaaggaggggaccttccacaccatgtggcatgtgacccggggcgccgtcctcatgcacaaggggaagcgtatcgagccctcctgggctgatgtgaagaaggacctgatcagctatggcggggggtggaagctggagggcgagtggaaggagggggaggaggtgcaggtcctcgcattagagccgggcaagaacccccgggccgtgcagactaagcccgggctgttcaaaaccaacacaggcaccatcggagccgtgtccctcgacttcagccccggcacgtccggcagccccattatcgacaagaaagggaaggtcgtgggactgtatggcaacggcgtggtcacccgctccggcgcctacgtgagcgctatcgcgcagaccgagaagagtattgaagacaaccccgagatcgaggatgatatcttccggaagcgccggctgacgatcatggacctgcaccccggagccggcaagacgaagcgctacctccccgccatagttcgggaggccatcaagaggggtctgagaaccctgatcctcgctcccacccgcgtcgtggccgccgagatggaggaagccttgcggggcttaccgattcgctatcaaacccccgccatccgggcggagcatacggggcgcgagatcgtggacctcatgtgccacgccacttttacgatgcgtctgctgagccccgtccgggtccccaactacaacctgatcatcatggatgaggcccacttcaccgaccccgccagtatcgccgcgcgcggctacattagcacgcgcgtggagatgggagaggccgccgggatcttcatgaccgccacgccgcccggctcacgcgacccgttcccccagtccaatgcccccattattgacgaagagcgcgagattcccgagcgctcttggaactccgggcacgaatgggtcaccgacttcaaggggaaaaccgtgtggttcgtgccgtcgatcaaagcggggaacgacatcgcagcctgcctgcggaagaatggaaagaaagtcatccagctttcccgcaaaaccttcgatagcgagtatgtgaagacccggaccaacgactgggacttcgtggtcactaccgacatctccgagatgggtgccaacttcaaggcggagcgcgtgatcgacccccgccgctgcatgaagcccgtgattctcaccgacggcgaggagcgggtcatcctggcaggccccatgccggtgacccacagctccgcggcccagaggcgggggcgcatcggccggaaccccaagaacgagaacgaccagtacatctacatgggtgagcccctggagaacgacgaggactgcgcccactggaaggaggcgaagatgcttctggacaatattaatacgcccgaaggcatcatcccgagcatgttcgagcccgagcgcgagaaggtggacgcgatcgacggcgagtaccggctgcgcggggaggcccgcaagaccttcgtcgacctgatgaggaggggagacttacccgtgtggctggcctacaaggtggccgccgaggggatcaactatgctgaccggaggtggtgcttcgacgggatcaagaacaatcagatacttgaggagaacgtcgaggtggagatttggactaaggagggcgagagaaagaagctgaagcctcgctggctggacgcgaggatctactcagaccccctagctcttaaggaattcaaggagtttgctgcgggccgcaagtcacttaccctcaacctgattacggagatgggccgactgcccaccttcatgacccagaagacccgagacgcactcgacaacctggccgtcctgcacacagccgaggccggtggccgggcctataaccatgcactctccgagctgcccgagaccctggagactctcctgcttctcacgctgctggccacggtgaccgggggcatcttcttattcctgatgagcggcagagggatcggcaagatgacactggggatgtgctgcatcatcaccgcctccatcctcctgtggtacgcgcaaatccagccgcactggatcgcagccagcatcatcttggagttcttcctcattgtgctgctgatccccgaaccagagaagcagcgtacgccgcaagacaaccagctcacatacgtcgtcatcgccatcctaaccgtggtcgccgcgaccatggccaacgagatgggcttcctggagaagaccaagaaggacctcgggctgggcagtatcgcgacacagcagccggagagcaacatcctggacatcgacctccgccccgccagcgcctggaccctgtacgcggttgccaccaccttcgtgacgcccatgctgcggcacagcatcgagaacagctccgttaacgtaagcctaaccgctatcgccaaccaggccaccgtgctgatgggcctggggaagggctggcccctcagcaagatggatatcggggtcccgctgttagcgatcggctgctatagccaagtgaaccccatcacgcttacagcagccctgctgctcttagtggcccactacgcaatcatcgggcccggcctgcaggccaaggccacccgcgaggcccagaagcgggctgcggccggcatcatgaagaaccccacagtggacgggatcaccgtgatagacctcgacccgattccctatgaccccaaattcgagaagcagctgggccaggtgatgctgctgatcctgtgcgtcacccaggtgttaatgatgcgcacgacctgggccctctgcgaagcccttaccctggccaccgggcccatatccaccctttgggaaggcaacccggggcggttctggaacacaaccatcgcggtgagcatggccaatatcttccgcggttcctacctggcaggagccgggctccttttcagcatcatgaagaacacgaccaacacccggcgaggcaccgggaatgtcggcgagacactcggcgagaagtggaagtcccgcctgaacgccctggggaagtccgagttccagatctacaagaagtccggcatccaggaggtggaccggaccctggcgaaggaggggatcaagcgcggagaaaccgaccaccacgccgtatcccgggggtccgccaagctgcgctggttcgtcgagcggaatatggttacccccgagggtaaggtggtcgacctcggctgcgggcgcggcgggtggagctactactgcggcgggctgaagaacgtgcgggaggtgaagggcctaacgaagggcgggcccggccacgaggagcccatcccgatgtccacctacgggtggaacctcgttcgacttcagtctggcgtagacgtgttcttcataccgccggagaaatgcgatacccttctctgcgacattggggagtcgtcgcccaacccgaccgtcgaggccggccggacactgagggtgctgaatctggtcgagaactggctgaacaacaacacccagttttgcatcaaagttctgaacccctacatgccttccgtgatcgagaagatggaggcgctgcaacggaagtacggcggggccctcgtgcgcaatccgctgagccggaacagcacacacgagatgtactgggtctccaatgccagcggcaatatagtgtccagcgtgaatatgatttcccgcatgttgatcaaccgatttaccatgcgtcacaagaaggcgacctacgagcccgacgtcgacctcgggtcagggacgcggaacatcgggatcgaatccgaaatcccgaacctggacataatcggcaagcgcatcgagaagattaaggaggagcacgagaccagctggcactacgaccaggaccatccctacaagacctgggcgtaccacggctcctatgagaccaaacagactgggagcgcgagcagcatggtgaatggcgtggtcaggctgctcaccaagccgtgggacgtgctgcccaccgtgacccaaatggccatgacggacaccaccccgttcggccagcagcgcgtcttcaaggagaaggtggacacccgcacgcaggagcccaaggaaggcaccaagaagttgatgaagatcaccgccgagtggctctggaaggagctgggcaaaaagaagaccccgcggatgtgcacgcgcgaagagttcacccggaaggtccgatcgaacgcagcactgggggcgatcttcaccgacgagaacaagtggaagtccgcccgagaggctgtcgaggacagtcgcttttgggaactcgttgacaaagagcgaaacctacacctggagggcaagtgcgagacctgcgtctacaacatgatggggaagcgcgaaaaaaagctcggcgagtttgggaaagccaagggcagccgggccatctggtacatgtggctaggcgcgcgtttcctggagtttgaggccctcgggttccttaacgaggaccactggttctcccgggagaactccctttccggcgtagaaggggaaggcctccacaaattggggtacatcttgcgcgacgttagcaagaaagagggcggcgccatgtacgcggacgacacggcggggtgggataccaggatcaccctcgaagatctgaaaaacgaggagatggtcaccaaccacatggaaggagagcacaagaagctggccgaggccatcttcaagctcacgtaccagaacaaggtggtgagggtccagcggcctacgccccgcgggaccgttatggatatcattagccggcgcgaccagcggggttccggccaggtgggcacctacggcctgaacacgttcaccaacatggaggcacagctgatacgccagatggagggggagggcgtctttaagaatatccagcacctcacggtaaccgaggaggccgcggtgcaaaactggctggcccgggtagggcgggagcgcctgagccggatggccatctccggcgacgactgcgtggtgaagcccctcgatgaccgattcgccaacgccctgactgcgctgaacgacatgggcaagatacggaaggacatccagcagtgggagccaagcaaggggtggaacgattggactcaagttcccttctgttcccaccacttccacgaactaatcatgaaggacggaagagtgctcgtggtcccctgccggaaccaggacgagctgatcgggcgcgcccggattagccagggcgccggatggtccctccgcgagaccgcctgtctcggaaaaagctatgcccagatgtggtcgttgatgtactttcaccggcgcgacctccggctggcggccaatgccatctgcagtgccgtcccctcccactgggttccgacgagccgcacgacctggtccatccacgccaagcacgagtggatgactaccgaggacatgctgaccgtctggaaccgggtgtggatccgcgagaatccctggatggaggacaagacgcccgtcgagagctgggaggagattccctacctcgggaagcgggaagaccagtggtgtgggtccctgatcggcttaacgagtcgcgcgacctgggccaagaacattcaggccgcgattaaccaggtccggtccttaatcgggaacgaggagtataccgactacatgccgagcatgaagagattcagacgcgaagaggaggaggcgggcgtcctgtggtga

SEQ ID NO: 24951 - RNA, 9876 nt, synthetic construct
  misc_feature 1..9876: note = derived and/or modified CDS sequence (opt11) from DENV-2__GU131902__SS-prME
  source 1..9876: mol_type = other RNA
agcgcgggcatgatcatcatgttaatccccaccgtgatggcgttccacctcaccacccggaatggggagccccacatgatcgtaggcatccaggagaagggcaagagcctgctgttcaagaccgaagacggggttaacatgtgtaccctcatggcgatggacctgggggagctgtgtgaggacacgataacctacaagtgccccctgctgcgccagaacgagcccgaagacatcgactgttggtgcaacagcaccagtacctgggttacctacggcacgtgcaccaccactggcgaacatagacgggagaagcgaagcgtcgccctggttccccacgtggggatggggctcgagactcggaccgaaacctggatgtccagcgagggggcttggaagcacgcccagcgcatcgagacctggatcctccggcacccaggcttcacgataatggcagcaatactggcttacaccatcgggaccacccacttccagagggtccttatctttatcctgctgaccgccgtggccccctccatgaccatgcgatgcattggcatcagcaaccgggacttcgtggagggcgtgtccgggggctcatgggtggacatagtactcgagcacggttcttgtgtcactaccatggctaaaaacaagcccacgcttgatttcgagctgatcaagaccgaggcgaagcaaccggccactcttcggaagtactgcatagaggccaaattgaccaacacgaccaccgagagccgctgcccaacccagggcgagccgtccctaaaggaggagcaagacaagcgtttcgtgtgcaagcacagcatggtggaccgcggctgggggaacggctgcggcctgttcggcaagggcgggatcgttacgtgcgccatgttcacatgcaagaagaacatggaaggcaagatagtgcagcccgaaaacctggagtacacgatcgtggtcacgccccattccggagaggagcacgcggtgggcaacgacactgggaagcacggaatggaaatcaaggtgaccccgcagtcttccatcaccgaggccgagttaacgggttacggcaccgtcactatggagtgcagcccgcggacgggcctcgatttcaacgaaatggtgttgctgcaaatggaaaacaaggcctggttagtgcaccggcagtggttcctggacctgcccctcccctggctgccgggggcagacaagcaggagtccaattggatacaaaaggagaccctggtaaccttcaagaacccccacgccaagaagcaggacgtcgtcgtgctcggaagccaggagggggcgatgcacacggcactgaccggcgccaccgagatccagatgagcagcgggaacctcctgttcaccggccacctgaagtgtaggctccgcatggacaagttgcagctgaagggcatgagctactccatgtgcacagggaagttcaaggtcgtcaaggagatcgccgagacccagcacgggacgatcgtgatccgggtgcagtacgagggggatggaagcccctgcaagatccccttcgagatcatggacctagagaagcgctacgtcctcggacggctgattaccgtgaatccgatcgtgacggagaaggactcccccgtcaacatcgaggcggagccgcccttcggggatagttatatcatcatcggcgttgagccgggccagctgaaactcaactggttcaaaaaaggctccagcatcgggcagatgttcgagaccaccatgcgcggcgcaaaacgcatggcaatactgggcgacaccgcctgggacttcggaagtctgggcggggtgttcacgtcgatcggcaaggccctccaccaagtctttggggccatttatggcgcagcattctccggggtgagctggaccatgaagatccttatcggagtgatcatcacctggatcgggatgaactcccggagcacttccctgagcgtctccctggtgcttgtgggtatcgttacgctgtacttaggcgttatggttcaagccgacagcgggtgcgtggtatcgtggaaaaacaaggagctcaaatgcggcagcggcatctttatcacagacaacgtacatacctggaccgagcagtacaaattccagccagagagcccgtccaagctggccagcgccatccagaaggcccaagaggaggggatttgcggcatccgctccgtcacgcggctggagaacctcatgtggaagcagatcacccccgaactgaaccacatcctggccgaaaacgaggtgaagctcaccatcatgaccggggacatcaagggtatcatgcaggccgggaagcgcagcctgaggccgcagcccacggagctgaagtactcttggaagacctggggcaaggccaagatgctcagcaccgaatcctacaaccagaccttcctcatcgacggcccagagacggcggagtgccccaacaccaaccgggcctggaacagcctggaggttgaggactacgggtttggtgtattcaccaccaacatctggctgaagctgaaggagaagcaagatgcattctgcgactccaagctgatgtcagccgccatcaaggacaatcgggcggtgcacgccgacatgggttactggatagagtccgccctcaacgacacgtggaagatcgagaaggccagtttcatcgaggtgaagaactgtcactggccgaaatcccacaccctgtggagcaatggcgtcctcgaatccgaaatgatcatccccaaaaacttagccggcccagtaagccagcacaactaccgcccggggtaccacacccagatcgcgggcccctggcacctggggaagctggaaatggacttcgacttctgcgacggcacgacggtgatagtcactgaagactgtgggaaccggggtccctccctccgcaccaccaccgctagcggcaaactgatcgccgagtggtgctgccggtcgtgcacgctcccccccctccgctaccgcggggaggacgggtgctggtacgggatggaaatccggccactgaaggagaaggaggaaaacctggtcaactccctcgttaccgccggccacggccaggtcgacaacttcagcctgggggtgctgggtatggccctcttcctcgaggagatgctgcgtacccgcgtggggaccaaacacgccatcctcctggtcgccgtctccttcgtgacgctgatcacaggcaacatgagcttcaaggacctcgggcgggtggtggtgatggtaggcgccaccatggccgacgacatcgggatgggcgtgacctacctcgcgctcctcgccgcgttcaaggtgcgccccaccttcgcggccggtctgctgctcagaaagctgacctccaaggagctgatgatgacaaccattgggatcgtgttactaagccaatccacgatccccgagaccgttttagagctcaccgatgcattggccctgggtatgatggtgctcaagatcgtccgcaacatggagaagtaccagctggccgtgacgatcatggccatcctgtgcgtcccgaacgcggtgatccttcagaacgcgtggaaggtgagctgtacgattctggctgtcgtatccgtaagccccttgctcctgacctccagccagcaaaaaaccgactggatccccttggccctcaccattaaggggctcaaccctacggccatcttcctgacgaccctcagccggactaacaaaaagcggagctggccgctgaacgaggcgattatggccgtaggcatggtgtccatactggccagctccctcctgaagaacgacatccccatgacgggcccactggtggccggtggcctcctgacagtctgctacgttctgaccgggcgctctgctgacctcgagctggaaagagcaaccgacgtgaagtgggaggaccaggccgagatcagcggcagtagccccatactgtccataacgatcagcgaagacgggagtatgagcatcaagaacgaggaggaggagcagaccctgacgatcttgatccgcaccggcctactcgtgatctccggcctgttccccatcagcatccccatcaccgccgccgcgtggtacctgtgggaggtgaagaagcagcgggcgggggttctctgggacgtccccagcccgccgcccatgggcaaggccgagctggaggacggggcataccgcatcaagcagaaaggcatcctggggtacagtcaaatcggcgccggtgtgtacaaggaggggactttccatacaatgtggcacgtgacccggggcgcggtcctcatgcacaagggcaagcgaatcgagccctcctgggcggatgtcaagaaggacttaatcagctacggcggcggctggaaactggaaggcgaatggaaagagggggaagaggtgcaggtcctggccctggagccaggcaagaacccccgggccgtgcagaccaagcccgggctgttcaagacgaacaccgggaccatcggggcagtgtccctcgacttctcgcccggcaccagcggtagccccatcatcgacaagaaggggaaagtcgtcggtctgtacggcaacggcgtggtgacgagatccggcgcctacgtatcagcgatcgcccagaccgagaagagtatcgaggataaccccgagatagaggacgacatctttagaaaacgtcggctgaccatcatggacctccaccccggggccggcaagaccaaacgttatctccccgccatcgtgcgggaagcgatcaagcgcggactgcgaacgctgatcctcgccccgacccgcgtcgtggccgctgagatggaagaggccctgcggggcctgccaatccgctatcagacccctgcgattcgggcggagcataccggacgtgaaatcgtggacctcatgtgccacgccacattcaccatgcgcctgctctcacccgtccgggtgccgaactacaacttaatcattatggacgaagcccacttcactgaccccgcctccatagcggcacgcggttacatcagcacccgggtagagatgggcgaggctgccgggatcttcatgacggccacgcctccgggcagtcgcgacccgttcccccagtccaacgcgccgatcatagacgaggagcgggagatcccagagcgaagctggaactccggccacgagtgggtcaccgacttcaagggcaagaccgtttggtttgtgccgagcatcaaagccgggaacgacatagccgcctgcctgcgcaagaacgggaagaaggtcatccagttgtcccgcaagacgttcgatagcgagtacgtcaagaccagaaccaacgactgggacttcgtggtcactaccgacatctccgaaatgggggcgaacttcaaggcggagcgcgttatcgacccccgccgctgcatgaaacccgtgatcctcactgatggcgaggagcgggtcattctggccggcccaatgccagtgacccactccagtgccgcacaacggcgggggcgcatcggccggaacccgaagaacgagaacgaccaatatatctacatgggagagccactggagaacgacgaagactgcgcgcactggaaggaggccaaaatgctactggacaacattaacacgcccgaaggcataatcccgagcatgttcgagccggagcgagaaaaggttgacgccatagacggcgaataccgtttacgcggggaagcgcgaaagaccttcgtcgacctcatgcgccgcggcgatctgcccgtgtggttggcctacaaggttgcggccgaagggatcaattacgccgaccggcgctggtgcttcgacggaatcaaaaacaaccagatcctcgaggagaacgtggaggtggagatctggaccaaggaaggggagcggaagaagctgaagccgcgctggctggacgccagaatctactccgaccccttggccctgaaagagttcaaggagttcgcggctggacgcaagtctctgaccctcaacctgattaccgagatgggccggctgcccacgtttatgacccagaaaacccgcgacgccctcgacaatctggccgtcctgcacactgcggaggccgggggccgggcctacaaccacgccctctccgagcttcccgagacactggagacactgctgcttctcactctgctggccacagtgaccggcgggatcttcctcttcctgatgagcgggcgcggaatcggcaagatgaccctggggatgtgctgcatcataactgcgtctatcctcctgtggtacgcgcagatccagccgcactggatcgccgccagcatcatcctggagttcttcctcatcgtgctgctgatccccgagcccgagaaacagcggacgccacaggacaaccagctcacctatgtcgtgatcgccatactaacggtggtcgcggccaccatggctaatgagatgggcttcctggaaaagaccaaaaaggaccttggcctgggctccatcgcaacccaacagccggagagcaacatcttagacatagacctaagacccgcctccgcgtggacgctgtacgccgtggccacgacctttgtgacccccatgctgcggcacagcatcgagaacagctcagtgaacgtgagcctcacggccatcgccaatcaggccaccgtgttgatgggactggggaagggctggcctctgtccaagatggacatcggggtgccgctgctggccatcggctgctacagccaggtgaaccccatcaccctcaccgccgccctgctgctcctggtggcgcactacgccataattgggcccgggctgcaggccaaggccacgcgcgaggcccagaaacgggcggccgccgggatcatgaagaaccccacggtagacgggataaccgtgatcgacctagaccccatcccctacgaccccaaattcgagaagcagctgggtcaggtgatgctcttgatcctgtgtgtcacacaggtgctcatgatgcgcacaacctgggccctctgcgaagccctgaccctggcgaccgggcctatctccacattatgggagggcaaccccgggcggttctggaacaccactatagccgtttcgatggccaacatttttcgaggttcctacctggccggcgcagggctcctcttcagcatcatgaagaacaccacgaacacacgtcgcggcaccggcaacatcggcgaaaccctgggcgagaagtggaaatcccgcttaaacgcgctcgggaagtccgagttccagatttacaagaagtccggcatccaggaggtggaccgtacgctggccaaagaaggaataaagcgcggggagacggaccaccacgccgtgagcagagggtccgccaagctgcgctggttcgtagagcgaaacatggtcacccccgagggcaaggtggtggacttgggctgcgggcgcggcgggtggagctactactgcggcgggctgaagaacgtgcgggaggtgaagggcctgaccaagggtggacccggccacgaggagcccatcccaatgtccacgtacgggtggaacttagtccgcctgcagagcggggtcgacgtattctttattccgccagagaagtgtgacacccttctctgcgacatcggggagtcttcaccaaacccgaccgtggaagcgggcagaaccctgcgcgtcctgaacctcgtggagaactggctgaacaacaacacgcagttctgcatcaaggtgctgaacccctacatgccgtccgtaatcgagaagatggaggcactgcagcggaagtacggcggggccctcgtgcgtaacccgctgagcagaaacagcacccacgagatgtactgggtgtctaacgccagcggtaacatcgtcagtagcgtgaacatgatatcccgcatgctgatcaaccggtttaccatgagacacaagaaggcgacctacgaacccgacgtggacctcgggtcaggcacccggaacatcgggatcgagtccgaaatccccaacttagacatcatcggcaagcgcatcgagaagatcaaggaggagcacgagacgtcatggcactacgaccaagaccacccctataagacgtgggcctaccatggatcttacgagaccaagcagacagggagcgccagtagcatggtcaacggagtggtccggctgctcacgaagccctgggacgttctgcctaccgtgacgcagatggccatgaccgacacaacccccttcggccagcaacgtgtgttcaaggagaaggttgacacccgcacccaggagcccaaggaggggacgaagaagctgatgaagataacagccgagtggctctggaaggagttgggcaagaagaagaccccgcggatgtgcacccgcgaggagtttacgcggaaggtgcgctccaacgcagcgctaggggcaatctttaccgacgagaataaatggaagtccgcccgggaagccgtggaagactcccgtttctgggagttggtcgataaggagcggaaccttcacctggagggcaagtgcgagacctgcgtgtacaacatgatgggcaagagggagaagaagttgggcgaattcgggaaggcaaagggcagccgggcgatctggtacatgtggcttggcgcccgcttcctggagtttgaggctctagggttcctgaacgaggaccattggttcagtcgggagaactccctttcaggggtcgagggggagggcctccataagctggggtacatactgcgcgacgtgagcaagaaggagggcggcgccatgtacgcggacgacacagccggatgggacacgcggatcaccctcgaggacctgaagaatgaggagatggtcaccaatcacatggaaggcgaacacaaaaaactggccgaggccattttcaaactcacgtaccagaataaggtagtgcgcgtgcagcggcccacgccgcgagggaccgtcatggacatcatcagccgtcgcgatcagcgggggtctggccaagtggggacctacggcctgaacacgttcacgaacatggaggcccagcttatccgccagatggagggcgagggcgtgtttaagaacatccagcacctgactgtgaccgaggaggcggcggtgcagaactggcttgcaagagtggggcgtgagcgcctgagcagaatggccatctccggtgacgattgcgtggtgaaacccctggacgaccgcttcgccaacgcgctgaccgccttgaatgacatgggcaagatccggaaggacatccagcagtgggagccgagcaagggttggaatgactggacacaggtgcccttttgctcccaccactttcacgagctgatcatgaaggacggccgcgtcttagtagtgccctgcagaaaccaggacgagctgatcgggcgcgcacgaattagccagggcgccgggtggtccctgcgggagacggcctgcctgggcaagagctacgcgcaaatgtggtcccttatgtacttccaccggagagatctccggctcgcggccaacgccatctgcagcgccgtgccctcccactgggtgccgaccagccgcaccacgtggtccatccacgccaaacacgagtggatgaccaccgaagacatgcttactgtgtggaacagggtctggattcgcgagaacccttggatggaggacaagacccccgtagagagttgggaggaaatcccatacctcggcaagagggaggaccagtggtgcggctccctgatcggcctgacgtcccgcgccacctgggcgaagaatatccaggcggcaatcaaccaagtacgcagtctcatcgggaatgaggagtacacggactacatgccatcaatgaagcgcttccggcgcgaggaagaggaagccggcgtcctgtggtaa

SEQ ID NO: 24952 - RNA, 9876 nt, synthetic construct
  misc_feature 1..9876: note = derived and/or modified CDS sequence (opt11) from DENV-2__GU131924__SS-prME
  source 1..9876: mol_type = other RNA
agtgcaggaatgatcatcatgctgatccccactgtcatggccttccacttgaccacccggaacggagaaccccacatgattgtcggcatacaggagaaagggaagtcccttttgttcaagaccgaagatggcgtgaacatgtgcactttgatggcgatggacctaggggaactgtgcgaggataccatcacctacaagtgccccctattacgacagaacgagcccgaggacattgactgctggtgcaactctaccagtacctgggtgacatacggaacgtgcaccactaccggcgaacatagaagggagaagcgcagcgtggccctcgtgccccacgtgggaatgggcctcgagacccggaccgagacgtggatgtccagcgagggggcctggaagcatgctcagcgcatcgagacttggattctgcggcacccgggcttcaccatcatggccgcgatcttagcctacaccatcgggacaacccacttccagcgcgtcctgatcttcatcctgttgacggctgtcgccccttccatgaccatgcggtgcatcggaatctccaatcgcgacttcgtcgagggcgtctccgggggcagctgggtggacatcgtgctcgagcacgggagttgcgtcaccaccatggcgaagaacaagcccactctggatttcgaacttatcaagaccgaggcgaagcaacccgccaccctaagaaaatattgcatcgaggcaaagctgaccaatacgactaccgagagtcggtgcccaactcagggcgagccctcgctcaaggaggagcaggataagcggttcgtctgcaagcacagcatggtggaccgcggctgggggaatggctgcggcctgttcggcaagggagggattgtcacgtgtgccatgttcacttgtaagaagaacatggagggcaagatcgtgcagcctgaaaacctggagtacacaatcgtggtgacgccccactcaggggaggagcacgcggtcgggaatgacacggggaagcatggcatggaaatcaaggtgaccccgcagagcagcatcaccgaggccgagctgaccgggtacggcacagtcacgatggagtgtagcccacggaccggtctcgactttaacgagatggtactactccagatggagaacaaggcctggctcgtgcatcgccaatggttcctggaccttcccctcccgtggctgccgggagccgacaaacaggaatccaactggatccaaaaggagacgctggtcacgtttaagaacccccacgcaaagaagcaggacgttgtcgtgctcggcagccaagagggggccatgcacacggccctcaccggcgcaactgaaatccagatgagctccggcaacctcctgttcaccggccacctgaagtgcagactccgcatggataaactacaactgaagggcatgagctattccatgtgcacggggaaattcaaggtggtaaaggagattgccgagacccagcatggcaccatcgtgatccgggtgcagtacgaaggcgatggcagtccctgtaaaattccgttcgagatcatggacttggaaaagaggtacgtccttggccgcctgataaccgtgaatccgatagtgacggagaaggactctccggtaaacatcgaggccgagccccccttcggggacagttacatcatcataggggtggaacctgggcagctgaagctcaactggttcaagaagggctcctcaattgggcagatgttcgagaccacgatgaggggcgcgaaacggatggccatcctgggcgacaccgcctgggactttggctccctgggcggggtttttaccagcatcggcaaggccctccaccaggtctttggggcaatctacggggcggctttcagtggcgtgagctggacgatgaagatcctcatcggggtgataatcacgtggatcggcatgaactcccggagcacctcactgagcgtctcgctggtactcgttggcatagtcacgctgtacctgggcgtgatggtgcaggccgactccgggtgtgtcgtgtcctggaagaataaggagctcaagtgcggcagcggcattttcatcaccgataacgtgcacacgtggaccgagcagtacaaattccagcctgaaagcccctccaagctggccagcgccatccagaaggctcaggaggaggggatttgcggaattcgctccgtcacgcggctggagaacttaatgtggaagcagatcacccccgagcttaaccacatcttagcggaaaacgaggtaaagttgaccatcatgacaggagacatcaagggaatcatgcaggccggaaagaggagcctgcgtccacagcccacggagctgaagtactcatggaaaacctgggggaaggccaagatgctgagcaccgagtcctacaaccagacctttttaatcgacggccccgagacggcggagtgcccgaatacgaaccgcgcgtggaacagcctggaagtggaggactatgggttcggggtcttcactaccaacatctggctcaagctgaaagagaaacaggacgcgttttgcgactccaagctgatgagcgccgctatcaaggacaatcgagcagtgcatgccgacatgggttactggatagagtccgcgttgaacgacacgtggaagatcgagaaggccagttttatcgaagtgaagaactgccactggcccaaatctcacaccctctggtcgaacggcgtccttgagtccgagatgataattcccaagaacctcgccggccccgtgtcacagcacaactaccgcccggggtaccacactcagatcgcgggcccatggcacctggggaaactggagatggatttcgacttctgcgatggcaccaccgtgatcgttacagaagactgcgggaaccggggccccagcttacgcactaccaccgccagcggcaagctgattactgaatggtgctgccgaagctgcacactgcccccgctccgctaccgcggggaggacggttgctggtatgggatggagatacgccccctgaaggaaaaggaggaaaacctggtgaactccctcgttaccgccggccacgggcaggttgacaacttcagcctgggggtgctgggcatggccctcttcctggaggaaatgctgcggacccgcgtggggacaaagcacgccattctcctcgtcgccgtgtcctttgtgaccctgatcactggcaacatgtcgttcaaagacctcgggcgagtcgtggttatggtaggagccaccatggcagacgacatcgggatgggcgtgacctacctggccttactcgcggccttcaaagtgcgtcccaccttcgccgcgggcctactgctgcggaagttgacatccaaagaactgatgatgaccacgatcggcattgtgctcctcagccagtccacaatccccgagaccgtgctggagctcacagacgcactggctctgggcatgatggttctcaaaatcgtccgcaatatggagaagtaccagctggccgtgacgatcatggccattctgtgtgtcccgaacgcagtgattctccagaacgcgtggaaggtgtcatgcaccatcctcgcggtggtgtccgtgagcccgttgcttctgacatcgagccagcagaaaacggactggatccccctggccctaacgatcaaggggctgaaccctaccgccatcttcctgaccaccctctcccgcacgaacaagaagcggagttggcctctcaacgaagcgatcatggcggtcggcatggttagtatcctggcctcttccctcttgaagaacgacatcccgatgaccggccccctggtggccggtggcctcctgacggtctgctacgtgctgaccgggcgcagcgccgacttagaacttgagcgggctacggacgtgaaatgggaggaccaggcggagatctcgggcagcagccccatcctatccatcaccattagcgaggacgggtcaatgagcatcaaaaacgaagaggaggagcagaccttgactattcttatccgcactggcctgttagttatctccggcctatttcccattagcatccccatcaccgccgccgcgtggtacctgtgggaggtgaagaaacagcgtgccggggtcctttgggacgtcccctcaccgccgcccatggggaaggcggagttggaggacggcgcgtatcgcatcaagcagaagggcatcctgggctactcacagatcggcgccggcgtgtataaggaagggaccttccacaccatgtggcacgtgacccggggcgctgtgttaatgcacaaagggaagcggatcgagccctcctgggccgacgtaaagaaggacctcatatcgtacggcggtggctggaagctggagggtgaatggaaggagggggaggaggtgcaggtccttgcgctagagcccggtaagaacccccgcgccgtgcaaacgaaacccgggcttttcaagacgaataccgggactatcggggccgtgtccctcgatttttcacccggaacgtcaggcagccctatcatcgacaagaaggggaaggtcgtgggtttgtacgggaatggcgtggtgacccgctccggcgcctacgtgagcgccatcgcgcagactgagaagtccatcgaggacaaccccgaaatcgaggacgacatcttcagaaaaagacggctgaccataatggacctgcatcccggggccggcaagacgaagcgctacctcccagcaattgtgcgggaggccattaagagagggctgcggaccctgatcttagcccctacccgcgtggtggccgccgaaatggaggaggctctgcgggggctgcccattcgataccagactcccgccatccgagcggagcacacgggtcgcgagatcgtggaccttatgtgccacgccaccttcaccatgcgcctgctgtcgcctgtgcgagtgccgaactacaacctcatcatcatggacgaggcccacttcaccgaccccgcctccatagccgcgcgcggttatatctcgacgcgggtggagatgggcgaagccgccgggatcttcatgaccgccacgccgcctggaagccgcgatccgttcccccagtccaatgcccccatcatcgacgaggagcgggagatcccagaacgcagctggaactccgggcacgagtgggttacggacttcaagggcaagacggtgtggttcgtgccgagcattaaggcgggaaacgacatcgccgcttgcctgcggaagaacggcaagaaggtgatccagctatccaggaagaccttcgacagcgagtacgtgaagacccggaccaacgactgggacttcgtggtcacgaccgacataagcgaaatgggcgcaaactttaaggcggagcgcgttattgacccccggcgctgcatgaagcccgtaatattgacggatggggaggaacgggtcatcctggccggccccatgccggtaacccatagtagtgccgcccagaggcgggggcgcatcggccgcaaccccaagaacgagaatgaccaatacatctacatgggggagccccttgaaaacgacgaggactgcgcccactggaaggaggccaagatgctcctcgacaacatcaatacgcccgagggcatcatcccgagcatgttcgagcccgagagagagaaggtagacgctatcgacggcgagtaccggctgcggggggaggcacgcaagaccttcgtcgacctgatgcggagaggggacctacctgtttggctggcgtacaaggtggctgcggaggggatcaactatgccgaccggcgctggtgctttgatgggatcaagaacaaccagatcctcgaggagaacgtcgaggtggagatctggaccaaggagggggaacggaagaagctgaagcctcgctggctggacgcaaggatctactccgatcccctcgccctgaaggagttcaaggaatttgccgcgggccgcaagagcctgaccctcaacctgatcacggagatgggccggctgcccaccttcatgacgcagaagacccgcgacgcactcgataacctggccgtcctgcacacagccgaggccggcggtcgggcttacaaccacgcactctccgaactgcccgagacgctggagaccctcctcctgttgaccctgctggccacggtgactggggggatcttcctcttccttatgagcggccgcgggatcggcaagatgaccctgggaatgtgctgcataataaccgcatccatcctcctgtggtacgcgcagatccagccgcactggatcgcggccagcataatcctggagttcttcctcatagtgctgctgatcccggagccggagaagcaacgtacgccccaagacaatcagctcacatacgtagtgatcgccatcctaaccgtcgtcgccgcgaccatggcaaatgagatgggcttcctggagaaaaccaagaaggacctcggtctaggctccatcgcaacgcagcagccggagagcaatatactggacatcgacctccgccctgccagtgcctggaccctgtacgcggtggccactaccttcgtgacacccatgctgaggcactccatcgagaacagcagtgtcaatgtgagcctcaccgcgatcgccaaccaggccaccgtgctgatgggcctgggaaagggctggccactctccaagatggacatcggggtcccgttgttagcgatcggatgctacagccaggtgaaccccatcacgttaaccgccgccctgctgctcctagtggcacactacgcaattatcgggcccggcctccaagcaaaagccacccgtgaggcccagaaaagggcagcggccggcatcatgaagaaccccaccgtcgacgggattacggtgatcgatttagacccgatcccctacgaccccaagttcgagaagcagctgggccaggtgatgctacttatcctatgcgtcacccaggttttgatgatgcgcacaacgtgggccctctgtgaggccctgactttggccacggggcctatctccactctctgggaaggcaacccgggaaggttctggaacacgaccattgcggtgagcatggccaatatcttccgcggctcctacctggcaggcgcagggctcctcttcagcattaagaagaacacgaccaacacccgtaggggcacggggaatatcggcgagacgctgggcgagaagtggaagtcccgcctgaacgcgctcggaaaatccgagttccagatctataagaagtccggaatccaggaggtcgaccggaccctggcgaaggagggaatcaagcgcggcgagacggaccaccacgccgtgagccgggggtcggccaagctccgctggttcgtggagcggaacatggtcacacccgagggtaaagtggtggacctcggctgcggacgcggcggttggagctattactgcggcgggctgaagaacgtccgggaggttaagggcctgacgaagggagggcctggccacgaggagcccatacctatgtccacttatgggtggaacctcgtgcgccttcagagtggtgtcgacgtatttttcatcccgcccgagaagtgcgacaccttgctatgcgacatcggggagtctagcccaaacccaaccgtggaagccgggcgtacgctgagagtactgaacctcgttgagaactggctgaacaacaacacgcagttctgcataaaggtcctgaacccctatatgccctcggtcattgagaagatggaggcgctgcagcggaaatacggcggagctctagtgcgcaaccccctgagccggaattctacccatgagatgtactgggtgtccaacgccagcggcaatatcgtctccagcgtgaacatgatctcccggatgctgatcaaccggttcaccatgcgccataagaaggccacgtacgagcccgacgtggatctcggcagcggcactcgtaatattggtattgagagcgagatccccaacctagacataattggcaagcgtatcgagaagatcaaggaagaacatgaaaccagctggcactacgaccaggaccacccgtacaaaacctgggcttaccatgggtcctacgagaccaagcagaccgggagtgcgtccagcatggtcaacggagtggtgcggttactcacgaagccgtgggacgtcctgcccaccgtgacccagatggccatgaccgatacgacccccttcgggcagcagcgcgtgtttaaggaaaaggtcgatacccgcacccaggagcccaaggagggcacaaagaagctgatgaagatcaccgccgagtggctctggaaggagctgggcaaaaaaaaaacccctcgaatgtgcacgcgcgaggagttcacccggaaggtgcgatccaacgccgccctgggggcgatattcactgacgagaataagtggaagtccgcacgggaggccgtggaggactcccgcttctgggaactcgtcgacaaggagcggaatctgcacctggagggcaagtgcgagacctgtgtgtacaacatgatggggaagcgcgagaagaagctgggcgagttcggcaaggcaaagggcagccgggcgatctggtatatgtggctcggcgcccggttcctggaattcgaggccctcgggttcttgaacgaggatcactggttctcccgggagaacagcctgtccggcgtcgagggggagggactccacaaactggggtacatcctgcgcgacgtgagcaagaaggaaggcggcgccatgtacgccgacgacacggcggggtgggatacacggatcaccctcgaagacttaaagaacgaggaaatcgtgactaaccacatggaaggcgagcacaagaagctggccgaagccatcttcaagctcacctaccaaaacaaagtcgtgcgggtacaacgccccacgccacgcgggacggtcatggacatcatcagccgccgcgatcagcggggatccgggcaagttgggacttatggcctgaacacgttcaccaacatggaggctcaactgatccgccagatggaaggggagggagtgttcaagaatatccagcacttgaccgtgaccgaggaggccgcggtgcagaactggctggcccgggtggggcgggagcgcctgagccgaatggccatttccggcgacgactgcgtcgtgaagcccctcgacgacaggttcgcaaacgcactaacggccttaaacgacatggggaagatccggaaggacattcagcagtgggagccgagcaaggggtggaacgactggactcaagtgcccttctgcagccaccactttcacgagctcatcatgaaggacggacgcgttcttgtggtcccctgcagaaatcaggacgagctgatcgggcgcgcgcgtatctcccagggcgccgggtggtccctgcgcgagaccgcgtgcctggggaagagctacgcccagatgtggtcactgatgtacttccaccgacgcgatctccggcttgcggccaacgccatctgttcagctgttccctcccactgggttcccacgagccgtactacctggtccatccatgccaagcatgaatggatgaccacagaggatatgcttaccgtgtggaaccgggtctggatacgcgagaacccatggatggaggacaaaacgcccgtggaatcgtgggaagagataccatatctcgggaagcgggaagaccagtggtgcgggtccctgatcggactgaccagccgagcgacctgggcaaagaacatccaggctgccataaaccaggtgcggtccctcattggtaacgaggagtacaccgactacatgccaagtatgaagcgcttccggcgggaggaggaggaggctggcgtgctatggtga

SEQ ID NO: 24953 - RNA, 9876 nt, synthetic construct
  misc_feature 1..9876: note = derived and/or modified CDS sequence (opt11) from DENV-2__GQ868638__SS-prME
  source 1..9876: mol_type = other RNA
tccgccgggatgattataatgctgatccccaccgttatggccttccatctcaccacccggaacggggagccgcacatgatcgtcggcatccaggagaaggggaagtccctgctgtttaagaccgaagacggcgtgaatatgtgcaccctcatggcgatggacctgggggagctgtgcgaggacaccatcacctacaagtgtccccttctgcggcagaacgagcccgaggacatcgactgctggtgcaacagcacctccacctgggtgacatacgggacatgtacaaccacaggcgagcaccgcagggagaagcgctcagtcgccctggtgccccacgtgggcatgggcctcgaaacgcgaaccgagacttggatgtcctcagagggggcgtggaagcacgcccagcgcatcgagacctggatcctgcggcaccccggcttcacaatcatggccgcgatcctggcctacaccatcggtaccacccacttccagcgagccctcattttcattctgctgaccgcagtcgcaccatccatgaccatgcggtgcatcggcatcagcaaccgcgactttgtggagggcgtgtccggtggcagctgggttgacatcgtcctcgagcacggttcttgcgtgaccaccatggccaagaataagcctacgctcgacttcgagctcatcaagaccgaggccaagcagcccgccaccctccggaagtactgcatcgaggccaagctaactaacacgaccacagagtctcggtgtccgacccagggcgagccctccctgaaggaggagcaggataagcgttttgtctgtaagcactcaatggtggaccgcggctggggtaacggctgcggcctgtttggcaagggcgggatcgtgacgtgcgcgatgttcacatgcaagaagaatatggaaggcaagatcgtccagcccgagaacctggagtacaccattgtggtgacaccccattccggggaggagcacgccgtcggcaacgacacggggaagcatggcaaggagatcaaggtgactcctcagagctccatcaccgaggccgagctaaccgggtacggcaccgtgacgatggagtgcagcccgcgaacgggcctcgacttcaacgagatggtgctgctgcagatggagaacaaggcctggctagtgcaccgccagtggttcctagatctacctctcccttggctgcctggggccgataaacagggctccaactggattcaaaaggagactctggtgaccttcaagaacccccacgcgaagaaacaggacgttgtggtactcgggagccaggagggcgcgatgcacacagcgctgaccggggccaccgagatccagatgtcatccggcaacctcctcttcaccggccatctgaaatgccggctgcgcatggacaagctccagctgaaggggatgagctactccatgtgcacgggcaaattcaaggtagtgaaggagatcgcggagacccagcatgggactatcgtcattcggctgcagtatgaaggcgacggctccccctgcaagatcccctttgagataatggacctggagaagcgctacgtgctggggcggctgatcaccgtgaacccgatcgtcacggaaaaggattcccccgtgaacatagaggcggaaccgcccttcggcgacagttacataataatcggggtggaaccgggccagctcaagctgaactggtttaagaaggggtccagcatcggccagatgttcgagaccaccatgcgcggtgccaagcgcatggccatcctgggggacaccgcctgggacttcggcagcctaggcggcgtcttcacgtcggtggggaaggcgctgcaccagatctttggcgcgatctatggcgccgccttctccggagtctcatggaccatgaagatcttgatcggagtaatcatcacatggatcgggatgaattctcggagcaccagcctgagcgtgtccctcgttcttgttggtatcgtgacgctgtacctcggggttatggtccaggccgactcaggttgcgtggtgtcttggaaaaacaaggagctgaagtgcggcagcgggatattcatcacagacaacgtgcacacctggaccgaacaatacaagttccaaccagagagtccttcaaagctagcgtcggccatccagaaggcccaggaggagggtatctgcgggattaggtctgtgactcggctcgagaaccttatgtggaaacagatcaccccagagctgaatcacatcctcgccgaaaacgaggtgaagctgaccattatgaccggcgacatcaaggggatcatgcaggccggcaaacgcagtctgcggccgcaacccacggaactaaagtactcttggaagacttggggcaaagcgaagatgttaagcaccgaatcccacaatcagaccttcctgatcgacggtcccgagacggccgagtgcccgaacaccaaccgcgcctggaatagccttgaagttgaggactacggctttggggtgtttacgaccaacatctggctgaagctgaaggagaagcaggacgccttctgtgactcaaagctcatgagcgccgcgatcaaggacaaccgtgcggtgcacgccgacatggggtactggatcgagtccgcactgaatgacacgtggaagatcgagaaggccagcttcatagaggtcaagaactgccactggcctaagtcccacaccctgtggagcaacggagtgctagagtccgagatgatcatccccaagaacctggcggggcccgtgagccaacacaattaccgaccgggctaccacactcaaaccgcagggccctggcacctgggcaaactcgagatggactttgatttctgcgacgggaccacggtcattgtgacggaagactgcggcaatcggggcccctccctgcgcacaaccacggccagcggcaaactcatcaccgagtggtgctgccgcagctgcacgctcccgcccctgcgctatcggggagaggatgggtgctggtacgggatggagatccgccccctgaaggagaaggaagagaacctcgtgaactccctggtcaccgccgggcacggccaggtggacaacttcagcctgggcgtgttagggatggcgctcttcctggaagagatgctacggacgcgcgtcggcaccaagcacgccatcctgctggtggccgtctccttcgtcaccctcattaccggtaatatgagcttcaaggacctgggccgagtggtggtcatggtcggggccactatgaccgacgacatcggcatgggcgtgacctacctggccctcctggcggccttcaaggtccgccccaccttcgcagccgggctgctcctcaggaagctgacgtcaaaggagctcatgatgaccaccattggaatcgttcttttaagccagtccaccattcccgagacgattctcgagctgaccgacgccctggcgctcgggatgatggtgctgaagatcgtccgcgacatggagaagtaccaactggccgtgaccatcatggccatcctctgcgtacccaatgccgtcatcttacagaacgcctggaaggtgagttgcaccatactggccgtcgtgtccgtcagccccttgctgctaacttccagccagcagaagaccgactggatacccctcgccttgaccatcaagggcctgaaccccaccgccatcttcctcacgaccctgtcccgcacgaacaagaagaggtcgtggccgctgaacgaggccatcatggcggttggcatggtaagtatcctcgccagctccctgctgaagaacgacattcccatgacaggacccttggtggcaggcgggctgctgaccgtctgctacgtgttaacgggccgaagcgccgacctcgagttagagcgagcgaccgacgtgaagtgggaggaccaggcggagatctcggggtctagtccaattctctccatcaccatcagcgaggacggaagcatgtctatcaagaacgaggaggaagaacaaacactgacgattttaattcgcaccggccttttggtcatctccggtctgttcccggtcagcatccccatcaccgccgccgcctggtacttatgggaggtgaagaagcaacgggccggcgtactgtgggacgtaccaagcccgccgcccatggggaaagcggagctggaagacggggcctaccgcatcaagcagaaggggatcctcggctacagccagatcggcgccggggtgtacaaggagggtacattccacaccatgtggcatgtcacgcgcggggctgtgctgatgcacaagggcaagcgcatcgagccgtcctgggccgacgtgaagaaggacctgatcagttacggtggcggttggaagctggagggggagtggaaggaaggagaggaagtccaggtgttagcgctcgaacctggaaagaacccccgtgccgtgcagacgaaacccggcttgttcaaaaccaacacgggtaccatcggcgccgtatccctggactttagcccgggcacctccggatctccgatcatcgacaagaagggcaaggtggtggggctgtacggcaacggcgtcgtgacccggtccggcgcctacgttagcgccatagcgcagacggagaagtccatcgaggataatcccgagatcgaggacgacatcttccggaagcgcagactgaccatcatggacctacacccaggcgcggggaagaccaagcgctacctgcccgccatcgtccgggaggccatcaagagaggcctgcgcaccctcattctggcgccgacgcgcgtggttgcagccgaaatggaggaggccctccgtgggctacccatccgctaccagacccccgccatccgggcggagcacaccggccgcgagatcgtcgatctgatgtgccacgccaccttcacgatgcgcctgctcagccccgtgcgggtgccaaactacaacctgatcatcatggatgaggcacacttcaccgaccccgccagcatcgccgcgcgaggctacatcagcacccgggtcgagatgggggaggccgccggcatctttatgaccgccacgccccccgggagccgcgatccattcccccagtcaaacgcccccatcatagacgaagagcgggaaatccccgagcgttcgtggaacagcggccatgagtgggtgaccgactttaaaggtaaaaccgtgtggttcgtcccgagcataaaggcgggaaacgacattgcggcctgcctccggaagaacggcaagaaggttatccaactctctcgcaaaaccttcgacagcgagtacgttaagacgcggaccaacgactgggactttgttgtgaccaccgatatctccgaaatgggggccaatttcaaggcggatcgggtaatcgacccccggcgctgcatgaagccagtcatcctgacggacggggaggagcgagtaatcctggccgggcccatgccggtgacgcattcatccgccgcccaacgccgtggccgcatcggcagaaaccccaagaacgaaaacgaccagtacatctacatgggcgaaccactggagaacgacgaggactgcgcccattggaaggaggcgaaaatgctgctggacaacatcaacacccccgagggcatcatcccgagcatgttcgagcccgaaagagagaaggtcgacgccatagacggggagtaccggctccgtggcgaagccagaaagaccttcgtggacctgatgcggcgcggggaccttcccgtgtggctcgcgtacaaggtcgctgctgagggcattaactatgccgaccggcgctggtgtttcgacgggatcaagaacaaccaaatcctggaagagaacgtggaggtggagatctggacgaaagagggcgagcggaagaagttgaagcctagatggctcgacgcccggatctactccgacccgttagcgcttaaggagttcaaggagttcgccgctggacggaagagcctcaccctgaacctgatcaccgagatgggcagattgcccaccttcatgacgcagaagacccgcgacgccctggataacctggccgtactacacaccgccgaggcgggtgggcgggcctataaccacgctctgtccgagctgcccgaaaccttagagacgctgctgctcctgacactgctcgcaacggtcaccggcgggatattcctgttcctgatgagcgggcgcggcatcggcaaaatgaccctcggcatgtgctgcataataacggcctccatcctgctgtggtacgcgcagatccagccgcactggatcgccgcgagcatcatactcgaatttttcctgatagttctgctgattcccgaacccgagaaacagcggacaccgcaggacaaccagctgacctacgtggtgatcgccatcctgaccgtcgtagccgcgacaatggccaacgagatggggttcctagagaagaccaagaaggacttgggcctgggctccatcgccacccagcagcccgagtcgaacatcctcgacatcgacttgcgccccgcaagtgcctggaccctgtacgcggtggccacgacattcgtcacccccatgctccgccacagcatcgagaactcgtccgtcaacgttagcctgaccgcgatcgccaaccaagcgacggtcttgatgggactcggcaaggggtggcccctgtccaagatggacataggcgtacctctgctcgcgatagggtgctactcacaggtgaatcctatcaccctgaccgccgccctgctgctgctcgtcgcccattacgcgatcatcggccctggcctccaggcaaaggcaacccgcgaggcccagaaacgggctgcggccgggatcatgaagaaccccacagttgacggtatcaccgtgatcgacctggacccgatcccgtacgaccctaagttcgagaaacagctggggcaggttatgttgctgatactgtgcgtgacccaggtgttaatgatgcgcaccacgtgggcactgtgcgaggccctgaccctcgccaccggccccatctccaccctgtgggaggggaacccgggccggttctggaacacgactatcgcggtcagcatggccaacatcttccgcggctcatatctggccggggccggcctcctgtttagcatcatgaagaacaccaccaacacacgacgaggaaccggcaacatcggcgagacgctgggtgagaagtggaagagccgcctcaacgccctgggtaagtcagagttccagacctataagaaatccggaatccaggaggtggaccgtacgttagcgaaggagggcattaaacgcggggagacggaccatcacgctgtgagccggggctccgccaagctacgctggttcgttgagcggaacatggtgacccccgagggcaaggtggttgacctgggctgcggacgagggggctggagctactactgcgggggcctgaaaaacgtgcgggaggtgaagggcctcaccaagggcgggcccgggcacgaggagcccatcccgatgtccacgtacggttggaatctagtgcgcctgcagagcggggtcgacgtgttcttcatcccgcctgaaaagtgcgacaccctcctgtgcgacatcggtgagtccagccccaacccgaccgtcgaagccggccggaccctgcgcgtgctcaacctggtagagaattggctgaacaacaacactcagttctgcatcaaggtgcttaacccctacatgccctccgtgatcgagaagatggaggctctccagcggaagtacggaggcgccctggtgcgcaacccgttaagcagaaacagcactcatgagatgtactgggtctccaacgccagcgggaacatcgtgtcctccgtgaacatgatatcccgcatgcttatcaatcggttcactatgcgccataagaaggccacctatgagccagacgtagacttaggcagcggcacccggaacatcggtatcgagtccgaaattcctaacctggacatcatcggaaagaggatcgagaaaatcaagcaagaacacgagacctcttggcactacgaccaggatcatccctacaagacctgggcctaccatggttcctacgagaccaagcaaacaggcagcgcatccagcatggtgaacggggtggtccggctcctaacaaagccgtgggacgtgctgcccaccgtgacccagatggccatgaccgacactactcccttcgggcagcagagggtcttcaaagagaaggtggatacacgagcccaggagcccaaggagggcacgaaaaagctcatgaagatcacagccgagtggctgtggaaagagctgggaaaaaagaagaccccgcggatgtgcacccgcgaggagttcacaagaaaggtgcgatccaacgccgcgctcggagccatcttcacggacgagaacaagtggaagtccgcacgggaggccgtcgaagactctcgcttttgggaattagtggacaaggaacggaacctgcacctcgaggggaagtgcgagacctgtgtgtacaacatgatgggcaagcgggagaaaaagttaggggaattcggcaaggcaaaaggtagcagggcgatatggtacatgtggctgggcgctaggttcctcgaattcgaggccctgggctttctgaacgaggaccactggttctcgcgggagaacagcctctccggggtcgagggcgaggggctgcacaagctgggctacatcctccgcgacgtatctaaaaaggagggcggggcgatgtacgcagatgacaccgccgggtgggatacccggatcacgctggaggacttgaagaacgaggagatggtcaccaaccacatggagggggaacataaaaaactcgccgaagccatattcaagctgacctatcagaacaaagtggtacgcgtccagcgccccacgccccgcggcaccgttatggacatcatcagcagacgcgaccagcgggggtccgggcaggtgggcacctatggtcttaacaccttcacgaacatggaggcgcaactcattcgccagatggagggtgagggggttttcaggaacatccagcacctgactgcgacggaggaggtggccgtgcagaactggctggcccgagtcgggcgcgagcggctcagccgcatggccatttccggtgacgactgcgtggtgaagcccctcgacgaccggttcgccaacgccctgacggccctcaacgacatgggtaagattcgcaaggacatccagcagtgggagcccagcaaaggctggaacgactggacacaggtccctttctgtagtcaccattttcacgagttgatcatgaaggacgggagagtgctggtggtcccctgccgcaaccaagacgagctcataggccgggcacgcatcagccagggggccggttggtccctgcgggagaccgcctgcctgggcaaaagctacgcgcagatgtggtccctcatgtactttcacaggagggacctgcgcctggccgcgaacgccatatgcagcgccgtcccctcacactgggtgccgaccagccggaccacctggtccatccatgcgaagcacgagtggatgaccaccgaggacatgctcaccgtctggaaccgcgtgtggatccgggagaacccttggatggaggacaagacccccgtggagtcttgggaagagatcccctacctggggaagcgcgaggaccagtggtgcggctccctgatcgggctcaccagccgggccacctgggccaagaatatccaggccgcgatcaaccaggttcgcagcctgatcggcaacgaggagtacaccgactacatgccgagcatgaagcggttccgccgcgaggaagaggaggccggggtgctgtggtag

SEQ ID NO: 24954 - RNA, 9876 nt, synthetic construct
  misc_feature 1..9876: note = derived and/or modified CDS sequence (opt11) from DENV-2__GU131927__SS-prME
  source 1..9876: mol_type = other RNA
tccgctggcatgataataatgctgatcccgaccgttatggcattccacctcactacccgaaacggggagccccacatgatcgtaggcatccaggagaagggcaagagcctgctattcaagaccgaggacggggtgaatatgtgcaccctgatggcgatggacctgggggagctgtgcgaggataccatcacctacaagtgccccctcctgcggcaaaacgagcccgaggatatcgactgttggtgcaacagcacaagcacctgggtgacctatgggacgtgcaccaccaccggcgagcaccggcgggagaagcgcagcgtcgccctcgtgccccacgtgggtatgggcctcgagacgcggaccgagacctggatgagcagcgaaggggcctggaagcatgcccagcgcattgagacctggattctgcggcacccaggattcacgatcatggcagcgatcctggcctacaccatcggtaccacccatttccagagggccctcatcttcatcctgctgacggccgtcgcgccctccatgaccatgcggtgtatcggcatcagcaaccgcgacttcgtagagggtgtgtccgggggcagctgggtcgacatcgtgctcgagcacgggtcctgtgtgaccaccatggctcggaacaaaccaacgctggatttcgagctgatcaagaccgaggccaagcagccggccacactccgaaagtactgcatcgaggccaagctgaccaacactaccaccgaaagccggtgccccactcagggcgaaccctccctaaaggaggagcaagacaagcgcttcgtgtgcaagcacagcatggttgacaggggctgggggaacggctgcggactgttcggcaagggcggaatcgtcacgtgcgctatgttcacgtgcaaaaagaatatggagggaaaaattgtccagcccgagaaccttgagtataccatcgtggtgacgccccactcaggggaggaacatgccgtaggcaatgacacggggaagcacggcaaagagatcaaggtgaccccgcaaagctccatcaccgaggccgagctgactgggtacggcacggtcacgatggaatgcagcccccgcaccggcctcgacttcaacgagatggtcctgctgcagatggagaataaggcctggctagtgcacagacagtggttcctggatctgcccctcccctggctcccaggggcagacaaacaggagtccaactggatccagaaggaaaccctggtgacgttcaagaatcctcatgcgaagaagcaggacgtcgtcgtcctcggcagccaggagggggccatgcacacggcgctgaccggcgccacagagattcaaatgagctccgggaacctgctgttcaccgggcatctgaagtgccggctgcggatggacaaactccagttaaagggcatgtcctacagtatgtgcacggggaagttcaaagtagtgaaggagatcgccgagacacagcacggcaccatcgtcatccgcgtgcaatatgagggggacggctctccctgcaaaatccccttcgagatcatggacttggagaagcgatacgtgctcggccgcctgatcaccgtcaacccaatcgtgacggaaaaggactccccggtgaacatcgaggcggagccgcccttcggggactcttacataattataggcgtggaaccggggcagctgaagctcaactggttcaagaagggctccagcatcgggcagatgttcgagactaccatgcggggcgccaagcgcatggcgatcctgggcgacacggcctgggactttggctccctgggcggcgtttttacgagtgtgggcaaggccctccaccaggtcttcggggcaatctacggcgccgccttctccggggtgagctggaccatgaagatcctgatcggcgtgatcatcacctggatcggcatgaactcccgctcgacctccctgtccgtgtccctggtgctggtgggcatcgttacactgtacctgggcgtgatggtgcaggccgacagcggctgcgtggtgtcttggaagaacaaggagcttaagtgtggcagcgggattttcatcaccgacaatgtgcacacctggaccgagcagtacaagttccagcccgagagtccctcaaaactggcgagcgccatccaaaaggcccaggaggaggggatctgtggaatccggtccgtcacgcgcttggagaacctcatgtggaagcagataacccccgagctcaaccacatcctggccgagaacgaggtgaaactcaccataatgactggggacatcaagggcatcatgcaggccgggcggcgcagcctgcggccgcagcccacggagctgaagtactcctggaagacctggggcaaggcgaagatgctcagcactgagtcttacaaccagaccttcctaatcgacggacccgagacgaccgaatgcccgaacgccaaccgcgcgtggaacagcctggaagtggaggactacgggtttggcgtcttcacgaccaacatctggttaaagctaaaggagaagcaggacgccttctgcgactccaaactgatgagcgccgcgatcaaggacaacagagccgtgcacgccgacatggggtactggatcgagtccgccctcaacgacacgtggaagatcgagaaggcgagctttatcgaggtgaagaactgccattggcccaagtcccacacgctttggagcaacggcgtgctggaatccgagatgatcatccccaagagcctcgcaggacccgtctcccaacacaactaccgcccggggtatcacacccagatcgctggcccctggcacctgggtaagttagagatggactttgacttttgcgatggcacaaccgttatcgtcacggaggactgcgggaaccggggcccctctctcaggaccaccaccgccagcggcaagctgatcacggagtggtgctgccggtcctgcactctgcccccgctccgctaccgcggggaggacgggtgttggtacgggatggagatcaggcccctgaaggagaaggaggagaacctggtgaacagcctcgttaccgccgggcacgggcaggtagataacttctccctgggcgtgttgggcatggccctattcctagaggagatgttgcggacccgtgtgggtacgaagcacgccatcctcctcgtcgccgtgagcttcgtcaccctgatcactggcaacatgtccttcaaggacttagggagggtcgtcgtgatggttggggccaccatggccgacgacatagggatgggcgtgacttacctggcgctgcttgccgccttcaaggtgcgccctaccttcgccgccggcctactcttgcgcaagctgaccagcaaggagttgatgatgaccacgatcgggatcgtcctcctgtcccagagcaccattcccgagaccatactagagctcaccgacgctctggccctggggatgatggtgctgaagatcgtgcggaacatggagaagtatcagctagccgtcacgatcatggcaattctgtgcgtgcccaatgccgtcatcctccagaatgcttggaaggtgagttgtacaatactggccgtggtcagcgtgtccccgctactcctgacctcctcccagcagaagacagattggatccccctggccctcacgattaagggactgaaccccaccgcgatcttcctaactaccctctcacgcacgaataagaagagatcgtggccgctgaacgaggcgatcatggccgtgggtatggtctcaatcctggcctccagcctcctgaagaacgacattcccatgaccggcccgctggtggccgggggtctcctgaccgtgtgctacgtactgaccgggcgctccgccgacctcgaactggagcgagcgacggacgtgaagtgggaggaacaggccgagataagcggcagctcacccatcctttcgatcaccatcagtgaggacgggagcatgtccattaaaaacgaggaggaggagcagaccttaaccatcctgatccgcacgggcctactcgttatcagcggcctgttcccaatctccatccccatcactgccgccgcatggtacctatgggaggtcaagaagcagcgggcgggggttctctgggacgtgcccagcccgcctcccatgggcaaggccgagctggaggacggagcctaccgcattaagcaaaagggcatcctcgggtactcccagatcggcgccggtgtctacaaggaggggacctttcacactatgtggcacgtgacccggggcgccgtgctcatgcacaaggggaagcgcatcgagccctcatgggccgatgtcaagaaagatctgatctcctacggcgggggatggaaactggagggagagtggaaggagggtgaggaggtccaggtgctcgctttagagcccggcaagaacccccgggcagtccaaacgaagcctgggctgttcaagaccaacaccggaaccattggagccgtgagcctcgacttttcccccggcacgtcgggatcgcccattattgacaaaaaggggaaggtggtcggtctgtacgggaacggcgtggtgacccgcagtggcgcctacgtctccgcgatcgcccagaccgagaagtctaccgaagacaaccccgagatcgaggacgatatatttcgaaagcgccggcttactatcatggacttgcaccctggggccggtaagaccaaacgctatctccccgccatagttcgggaggcgatcaagcgcgggctgcggaccctgatactcgccccgacccgcgtggttgccgccgagatggaggaggcgctgcggggccttcccatccgctaccagacgcccgccatccgtgccgagcacaccggccgggagatcgtagacctcatgtgtcacgccactttcactatgaggctgctgtcccccgtgcgggtcccgaattacaacctcatcattatggatgaagcccacttcacggaccccgcgagcatcgcggcccgcggttacatcagcacccgggtggagatgggggaggccgccggtatcttcatgaccgcgacgccaccaggctcccgcgacccgttcccccagagtaatgcgcccatcatagacgaggagcgggagatccccgagcgctcgtggaatagcgggcacgaatgggttacagacttcaagggaaagaccgtctggttcgtgccgagcatcaaggcggggaacgacatcgccgcctgtctgcgtaagaacggcaagaaggtgatccagctaagcagaaagaccttcgattcagaatacgtgaagacccggacgaacgactgggacttcgtggtcacgaccgatatcagcgagatgggcgcgaacttcaaggccgagcgcgtcatcgacccgcggcgctgcatgaagcccgtgatcctcaccgacggggaggagcgggtgatccttgcagggccaatgccagtgacgcactcctctgcagcacagcgccgcgggcgcattggccggaaccccaagaacgagaacgaccagtacatctacatgggggagcccctagagaacgacgaggactgcgcacactggaaggaggccaaaatgcttctggataacatcaacacccctgagggcatcattccatccatgtttgagcccgagcgcgagaaggttgatgcaatcgacggggagtacaggctgagaggggaggcccgcaagaccttcgtggacctcatgcggcgcggcgatctgcccgtctggctggcatacaaggtcgcggccgaggggatcaactacgccgatcggcgctggtgtttcgacggcatcaagaacaaccaaatactcgaggaaaacgtggaggtcgagatttggaccaaggagggggagcgtaagaagctgaagccacgctggctggacgccagaatctacagcgaccccctcgccctgaaagagttcaaggagttcgcggcaggcaggaagtccctgacattgaacctgataaccgagatgggccggctgcccaccttcatgacccagaagacgcgtgacgccctagacaacctggccgtgctgcacaccgcggaggccggtggtcgtgcctataaccacgcgctcagcgagctgcccgagaccttggagaccctcctgttattgacgctgctggccacggtcaccggaggcatcttcctcttcctgatgtcaggccgcgggataggcaagatgaccctgggaatgtgctgcatcatcaccgcgagcatcttactgtggtacgcccagatccagccgcactggattgccgcctccattatcctggagttcttcttgatcgtgctgctgatccccgagcccgagaagcagcgaacgccccaggacaaccagctcacctacgtggtcatcgccatcctgacagtggtagcggccaccatggccaacgagatgggtttcctagagaagacgaaaaaggacctcgggctcggctcgatagccactcaacaaccggagagtaacatcctggacatagacctcaggcccgcttcggcgtggactctgtacgccgtcgcgaccacgttcatcacccccatgctgcggcacagcatcgagaactcctccgtgaacacctccctcaccgccatcgccaatcaggcgacggtgctgatgggcctgggaaagggctggccgttaagcaagatggacatcggggtcccgctgctggccatcggctgttactcccaggtgaatcccatcacactcacagccgcccttttgctactggtggcgcactacgcaatcatagggcccggcctccaggccaaagccaccagagaggcccagaagcgggcggccgccggcatcatgaagaatcccacggtcgacgggatcaccgtgattgacctcgacccgatcccctacgaccccaagttcgagaagcagctgggccaagtgatgctgctcatcctgtgcgtcacccaggtactgatgatgagaaccacgtgggctctctgcgaggcactgaccctggcgaccgggcccatcagcaccctctgggagggcaatccggggcggttctggaacactaccatagcggtgtcaatggccaacatcttccgcggcagctacctggccggcgccggactcttgttttccatcatgaaaaacaccacgaacacgcggagaggcaccgggaacatcggcgagacactgggcgagaagtggaaatcccgtctgaacgcgcttggtaagtctgagttccagatttacaagaagtcaggcatccaggaagtcgaccggaccctggccaaggaagggatcaagcgcggcgagacggaccaccacgcggtatcccgggggagcgccaagctgcgctggttcgtggagcggaacatggtcacaccggagggcaaagtggtggacctcggatgcgggcgcggcgggtggtcctactactgcggagggctgaagaacgtcaaggaagtaaaaggcctgaccaagggtgggcccggccacgaggaacccatcccgatgagtacctacgggtggaacctcgtgaggctgcagtcgggcgtggacgtgttcttcatcccgcccgagaagtgtgacacactgctctgcgacatcggggagagctcccccaaccccacggttgaggctgggcgcaccttgcgagtcctgaacctcgtggagaattggctgaacaacaatactcagttctgtatcaaggtgcttaacccctacatgcccagcgtcatagagaaaatggaggccctacagcgcaagtacggcggggccctcgtgcggaacccgctgtctcgcaactccacccacgagatgtattgggtgagcaacgcctcgggcaacatcgtctcctccgtgaacatgatcagccggatgcttatcaaccgcttcacgatgcggcacaagaaagccacctacgagcccgacgtcgacctcgggtccggcacccgcaacattgggatcgaaagcgaggtccccaacctggacatcatcggtaagcggatcgagaaaatcaagcaggagcacgagacctcctggcactacgaccaggaccacccctacaagacatgggcgtaccacggcagctacgagaccacccaaaccgggtccgccagcagtatggtgaacggcgtagtccgcttgctcacgaagccgtgggatgtgctgcccaccgtgacccagatggccatgaccgacaccactcccttcgggcagcagcgcgtcttcaaggagaaagtggacacgcggacccaggagcccaaggaaggcacgaagaagctgatgaagatcacggccgagtggctctggaaggagctgggcaagaagaagactccgcgcatgtgcactcgggaggagttcactcgcaaggtgcgtagcaacgccgcgctgggggccatcttcaccgacgagaacaagtggaagtcggcccgtgaggccgtcgaggacagccggttttgggagctcgtagacaaagagcgcaacctgcacctggagggcaaatgcgaaacctgtgtgtacaacatgatggggaagcgggagaagaagttgggcgagttcggaaaggccaagggctcccgcgcgatttggtacatgtggctgggcgcccgattcctggagttcgaagccctagggtttctgaacgaggaccactggttcagccgcgagaactccctctctggtgtagagggggaaggcttacacaagctcggttacatcctgcgggacgtgagcaagaaggaagggggtgccatgtacgccgacgacaccgccgggtgggatactcgcattaccctcgaggatctgaagaacgaggaaatggtcaccaaccatatgaaaggcgagcataagaagttagctgaggccatcttcaaacttacctaccagaacaaggtggtgagggtccagcgccccacgccccgagggaccgtgatggacatcatatcccgtcgggaccagcgcggcagcggccaggtggggacctatggcctgaacacctttactaacatggaggcccagctgatccggcagatggagggggagggcgtgttcaagaatatccagcacctcaccgtgacagaggaggtagcggttcagaactggttagcccgcgtggggcgcgagcggttgtcccgcatggctatctctggcgacgactgcgtggtcaaaccgttagatgaccggttcgcaaacgccctgaccgcgctgaatgacatgggaaagatccgcaaggacatccagcagtgggagccgtcaaagggttggaatgattggacccaagtgccattctgcagccaccacttccacgagctcatcatgaaggacggccgggtcctggtcgtgccctgtcgcaaccaggatgagctcatcgggcgggcccgcatttcccagggcgccgggtggagcctccgggagaccgcatgccttggaaagtcctacgcccaaatgtggagccttatgtatttccaccgccgggacttacgcctggccgcgaacgccatctgctccgccgtgcccagccactgggtcccaacctcccgcaccacctggagcatccacgccaagcacgagtggatgactaccgaggacatgcttaccgtgtggaaccgcgtgtggatccgggagaacccctggatggaggacaagacccccgtcgagtcctgggaggagatcccctatctaggcaagcgggaggaccagtggtgcggcagccttataggcctgacgtcccgtgccacctgggctaagaacatccaggccgccataaaccaggtgcgcagtctcatcgggaacgaagaatacaccgactacatgccgagcatgaagcggttccgtcgcgaggaggaggaggcgggcgttctgtggtga

SEQ ID NO: 24955 - RNA, 9876 nt, synthetic construct
  misc_feature 1..9876: note = derived and/or modified CDS sequence (opt11) from DENV-2__GU131928__SS-prME
  source 1..9876: mol_type = other RNA
tccgccggaatgattataatgttaatccccacagtgatggccttccacctcaccacgcgcaacggggagccgcacatgatcgtcgggatccaggagaagggcaagagcctgctgttcaagactgaagacggcgtgaacatgtgcaccctaatggcgatggacctgggggagttatgcgaggacaccatcacctacaagtgccccctcctgcggcagaacgaacccgaggacatcgactgctggtgtaactctacaagtacctgggttacctacgggacctgcaccaccaccggtgagcaccgccgggagaagcgcagcgtcgctctggtgccccacgtggggatgggcctcgagacccgtaccgaaacgtggatgtcaagcgagggggcgtggaagcacgcccaacgcattgagacctggattctgaggcatccgggcttcacgatcatggctgccatcctggcctacaccattgggaccacccacttccagcgcgtactgatcttcatcctgctgacggccgtggcgccctccatgacaatgcggtgcatcggcatctccaaccgcgactttgtggagggcgtctccgggggctcttgggtggatatagtgctcgagcacgggagctgcgtcaccacgatggcgaagaataagccaacgctggacttcgagctgatcaagacagaggccaagcagccggccaccttacggaaatactgcatcgaggccaaactcaccaacacgaccacagagagccgctgcccaacccagggcgagccctccctgaaagaggaacaggataagagatttgtttgtaagcatagcatggtggaccgcggctgggggaacggctgcggcttatttggtaagggcgggatcgtcacgtgtgccatgttcacgtgcaagaagaacatggagggcaagatcgtgcagcccgagaacctcgagtatacaatcgtggtgacgccccattccggggaggagcacgcggtgggtaacgacacggggaagcacggcatggagatcaaggtgacgccgcagagctccattacagaggccgagctgacggggtacggcacggtcacgatggagtgcagcccccggaccggcctcgacttcaacgagatggtgctgctccagatggagaacaaggcgtggctcgtccaccgccagtggttcctggacctgcctctaccctggttgccgggggccgacaagcaggagtccaattggatccagaaggagaccctggtcacattcaagaacccccacgccaagaagcaggacgtcgtcgtgctcggcagccaggagggggcaatgcacacggccctaaccggcgccaccgagatccagatgagctcagggaacctccttttcaccggccatctgaagtgccggttacgcatggataaactccagctgaaaggcatgagctattccatgtgcacaggcaagttcaaggtggtcaaggagatcgccgagacccagcacgggaccatcgtgatacgggtgcaatacgagggggacggcagcccctgcaaaatacccttcgagatcatggacctggagaagcgttacgtcctcggccggctgatcactgtgaacccgatcgtgacggagaaggactcccccgttaacatagaggccgagccacccttcggggactcctacatcatcataggtgtggagccggggcagctgaaactcaactggtttaagaagggttcaagcatcgggcaaatgttcgagacgaccatgcgcggcgcgaaacgcatggccatattgggtgacaccgcctgggacttcggctccctgggcggggtattcacgagcatcggcaaggccctccaccaggtcttcggggcaatatacggggtggcgttttcaggcgtcagctggaccatgaagatactgatcggggttatcatcacctggatcggcatgaactcacggagcacttccttaagcgtatccctggtgttagttgggatcgtgacgttgtacctgggcgttatggtccaggccgacagcgggtgcgtggtgtcctggaagaacaaggagttaaagtgcggcagcggcatcttcatcactgacaacgtccacacctggaccgaacagtacaagtttcagcccgagagcccctccaagctggccagcgccatccagaaggcgcaggaggaggggatctgcggcatccgttcggttacgagacttgagaacctaatgtggaagcagatcacccccgagctgaaccacatactggccgagaacgaggtgaagctcaccattatgaccggggacattaaaggcatcatgcaagccgggaagcgcagcctgcggccgcaacccacggagctgaagtactcctggaaaacctggggcaaggccaagatgctcagcaccgagtcatacaaccagactttcttgatcgacgggcccgaaacggccgagtgcccgaacaccaaccgcgcgtggaacagcctcgaagtcgaggactacgggttcggcgtgttcaccaccaacatctggctcaagttaaaggagaagcaggacgccttctgtgactcgaagctgatgtcggccgccatcaaagataacagagccgtgcacgcggacatgggttactggatcgaatccgccctcaacgatacgtggaagatcgagaaggcctcctttatcgaagtcaaaaactgccactggcccaagtcccacacgctctggagcaacggcgttctggagtccgagatgatcatcccgaagaacctcgccggccccgtgagccagcacaactaccgccccgggtaccacacccagatcgccggcccctggcacctggggaagctggagatggacttcgacttctgcgacgggaccacagtcatcgtgaccgaggactgcgggaaccgcggccccagcttacgcaccaccaccgcgagcggcaaactgatcacggagtggtgctgccggagctgtactcttcccccgctccgctacaggggggaagacggctgctggtacgggatggaaatccgccccctgaaggagaaggaggagaacctggtgaactccctcgtcaccgccggccacggccaggtagacaacttcagcctgggcgtgctggggatggccctcttcctcgaggagatgctgaggactcgagttgggacgaagcacgccatactcctggtggcggtgtcctttgtcacactgatcactggtaacatgtcgttcaaggaccttggacgggtggttgtcatggtaggcgccaccatggccgacgatatcgggatgggcgtgacgtacctggccctgctcgccgcgttcaaggttcgccccacgttcgccgccggtcttctgttacggaaactgacctcgaaggaactaatgatgaccacgatcgggatcgttcttctgagccaatccacgatacccgagaccgtactggagctcaccgacgccctggccctgggcatgatggtcctcaaaattgtgcgcaatatggagaagtaccagctagcagtcacgatcatggccatcctctgcgtgcccaacgcagtgatactccagaatgcctggaaggtcagctgcaccatactagcggttgtgtccgtcagccccctgctcctgacctccagccagcagaaaaccgactggatacccctggcgctcacgatcaaggggttgaaccccacggcgatcttcctgaccaccttaagccgcacgaacaagaagcggagctggccgctgaacgaggccatcatggcggttggcatggtgtccatcctggcgagcagtctcctcaagaacgacatccccatgaccggccccctggtcgccgggggcctgctgactgtatgttacgtgctgacggggcgcagcgccgacctcgagctggagcgggccacagacgttaagtgggaggaccaggcagagatctccggcagcagccccatcctgtccatcaccatctctgaggatgggtccatgagcatcaagaacgaggaggaggagcagaccttgaccatactgatccgcacgggtctgcttgtgatctccggcctgttcccgattagcattcctatcaccgcagccgcatggtacctatgggaggtcaagaagcaaagagccggggtcctctgggacgtgccctctccgccgcccatgggtaaggctgagctggaggacggggcgtatagaattaagcagaagggcatcctggggtactctcagattggcgccggcgtgtacaaggagggaaccttccacacaatgtggcacgtcaccagaggcgccgttctcatgcacaagggtaagaggatcgagccctcctgggcggacgtaaagaaagacctaattagctacggtgggggctggaagctggagggcgagtggaaagagggagaggaggtccaggtgctcgccctggaaccgggcaagaaccccagggcggtgcagacgaagcccgggttattcaagaccaacaccggcaccattggagcagtatcactcgacttctcacccggcacgtccgggagccccatcatcgacaaaaaggggaaggtggtgggcctgtatggtaacggcgtcgtgacccggtccggcgcctatgtgagcgccatcgcccagaccgagaaatccatcgaggataacccagagatcgaagacgatattttccggaaaaggcggctgaccatcatggacctgcaccccggggcaggcaagacgaagcgctacctccccgctatcgtccgagaggccatcaaacgcgggctgcggaccctgatcctcgccccaacgcgcgtcgtagctgccgagatggaggaggccctgcggggcctacccattcgctaccaaaccccggccatccgggccgagcacacgggtcgcgagatcgtcgatctcatgtgccacgcgaccttcaccatgcgcctgcttagccccgtgcgggtgcctaactacaacctaatcatcatggacgaggcccactttaccgaccccgcctcaatagccgcccgcggctacatcagtacacgcgtcgagatgggcgaggcagccggaatcttcatgacggcgactccgccaggctcgcgcgatccgttcccccagtccaacgcccccatcatcgacgaggagcgggagatccccgagcgctcgtggaattccggacacgagtgggtgaccgacttcaagggtaaaacggtgtggttcgtcccgagcataaaggccgggaacgacatcgcggcctgcctgcggaagaatggcaagaaagtgatccagctgtcccgcaagaccttcgactctgagtacgtgaagactcggaccaacgactgggacttcgtcgtgacgaccgacatcagcgagatgggtgccaattttaaggccgagcgcgtgatcgacccccgccgctgcatgaagcccgtcatactcaccgacggggaggagcgggttatcctggcgggcccgatgccggttacccactcatccgccgcccagagacgggggcgtataggtagaaacccgaagaatgaaaacgatcagtacatctacatgggggagcccctggaaaacgacgaggactgcgcccattggaaggaagccaagatgctcctggacaatataaacacgcccgagggcatcatcccttccatgttcgagcccgagcgcgagaaggtggacgcgatcgatggcgagtaccggctgaggggggaggcccggaagaccttcgtggatctcatgcggcgcggcgacctgcccgtgtggctggcctacaaggtcgccgccgaggggatcaactacgcggaccggagatggtgtttcgacggcatcaagaacaaccagatcttggaggagaacgtcgaggtagagatctggaccaaagagggggagaggaagaaactgaagccgcgctggctggacgcccgtatctactccgatcccctcgctctgaaggagttcaaggagttcgccgccggccggaagagtctgaccttaaacctgatcactgaaatgggccggctgcccaccttcatgacccaaaagacccgagacgccctcgacaacctggccgtgctgcacacggctgaggccggggggcgggcgtataaccacgccctctccgagctgcccgagaccctggagactctcctgctgctcaccctgctggccacggtgacaggcggcatcttcctcttcctgatgtccggccgcggaatcggcaaaatgaccctggggatgtgctgtatcatcaccgcgtccatcctcctgtggtacgcacaaatccagccgcactggatcgccgcctccatcatcttagagttcttcttaatcgtcctgctgatccccgagccggagaagcagcggacgccacaggacaaccagctcacgtacgtggtgatcgcaatcctgaccgtcgtggccgccaccatggcgaacgaaatgggcttcctggagaaaaccaagaaggacctcgggttaggctccatcgcgacgcagcagccggagagcaacatcctcgatatcgacctccgccccgcctccgcttggaccctgtacgctgtggcgaccactttcgtcacgcccatgctgcgccacagcatcgagaacagctccgtgaacgtgagcttaaccgccatcgccaaccaggccaccgtcctgatgggcttagggaagggctggcccctttcgaagatggacataggggtaccgcttctggccatcggttgctactcacaagtgaaccccataacattgacggcagccttactgctcctggtcgcccactacgccatcatcggccccgggttacaggcgaaggccacccgcgaggcccagaagcgagcggctgcaggcatcatgaagaacccgaccgtcgacgggatcaccgtgatcgatcttgacccaatcccctacgacccaaagtttgagaagcagctgggccaggtcatgctgttgatcctctgtgtgactcaggtcctgatgatgcgcaccacctgggccctatgtgaggctttgaccctggcgacggggcccatcagcaccctctgggagggcaacccgggacggttctggaacaccaccatcgccgtcagcatggcgaacatcttccgcggctcgtatctggccggcgccgggttactctttagcataatgaagaacacgaccaacactcggcgcggtaccgggaacatcggcgagacgctgggcgagaagtggaagtcccgcctgaacgccttagggaagtccgagttccagatctacaagaagagcggcatccaggaggtggaccggaccctggccaaggaggggatcaagcgcggagagaccgaccaccacgcggtgagccgggggtccgccaagctgcgctggttcgtcgagcgcaacatggtgacccccgagggcaaggtggtggacttaggctgcgggcgcggagggtggagctactactgcggcgggctgaagaacgtccgagaggtgaagggcctgactaagggcgggcccggccacgaggaaccaatcccgatgtcgacctacgggtggaacctcgtgcgcctgcagagcggggtggacgtgttcttcattccgccggagaagtgcgacacgttgttatgcgatatcggcgagagtagccccaacccgaccgtcgaggccggccggacgctgcgcgtgctgaatttggtggagaactggctgaataacaacacccagttctgcatcaaggtcctgaacccctacatgccgtccgtgatcgagaagatggaggccctgcagcggaaatacggtggggcactggtgaggaaccctctgagccggaacagcacgcacgaaatgtactgggtctccaatgccagcggaaacatcgtctccagcgtgaacatgatatcccggatgctcatcaacaggttcaccatgaggcacaagaaggctacctacgagccggacgtcgacctcggatcgggcactcgcaatatcggcatagagagtgagaccccaaacctggacatcatcggcaagcgcatcgagaagatcaaggaggaacacgagaccagctggcactacgatcaagaccacccctacaagacctgggcctaccatggtagttacgagacgaagcagaccgggagcgcctcctccatggtcaacggcgtggttagattgctcaccaagccgtgggacgtgttgcccacagtgacgcagatggcgatgacagacaccacccccttcggccaacagcgcgtcttcaaggagaaggtcgatacgcgaacccaggagcccaaggagggaaccaagaaattgatgaagatcaccgccgagtggctctggaaggagttgggcaagaagaagacgccgaggatgtgcacccgcgaggaattcacccgtaaggtgcgctccaacgccgccctgggggccatcttcaccgacgagaataagtggaagtccgcgcgggaggccgtagaggactccaggttctgggagctcgtggacaaggaacggaacctgcacctagagggcaagtgcgagacgtgcgtctacaatatgatggggaagcgcgagaagaaactgggcgagttcggtaaggccaagggttctcgagcaatctggtatatgtggctgggcgcccgcttccttgagttcgaggcgctcgggtttctgaacgaggaccattggttctcccgggagaacagcctgtccggcgtggagggggagggactccacaagcttgggtacatcctgcgcgacgtgagcaagaaggaaggcggcgcaatgtacgcggacgacaccgccggttgggacacccggatcaccctggaagacttaaagaacgaggagatggtcacgaatcacatggaaggcgagcacaagaagctggcggaggctatcttcaagctgacctaccaaaacaaggtagtgcgcgtccagcggcccacgccccgtgggaccgtgatggacatcatcagccgccgcgaccaaaggggctccggccaggtggggacgtacggtctgaacaccttcaccaacatggaagcccaactgatcaggcagatggagggggagggcgtcttcaagaacatccagcacctcaccgtgacggaggaggccgccgtccagaactggctggcgcgcgtcgggagagagcgcctgtcacggatggccatctccggtgacgactgcgtggtcaagcccctcgacgatcgcttcgccaacgcactgaccgcactgaacgacatgggcaagatccgaaaggacatccagcagtgggagccgagcaagggatggaacgattggacccaggtccccttctgctcccaccacttccacgagcttatcatgaaggacggccgcgttcttgtggtaccctgccggaatcaagacgagctgatcggccgcgcgcggatcagccagggcgcaggctggagtctacgcgaaaccgcctgcctgggcaagtcctacgcccaaatgtggtccctcatgtacttccaccggcgggacctccggctggccgcgaacgccatctgctcggccgtgccctcccactgggtgcccacgagccgcaccacctggtccatccatgccaagcacgagtggatgaccaccgaggacatgctgacggtctggaatcgggtgtggatccgcgaaaacccctggatggaggataagacccccgtggagagctgggaggagatcccctacctcggcaagcgggaggaccagtggtgcggctccctgattggcctcacgagccgcgccacctgggcgaaaaatatccaggccgccatcaaccaggtccggtccctcataggcaatgaggagtacaccgactacatgccatcgatgaagcgcttccggcgcgaggaggaggaagccggtgtgctgtggtga

SEQ ID NO: 24956 - RNA, 9876 nt, synthetic construct
  misc_feature 1..9876: note = derived and/or modified CDS sequence (opt11) from DENV-2__GU131929__SS-prME
  source 1..9876: mol_type = other RNA
tcagccggcatgatcatcatgctgatcccaaccgtgatggccttccacctcacgacccgcaacggggaaccccacatgatcgtcggaatccaggagaagggcaagagcctgctgttcaaaaccgaggacggcgtgaacatgtgtacgctcatggcgatggatttgggggaactgtgcgaggatacgatcacctacaagtgccccctcctgcggcagaacgagcccgaggacatcgactgctggtgcaattcaaccagcacctgggtgacctacgggacctgcaccaccacgggcgagcacagacgggagaagcgcagcgtagcccttgtgcctcacgtgggcatgggcctcgagaccaggacagagacctggatgagcagcgagggggcgtggaagcatgcccagcggatagaaacctggatcctgcgtcacccggggttcacgatcatggccgcgatcctggcctacaccattgggaccacccacttccagcgcgtcctcatctttatcctgttaacggccgtggccccctccatgaccatcagatgcatcggtatcagcaaccgcgacttcgtggagggcgtatccggcggcagttgggtggacatcgtgctagagcacgggagctgcgtcacaaccatggcgaagaacaagcccacgctggacttcgagctgatcaagaccgaggcaaagcagcccgcaaccctccggaaatactgcatagaggccaaactgaccaacacgacgaccgagagccggtgccccacgcagggcgagcccagtctcaaggaggaacaggacaaacgattcgtgtgcaagcactcaatggtggaccgcggctgggggaacggctgcggcttgttcggcaagggcgggatagtcacgtgcgccatgttcacgtgcaaaaagaacatggaagggaaaatcgtacagcccgaaaatctggagtacaccatagtcgtcactccccactccggggaagagcacgcggtgggaaacgatacggggaagcacgggatggagatcaaggtaaccccgcagagctcgatcaccgaggccgagctgaccggatacggtaccgtcacgatggagtgcagcccacgaacgggcttagacttcaacgagatggtgctgctgcaaatggagaacaaggcatggctcgtgcaccgccagtggttcctggacctgccccttccctggctgccaggggccgacaaacaggaatccaactggatccagaaggagaccctggtcaccttcaagaatccgcacgctaagaagcaagatgttgtcgtgctcggcagccaggagggggcgatgcacacggccctgaccggcgcgaccgaaatacagatgagctccgggaatcttctgttcacaggccacctgaaatgccggctgcgcatggacaaattgcagctgaagggtatgagctactccatgtgcacggggaagtttaaggtggtaaaggagatcgccgagacccagcacggcaccatcgtgatcagggtgcagtacgagggggacggcagcccctgcaagatacccttcgagattatggacctcgaaaagcgctacgtgctcggccggctcatcaccgtgaacccaatcgtcacggagaaggacagccccgtcaatatcgaggcggagccgcccttcggggattcgtacatcatcatcggagtggagccggggcagctgaaactcaactggttcaagaaggggtccagcatcgggcagatgttcgagaccaccatgcgcggcgcgaagcgcatggccatcctgggcgacaccgcctgggacttcgggtcattaggcggggtgttcacctcaatcggcaaggccctccaccaagtcttcggagcgatctacggggtggcgttctccggcgtgagctggaccatgaagatcttaatcggggtcatcataacctggatcggcatgaactcccggagcaccagtctgtcagtgtccctcgtgctcgtcgggatcgtgacactgtacctgggggtgatggtccaggcagattcggggtgtgtggtgtcctggaagaacaaagagctcaagtgcggcagcggtatctttatcacggacaacgtccacacctggaccgaacaatacaagtttcaacccgagtccccctccaagctggctagcgccatccagaaggctcaggaggaggggatctgcggaatccgctccgtgacgcggctggagaatctaatgtggaagcagatcacgcccgagctgaaccatatcctggccgagaacgaggtgaaacttaccatcatgacaggggacattaaaggtattatgcaggccgggaaacgcagcctgcggccgcagcccacggagctgaaatacagctggaagacctggggcaaggccaagatgctcttcacggagagctacaaccagactttcctgatcgacggccccgagacggccgagtgcccgaataccaatcgcgcctggaactccttggaagtagaggactacgggttcggcgtgtttaccaccaacatctggctcaagctgaaggaaaagcaggacgctttctgcgacagcaaactgatgtccgccgcaattaaggacaatagggccgtgcacgcggacatgggatactggatcgagtcggccctcaatgacacgtggaagatcgaaaaggcctcctttatcgaggtcaagaactgccactggcccaagagccacacgctctggtcaaacggtgtgctggaaagcgagatgatcatccctaagaacttagcgggccccgtgtcgcagcacaattataggcccgggtaccacacccagattgccggcccctggcacctgggcaaactggagatggacttcgacttctgcgatggcacaaccgtcatcgtgacggaggattgcgggaacaggggccccagccttcgcaccaccaccgcgtccggcaagctgatcacggagtggtgctgtcggagctgcaccctaccccccctccgttacaggggggaggacggctgctggtacggcatggagatccgccccctgaaggagaaagaggagaacctggtgaactctctcgtcaccgccggccacgggcaggtggacaacttctcactcggcgtgctgggcatggccctcttcctggaggagatgctgcggacacgcgtcgggacgaagcacgccatactcctggtggcggtgagcttcgtcactttgattacgggcaacatgtccttcaaggacctcggtcgggtggtggttatggtaggcgccaccatggccgacgacattgggatgggcgtgacgtacctggccctgctcgccgcgttcaaggtccgccctacattcgccgccggcctgctcctccggaagctgaccagcaaggagctgatgatgacgacaatcgggatcgtgctcctgtcgcagagcacgatccccgagaccgttttggagctcaccgacgcgctggcactgggcatgatggtcttgaagatcgtgaggaacatggaaaagtaccagcttgcggtcacgatcatggccatcctgtgcgtgcccaacgcggtgatcttacagaacgcctggaaggtctcctgcaccatactggctgtcgtctccgtcagccctctcctcctcaccagctctcagcagaaaaccgactggatcccactggcgctcacgatcaaagggctgaaccccacggccatcttcctaaccaccttgagccgcacgaacaagaagcggtcctggccactgaacgaggccattatggccgtgggcatggtctcaatcctggcgtccagcctcctgaagaacgacatccccatgactggccccctggtcgccgggggcctcctgaccgtgtgctacgtgctcaccgggcgcagcgccgacttagagttagaacgggccacggacgtcaagtgggaggaccaggccgagatatcgggctccagccccatcttaagtatcacgatctccgaggacgggagcatgtccatcaaaaatgaggaggaagagcagaccctcacaatcctgatccgcacgggcctgttggtgatcagcggcctgttcccgatctccatccccatcaccgcggctgcctggtacctgtgggaagtgaagaagcagcgggccggggtactctgggacgtgccatcaccaccgcctatggggaaggccgagctggaggacggggcgtaccgcattaagcagaagggcatactggggtactcccagatcggcgccggcgtgtataaggaaggtaccttccacactatgtggcatgtcacccgcggcgccgtgctcatgcacaaggggaagaggatcgagcccagctgggccgatgtgaagaaggacctgatctcctacggcgggggctggaagctggagggcgagtggaaagagggggaagaggtacaggtgctggcgctggagcccggcaagaacccccgggcggtgcaaacgaagcccggactgttcaagaccaacaccggaaccatcggggcagtcagcctcgatttctcccccggcacgagcggctcccccatcatcgataagaaggggaaggtcgtgggcctgtacgggaacggcgtcgtgacccgcagcggggcctacgtgtccgcgatcgcccagaccgagaagtcgatcgaggataaccccgaaatcgaagacgacatatttcggaaaaggcggttaaccataatggatctgcaccccggggctggcaagacgaagcgctatctacccgccatcgtccgggaggccatcaagcggggcctgcggactctgattctcgcccctacccgcgttgttgccgccgagatggaggaggcgctgcggggcctgcccatccgctaccagacccccgcaatccgggccgagcacacagggcgcgagattgtcgacctcatgtgccacgcgaccttcaccatgcgcctgctgtcccccgtacgggtgccgaattacaacctcatcatcatggacgaggctcatttcaccgaccccgccagcatcgccgcccgcggctacatctccacgcgggtagagatgggcgaggcggccgggatcttcatgacagccacgccgcccggcagccgcgacccgttcccccagagcaacgctcccataatcgacgaggagcgcgaaatccccgagcgctcctggaacagcgggcacgagtgggtgactgacttcaaggggaagacggtgtggttcgtcccgtccatcaaggccgggaacgacatcgctgcctgcctgcgtaagaacggcaagaaagtgatccagctgtctcgcaagacattcgactccgagtacgtcaagacccggaccaacgactgggacttcgtcgtgacgaccgacatcagcgagatgggcgccaactttaaggccgagcgcgtgatcgatccgcggcgctgcatgaagcccgttatcttgaccgacggggaggagcgggtcatcttagcgggccccatgccagtgactcactccagcgcagcccagcgccgggggcgcataggacgaaaccccaagaacgagaacgaccagtacatctacatgggggagcccttagagaacgacgaggactgcgcccactggaaggaagcaaagatgttattggacaacatcaacacgcctgagggcatcatcccatcaatgttcgagcccgagcgagagaaggtcgacgcgattgacggcgaataccggttacgcggggaggcccgcaagaccttcgtggacctcatgcggcgcggagacttacccgtgtggctggcctacaaggtagcagccgagggcatcaactacgcggaccggcgctggtgcttcgacggtatcaagaacaatcagatcctcgaagagaacgtggaggtcgagatctggaccaaggagggtgagcggaagaaactgaagccgcgctggctggacgcccggatttacagcgaccccttagccttaaaggaatttaaggagttcgccgccggccgtaaatccctaaccctcaacctgatcacggagatgggccgactgcccaccttcatgacacagaagactcgcgacgcgctggacaacctggccgttctgcatactgccgaggccgggggccgtgcgtacaaccacgccctcagcgagctacccgagacattggagaccctcttgcttctaaccctgctagcaacagtcaccggaggcatcttcctcttcctgatgtccggcagaggtatcggcaagatgaccctggggatgtgctgcatcatcacagcctcaatcctcctgtggtacgcccagatccagccgcattggatcgcggcctccatcatactcgagttcttcctcatcgtcctgctgatccccgagcccgagaagcagcggacgccccaagacaaccagctaacgtacgtggtgatagccatcctgaccgtcgtggcagccaccatggcgaacgagatggggttcctggagaagaccaagaaggacctcgggctaggcagcatcgccacgcagcaaccggagtctaacatcctggacatcgatctccgccccgccagcgcctggaccctgtacgccgtggcgaccacattcgtcacgcccatgcttaggcactccatcgagaacagcagtgtgaacgtgtccctcaccgcgatcgccaaccaggctaccgtcctgatgggcttaggaaaaggctggcccctcagcaagatggacatcggagtgccgctgctcgccatcggctgctactcccaggtgaaccccatcacccttacggcagcccttttacttctggtcgctcactacgctatcattggcccaggccttcaggcgaaggccacccgcgaggcgcagaagcgggctgccgcggggatcatgaagaaccccaccgtggacggaattaccgttatcgacctcgacccgatcccctacgatcctaagtttgaaaagcagctgggccaggtcatgttattaatcctctgcgtcacccaggtactgatgatgagaaccacctgggccctctgcgaggccctgaccctggcgacagggcccatcagcaccctctgggagggcaatccggggagattctggaacaccactatcgccgtctccatggccaacatcttccgcggctcctacttagctggcgccgggctccttttctccatcatgaaaaacacgactaacacccggcgcggtacggggaacataggcgagacgctgggcgaaaagtggaagtcccgcctgaatgccttagggaagtccgaattccagatctacaagaagtccggcatccaagaggtcgatcgcacacttgccaaggaggggatcaagcgcggcgagaccgaccaccatgcggtgtcccgggggagcgccaagctgcgctggttcgtagagcgtaacatggtgacacccgagggcaaggtggtcgatctgggatgcggacgcggcgggtggtcctactactgcggcgggctgaagaatgttcgggaggttaagggcctgacgaagggggggcccggccacgaggagcccatacccatgagcacatacgggtggaatctcgtcagactgcagtccggcgtggacgtgttcttcatcccgcccgagaagtgtgacacactgctctgcgacatcggcgagtcgtctcccaaccctaccgtcgaggccggcagaacgctccgcgtcctgaacctcgtcgagaactggctgaacaataacacccagttctgcatcaaggtcctgaacccgtacatgcctagcgtgatcgagaagatggaagccctgcaacggaaatacggcggggcactcgtgcgaaacccgctctcccggaatagcacccacgagatgtactgggtcagcaacgcatccggcaacatcgtcagctccgtgaacatgatcagccgcatgctgatcaaccggttcaccatgcgccacaagaaggccacctacgagcccgacgtcgacctcgggagtgggacgcggaacatcgggatcgagagcgaaaccccaaacctggacatcatagggaagcgcattgagaagatcaaggaggagcacgaaacctcttggcattacgaccaggaccacccgtacaaaacgtgggcttaccacggcagctacgagacgaagcagaccgggtccgccagctcgatggtgaatggcgttgtccggctgctcaccaagccgtgggacgtgttgcccaccgtgacgcagatggcgatgaccgacaccacgccgttcgggcaacagcgggtcttcaaagagaaggtcgacacgcgcacccaggaacccaaggagggcaccaaaaagttaatgaagatcaccgccgagtggctatggaaggagctgggcaagaagaagactccccggatgtgcacccgcgaggagttcacgcggaaggttcgctcaaacgccgccctgggggccatcttcaccgatgaaaacaagtggaagagcgcgcgagaggcagtcgaggattcccgcttctgggagcttgttgacaaggagcgaaatctgcacctggagggcaagtgcgagacgtgcgtctataacatgatggggaagcgcgaaaagaagctcggcgagttcgggaaggccaaaggctcccgggcaatctggtacatgtggctgggcgcccgctttctggagttcgaggcgctcgggttcctgaacgaggaccactggttcagccgtgagaactccctgagcggagtagagggcgagggcctccacaagctggggtacatcctgcgcgacgtgtcaaagaaggaggggggcgcgatgtacgccgacgacaccgcgggatgggacacccggatcaccctagaggacctcaaaaacgaggagatggtcactaaccatatggagggcgagcacaagaagctggcggaggccatctttaagctcacttaccagaacaaggtggtgcgcgtccaacgtcccacgccgcgggggaccgtgatggacataatcagccgtcgcgaccagcggggaagcggccaggtggggacgtacggcctgaacaccttcaccaacatggaagcgcagctgatccgccagatggagggggagggcgtctttaagaacatccaacacctcaccgtgacggaggaggccgctgtacagaattggctggcgcgggtcgggcgcgagcgcttatcccggatggccatcagcggcgacgactgcgtagtgaagcccctcgacgaccgcttcgcgaacgccctgacagccctgaatgacatgggtaagatccggaaggacatccagcagtgggagccatctaaggggtggaacgactggacccaggtccccttctgcagccaccatttccatgagttaatcatgaaggacggccgcgtgctggtcgtcccctgtcggaaccaggacgagttaatcgggcgcgcgcggatctcccagggcgcggggtggagcctacgcgagaccgcctgcctgggcaagtcctacgcccaaatgtggagcctgatgtacttccaccggcgcgacctacggctggccgcgaacgcgatatgctcagctgtgcccagccattgggtgcccacgtcacgcacaacctggtctatacatgcaaagcacgagtggatgaccaccgaagacatgctgactgtctggaacagggtatggattcgcgaaaacccctggatggaggacaagacgcccgtggagtcctgggaggagatcccctacctcggcaagcgggaggaccagtggtgcggtagcttgattggcctgacctcccgcgccacctgggcgaaaaacatccaggccgccatcaaccaggtcagaagccttatcgggaacgaggagtacacggattatatgccgtccatgaagcgcttccggcgcgaggaggaggaggccggcgtgctgtggtga

SEQ ID NO: 24957 - RNA, 9876 nt, synthetic construct
  misc_feature 1..9876: note = derived and/or modified CDS sequence (opt11) from DENV-2__GU131930__SS-prME
  source 1..9876: mol_type = other RNA
tcggcaggcatgatcatcatgctgatcccgacagttatggccttccacctcaccacccgcaacggggaaccccacatgatcgtgggcatccaggagaaaggtaagagcctactcttcaagaccgaggacggcgtgaatatgtgcaccctcatggcgatggacctgggggagctgtgcgaagacaccatcacatacaaatgcccgctgctgcgacagaacgagcccgaggacatagactgctggtgcaactccactagcacgtgggtgacctacgggacgtgcaccaccaccggcgagcaccgccgggagaagcggagcgtcgctctggtgccccatgtggggatggggctcgagacccggactgagacctggatgagctccgagggtgcctggaagcacgcccagcggatagagacttggatcctacggcacccgggttttactatcatggccgcgattctggcctacaccatcgggaccacccatttccagcgcgccctcatcttcatcctgctgacggccgtggcgccctccatgaccatgcggtgcatcggcattagcaaccgcgacttcgtggagggcgtaagcgggggctcatgggtcgatattgtgctggagcacgggtcctgcgtgactaccatggcaaagaacaaacccacgctggatttcgagctgatcaagaccgaagcgaagcagcccgccaccctcaggaagtactgcatcgaggcgaagctgactaacacgaccaccgagagccgctgccccacccagggcgagccctccctgaaggaggaacaggataagcggttcgtctgtaagcactccatggtggaccgaggctgggggaacggatgtgggttgttcggcaagggcgggatcgtgacgtgtgcgatgttcacgtgcaagaagaacatggagggtaaaatcgtccagcccgagaatttggagtacaccatcgtggtcacgccccattccggggaagaacacgccgtcggcaatgacacagggaaacacggcaaggaaatcaaggtgaccccacagagctctatcaccgaggccgaactgactgggtatgggaccgtgactatggagtgtagcccccggaccggcctcgacttcaacgagatggttctgttgcagatggagtctaaggcatggctagtgcatcgccagtggttcctggacctgccattgccctggctgcccggggccgacaagcagggcagcaactggatccagaaggagacgctggtgactttcaagaaccctcacgcgaagaaacaggacgtcgtcgtcctcgggtcccaggagggcgctatgcacacggccctgaccggggccacagagatccagatgtccagcgggaacctcctgtttaccggtcacctgaagtgccggcttcggatggacaaactccaactgaagggtatgagctactccatgtgcacaggcaagttcaaagtggtgaaggagatcgccgagacccagcacggtacaatagtcatccgggtgcagtacgaaggcgacggctccccctgcaagatcccgttcgagatcatggatctggagaagcgttacgtgcttgggcggctgatcactgtcaacccgatcgtgacagaaaaggacagccccgtcaacatagaggccgagccccctttcggcgactcctacatcatcattggggtcgagccgggacagttaaagctcaactggttcaagaagggcagctccatcggccagatgttcgagaccaccatgcgcggcgccaagcgtatggccatccttggcgacaccgcctgggacttcggcagccttggcggggttttcacgtccatcgggaaggcgctccaccaagtattcggtgctatttatggcgccgccttttcaggagtctcctggaccatgaagatcctaataggcgtgataatcacctggatcgggatgaacagccgctctaccagcctgtccgtgtctctggtcctggtgggcatagtgacgctgtacctgggagtcatggtgcaggccgacagtggctgcgttgtctcatggaagaacaaggagctaaagtgcggctccgggatattcatcaccgacaacgttcacacctggaccgagcagtacaagttccagccggagtcccccagcaagctggcctcagctatccaaaaggcccaggaggagggcatctgtggtatccgcagcgtgacgagactggagaacctcatgtggaagcaaatcacccccgagctgaaccacatcctggccgagaacgaagtcaagctcacgataatgaccggcgacatcaaggggatcatgcaggccggtaagcgctccctgcggcctcaaccgactgagctgaagtacagttggaagacctggggcaaggcgaagatgttgtctactgagagccacaaccagaccttcctgatagacgggcccgagacggccgaatgccccaacaccaatcgcgcctggaactcgctggaggtggaggactacggcttcggggtgtttactaccaacatctggctcaagttaaaggagaagcaggacgccttctgtgacagtaagctgatgtccgctgcgataaaggacaaccgggccgtccatgccgacatgggatactggatcgagtcagctctcaatgacacgtggaaaatagagaaggccagcttcatcgaggttaagaactgccattggcccaagtctcacaccctgtggtccaacggcgtgctggagagcgagatgatcatccccaagaacctcgcgggacccgtctcccagcacaactaccgcccgggctaccacacccagaccgccgggccctggcacctgggtaagctggagatggacttcgacttctgtgacgggacaacggtgatcgtgactgaggactgcggcaaccgaggccccagcctgcgcaccaccacggcctcggggaagctgatcaccgaatggtgttgccggtcctgcaccttacccccgctccgctaccggggcgaggatggatgctggtacgggatggagatccggccactgaaggagaaggaggagaacctggttaacagcctcgtgaccgctggacacggtcaggtggacaacttctccctgggcgtcctaggcatggccctgttcctggaggagatgctgcggacacgcgtgggaaccaagcacgccattctattagtggctgtcagcttcgtaaccctgattaccgggaacatgtcctttaaggacctcggccgggtggtggtgatggtggggacgaccatgaccgatgacatcggcatgggggtcacttacctggccctgctcgccgcgtttaaggtccgccccacgtttgccgcagggctactgttacggaagctgacgagcaaggagctgatgatgaccacaatcggcatcgtactcttgtcccagagcacgatccccgagaccatcctggagctcaccgacgccctggccctgggaatgatggtcttgaagatcgttcgcgacatggagaagtatcaactggcggtgaccatcatggccatcctgtgcgtcccgaacgccgtgatcctccaaaacgcctggaaggtatcatgcacgatactggccgtggtatcagtatctcccctgttattaaccagctcccaacagaagaccgactggattccgttagctttgaccatcaaggggctgaaccctacggccatcttcctgaccaccttgtcacgcactaataagaagcggagctggccgctgaacgaagcaatcatggctgtgggcatggtgagcatcctggcgtccagcctcctgaagaacgacatccccatgacagggcccctggttgccggcgggctcctgacagtgtgttatgttttaactggcagatccgccgatctcgagttagagcgggccaccgacgtaaagtgggaagatcaggccgagatcagcgggagctcccccatcctaagcattacgatctccgaggacggcagcatgagcatcaagaatgaagaggaagaacaaacgctcacgattctgatccgcaccggtttactcgtgatcagcgggctgtttccggtatccatccccatcaccgcggccgcatggtacctctgggaggtcaagaagcagcgggccggcgtcttatgggacgtaccgagcccaccgcccatggggaaggccgagctggaggacggcgcgtaccgcatcaagcagaagggaatcctggggtactcccaaatcggagcgggggtatacaaggaggggactttccatacaatgtggcacgtgacgcgcggggcggtgctgatgcataagggcaagaggatcgagcccagctgggctgatgtcaagaaagacctgatctcctacgggggcggctggaagctggagggggaatggaaggagggcgaggaggtccaggtgttagcgctcgagcccgggaagaacccccgggcggtccagaccaagcccggcctgttcaagacgaacaccggaaccatcggcgccgtgagcctcgacttctcccccggcacaagcgggtcccccattatcgataagaagggcaaggttgtcggactgtatgggaacggtgtggtgacgcgcagcggggcctatgtctctgcaatcgcccagaccgagaagtctatcgaagacaaccccgaaatcgaggatgacatctttcggaagcgacggctgaccatcatggaccttcaccccggcgcggggaagaccaaacgctaccttcccgccatcgtacgggaggccatcaagcgcggcctgagaacgctgatcctcgctcccacccgggtggtcgcggcggagatggaagaggcgctgcgggggctgcccatccggtaccagacccccgccatcagggccgagcacaccggccgcgagatcgtggacctcatgtgccatgcgactttcaccatgcgcctgctgagccctgtgcgagtgccgaactacaacctcatcatcatggacgaggcccacttcaccgatccagcaagcatcgccgcacggggctacataagcacgcgggtggagatgggggaggcagccggcatcttcatgacggcgacgccgcccgggtctcgcgacccgttcccccagagcaacgctcccataattgacgaggagagagagatccccgaacgctcctggaacaccggtcacgagtgggtgaccgacttcaaagggaaaaccgtctggttcgtgccgagcatcaaggccggcaacgacatagcggcctgcctgcggaagaacggcaagaaagtgatccagctgtcccgcaaaactttcgacagcgagtacgtcaaaacccggaccaacgactgggacttcgtggtcacgaccgacatctccgagatgggggccaattttaaggccgaacgcgtcatcgacccccggcgctgcatgaagcccgtgatcctcaccgacggagaggagcgggtgatcctggcgggacccatgccggtaacccacagctccgccgcccagcgccgggggcgcattggacggaaccccaagaacgagaacgatcagtatatctacatgggcgagcccctggagaacgatgaggactgcgctcactggaaggaagcaaaaatgctcttggacaatatcaacacgccggagggcatcatcccgagcatgttcgagcccgagcgcgaaaaggtagacgcgatcgacggggagtaccgtctgcggggcgaggcccgcaagaccttcgtggacctcatgcggcggggtgacctgcccgtctggctggcttacaaggtggctgctgagggaataaactacgctgacagacgctggtgcttcgacgggatcaagaacaaccaaatcctcgaggagaatgtggaagtcgagatctggacaaaagagggcgagagaaagaagctgaagccgaggtggctggacgcccggatctacagtgaccccttggccttaaaggagttcaaggagttcgccgccggccgcaagagcctgaccctcaacctgatcacggaaatggggcgactgcccaccttcatgacccagaagacgcgcgacgcgctcgacaatctggccgtgctgcacacggccgaggccggcgggagggcgtacaaccatgccctctccgaactgcccgagacccttgagaccctcttgctgctcactctgttagcgactgtcacgggcggcatcttcctcttcctgatgagcgggcgcggcatcgggaagatgaccctaggcatgtgctgcatcatcaccgcctcaatcctcctgtggtacgcccagatccagccccactggatcgcggccagcatcatcctggagttcttccttattgtgctgctgatacccgagcccgaaaaacagcggacgcctcaggacaaccagctcacgtacgtggtcatcgctatattaaccgtagttgccgccaccatggcgaacgagatggggttccttgagaagaccaagaaggacctcggcctcggctctattgccacccagcagccggagtccaacatcctggacatcgacctcaggcccgcatccgcctggacgctgtacgccgtcgcgaccactttcgtgacgccgatgctgcggcacagcatcgagaacagctccgtgaacgtctctctcacggccatcgccaaccaagccacggtgctgatggggctgggcaagggctggccactctccaagatggacatcggcgttccgctgctggccatcgggtgctacagccaggttaaccccatcaccctcacggcggcgctgttactcctggttgctcactacgccatcatcggccccggcttacaagcgaaagccacccgagaggcccagaagcgggccgcggcggggatcatgaagaaccccaccgtggacggcatcaccgtcattgacctagaccccattccctacgacccaaagttcgagaagcagctgggacaggttatgctgttgatcctgtgcgtgacacaggttctgatgatgcgcaccacctgggctctctgcgaggccctgaccctggccacgggccccatttccaccctctgggaggggaacccggggcggttctggaacacgactatcgctgtgtcgatggcgaacatattccggggctcctacctggccggggccggcctcctcttctcgattatgaaaaacacgaccaacacccgccgtgggacaggaaatatcggcgagacgctgggggaaaagtggaagtcccgcctgaacgccctcggaaagagcgagttccagacatacaagaaatcggggatccaggaggtagaccgaacactggccaaggagggcatcaagcgcggagagaccgaccaccacgcggtgagccggggatccgcaaagttgcgctggttcgtggagcgcaacatggtgacgcccgaaggcaaggtcgtggacctcggctgcggcagagggggctggtcctactattgcgggggccttaagaacgtgcgggaggtcaaaggactgaccaagggcgggcccgggcatgaggagccaataccgatgtccacctacgggtggaacttagtccgcctgcagagcggggtggacgttttctttatcccgcccgaaaagtgcgacacacttctctgcgacatcggcgagtccagcccaaacccgaccgtggaggccggccggacattgcgcgttctgaacttagtcgagaactggctgaacaataacacccagttctgcatcaaggtactgaacccctacatgcccagtgtgatcgagaagatggaggcccttcagcggaaatacggtggcgcgctagtccgcaacccgttaagcagaaattcgacccacgagatgtactgggtgtccaacgccagcggtaacatcgtgtcctcagtcaacatgatttcccgcatgttgatcaaccggttcaccatgaggcacaagaaggccacgtacgaacccgacgtagacctgggtagcgggacccggaacatcgggatcgagtccgagatcccgaacctggacattattggcaagcgcatcgagaagattaagcaggagcacgaaaccagctggcactatgaccaggaccacccgtacaagacatgggcataccacggctcctatgagacgaagcagactggcagcgcttcaagcatggtgaacggggtcgttcggctgctcaccaagccgtgggacgtgctgcccacagtcacgcagatggcgatgaccgacaccacaccctttggccagcaacgcgtgttcaaggaaaaggtggacacgcgcacccaggagccgaaggagggcaccaagaagctgatgaaaatcactgccgaatggctctggaaggagctggggaagaagaagacgccacggatgtgcacccgcgaggagttcacccggaaggtccgctccaacgcggcactgggcgccatcttcaccgacgaaaacaagtggaagtccgcccgggaggccgtggaggactcgcgattctgggagttggtggacaaggagcggaacctgcacctggagggtaagtgcgagacctgtgtctacaacatgatgggcaagcgcgaaaagaagctcggggagttcggcaaagccaagggctcacgggccatttggtacatgtggctgggggcccgcttcctggagttcgaggcgctcggcttcctgaacgaagatcactggttctcgcgggagaatagcctgtccggggtggagggcgagggactgcacaagctgggctacatcctgcgcgacgtcagtaagaaggagggtggggccatgtatgccgacgacaccgccggctgggacaccaggatcaccctcgaggacctgaagaatgaagaaatggtgacgaaccacatggagggtgagcataagaagttggcggaggccatcttcaagctcacataccagaacaaagtagtccgtgtgcagcggcccacgccccggggcaccgtgatggacatcatcagccggagggaccagagggggtccggccaggtcggcacctacgggctgaacaccttcaccaacatggaggctcagctgatccgccagatggagggcgagggggttttcaagaacatccagcatctcaccgcgacggaggaggtggccgtcaagaattggctggcgcgggtaggcagggaaaggttgagccggatggccatctccggcgacgactgcgtggtcaagccgctggacgatcgcttcgccaacgctctgaccgccctgaacgacatggggaagatccgaaaggacatccagcagtgggagccgagtaaaggttggaatgactggacccaggtgcccttctgttcccaccattttcacgagctgatcatgaaggatgggcgcgtcctggtcgttccttgccggaaccaggacgagctgatcggccgcgcgcggatcagccagggggccggatggtcactccgcgagaccgcctgcctgggcaagtcgtacgcccagatgtggtccctgatgtacttccaccggcgggaccttcggctggccgcgaacgccatctgcagcgctgtgccctcccactgggtcccgaccagccgcacgacatggagtatacacgctaagcacgagtggatgaccaccgaagatatgctgaccgtatggaacagggtgtggatccgcgagaacccctggatggaggacaaaaccccggtcgaaagctgggaggagatcccctacctcggcaagcgggaagaccagtggtgcgggtccctgatcgggctgactagccgtgcaacctgggccaagaacatccaggccgccatcaaccaggtgcggagtctcatcggcaatgaggagtatacggactacatgccgagcatgaagcgcttccggcgcgaggaggaagaggccggggtgctgtggtga

SEQ ID NO: 24958 - RNA, 9876 nt, synthetic construct
  misc_feature 1..9876: note = derived and/or modified CDS sequence (opt11) from DENV-2__GU131931__SS-prME
  source 1..9876: mol_type = other RNA
agtgcggggatgatcatcatgctgatccccaccgtgatggcctttcacctcaccaccagaaatggggaaccgcacatgatcgtagggattcaggagaagggaaagtccctgctgtttaagaccgaggacggcgtcaatatgtgtaccctgatggcgatggacctgggtgagttatgcgaggatactatcacctataagtgccccctcctgcggcagaatgagcccgaggacatcgactgctggtgcaatagcacatctacctgggtgacctacgggacctgcacgaccaccggcgagcaccgccgcgagaagcgcagcgtcgccctggtgccccacgtggggatgggcctcgagacccggaccgagacctggatgtcgtcagaaggggcttggaagcatgcccagcgcatcgagacgtggatcctgcggcacccgggcttcaccatcatggcggccatccttgcacataccatagggaccacccactttcagcgcgtccttatatttatcttacttacggctgtggcaccctccatgaccatgcggtgcatcggcatcagtaaccgcgacttcgtggagggcgttagtgggggcagctgggtggacatagtgcttgagcacggctcctgcgtcaccaccatggcgaagaacaaacccacgctggatttcgagctcatcaagaccgaagccaaacagcccgccaccctgcggaagtactgcatcgaggcaaagctgacaaacacgaccaccgaaagccgctgtcccacccagggcgagccctccttaaaggaggagcaggacaaacggttcgtgtgcaagcactccatggtggaccgcggctgggggaatgggtgcggcctgttcggcaagggcgggatcgtcacgtgcgccatgttcacgtgcaagaagaacatggagggcaagatcgtccagcctgagaacttggagtacaccattgtggtaacgccccactccggagaggaacacgcggtgggcaacgacacggggaagcacggcatggagatcaaggttactccgcagtcctccatcaccgaggccgagcttaccgggtacggcaccgtcacgatggagtgcagcccccggaccggcctcgacttcaacgaaatggtgctgctgcagatggagaacaaggcatggctcgtgcatcgtcagtggtttctggacctgcccctcccatggctgccgggggccgacaagcaggaatccaactggatccagaaggagacccttgtcactttcaagaacccccacgccaagaaacaggacgtggtagtcctaggcagccaggagggggctatgcacacagcgcttaccggcgcaaccgagatccagatgagctccgggaatctcctgttcaccggacacctgaagtgccggctgcgcatggacaagctccagctgaagggcatgagctactctatgtgcacgggcaagttcaaggtggtcaaagaaatcgccgagacccagcacggtaccatcgtgatcagggtgcaatacgagggggacggctccccctgcaagatccccttcgagatcatggacctggagaagcgttacgtcttaggccggctgatcaccgtaaacccgatcgtgacggagaaggactcccccgtcaatatcgaggccgagccgcccttcggggacagctacatcatcataggcgtggagccgggtcagctgaagctcaactggttcaagaagggctcctccataggccagatgttcgagaccaccatgcgcggcgcgaaacgcatggccatcctgggcgacactgcctgggacttcgggagtctaggaggggtctttacgagtatcggcaaggccctccaccaaatcttcggggccatctacggcgcggccttctccggcgtcagctggaccatgaagatactaatcggagtgataatcacctggatcggcatgaacagtcggtccacgtctcttagcgtgagtttagtcctcgtggggatcgtgaccctgtatctgggcgtcatggtccaggcagacagtgggtgcgtggtctcctggaagaacaaggagctcaagtgcggcagcggcatcttcatcaccgacaatgtacatacatggaccgagcagtacaagttccagcctgagagcccatccaagctggccagcgcgatccagaaagctcaagaggagggtatctgcggcatccgctccgtcacgcggctggagaacctgatgtggaaacagatcacacctgagctgaaccacatcctggctgagaacgaggtcaagctcaccatcatgaccggggacatcaagggcatcatgcaggccgggaaacgaagtctgcggccgcagcccacggagctgaagtactcctggaagacctggggcaaagccaaaatgctaagcactgagtcccacaaccagacctttttaattgacggacccgagacggcggaatgtcccaacactaaccgcgcctggaacagtctggaggttgaggactacgggttcggcgtgttcaccacgaacatctggctcaagctaaaggagaaacaggacgccttctgcgactccaagttaatgagtgccgcgatcaaagacaatcgggcggtgcacgcggacatggggtactggatcgagtccgctctgaacgacacgtggaagatcgagaaggcctctttcattgaggtgaagaactgccactggcccaagtcgcacaccctctggagtaacggcgtgctggagtccgagatgatcatccccaagaacctcgccggccccgtcagccagcacaactaccgcccggggtaccatacacaaatcgcgggaccctggcatctgggaaagctagagatggacttcgacttctgcgacggaaccaccgtgatcgtgacggaggactgtgggaacagaggcccctccttacgaaccaccaccgccagcggcaagttaatcacagagtggtgctgccggagctgcaccctgcccccgctccgctaccgcggggaggatggatgctggtacgggatggagatccgccccctcaaggagaaggaggagaacctagttaactccctcgtaaccgccggccacggtcaggtggacaatttcagcctaggcgtcctcggcatggccctcttccttgaagagatgttacggacccgcgtggggacgaaacacgcgatccttttagtggccgtctccttcgtgacactaatcaccggcaacatgagcttcaaggacctcgggcgggtggtcgtgatggttggagctaccatggccgacgacatcgggatgggcgtcacgtacctggcccttctcgcggcattcaaggttcgacctaccttcgccgccggcctgctgctccgcaagctgaccagcaaggagttaatgatgaccacgatcgggatcgtgctcctgagccagtcaaccatccccgagaccgtcctggagctcaccgacgcactggcgctgggcatgatggtgctcaagatcgtgcgaaacatggagaagtaccagctggccgtcacgatcatggccatcctgtgtgtcccgaatgccgtcatcctccagaacgcctggaaagtcagctgcaccatcctggcggtggtctccgtaagccctctgttgttaacctccagccagcagaagaccgactggatccccctggccttaacaatcaaggggctgaaccccaccgccatctttctgacgaccctctcccgcacgaacaaaaagcggagctggccgctgaacgaagccatcatggcggtgggcatggtgtccatcttggctagctcactgcttaaaaacgacatccctatgaccggtcccctggtggcagggggtctcctaactgtctgctacgtccttacggggcgcagcgccgacctcgagttagagagggccacggacgtgaagtgggaagaccaggcggagatctccggcagcagccccatcctgtctatcacaatcagcgaggacggttccatgagcataaagaatgaggaagaggaacagaccctcaccatcctgattcgcacgggcctgctggtgatttctggcctgttcccgatcagcatccccatcaccgccgccgcgtggtatctgtgggaggtcaagaagcagcgggccggggtgctctgggacgtgccctctccaccacccatgggcaaggcggagctggaggacggggcctaccgcatcaagcagaagggcatcctagggtatagccagatcggcgcgggtgtctacaaagaaggcaccttccacaccatgtggcacgttacccggggcgccgtgcttatgcacaaggggaaacgcatcgagccctcctgggctgacgtcaagaaagacctgatctcctatggcggtggctggaagctggagggcgagtggaaggagggggaggaggtccaggttctcgcgctggagcccggcaaaaacccccgggcagtacagacgaaaccaggtctgttcaaaacaaacaccggcaccatcggggcagtgagcctggacttcagccccggcacgtccggcagcccaatcatcgacaaaaaggggaaagtcgtcgggctttacgggaatggggtggtgacccgcagtggcgcctacgtcagcgcaatcgcacaaacagaaaagagcatcgaagacaaccctgagattgaggatgacatcttccggaagcgccggttaaccatcatggacctgcaccccggggccggcaagacgaagcgctatctccctgcgatagtgcgggaggccatcaagcgcgggctgcggacccttatcctagcgccgacccgcgtggtcgccgccgagatggaggaggcactgagaggtctgcccatccgctaccagaccccggctatccgggcggagcacacggggcgagagatcgtggacttgatgtgccacgccaccttcaccatgcgcctgctgagcccggtgcgggtcccgaactataacctcataatcatggacgaggcccacttcaccgacccagcctcgatagccgcgcgcggctacatcagcacgagagtagagatgggcgaagccgccgggatctttatgacggccacgccgcccggatctcgagaccccttcccgcagtccaacgctcccatcatcgacgaagaacgggagatccccgagagatcatggaactccggccacgagtgggtgaccgacttcaagggtaaaactgtctggttcgtgccgagcatcaaggcggggaatgacatagccgcgtgtctgagaaagaacggtaagaaagtgattcagctatcgcgcaagaccttcgacagcgagtacgtcaagacccggaccaacgactgggacttcgttgtgactacggatatctccgagatgggggccaactttaaggcggagcgagtcatcgatccccggcgctgtatgaaacccgtcatcctcaccgacggggaggagcgggtgatcctggccggcccaatgccggtcacccacagctccgccgcccagcgccgcggtcgcataggccggaaccccaagaacgagaacgatcagtacatttacatgggggagcccctggagaacgacgaggactgcgcccactggaaggaggcaaagatgctactggacaacatcaacacccctgagggcatcatcccttcgatgttcgagcccgagcgcgagaaagtggacgccatagacggcgagtaccggctgcgcggggaggctcgtaaaaccttcgtggacctcatgcgacgtggcgacctgcccgtctggctggcatacaaggttgccgcagaggggatcaactacgccgaccggcgttggtgcttcgacggcatcaagaacaaccagatcctcgaggagaacgttgaggttgagatctggacaaaggagggagagcggaagaagctgaagccgcgctggcttgacgcccggatatactccgaccccctcgccttaaaggagttcaaggagttcgccgccggccgcaagtcactgaccttaaacctgatcacggagatgggacggctgcccacgttcatgacacagaagacacgggacgccctcgacaacctggccgtactgcacacggccgaggctggcgggcgggcctacaatcacgccctttccgaactaccagagaccctggagaccctgctgctgctcaccctgctggctacggtcaccgggggcatcttcctattcctgatgagcggccgcgggatcggtaagatgacactgggtatgtgctgtatcataaccgccagtatcctcctgtggtatgcgcagattcagccgcactggatcgccgccagcatcatcctggagttcttcctcatcgtgctgttaatccccgagcccgagaagcagcggacgccgcaggataaccagctcacatacgtcgtcatcgccattctgacagtagtagccgcgaccatggccaacgaaatgggctttttggaaaagactaagaaggacctcgggctgggctccatcgccacgcagcagccggagagcaacatcctggacattgatctccgccccgcctccgcctggaccctgtacgcggtcgccacaaccttcgtgacgcccatgttgagacacagcatcgaaaactcttccgtgaacgtcagcctgaccgcaatagccaaccaggcgaccgtgctgatgggcctgggcaaaggctggcccttaagtaagatggacatcggagtgccgctgctggcaatcggatgctacagccaggtcaacccgattaccctcaccgccgcgctgctgctcctggtggcccattatgcgatcatcgggcccggcctccaggccaaggccacccgcgaggcgcaaaagcgggcagcggccggcatcatgaaaaaccccaccgtggacggaatcaccgtgatcgacctcgatcccatcccctacgaccccaagttcgagaagcaattaggacaggtcatgctgttgatcctgtgcgtaacgcaagtcctaatgatgcgcaccacctgggccctctgcgaggctctgaccctggcgacggggcccatcagtaccttgtgggagggaaaccccgggcggttctggaacaccaccatcgcagtgagcatggccaacatcttccgcggcagttatcttgccggcgccgggctactcttcagcattatgaaaaatacgaccaatacccggcgaggcactgggaacatcggcgagacgttaggcgagaagtggaagtctcgcctgaacgccctcggaaagtccgagttccagatctacaagaagtccggcattcaggaggtggatcggaccctggcaaaggaggggatcaagcgcggcgagaccgaccatcacgccgtgtcgagggggtccgccaagctgcgctggttcgtcgagcgcaacatggtgacccccgagggcaaggtcgtggacctcggctgtgggcgcggagggtggagttactactgcggcgggcttaagaacgtcagagaggtcaagggcctgacgaagggtgggcccggccacgaggagccaatcccgatgagcacctacgggtggaatctcgtgcggctgcagagcggcgtggacgtcttcttcataccgcccgagaagtgcgatacccttctctgcgacatcggggagagcagccccaacccgactgtggaggctggccggactctgcgcgtgctgaacctcgtagagaactggctgaacaacaacactcagttctgcatcaaggtgctgaacccctatatgccctccgtcatcgaaaagatggaggcgctgcagcggaagtacggaggtgccctcgtccggaatccgttgagccggaacagcacgcacgagatgtattgggtgtccaacgccagcggcaatatcgtatccagtgtcaacatgatctcccgcatgctgataaaccggtttaccatgcgacataaaaaggccacctacgaaccggacgtcgaccttgggagcgggactcggaacatcgggatcgaatctgaaatccccaatctggacattatcggcaagcgcatcgagaagatcaaggaggaacatgagacgagctggcactatgaccaggaccacccctacaaaacttgggcctaccacggctcctatgagaccaagcaaactgggagcgcctcaagcatggttaatggcgtcgtgcggctgctcaccaagccgtgggacgtgctgcccactgtcacccagatggccatgacggacactacccccttcgggcagcagcgcgtcttcaaggagaaggtggatacccgcacgcaggagcccaaggagggtaccaagaagctgatgaagatcacagccgagtggctttggaaggaactgggcaagaaaaagactccccggatgtgtacgcgcgaggagttcaccaggaaggtccgatcaaacgccgccctgggggctatcttcaccgacgagaacaagtggaagtcggcccgggaggccgtggaggactcccgattctgggagctcgttgacaaggaacgcaacctgcacctggaggggaagtgcgagacctgcgtctacaacatgatggggaagagagaaaagaagctcggcgagttcgggaaggccaagggctctcgagccatctggtacatgtggctgggcgcgcggttcctggagttcgaggccctcgggtttctgaacgaggaccactggttttcccgggagaacagcctctccggcgtggaaggggagggcctccataagctggggtacatcctccgagatgtctcaaagaaagaagggggcgccatgtacgccgacgacacggcgggatgggacacccggatcacactcgaggacctgaagaacgaggagatggtgaccaaccacatggagggcgagcataagaagctggcagaggccatcttcaaactcacttaccagaacaaggtggtccgcgtgcagcgccccacgcccagagggaccgtgatggacatcatcagccggagagaccagcggggttccgggcaggtcggcacttacgggctgaacacgttcacaaacatggaagcccagctgatcagacagatggagggggagggcgtgttcaagaatatccagcacctcaccgtgaccgaggaggccgcggtacagaactggctggcaagggtggggcgagagcgcctgagccggatggcgatctccggcgacgactgcgtggtcaagcccctcgacgaccgcttcgcaaacgccctgacggcgctgaacgacatgggcaagatccggaaggacatccagcagtgggagccgagtaaggggtggaatgactggacccaggtgcccttctgctcccaccacttccacgagttgatcatgaaggatggccgcgtgctggtcgtgccctgccggaatcaggacgaactgatcgggagggcacggatcagccaaggcgcggggtggtccctgcgcgagactgcctgtctgggcaagtcatacgcccagatgtggtcactaatgtacttccaccggcgcgacctccggcttgcggccaacgccatctgcagcgccgtaccctcccactgggtaccaacctcgcgcacgacctggtccatccacgccaagcatgagtggatgacaaccgaggacatgctgaccgtgtggaaccgggtctggattcgcgagaatccctggatggaggacaagacccccgtcgagagctgggaggagatcccgtacctcggcaagcgagaggatcagtggtgcgggtccttaattggcctgaccagccgcgcgacctgggctaagaacatccaagccgccatcaaccaggtgcggtcactcatagggaacgaggagtacaccgactacatgccaagcatgaagcgcttccggcgcgaggaggaggaggcaggcgtgctgtggtga

SEQ ID NO: 24959 - RNA, 9876 nt, synthetic construct
  misc_feature 1..9876: note = derived and/or modified CDS sequence (opt11) from DENV-2__GU131932__SS-prME
  source 1..9876: mol_type = other RNA
agcgcaggcatgatcatcatgttgatcccgactgtgatggccttccacttaaccacccgcaacggtgagccccacatgatcgtcggcatccaggagaagggcaagtccctattattcaagaccgaggacggcgtaaacatgtgcaccctcatggcgatggacctgggggagctctgcgaggacacaatcacgtacaagtgccccctcctgcgacagaacgagcccgaagacatcgactgctggtgtaacagcaccagcacgtgggtgacctacggaacctgtactacaacgggcgagcaccgccgcgaaaaacgcagcgtagcactggtgccgcacgtggggatgggtctagagactcgtacagagacctggatgtccagcgagggggcctggaagcacgcccaacgaatagagacctggattctgcgtcacccgggcttcacgatcatggccgcgatcctggcctacacgattgggacaacccatttccagcgcgtccttatctttatactgctgacggctgtggccccctccatgaccatgaggtgcatcggcatcagcaaccgagacttcgtcgagggagtctccgggggctcgtgggtggacatcgtgctcgagcacgggtcctgtgtcaccaccatggctaaaaacaagcccacgttggacttcgagctgattaagactgaggcgaagcagcctgccacactccggaagtactgcattgaggccaaactgacaaatacgaccaccgagagcagatgccccacccagggcgagccctccctgaaggaggagcaggacaagagattcgtgtgcaagcactcaatggtggaccgcggctgggggaacggctgcggcctgtttggcaagggcgggatcgtcacgtgcgccatgttcacgtgcaagaagaacatggagggcaaaatcgtgcagccggagaacttagagtataccattgtcgtcacgccccattccggtgaggagcacgcggtgggcaacgacacggggaagcacggcatggaaatcaaggtaaccccccaatccagtatcaccgaggccgagctgaccgggtacggcaccgtcacgatggagtgtagccctcgaaccggcctcgacttcaatgagatggtgctactgcagatggagaataaggcctggctcgtgcaccgccaatggttcctggacctgcccctcccctggttgccgggggccgacaagcaggagtccaactggatccaaaaagagaccctggtcaccttcaagaatccacacgccaagaagcaggacgtggtcgtgctcgggagccaggagggggcgatgcacacggccttaactggcgccaccgagattcaaatgagctccgggaacttactgttcaccggccacctgaagtgtcggctacgcatggacaagctccagctaaagggcatgagctactccatgtgtacggggaaattcaaagtagtgaaagaaatcgctgagacccagcacggcaccatcgtaatccgggtgcagtacgagggggacggaagcccctgcaagattccctttgagatcatggacctggagaaacgctacgtcctcggccggctgattactgtgaaccccatcgtgaccgagaaggactccccggtcaacattgaggccgagcctccctttggggacagctacatcataatcggcgtggagcccgggcagctaaaactcaactggttcaagaaaggctccagcatcgggcagatgttcgagaccaccatgcgtggcgctaagcgcatggccatcctaggggataccgcctgggacttcggttccctggggggcgtgtttacgtcgatcggcaaggcactccaccaggtcttcggcgcgatctacggcgctgccttttccggcgtgtcgtggaccatgaagatattgatcggggtgatcataacctggattggcatgaactccaggtccacctccctgagcgtcagtctggtactcgtggggatcgtcacgttgtacctgggcgtgatggtgcaggccgatagcgggtgcgtcgtgtcgtggaagaacaaagaactgaagtgcggcagcggtatcttcatcaccgacaacgtacacacctggaccgagcagtacaagttccagccggagtcaccctcgaagctggccagcgcaattcagaaggcccaggaggaggggatctgcggcatccgctccgtcacgaggctggaaaacctcatgtggaagcagatcacccccgagctgaaccacatactggccgagaacgaggtgaagctgaccatcatgaccggagacatcaagggcatcatgcaggccggcaaaagatcactgagaccgcagcccacggagctgaagtactcctggaaaacctggggcaaagccaagatgctcagcaccgaatcctacaaccagaccttcctgattgacggccccgagactgcggagtgccccaatacgaaccgcgcatggaactcacttgaggtggaggactacgggtttggcgtcttcaccacaaacatctggctcaagttaaaggagaaacaagacgcattctgcgactccaagctgatgagcgccgccataaaggacaaccgggcggtccatgccgacatggggtactggatcgagtccgcgctcaacgacacgtggaaaatagagaaggccagctttatcgaagtgaagaactgccactggcccaaatcccacaccctgtggagcaacggtgtcctggagtccgagatgattatccccaagaacctcgccgggcccgtgagccagcacaactaccgccctgggtaccatacccagatcgcgggcccctggcacctggggaagctggagatggacttcgacttctgcgacggcaccacagtaatcgtcacagaggattgcgggaaccggggccccagccttcgcaccaccaccgcgagcggcaagctgattacagaatggtgctgccgtagctgcaccctgccccccttgcgctaccgaggggaggacggctgttggtacgggatggagatccgccctctcaaggagaaggaggagaacctggtgaactccctcgtgaccgccggccacgggcaggtcgataatttcagcctgggtgtgctaggcatggccctattcctggaggagatgctgcgcacccgcgtggggacgaagcacgcgatcctccttgttgccgtgtccttcgtgaccctgatcaccggtaacatgagcttcaaggacctcggtcgggtcgtggtgatggtcggcgccaccatggccgacgacatagggatgggcgtgacgtaccttgccctgctcgcggccttcaaagtgcgccccaccttcgcggccggccttctgctccggaagctgacctcaaaggaactgatgatgaccactatcggcattgtgctcttaagccagtccaccattcccgagaccgttctggagctcaccgacgccttggcgctgggcatgatggtgctcaagatcgtccgcaacatggagaagtaccagctagccgtgacgataatggcgatcctatgcgttccgaacgcggtgatcctccagaacgcatggaaggtgtcctgcactatcctggctgttgtatccgtgagccccctgcttctgacctccagccagcagaagaccgactggatccccctggccctcacgattaaggggctgaaccccacagccatcttcctgaccaccctctcgcgcacgaataagaagcgaagctggccgctgaacgaggccatcatggcggtcggtatggtgtccatcctggccagctccctcctgaagaatgacatccccatgacgggacctctggtggccgggggtctcctgaccgtctgctacgtgctgaccgggcgcagcgcggacctcgagctggagcgggccactgatgtgaagtgggaggaccaggcggagatctccggcagctcacctatcctgtccatcaccatcagcgaggacgggtccatgtcgatcaagaacgaggaggaggagcagaccctcaccattctgatccgcaccgggctgctcgtcatcagcggcctgttcccgataagcatccccatcacggccgctgcctggtacctgtgggaggtgaagaagcagcgggcaggggtgctctgggacgtccccagcccgccccccatgggcaaggcggagttagaggacggggcctaccgcatcaaacagaagggcatcctggggtatagccaaatcggcgccggcgtttacaaagaagggaccttccacaccatgtggcacgtgacccggggtgccgtcctcatgcacaaggggaagaggatcgagccgtcctgggccgacgttaagaaggacctgatatcatatggcgggggctggaagctggagggcgaatggaaggagggggaagaggttcaggtcctcgcgctggagcccgggaagaacccccgggcggtgcagacgaagcccggcctgtttaagaccaacaccggtaccatcggagcagtttccctcgacttcagccccggcacgtccgggagccccatcatcgataagaagggtaaggtcgtgggcctgtacgggaatggcgtggttacccgctccggcgcttacgttagcgcgatcgcgcagacggagaagtccattgaggacaaccccgagatcgaggacgacatcttccggaagcgccggctgaccatcatggacttacaccccggcgccggcaagactaagcgctaccttcccgccatcgtgcgggaagccatcaaacgcgggttacggaccctcatccttgcgccgacccgcgtcgtggccgccgagatggaggaggcccttcggggactgcccatccgctatcagacgcctgccatccgagccgaacatacggggcgtgagatcgttgacctcatgtgccacgctacttttaccatgcgccttctgagccccgtacgggtgcccaactacaacctcataatcatggacgaagcccacttcacggaccccgcatcgatcgccgcccgcggctacatcagcacccgggtcgagatgggcgaggccgccgggatctttatgaccgctacgccacctggatcacgcgacccgttcccccagtccaacgcacccatcattgacgaggagcgggagatacccgaacgcagctggaactccgggcacgaatgggtcaccgattttaagggcaagaccgtgtggttcgtaccaagcatcaaggcgggcaacgatatcgctgcgtgcctccgaaagaacggcaagaaggtcatccagctgtcccgcaagacgttcgatagcgaatacgtcaagacccggaccaatgactgggatttcgtggtcacgaccgacatcagcgaaatgggcgccaactttaaagcagagcgcgtgatcgatccccggcgttgcatgaaacccgtgatcctcaccgacggggaagaaagggtaatccttgccggacccatgccggtgacccacagctcagcggcccaacgccgggggcgcatcggcagaaaccccaagaacgagaacgaccagtacatctacatgggggagcccctggagaacgacgaggactgtgcccactggaaagaagccaagatgcttctggacaacatcaacacgcccgaaggcatcataccgagcatgttcgagcccgagcgcgagaaggtggacgccatcgacggcgagtaccggctgcgcggggaggcccggaagacctttgtcgacctcatgcggcgcggcgacctgcccgtgtggctggcttacaaggtggccgcggagggtatcaactacgccgaccggcgctggtgcttcgatggcataaagaacaaccagatcctcgaggagaacgtcgaagtggagatttggaccaaggaaggggagaggaagaagctgaagccacgctggctagacgcccggatctattccgacccactcgccctgaaggagttcaaggagtttgcagcgggccgaaagtcgttaaccctcaacctgatcacggagatgggccggttacccaccttcatgacccagaagacccgcgacgccctcgacaacttagccgtcctgcacactgccgaagccggcgggcgggcttacaaccacgccctctccgagctgcccgagaccttagagaccctcttgttactcacactactggcgacagtgaccgggggtatcttcctcttcctaatgtcaggtcgcgggatcggcaagatgacactggggatgtgctgcatcatcaccgcttccattctcctgtggtacgcccagatccagccgcactggatcgccgccagcatcatccttgagttcttcctcatcgtgctgctgatccccgagcccgagaaacagcgtaccccccaggacaaccaactcacgtacgtcgtgatcgcgatccttaccgtggtcgccgcgaccatggccaacgagatgggctttctggagaagaccaagaaggacttaggactgggctcaatcgccacgcagcaaccggagtcaaacatactggacatcgatctaaggcccgcgtccgcctggaccctgtacgcggtggccaccaccttcgtgactcctatgctgcggcacagtatagagaacagctccgtcaatgtcagcctcaccgccatcgcgaaccaggccaccgtcctgatgggcctagggaaaggttggcccctctcaaaaatggacatcggggtcccgctgctggcgatcggatgctacagccaggtgaatccgatcacactcacggccgccctgctactcctggtggcccattatgcgattatcgggcccggcttacaggctaaggcaacccgcgaggcccagaagagagccgccgccggcatcatgaagaaccccacagtagacgggattactgtaatcgacctcgacccgatcccctacgaccccaagttcgagaaacagcttggccaggtgatgcttctcatcctgtgcgtgacccaggtgttaatgatgcgcaccacctgggccctctgcgaggcgctaaccttggctacggggcccatatccaccttgtgggagggcaatcctggccggttctggaataccacaatcgcggtgagtatggccaatatattccgcggctcctacttagcaggcgccgggttactcttcagcatcatgaagaacacgacgaacacacggcggggcaccggtaacataggggaaacgctgggcgagaagtggaagaaccgcctcaacgccctcgggaagtccgagttccagatttacaagaagtccggcatccaggaagtcgacagaacgctcgcgaaggaggggatcaagcgcggcgagaccgaccaccacgccgtctcacgtgggagtgccaagctacgttggttcgtggagcggaacatggtcacccccgagggcaaggtggtggacctcggctgcgggcgcggcgggtggtcctattactgcggaggactgaagaacgtacgggaagtgaagggcctgacgaagggcggtcccggccacgaggagcccatcccgatgagcacctacggctggaacctcgtgcgcctgcagtcgggcgtcgacgtgtttttcatcccgcccgagaagtgcgacaccctgctgtgcgacatcggagagagctcccccaacccgaccgttgaggcaggccggacgctgcgcgtcctgaacctcgtggagaactggttaaacaacaacacccagttctgcatcaaggtgcttaacccttatatgcccagcgttatagagaagatggaggcgctgcaacggaagtatggcggagccctcgtgcgcaacccgctgtcccggaatagcacccacgagatgtattgggtgtcaaacgcgtccggcaacattgtcagcagtgtgaacatgatcagccgtatgctgatcaaccggttcaccatgaggcacaagaaggccacttacgaacccgacgtggatctcggatcgggcacgcggaacatcggaatcgagtctgagatcccaaacctggacatcatcggcaagcgcatcgagaagatcaaggaggaacatgagactagctggcactacgaccaggaccatccctacaagacctgggcttatcacggaagctatgaaaccaaacagacggggagtgcatcgtccatggtcaatggggtagtacggctgctcaccaagccgtgggacgtcctgcctaccgtgacccagatggccatgacggataccacgcccttcgggcagcagagagtgttcaaggagaaagtcgacacccgcacgcaggagcctaaggaggggactaagaagctgatgaagatcaccgccgagtggctctggaaggagctgggcaagaaaaagacgccgcggatgtgcacgcgcgaggaattcacccgaaaggtgcgaagcaacgctgccctgggtgcgatctttaccgacgagaacaagtggaagtccgcccgggaggccgtggaggacagccgcttctgggagctcgtagacaaggaacggaatctacacttggagggcaagtgcgagacctgtgtgtacaacatgatggggaagcgcgagaagaagctcggcgagttcgggaaggccaagggcagtagggccatctggtacatgtggctgggcgcgcgctttctggagttcgaggccctcgggttcctaaacgaggaccactggttcagccgcgagaactccctgagcggcgtggagggcgagggcctccacaagctgggatacatcctgcgcgatgtttccaagaaagagggcggcgccatgtacgccgacgatacggctgggtgggacacccggatcacgctcgaggacctgaagaatgaggagatggtgaccaaccacatggagggcgagcacaagaagctggccgaggccatcttcaagctcacgtaccagaacaaggtggtgcgcgtgcagagaccaacacccagggggacagtgatggacatcatcagccggcgcgaccagcgaggcagcggtcaggtgggaacctacgggctgaacaccttcaccaacatggaggctcagctgattcgccagatggaaggagagggcgtgttcaagaacatccagcatctcaccgtgactgaggaggccgcggtgcagaactggctggcccgggtggggcgcgagcgcctgagtcggatggcaatcagcggcgacgactgcgtcgtaaagcccctcgacgatcgcttcgccaacgctctgacggcgctgaacgatatgggcaagatccggaaggacatccagcagtgggagccgtccaagggatggaacgactggacccaggtacccttctgctctcaccacttccacgagttaataatgaaggacggcagagttctcgtggtgccctgccggaaccaggatgagctgatcgggagagccaggatttcccagggcgccggatggagtctccgcgaaaccgcctgcctgggcaagagctacgcccagatgtggagcttgatgtacttccaccggcgcgacctccggctagcggccaacgccatctgctccgccgtccccagccactgggttccgacctcccgcacgacctggagcatccacgccaagcacgagtggatgaccaccgaagacatgctgacagtgtggaaccgggtctggatccgggaaaacccctggatggaagacaagacccccgtggagtcctgggaggagatcccctacctcggaaagcgggaggatcagtggtgcgggagccttatcggcttgacctcccgcgcgacctgggcaaagaacatccaggcagccattaaccaggtacgtagcctcatcgggaacgaggaatacaccgactacatgccgtccatgaagcgctttcggagggaggaggaggaggcgggcgtcctgtggtga

SEQ ID NO: 24960 - RNA, 9876 nt, synthetic construct
  misc_feature 1..9876: note = derived and/or modified CDS sequence (opt11) from DENV-2__GQ199892__SS-prME
  source 1..9876: mol_type = other RNA
accgccggggtgatcgtgatgttgatccccacggcgatggcgtttcacctgaccacgaggaatggggagccccacatgatagtgggccgacaggagaaggggaagtccctgctgttcaagaccgaggacggcgtgaatatgtgcaccctcatggccatcgacttaggggagctctgcgaggacaccattacgtacaagtgccccctcctacgccagaacgaacccgaggacatcgactgctggtgcaacagcacctccacctgggtcacctacggaacctgcaccaccacgggtgagcaccggcgcgagaaacggagtgtggctctggttccccacgtcgggatgggtctcgagacccggaccgagacctggatgtcttcggagggggcctggaaacatgtccagcgaatagagacatggatccttcgccacccggggttcacaatcatggccgcgatcttggcctacaccatcgggaccacgcattttcagcgggccctcatctttatcctgctgacagccgttgcgccctcgatgaccatgagatgcatcggcatcagtaatcgcgattttgtggaaggggtatctgggggatcctgggtggatatcgtgctagagcacgggtcttgcgtaaccacgatggccaagaacaaacccaccctagattttgagctgatcaagaccgaggccaagcagcccgcaaccctccgcaagtactgcatcgaggccaagctgacgaacacaaccaccgagtcccggtgcccgacgcagggcgagccctccctgaacgaggagcaggacaagcgctttatctgcaagcactcgatggtggaccggggctgggggaacggctgcgggctgtttgggaagggagggatcgttacttgcgcgatgtttacgtgcaaaaagaatatggagggtaagatcgtgcagcccgagaacctggagtacaccatcgtgataacgcctcacagcggggaggaacatgccgtgggtaacgataccggtaagcatgggaaggagataaagatcacaccccagtccagcaccaccgaggctgaactgacggggtacggcaccgttaccatggagtgcagcccccggacagggttagattttaacgagatggtgctgctgcagatggaagataaagcgtggctcgtccaccgtcagtggttcctggacctgccgctcccctggctgcccggggccgacacgcaggggagcaactggatccaaaaggagaccctggtgacctttaaaaatccccacgcgaaaaagcaggacgtcgtcgttctcgggtcacaggagggcgcgatgcacactgccctgacgggtgccacagagattcagatgtcgtcgggcaacctcctgtttactgggcacttaaagtgccgcctccggatggacaaactccagttgaaaggcatgtcgtacagcatgtgcaccggcaaattcaaaatcgttaaggaaattgccgagacccagcacggtaccatcgtgattcgcgtgcagtacgagggagacggcgcgccctgcaagatccccttcgagatcactgaccttgaaaagcggcacgttctcgggcgactgatcacggtcaacccgatcgtgacggagaaggactccccggtcaatatagaggccgagccgccgttcggcgatagttacatcatcgtgggagtggaacctggccagctgaagctcaactggtttaagaagggttcctcaatcggccagatgttcgaaacgaccatgcgcggcgccaaaaggatggccatcctgggggacaccgcttgggacttcggcagcctcggcggcgtcttcacgagtatcgggaaggctctccatcaggtcttcggggccatttacggcgccgccttctccggggtgagctggaccatgaaaatcctgataggcgtcattattacctggatcgggatgaactcacgaagcacgtcgctgagcgtgtctctggtgctcgtcggcgtagtgaccctgtacctgggggccatggtccaagcggatagcggctgcatagtgtcatggaagaataaggagctcaaatgtggcagcgggatattcataaccgacaacgtgcatacatggaccgagcaatacaagttccagccggaatcaccctcaaagctggccagcgcgatccagaaggcccatgaagagggtatatgcggaatccggtccgtcacccgcctggagaacctcatgtggaaacagatcactccggagttgaaccatatactgtcggagaacgaggtgaagctcacaatcatgaccggagacatcaagggtatcatgcaggcgggcaagcgatccctgcgcccccagcccacggaactgaaatactcctggaagacatggggcaaggcaaagatgctctccaccgaaagtcacaaccagacttttctgatcgacgggcccgagacggctgagtgtccgaacacaaaccgggcctggaactccctggaggtggaagattacggattcggggttttcagcactaacatttggctcaagctgcgcgagaaacaggacgttttctgcgactccaagctgatgtccgccgcgatcaaggacaaccgggccgttcacgcagacatgggctactggatcgagtccgccctcaatgatacctggaagatggagaaggcctccttcatcgaggtcaagtcctgccattggcccaagtctcataccctttggtccaacggcgtactcgagagcgagatgattattcctaagaacttcgcgggccccgtgagccagcacaattaccgacccggctaccacacgcagacggcgggtccctggcacctcggcaaactggagatggacttcgacttctgcgaggggaccaccgtcgtggttacagaggactgcggcaaccgggggcccagcctgaggacgaccaccgccagcggtaaactcataacggaatggtgttgccgctcatgcaccctgcccccgctgagataccggggcgaagacggttgctggtatggcatggagattcgcccactcaaggagaaggaggaaaatttggtcaactcgttagttacggcagggcacggtcagattgacaacttctccctcggcatcctcgggatggcgctgtttttagaagagatgctgagaactcgcgtgggcacgaagcatgccatcctcctcgtcgccctgagcttcgttaccttaatcaccggaaacatgtccttccgggacctcggccgcgtcatggtaatggtcggggccaccatgaccgacgacatcggcatgggcgtgacctacctggccctgctcgcggcattcaaagtgcgccccacctttgccgcggggctgctgttacggaagttgaccagcaaggaactaatgatggccacgatcggaatcgccctcctgtcccagagcacattgcccgagaccatcctcgagctgactgacgctctggcccttggaatgatggccctgaagatcgtgcgcaacatggagaagtatcagctggccgtaacgatcatggccatatcctgcgtccccaacgccgtgatcctgcagaacgcctggaaagttagctgcacaatattagcggcggtctccgtaagccccctgctcctgaccagttcgcaacagaaggccgattggatccccctggcactcacaataaaggggttgaacccaacggcgatctttctgaccaccctctcccgtactagcaagaagcgaagttggccgctgaacgaggcgattatggcagtcggcatggtgagcatcctggcctccagcctcttgaagaacgacatccccatgactgggcccttagtggccggcgggctcctaaccgtgtgctacgtgctgaccggccggtcggccgacctcgagctggaacgcgccgcggatgtgaaatgggaggaccaggccgaaatctccgggtcttcccccatactgagcatcacaatctccgaggacggcagcatgtccatcaagaatgaggaggaagaacaaacgctgaccatcctaatccgcaccgggctgctagttatcagcggggttttcccggtgtccatccccatcaccgccgccgcctggtatctgtgggaggtcaaaaagcagcgcgcgggagtcctgtgggacgtgcccagtccaccgcccgtcggtaaggccgagctcgaagacggagcataccggatcaagcagcgcgggatcctgggctactcccaaattggagccggagtgtataaggagggcaccttccatacgatgtggcacgtgacccgcggggctgtcctcatgcacaggggtaagcggatagagcctagctgggcggacgtcaagaaagatctcatctcctatgggggcggctggaagctggaaggagagtggaaggaaggggaggaggtgcaagtcctggcgctggagcctggcaagaatccacgcgccgttcagacgaagccaggaatattcaaaacaaacacggggaccatcggcgcggtgagtctggacttttcccctggtactagcgggtccccgatcgtcgaccgaaaaggaaaagtggtcgggctctacggcaacggcgtcgtgacccgctcaggggcgtacgtgtccgccatcgcccagaccgaaaagagcatcgaagacaaccccgagatcgaggatgatatcttccggaaaaagcgcctcaccatcatggacctgcaccctggcgccggtaagaccaagcggtacctccccgctatcgtccgcgaggccatcaagcggggcctgaggaccctcatattagcgccgacgcgcgtggtggccgcagagatggaggaggccctgcgggggctcccgatccgctaccaaacccccgctatccgcgcggagcacaccggccgcgagattgtcgacctgatgtgccacgctaccttcactatgcggctgctgtcacccgtacgcgtgccgaactacaatctgatcatcatggacgaagcccacttcaccgaccccgcttccatcgcggccaggggctacatctcgacacgtgtggagatgggcgaggccgctggcatcttcatgacagcgacgcctcctgggtcccgtgacccgttcccacagtcgaatgcccctattatggacgaggagagagagatccccgagcggtcctggaacagcggccatgagtgggtgaccgactttaaggggaaaacggtgtggttcgtcccgtctatcaaggccggcaatgacatcgccgcgtgcctgcgcaagaacggcaagaaagtgatccagttgagccggaaaaccttcgacagcgagtacgtgaagacgcgcgcgaacgactgggacttcgtcgtgaccaccgacattagtgaaatgggagccaacttcaaggccgagcgggtaatcgatcccagacggtgcatgaagcccgttatcctgaccgacggcgaggagcgcgtgatcctggccgggcccatgccagtgacgcattcctccgccgcgcagcggcgcggccgaatagggcggaatcctaaaaatgagaacgatcaatacatttacatgggcgaacccctcgaaaacgacgaggactgcgcacactggaaggaagccaagatgctgctcgacaacatcaacacccccgagggaatcatcccgtccatgttcgagcccgagcgcgaaaaggtagacgccattgacggagagtaccgtctccgcggcgaagcccggaagaccttcgtggacctgatgcgccgcggtgacctgcccgtgtggcttgcgtacaaggtagccgcggagggcatcaattatgccgatcggaagtggtgcttcgacgggatcaagaacaaccagatcctggaggagaatgttgaggtcgagatctggaccaaggagggagagcggaagaaactaaagccgcggtggttagacgcgcggatctactctgacccgttggccctcaaagagttcaaggagttcgccgccggtcgaaagtccctcacgttgaatttgatcaccgagatgggccggctccccacctttatgacccaaaaggcgcgcaacgccctggacaaccttgctgtcttgcacacggccgaggtgggcggaagggcctatacccacgccctgagcgagctgcccgagaccctcgagaccttgctgctcctgactctgctcgcgaccgtaaccggcgggattttcttatttctaatgagtggtaagggcatcggcaaaatgaccctcggcatgtgctgcatcatcaccgccagcattttgctgtggtacgcccagatacagccgcattggatagccgcctccatcatcctcgagttctttctgatagtgttgctcatccccgagccagagaagcagcgcacgccccaggacaaccagttgacctacgtggtaatcgcgattttgactgtggtggccgctaccatggccaacgagatggggtttctcgagaaaacgaagaaggacctgggctttggaagcataacgacgcaggagagcgagtcgaacatcctggacatcgacctccggccggccagcgcgtggacgctctacgccgtggccacgactttcgtcacccctatgctgcgtcactccattgaaaattctagtgtgaatgtttcacttaccgcaatcgcgaaccaagctaccgtgttgatggggctgggaaaggggtggcccttatctaaaatggacatcggggtaccgctgctggcgatcgggtgctatagccaggtcaatccaatcacactaaccgcggccctcttactccttgtggcgcactacgcgatcatcggtcccggcctgcaagccaaggccacaagggaagcgcagaaaagagctgcggccgggatcatgaaaaaccccacggtggacggcatcaccgtcatcgacttagagcccatcccgtacgaccccaagttcgaaaaacaactgggtcaggtcatgttgctcatcctatgcgtaacccaagtcttaatgatgcgcaccacctgggccctatgcgaggctttaacgctggcgaccggccccatctccactttgtgggagggtaaccctggccgcttctggaacactaccatcgccgtgtctatggccaatatcttccgtgggtcctacctggccggtgcgggcctccttttcagcatcatgaaaaacaccaccaatacccggcgcgggacaggcaacgtgggcgagacactgggggagaagtggaagtccaggctgaacgcccttggcaagagcgagttccaaatctacaagaaatccggcatccaggaggtcgatcgcaccctggccaaagagggaatcaagcgcggggagaccgaccaccacgccgttagccgcgggtccgccaagctgcgatggtttgttgagcgcaacatggtcaccccagagggcaaggtggtggacctcggatgcggccgcgggggctggagctactactgcgggggcctgaagaacgtccgggaggtcaaaggcctgaccaaaggtgggcccgggcatgaggagcccatccccatgtccacctatggctggaacctcgtgcggctgcagagcggggtagacgtcttcttcacgccacccgagaagtgcgataccctgctctgcgacataggggaaagctccccaaaccccaccatcgaggccggcaggaccctgcgcgtactgaatctcgtcgaaaactggctgaataacaacacccagttctgtataaaggtattaaacccatacatgcccagtgttatcgagaagatggagaccttacagcgcaaatacggtggcgccctcgtgcggaatccgctgtcacgcaactccacacacgagatgtactgggtttcaaatgcgacggggaacatcgtgagctccgttaacatgatcagcagaatgctaattaacagatttactatgaaacataagaaggccacatacgaaccggacgtggacctcggatccgggacccggaacatcggcatcgagagcgagatccccaacctggacataatcgggaagcggatcgagaagatcaagcaggagcacgaaacctcctggcattacgaccaggaccacccgtacaaaacatgggcataccacgggtcttacgaaactaagcagaccggctccgcgagcagcatggtgaacggggtggtgcgcctgctcaccaagccctgggacgtagtcccgatggtaacgcagatggccatgacggacaccaccccctttggacagcagcgagtattcaaggagaaggtcgacacccgcacgcaggagcccaaagagggaacgaagaaactgatgaagatcaccgcggaatggctttggaaggagctcgggaaggagaagactccccggatgtgcacgcgcgaggagttcacccggaaagtgcgaagcaacgcagccttaggcgcaattttcaccgacgagaacaaatggaagtccgcccgggaggccgtggaggatggccgcttctgggagctggtagatcgagaacgcaacctccacctggaaggtaagtgcgaaacctgtgtgtacaacatgatggggaagcgcgagaagaagctgggcgagtttggcaaggccaaggggtcacgcgcaatctggtacatgtggctaggcgccagattcctggagtttgaggccctgggcttccttaacgaggaccattggttctcccgcggcaattcactcagcggggtggagggcgaagggctacaccggctcggttacatcctgcgcgaggtcggtaagaaggaaggaggcgccatgtacgccgacgacacggctgggtgggacactcggatcacccttgaggacctcaagaacgaagagatggtgacgaatcacatgaagggcgagcacaagaaattagccgaggcaatattcaagctgacgtaccaaaacaaagtcgtgcgcgtgcagcgcccgacgccgcggggcaccgtcatggatataatttccagaaaggaccagcgaggaagcggacaggtaggtacctacggcctcaacacgttcaccaacatggaggcccaactgatccgtcagatggagggcgaggggatcttcaagtccatacagcacctgaccgccaccgaagagatagcggtgcagaactggctcgccagggttgggcgcgagaggctgtctcgcatggcaatatccggtgatgactgcgtggtgaagcccattgacgaccggtttgccagcgcactgactgcgctcaacgatatgggcaaggtacgcaaggacatccagcagtgggagccctccagggggtggaacgactggacacaggtgcctttttgctcacaccattttcacgagctcgtgatgaaagacggccgcgtcctcgtcgtgccctgccggaaccaggacgagctcatcgggcgcgcccgaatctcccaaggcgccggctggagcctgaaggaaaccgcctgcttagggaaaagttacgcccagatgtggaccctcatgtacttccaccgcagagacctgcgtctcgctgctaacgccatctgctctgcagtcccatcccactgggtgccgacatcccgtacgacctggtctatccacgcgaagcacgaatggatgaccaccgaagacatgctcgccgtgtggaatcgcgtctggatccaagagaacccgtggatggaagacaagactcctgtagagtcttgggaagaggtcccgtatctggggaagagagaagatcagtggtgcggctctctaatcggtctcacctcgcgtgcgacctgggccaaaaatatacagaccgcgattaatcaggtccggagcctgataggcaacgaagggtatacggactatatgccctccatgaagcggtttcgccgggaggaagaggaggcgggcgtgttgtggtga

SEQ ID NO: 24961 - RNA, 9876 nt, synthetic construct
  misc_feature 1..9876: note = derived and/or modified CDS sequence (opt11) from DENV-2__JF730044__SS-prME
  source 1..9876: mol_type = other RNA
accgccggggtgatcatcatgctcatccctaccgccatggcgttccacctcaccacccgcaacggtgagcctcacatgatagtcggccggcaggagaagggcaagagtctgctgttcaagaccgaggacggtgtgaacatgtgcacattaatggccatcgacctgggggagctgtgcgaggacaccatcacttacaagtgcccactcctgcgccagaacgagcccgaggatattgactgctggtgtaacagcacaagcacctgggtgacctacgggacctgcaccaccacgggcgaacaccggcgcgagaagcggagtgtcgctctggtgccccacgttgggatgggcctcgagacccgtaccgagacctggatgagcagcgagggggcatggaagcatgtccagcggattgagacgtggatcctgcgccatcccggcttcaccatcatggcagcgatcctagcttacaccatcggtaccacgcacttccagcgggccctcatcttcatccttctaaccgccgttgcacccagcatgactatgcgctgcatcggcatctccaaccgggacttcgtggagggggtcagcggcgggtcctgggtcgacattgtgctcgagcacgggagctgcgtcactacgatggccaaaaacaagcccaccctggatttcgagctgattaagaccgaggcaaaggagcccgctaccctccgcaagtactgcatcgaggccaagctgacgaacaccaccaccgagtccagatgcccgacgcagggcgagcccagcctgaacgaggagcaggacaagcgcttcgtgtgcaagcactccatggtggaccggggatgggggaacggctgcgggctgttcggcaagggcgggatcgtgacctgcgcgatgtttacgtgcaagaagaacatggagggcaagatcgtgcagcccgagaacctagaatacaccatcgtgatcacgccccacagcggggaagagcacgccgtcggcaatgacaccgggaaacacggcaaggagatcaagatcaccccgcaatcctcatccaccgaggccgagctgaccgggtacggcacggtgaccatggaatgcagcccccgcaccggcctcgacttcaacgagatggtgctgctgcagatggaggataaagcatggctcgtccaccggcagtggtttttagacctccctctcccctggctgccgggggccgacacgcagggctccaattggatccagaaggagacgctggtaaccttcaaaaacccccacgcgaagaagcaggacgtggtcgtactggggagccaggagggcgccatgcacaccgcgctgaccggggccacggagatccaaatgagctccgggaacctcctcttcactggccacctgaagtgccgcctgcggatggacaagctccagctgaaggggatgagctactccatgtgcaccggaaagttcaagattgtcaaggagatcgccgaaacccagcacgggacgatcgtgattcgcgtgcagtacgagggcgacggctcgccctgcaagatcccattcgagatcatggacctggagaagcgacacgtcctagggcgcctgatcaccgttaacccgatcgtcaccgaaaaggacagtcctgttaacatcgaggcggagccgcccttcggcgacagctatatcatcatcggggtggagccgggccagctgaagctcaactggttcaagaaggggtccagcatcggccagatgttcgagaccacgatgcgcggagccaagcgcatggccatcctgggggacactgcatgggacttcggctccctcggcggggtgttcaccagcatggggaaggccctccaccaggttttcggggcgatatacggcgcagccttctccggggtgagctggaccatgaagattctgatcggcgtaatcattacgtggatcgggatgaactcccgctccacctccctgagcgtctccctggtgcttgtgggcgtcatcaccctgtacctgggggccatggtacaggcggacagcggctgcgtggtctcctggaagaacaaggagctcaagtgcggcagcgggatcttcataaccgacaacgtgcatacgtggacggagcagtacaagttccagcccgagagcccctccaagctggcgtcggccatccagaaagcccatgaagagggcatctgcgggatccggtccgtaacccggttggagaacctaatgtggaagcagatcacccccgagctgaaccacatcttaagcgagaacgaagtcaagctcacgatcatgaccggcgacatcaaggggatcatgcaggccgggaagcggtccctgcgccctcagcccaccgagctgaagtatagctggaagacctggggcaaggcgaagatgctctccacggaatcccacaaccagaccttcttgatcgatgggcccgagactgccgagtgcccgaacaccaaccgggcctggaactccctggaggtggaggactacggcttcggggtgttcacgaccaacatctggctcaagctgcgcgaaaaacaggacgtcttctgcgactccaagctgatgtccgccgccatcaaggataaccgggcggtgcatgccgacatggggtactggatcgagagcgctctcaacgacacctggaagatggagaaggcctccttcatcgaggtcaaaagctgccactggcccaagtcacacactctgtggagcaacggcgtgctggaatcggagatgatcatccccaagtccttcgccgggccggtaagccagcacaattaccgcccgggctactacacccagacggcggggccctggcacctcggaaagttggagatggacttcgacttctgcgaagggaccaccgtggtagtgaccgaggactgcggcaaccggggcccctccttgcgcacaaccactgccagcggtaagttgattacggagtggtgctgcagatcctgcacgctgcccccgctgaggtacagaggcgaggacgggtgctggtacggcatggaaatccgccccctcaaagagaaggaggagaacctggtcaacagcctggtgaccgccgggcacggccagatcgacaacttctccctcggcgttctggggatggcccttttcctcgaggagatgctgcggacccgcgtgggaaccaaacatgcgatcctgctcgtcgccgtgagcttcgtgacgctgattaccggtaacatgtccttccgggacttaggccgcgtaatggtgatggtcggagccaccatgaccgacgacattggcatgggggtcacgtacttggccctgctggccgcgttcaaggtgcgccccaccttcgccgccgggctcctgctgaggaagctcactagcaaggaactgatgatggccaccatcggtatcgcccttctctcccagagcacgattcccgagaccatccttgagctgaccgacgcgctcgccctggggatgatggtgctgaagatcgtgcgcaacatggagaagtaccagctcgccgtgaccatcatggcgatctcttgcgttccgaacgctgtcatcctgcagaatgcgtggaaggtgtcctgcacgatcctggccgccgtgtccgtcagccccttactgctgacgtccagccagcagaaggccgactggatccccctcgcgctgaccatcaagggcctgaacccgaccgccatcttcctcacgaccctgtcgcggacgtccaagaagcgctcctggccgctgaacgaggccatcatggccgtcgggatggtcagcatcctagccagctccttgctgaagaacgacatcccaatgacggggcccctcgtggctggcgggctgctgactgtgtgttatgtcctcaccggccgtagcgccgacttagagctggagcgcgccaccgacgtgaaatgggaggatcaggcggagatctccgggagctcccccatcctcagcatcaccatcagcgaagacggcagcatgtccattaagaacgaggaggaggagcagacgctgaccatcctgatccggaccggactcctggtgatctccggactgttccctgtctcaatccccatcaccgccgctgcctggtatctctgggaggtgaagaagcagcgcgccggcgtactgtgggacgtccccagccccccgcccgtggggaaggccgagctggaggacggcgcctaccggatcaaacagaaggggatcctcggctactcccaaatcggcgcgggggtgtataaggagggcaccttccacacgatgtggcacgtcactcgcggggccgtgctgatgcaccggggcaaacgcatcgagccctcgtgggccgacgtgaagaaggatctgatcagctacgggggcggctggaaactcgagggtgagtggaaggagggcgaggaggtccaggtcctggccctggagcccgggaagaacccccgggccgtgcagaccaagcccggcctcttcaagaccaacacggggaccattggcgcggtctccctggacttctcccccggcaccagcggttcccccatcgtggacaggaaaggtaaggtggtcgggctgtacggtaacggcgtggtgacccggagcggagcctacgtatcagccatagcccagacggaaaagtccattgaggataaccccgagattgaggacgacattttccgcaagaagcggctcaccatcatggacctgcaccctggcgcggggaaaaccaagcgctacctgcccgccatcgtgcgtgaggccatcaagcgaggcttgcggaccctcatcctggcgccgacacgcgttgtcgccgcagagatggaggaagcgctccgcggactccccatccggtaccagacccccgccattagggctgagcacaccggccgggagatcgtggaccttatgtgccatgccaccttcacgatgcgcctgctctcacccgtgcgggtcccgaattacaatctgatcattatggacgaggcgcactttaccgaccccgcctccatcgccgcccgcggctacatcagcaccagggtagagatgggggaagcagcgggcatcttcatgaccgccacgcctcccgggtcccgcgacccgttccctcagagcaacgctcccatcatggacgaagagagggagatccccgaacgctcctggaacagcggccacgagtgggtgaccgacttcaaggggaaaaccgtctggttcgtgccgtccatcaaagcgggcaacgatattgcggcctgcctgcggaagaacggaaagaaggtgatccagctctcgcgcaagacgttcgactccgaatatgtcaagacgcggaccaacgattgggacttcgtggtgactaccgacattagcgagatgggcgccaacttcaaggccgagcgcgttatcgacccccggcgctgcatgaagcccgtgatcttaacggatggcgaggaacgagtgatcctggccgggccaatgccggtcacccactccagcgctgctcagcgccggggccgcatcgggaggaacccaaaaaacgagaacgaccagtacatctacatgggcgagcccctcgagaacgacgaagactgcgcccactggaaggaggccaagatgctgctggacaacatcaacacaccagagggcatcatcccgtccatgttcgagcccgagcgggaaaaggtggatgctatcgacggggagtaccgcctccggggcgaagcgcgaaagaccttcgttgacctaatgcggcgaggggacctgcccgtctggctcgcctacagagtggccgccgagggtataaactacgccgaccgccggtggtgtttcgacggggtgaagaacaaccagatcctggaggagaacgtcgaggtggagatctggacgaaggagggcgagcgcaagaagctgaagccgcggtggctggacgcgcgcatctacagcgaccccctggccctgaaggagttcaaggagttcgcagccggccggaagtccctcaccctgaacctgatcactgagatggggcgcctccccaccttcatgacgcaaaaggctcgggacgcccttgataacttagccgtcctccacactgccgaggccggcggccgcgcgtacaaccacgccctgagcgagctgcccgagaccctcgagaccctgctgcttctgacgcttctcgccactgttaccggcggtatcttcctgttccttatgagtgggaagggcgtgggaaagatgactctcgggatgtgctgcatcatcaccgccagcatcctgctgtggtacgcccaaatccagccgcactggattgcggcctctatcatcctcgagttcttcctgatcgtactgctcatccccgagcccgagaagcagcggactccccaggacaaccagttaacatacgtggtgatcgccatactgaccgtcgtagccgccaccatggcgaatgaaatggggttcctggagaagacgaagaaggacctgggactcggctccatcgcaacccaggagccggagagcaacatcctcgacatcgacctgcgccccgcctccgcctggaccttgtacgccgtggcgaccacgttcgtgacccccatgctccggcacagcatcgagaactcttctgtgaacgtgtctctgaccgccatcgccaaccaagccaccgtcctgatggggctcggcaagggttggcccctgtcaaagatggacattggcgtgccgctgctcgcgatcggttgctactcccaggtgaaccccgtcactctgaccgccgccctgctccttctggtagcccactacgccatcatcggccccggtctccaggcgaaggccaccagagaggcccagaagcgggcagccgcggggatcatgaagaaccccaccgtggacggcatcacggttatcgacctggacccgatcccctacgaccccaaattcgagaagcagctggggcaggtcatgttactgattctgtgcgttacccaggtcctcatgatgaggacgacctgggccttgtgcgaggccttaacgctcgccaccggccccattagcaccctgtgggaggggaacccgggccgcttctggaacaccactatcgccgtgtccatggctaacatcttccggggttcgtacctggccggggccggcctactgttctccatcatgaagaacacaacgaacaccaggcgggggacgggcaacatcggcgagaccctgggggagaagtggaagtcccgcctcaatgccctgggcaagtcagagttccagatctacaagaagtccggcatccaggaggtggaccggaccctggcgaaggagggcatcaagcgcggggagaccgaccaccacgcggtctcccggggaagcgcaaagctaaggtggttcgtggaacggaacatggtgacccccgagggcaaggtcgtggacctggggtgcggccgcggaggctggtcctactactgcgggggcctgaagaacgtgaaagaggttaagggcctcaccaagggcgggcccgggcacgaggagccgatcccgatgtcaacttacggctggaaccttgtgagactgcagagcggggtggacgtgttttttactccacccgagaagtgcgacactctcttgtgcgacatcggcgagtccagccccaatccgaccatcgaggcaggccgcactctgcgggtgctctccctggtggagaactggctgaacaacgacacccagttctgcataaaggtcctcaatccctacatgcccagcgtgatcgaaaagatggagaccctgcagcgcaagtacgggggtgccctggtgcggaacccgctgtccagaaacagcacgcacgagatgtactgggtctctaacgccaccgggaacatcgtgagctccgtgaacatgatcagccggatgctgatcaaccgcttcaccatgaagcacaagaaggccacctacgagcctgacgtcgatctgggatccgggactcgaaacataggcatcgagagcgagatccccaacctggatatcatcggcaagcgcatcgagaaaatcaagcaggagcacgagacgtcgtggcactacgaccaggaccacccctataagacctgggcctaccacgggagctacgagaccaagcagacgggctccgccagctccatggtgaatggggtggtccgcctcctcaccaagccgtgggatgtggtgcccatggttacccagatggcaatgaccgacacgacccccttcggccagcagcgggtattcaaggagaaggtggacactcgcacgcaggagcccaaggaaggtaccaagaagctgatgaagatcaccgcggagtggctctggaaggaactggggaagaagaagacgcctagaatgtgcacccgcgaagagttcacgcggaaggtccgcagcaacgccgctctgggcgcgatcttcaccgatgagaacaagtggaaatccgcccgggaggcggtggaggacagccgcttctgggagctcgtagacaaggagcggaacctgcacctggaggggaagtgcgagacctgtgtctacaatatgatgggcaagcgcgagaagaagctcggggagttcggcaaggccaagggctctcgggcgatctggtacatgtggctgggagcccgattcctggagttcgaggccttaggcttcctgaacgaggaccactggttctcccgggagaactctctatccggtgtggagggcgagggcctccacaaactgggctacatcctgcgcgacgtcggcaagaaggagggcggggccatgtatgccgacgacaccgccgggtgggacacgcggatcaccctcgaggacctgaagaacgaggaaatggttaccaaccacatggagggagagcacaagaagctggccgaggcaattttcaagctcacctaccagaataaagtggtccgcgtgcagcggcccacgccccgcgggaccgtgatggacatcatcagtcgccgcgaccagcggggatccggccaggtcgggacctacggactgaacaccttcacgaatatggaggcccagctgatccgccagatggagggggagggcatcttcaagagcatccagcacctgaccgccaccgaagagatcgccgtgcagaactggctggcccgcgtgggccgcgagcgcctgtcccggatggcgatcagcggggacgactgcgtcgtcaagcccttagacgaccgcttcgcgtccgctttaaccgccctcaacgacatgggcaaggtgcggaaagacatccagcagtgggagccgagccgcgggtggaatgactggacgcaggtccccttctgctcccatcacttccacgagctcatcatgaaggatggccgcgtgctggtggtcccatgccgcaaccaggatgagttgatcgggcgggcccgcatcagtcagggtgcgggctggtccctcaaggagaccgcctgtctgggaaagagctacgcccagatgtggtccttaatgtacttccacaggcgcgatctccggctggccgcgaatgcgatctgctccgccgtcccctcccactgggtgccgacctctcggaccacctggagcatccatgccaagcacgagtggatgacgaccgaggacatgcttaccgtctggaatcgggtgtggatccaggagaacccctggatggaagacaagactcccgtggaatcttgggaagaggtcccctatctaggcaaacgcgaggaccagtggtgcgggagcctgatcggattgacgtctagagccacctgggcgaagaacatccagactgccattaaccaggtgcgctcactcatcggcaatgaggagtacaccgactacatgccatctatgaagcggttccgccgcgaggaggaggaggccggcgtgctgtggtga

SEQ ID NO: 24962 - RNA, 9876 nt, synthetic construct
  misc_feature 1..9876: note = derived and/or modified CDS sequence (opt11) from DENV-2__FJ639697__SS-prME
  source 1..9876: mol_type = other RNA
accgccggcgttataatcatgctgataccgaccgccatggcgttccacctcaccactcgcaacggggaaccccacatgattgttggccggcaagagaagggtaaatccctgctgttcaagaccgaggacggcgtgaacatgtgcaccttaatggccatcgacctgggggaactgtgtgaagacacaataacttacaaatgccctctcctgcgccagaacgagccggaggatatcgactgttggtgcaacagcaccagcacctgggtgacgtacgggacgtgcaccaccacgggcgagcaccggcgcgagaagcggagcgtcgccctggtgccacacgtagggatgggactggaaacccgcaccgaaacctggatgtcatccgagggggcctggaagcacgtccagcgaatcgagacgtggatccttcgccaccccgggtttaccatcatggctgcgatcctggcctacacgatagggaccactcatttccagcgggccctcatcttcatcctgctgaccgccgtggcgcccagtatgaccatgcgctgtatcggaatctccaatcgcgattttgtggagggcgtaagcggaggctcctgggttgacatcgtgctcgagcacggcagctgcgtcaccacgatggccaagaacaagcccaccctggatttcgagctgatcaaaaccgaggccaaagagcccgccaccctccgcaagtactgcatcgaggccaaactgacgaacaccaccactgagtcccggtgccctacgcaaggcgagcccagcctcaacgaggagcaagacaagcgcttcgtatgcaagcacagtatggttgaccgggggtgggggaacggctgcgggctgttcggaaagggcgggatagtgacatgcgcgatgttcacgtgtaagaagaacatggagggtaagattgtccaacctgagaacctggaatacactatcgtgatcactccacacagcggggaggagcatgccgtcgggaacgacaccgggaagcacggaaaggagattaagatcaccccccagtcgagctccacggaggcggaactgaccgggtacggcacggtgaccatggagtgcagccccagaaccggtctcgacttcaatgagatggtgctgttgcagatggaagacaaggcctggctggtccaccggcagtggttcctggacctgcccctcccctggctgccaggggccgatacccaaggctccaactggatacagaaggagacgctagttaccttcaagaacccacacgcgaagaagcaagacgtcgttgtgctcgggagtcaggagggcgccatgcacaccgccctgaccggggccacggagatccagatgagctccggcaatctcctgttcaccggccacttaaaatgccgtctgcggatggacaagctccagctgaaggggatgagctactccatgtgcaccggcaaatttaagatcgtcaaggagatcgctgagacacagcacgggacaatagtgatcagggttcaatacgaaggagacggcagcccctgcaagatcccctttgagataatggacctggagaagaggcatgttttggggcgtctgatcaccgtgaacccgatcgtgaccgagaaggacagccccgtcaatatcgaagcggagccacccttcggtgatagttatatcataatcggggtagagcctggtcaactgaagctgaactggtttaaaaaggggtcgagcatcgggcagatgttcgagactacgatgcgcggtgccaagcggatggctatcctgggggacaccgcctgggacttcggctccttgggcggggtattcaccagcatggggaaggccctccaccaggtcttcggggctatctacggggccgcattctccggggtaagctggaccatgaagatactgatcggcgtgatcatcacgtggatcgggatgaattcccgcagcaccagcctgtcagtctccctcgtgctcgtaggagtgataaccctgtacctcggcgccatggtccaagcagacagcggctgcgtggtctcctggaagaacaaggagctcaagtgtggcagtgggatcttcataaccgacaacgttcacacgtggaccgagcagtacaagttccagcccgagagcccatccaagctggcaagcgccatacagaaagcccacgaggagggcatctgcgggatccgctcagtgacccggctggaaaacctgatgtggaagcagataaccccagagctgaatcacatcttgtcggagaacgaggtcaagctcacaataatgaccggcgacataaaggggatcatgcaggccggtaaacggtccctgcgtccgcagcccaccgaactgaagtactcttggaagacctgggggaaggctaagatgctcagcacggagagtcacaaccagaccttcctgattgacggtcccgagacagccgagtgcccgaacactaaccgggcgtggaactctctcgaggtggaggattacggcttcggggtgttcacgaccaacatctggctcaaactacgcgagaagcaggacgtcttctgcgactcaaagctgatgtccgcagctatcaaggacaatcgggcagtgcacgcggacatgggctactggatcgagagcgccctcaatgatacctggaagatggagaaggcctccttcatcgaggtcaagagctgccactggcccaagtcccacaccctgtggagcaacggcgtgctggagtcggagatgataatccccaagtccttcgctgggcccgtgagccagcataattaccgcccgggatactacacccagactgcgggcccctggcacctgggcaagctggagatggatttcgacttttgcgaaggcaccactgtggtcgtgaccgaggactgcggcaacaggggcccatccctccgaaccaccaccgccagcggaaagttaatcaccgagtggtgctgccggtcctgcacgctgcccccgctgcgctaccggggcgaagacggctgctggtatggcatggagatccgacccctcaaagagaaggaggagaacctagtgaactccctggttacagcggggcacggacagatcgacaacttctctctcggcgtgctcgggatggccttgttcctcgaagagatgctacggacccgcgtaggaacaaagcacgcgatcttgctcgttgccgtaagtttcgtgacgctgataaccgggaacatgagcttcagggacctggggcgcgtcatggtgatggtgggggcaaccatgaccgacgacatcggcatgggcgtcacttatctcgccttactagccgcgttcaaggtacgccccacgttcgcggccggcctcttgctgagaaaactgacaagcaaggagctcatgatggccaccataggcatcgccctgctctcccagagcacgatccccgagaccatactggagctgaccgatgcactggccctggggatgatggttctgaagatcgtacgcaatatggagaagtaccaactcgccgtgaccatcatggccatctcctgcgtgccaaacgccgtcatcctgcagaacgcttggaaggtgtcttgcacgatcttggccgccgtgtccgttagccccctcctgctgacatcctcccagcagaaagccgactggatccccctcgcgctgacaatcaagggtctgaacccaaccgcgatcttcttaacgacgctgtccaggaccagcaagaagcgttcctggccgctgaatgaggccatcatggccgtgggcatggtcagcatcctcgccagctccctgctgaagaacgatatccccatgaccgggcccctcgtggcgggagggctgcttactgtctgctatgtcctcaccggccggagcgcagacctggagctggagcgcgccaccgacgtgaagtgggaggaccaggcggagatctcggggagctcccccatcctcagcatcaccatctctgaggacggcagcatgtccatcaaaaacgaggaggaggagcagacgctaaccatcttaattcggaccggcctactggtgatcagcgggctgttcccggtctccatccccatcacagcagcggcctggtacttatgggaggtgaagaagcagcgcgcgggcgtgttatgggatgtcccgtcgccgccgcccgtggggaaggccgaactggaggacggcgcctaccgcatcaagcagaagggcatcctcggatactcccagataggcgcgggggtgtacaaggagggcaccttccatacgatgtggcacgtcacccgcggggctgttctgatgcatcgaggcaagcgcatcgagcccagctgggccgacgtgaagaaagacctgatcagttacgggggcggctggaagcttgaaggggagtggaaggagggcgaggaggtccaggtgctggccctcgaacccggtaagaacccccgggcggttcagacaaaaccgggcctttttaagaccaacacggggacaattggcgcagtgagcctcgacttctcccccggcaccagcggctcccccatcgtagatcgcaagggcaaggtggtcgggctgtacggcaatggcgtggtaacccggagcggggcctacgtcagcgccatcgcccagacggagaaaagcatagaggacaatcccgagatcgaggacgacatcttccgaaagaagcggctcaccatcatggacctgcatcccggggccgggaagaccaagcgctaccttccagcgatcgtgcgagaggctatcaagcgcggcctacgtacactcatactcgcaccaacccgcgtggtcgccgcggaaatggaggaggccctgaggggtctccccatccgatatcagacccccgccatccgcgccgagcataccggccgggagattgtggacctgatgtgtcacgccactttcacgatgcgactgctctctcccgttcgcgtcccgaactataacctaatcataatggacgaggcacacttcaccgaccccgccagcatcgctgctcgcggctatatcagcacccgggtagagatgggggaagccgcggggatcttcatgactgccacgccgccgggttcacgcgacccgtttcctcagagcaatgcgcccatcatggacgaggagcgggagatccctgagcgctcctggaatagtggccacgagtgggtgactgacttcaagggcaagaccgtctggttcgtgccttccatcaaggccgggaacgacatagcagcctgcttgcgaaaaaacggcaagaaggtgatccagctcagcaggaagaccttcgactccgagtatgtgaagacacggaccaacgactgggacttcgtggtgaccaccgatatcagcgagatgggggccaacttcaaggcagagcgcgtcatcgatccccggaggtgcatgaaaccagtgatcctcacggacggcgaggagcgggtaatcctggccgggccaatgccggtcacccattccagcgcagcccaacgccgggggcgcatagggcgcaacccgaagaacgagaacgaccagtacatctacatgggcgagccgctcgagaacgacgaggactgcgcccactggaaggaggccaagatgcttctggataacattaacacccccgaagggatcataccgtcgatgttcgagcccgagcgagagaaagtggacgccatagacggcgagtaccgactgcggggcgaggcgcgcaagacgttcgtggacctgatgcggcgcggggacttgcccgtctggcttgcctaccgggtcgccgccgagggcatcaactacgccgaccgccgttggtgcttcgacggggtgaaaaataatcagatcctggaagagaacgttgaggtggagatctggactaaggagggcgaacgcaaaaagctgaagccacgttggctagacgcgcgcatctattcagaccccctggccctgaaggagttcaaggagttcgcagccggacggaagagtcttaccctaaacctaatcaccgagatggggaggctccccaccttcatgacgcaaaaggcgagagatgccctggacaaccttgccgtgctccacaccgccgaggccgggggtcgtgcgtacaatcacgccctgagcgaactgcctgagacccttgagaccctgcttctgctgactctcctcgccactgtcaccggcgggatatttcttttcctgatgtccggaaagggcgttggtaagatgaccctaggcatgtgctgtatcatcaccgcgagcatcctgctgtggtatgcccagatccagccgcactggatagcggccagcatcatcctcgagttcttcctgattgtcctgctcatccccgagcccgagaaacagcggacacctcaggataaccaactcacgtacgtggtgatcgctattctgaccgtcgtggccgcgaccatggccaacgagatggggtttctcgagaagacgaagaaggacctgggcctaggctccatcgccacccaggagccggaaagcaatatcctcgatatcgacttacgccccgcctccgcctggaccctgtacgcagtggctaccacgttcgtcacccctatgctccgacacagtatcgagaactctagcgtcaacgtgtcactgaccgccatcgccaaccaggccacggtccttatggggcttgggaaagggtggccactctcaaaaatggatatcggcgtgccactgctcgcaatcgggtgctactcccaagtaaaccccgtgactctgaccgccgccctgctcctgctggtggcccactacgcaatcatcgggcccggcctccaagcgaaggcgactcgtgaggcacaaaagcgggccgccgccggtatcatgaagaaccccaccgtggatggcatcacggtcatcgacttagatccgattccctacgaccccaaattcgagaagcagctggggcaggtcatgctcctgatcctgtgcgtgacccaggtcctcatgatgcgcaccacctgggccctatgcgaggccctgacgctggcgaccggcccaatctccaccctgtgggaggggaacccgggccgcttctggaacaccacgatcgccgtgtccatggcgaacatcttcaggggctcttacctagccggcgccggcttgctgttttccatcatgaagaacaccacgaacacccgccgggggactggcaacatcggcgagaccctgggggaaaagtggaagtcccgcctcaacgccctcggcaagtccgagttccaaatttacaagaaatccgggatccaagaggttgaccgaacgctagcgaaggagggcatcaagcgcggcgaaacggaccaccacgctgtctcccggggcagcgccaagttgcgctggttcgtggagcggaacatggtgactcccgaaggtaaggtagtggacctgggatgtggccggggtggctggtcctactattgcggtggcttgaagaacgtaaaggaagtaaagggactcaccaagggggggcccgggcacgaggaacctatcccgatgagcacctacggttggaacctagtgcgtttacagagcggggtggatgtcttctttacgccgcccgaaaaatgcgatacgctcctgtgcgacataggcgagagtagccccaacccgaccatcgaggctggtcgcaccctgcgggttctctctctggtggaaaattggttgaacaacgatacccaattctgcatcaaggtcttaaacccctacatgcccagcgtgatcgagaagatggagaccctgcagcgcaagtacggaggagccctggtgcgtaacccgctgtcccgtaacagcacgcacgagatgtactgggtctccaacgccacagggaacatcgtgtcatccgtgaacatgataagccggatgctaataaaccgcttcaccatgaagcacaagaaggccacctacgagctggacgtcgatctgggctctgggacgcggaatatcggaatcgagagcgagatccccaacctcgacataatcggcaagcgcatcgagaagatcaagcaggagcacgagacgtcctggcactacgaccaggaccacccctacaagacctgggcctaccacgggtcatacgagaccaagcagacgggctccgcctcttccatggtgaatggggtcgttcgtctgctaaccaagccctgggacgtggtgcccatggtcactcagatggcgatgaccgacacgacccccttcggccagcaacgggtattcaaggagaaggtcgacacacgcacccaggagcccaaggagggcacgaagaagctcatgaaaatcaccgcggagtggctgtggaaagagctggggaagaagaagaccccccggatgtgcacccgcgaggagttcacgaggaaggtccgaagcaacgctgctctcggggcgatcttcaccgacgagaacaagtggaagtctgcccgggaggcggtggaggacagccgcttctgggagctggtggacaaggaacggaacctgcacctcgagggtaagtgcgagacctgcgtctacaacatgatggggaagcgcgagaagaagttgggggagtttggcaaagcgaaaggcagccgggccatatggtacatgtggctgggggcccgctttctcgagtttgaggccctggggttcttaaacgaggaccactggttctcccgggagaacagcctcagcggggtggagggcgaggggctgcataagctgggctacatcctgcgtgacgttggcaagaaggagggtggggcgatgtatgccgacgacaccgcagggtgggatacgcgtatcaccctcgaggacctgaaaaatgaggagatggtgaccaatcacatggaaggcgagcataaaaagctcgctgaagcgatattcaaactgacctaccagaacaaggtggtacgcgtgcagcggccgacgccccgcgggaccgtgatggacatcatttctcgtcgcgaccagcggggctccggtcaagtcgggacctacggcctgaacaccttcaccaacatggaagcccagctcatacgccaaatggaaggggaaggcatcttcaagagtatccagcacctgactgtgactgaggaaatcgccgtgcagaactggctggccagggtcgggcgggaacgcctctccagaatggccatcagtggggacgactgcgtggtgaagccgctggacgatcggttcgcgtccgcccttacggccctcaacgacatgggcaaggtccgtaaggacatacaacagtgggaacccagccgtgggtggaacgactggacccaggtgcccttctgctcccaccactttcacgagctgattatgaaggacggccgggtactcgtcgtgccttgtcgcaaccaggatgagctcatcgggcgggcccgcatcagccagggcgccggctggtccctgaaggagaccgcttgcctgggcaagagctatgcccaaatgtggtcattaatgtacttccaccggagggacttacggcttgccgccaatgcgatctgctccgcggtgccctcgcattgggtacccaccagccggaccacctggagcatccacgccaagcacgagtggatgacgaccgaggacatgctcaccgtgtggaaccgcgtgtggatccaggagaacccttggatggaggacaagacccccgtcgaatcctgggaagaggtgccctacctgggcaagcgcgaggaccagtggtgcggctctcttattggtctcacgtcgcgaaccacctgggctaagaacattcagacggccataaatcaggtgcgcagtctgatcgggaacgaggagtatacggactacatgccctccatgaagcgctttcgccgcgaggaagaggaggcgggcgtgctgtggtga

SEQ ID NO: 24963 - RNA, 9876 nt, synthetic construct
  misc_feature 1..9876: note = derived and/or modified CDS sequence (opt11) from DENV-2__FJ639698__SS-prME
  source 1..9876: mol_type = other RNA
accgctggcgtaatcatcatgttaatcccaaccgctatggcgtttcacctcactacccgcaacggggagccacacatgatagtgggtcggcaggagaaaggtaaatccctgctgttcaagaccgaggatggcgtgaacatgtgcaccctcatggcaatcgacctgggtgagctgtgcgaggataccatcacctataagtgccccctcctgcgccagaatgaacccgaggacatcgactgctggtgtaactctacttccacatgggtaacctacgggacctgtaccacgacgggcgagcatcggcgcgagaagaggtcggtcgccctggtgccccacgtcgggatgggcctcgagacaaggactgagacctggatgagcagcgagggggcctggaagcacgcccaacggatcgaaacatggatcctgcgtcaccccgggttcacaatcatggcggccatccttgcctacaccatcgggaccacgcactttcaaagggccttaatctttatcctgctgacggcagtggccccgagcatgaccatgcgctgcatcgggatatccaaccgggacttcgtggagggtgtgagcggagggtcctgggtcgacatcgtcctcgagcatgggagctgtgtgaccactatggcaaagaataagcccaccctggacttcgagctgataaaaaccgaagccaaagagccagccaccctccgcaagtactgcatcgaggcgaaactgactaacaccaccactgagtcccggtgtccgacgcagggcgagccgagcctgaacgaggagcaagacaagaggttcgtctgcaagcactccatggtggaccgggggtggggtaacggctgcgggctgttcggtaagggcgggatcgtgacctgcgccatgttcagctgcaagaagaatatggagggcaagatagttcagcccgagaacctggagtacaccatcgtgatcacgccccacagtggggaggagcacgccgtgggcaacgatacgggcaagcacggaaaggagataaagataaccccgcagagctccatcacggaggccgaactgaccggctacgggaccgttacgatggagtgtagcccacgcactgggctcgacttcaacgaaatggttctgctgcagatggaggacaaggcctggctcgtgcaccggcaatggtttctggatctgcccctgccgtggctgccgggggcggacacccagggaagcaactggatacagaaggagaccctggtcacgttcaaaaacccccacgccaagaaacaggatgtcgtggtcctcgggagccaggagggcgccatgcacaccgcactgacgggggccaccgagatccagatgtcgtccgggaacctactctttacgggccacctgaagtgccgcttacggatggacaagctccagctgaagggtatgagctactccatgtgcactgggaagtttaagattgtgaaagaaatcgcggaaacccagcatggtaccatcgttatcagggtgcagtacgagggcgacggctcaccctgcaagatcccgtttgagatcatggacctggagaagcggcatgtgttagggcgcctcattacggtaaacccgatcatcaccgaaaaagactcccccgtgaacatcgaggcggagcccccattcggcgacagctacatcatcatcggggtggagccgggccagctgaagctcaactggtttaagaagggctccagcatcgggcaaatgttcgagaccaccatgcgcggcgccaagcggatggccatcctgggggacacagcctgggacttcggctctctcggcggggtcttcaccagcatcgggaaggcgctccaccaggtgttcggggctatctacggcgccgcgttctctggagtgagctggaccatgaaaatcctgatcggcgtcatcatcacctggatcgggatgaactcccgcagcacgtcactcagcgtatccctggtcttagtcggtgtgataaccctgtacttgggagcgatggtgcaagccgactccggctgcgtcgtgtcctggaaaaacaaagagctcaagtgtggatctgggatcttcatcaccgacaacgtgcacacctggacggagcagtacaagttccagccggagagcccctccaagctagcctcagctatccagaaggcccacgaggaaggcatctgcgggattcgttccgtcacccggctagagaacctcatgtggaagcagattacccctgagttgaatcacatcctgtcagaaaatgaggtgaagttaactatcatgacgggcgacatcaaggggattatgcaggcgggcaagcggtccctgcgcccgcagcccaccgagctgaagtactcgtggaagacctggggcaaggccaaaatgctctcgaccgagagccacaaccagacatttctgatcgacgggcccgagaccgccgagtgcccgaacactaaccgtgcttggaactccttggaggtggaggactacggctttggggtcttcacaactaacatctggctcaagttaaaggagaaacaggacgtcttctgcgaccccaaactaatgagcgctgctatcaaagacaatcgggcagtacatgccgacatgggatactggatcgagtccgccctcaacgacacctggaaaatggagaaggcttctttcattgaggtgaagtcctgccactggcccaagagccacaccctctggagtaacggcgtgctggagagtgagatgatcatccccaaggggttcgcaggcccggtgagtcagcacaactacaggcccggttactacacccagaccgccggaccctggcacttgggaaaattggagatggacttcgatttctgcgagggcacgacagtggtggtgaccgaggactgcggcaatcgcggtccgagcctgcggacgacgaccgccagcggtaagctcatcaccgagtggtgttgccgctcctgcacgctaccgcctctgcggtaccgcggggaagacggctgttggtacgggatggagatacggcccttgaaggagaaggaagagaacctggttaactccctggtgacggccggccacggccaaattgacaacttctccttaggggtgcttggcatggcgcttttcctcgaggaaatgcttcgcacgcgggtcggaaccaagcacgcaattttgcttgtggccgtatcatttgtgaccctgatcacgggcaacatgtcgttcagggatctgggcagagttatggtgatggtcggggcgaccatgaccgacgacatcgggatgggggttacatacctcgcactgctcgcggccttcaaggtgcgaccgacgttcagcgccggcctcctgctgcgcaagctcacctccaaggagcttatgatggccacaatcggcattgccctgctctcgcaatcaacaatcccggaaacgatcctggagctgaccgatgcactggccctgggcatgatggtcctgaagatcgtacggaacatggagaaatatcagctcgccgtgaccatcatggcaatcagctgcgtccccaacgctgtgatcttgcaaaacgcttggaaggtgtcctgtaccattcttgccgccgtcagcgtgagccccctcttactgacgagctcccagcagaaagcggactggatcccccttgcgctgaccatcaagggcctaaacccgactgccatattcctcacaacgctgtctcgaacctcaaagaagcgtagctggcccttaaacgaggcgatcatggccgtgggaatggtctccatcctcgctagcagcttactaaagaacgatatcccgatgaccggcccgctggtggccgggggcctgctgaccgtatgttacgtgctaacggggcggtccgccgacctggagcttgaacgagcgaccgacgtaaaatgggaggatcaggccgagatcagcggcagcagcccgatcctctccatcaccattagtgaggacggatccatgagcatcaagaacgaggaggaagaacagactctaacgatcctgatacgcaccgggctattagtcatctcaggtctgttccccgtgagcatccccattaccgccgccgcctggtacctctgggaggttaaaaagcagcgggccggggtgctgtgggacgttcccagcccaccacccgttggcaaggccgaactggaggacggggcctatcgcatcaagcagaaggggatcctggggtatagccagattggggctggcgtctacaaggaagggaccttccacaccatgtggcacgtgacccggggcgcagttctgatgcatcgcgggaagcgtatcgaaccgtcctgggccgacgtcaagaaagacctgatctcatacggcggcgggtggaagctcgaaggcgaatggaaggagggggaggaggtacaggtcctagccctggagcccggcaagaacccgcgcgccgtccaaaccaagcccggcttatttaagacgaacacaggcacgatcggtgcggtgtccctggacttcagcccggggacctccggcagccccattgtggatcggaaggggaaggttgtgggcctgtacggcaatggcgtggtcacccgttccggcgcatacgtgagcgccattgctcaaacagagaagtccatcgaggataaccccgagatcgaagacgacatcttccggaagaagcgcttgacaatcatggacctgcatccgggggcgggcaagaccaagcggtacttgccggccatcgtgcgcgaggccatcaagcgggggctgcgcacgttgatcctcgccccaacccgggtcgtggcggcggagatggaagaagccttacgcggcctccctatcagataccaaacacccgccatacgggccgagcacactggaagagagatcgtggacctgatgtgccacgccaccttcaccatgcggctgctctcccccgtgcgtgtgcccaactataacttgatcatcatggacgaggctcacttcacggaccccgccagcatcgccgcccgggggtacatcagcacccgagtggagatgggcgaggccgcggggatcttcatgaccgccacgccgcccggcagcagggaccccttcccccagtccaacgcccctatcatggatgaggagcgtgagatccccgaacggagctggaactccgggcacgaatgggtcacggacttcaaaggtaagaccgtgtggtttgtcccctcgatcaaggccggcaacgatatcgcggcatgcctacgcaaaaacgggaaaaaggtcatccaactctcccggaagaccttcgacagcgagtacgttaagactcgtacgaatgactgggacttcgtggtcaccaccgacatatccgaaatgggcgccaacttcaaggctgagcgggtgatcgaccctaggcgatgcatgaaacccgtgatcctgaccgacggggaggagcgcgtcatcctggccggtccgatgcccgtgacgcatagctccgcagcccaacggcgcgggcggatcggccgcaatcccaagaatgagaacgaccaatacatctacatgggagaacccctagaaaacgacgaggattgtgcccattggaaggaggccaagatgctgctcgacaacatcaacactccggagggcatcatcccaagcatgttcgagcccgagcgggagaaggtggacgcaatcgatggcgagtatcggcttagaggggaggcgcggaagacctttgtcgacttgatgcgtcgaggcgacctgccggtgtggctagcgtaccgcgttgccgcagaggggatcaactatgcagaccggcgctggtgtttcgacggcgtcaagaacaatcagatcctagaggaaaacgttgaagtggaaatctggacgaaagagggcgaacgtaagaagctgaagccccgctggcttgacgcgcggatctactctgacccgctggccctgaaagagtttaaggagtttgccgctgggcgcaagagcctcacgctgaacctgatcaccgagatggggcggctccccacctttatgacccagaaagcgcgcgacgccctggataacctggctgtcctacacacagccgaggtcgggggcagggcctataaccacgcactgtccgagctgccggagaccctcgagaccctgctgttgctcaccctgctcgccactgtgacaggcgggatcttcttattcctgatgagtggtaagggggtaggcaagatgacactgggaatgtgttgcatcataaccgcctccatcctgctgtggtacgcgcagatccagccccactggatcgccgcgtctatcatcctcgagtttttcttaatcgtgctgctcatccccgagccagagaagcagcgaacaccccaggataatcagctgacctacgtcgtgatcgccatcctgaccgtggtcgccgccaccatggcgaatgagatgggctttctcgagaagaccaagaaggacctgggccttgggagcatcgcaacgcaggagcccgaatccaacatcctcgacatcgaccttcgccccgccagcgcctggaccctgtacgccgtagctaccacgttcgtgacgcccatgctccgccattccatcgaaaacagctccgttaacgtgtctctgaccgcgatcgccaaccaggcaacggtactgatgggcctagggaagggctggccgctgagcaagatggacatcggggtccccttactcgctatcggctgttacagccaggtaaaccctatcacccttacggcggcactactcctgctagtggctcactacgccatcatcggccccgggctccaagccaaggcgacccgggaagcccagaagcgcgccgcagccggcattatgaaaaacccaacggtcgatgggatcacagttatcgatctggaccctatcccttacgatcccaagtttgagaagcagctgggccaggtgatgctcctgatactgtgtgtcacccaagtgctaatgatgcggacgacctgggcactgtgcgaggccttaacattggctacggggccgatctcgaccctgtgggaaggcaaccccggccgcttctggaataccaccatcgccgtttccatggccaacatcttccgcgggtcttacctggccggcgcaggtttgcttttcagcattatgaagaatacgactaacacccggcgcggaaccggcaacatcggggagacgttaggcgaaaagtggaagtcccggcttaatgccctggggaagaatgagttccagatctacaaaaagtccggaatccaggaagtcgacaggacccttgcaaaggaagggatcaagcggggcgaaaccgaccaccacgcggtgtcgcgtggcagcgctaagctcagatggttcgttgagcgaaacatggtcacacccgaggggaaggtggtggatctgggctgcggaaggggcggttggtcctactactgcggcggcctaaagaacgtccgcgaggtgaaaggtctcactaagggcggtcccgggcacgaggagccgatccccatgtccacctacgggtggaacttagtgcggctgcagagtggcgtcgatgtattctttacgccgcccgagaagtgcgacacgctcctatgcgatattggcgagtctagcccgaatcccacgatcgaggccgggcggaccctacgggttctgagcttagtcgagaactggttaaataacgacacccaattctgtatcaaggtgctaaacccgtatatgccgtctgtgattgagaagatggagaccctgcagcgcaaatatgggggtgccctggtacggaacccactgtcccgcaacagcacccacgagatgtactgggtgagcaacgcgacaggcaacatcgtgagctccgtaaacatgatttctcggatgctcattaaccgcttcaccatgaagcataagaaagcgacctacgagcccgatgtggacctggggtccggcacccggaacattggcatcgagagcgagatcccaaacctggacatcatcgggaagcgcatcgagaagatcaagcaggagcatgagacgagttggcactacgaccaggaccacccgtacaagacctgggcctaccacggaagctacgagaccaagcagaccgggtccgcctcgtccatggtgaacggagtcgtgcgccttctgacgaagccctgggatgtagtccccatggtgacccagatggccatgaccgacaccacgccatttggccagcaacgggtgttcaaggagaaggtcgacacccgtacccaggagccgaaagagggtactaagaaactaatgaagatcacagccaagtggctctggaaggaactgggcaaaaagaagacgccccggatatgtacccgcgaggagttcacaaagaaggtgcggagcaacgcagccctcggggctatcttcactgacgagaacaagtggaagtccgcccgcgaggccgtggaagacagccgtttttgggaattggtcgacaaggagcggaatctacacctggagggaaagtgcgagacctgcgtgtacaacatgatggggaagcgggaaaagaagctcggcgagttcggcaaggcgaaggggtcccgagctatttggtacatgtggctgggagccaggttcctagagttcgaggctctcggctttctgaacgaagaccactggttcagccgcgaaaacagcctgtcgggcgtcgagggagagggcctccataaattgggctatatcctgcgagacgtctccaagaaggagggtggcgcgatgtacgctgacgacaccgcgggttgggacacacgcatcacgctcgaggacctgaagaacgaggagatggtcaccaaccacatggagggcgaacacaagaagctagcggaggccatcttcaagctcacataccagaacaaggtcgtgcgggtgcagcgccccacgccccgggggacagtcatggacatcatctcccgcagagaccagcgaggtagcggccaggtggggacctacggcttaaacaccttcaccaacatggaggcgcagctgatcaggcagatggagggggagggaatcttcaagtccatacagcacctcacggtgaccgaggaggtcgcggtgcagaactggctggcccgcgtgggccgcgaacggctgagccgcatggccatcagcggggacgactgcgtcgtcaagccactggacgaccggttcgccagcgctctcaccgccctgaacgacatgggcaaggtgcgcaaggacattcaacaatgggaaccgtctcgggggtggaacgactggacgcaggttcctttttgcagccaccacttccacgaactcatcatgaaggatgggagagtactggtggtcccctgccgtaaccaggacgagctgattgggcgtgcccgcatctcacagggcgccggctggagcctcaaggaaaccgcctgtctgggcaaatcatacgctcagatgtggagcttgatgtacttccaccgtcgggacctccggctggccgctaacgccatatgttccgccgtcccctcacactgggtacccacatcacggactacctggagcattcacgcgaagcacgagtggatgaccactgaagacatgctgaccgtctggaatcgcgtgtggatccaggagaacccatggatggaggacaaaacccccgtcgaaagctgggaggaggtgccgtacctcggcaaacgggaggatcagtggtgcgggtccctgatcggcctgacctcccgcgcgacgtgggccaagaacattcaaaccgcaatcaaccaggtacgatccttaatcgggaatgaggaatacactgactacatgccctccatgaagcgcttccggcgcgaagaggaggaggcgggcgtgctgtggtga

SEQ ID NO: 24964 - RNA, 9876 nt, synthetic construct
  misc_feature 1..9876: note = derived and/or modified CDS sequence (opt11) from DENV-2__FJ639699__SS-prME
  source 1..9876: mol_type = other RNA
accgccggagtaattatcatgctgatccccactgccatggcgttccacctcaccacccgcaacggggagccccacatgatcgtcggccggcaggaaaaggggaagtcgctgctgtttaagacggaggacggcgtgaacatgtgcacccttatggccatcgaccttggcgagttgtgcgaggataccatcacctacaagtgcccactcctgcgccagaacgaacccgaggacatcgactgttggtgcaatagcaccagcacctgggttacttacgggacttgtaccaccacgggggagcaccggcgagagaagcggtcagtcgccctagtcccacacgtgggcatgggcctcgagacacgcaccgagacctggatgagctccgagggggcctggaagcacgcgcagcggatcgagacatggatcctgcgtcaccccggtttcaccatcatggcagccatcctggcatatacgatcgggacgactcacttccagcgggcactcatcttcatactgctgaccgcggtggcgcccagcatgacgatgcgctgcatcggcatctccaatcgggacttcgtagaaggcgtgtctggaggttcctgggtggacatcgtcctcgagcacgggagctgcgtaacaacgatggccaagaacaaacccaccctggactttgagctgattaagaccgaggccaaggagcccgccaccctccgcaagtactgcatcgaggcgaaactgacgaacaccaccacggagtcccggtgcccgacgcagggcgaaccgagcctaaacgaggagcaggacaaacgcttcgtctgcaagcactctatggtggaccgtggctgggggaacggctgtggcttgtttggcaaagggggaatcgtgacctgcgccatgttcagctgcaagaaaaacatggagggaaaaatcgtgcagcccgagaacctggagtacaccatagtgatcacgccccattccggggaggagcacgccgtgggcaacgacacggggaagcacggcaaggagatcaagatcactccgcaaagctccataaccgaggctgaactgactgggtacggtaccgtcacaatggagtgcagcccacgcaccggcctcgacttcaacgagatggtgttactgcagatggaggacaaggcctggctcgtgcaccggcagtggttcctggacctgccacttccctggctgccgggcgcggatacacaaggctccaactggattcaaaaggagaccctggtcacgttcaagaacccacacgccaagaagcaggacgtagtggttctcggcagccaggagggggccatgcacaccgcactgaccggggcaacagagatccagatgagctctggcaacctcctgttcactggccatctgaagtgccgcctgcggatggacaagttacaactgaaggggatgtcatactccatgtgcaccggcaagttcaaaatcgtgaaggagatcgcagagactcagcacgggaccatcgtgatccgggtgcagtacgaaggcgatggctctccctgcaagatacccttcgagattatggacctggaaaagaggcacgtgctagggcgactgataacggtcaacccaatcattactgagaaggactcgccagtgaacatcgaggccgagcctcccttcggcgacagctacattatcattggggtggagcctggacagctgaaactcaactggttcaagaagggatccagcatcggccagatgttcgaaactaccatgcgaggggccaaacggatggccatcctcggggacacagcctgggacttcggctccctcggcggggtcttcaccagcatcgggaaggcgctccatcaagtgttcggagccatctacggcgccgccttctctggggtttcttggactatgaagatccttatcggggttatcatcacctggatagggatgaactcccgctcaacctccctgagcgtgtccctggttttggtcggcgtgattactctctacctgggtgcaatggtgcaggccgacagcggctgcgtggtgtcctggaagaacaaggaactcaagtgcggcagcggtatttttatcaccgataacgttcacacctggacggaacagtacaagttccagcccgagagcccctccaagctggcctcggccatccagaaggcccacgaagaaggcatctgtgggatacggtccgtcaccagattggagaacctcatgtggaagcagattaccccagagctgaaccacatcttatcagagaacgaggtgaaactcaccatcatgacgggcgatataaaagggatcatgcaggcgggcaagcggtccctgcgcccgcagcccaccgagctgaagtactcctggaagacttggggcaaggccaagatgctatcaaccgagagccacaatcagactttcctcatcgacgggcccgagaccgcagagtgcccaaacaccaatcgggcctggaattcactggaggttgaagattacggctttggtgtattcactacgaacatctggctcaaactgaaggagaaacaggacgttttttgtgatagcaagctgatgtccgcagccattaaagacaaccgggccgtgcacgcggacatgggctactggattgagtccgccctcaacgatacctggaagatggagaaggcttccttcatcgaggtaaagtcatgccactggcctaaatcccacaccctatggagcaacggcgtgctagagtccgagatgataattcccaaggggtttgctggccccgtgagccaacataactaccggccggggtattacacccagaccgccggaccatggcatctcggaaagctggagatggacttcgacttctgtgagggcacgaccgtcgtggtcaccgaggactgcggcaatcgggggcccagcctgcggaccacgaccgcctccggcaaactcataacggaatggtgctgccgcagctgcaccttgcctcctttgcggtaccgcggggaagatgggtgttggtacgggatggagatccggcccctcaaggagaaggaagagaacctggtcaacagtttggtgacggccggccacggccagatcgacaacttcagcctaggggtgctgggcatggccctgttcctcgaggagatgttgcgcacccgggtcgggaccaaacatgccattctgctcgtggccgtgtcgtttgtcaccctgatcacgggcaacatgtcgttccgcgatctggggcgcgtgatggtgatggtcggggcgaccatgactgacgacataggcatgggggtgacttacctagccttgctggcggccttcaaggtgcgccccacttttgccgccggccttctgctgcgaaagctcaccagtaaggaactgatgatggccacaatagggatcgcactgctcagccagtccaccatccccgagacgatcttggagctgaccgacgccctcgccctgggcatgatgatccttaagatcgtccgcaatatggagaagtaccagctcgccgtcaccatcatggccatcagctgcgtgccaaacgcggtaatactgcagaacgcctggaaggtctcctgcaccatcctggctgccgttagcgtcagccccctcctgttgacgtcatctcagcagaaagcggactggatacccctcgccctaactatcaagggcttgaaccccaccgccatcttcttgaccacgctgagccgaaccagcaagaagcgtagctggccactgaacgaggccataatggccgtaggcatggtgagtatcctcgcgtcgtcactgctgaaaaacgacatccccatgaccggccccctcgtcgctggggggctgctgaccgtgtgctacgtcctcacgggccggtccgccgacctggagctggaaagagccaccgacgtgaagtgggaagatcaagccgaaatcagtgggtcctcacccatcctatccatcactatcagcgaggacggctccatgagcattaagaacgaggaggaggagcaaacactgacgatcctgatccgcaccgggctcctggtgatctccggcctgttccccgtgagcatccccatcaccgcggccgcatggtacttatgggaagtgaaaaagcagcgagccggagtgctgtgggacgtcccctcaccgccgcccgtcggcaaggccgagctggaggacggggcgtaccgcatcaagcagaagggcatcctcggctatagccagatcggggccggcgtgtacaaagaggggaccttccacaccatgtggcacgtcacgcgcggcgctgttctgatgcatcgcggcaagcggatagagccttcctgggctgacgtcaagaaggacctaattagctacggcggtggttggaaactagagggtgagtggaaagagggggaggaagtccaggtgctagcactggagcctggcaagaacccccgcgcggtgcagactaagcctggcctctttaagaccaacaccgggacgatcggcgccgtctccctggacttcagtcccgggaccagtggcagccccatcgtggaccggaaagggaaggtggtcggtttatacggcaacggggttgtcacccgctccggcgcctacgtctccgcgatcgctcaaaccgagaaatccattgaagacaaccccgagatcgaggacgacatatttcgcaagaagcgcctcacgatcatggacctgcaccccggggccggcaagaccaagcgttacctgcccgccatcgtgcgcgaagccatcaagcgggggcttcgcaccctcatcctggccccaacacgggtggtcgcggccgagatggaggaggccttgcgcgggctccccatccgctatcaaacgcccgccatccgggccgagcataccggccgcgagatcgtggacttgatgtgccatgcgacattcacgatgaggctgctctcccccgtccgagtcccaaattacaatctgatcatcatggacgaggcccatttcacggaccccgccagcatcgccgcccgggggtacatatccacccgagtagagatgggcgaggcggcggggattttcatgaccgccacgccgcccggctctagagatccattcccccagagcaacgcgcccatcatggacgaagagagagaaataccggagcggagctggaactccgggcacgaatgggttacggacttcaagggcaagaccgtctggttcgttccgagcatcaaagcgggcaacgatatcgccgcctgcctccgcaaaaatgggaagaaagtgatccagctctcacggaagaccttcgacagcgagtacgtcaaaacccgcacaaacgactgggacttcgtcgtgaccacagacatctcagagatgggcgccaacttcaaggccgagcgggtcattgacccccgccggtgcatgaaacccgtgatcctgaccgatggggaagagcgcgtaatcctggctgggcctatgccagtaacgcattcctccgcggcccagcggcgcggccggatcggccgcaacccgaagaacgagaacgaccagtacatctacatgggcgagcccctggagaacgacgaggattgtgcacattggaaggaagccaagatgctgctggataatatcaacaccccagaggggatcatcccgagcatgttcgagcccgagcgcgagaaagttgacgcgattgacggcgagtaccggttacgcggagaggcccggaagactttcgttgacctgatgcgcagaggagacctgcccgtgtggctcgcctaccgcgtcgccgccgagggtatcaattatgcggatcggagatggtgctttgatggagtgaagaacaaccagatcttggaggagaatgtcgaggtggagatctggaccaaagagggcgagcggaaaaaactgaagccgcgctggctcgacgcacggatctatagcgaccccctggccctgaaggagttcaaggaattcgccgccgggcgcaagagtctaacgctgaatctgatcacggaaatgggacgcttaccaacattcatgacccagaaggcccgcgacgcgctggacaacctagctgttctccacacagccgaagtcgggggccgagcgtacaatcacgccttgtccgagctgccagaaacgctcgagaccctgctgctcttgaccttgctcgccactgtgaccggcggaattttcctgttccttatgagcggcaagggggtgggcaagatgaccctcgggatgtgctgtatcatcacagccagtatccttctgtggtacgcccagattcagccgcactggatcgctgccagtatcatcttggagttcttcctgatcgtcctgctcatccctgagcccgagaaacagagaacgccgcaggataatcagctgacgtacgtggtcatagccatcctgaccgtggtggccgctaccatggcgaacgagatgggcttcctcgagaaaacaaagaaagacttaggcctagggagcatcgccacccaggaacccgaatccaacatcctcgatatcgacttacggcccgcaagcgcctggaccctgtacgccgtcgcgaccacgttcgtgacgccaatgctccgacactctatcgagaacagctcggtgaacgtcagcttgaccgccatcgcaaaccaagccaccgtgttgatgggcctcggtaagggctggccgctatccaagatggacataggggtgcccctactcgcgataggatgctacagccaagtcaaccccattaccctgacagccgcactgttgttgctcgtggcccactacgctatcatcggccccggtctccaggcgaaggccacccgtgaagcccagaagcgcgcggccgcgggcatcatgaagaaccctaccgtggatgggatcacagtgatcgacctggacccgataccctatgacccgaagttcgagaagcagctgggccaggtgatgctcctcattctgtgcgttactcaggtcttgatgatgcggaccacctgggccctgtgcgaggccctgaccctcgcgacggggccaatctccaccctgtgggaaggcaacccgggtcgcttttggaacacaaccatcgccgtgagcatggcgaacattttccgcgggtcctatctagccggcgccggtctcctcttctcgatcatgaagaacactaccaacacccgtcgcggcaccggcaacatcggtgagactctgggcgagaagtggaagtcccggttgaacgcgctggggaagaatgagtttcagatctataagaagtccggcatacaagaagtggaccgcaccctggcgaaggagggaatcaagcggggcgagaccgaccaccacgctgtctcgcgcggcagcgccaagctccggtggttcgtggagcggaacatggtgacccccgaggggaaagtagtggacctgggctgcgggcggggcggctggagctactactgtggtggcctgaagaacgtgagggaggtcaaagggctcacgaagggcgggcccggccacgaggagcccatccctatgagcacctacgggtggaacctggtgagactgcagtccggtgtggacgtctttttcacgccacccgaaaagtgcgacacactcttatgcgacatcggcgagagcagccccaacccgaccatcgaggccggacgcaccctacgggtgctatccctggtcgaaaactggctgaacaatgacacccagttctgcatcaaggtcttgaacccctacatgcccagcgtgattgaaaagatggagactctgcagagaaagtacggcggggccctggttaggaaccctttgtcccggaactccacccacgaaatgtactgggtctcgaacgccacgggcaacatcgtaagctccgtcaacatgataagtcggatgctcatcaaccgcttcactatgaagcacaagaaggccacctatgagcccgacgtggacctcgggtccggaacacggaacatcggtatcgagagcgaaattcccaacctggacatcatcggtaagcgcatcgaaaaaataaagcaagagcatgagacatcctggcactacgaccaggaccacccctacaagacttgggcctatcacggcagctacgagaccaagcagaccgggtccgcatcatccatggtgaatggtgtagtccgccttctgacgaagccgtgggacgtggtgcccatggtcactcagatggccatgactgacaccacgccattcgggcagcagagggtgttcaaggaaaaagtcgacacgcgcacccaggagcccaaagagggcacgaagaagctgatgaagatcacggcgaaatggctctggaaggagctgggcaagaaaaagaccccgcggatctgcacccgggaggaatttactaagaaggtccgtagcaacgccgccctgggcgcgatattcacagacgagaataagtggaagtcggcccgcgaggcggttgaggacagccggttctgggagctcgtggacaaggagcgtaacctccacttggagggcaagtgcgaaacctgcgtgtacaacatgatggggaagcgggagaaaaagctcggggagttcggcaaagccaaggggtcccgagccatctggtatatgtggctgggcgcccggttcctggagttcgaagcgctcgggttcctgaatgaggaccactggtttagccgggagaactcgctgtccggcgtggagggcgagggcctccacaagctgggctacatcctgagagacgtgagcaagaaggaggggggcgccatgtacgccgacgacaccgccgggtgggacactaggatcacgctcgaagatctgaagaacgaggagatggtcaccaaccacatggaaggcgagcacaagaagctcgcagaggcaatcttcaagctcacctaccagaataaggtggtccgggtgcagcgccccacaccccgggggacggttatggatatcatctcacgccgggaccaaagagggagtggccaggtcgggacctacggccttaacaccttcaccaacatggaggcgcagctgatccggcaaatggagggggagggtatcttcaaatcgatccagtatctcacggtgacggaggaggtggccgtgcagaattggttggcccgcgttggtcgcgagcggctgagccgcatggcaatctccggggacgactgcgtagtgaagcctctcgacgaccgtttcgcgagcgcattaaccgccctgaacgacatggggaaagtgcgcaaggacatccagcaatgggaaccgagtcgggggtggaacgactggacccaggtgcctttttgcagccaccacttccacgagttgataatgaaggacggacgcgtccttgtagtgccctgccggaaccaagacgagcttatcggcagggccaggatatcccagggcgctgggtggagcctcaaagagactgcatgcctggggaagtcctacgcccagatgtggagcctgatgtacttccatcgccgggatctgcggctggctgccaatgccatatgttccgcggtgcctagccattgggtgccgacctcccggaccacttggagcatccacgctaagcacgaatggatgaccacagaggacatgctgaccgtgtggaaccgcgtctggatccaagaaaatccctggatggaggacaagaccccggttgaatcttgggaggaggttccctacctcggcaagcgggaggaccagtggtgcgggtctctcattggcctgacctctcgcgccacatgggctaagaacatccagaccgccatcaaccaggtccggtccctcatcgggaacgaggagtacacggactacatgccgagcatgaagcgcttcaggcgcgaggaagaggaggccggcgtgctatggtag

SEQ ID NO: 24965 - RNA, 9876 nt, synthetic construct
  misc_feature 1..9876: note = derived and/or modified CDS sequence (opt11) from DENV-2__FJ639700__SS-prME
  source 1..9876: mol_type = other RNA
accgccggcgtgataatcatgctgatcccgaccgctatggcgttccacctcactacccgcaacggggagccccatatgatcgtgggtcggcaggagaaggggaaatccctgttgtttaagaccgaggacggcgtcaacatgtgcaccctcatggccatcgacctcggcgagctgtgcgaggacaccatcacgtacaagtgccccttactgcgtcagaacgagcccgaggacatcgactgctggtgcaacagtactagcacgtgggtgacctacgggacctgcaccaccacaggcgagcaccggcgcgaaaagcggtccgtcgcgcttgtgccccatgtggggatgggcttagagacccgcaccgagacctggatgagcagcgagggggcctggaagcacgcccagaggatcgagacctggatactccgccaccccggcttcaccatcatggcggcaattctggcctacaccatagggaccacgcactttcaacgggccctcatcttcattctgctgaccgcggtcgcgccaagcatgaccatgcgctgcatcggcatctctaatagagacttcgtggagggtgtgtcaggtggctcctgggtcgacatcgttctcgagcatgggagctgcgtgaccacgatggccaagaacaaaccaaccctggactttgagctgatcaagaccgaggccaaggagcccgccaccctccgcaagtattgcatcgaagcgaagctaacgaacaccaccaccgagtcccggtgcccgacccagggcgaacccagcctgaacgaagagcaggataagcgcttcgtctgcaagcactccatggtggaccgggggtggggcaacggctgcggcctgttcggcaagggcgggatcgtaacgtgcgccatgttcagctgcaaaaaaaacatggagggcaagatcgtccagcccgagaacctcgaatataccatcgtcataacaccccattccggggaggagcatgccgtgggcaacgacacggggaaacatggcaaggagataaagatcactccgcagagctccatcacagaggccgagctcaccgggtacggcactgtcacgatggagtgcagcccccgcacgggcctagacttcaacgagatggtgctgctgcagatggaggacaaggcctggttggtacaccggcagtggtttctggacctgcccctcccttggctgccgggcgcggacacccagggctccaattggattcagaaggagaccctggtcacgtttaagaatccccatgccaagaagcaggatgtggtggtcctcggtagtcaggaaggcgccatgcacacggccctcacaggggcgaccgagatccagatgagcagtgggaacctcctgttcactgggcacctgaagtgtcgcctgcggatggacaagctccagctgaagggtatgagctactccatgtgcaccggcaagttcaagatcgtgaaggagattgcggagacccagcatggtaccatcgtcatccgcgtgcagtacgagggcgacggcagcccctgcaaaatccccttcgagatcatggacctggagaagcggcacgtactcggccgcctgatcacggtaaacccgatcatcaccgagaaggactcccctgtgaacatagaggcagaaccgcccttcggtgacagctacataatcatcggcgtggagcccgggcagctgaagctcaattggtttaaaaaagggtcctctatcggccagatgttcgagaccactatgcgcggcgccaagcggatggccatcctgggcgacacggcctgggacttcggcagtctaggcggggtgttcaccagcatcgggaaggcgctccaccaggtgttcggagccatctacggagccgccttcagtggggtgtcatggactatgaaaatcctcatcggcgtcatcatcacctggatcgggatgaactccagatcgacctcccttagcgtgtccttggtgctcgtcggcgtgatcaccctgtatctgggggcgatggtgcaggccgacagcggttgtgtcgtgtcctggaagaacaaggagttaaagtgcggcagcggtatctttatcaccgacaacgtacacacctggacggagcagtacaagttccaacccgaaagcccctcaaagttagccagcgccatccagaaagcccatgaggaaggcatttgcgggatccggtccgtcacccgcctcgagaacctcatgtggaagcagatcacccccgagctgaatcacatcctgagcgagaatgaggcgaagctcaccatcatgacgggcgatatcaagggcatcatgcaggccggcaagcggtccctgcgcccgcagcctacagagctgaagtacagctggaagacctggggcaaggctaaaatgctctccactgagtcacacaatcaaacgttcctgatagacgggccggagactgccgagtgcccgaacaccaaccgggcctggaactccctggaggtggaggactacggcttcggggtgttcaccacgaacatctggctcaagctgaaagagaaacaagacgtcttctgcgacagcaagttaatgtcggcggccatcaaggacaaccgagccgttcacgccgacatgggctactggatcgaaagcgcccttaacgacacatggaaaatggagaaggcgtccttcatcgaggtgaaaagttgccactggcccaaatcccacacactgtggagcaacggggtcctggaatcagaaatgattatccccaaggggttcgccggccccgtgagccagcacaactaccggccggggtaccatacccagaccgccggcccctggcacctcgggaagttagagatggacttcgacttctgcgaaggcacgacagtggtcgtgaccgaggactgcggcaaccgggggcccagcctgcggaccacgacagcctccggcaagctcatcaccgagtggtgctgccgcagctgcacgctgcccccactgcggtaccgaggggaggacggatgctggtacgggatggagatccgtcccctcaaagagaaagaggagaacctggtgaacagcttagtcacggccggccacggccagatcgacaatttcagcctcggggtgctgggcatggccctgttcctcgaggagatgctgcgcacccgagtggggaccaagcacgccatcctgttggttgcagtgtccttcgtgaccctcataacgggcaacatgagcttccgagacctgggacgggtcatggtaatggtgggcgcgaccatgaccgacgatatcggcatgggagtcacctacctcgcgctgctggccgccttcaaggtgcgccccacgttcgccgccggcctcctgctgcgtaagctcacctcaaaggagttaatgatggcgaccatagggatcgcactgctcagccagagtaccatacccgagacgatacttgagctgaccgacgccttagcccttggcatgatgatcctgaagatcgtgcgtaacatggagaagtaccagctcgcggtcacaataatggcgatcagctgcgtgccgaacgccgtgatcttgcaaaacgcctggaaggtcagctgtaccatactggccgcggtgtcggtgtcgcccctgctgctgacgagctcccagcagaaagccgactggatcccactcgcccttaccatcaagggcctgaaccccaccgccatcttcctcaccacgctgtctcgcacctccaagaagagaagctggccgcttaacgaggccatcatggcggtggggatggtgtccatactggctagcagcctgctgaagaacgatatccccatgacaggccctctcgtggccgggggcctccttaccgtctgctacgtgctcactggccgctccgccgacttggagctggaacgggccaccgacgtgaagtgggaggaccaggcggagatcagcggctcgagccccatcttatccatcacaataagcgaggatggctccatgagcatcaagaacgaggaggaagaacagaccctgacgatcctgattcgcaccgggctgttagtcatctccggtctgttcccggtgagcatccccatcaccgccgccgcctggtatctctgggaggtcaaaaagcagcgggcgggagtcctgtgggacgtgccgtccccgccgcccgtcgggaaggcggagctggaggacggggcatacagaatcaagcagaaagggatcctcggatacagccagatcggtgccggcgtgtacaaggaggggaccttccacaccatgtggcacgtgacgcggggcgctgtcttaatgcaccgcgggaagcggatcgagccctcctgggccgacgtgaaaaaggacctgatcagctacggaggcggctggaagctcgagggcgagtggaaggagggggaggaggtgcaggtgctggccctggagcccggcaagaacccacgcgccgtgcaaaccaaacccggcctattcaagactaataccggcacgatcggcgccgtgagcctggattttagcccaggaactagcggcagcccaatcgtcgaccggaaggggaaggtggtgggcctgtacggcaacggagtcgtgactcgctccggcgcctacgtgagcgcgatcgcccaaaccgagaagtccattgaggacaatcccgagatcgaggacgacattttccggaagaaacgcctcacgatcatggacctgcaccccggcgcgggcaagaccaagcggtacctgcctgccattgtccgcgaggctatcaagcgggggctgcgcaccctcatcctggcaccgacccgagtggtagccgccgagatggaggaagcccttagaggcctgcctatacgctaccaaacacccgccatccgggcggaacacaccggcagggagatcgtcgacctgatgtgccacgcgaccttcaccatgcggctgctcagccccgtgcgcgtgccgaactataacctgatcatcatggacgaagcccacttcacggaccccgcgagcatcgcagctcggggctacatttccacccgggttgagatgggcgaggccgccgggatcttcatgaccgcgacgccgcctggtagccgcgacccgttcccccagtccaacgcgcccatcatggacgaggagcgcgagatccccgagcggagctggaactccgggcacgagtgggtgaccgatttcaagggcaagaccgtgtggtttgtccctagcatcaaagccggcaatgacatcgcagcctgcctgcgcaagaatgggaagaaagtgatccagctctcccggaagacctttgactcagagtacgtcaagacccgcacgaacgactgggactttgtcgtgaccaccgacatctcagagatgggcgccaacttcaaggctgagcgggtgatcgacccacgccggtgcatgaagcccgtcattctgaccgacggcgaggaacgcgtgatcctggccggccctatgccggtgacgcacagctcagccgcccaacggcgtggccggatcggccgcaaccccaagaacgagaacgaccaatacatctacatgggtgagcccctcgagaacgacgaggactgcgcacactggaaggaagcgaagatgctgctggacaacatcaacacccccgaggggatcatcccgagcatgttcgaacctgagcgtgagaaggtcgacgccatcgacggcgagtatcggctccgcggggaggcccggaagaccttcgtggacctgatgcgccggggcgacctgccggtatggctcgcttaccgcgtcgccgcggaggggatcaactatgccgatcgtcgttggtgcttcgacggcgtgaaaaacaaccagattttggaggaaaacgtggaggtagagatctggacaaaggagggcgagcggaagaagctgaagccccgctggctcgacgcccggatatactccgacccgctggccctaaaggagttcaaggagttcgcagccggacgcaagagcctgacgttaaacctgataaccgagatgggtcggctccccacgttcatgacccagaaggcccgcgatgcgcttgacaaccttgccgtgctccatacggccgaggtcgggggccgggcctataatcacgccctgtccgagctgcccgagaccctcgagaccctgctgcttctgaccctcttggctacggtcaccggagggatcttcctgttcctgatgagcggcaaaggtgtgggcaagatgaccctcgggatgtgctgcatcatcactgcctccattctgctttggtacgcacagatccagccacattggatagcagcctctatcatcctcgagttcttcctgatcgtgctcctaatccccgagcccgaaaagcagcgcacgccccaggacaaccagctcacgtatgtcgtgatcgccatcctgaccgtcgtggccgctaccatggccaacgaaatgggcttcctcgagaagaccaagaaggacctgggcctggggagcatcgccacgcaggagccggagtccaacatcctcgacatcgacctccggcccgccagcgcctggacgctgtacgcagtggctactaccttcgtcacgcccatgctccgccattccatcgagaactcctccgtgaacgtcagcctgacggccatcgctaatcaggcgaccgtactgatgggcctcgggaagggctggcccctgtccaagatggacatcggggttccgttgttagccattgggtgttactctcaggtgaaccccatcacgctgacggcagcccttctcctgcttgtcgcccactatgccatcattggcccagggctccaggccaaggccacccgggaggcccaaaagcgcgccgcggctggcatcatgaagaaccccaccgtggacgggatcaccgtgatcgacctggaccccatcccctacgaccccaagtttgagaagcagctgggccaggttatgctgctgatcctgtgcgttacacaggttctcatgatgaggaccacctgggccctgtgcgaggccctgacgctcgccacggggcccatatccacactgtgggagggcaacccgggccgcttctggaacaccaccatcgcggtcagcatggccaacatcttccgagggtcctacctggccggggccgggctcctgttcagcatcatgaagaatacgaccaacacccggcgcggcaccggcaatatcggggagacactgggcgagaagtggaagtcccggcttaatgcgctggggaagaacgagtttcagatatacaagaagtccggcatccaggaggtggaccgcaccctggccaaggagggaatcaaacggggcgagaccgaccaccacgcagtctcccgcgggtctgccaagctacggtggtttgtcgagcgcaacatggtgacgcccgaagggaaggtggtcgatctgggctgcgggaggggcggatggagctattactgcggcggcctgaagaacgtgcgcgaggtgaaaggcctcacgaagggcgggccgggacacgaagaacccatcccgatgagtacatatgggtggaatctggtgcggctgcaatcaggcgtggacgtattcttcacgcctcccgagaagtgcgacaccctcctctgcgacatcggcgagagcagccccaatccaacgatcgaggccgggcgcacccttcgggtcctctccctagtggagaactggctgaacaacgacacacagttctgcatcaaagtgctcaacccctacatgccttcggtaatcgagaagatggagaccctgcagcgcaaatacggtggtgcgctcgtgcggaaccccctctctcgcaacagcacccacgaaatgtactgggtgtccaacgccactggcaacatcgttagctccgtaaacatgatcagccggatgctcatcaaccgcttcaccatgaaacataagaaggccacctacgagcccgacgtggacctgggctccggcacccggaacatcggaatcgagtcagagatcccaaacctggacatcattgggaagcgcatcgagaagatcaagcaggagcatgagacgagttggcattacgaccaggaccacccgtacaagacctgggcctatcacggcagctacgagactaaacaaaccggttccgccagcagtatggtcaatggagtggtgcgcctcctaacgaagccgtgggacgtcgtgccgatggtgacccaaatggctatgaccgacacaacccccttcggccagcaacgggtattcaaggagaaggtggatacccgcacccaggagcccaaggaaggaacgaagaagcttatgaagattacggccaagtggctctggaaggaactgggcaagaagaagaccccgcggatctgcacccgcgaggagttcacaaagaaggtgcgatctaacgccgccctgggggccatcttcacggacgagaacaagtggaaatcagcgcgcgaggccgtcgaggacagccgtttctgggagctcgtggacaaagagcgcaacctgcacctcgagggcaagtgtgagacctgcgtgtacaacatgatggggaagcgggagaagaaactcggagagttcggcaaggccaaagggtcgcgcgctatctggtacatgtggctgggggcgcggttcctggagttcgaggccctcgggttcctgaacgaggaccactggttcagccgcgagaacagcctgagtggcgtcgagggggagggcctacacaagttgggctacatcctgcgggacgtgagcaagaaagagggcggcgccatgtacgccgacgacaccgccgggtgggacacccgcatcacgctcgaggaccttaaaaacgaagagatggtgaccaaccacatggagggcgagcacaaaaagctcgcggaagccatattcaagctcacctaccagaacaaggtcgtgcgggtccagcgccccaccccccgtgggactgtgatggacatcatttcccgaaaggaccagagaggcagcggccaggtggggacctacggactcaacaccttcactaacatggaggcacagctgatacgccagatggagggcgagggcatcttcaagtcgatccagtacctgacggttaccgaggaggtggccgtacagaactggctggcgcgggtcggtagagagcggcttagccgcatggcgatctcgggagatgactgcgtagtgaagccactagacgatcgcttcgccagcgccctcaccgccctgaacgacatgggaaaggttcggaaggacatccagcagtgggaaccgtcccgcgggtggaatgattggacccaggtccctttctgcagccaccatttccacgagctcatcatgaaggacgggcgggtgctggtcgtgccctgccgcaaccaggatgagctgatcgggcgagcacggatctcccagggcgctggctggagcctcaaggagacggcctgcctggggaagtcctacgcccagatgtggagcctgatgtatttccatcggcgcgacctccggctggccgccaacgcgatatgcagcgccgtacccagccactgggtccctacgtcccgcaccacctggagcatccacgccaagcatgagtggatgaccacggaggacatgttaaccgtgtggaaccgggtatggatccaggagaacccctggatggaggataagacgcctgtcgaaagctgggaggaggttccctacctggggaaacgcgaggaccagtggtgtggctcactcatcggtctaaccagccgtgccacgtgggcgaagaacatccagacggccatcaaccaggtgcgctccctcatcggcaacgaggagtacaccgactacatgccatcgatgaagagattccgccgggaggaggaggaggccggcgtactgtggtga

SEQ ID NO: 24966 - RNA, 9876 nt, synthetic construct
  misc_feature 1..9876: note = derived and/or modified CDS sequence (opt11) from DENV-2__GQ868620__SS-prME
  source 1..9876: mol_type = other RNA
agcgccggtatgataatcatgcttattcctacagtgatggccttccacttgacaacccgcaacggggagccccacatgatcgtgggcatccaggaaaaagggaagtccttactgtttaagaccgaggacggagttaatatgtgcacactgatggccatggacctgggggaactatgcgaggacaccatcacctacaaatgccccctcctgcggcagaacgagcctgaagatatcgactgctggtgcaatagcacctccacctgggtgacctacgggacatgcaccacaaccggcgagcaccgacgggagaagcgcagcgtcgccctggtgccccacgtgggtatgggcctagagactcggaccgagacctggatgtccagcgagggtgcctggaagcatgcccagcgcattgagacatggatcctgcgacacccgggtttcacgatcatggccgcgatccttgcatacaccatcgggactacccatttccagagggccctaatattcattcttttaacggccgtcgcgccgagcatgacgatgcggtgcatcggcatttcaaaccgcgatttcgtggagggcgtatccggcggctcttgggtcgacattgtcctcgagcacggttcctgtgtgacaacaatggccaagaacaagccaacgttagacttcgagctgattaaaaccgaggccaagcagcccgcgacgctccgaaaatactgcatcgaggccaagctgaccaacacaaccaccgagtcgcgctgtcccacgcagggcgagccctccctgaaagaagagcaggataagcggttcgtctgcaagcacagtatggtggaccgcgggtgggggaacggatgcgggctgttcggcaaaggagggattgtgacttgcgcgatgtttacctgcaagaaaaacatggaaggcaagatcgttcaaccagagaacctggaatacacaatcgtcgtgacaccacacagcggcgaggagcatgccgtcggcaatgacacggggaaacatggcaaagaaattaaggtaaccccgcagagctccataaccgaggcagagttgacggggtacggcaccgtgacgatggagtgcagccccagaacaggcctcgacttcaacgaaatggtcctgctgcagatggagaacaaagcctggctcgtccaccggcaatggttcctcgaccttccactcccctggctgccgggagccgataagcagggctccaactggatccaaaaggagaccctcgtgaccttcaagaacccccacgcgaagaagcaggatgttgttgtcctcgggagtcaagagggcgccatgcacacagcgcttacgggggccacggaaatccagatgtccagtggcaatctcctgttcaccgggcacctgaagtgccgcctgcgcatggataaattacagctgaaggggatgagctactccatgtgcacgggcaaatttaaagtggtcaaggaaattgccgagacgcaacatggcaccatcgtaatccgcgtgcagtacgagggcgatggctcaccatgtaagatacccttcgagatcatggacttagagaagcgctacgtgctcgggcggcttatcactgtcaatccgatcgtaactgagaaagacagtcccgtgaacatcgaggcggagccgccctttggcgacagctatatcattatcggggtcgagccgggtcagctgaagctcaattggttcaaaaaggggagcagcatcggccagatgttcgagaccaccatgcgcggcgcaaagcggatggcaatcctgggtgacaccgcctgggacttcggtagcctcggcggggtcttcacgagcatagggaaagctctccaccaagtgtttggcgcgatctacggggcggcattctccggggtcagttggaccatgaagatcctgatcggcgtgataataacctggatcggcatgaactctcggtcaacatccctaagcgtgtccttagtcctcgttggcatagtgacactttacctgggggtcatggtgcaggccgatagtggctgcgtcgtgtcgtggaaaaacaaggaactcaagtgcggcagcgggatcttcattacagacaacgtgcacacctggaccgagcagtacaagtttcaacccgagagcccatccaagctggcatcggccatccagaaggcccaggaagaaggcatctgtgggatccgatctgtgacgcgactggagaacctcatgtggaagcaaatcaccccagagctaaaccacatattggccgagaatgaggtgaaattaacaatcatgacgggcgacatcaaggggatcatgcaagcgggcaaaagatcgttacggccccaaccgacagagctgaagtactcctggaagacatggggcaaggcgaagatgctcagcaccgagtcccacaatcagacgttcctgattgatggccccgaaacggccgagtgcccgaatactaaccgcgcctggaacagcctggaagtggaggactatggattcggagtgtttaccaccaacatctggctcaagctgaaggagaagcaggacgcgttctgcgacagtaagctgatgagcgccgcgatcaaggacaaccgagccgtccacgccgacatgggctactggatcgagtccgccctaaacgacacgtggaaaattgaaaaggcatctttcatcgaggtgaagaattgccactggcccaagtcccacaccttgtggtcgaatggcgtgttagagtccgagatgatcatccccaagaatctggcgggccctgtcagccagcacaattaccgtcccggctaccatactcagatcgcggggccgtggcatctgggcaagctggagatggacttcgacttctgcgacggtaccacagtgatcgtgacggaggactgcggcaaccggggcccatccctccgcaccaccaccgcgagcgggaagttaatcacggagtggtgctgccggtcttgcaccctgcccccgcttcgctaccggggcgaggacgggtgctggtatggcatggagatacgccctctgaaggaaaaggaggagaacttggtcaactccctcgtgacggccgggcacggacaagttgataacttcagcctaggcgtccttgggatggccttgttcctggaggaaatgctgcggacgcgcgtgggcacgaaacacgcgatcctccttgtggccgtctccttcgtgaccttaatcaccgggaatatgagcttcaaggacctcggccgggtagtagtgatggtgggggccacgatgacggacgacatcggcatgggcgtcacctacctggccctgctcgcggctttcaaagtccgccccaccttcgctgccgggctgctactccggaagctaacctccaaggagttgatgatgacaaccatcggcatcgtgctcctgtcgcaatccacgattccagagaccatcctggagctcacagacgcgctggcactggggatgatggttctcaagatcgtgcgcaatatggaaaagtaccagctagccgtgaccataatggccatcctttgcgtcccgaacgctgtgattttgcagaacgcatggaaggtctcttgtaccatcctggctgtggtgtctgtctcgccactgctcctgacctccagccagcagaaaacggactggatccccctggctctcacaatcaaaggtctgaatccaaccgccatcttccttaccacactcagccgcaccaacaagaagcgcagttggccccttaatgaggccattatggctgtgggtatggttagtatccttgcctcatccttactgaagaacgacatccccatgaccgggcccctggtagccggcgggctactgacggtttgctacgtgctcacgggcaggtcagcagacctcgagctggagagagccactgacgtaaaatgggaagaccaagcggagatttccgggagcagccctattctgagcatcaccatcagcgaggacggatccatgagcataaagaacgaggaggaggagcagaccctgacgatcctgatacgcaccggactgctcgtgatctcagggctgttcccggtttctatccccatcaccgccgctgcctggtacctgtgggaggtcaagaaacagcgggccggcgtactctgggacgtgccttcgccaccacccatgggtaaagccgagctggaggacggcgcctatcgtatcaagcagaagggcatactgggctacagccaaattggagccggcgtctataaggagggaaccttccacaccatgtggcatgtgacgcgcggggcagtgctgatgcacaagggcaagcgcatcgagccctcctgggccgacgtcaagaaagacctcatcagctatgggggcggctggaaattagagggcgagtggaaggaaggcgaggaggtgcaagtcctcgcgctggagcccgggaagaaccccagggtcgtgcagacaaagcccggccttttcaagaccaacaccggtacgatcggcgccgtatccctcgatttcagccccggcacctctggaagtcccatcatcgataagaaaggcaaggtggtggggctgtatggcaacggcgtggtcacccgctccggggcgtacgtgagcgcgatcgcccagacagagaagagtatcgaggacaatcctgaaatcgaggatgatatcttccggaaaaggcggctgacgatcatggacctgcatcccggagcgggcaaaaccaagcgttacctacctgcaattgtgcgggaggccatcaagcgcggcctgcggactctaatcctcgccccgacccgagtcgtggcggcggagatggaggaggccctgagggggctgcctattcgctaccagacgccggccatccgggctgaacacactggccgtgagatagttgacctcatgtgccacgcgaccttcactatgcgtctgctgagccccgtccgggtgccgaactacaatctaatcatcatggatgaggcccacttcacggaccccgcgtcgattgccgcccgcggttatatcagcacccgagtggagatgggggaggcggcgggtatcttcatgaccgccacgccgcccggaagccgcgacccgttcccgcagtccaacgccccaatcatcgacgaggagcgcgaaatacctgagcgcagctggaactccggccatgagtgggtcacggattttaaagggaagactgtatggttcgttccaagtatcaaagccggtaacgacatcgcagcatgcctgaggaagaacggcaaaaaggtaattcagctgtcccgcaagacttttgacagcgagtacgtgaagacgcggacgaacgactgggatttcgtggtcacaaccgacatctccgagatgggggcgaattttaaggcagagcgcgtgatcgacccccgtcgttgcatgaagcccgtgatcctaaccgacggcgaggagcgcgtcatcctggcggggccgatgccggtgactcacagctccgccgcgcagcgccgggggcggatcgggcggaacccaaagaacgagaacgatcagtacatctacatgggtgaacccctggagaacgacgaagactgcgcgcactggaaagaggccaagatgctgctggacaacatcaacacccccgaggggatcatccccagcatgttcgaacctgagcgcgagaaggtggatgctatcgacggtgagtaccggttacgtggcgaggcccgtaagaccttcgtcgacttaatgcgaaggggggatctgccggtctggctggcctacaaggtagcggccgagggcataaattacgcggataggcgatggtgcttcgacgggataaaaaacaatcagatcttggaagagaacgtcgaggtggaaatctggacgaaagaaggagagaggaagaaactcaaaccgcgctggcttgacgcccggatctactctgatccgttggcgctcaaggagtttaaggaattcgccgccggccgaaagtccctgacgcttaatctgatcaccgagatggggcggctgcccaccttcatgacccagaaaactcgcgatgcgctcgataacctggcagtcttacacactgccgaggcaggcgggcgggcgtacaaccatgccctctccgagctgcccgagaccctggaaaccctcctgctgctcacgctgctggctaccgtgaccggcggcatcttcctctttttgatgtctggtcgcggcataggcaaaatgacactgggaatgtgctgtataatcacggcatccatcctcctgtggtacgcacagatccagccgcattggatagcggccagcatcattctggaattctttctcatagtgctgcttatccctgagccggagaagcagcgtacgcctcaggataaccagctcacctacgtcgtcatcgccatcctcacggtggtcgccgccacgatggcgaacgagatggggttcctagagaagactaagaaggatctcggtctgggttccatcgccacccaacagccagaaagcaatattctggacatagacttacgcccagcctccgcgtggaccctgtacgccgtcgcgaccacgttcgtaaccccgatgctgcggcatagcatcgagaattcgtccgtcaatgtgagcctcaccgccattgcgaatcaggccaccgtgctgatggggctgggcaaaggatggcccctcagtaagatggatatcggagtcccgctgctggccattgggtgctacagccaggttaaccccattaccctcacggcggcgctgttactcttgatcgctcactatgccatcataggccctggcctgcaggcgaaggccacccgtgaggcacagaagcgggccgccgcagggatcatgaaaaatcccaccgtggatggcatcacggtaatcgacctcgaccctataccctacgaccccaagttcgaaaagcagctgggccaggtgatgctgctaatactgtgtgttacccaagtcctgatgatgcgcacgacctgggccctctgcgaggccctgactctggccaccggtcccatctctactctctgggaggggaatcccggccggttctggaacaccacgattgccgtgagcatggcgaacatctttcgcgggtcctacctggccggggctggcttgctctttagcatcatgaagaacgcaaacaacactcgacgcgggacaggcaacatcggcgagaccctgggggagaaatggaagtcccgcctaaacgccctcggaaagagcgagttccaaatatacaagaagtcggggatccaggaagtggacaggacgctggcgaaggaggggatcaaacgcggggagaccgaccaccacgctgtctctcggggctccgcaaagctgcgctggttcgtggaacggaatatggtgaccccggagggtaaagtcgtggatctagggtgcggccgtgggggctggagttactactgcgggggtctgaagaacgtacgggaggtcaagggtctgactaagggcggccccgggcacgaggaacccatcccgatgtccacgtatggttggaacctggtgcgactgcagagcggggtagatgtctttttcatcccgcccgagaagtgtgacaccctgctgtgcgacatcggtgagtccagcccaaatccgaccgtagaggcagggcggaccctgcgcgttctgaacctcgtcgagaactggctgaacaatgacacgcaattctgcatcaaggtcctaaacccctacatgccctcagtgatcgagaaaatggaggcgctacagagaaagtacgggggagccctcgtccggaacccgctgagccgcaactcgacccacgagatgtactgggtgtccaatgctagcggtaacatcgtgtcctcagtcaacatgatctcccgcatgttgatcaaccggttcaccatgcgacacaaaaaggccacgtacgaacctgatgtggatctgggcagcggtacccggaacatcgggatcgagtccgagatccccaacctggacatcatcggaaagcgcatcgagaagatcaagcaagagcacgagacaagttggtattacgatcaggaccacccctataagacctgggcttatcacgggtcatatgagaccaagcagaccggcagcgcgagcagcatggtgaatggggtcgtccggttgctaacgaaaccgtgggatgttctgcctactgtcacccaaatggccatgaccgacacaacaccctttggccaacagcgtgtcttcaaggagaaagttgacacccgtacccaggagcccaaggagggtacgaaaaagttaatgaagatcactgctgagtggctctggaaggagctggggaagaaaaagactccccggatgtgcaccagagaagagttcatccggaaggtccggtccaacgccgccttaggggcaatcttcacggacgagaacaagtggaagtcggcccgggaggccgtggaagatagccgcttctgggagttggtggacaaagagcgtaatctgcatctagaagggaagtgcgagacctgcgtctacaatatgatggggaagcgcgagaagaagctcggggagttcggaaaggctaagggaagccgggccatttggtacatgtggctgggcgcgagattcctggaattcgaggccttaggcttcctgaatgaagaccactggttctcccgcgagaacagcctgtccggggtggaaggagaggggctccataagctggggtacatactgcgcgacgtcagcaagaaggaaggcggggccatgtacgccgacgacacagcaggatgggacacccgcatcacgctcgaagacctgaagaacgaggagatggtgacgaaccacatggagggggagcacaagaagctggctgaagccatcttcaagctcacctaccagaataaggttgtccgcgtgcagcggcccacgcctcggggcacggtgatggacattatcagccggcgtgaccagcgtggctccggccaggtgggcacctatggtctgaatacctttaccaatatggaggcacagctaattcgccaaatggaaggcgaaggggtgttcgagaacatccagcacctgacggtgaccgaggaggttgccgtgcagaactggctggcacgtgtaggcagagagcgcttgtcacggatggcgatctccggggacgactgtgtcgtgaagccactcgacgaccgcttcgctaacgccctgaccgctctgaacgacatggggaagattcggaaagacattcagcaatgggagcccagcaagggctggaacgactggacccaggtgcccttctgtagccaccatttccacgagctcatcatgaaagacgggcgcgtgctggtggttccctgcagaaatcaggacgagctgatcgggcgcgcgcggataagccaaggggccggctggtccctcagggagactgcctgcctgggcaaaagctacgcgcagatgtggagtcttatgtacttccataggcgcgaccttcgtctggccgcgaacgccatatgcagcgccgtcccctcccactgggtccccacaagcagaacaacctggtccatccacgccaagcacgagtggatgacaacagaggacatgctgactgtgtggaatagggtgtggatcagggagaacccctggatggaagataagacacccgttgagtcatgggaggagatcccttacctcggtaagcgggaggaccagtggtgcggctccctgatagggttaacgtcgcgcgccacatgggcgaagaatatccaggccgccatcaaccaggtgcgatccctaattggaaacgaggagtacaccgactacatgccgagcatgaagcgcttccggcgcgaggaagaggaggccggagtactttggtga

SEQ ID NO: 24967 - RNA, 9876 nt, synthetic construct
  misc_feature 1..9876: note = derived and/or modified CDS sequence (opt11) from DENV-2__FJ639702__SS-prME
  source 1..9876: mol_type = other RNA
accgccggggtgatcattatgctgatccccaccgcgatggcattccacctcaccacccggaacggggagccccacatgatcgtaggtcggcaggagaaaggaaagagcctccttttcaagaccgaggacggcgtgaacatgtgcaccctcatggccatcgaccttggggaactgtgcgaggatacaatcacctacaagtgccccctcctgcgtcagaacgagccagaggacatcgattgctggtgtaatagcaccagcacctgggttacctacgggacgtgcaccaccacgggagagcatcggcgcgagaagcgctccgtagccctcgttccacacgtggggatgggcctcgaaacccggaccgagacctggatgtcaagcgaaggcgcgtggaaacatgttcaacgcatcgagacctggattctgcggcacccaggcttcactatcatggccgcgatcctggcttacaccatcggtaccacgcactttcaacgggccctcatcttcatcctgctaaccgccgtagctccaagcatgaccatgcgatgtataggaatctccaaccgggacttcgtggagggggtcagcgggggctcctgggttgatattgtgctcgagcacggaagttgcgtgaccacgatggctaagaacaagcccaccctggactttgagctcataaagaccgaggcgaaagagcctgccaccctacgcaagtattgcattgaagccaagctgaccaatactactaccgagtcccgttgtcccacccagggcgagccctcgctgaatgaggaacaggacaagcgcttcgtgtgtaagcactccatggtagatcgtggctgggggaacgggtgtggactgttcggcaaaggcgggatcgtgacgtgcgcaatgtttacatgcaagaagaacatggagggcaaaatcgttcagccagagaacttagagtacactatagtgattacgccacacagtggagaggagcacgccgtgggaaacgatacgggtaagcacggcaaggagataaaaataacgccacagtcctcatccacagaggcagagcttaccgggtacggaacggtaaccatggaatgctcacctcgcaccggcttagatttcaacgagatggttttactgcagatggaagacaaagcctggctcgtccatcggcagtggtttctggacctgcccttaccctggctgccgggggcggacacccagggaagtaactggatccagaaggaaacattggtgaccttcaagaacccacacgcgaagaagcaggatgtggtggtgctcgggagccaggagggcgccatgcacaccgccctgaccggcgcgacagagatccagatgtcaagcggtaatctcctgtttacgggccacctgaagtgccgcctgcggatggacaaacttcagctgaaagggatgagctattctatgtgcaccggcaagttcaagatcgtaaaggaaatagcagaaacacagcatggaacgatcgttatcagagttcagtacgaaggcgacggcagcccctgcaagatcccctttgaaatcatggacctggagaaacggcacgttctcgggcgcttgataacggtgaacccgatcgtgaccgagaaggacagccccgtcaacatagaggcagagccgcccttcggggacagctacatcatcatcggggtggaaccaggtcaactaaagcttaactggttcaaaaaaggatcctctatcggccaaatgttcgagaccacaatgaggggcgccaagcggatggccattctgggggacaccgcttgggacttcggatccctcggcggtgtgttcacatctatggggaaggcactgcaccaagttttcggggcgatctacggcgccgccttttccggggtgagctggaccatgaagatcctgatcggtgtgataataacgtggatcgggatgaacagtcgcagcaccagtctgagcgtgtccctggttcttgtaggtgtcatcacgctgtaccttggggccatggtacaggctgattcgggctgcgttgtctcctggaagaacaaagaactcaagtgtggcagcggtatcttcataaccgacaacgtgcacacgtggaccgagcagtacaagttccagcccgaatcaccctccaagctggctagcgcgatacaaaaggcccacgaggagggaatctgcggcatacggtccgtgaccaggctggagaatctcatgtggaagcagatcaccccagagctgaaccacatcctatccgagaacgaggttaagctcactatcatgaccggcgatatcaagggaatcatgcaagccggcaagcgatccctgcgcccgcaacccaccgaactgaagtacagctggaagacctggggcaaagcgaagatgctcagtacggagagccacaatcagaccttccttattgatgggccagagaccgccgagtgcccgaacaccaaccgggcctggaactccctcgaagtggaggactatggctttggggtatttaccaccaacatatggctcaagctgcgtgagaagcaagatgttttctgcgacagcaaactgatgtccgctgctatcaaggacaaccgtgcggttcacgcggatatgggttactggatcgaaagcgccctcaatgacacatggaagatggagaaggcctcgttcatcgaagtaaaatcgtgtcactggcccaaatcccacaccctgtggtcaaacggcgtgctggagagcgagatgattatccctaagagcttcgcaggacccgtgagccagcataattatcggccaggctactacacgcagacggctgggccgtggcacctcggcaagttagagatggacttcgatttttgcgaagggacaaccgtggtcgtgaccgaggactgcggaaaccgggggccttccctgcgcacgactactgccagcgggaagctcattaccgaatggtgttgccggtcctgcacgctgcccccactgcggtaccgcggcgaggacgggtgctggtacggcatggagatccgccccctgaaggaaaaggaggaaaacctggtaaacagcttagttactgccggccacggtcaaatcgataacttctctctcggagtgttggggatggccttattcctggaggagatgctgcggacccgggtgggaactaaacacgcgatcctgctcgtcgccgtaagcctggtgaccctaatcaccggtaacatgtccttccgagacctcggccgagttatggtcatggttggtgccaccatgaccgacgacataggcatgggcgtcacgtacctggcactgctcgccgctttcaaggtacggccaaccttcgccgcaggtttgctgctccggaagttgacctcaaaggaactaatgatggccaccattgggatcgccttattatctcaatccacgataccggaaacaatccttgaattaactgacgcactggctctgggtatgatggtcctcaaaatagtgaggaacatggagaagtatcagttagcagtgacgatcatggcgatctcctgcgttccgaatgccgtgattctgcagaacgcgtggaaggtgtcgtgcacgatcctcgctgccgtatccgtctcccccctgttgcttaccagctcgcagcagaaggccgactggatccccctcgcactgaccattaagggccttaaccccacagctatctttctgacgaccctatcccggaccagcaagaagcgctcctggccgctaaacgaggccatcatggcagtagggatggtctctatcttggcgagctccctgctcaagaacgacatcccgatgaccggtcccctagttgcaggcggtttgttaacggtgtgctatgtgctgaccggccgtagcgccgatctggagttggagagggcaacggacgtcaaatgggaggaccaggcggaaatatccgggtcttcccccatcctatcaatcaccatttccgaggacggttccatgtccataaaaaacgaagaggaggagcagacgcttaccatactaatccgcactggcctgctggttatcagcgggctcttccccgtgtccatccccattacggccgcggcctggtacctgtgggaggtcaaaaagcagcgcgcaggcgtactttgggatgtcccaagccctccgcccgtaggtaaggcggagctcgaggacggcgcctaccgtatcaagcagaaagggatcctggggtacagtcagatcggcgctggggtatacaaggagggaacctttcatacgatgtggcacgtgacccgcggggcagtattgatgcaccggggcaaacgcatcgagcccagctgggccgacgttaagaaggacctcatctcatacgggggcggttggaagctagaaggggagtggaaggagggggaggaggtgcaggtgctggcactcgagcccggcaagaatcccagagcagtgcagaccaagccgggactgttcaagaccaacacgggtaccatcggcgcggtcagtcttgacttttcccccggtacgagcgggtcccccatcgtggatagaaaaggaaaggtcgtcgggctatatggaaacggagtggtgacacgaagcggggcttatgtcagcgcaatcgcgcagacggaaaagtcgattgaggacaacccagaaatcgaggacgacatattccgcaagaagcggcttaccatcatggacctccacccgggcgcaggaaagacaaagcgctacctgccagccatagtgcgggaggccatcaagcgcggccttaggaccctgatcctggcgcccacgcgcgtggtcgccgcggagatggaagaagccctccgcggtctgcccatcaggtatcagacgcccgccatacgcgccgagcacaccgggcgggagattgtggacctgatgtgccacgcaacatttactatgcggctcctgagcccggtgcgggtcccgaattacaacctgatcatcatggatgaagcgcacttcaccgatcccgcgtccattgctgcaaggggctacataagcacacgggtggaaatgggcgaggccgcgggaatcttcatgaccgccactccccccgggagtaaggacccgttcccacagagcaacgcccccattatggacgaggaacgcgagattcctgagcgcagctggaacagtggacacgagtgggttaccgactttaaaggaaagacggtctggttcgttccgtccatcaaagcaggcaacgacatagccgcctgcctccgcaagaacggaaagaaagtgatccagctaagccgaaaaacattcgacagtgaatacgtcaagacgcgcaccaacgactgggacttcgttgtcactaccgatatttcggagatgggggccaatttcaaggcggagcgggtcatcgacccccggcgttgcatgaaaccggtgatcctgacagacggcgaggagcgcgtgattctcgccggacccatgcccgtcacgcactccagcgcggcccagagacgcggccggataggacgcaaccccaaaaacgaaaacgaccaatacatctacatgggcgagcccctggagaacgatgaggattgtgcacattggaaagaagcaaagatgctgctagacaacatcaacacccccgagggcatcatccccagtatgttcgagcccgagcgcgagaaggtggatgccattgacggcgagtaccgattacgcggcgaggctcgcaagacgttcgtggacctgatgcgccggggagaccttcccgtctggctagcttatcgagtggccgcggagggcatcaactacgcagacagacgctggtgttttgacggggttaagaacaatcagatcttagaagagaatgtcgaagtagaaatctggacgaaggagggcgagcgcaagaagttaaagccacgttggcttgatgcgcggatctacagcgatccactggccctcaaggagtttaaggagttcgcagcaggccgcaaatccctcactctgaacctcatcaccgaaatgggccgcctgcccactttcatgacccagaaggcgcgagacgcgctggacaaccttgctgtgctccacaccgccgaggcgggcggacgggcatacaaccacgcgttatctgaacttcccgaaaccctggagaccttgctcctgttgacgctgctagcaaccgtcacaggcggagtcttcctgtttctcatgtccggcaagggagtcggcaagatgaccctcggaatgtgctgcatcattacggcctctatcctgctctggtatgcccaaatccagccgcactggatcgcagcaagcataattttagagttcttcttgatcgtactcctgatccccgagccagaaaagcagcgcacgccacaagacaatcagttaacctacgtggtcatcgccatactgaccgtggtcgccgccaccatggctaacgagatggggttcctggagaaaactaagaaggacctgggcttgggctccatcgccacccaagaacccgaatccaacatcctcgacatcgacctccggcccgcctccgcctggacgctatacgcggtcgcaaccacattcgtaacacccatgctgcgccacagcatcgaaaactccagtgtgaatgtctccctgaccgcgatagccaaccaggccaccgttctcatggggctgggcaagggatggcccctgagcaagatggacataggagtgcccctcctggccatcgggtgctactcccaagttaatcccgtgacgcttaccgccgctctcctgctcttggttgctcactacgccatcatcggcccaggtctgcaggccaaggctacacgagaagcgcagaaaagagccgccgccgggatcatgaaaaaccccaccgtcgacggcatcacggtgatcgacctggacccgatcccctacgatcccaagtttgagaagcagctcgggcaggtcatgctcctgatcctctgcgtcacccaggtcttaatgatgcggaccacctgggccctatgcgaggcactaactctggcaaccggtcctatcagtaccctgtgggaggggaacccaggccgattctggaataccactatagccgtgagcatggcgaatatattccgaggcagctacctggccggggctggccttctgttttcgatcatgaaaaataccaccaacacgcggcgcggaacgggtaacatcggggagaccctcggagaaaagtggaagtcccggctgaacgctctgggtaagtccgagttccagatctataagaagtccgggatccaggaagtagaccgcaccttggcgaaggaaggcatcaagaggggggagaccgatcaccacgccgtgagccgcgggtccgccaaactccggtggttcgttgagcgcaacatggtcacccccgagggaaaggtggtcgacctgggttgcggccgcggcggctggtcctattattgcggcgggctcaagaatgtgaaagaggtgaaagggctgacgaagggcgggcccgggcatgaggagcccatcccaatgagcacttacggctggaacctggtacgcctgcagagcggggtcgatgtgttctttacgccgcctgagaagtgcgacacgttactgtgcgatatcggcgagtccagcccaaacccgacgatagaagctgggcgaaccctgcgcgtgctttccctggtggagaactggctcaacaatgacacacaattctgtataaaagtcctcaatccatatatgcctagcgtgattgagaagatggagactctgcaacggaaatacggaggcgccctggtgcggaatccgctaagtagaaacagcacgcatgagatgtactgggtatctaacgcgacggggaatatcgtgagctccgtgaacatgatcagtcgcatgctcataaaccgtttcaccatgaagcataagaaggctacctacgagcccgatgtggacctgggctctgggacccgtaacatcggtatagagagcgaaatccccaaccttgacatcatcggcaaacggatcgagaagataaagcaggaacacgaaacctcatggcactatgaccaggaccacccctacaaaacgtgggcgtaccacgggagttatgagaccaagcagactggctccgccagctccatggttaacggggtagtccgcctgctaaccaagccgtgggatgtagttccaatggtaacccagatggcaatgaccgatacgactcccttcggccagcagcgtgtctttaaggaaaaggtcgacacccgcacccaggagcccaaggagggcacgaaaaagctgatgaaaatcaccgctgagtggctgtggaaggagctgggtaaaaagaagaccccgcgcatgtgtacccgagaggagttcacgcgcaaagtgaggagcaacgcagccctcggcgccatcttcacggacgagaacaagtggaagtccgctcgcgaggcggtggaagacagccggttctgggagctggtggataaggagcggaatctgcatctggaggggaaatgcgagacctgtgtgtacaacatgatggggaagcgggagaagaagcttggcgagtttggcaaggcgaagggctcgcgcgcgatttggtacatgtggctaggggcgagatttctcgaatttgaagcgctaggcttcctgaacgaggaccattggttctcccgcgagaattctctgtcgggggtagaaggcgaagggttgcacaagctgggctacatcttgcgagacgtaggcaagaaggagggcggggccatgtacgccgacgacaccgcagggtgggatacgcggatcactctggaggatctgaagaatgaggaaatggtgaccaaccacatggaaggagagcacaagaagctcgccgaagcgatctttaagctgacctatcaaaacaaagtggtgcgggtgcagcgtccaacgccccgggggaccgtcatggacataataagccgccgcgaccaaaggggctctggccaagtgggcacttacggcctgaataccttcactaacatggaagcccagctcattcggcagatggagggcgagggcatattcaagtccatccagcacctaaccgccactgaggagatcgctgtgcagaactggcttgcccgcgtcggccgcgaacgcctctccagaatggcgatctcgggggacgactgcgtggtcaagcccctcgacgaccgattcgcgtctgctctgacggccctcaatgatatgggcaaggtccgcaaggatattcagcagtgggagccaagccggggctggaatgactggacccaagtacccttctgttcccaccacttccacgaactaattatgaaggacggccgcgtgctggtcgtgccttgccggaaccaagatgagctcatcgggcgcgcacgtatcagccagggggcgggatggtcattgaaagagactgcctgcctgggcaaaagctacgcgcagatgtggtccttgatgtacttccatcgccgggacttgagattggccgcgaatgcaatctgcagcgccgtgccatcccactgggtcccgaccagccggaccacctggagcatccacgccaagcacgaatggatgacgaccgaggacatgctaaccgtgtggaaccgcgtatggatacaagagaacccttggatggaggacaagactccagtggagtcatgggaggaggttccctaccttggcaagcgggaggaccagtggtgcgggtctttaatcggcctcacttctcgcgcgacctgggcgaagaatattcagaccgccatcaaccaagtccggtctctgatcgggaatgaggagtacaccgattacatgccgtctatgaagcgtttccggcgggaggaggaagaagccggcgtcctttggtga

SEQ ID NO: 24968 - RNA, 9876 nt, synthetic construct
  misc_feature 1..9876: note = derived and/or modified CDS sequence (opt11) from DENV-2__GQ868621__SS-prME
  source 1..9876: mol_type = other RNA
tctgcggggatgataataatgctgatcccaacagtaatggccttccatctcaccacccgcaacggtgagccccacatgatagtcggcatccaagagaaagggaagtccttgttattcaagactgaagacggcgtcaacatgtgcactctcatggcgatggatctgggggagctgtgcgaggacactatcacctacaagtgtcccctcctgcggcagaacgaacccgaggacatcgactgctggtgcaacagcaccagcacgtgggttacgtatgggacctgtaccacaacgggcgagcaccgccgcgagaagcgctctgtcgccctggtcccccacgtggggatgggactcgagacccgtaccgagacctggatgtccagcgaaggggcctggaagcacgcccagcgcatcgagacttggatcctgcgacaccctggtttcacgataatggccgcgatcctggcctacaccatagggaccacccactttcaacgcgtcctcatcttcatcctactgacggccgtcgcccccagcatgactatgcggtgtatagggatcagcaaccgtgacttcgtggagggcgtctctggcggaagctgggtggacatcgtcctcgagcacgggtcctgcgtaaccaccatggcgaagaataagcccacgctggacttcgagctgataaagaccgaggccaagcaaccggcaactctccgtaagtactgtatcgaggccaagctgaccaacacgaccaccgagtcccgctgtcctacccaaggcgagccctccctgaaggaggagcaggacaagcggttcgtgtgcaagcacagtatggtagaccgcggctgggggaatggttgcggcctgttcggcaagggcgggatcgtcacttgcgccatgttcacttgcaaaaagaacatggagggcaagatcgtgcagcccgaaaacctggagtataccatcgtcgtcacgccacactcaggggaggagcatgcggtaggaaacgacacggggaagcacggtaaggagattaaggtgaccccgcagagttccatcaccgaggccgagctgactggctacggaaccgtaacgatggagtgcagcccccggacgggcttggacttcaacgagatggtactgctacagatggagaacaaagcgtggctcgtacacagacagtggttcctggacctgcccctcccctggctaccgggggcagacaagcaggaatctaattggatacaaaaggagacccttgttacgtttaagaaccctcacgccaaaaagcaggacgtggtcgtactcggctcacaggagggggcgatgcacacggccctgacgggagcaacagaaatccagatgagctctggaaatctcctgttcaccggccacctgaagtgccggctgcgcatggacaagctccagctcaaagggatgagctactccatgtgcactggcaagttcaaagtcgtcaaggagatcgccgagacccagcacggcacaatcgtgataagagtccaatacgagggagacggaagcccgtgcaagatccctttcgaaatcatggacttggaaaagcgctacattctcggccggctcattaccgtcaacccgatcgtgacggagaaagactccccggtaaacattgaggccgagccgccctttggagacagctacatcataatcggcgtcgagccgggacagctcaagctcaattggtttaaaaagggctccagcatcgggcagatgttcgagaccaccatgcgcggcgcaaagcgcatggccatcctgggagataccgcctgggacttcgggtctctaggcggggtgttcacgagcatcggcaaggccctccaccaagtgttcggggcaatctatggggccgcgttctccggcgtcagctggaccatgaagatcctgatcggggtgatcattacctggatcggcatgaatagccggagcacctccctgtcggtgtccctggtcctcgtcgggattgtcacgctttacctgggcgtcatggtgcaggccgacagcgggtgcgtggtctcctggaaaaacaaagagctcaagtgcggcagcggaatctttatcaccgacaacgtacacacctggacagagcaatataagttccagcctgagtccccctccaaactggccagcgcgatccagaaagcgcaggaagagggaatctgtgggatcaggtcggtgacacggctggagaacctcatgtggaagcagatcacacccgagctgaatcacattctggccgagaacgaggtcaaactcaccatcatgaccggcgacatcaagggcatcatgcaggccgggaagagaagcctgcggccgcaacctaccgagctgaagtactcctggaaaacgtggggcaaggcaaagatgttaagcaccgagtcctacaatcagaccttcctaatcgatggacctgaaacggcggagtgccccaacaccaatcgcgcctggaacagcctggaggtggaggactacggcttcggcgtgttcactactaatatctggttaaagctgaaggagaagcaggatgcattttgcgactccaagctgatgagcgccgccattaaggacaaccgggcggtccacgccgacatggggtactggatcgagtccgcccttaacgatacctggaagatcgagaaggccagctttatcgaggttaagaattgtcactggcccaagtcccatacgctctggagcaacggcgtgctggagtccgagatgatcatccctaaaaacctcgctggccccgtcagccagcacaactaccgaccgggttaccacacccaaatagcgggcccctggcacctggggaagttggagatggacttcgatttctgcgacggcaccaccgtaattgtgacggaggactgcgggaaccggggcccctccctccgcaccaccaccgccagcggcaaactgataacagagtggtgctgcaggagctgtaccctgcccccgctgcgctaccgcggggaggacggctgttggtacgggatggaaatccgccctctgaaggaaaaggaagagaacctggttaacagcctcgtgacagccgggcacggccaggtggacaacttcagcctgggcgtcctcggcatggccctattcttggaggagatgttgcggacccgtgttgggacgaagcacgcgatcctcctagtggccgtctccttcatgaccctgatcaccggcaacatgtctttcaaggatctcggacgggtggtggtcatggtgggggccacaatggccgacgacatcggtatgggcgtgacgtacctggccctcctcgcggccttcaaggtgcgacctaccttcgcagccggcctgctgctccggaagttgacttccaaggagctgatgatgactaccattgggatagtgctcctgagccaatccacaatccccgaaaccgtactggagctcacagacgcattggcgcttggcatgatggtcctgaagatcgtgcgcaacatggagaagtaccagctggccgtcacaatcatggccattctgtgtgtcccgaacgccgttatcttgcagaacgcatggaaggttagctgtaccatcctggcggtggtgtccgtcagccccttactactgacctccagtcaacagaagacagactggatccccctggccctcacgatcaaagggctgaaccccaccgccatctttctgactaccctctcccgcacgaacaagaagcggagctggccgctgaatgaagcaattatggcagtcggcatggtgagtatccttgccagctccctcctaaagaacgacatacctatgaccggccctttagtcgcggggggcctcttaacagtctgctacgtgctgaccgggcgcagcgccgacctcgagctagagcgtgccacggacgtcaagtgggaggaccaggccgagatcagtggctcttcgcccatcctgtccatcaccatcagcgaagacgggagtatgtctattaagaacgaggaggaggaacacaccctcaccatcctgatacgcactggcctgcttgtgatttcaggcctgtttccaatcagcatccccatcaccgccgccgcctggtacctgtgggaagtcaagaaacagcgggcaggggtcctctgggacgtgcccagtccgccacccatgggtaaggcagagctcgaggacggagcctatcgcattaagcagaagggcatactggggtactcccagatcggggccggcgtttacaaagagggtaccttccacaccatgtggcacgtcacccgaggcgccgtgctcatgcacaaggggaaacgaatcgagccttcatgggccgacgtaaagaaggatctgatcagctacggcgggggctggaaattggagggcgaatggaaagagggcgaggaggtacaggtgctcgcgctggagcccggtaagaacccccgggccgtgcaaacgaaaccagggctgttcaagaccaatactggcaccatcggggccgtctccctcgacttttcgcccggtacgtcaggcagcccgatcatcgacaaaaaggggaaggtggtgggcctgtacgggaacggagttgtgacacgctccggggcttacgtgtctgcgattgcgcaaaccgagaagtccatcgaagacaatcccgaaatcgaagacgacatcttccggaagcgcaggctgaccatcatggacttacacccaggggctggcaagacgaagcgctacttacccgccatcgtccgtgaagccataaagcgcgggctgcggacgctgatcctcgcgccaacacgcgtggtggccgccgagatggaggaggccctgaggggcctgcccatccgctaccagacccccgccatcagagcggagcacactggacgagagattgtcgacctcatgtgccacgccacgttcaccatgcggctattgagcccggtgcgcgtcccgaactacaacctcattatcatggatgaggcccacttcaccgaccccgcctccattgccgcgcgcggctacatttcaacgcgggtggagatgggcgaggccgccgggattttcatgaccgcgacgccgcccggtagcagagacccgttcccccagagtaacgcccccatcatcgacgaggagcgggagatccccgagcgcagctggaattccggtcacgagtgggtgaccgattttaagggcaaaacggtgtggttcgtcccgagcatcaaggcggggaacgacatcgcagcgtgcctgcggaagaatggcaagaaggtgatccagctgtcacgcaagaccttcgacagcgagtacgtgaagacccggacaaatgactgggacttcgtcgtgaccaccgacatctccgaaatgggcgccaacttcaaggcagagcgcgtaatcgacccccggcgctgcatgaagcccgtgatcctcaccgacggggaggagcgggtgatcttagccggacccatgccggtgacacacagctctgccgcacagcgtcgggggcgcattggccggaaccccaagaacgagaacgaccagtacatatatatgggggagcccctggagaacgacgaggactgtgcgcactggaaggaggcgaagatgttactggacaacatcaacacgcccgagggcatcatcccgagcatgttcgagcccgagcgcgagaaggtcgacgccatcgatggcgagtacagattacgcggggaggcccggaagaccttcgtggacctgatgcggcgcggggatctacccgtttggctggcctacaaagtggccgcggaggggatcaactacgccgatcggcgctggtgcttcgacggcattaagaacaaccaaattctcgaagagaacgtggaggtggagatctggactaaggagggggagcgcaaaaagttaaagccgcgctggctggatgcacggatctattccgatccgctggccctgaaggagttcaaggagttcgctgcgggtcgcaagagcttgaccctgaatttaatcacggagatgggccggctgcccacctttatgacccagaaaactcgcgacgccctagacaatctggccgtcctgcacacggccgaagccggcggacgggcctataatcacgccctctccgagctgcccgagaccctagagaccctactgctgctcaccctactggccacggtgacagggggcatcttcttgttcctgatgtcaggacgcggaatcggcaagatgacactagggatgtgctgtatcataaccgcgtccattctcttgtggtacgctcaaatccagccgcactggatcgccgcctctattatcttagagttcttccttatcgtcctactgatccccgagcccgagaaacaacgcacgcctcaggacaaccaactcacgtatgtggtcatcgcaatattgacggtagtggccgccacgatggccaatgagatgggcttcctagagaagaccaagaaggacctcgggctggggagtattgccacgcagcagccggagagcaatatcctggatatagacctccgccccgcctccgcgtggaccctatatgcggtagccaccacgttcgttacgccgatgcttcggcacagcatcgagaacagctccgttaatgtgagcctcaccgcaatcgccaaccaggccaccgtcttaatgggcctggggaagggatggcccctatccaagatggacattggggtgcctctgctggcgattggctgctactctcaagtgaaccccatcaccctcacggcagcgttactgttgctggtcgcgcactatgcgataatcggtcccgggctgcaggccaaggccacccgcgaggcacagaagcgggccgcggccggcatcatgaaaaacccaaccgtggacggtatcacggtgatcgacctcgaccccatcccctacgaccccaagtttgagaagcagctgggccaggtcatgctgttaatcctgtgcgtgacccaggtgctgatgatgcgcaccacctgggccctctgcgaagcgctgaccctggcaacggggcccatatccacgttgtgggagggcaacccgggtagattctggaacaccactatagcagtcagcatggccaacatcttccgcggctcctacctggctggcgccgggttgctcttcagcatcatgaagaacacgaccaacaccagacgcggcacggggaacatcggggagacgctgggcgagaagtggaagtccaggctgaacgccctcgggaagtccgagttccagatatataagaagtccgggatacaagaggtggaccgtaccctggcgaaggaggggatcaaaagaggcgagacagaccaccacgccgtcagccggggatccgccaagctgcgctggttcgtcgagcggaacatggtgacacccgagggcaaggttgtggacttaggctgtgggcgcggcgggtggagctactactgcggcgggctgaagaatgtacgggaggtaaagggcctgacgaagggcggccccggacacgaagagcccattccaatgtccacctacgggtggaacctcgtccgcctgcagagcggagtagacgtgttcttcattccgcctgagaagtgtgacacccttttgtgcgacataggggaatccagccccaacccgaccgtggaggccggcagaacgctgcgagtcctgaacctcgtggaaaattggctgaataataacactcagttttgtatcaaggtcctcaacccctatatgccctctgtgatcgagaagatggaggcgttacagcggaaatacggcggggcactcgtcaggaaccctctaagccggaacagcacccatgagatgtattgggtctccaatgcgagcggtaatatagtctccagcgtgaacatgatctcccggatgctcattaaccggttcaccatgcgacacaagaaggccacctatgaacccgacgtcgacctcgggagcggcacgcggaacatcgggatcgagagcgaagtaccaaacctggacatcataggaaaacgcatcgagaagataaagcaggagcacgagaccagctggcactacgaccaggaccacccctacaagacctgggcctaccatgggagctacgaaaccaagcagacggggagcgcgtcctcaatggtgaacggcgtcgtgcggctgttgaccaagccgtgggacgtgctgcccaccgtaacccagatggccatgacggataccaccccctttgggcaacaacgcgtgttcaaagaaaaggtagatacccgcacgcaggagcccaaagagggcaccaagaagctgatgaagatcaccgccgagtggctctggaaggaactgggcaagaagaagaccccgcggatgtgcactagagaggagttcacccggaaggtccgctctaacgccgccctgggggctatcttcaccgacgaaaacaagtggaaatccgcccgtgaggccgttgaggactcacgcttttgggagttggtggacaaggagcggaacctgcacttagaaggcaagtgcgagacgtgtgtctataacatgatggggaagcgcgagaagaagctcggcgagttcgggaaggccaagggctcgcgggcgatctggtacatgtggctgggcgcgaggttcctggagttcgaagccctcggctttctgaacgaggatcactggttctcccgggagaacagcctgtctggcgtggagggggaggggttgcataagctgggctacattctgcgcgacgtaagcaagaaggagggcggcgccatgtacgccgacgacacggcggggtgggacacgcgaatcactctcgaggacctgaagaacgaggagatggtcaccaaccacatggagggtgagcacaagaagctggccgaagccatcttcaagctcacgtaccagaataaggtggtcagagtgcagaggcccacgccccgaggtaccgtgatggacatcatcagcaggcgcgatcagcgtggctccgggcaagtcggcacctacggtttaaacacgtttacgaacatggaggcccagctgatccgccagatggaaggggagggcgtgttcaaaaacattcagcacctgaccgtgaccgaagaagtcgcagtgcagaactggctggcgcgggtggggcgcgagcgcctgtcgcgtatggccatatccggtgatgactgcgtggtgaaaccgctcgacgaccgctttgccaacgcattgaccgccctgaacgatatgggcaaaatccggaaagacatccagcagtgggagcctagcaagggttggaatgattggacccaggtgcccttctgctcccaccacttccacgagctcatcatgaaggacggacgcgtcctagtggtgccctgcagaaatcaggacgagttgatcgggcgcgcgcggatctcccaaggcgcaggatggagtctccgcgagaccgcctgtttggggaagagctacgcccagatgtggtccctcatgtacttccaccggcgagacctccggctcgcagctaacgctatctgcagcgccgtaccctcccattgggtgccgacctctcgcaccacatggtcaatccacgccaagcacgaatggatgacgaccgaagacatgcttaccgtgtggaaccgggtttggatccgcgagaacccgtggatggaagacaagacgcccgtggagagctgggaagagattccctacctcggcaagcgggaggaccagtggtgcgggtccctgatcggcctgaccagccgcgcgacctgggcgaagaacatccaggccgccatcaaccaggtgcgtagtctcatcgggaacgaggagtataccgactatatgccaagcatgaagcgcttccggcgcgaggaggaggaggccggggtcctgtggtag

SEQ ID NO: 24969 - RNA, 9876 nt, synthetic construct
  misc_feature 1..9876: note = derived and/or modified CDS sequence (opt11) from DENV-2__FJ639704__SS-prME
  source 1..9876: mol_type = other RNA
tctgcgggaatgatcatcatgcttatccccaccgtggtggccttccacctcaccacccggaatggggagccccatatgatcgtgggcatccaggaaaaagggaagtccctgctgttcaagaccgaagacggcgtgaacatgtgcaccctcatggcgatggacctgggggaactgtgcgaagacaccatcacctacaagtgcccgctactgcggcagaatgagccggaggacatcgactgttggtgcaacagcaccagcacctgggtcacctacggtacctgcaccaccaccggggagcaccgccgggaaaaacgctcggtagccctggtgccccacgtcgggatgggcctcgagacacggaccgagacgtggatgtctagtgagggggcctggaagcacgcccagcggatcgagacctggatcctgcggcacccgggtttcacgatcatggccgctatactggcctacaccatcgggaccacccacttccagagagcccttatcttcatcctcttgacggccgtcgcgcccagcatgaccatgcggtgcataggcatctctaaccgcgacttcgtggagggcgtctccgggggaagctgggtggacatcgtcctggagcacggtagttgcgtcaccaccatggccaagaacaagcccacgctggacttcgagttaatcaagaccgaggccaagcagcctgccaccctccggaagtactgcatcgaggccaagctgaccaacacgaccaccgaaagccgctgcccgacccagggcgagccgtccctgaaggaggaacaggacaagcgattcgtgtgcaagcactcaatggtggaccgtggatgggggaacggctgcggcctgttcggaaagggcgggattgtcacgtgcgcgatgttcacgtgcaagaagaacatggagggcaagattgtgcagccagagaacctggagtacaccatcgtggtcaccccgcactccggagaagaacacgccgtcggcaacgacacggggaagcacggcaaggagatcaaggtgacaccgcagagcagcataacagaggccgagctgaccgggtatggcaccgtcacgatggagtgcagcccccggactggactcgacttcaacgaaatggtcctgctgcagatggagaacaaggcctggctggtgcaccgacagtggttcctggacctgcccctcccctggctgccaggggccgacaagcaggagtccaactggatccagaaggagaccctggtcaccttcaagaacccccacgcgaagaagcaggatgtcgtggtcctcggtagtcaagagggggccatgcacacggccctgactggcgctaccgagatccagatgagctccggtaatctgctgttcacgggacacctgaagtgccgtctccgcatggacaagctccagctgaagggcatgagctactccatgtgcacgggcaagttcaaggttgttaaggaaatcgcagaaactcagcacggcaccatcgtgatccgggtgcagtatgaaggagacgggagcccctgcaagattcctttcgagatcatggacctggagaaacgttacgtcctcggccggttaatcaccgtgaaccctatcgttaccgagaaggactcccccgtcaacatcgaagcggaaccgcccttcggggacagctacataataatcggcgtggagccaggtcagctgaagctcaactggtttaagaagggctccagcatcgggcaaatgttcgaaactaccatgcgcggcgccaagcgcatggccatcctgggcgacacagcttgggatttcgggagtctgggcggagtgttcacgagcatcggcaaggccttacaccaggtcttcggtgcgatctacggcgccgccttttccggggtgagctggaccatgaaaatcctaatcggggtgatcatcacctggatcgggatgaactcccggagcacatccctgagcgtatctctggtgctagtggggatcgtcacgctatacctgggggtgatggtccaggccgacagcgggtgcgtcgtctcctggaagaacaaggagctcaaatgcggaagcggcatcttcatcaccgacaacgtgcacacgtggaccgagcagtacaagttccagcccgagagcccctccaagctggcgagcgccatccagaaagcccaggaggaagggatttgtggcatccgatccgtcactcggctggagaacctcatgtggaagcagataacccccgagctgaaccacatcctggccgaaaacgaagtgaagctcaccatcatgaccggcgatatcaagggaatcatgcaggctgggaaacgcagcctgcgtccgcaacccacggagctgaaatattcctggaagacctggggcaagaccaagatgttaagcaccgagtcctacaaccagacgttcctgattgacgggcccgagaccaccgagtgcccgaacaccaatcgggcatggaacagcctggaggttgaggactacgggttcggcgtcttcaccaccaacatctggttaaaacttaaggagaagcaggacgcgttctgcgactccaaacttatgagcgccgccataaaggataaccgggccgtgcacgcagacatggggtactggatcgagtccgccctcaacgacacctggaagatcgaaaaggccagcttcatcgaagtgaagaactgtcactggccaaaatcccacaccctgtggagcaacggcgtcctagagtccgagatgatcattcccaagaacctcgccggccccgtgtctcagcacaactaccgacccggctaccacacccagatcgccgggccctggcacctagggaagctagagatggacttcgacttttgcgacggcacgaccgtgatagtgaccgaggattgcgggaacagagggccctccctccgcaccacgactgcgtcgggcaagctgatcactgaatggtgctgccggagctgcaccctgcctccgctccgctaccgcggggaggacggatgctggtacgggatggagatccgccccttaaaggagaaagaggagaacctggttaactccctcgtcacggccggccacgggcaggtcgacaatttttcgctgggcgttttgggcatggccctgtttctagaggagatgctgcgtactagggtggggaccaagcacgcaatcctcctggttgcagtgtccttcgtgaccctgatcacgggcaacatgagcttcaaggacctcgggcgggtcgtggtgatggtcggtgccaccatggcggacgacatcggaatgggcgtgacctacctggccctactcgcggcgttcaaggtgcgccccacgttcgccgccggcctgctgctccggaagctgacgtctaaagagctgatgatgactactattgggattgtcctcctgagccaatccaccatccccgagacgatccttgagctcaccgacgccttggccttagggatgatggtgctcaagatcgtgcgtaacatggagaagtaccagctggcggttaccatcatggcaattctgtgtgtgccgaacgccgtgatcctccaaaacgcgtggaaggtgagctgcaccatcctagccgtggtctccgtgagccccctgcttctgacgagcagccaacagaaggcggactggatccccttagcccttacaatcaagggcctgaatcccacagccatcttcctgacaaccttgtcgcgcaccaacaagaagcgtagctggccgctgaacgaggcgatcatggcggtgggcatggtctccatcctggcctctagtctcctgaagaacgatatacccatgaccggccccctggtggccgggggcctcctcaccgtgtgctacgtcctgacgggtcggagcgctgacctagagctggagcgggcaacagacgtgaaatgggaggagcaggcggaaatctccggcagtagccctatcctatccatcacgatcagcgaggacgggtccatgagcatcaagaacgaggaggaggagcagaccctaacgatcctgattcgaaccggcctgctcgtgatctcgggcctgttcccgatctccatccccatcaccgcagccgcatggtatttgtgggaggtcaagaagcagcgggccggcgtgctatgggacgtgcccagcccgccgcccatgggcaaggcggagctggaagacggggcctaccgcatcaaacagaagggaatcctggggtactcccagataggcgccggagtctacaaggagggaacctttcacaccatgtggcatgtgacgcggggcgcagtgctcatgcacaaaggtaagcgcatcgagccctcctgggcggacgtcaagaaggacctcatcagctacggcgggggctggaaactggagggagagtggaaggagggagaagaggtccaggtgctcgcgctggagccgggcaagaacccacgggccgtccagaccaagcccggtctgttcaagactaacacaggcacgatcggggccgtgtcgttggacttcagcccaggaacctcgggcagccctatcatcgacaagaaggggaaggtggtgggcctgtacgggaatggtgtcgtaacccgctccggcgcctacgtcagcgccattgcacagacagagaagtccattgaggataaccctgagatcgaggacgacatcttccggaagcgccggctgaccatcatggacctccaccccggggccggcaagaccaagaggtatctccccgccatcgtgcgcgaggccataaaacgcgggctgcggaccctgatcctcgcgcccacccgcgtggtcgccgcggagatggaggaagcattacgcggcctgcccattcgctaccagacgcccgcaatccgggcggagcacaccggtcgcgagatcgtagaccttatgtgccacgccaccttcaccatgcgcctgctatcgcccgtgcgggtcccgaactacaacctcatcatcatggacgaggcccactttacagaccccgcctccatcgccgcccgcggttatatctcgacccgggtggagatgggcgaggccgccggcatcttcatgaccgcaacgccgcctggcagccgcgacccgttcccccagtccaacgcccctattatcgacgaggagcgggagatcccagaacgctcctggaactccggacatgaatgggtgacggacttcaagggcaaaaccgtctggttcgtaccgagcatcaaggcggggaacgacatcgccgcctgcctgcggaagaacggtaagaaggtgattcagctgtcccgcaagacctttgattcagagtacgtgaagactcggacgaacgattgggacttcgttgtgaccacggacatctccgagatgggcgccaacttcaaagctgagcgcgtcatcgacccccgccgctgcatgaagcccgtgatcctcaccgacggggaggagcgggtgatcctcgccgggccgatgccagtcacgcacagctccgccgcccagcgccgtgggcgcatcggccggaaccccaagaacgagaatgaccaatacatctacatgggtgaacccctcgagaacgacgaggactgcgcccattggaaggaggcgaaaatgctcctggacaacatcaacactccggagggcatcatccctagcatgttcgaacccgagcgcgagaaggtggatgccatcgacggcgagtaccggctgcgcggggaggcccgcaagacgttcgtggacctcatgcggcgcggagacctgccggtatggctggcctacaaagtggccgcggaggggatcaattacgccgaccggcgctggtgcttcgacggcatcaagaacaaccagatactcgaggagaacgtggaggtggagatctggaccaaagagggggagaggaagaaactgaagccccgctggctggacgcgcggatatattccgacccccttgccttaaaagagtttaaggagttcgccgcgggccgtaagagcttaacattgaatttgatcaccgagatgggccggctccccaccttcatgacccagaaaacccgcgacgccctagacaacctggccgtgctgcacaccgcggaggccggtgggcgcgcctacaaccacgcgctctccgagctgcctgagaccctggaaaccctcctgctgctcacgctgctggccaccgtcaccgggggcatcttcctattcctgatgtcaggccgggggatcggcaagatgaccctggggatgtgctgcatcatcaccgcctccatcttgctatggtacgcgcagatccagccgcactggatcgccgccagcatcatactggagttcttcttaatcgtgcttttgatccccgagcccgagaagcagcgaacgccccaggacaaccagctcacctacgtagtcatcgcaatactaaccgtcgtggccgcgaccatggccaatgagatggggttcctggagaagaccaagaaggacctcgggctggggtccatcgccacccagcaaccggaaagcaacattctggacatcgacctcaggcccgcctccgcctggaccctgtacgcggtcgccaccacgtttatcacccccatgctgcgccacagcatcgaaaactcctccgtgaacatcagcctcaccgcaatcgcgaatcaagccacggtgctgatgggcctcgggaagggttggccgctctcgaagatggacattggggtaccgctgctggcgatcggctgctacagccaggtaaaccccatcacgctcacagccgccctgctgctcctggtcgcccactacgcaatcattgggcccggcctgcaggccaaggcgacccgcgaggcgcagaagcgggcggcggcgggtatcatgaagaaccccaccgttgacggaattacggtgattgatctggaccctatcccctacgacccgaagttcgaaaagcagctgggccaggtgatgctgctcatcctgtgcgtcactcaggtactgatgatgaggacgacgtgggccctttgcgaggctctcacgctggccaccgggcccatctcgaccttgtgggagggcaacccggggaggttctggaacaccacgattgctgtgtcgatggccaacatcttccgcggctcctacctggccggcgccgggctcctattcagcatcatgaagaacaccaccaacactcggcgcggcacggggaacatcggcgagaccctgggcgagaagtggaaatcccgcctgaacgccctcggtaagtccgagttccagatctacaagaagtccggcatccaagaggtcgacaggaccctggcgaaggaggggataaagcggggcgagacggaccaccacgctgttagccgagggtccgccaaattgcgctggttcgtggagcggaacatggtcacgcccgagggcaaggtggtggaccttggctgcgggcgcggcgggtggtcatactactgcggcggactgaaaaacgtcaaagaggtgaagggactaaccaagggcggtcccggccacgaggagccgattccgatgtccacctacgggtggaatttagtgcggctgcagagcggcgtcgacgtgttcttcatcccacccgagaagtgcgacacactgctctgcgacatcggggagtctagcccgaacccgacggttgaggccggccgcaccctgcgggtactgaacctcgtggagaactggctgaacaacaatacccagttctgcatcaaggtgttgaatccctacatgccatccgtcatcgagaagatggaagcgctgcagcgcaaatacggcggggccctcgtgcggaaccctctgtctcgcaactccactcacgaaatgtactgggtgtccaatgccagcggcaacatcgtatccagcgtgaacatgatctcccggatgctgataaaccgttttacaatgcggcacaagaaggctacgtacgaacccgacgtggacctcgggtctggcacccgcaacatcggaatcgagtcagaggtccccaatctggacatcatcggtaagcggatcgagaagatcaaacaagaacacgaaaccagctggcactacgaccaggatcacccctacaagacctgggcctaccacggcagttatgagacgaagcagaccgggtcggcatcaagcatggtcaacggcgttgtgcgcctcctcaccaaaccctgggacgtacttcccaccgttacccagatggcgatgaccgacaccaccccgttcgggcagcagcgggtctttaaggagaaggtggacacgcgcacccaagagcctaaggagggcaccaagaagctgatgaagataaccgcagagtggctctggaaggagctgggcaagaagaagaccccgcggatgtgcacccgggaggagttcacacgcaaggtgcgttccaacgcagccctgggtgcgattttcaccgacgagaacaagtggaagtccgctagagaggccgtcgaggactcccggttttgggaactcgtggacaaggagagaaacctgcacctggaggggaagtgcgaaacgtgcgtgtacaacatgatggggaagcgggaaaagaagctcggggagttcgggaaagcaaagggcagccgcgcgatctggtacatgtggctgggcgcgcggtttctggagttcgaggcgctcggattcctgaacgaggaccactggttctcccgcgagaatagcctgtccggcgtcgagggggagggcctgcacaagctggggtacatcctgcgggacgtgagcaagaaggaaggaggggccatgtacgccgacgacaccgcgggctgggacacccgaattaccctcgaggacctgaagaacgaggagatggtcacgaaccatatggagggcgagcacaagaagctcgctgaggccatctttaaactcacctaccagaacaaggtggtgagggtccagcgccccacgccgcgggggaccgtgatggatatcatcagccgacgggatcagaggggttccggccaggtcgggacgtacggactgaacacctttaccaacatggaagcccagttgatccggcagatggagggggagggcgtctttaagaacattcaacacttgacggtgacggaggaggtcgcggtccaaaactggctggcgcgcgtggggcgggagcgactgagccgcatggccatctccggtgacgattgcgtggtgaagcccctcgacgaccggttcgccaacgcgctgaccgctcttaacgacatgggtaagatccggaaagacatccagcagtgggagccgagcaaggggtggaacgactggacacaggttcccttttgctcccaccacttccacgagctcatcatgaaggacggccgggtgctcgtggtgccctgccgcaatcaggacgagctgatcggacgggcgcgcatcagccagggcgccgggtggtccctccgggagaccgcatgcctgggcaaaagctatgcccagatgtggtccctgatgtactttcaccgccgagatctccgcctggcggcgaacgccatctgcagcgccgtaccatcccattgggtcccgacgagccggaccacttggtctatccacgcgaaacacgaatggatgacaacagaggacatgctgacggtttggaatagggtgtggatccgggagaacccctggatggaggacaagacccccgtcgagagctgggaggagatcccgtacctcggcaagcgcgaagaccagtggtgcgggtccttaatagggctgacctctcgggccacctgggcaaagaacatccaggccgctattaaccaagtgcgctccctgatcggcaacgaggagtacactgactacatgccgagcatgaagcgcttccgccgggaggaggaggaggccggcgtgctgtggtga

SEQ ID NO: 24970 - RNA, 9876 nt, synthetic construct
  misc_feature 1..9876: note = derived and/or modified CDS sequence (opt11) from DENV-2__GQ868622__SS-prME
  source 1..9876: mol_type = other RNA
tctgcgggaatgatcatcatgctcatccccaccgtgatggccttccatctcaccacacgaaacggggagccccacatgatcgtgggcatccaggaaaagggcaagagtctacttttcaaaaccgaggacggagtcaacatgtgcaccctcatggcgatggacctgggagaactgtgcgaggacacgatcacctataagtgccccttgttgcggcagaacgagcccgaggatatcgactgctggtgcaatagcacctccacctgggtgacctacgggacttgtaccaccacgggcgagcaccgccgagagaagcggagcgtcgccctggtgccgcacgtagggatgggactcgaaacacgtaccgagacgtggatgtccagcgagggggcctggaaacacgcgcaacgcatagagacctggatcctgagacacccgggctttacgatcatggccgcgatcctggcctacaccatagggaccacccacttccagcgcgcattaattttcatcctgctgacggccgtcgcgccctccatgacaatgcggtgtataggcatctcaaaccgcgacttcgtggagggcgtctccgggggctcctgggtcgacatcgtgctcgagcacgggtcctgcgtgactaccatggccaagaacaagcccacgctagactttgagttgatcaagaccgaggcccggcagccggccaccctccgcaaatactgcatcgaggccaagttgaccaacacgaccaccgagagccggtgccccacccagggcgagccctccttgaaggaggagcaggacaaacgcttcgtttgcaagcacagcatggtagatcggggctggggcaacggctgcggtctgttcggcaagggcgggatcgtgacttgtgcgatgttcacgtgcaagaaaaacatggaaggaaagatcgtccagcccgagaacctggaatacaccatcgtggtgacgccccactccggggaggagcacgccgttggcaacgacacggggaagcacggcaaggagatcaaggtcactccgcagagctccatcaccgaagccgagctgacgggctacggaaccgtaacgatggagtgcagtccaagaaccggcctcgacttcaacgaaatggtcctgcttcagatggagaacaaagcgtggctcgtgcaccgccagtggttcctggatctgcccctcccctggctgccgggggccgataagcagggctctaattggatccagaaggagaccctggtgaccttcaagaacccccacgccaagaagcaggacgtcgtggtcctcgggtcgcaggagggcgccatgcatacggctttaaccggggccacggagatccagatgagctccggcaatctgctgttcactggccacctgaagtgccgcctacgtatggataagctccagctgaaggggatgagctactccatgtgcacgggaaaattcaaggtcgtcaaggagatcgccgagacacagcacgggaccatcgtcatcagggtgcagtacgagggcgacggcagcccctgtaagatccccttcgagatcatggatttagagaagcggtacgtcctcgggcggctgatcaccgtcaatccgatcgtgacggagaaggactcccccgtgaacatcgaggctgagcctcccttcggcgactcatacatcatcattggggtagagcccggccagcttaagttgaactggttcaaaaagggctccagcataggccagatgttcgagaccaccatgcgtggtgccaagcggatggcgatcctgggggacaccgcctgggacttcggctccctcggcggggtgttcacgagcatagggaaggcactccatcaggtgtttggggcgatctacggggcagccttttctggggtctcctggactatgaaaatcctgatcggcgttattatcacctggatcgggatgaacagcaggagcacctcactgtctgtgtccctggtcctcgtggggatcgtgacgctgtacctgggggtcatggtgcaggcagacagcggctgcgtggtcagttggaagaacaaggagctcaagtgtggcagcggtatcttcatcacggacaacgtgcacacctggactgagcagtataaatttcagcccgagagcccgtccaagctggcgagcgccatccaaaaggcccaggaagagggcatctgcgggatccggtccgtgactcgcctggagaacctcatgtggaagcagataacccctgagctgaaccacatcttagccgagaatgaggtcaagctgaccatcatgaccggcgacatcaaggggatcatgcaggccggcaagaggagcctgcgcccgcagcccacggagctgaagtactcctggaaaacctggggtaaggcgaagatgctcagcaccgagtcccataaccagacatttctcatcgacgggcccgaaacggccgagtgcccgaataccaatcgggcctggaatagcctggaggtggaggactatggtttcggagttttcaccacgaacatctggttgaagctgaaggagaaacaggacgccttctgtgactccaagctgatgtcagcagcgatcaaagacaaccgcgccgtccacgccgacatgggctactggatcgagagcgccctcaacgatacatggaaaatagagaaggctagcttcatcgaggttaagaattgtcactggcccaagagccacactctgtggagtaacggcgtgctggagtccgagatgatcatacccaagaatctcgcggggcccgtaagccagcacaactaccggccgggctaccacacccagatcgccgggccctggcacctgggcaagctggagatggacttcgatttctgcgacggcaccaccgtgattgttacggaggactgcggcaaccgcggcccgagcttgaggacgacgaccgccagcggtaagctgattacggaatggtgctgccgctcatgtaccctccccccgctccggtatcgcggcgaggacgggtgctggtacggcatggagatccggcccttaaaagagaaggaggagaacctggtcaacagtctggtgacggctgggcacggccaggtggacaacttcagcttgggcgtcctggggatggctcttttcctggaggagatgctgcgcaccagggtgggcacgaaacacgccatcctcctggtggccgtttccttcgtgaccctcattaccggcaacatgagcttcaaggatctcggccgcgtcgttgtgatggtgggggccaccatgacggacgacatcggaatgggcgtcacctaccttgcactgcttgctgccttcaaggtgcgtcccaccttcgcagctgggctattactccgcaagttgaccagcaaggagctgatgatgaccaccattggcatcgtgctgctgagccaatcgactatccccgaaaccattctagaactcacggacgccctggcgctggggatgatggttctcaagatcgtacgcgacatggagaaataccagctcgccgtgactatcatggccatcctgtgcgttccaaacgccgtgatactccagaacgcctggaaggtctcttgcaccatcctggcagtagtgtccgttagccccctgctcctgacctcaagtcagcagaagacggactggataccgcttgccctcaccatcaagggtctgaaccccactgccatcttcctgaccacgctctcccggaccaacaagaaacgcagctggccgctgaacgaggccatcatggctgtgggcatggtttcaatcctagcctcctccctcctgaagaacgatatccccatgaccggtcccttagtcgctggcgggctcctgactgtgtgctacgtgctgacgggccggtccgcagacctggagctggagcgtgccacagacgtgaagtgggaggaccaggcggagatctccgggagcagccccatcctgtccattacaatcagcgaggatggctccatgagcatcaaaaacgaggaagaggaacagaccctcacgatcctgatccggaccggcctgctcgtgatctccgggctattcccggtgagcatccccatcaccgccgccgcctggtacttatgggaggtcaagaagcagcgcgccggcgtgctgtgggatgtgcccagcccgccgcctatggggaaagcggagctggaggacggcgcataccggatcaagcagaagggtatcctgggctactctcagatcggggcgggcgtctacaaggagggcaccttccacaccatgtggcacgtgacccgcggggccgtgctcatgcataagggcaagcgcattgaaccctcctgggccgacgtcaaaaaggacctgatctcatacgggggcggatggaagttggagggggagtggaaggagggcgaggaggtccaggttctagcgctggagcctgggaagaacccccgcgccgtccagacgaagccgggcctgttcaagaccaacaccgggacgatcggtgcagtgtcccttgacttcagccccggcacgtccgggtcccccattattgataaaaaggggaaggtggtcgggctatacggcaatggcgtggtgacccgatccggcgcttacgtcagcgcgatcgcgcagaccgagaagtccatagaggacaacccagagatagaggacgacatcttccgcaagcggcgcctgacgataatggacctgcaccccggcgccgggaagactaagcgttacttgcccgccatcgtgcgcgaggctatcaaacggggattgcgcacactgatcctcgcaccaacccgggtggtcgccgccgagatggaggaagctttacgcggtctgcccatccgataccagacgcccgccatccgcgcggagcataccggccgcgagatcgtagacctcatgtgccacgccaccttcacaatgcggctgctgtcgcccgtgcgcgttccgaactacaacctcatcattatggacgaggcccacttcaccgaccccgcctccatcgccgcgagaggctacatcagcacccgcgtagagatgggggaagccgccggtatcttcatgaccgctacccctcctggcagccgggacccgttcccgcagtccaacgcccccataatcgacgaggagcgcgagatcccggagcggagttggaactcaggccacgagtgggtgactgacttcaaagggaagaccgtctggttcgtgccgtcaatcaaggccggcaacgacatcgccgcctgcctgcgcaagaacggcaaaaaggtgatccagctgtcccggaagaccttcgacagcgaatacgtaaagacccgcacgaacgactgggactttgtggtgaccaccgacatctccgagatgggggccaattttaaagcggagcgcgtcatcgacccccgtcggtgcatgaagccagtgatcttaacagatggcgaggagcgcgttatcctggcgggccccatgccggtcacgcacagctccgccgctcaacggcgcggtcggatcgggcgcaacccaaagaacgagaacgaccagtatatctacatgggcgagcccctggagaacgacgaggactgtgcacattggaaggaggcgaagatgctcctggacaacatcaacacccctgagggaatcatacccagcatgttcgagcccgagcgggagaaagtggacgccatcgacggggagtacagactgcgcggcgaggcacggaaaaccttcgtagacctcatgcgacgcggagatctgcccgtctggctggcctacaaggtggcggcggaaggcattaactacgccgaccgcaggtggtgcttcgacggtatcaagaacaaccagatcctcgaggagaacgtggaggtcgagatctggaccaaggagggcgaacgcaagaagctcaagccgcggtggctggacgctcgcatttactccgacccgctcgccctgaaggagttcaaggagttcgccgcaggccggaagtcactgacactcaacctgatcaccgagatggggcgtctgcccaccttcatgacccaaaagacgcgggacgccctcgacaacctggctgtgctgcatacggccgaggcgggcgggagagcctacaaccacgccctctccgagttgcccgagaccctggagacgttgctgctgctcacgctgctggccacggtcaccggcggcatcttcctgtttctcatgagcgggcgaggcatcgggaagatgaccctgggcatgtgctgcatcatcaccgcatccatcctcctatggtacgcgcagatccagccccactggatcgccgcgagcattattctcgagttctttctcatagttctgctgatccccgaacccgagaagcagcgcactccccaggacaaccagcttacctacgtggtaatcgccatcttgaccgtcgtggccgccaccatggccaacgagatgggcttcctagaaaaaacgaagaaggacctcggcctcggaagtatcgccacccagcagccggagagcaacatcctggacatcgacctacggcccgcgtccgcctggaccctgtacgcggtcgcgaccacgttcgtgacccccatgctaagacactctatcgagaacagctccgtcaacgtcagtctgactgcaatcgccaatcaggccaccgtgctaatgggtctgggtaaggggtggccactctccaagatggacatcggcgtgccgctgctggcgatcgggtgctacagccaggtcaaccccatcacgcttaccgccgccctgcttctcctggtggcacactacgctatcatcggcccaggcctgcaggccaaggccacacgtgaggcgcagaagcgggctgctgccgggatcatgaagaaccccacagtggacggcatcacggtcatcgacctcgacccgatcccctacgaccccaagttcgagaagcagctcgggcaggtgatgttgttaatcctgtgcgttactcaagtcctgatgatgaggaccacctgggcactctgcgaggccctgactctggccacgggcccgatctccaccctctgggaggggaaccctggcagattctggaacaccacgatagccgtgagcatggccaacatcttccggggctcctaccttgccggggccggcctcctcttcagtatcatgaaaaacaccaccaacacccgtcgaggcactggaaacatcggcgagaccctgggggagaagtggaagtcccggctgaacgccctcggcaagagcgagtttcagacatacaaaaaatccgggatccaggaggtggaccgcacactggcgaaggagggcatcaagcgcggggagacggaccaccatgccgtaagccgcggcagtgctaaactgcggtggttcgtggagcgcaacatggtgacccccgaggggaaggtcgttgacctcgggtgcggccgtggcgggtggagctactactgcggcggcctgaagaacgttcgcgaggtcaagggactgaccaagggcggccccgggcacgaggagcccatcccgatgtccacctacggctggaacctcgtgcggctgcagagcggggtggacgtcttcttcatcccgccagaaaagtgtgacacgctgctctgcgacatcggcgagtcgtcgcccaacccgacggtagaggccggccgcaccctgcgggtgttaaaccttgtcgagaactggcttaacaacaatacccagttctgcatcaaggtgctgaacccctacatgccctccgtgatcgagaagatggaggcgttacagcgcaagtatgggggcgcactggtgcggaacccgctgtcccgcaactccacccacgagatgtactgggtaagcaacgccagcgggaacatcgtcagcagcgtcaacatgatctcccggatgctgatcaaccggttcacgatgcggcacaagaaggccacctacgagcccgacgtggacctcggcagcgggacccgcaacattggaatagagtccgagatccccaacctggacataatcggtaagcgtatcgaaaagatcaaacaagagcatgagaccagctggcactacgaccaggaccacccatacaagacgtgggcctaccacgggtcctatgaaactaagcagaccggctccgcgtccagcatggtgaatggagtcgtgcgcctgctcaccaagccgtgggacgtgctgcccacggtcacccagatggccatgaccgacacgacgcccttcggccagcagcgtgtattcaaggagaaggtggacacccggacccaagagcccaaggaaggcaccaagaaattgatgaagatcaccgccgaatggctgtggaaggagttggggaagaagaagaccccgcgcatgtgcacccgggaagagttcacccgaaaagtccggtccaacgccgctctcggcgcgattttcacagatgagaataagtggaaatccgcccgcgaggccgtagaggaccggcgcttctgggagctcgtggacaaagagcggaacctgcacctagaggggaagtgcgagacctgcgtctacaatatgatgggcaagcgcgaaaagaagctcggggagttcggcaaagcaaagggctcccgcgccatctggtacatgtggctaggcgccagattcctggagttcgaggccttaggcttcctgaacgaggaccactggttcagccgggagaactccctgtcaggtgtggagggcgaggggctccataagctgggctacatcctgcgcgatgtctccaagaaggagggcggtgccatgtacgccgatgacaccgcgggctgggacactcggatcaccctcgaggatttgaagaacgaagagatggtgaccaaccacatggagggggagcacaagaagctggccgaggctatcttcaagctcacctatcaaaacaaggtggtccgcgtgcaacggcccacgccccggggcacggtgatggatatcatcagccggcgggaccaaagggggagcggccaggtgggtacctacgggctgaacaccttcacgaatatggaggcccagctgattcgacagatggaaggcgagggagtgttcaagaacatccagcacctcacggccaccgaagaagtggccgtccagaattggctggcacgggtgggtcgggaacgcctatcccggatggctatcagcggcgacgactgcgtagtcaagcccctcgacgatcggttcgccaacgccctgaccgccctgaacgacatggggaaaatccggaaggacattcagcagtgggagccgtccaagggctggaacgattggactcaggtgcccttctgcagccatcacttccacgagctcattatgaaggacggacgcgtactggtcgttccctgccggaaccaagatgaactaatcggccgcgcgcggatctcccagggggcaggctggagcctccgcgaaacggcctgcctgggcaagtcctacgcccagatgtggtcactgatgtacttccaccgcagggatctccggcttgcggccaacgccatctgctccgccgttcccagccactgggtccccacctccagaaccacgtggagcattcacgccaagcacgagtggatgaccacggaagacatgctgaccgtatggaatcgggtgtggattcgagagaacccctggatggaggacaaaaccccggtcgagtcttgggaggagatcccctacctaggaaagcgggaggaccagtggtgtggcagcctgatcgggctgacctcccgcgcgacgtgggccaaaaacatacaggccgccatcaaccaggtgcggagcctgatcgggaacgaggagtacaccgactacatgccatccatgaagagattccgccgggaggaggaggaggcgggggtactgtggtga

SEQ ID NO: 24971 - RNA, 9876 nt, synthetic construct
  misc_feature 1..9876: note = derived and/or modified CDS sequence (opt11) from DENV-2__FJ639705__SS-prME
  source 1..9876: mol_type = other RNA
tccgcgggcatgataatcatgcttatccccactgtgatggccttccatctcaccacccggaatggtgagccccacatgatcgtgggtatccaggagaagggcaagagcctgctgttcaaaaccgaggacggggtcaacatgtgcaccctcatggcgatggacctgggggaactgtgcgaggacaccatcacttacaaatgccccctcctgcggcagaacgagcccgaggatatcgactgttggtgcaacagtacaagcacctgggtgacctacgggacatgtacaaccactggcgagcatcggcgggaaaagcggagcgtcgccctggtgccgcacgtggggatgggtctcgagacccgtaccgagacctggatgtccagcgagggggcctggaagcacgcccagcggatcgagacctggatcctgcggcatccagggttcacgatcatggccgcgatccttgcctacacgatcgggaccacccatttccagcgcgctctcatcttcatcctgctgacggcggtcgcgccgtccatgaccatgcggtgcatcggtatcagcaacagggacttcgtggagggcgtctccggagggagttgggttgacatcgtgttagaacacgggtcgtgcgttaccaccatggccaagaataagcccacgctggatttcgagctgatcaagaccgaagcacggcagcctgccaccctccgcaagtactgcatcgaggcaaagctgaccaacacgactactgagagccggtgccccactcagggcgagccatccctgaaggaggaacaagacaagcgcttcgtctgcaagcacagcatggtggatcggggctgggggaacgggtgcgggctgtttggcaagggcgggatagtgacatgtgcgatgttcacgtgcaagaagaacatggagggaaagatcgtccagcccgaaaacctggaatacaccatcgtggtgacgccccactccggggaggagcatgccgtcggcaacgacaccgggaagcatggtaaggagatcaaggtgaccccgcagagctccatcactgaggccgagctgaccgggtacggcacggtcacgatggagtgcagcccccgcaccggcctagacttcaacgagatggtcctgctgcaaatggagaacaaggcatggcttgtgcatcggcagtggttcctggacctccccctcccctggctgccgggggccgacaagcagggatccaactggatacaaaaggagaccctggttactttcaagaacccccacgcgaagaaacaggacgtcgtggtgctcggaagccaagagggcgccatgcacacggccctgaccggggccaccgagatccagatgtcctccggcaacctcctgtttaccggacacttaaagtgtcgcctgcggatggacaaacttcagctgaaggggatgagctactccatgtgtactggtaagttcaaggtggttaaggagatagccgagacccagcacgggaccatcgtcatccgagtgcagtacgagggcgacggcagcccctgcaagatccccttcgagattatggacctggagaaacggtacgtgctcgggcgcctgatcacggttaacccgatcgtgacagagaaggattcccccgtgaacatcgaggcggagccacccttcggcgacagctacatcatcatcggggttgagccgggacagctgaagctcaactggttcaagaaggggtccagcatcggtcagatgttcgagactaccatgagaggtgccaagcggatggcaattctgggggacaccgcctgggacttcggctccctcggaggggtgttcacgagcatcggcaaggccctccaccaggtattcggggcgatctacggcgctgccttctccggggtcagctggaccatgaagatcctgattggcgttatcataacctggatagggatgaactcccgaagcacatccctgagcgtatccctcgtcctcgtgggcattgtgacgctgtaccttggagtaatggttcaggccgatagcggctgcgtagtctcctggaagaacaaggagttgaaatgcggcagcgggatcttcatcaccgataacgtgcatacctggactgagcagtacaagttccaacccgagtcgccatccaagctggcgagcgcaatccagaaggcccaggaggagggcatctgcgggatccggtccgtgacgcgcctggaaaacttgatgtggaagcagatcacccccgagctgaaccacatcctggcggagaacgaggtcaagctcacaatcatgaccggtgacatcaagggtatcatgcaggccggaaagcggagcctgaggccgcagcccacggagctgaagtactcctggaaaacctggggcaaagcgaagatgttgagcaccgagtcccacaaccagacgttccttatcgacgggcccgagactgccgagtgcccaaacaccaaccgggcctggaacagcctggaggtcgaagactacggtttcggggtgttcaccaccaacatttggctaaagctgaaggagaagcaggacgccttctgcgactccaagttgatgagcgccgcgatcaaggacaaccgtgccgtccatgccgacatgggctactggatcgagtccgccttaaacgacacttggaaaatcgagaaagccagcttcattgaggtcaagaattgccactggcccaaatcccacacactgtggagcaacggcgttttagaatccgagatgatcatccctaaaaacctcgcggggcccgtcagccagcacaactatcggcctggctatcacacccagatcgccgggccctggcacctgggcaagctggagatggacttcgacttctgcgatgggaccaccgtaatcgtgactgaggactgcggcaaccgcggcccctcccttcggacgaccaccgccagcgggaagctgatcacggagtggtgctgccgcagctgcacccttcccccactccggtaccgcggcgaggacgggtgctggtacggcatggagatccggcccctgaaggagaaggaggagaatctggtcaactccctcgtaaccgccggccacggtcaggtggacaacttcagcttgggcgtcctgggaatggctctcttcctggaggagatgctgcgcacccgcgtgggcaccaagcacgccattctcctggtggccgtatccttcgtgacactgatcaccggcaacatgagcttcaaggacctcggccgcgtggtcgtgatggtgggggccaccatgactgacgatatcgggatgggcgtcacctacctggcactgctcgcggcctttaaagtgcggcccaccttcgccgcgggcctgctgctccgcaagctaacctccaaggagctgatgatgacgaccatcggcatcgtgctcctgtctcagtcaaccatccccgagaccatcttagagctcacagacgccctggcgctcgggatgatggtactcaagatcgtgcgcgacatggagaaataccagctggccgttaccatcatggcaattctgtgcgtcccgaacgcagtgatcctccagaacgcctggaaggtgtcatgtacaatcctggcagtggtgtccgtaagccccctgctcctgaccagtagccagcagaagacggactggatcccactcgccctcaccataaaaggcctgaaccccactgccatcttcctgaccacgctctcccggaccaacaagaagcgcagctggccactgaacgaggccataatggcggtcggaatggtgtccatcctagccagctccctcctgaagaacgatatccccatgactgggcccctagtcgccggcgggctcctgacggtttgctacgttctgacgggcagaagtgcagacctagagctggagcgcgccaccgacgtcaaatgggaggaccaggcggagatctctgggagcagccccatcctgtccatcaccatcagcgaggacggctccatgagcatcaagaacgaggaagaggagcagaccctcacgattctgatccggaccgggctgctcgtgatctccggactatttcccgtgtccatccccatcaccgcagccgcttggtacctgtgggaggtcaagaagcagcgcgccggcgtcctctgggacgtgccgagcccgccgcccatggggaaggcggaactggaggacggcgcctaccgtatcaagcagaagggcatcctaggctacagccagatcggcgccggggtctacaaggagggcaccttccacaccatgtggcatgtcacccgcggggccgtgctcatgcataagggcaaacggatagagcctagttgggcagacgtcaagaaggatctgatcagctatgggggcggctggaagctggagggggaatggaaggagggcgaagaggtccaagtgctcgcgctggagcccgggaaaaacccacgcgccgtccaaacaaagcccggtctgttcaagaccaacaccgggacgatcggcgcggtctccctcgacttcagtcccggcacctccgggtctcccatcatcgataagaaggggaaggtggtcgggctgtatggcaatggtgtggtgacccggtccggggcctacgtcagcgccatcgcgcagaccgagaaatccatcgaggacaaccccgagatcgaagacgacattttccgcaagcggcgcctgactattatggacctgcaccccggcgcggggaagaccaagcgctacctccccgctatcgtacgagaggcaataaagcggggcctgcgcacattgattttagcgccgactcgggtggtggccgccgagatggaggaggccctgcgcgggctgcccatacggtaccagacgcccgccataagagctgagcacaccggccgcgagatcgtggatttgatgtgccacgctacgttcaccatgcggctcctgagccccgtccgcgtcccgaactacaacctcattatcatggacgaggcccactttacggaccccgcctccatcgcggctcggggctacatctcaacccgtgtggaaatgggggaggccgccggcattttcatgaccgccacgcctcccgggagccgtgacccttttcctcaatccaacgcccccatcatagacgaggagcgggaaatccctgaacggagctggaatagcggccacgaatgggtgacggacttcaaagggaagaccgtctggttcgtgccgagcatcaaggcgggcaacgacattgcggcctgcctgcgcaaaaacggcaagaaggtgatccaattaagccgcaagaccttcgacagcgagtacgtcaagacccgcacgaacgactgggacttcgtggttaccaccgacatctcggaaatgggcgccaatttcaaggccgagcgggtcatcgaccccagaaggtgcatgaagcccgtgatcctcaccgacggggaggaacgcgtgatcctggctgggcccatgccggtcactcattcttccgccgcccagcggcggggccgaatcggtcgcaaccccaagaacgagaacgaccagtacatctacatgggcgaacccctggagaacgacgaggactgcgcccactggaaggaagcgaaaatgttgctcgacaacataaacacccccgaggggatcatcccgagcatgtttgaaccagagcgggagaaggtagacgccatcgacggggagtaccgcctccgaggcgaggcccggaagaccttcgtggacctcatgcgcagaggggatctacccgtctggctagcctacaaggtggctgcggagggcatcaactatgccgaccgccggtggtgtttcgacgggataaagaacaaccagatactcgaggaaaacgtggaagtagagatctggaccaaggagggcgagcgcaagaagctgaagcctcgctggctggacgcccgcatctattccgaccccctcgcgctgaaggagttcaaagagttcgccgcgggacgtaagtccctaacgctcaacctaatcaccgagatggggcgcctgccgaccttcatgacccagaagacgcgggacgcgctagacaacctggctgtgctgcacaccgctgaggcgggcgggcgcgcctacaaccacgctctctctgagctgcccgagaccctcgaaaccctcctgctgctaacgttactggccacagtaaccggcggaatattcctcttcctgatgagcgggcggggcatcgggaagatgaccctggggatgtgctgcattatcaccgcgtccatcctcctgtggtacgcgcaaatccagccgcactggatcgccgcctcgatcatcctggagtttttcctgattgtgctgctgatccccgagcccgagaagcagcgcacgccccaagacaaccagctcacctacgtggtaatcgccatcctgacagtggtggccgcgaccatggccaatgagatgggattcttagaaaagacgaagaaggacctcggtctgggatccatcgccacgcagcaaccggagagcaacatactggatatcgacctccggccagccagtgcctggaccctgtacgcggtcgccaccacgttcgtgacccctatgctacgccactcaatcgagaacagctccgtcaacgtcagcctcaccgccatcgccaaccaggccaccgtgctgatggggctgggcaaggggtggcccctctccaagatggatatcggcgtgcctctgctggcgatcggctgttacagccaggtcaatcccattacgctcaccgccgccctgctgtccctcgtggcacattatgcgatcataggtcccggcctacaagccaaggccacccgtgaagcccagaaacgggccgcggccggcataatgaagaaccccaccgtggatggcatcacggtcatagacctggatccgatcccctacgaccccaagttcgagaagcagttgggccaggtgatgctgttgattctctgcgtgacacaggtactgatgatgcggaccacctgggcgctgtgcgaagccctcactcttgcaaccggccccatcagcaccctgtgggaggggaaccctggccgcttttggaacaccacgattgccgtgtccatggccaacatcttccggggcagctatctcgcgggggcgggcctgctgttctcgattatgaaaaacaccacgaacacccggcgtgggacgggaaacattggcgagaccctcggggagaaatggaagtcccggctgaacgccctcggcaagtccgagtttcagacctataaaaagtccgggatccaggaagtcgatcgcaccctcgcgaaggagggcatcaagcgcggggagacggaccaccatgccgtctccaggggatccgccaagctacggtggttcgtggagcgcaacatggtgacccccgagggcaaggtggtggacctggggtgcggtcgaggagggtggtcctactactgcggtggcctcaagaacgtccgcgaggtcaaagggcttaccaagggcggacccggtcatgaggagccgatcccgatgagcacctacggctggaatctggtgcggctccagtccggggtggacgtctttttcatcccgcccgagaagtgcgatacgctgctttgtgacatcggcgagtcgtcacccaatccgaccgtggaggccggccggaccctccgcgtcctgaacctggtcgagaactggctcaacaacaacacacagttttgcatcaaggtactgaacccctacatgcccagcgtaatcgagaagatggaggcgctgcagcgcaagtacgggggcgccctggtccggaatcccctcagcagaaattccacccacgagatgtattgggtgagcaacgccagtgggaacatcgtaagctccgtcaacatgatcagccggatgctcatcaatcgcttcacaatgcggcacaagaaggccacctacgagccagacgtggacctgggttccgggacccgcaacatcggcatcgagagcgagatccccaacctcgacataatcggtaaacggatcgaaaagatcaagcaggaacatgagacctcctggcactacgaccaggaccatccctacaagacgtgggcctaccacgggagctatgagaccaagcagacaggctccgcaagctctatggtgaacggggtcgtgcgcctgttaaccaagccgtgggacgtgctccccacggtcacccagatggccatgaccgacaccacgcccttcggccagcagcgcgtgtttaaggagaaagtggacacccgaacccaagagccaaaggaaggcaccaagaaactgatgaaaatcacggccgagtggctgtggaaggagctcgggaagaagaagaccccgcgcatgtgcacccgggaggagttcacccgcaaggtcagaagcaacgctgccctgggtgcgatcttcacggacgaaaacaagtggaagtccgcccgcgaggccgtggaggacagccgtttctgggagctggttgataaggaacgcaacctccacctagagggcaagtgtgaaacttgcgtctataacatgatgggcaaacgtgagaagaaactgggggagttcggcaaggccaaaggatcccgcgccatctggtacatgtggcttggggcgcgcttcctggagttcgaagccctaggattcctcaacgaggaccactggttcagccgcgagaactccctgtccggggtcgagggggagggactccacaagctcggatacatcctgcgggacgtcagcaagaaggagggcggggccatgtacgccgacgacactgcgggatgggacaccaggatcacgctggaggacctcaaaaacgaagagatggtgaccaaccacatggagggggagcacaagaagctggcagaggccattttcaagttgacctaccaaaacaaagtggtccgggtccaacgccccacgccccggggcacggtgatggacataatctcaaggcgggatcagcgcgggagcggccaagttggcacctacggactgaataccttcaccaacatggaggcccagctaatacggcagatggagggcgagggggtattcaagaacatccagcacctgacggcaaccgaggaggtggcagtccagaactggctcgctcgcgtgggccgcgagcggctatcccgcatggccatatcgggcgacgactgtgtggtaaagccccttgacgatcggttcgccaacgccctcaccgcgctgaacgacatggggaagattcgcaaggacattcagcaatgggagccgagcaaaggctggaacgactggacccaggtgcccttctgcagccaccacttccacgagctaatcatgaaggatgggcgcgttctcgtcgtgccgtgccgcaaccaggacgagctgataggccgggctcgcatctctcagggggccggctggagcctgagggagacggcctgtctcggcaagtcctacgcccagatgtggagcttgatgtacttccaccgacgggacctaaggctggcggccaacgccatctgctccgccgtgcctagccactgggtcccgacctcccggacgacgtggagcatccacgcgaagcatgagtggatgaccacggaggacatgctgaccgtgtggaaccgcgtgtggatcagggagaatccctggatggaggataagacccccgtcgagtcctgggaggagatcccctacctcggtaagcgggaggaccaatggtgcgggtccctcatcgggttaacctcccgtgcgacgtgggccaagaacatccaggccgccatcaaccaggtgcgctccctgatcggcaacgaggagtatactgactatatgccgagcatgaagcggttccgccgcgaggaagaggaagctggagtcctctggtga

SEQ ID NO: 24972 - RNA, 9876 nt, synthetic construct
  misc_feature 1..9876: note = derived and/or modified CDS sequence (opt11) from DENV-2__FJ639706__SS-prME
  source 1..9876: mol_type = other RNA
agtgccgggatgatcattatgttaatccccaccgtgatggccttccacctcaccactcggaacggggaaccccacatgatcgtcggaatacaggagaaagggaagtccctcctgttcaagaccgaagacggcgtgaatatgtgtacactcatggcaatggacctgggggagctgtgcgaggacaccattacctacaaatgccctctcctgcggcagaacgaacccgaggacatcgactgctggtgcaacagcacgtccacctgggtaacgtacggcacctgcacgacgaccggcgagcaccgaagagagaagcgcagcgtcgcccttgtgccccatgtcgggatgggcctcgaaacccgaacagagacctggatgtccagcgagggcgcctggaagcacgcacagcgaatcgagacctggatcctgcggcatccgggcttcactatcatggccgcgatcttggcctacaccattgggacaacccacttccagagggccctgatcttcatcttacttacggctgtcgcgccatccatgaccatgcgttgcatcggcatcagtaacagggacttcgtcgagggcgtaagtgggggcagctgggtcgacatagtgctcgagcacgggtcctgcgtgactacgatggccaagaacaagcccacgctggacttcgagttaatcaagaccgaggcgaagcagcctgccaccctccggaagtattgcattgaggccaagctgaccaatacgaccacggagagccgctgccccacgcagggcgagccctccctaaaggaggagcaggacaagcggttcgtctgcaagcacagtatggtggaccgcggatgggggaatgggtgcgggctgttcggcaagggcgggatagtgacgtgcgccatgttcacttgcaagaagaacatggagggaaagattgtccagccggagaatttagagtacaccatcgtagttacgccccactccggggaggagcatgccgtcggcaatgacacggggaagcacggcaaggaaatcaaggtgaccccgcagagcagtatcaccgaggcagaactgaccgggtacggcaccgtgacgatggagtgctccccacggaccggcctcgacttcaacgaaatggtgctgctgcagatggagaataaggcctggcttgtgcaccgccagtggttcctggacctgcctctcccctggctcccgggggccgacaaacagggttccaactggatccaaaaggagaccctggtgacattcaagaacccgcacgcgaagaagcaggacgtagtggtattggggagccaagagggagccatgcacacggcgcttaccggggccaccgaaatacagatgagcagtggtaacctactgttcaccggacacctgaaatgccggctgagaatggataagctccaattaaaggggatgagctattccatgtgcactggcaagtttaaagtggtcaaggagatcgccgagacccaacatgggaccatcgtcatccgggtgcagtacgagggcgatggcagcccctgcaagatccccttcgaaatcatggacctggaaaagcgttacgtactcgggagactgatcaccgtcaaccccatcgtcacggagaaggactccccggtgaacatcgaggcggagccgccctttggtgacagctacatcatcatcggggttgagcccggccagctgaagctcaactggtttaaaaaggggtccagcataggccagatgttcgagaccaccatgcgcggcgccaaacgcatggccatcctgggggacacagcctgggacttcggatccctcggtggggtgttcacgagcatcgggaaagccctccaccaggtgttcggtgctatctacggtgccgctttcagcggggtcagctggaccatgaagatcctgatcggcgtgatcatcacatggatcggtatgaacagcaggtctacctctctatctgtgtctctagtcctagtgggcatcgtgacactgtacctaggagtcatggtgcaggccgacagcggctgcgttgtcagctggaagaacaaggagctcaaatgcggcagcgggatcttcatcaccgacaacgtgcacacctggaccgagcaatacaagttccagccagaaagcccctccaagctggcgagcgccatccagaaggcgcaagaggagggcatctgcgggatacgcagcgtcacgcggctggagaatctcatgtggaaacagatcacccctgagctaaatcacatcctggccgagaatgaagtaaagctgaccatcatgaccggcgacattaaagggatcatgcaggcaggcaagcgcagcctgcggccgcaacccactgagcttaagtattcctggaagacctggggcaaggcgaagatgctcagcaccgaaagccacaaccagacattcctgatcgatgggcctgagactgccgagtgcccgaacacgaaccgcgcctggaacagcctagaggtggaggattacggcttcggggttttcaccaccaacatctggttgaagctgaaagaaaagcaggacgccttctgcgattccaaattaatgagcgccgcgatcaaggataatcgcgccgtccacgctgacatgggctactggatcgagtctgccctcaacgacacgtggaaaattgagaaggcaagcttcatcgaggttaagaactgccactggcctaagtcccataccctttggagtaacggggtgctagagtcggagatgatcatcccaaaaaacctcgcggggcccgtcagccagcacaactaccgcccaggttaccacactcagatagccgggccctggcacctgggcaagctggagatggatttcgacttctgcgacggtaccaccgtgatcgttacggaggactgcgggaaccggggcccctccctgcgcacaaccaccgccagcgggaagcttatcactgagtggtgttgccgaagctgcaccctgccgccgctccgctatcggggcgaggacggatgttggtacggaatggaaatccgcccacttaaggaaaaggaggaaaacctagtcaactccctcgtgacggccgggcacggtcaggtcgacaattttagcctgggcgtgctcgggatggccctgttcctggaggagatgctgcggacacgcgtaggcacaaagcacgcgatcctcctcgtcgccgtctcgttcgtgaccttgattaccggcaacatgtccttcaaggacctgggccgggtggttgtaatggtgggggcaaccatgaccgacgacatcgggatgggcgtcacctacctggccctgcttgccgccttcaaagtgcgccccaccttcgcggccgggctcctgctgaggaagctgacctccaaggagctgatgatgacaaccatcggcatcgccctcttaagccaaagtacaatcccggaaactatcctggaactcacggacgcgcttgccttggggatgatggtgctcaagatcgtgcgcgacatggagaaataccagctcgccgtgacgattatggccatcctgtgcgtgccgaacgccgtcatcttgcagaacgcgtggaaggtgagctgcaccatcctagccgtcgtcagcgtgagcccgctgctcttgaccagtagccagcagaagactgactggatccccctggccctcacaattaaggggttaaatcccaccgccatcttcctgaccacgctctcccgaaccaataaaaagagaagctggccgctgaacgaagcgatcatggccgtcgggatggtgtccatacttgccagctcccttctgaagaatgacatccctatgactggtccactggtggctggcggcctactgaccgtctgctacgtgctgacagggcgcagcgcagacttggagctggaacgtgccaccgacgtgaaatgggaggaccaggccgagatctccgggtcgagccccatactgtccatcaccataagcgaggacggctccatgagcattaagaatgaggaggaggaacagaccctcacgatactgattcgcactggcctgttagtcatatccgggctgtttccggtgagcatccccatcacagccgccgcatggtacctatgggaggttaagaaacagcgggcgggtgtcttatgggacgttcccagcccgccgcccatggggaaggccgagcttgaggatggcgcctaccgcatcaagcagaagggaatcctgggctacagccagatcggcgccggggtctacaaggaggggacgttccacaccatgtggcacgtcactcgcggggcggtgttgatgcataaggggaaacgcattgaaccctcctgggccgatgtgaagaaggacctgatctcgtacgggggcggctggaagctggagggggagtggaaagagggcgaggaggtccaggtgctcgccctggaacccgggaaaaacccccgggccgtgcagaccaagcccgggctgttcaagaccaatacggggacaataggcgccgtgtccctcgacttcagccccggcacgtccgggagcccaatcatcgacaagaagggtaaggtcgtggggctgtatggcaacggcgtcgtgaccaggtctggggcctacgtgtccgcgatagcccaaaccgagaagtccatcgaggacaaccccgagatcgaggacgatatttttcggaagcgccgactgacaataatggacctccaccccggcgccggcaagaccaaacggtatctccccgctattgtacgggaggcgataaaacgcggcctccggaccctgatcctcgccccgacccgcgtagtggccgcagagatggaagaggcactgcgagggctccccatacgttatcagacgcccgcaatcagggccgagcacaccggccgcgagatcgttgacctaatgtgccacgccaccttcaccatgcgtctgctgagcccggtgcgagttccgaactacaacctcatcatcatggacgaggcccacttcacggatcccgcctccatcgcggcccgcggctacatcagcacacgggtcgagatgggggaagccgccggcatcttcatgacagccacgccgcccggttctcgcgatccgtttccccagtccaacgctcccatcatagacgaggagcgggagattcctgagcgcagctggaactccggccacgaatgggtgactgacttcaaggggaagacagtgtggtttgtcccgtcaatcaaagccggcaacgacatagccgcttgcctgcggaagaatggcaagaaggtgatccagttgtcccgcaaaacgttcgatagcgagtatgtaaaaacccggacgaacgactgggacttcgtcgtgaccaccgatatttcagagatgggagcgaacttcaaggccgagcgcgtaatcgacccccggcgctgcatgaagccagtcatcttgaccgacggcgaggagcgggttatcctggcaggccccatgccggtgacgcacagctccgccgcacagagaagagggcgcatcgggcgaaaccccaagaacgagaacgaccaatacatctatatgggagagccgcttgagaacgatgaggactgtgcgcactggaaggaggcgaaaatgctcctggacaatatcaataccccagaaggcatcatcccgagcatgttcgaacccgagcgcgagaaggttgacgccatcgacggggagtaccggttgcgcggcgaggcacgcaaaaccttcgtagacctcatgcggcgcggggacctgcccgtgtggctggcctataaggtcgcggctgaaggtatcaactacgccgaccggcgctggtgcttcgacgggatcaagaataaccagattttggaggagaacgtggaggtggagatctggacgaaagagggcgagcgaaagaagctgaaaccgcggtggctcgacgcacggatctactccgaccccctcgccctgaaagagttcaaggaattcgcggccggaagaaaaagcctgacgctcaacctgatcactgagatggggagactccccaccttcatgacccagaaaacgcgcgacgcgctcgacaacctggccgtcttacacacggctgaggcaggcggtcgggcctacaaccacgcgctgtccgagctgcccgaaaccctagagaccctcctactcctcacgttgttagccaccgtgaccggcggcatcttcctattcttgatgagcgggcgcggaatcgggaaaatgacactgggcatgtgctgcatcatcaccgcgtccattctcctgtggtacgcccagatccagccgcactggatcgcggccagcattatcctcgagttcttccttatcgtcctgctgatccccgagcccgagaagcagcggacgccccaggacaaccagttaacctacgtggtgattgccatcctgacagtcgttgcggctaccatggccaatgagatgggcttcctcgagaagacgaagaaggacctcggattaggctccatcgcaacacagcagccggagtccaacatcctggacatcgacctacgccccgcctccgcctggaccctgtacgccgtggcgaccacgttcgtcaccccaatgctccgacactcgatcgagaacagctccgtgaacgtgagcctcaccgctattgccaaccaggcgaccgtactgatgggtttgggaaaggggtggcccctctcgaagatggacatcggcgtgccattactggccatagggtgctacagccaggtgaaccccatcacgctcaccgccgccctgctgctcctagtggcgcattatgccatcattggccccggtcttcaggccaaggccactcgcgaggcgcagaagcgtgcagccgcaggcatcatgaagaaccccaccgttgacggcatcaccgtgatcgacctcgatccgattccctacgatcccaaattcgaaaaacagttaggtcaggtgatgctgttgatcctgtgcgtgacgcaggtgctgatgatgcgcactacctgggcgttatgcgaagccctgacgctggcaaccgggcccatctccaccctttgggaggggaatccggggcgattctggaacaccaccatcgccgtcagcatggcaaacatatttcgcggttcctacctcgccggcgccggcctcctatttagcatcatgaagaacactacaaacacccggcgcgggactggcaacatcggcgagaccctgggggagaagtggaaatcccgactgaatgccctcggcaagtccgagtttcagacctacaagaagtctggaatccaggaagtagaccgtaccctggccaaagagggaatcaagcgcggggagacggaccaccacgctgtttcgcgtggatccgccaagttgcgctggttcgttgaacgtaacatggttactcctgagggcaaggtggttgacctcgggtgcggccgcgggggctggagctattactgcgggggcctgaagaacgtgcgggaggtcaagggcctgaccaaggggggccccgggcatgaggagcccatcccgatgagtacctacggctggaacctcgtccgcctgcagagcggggttgacgtgtttttcatccctcccgagaagtgcgacacgctgctatgcgacatcggcgagtcttccccgaacccgacagtcgaggcgggccggaccttgcgcgtgctgaacctcgtggagaactggctgaacaacaacactcagttctgcataaaggtcctgaacccctacatgccctccgtgatcgagaagatggaggctctgcagcggaaatatgggggcgccctcgtgcgcaacccgctgagccggaacagcacccacgagatgtactgggtctcgaacgcctctgggaacatcgtttccagcgtgaacatgatctctcgcatgctgatcaaccggttcacgatgaggcacaagaaagccacctatgaacccgacgtcgatctcggcagtgggacccggaacataggcatcgagtccgaaatccccaacctagacatcatcggcaagcgcatcgagaaaatcaagcaggagcacgagacctcgtggcattacgaccaagaccacccctacaagacgtgggcataccatgggtcctatgagactaagcagaccggcagcgcctccagcatggtgaatggggtcgtcagactgctcactaagccgtgggacgtgctcccaacggtcacacagatggccatgaccgacactactcccttcggccagcagcgcgtcttcaaggagaaagttgacacccggacccaggagccaaaagaaggcaccaagaagctgatgaaaatcacagccgaatggctatggaaggagctggggaagaaaaagaccccgcggatgtgcaccagagaggagttcacccggaaagtgcgcagcaatgccgcgctgggcgcaatcttcacggacgagaacaagtggaagtccgcccgggaggccgtcgaggattcccgcttctgggagctcgtggacaaggagcgaaacctgcacctggaggggaagtgcgaaacctgcgtatacaatatgatgggcaagcgcgagaagaagctcggggagttcggcaaagcaaaggggagcagggcgatctggtacatgtggctgggggctcgcttcctcgagttcgaggccctcggcttcctgaacgaggaccactggttcagccgggaaaatagcctttccggggtcgagggcgaggggctccacaagctgggctacatcctgcgcgacgttagtaagaaggaggggggggccatgtatgcggacgataccgccggctgggacacccgtatcacgctagaggacctgaagaacgaggaaatggtcactaaccatatggagggggagcacaagaagttggccgaagccatcttcaagctcacataccagaacaaggtcgtgcgcgtgcagcggcccacgccgcgtggcacggtaatggatatcatctcgcggaaggaccagagaggatccggacaggttgggacatacggactgaacacattcaccaatatggaggcccagcttatccggcaaatggagggcgaaggggttttcaaaaacatccagcacttgacggcgaccgaggaggtggccgtgcagaactggctggctcgtgtcggccgggagcgcctgagccgcatggccatatccggcgacgactgcgtggtgaagcccttagacgaccggtttgccaatgcgctgactgctctgaacgatatggggaagatacgcaaggacatccagcagtgggaaccgagcaaaggttggaacgactggactcaagtccccttctgttcccaccacttccacgagctcatcatgaaggacgggcgggtgctggtggtaccctgccgcaaccaggacgagttaatcgggcgggcccgcataagtcagggtgccggctggtcccttagggagacggcctgcctgggcaagagctacgcgcagatgtggtccctgatgtacttccaccgccgggatcttcgactggctgcgaacgccatctgcagcgccgtcccctcccattgggtaccgaccagccgtacgacctggagcatccatgcgaagcacgagtggatgacgacggaagatatgctgaccgtgtggaatcgcgtatggatccgagagaacccttggatggaggataagacccccgtggaaagctgggaggagattccctatcttggcaaacgcgaggaccagtggtgtgggtccttgatcggtctgaccagcagagccacttgggccaagaacatacaggccgccatcaaccaggtgcgctccttaatcggcaacgaagagtacaccgactacatgcccagtatgaagcggtttcgacgtgaggaagaggaagctggagtcctgtggtga

SEQ ID NO: 24973 - RNA, 9876 nt, synthetic construct
  misc_feature 1..9876: note = derived and/or modified CDS sequence (opt11) from DENV-2__FJ639707__SS-prME
  source 1..9876: mol_type = other RNA
tcggcggggatgatcatcatgcttatccccaccgtgatggccttccacctcaccacccgcaacggggagccccacatgatcgtcgggatccaggagaaggggaagtccctgcttttcaagaccgaggacggcgtgaacatgtgcaccctaatggcgatggaccttggggaactgtgcgaggacaccatcacgtacaagtgccccctcctgcggcagaatgagcccgaggacatcgactgctggtgcaacagcacctcaacctgggtgacctacggaacctgcaccactaccggcgagcatcgccgtgagaagcgcagcgtcgccctggtaccccacgtgggaatgggcctcgagacacggaccgagacctggatgtcaagcgagggggcctggaagcacgcccagcgcatcgagacttggatccttcgccacccgggcttcacgatcatggccgcgatcctggcctacaccatcgggacgacccacttccaacgcgtcctgatcttcatcctgctgacagccgtggcgccttccatgaccatgcggtgcatcggtatcagcaatcgcgatttcgtggagggcgtctccgggggcagctgggtggacattgtgctcgagcacgggtcctgcgtcaccaccatggcgaagaataaacccacgctggatttcgagctgatcaagaccgaggccaagcagcccgcaaccctccggaagtactgcatcgaagccaaactgaccaacacgactaccgagtcccgctgccccacccagggcgaaccctcactgaaggaggagcaggacaagcggtttgtgtgcaagcacagcatggtggaccgcggctggggcaacggctgcggcctgtttggcaagggcggcatcgtcacgtgcgccatgttcacgtgcaagaaaaacatggagggcaagattgtccagcccgagaacctggaatacaccatcgtggttaccccccactccggggaagagcacgccgtcggcaacgacacggggaagcacggcaaggagatcaaggtgaccccgcagagctccatcacggaagctgaactgaccgggtacggcaccgtcacgatggaatgcagcccgcggaccggactcgacttcaacgagatggtgttactgcagatggaaaacaaggcctggctcgtgcaccgccagtggttcctggaccttcccctcccctggctgccgggcgccgacaagcaagagtccaactggatacagaaggagaccctggtgaccttcaaaaacccccacgccaagaagcaggacgtggtcgtactcggcagccaggagggagcgatgcacacggccctgaccggggccaccgagatccagatgagctccgggaacctccttttcaccggacacctcaagtgccggctgagaatggacaagctccagctgaagggcatgagctactccatgtgtactggaaagttcaaggtagtcaaagagatcgccgagacgcagcacggcaccatcgtgattcgggtgcagtacgagggggacggcagcccctgcaagatcccctttgagatcatggacctggagaagcgctacatattgggccggttgatcactgtcaacccgatcgtgacggaaaaggactcccccgtgaacatcgaggccgagccgccttttggggacagctacatcatcatcggcgtcgagccggggcagctgaagctcaactggtttaagaaaggttccagcatcgggcagatgttcgagaccaccatgcgcggcgccaagcgcatggccattctgggcgacaccgcctgggatttcgggtccctgggcggggtgttcacgagcatcggcaaggccctccaccaggtattcggggctatctacggcgcggccttctccggcgtcagctggaccatgaagatcctgatcggggtgatcatcacctggatcggcatgaactcccgtagcacctccctgagcgtgtccctagttctcgtcgggatcgtgacgctgtacctgggcgtcatggttcaggccgacagcgggtgcgtggtctcatggaagaacaaagagctcaaatgcggctcaggaatcttcatcaccgacaacgtacacacctggaccgagcagtacaagttccagcccgaaagcccctcgaagctggccagcgcgatccagaaggcccaggaggagggaatctgcggcatcagatccgtgacgcgactggagaatctcatgtggaagcagatcacccccgagcttaaccatatcctggccgagaacgaggtcaagttgaccatcatgaccggggatatcaagggcatcatgcaggccgggaagcggagcttaagaccgcagcccactgagctgaagtactcctggaagacctggggcaaggccaagatgctcagtacggagtcctataaccagaccttcctgatcgacggccccgaaacgaccgagtgccccaacaccaatcgcgcgtggaacagcctggaggtggaggactacgggttcggcgtgttcaccacgaacatatggctcaagctgaaagaaaagcaggacgccttctgcgactccaagctgatgagcgccgccataaaggacaaccgtgccgttcatgcggacatggggtactggatagagtccgccctcaacgacacctggaagatcgagaaggccagcttcatcgaggtgaagaactgccactggcccaagtctcacaccctgtggagcaacggcgtgctggagtccgagatgattatccccaagaacctcgccggcccggtcagtcagcacaactatcgccccgggtaccacacccagatcgccggcccctggcacctggggaagttagagatggacttcgacttctgcgacggcaccaccgtgatcgtgaccgaggactgcgggaaccgggggccctccctccgcaccaccacggcgagcggcaagctgatcaccgaatggtgttgccggagctgcacactgcccccgctgcgctatcgcggggaggacggctgctggtatgggatggagatccgccccctcaaggagaaggaggagaatctggtcaactccttggtgaccgccggccacggccaggttgacaatttcagcctgggcgtcctgggcatggccctcttcctggaggagatgctccgcacgcgcgtggggaccaagcatgccatcctcctggtagcggtctcctttatgaccctgatcacaggaaacatgagcttcaaggacttggggcgggtggtggtcatggtgggcgccacgatggccgacgacatcgggatgggcgtgacctacctggccctactcgccgcgtttaaggtccgccccaccttcgccgccggcctgctgctccggaagctgacttccaaggagctgatgatgacgaccatcggtatcgtgttgttatcgcagtccaccatccccgaaaccgtgctagagctcacggacgccctggcactgggcatgatggttctcaagatcgtgcggaatatggagaagtaccaactggcggtgactatcatggcgatactgtgcgtcccgaacgcagtgatcctgcaaaacgcctggaaagtcagctgcaccatcctggcagtggtgtccgtcagccctttactcttgacctccagccagcagaagacggactggatccccctggcgctcaccatcaaggggctgaaccccactgcgatcttcctgaccacgctctcccgcacgaacaagaagcgcagctggccgctgaacgaggcaatcatggccgtgggcatggtatccatcttagcgagctccctcctcaaaaacgacatccccatgaccggccccctggccgccgggggccttctgaccgtctgctacgtgttgacggggcgcagcgccgacttggagctggagcgggccaccgacgtgaagtgggaggaccaggcggagatctccggctcgagccccatcttgtccatcaccatcagcgaagacgggtccatgagcatcaagaacgaagaggaggagcagaccctcacgatcctgattcgcaccggtctgctcgtaatctcgggcctcttcccgataagtatccccatcaccgccgcagcctggtacctgtgggaggtaaagaagcaacgcgccggggttctgtgggacgtccccagcccgcctcccatgggcaaggcggagctggaggacggggcctaccgcatcaagcaaaagggcatactggggtacagccagatcggggccggcgtatacaaggagggcaccttccacaccatgtggcacgtgacgcggggcgctgtccttatgcacaaggggaagcgcatcgagcccagttgggccgacgttaagaaagacctgattagctacggcgggggctggaagctggagggcgagtggaaggagggggaggaggtgcaggtcctcgcgttggagcccggcaagaatccccgagccgtgcagaccaagcccgggttgttcaagaccaacaccggcaccatcggggccgtttccctcgacttcagccccggcaccagcggcagccccataatcgacaagaagggcaaggtcgtgggcctgtacggcaacggcgtggtcacccgctccggcgcctacgtgagcgccatcgcacagaccgagaagtccatcgaggacaaccccgagatcgaggacgacatcttccgaaagcgccggttaacgatcatggatctgcaccccggggccggcaagaccaagcggtacttgcccgccatcgtgcgggaggccatcaagcgcgggctgcgtaccttgatcttggcgccgacccgcgtagtagccgccgagatggaggaggccctgcggggactgcccatccgctaccagacgccggccatcagagcagagcacaccgggcgggagatcgtggacctcatgtgtcacgccaccttcaccatgcgcctgctgagccccgtccgggtgccgaactataacctgattatcatggacgaggcccacttcacggaccccgcctccatcgctgcgcgcggttacatctctacccgggtggaaatgggcgaggcggccgggatcttcatgaccgcgacgccgcccggcagccgcgacccgttcccccaatcgaacgcccccatcatcgacgaggagagggagatccccgagagaagctggaactccggtcacgagtgggtcactgacttcaagggcaaaaccgtgtggttcgtgccgagcatcaaggcggggaacgacatcgccgcctgtcttcggaagaatggtaagaaggtcatccaactgtcccgcaagaccttcgactccgagtacgccaagacccggacgaacgactgggacttcgtggtgaccaccgacatctccgagatgggcgcgaatttcaaagccgagcgcgtcatcgacccccggagatgcatgaagcccgtgatcctcaccgacggggaggagcgggtgattctggcgggccccatgccggtcacccacagcagtgccgcccaacgtcgggggcgcatcggcagaaaccccaagaacgagaacgaccagtacatatacatgggggagcccctggagaacgacgaggactgcgcgcactggaaggaggccaagatgcttctggacaacatcaacacacccgagggcattatcccgagcatgttcgagcccgagcgcgagaaggtcgacgccatcgacggcgagtatcggctccgcggggaggcccgcaagaccttcgtggacctcatgcggaggggcgatctgcccgtttggctggcctacaaggtggcggccgaggggatcaattacgcggaccggcgctggtgtttcgacggaatcaaaaacaatcagatactcgaggagaacgtggaggtcgagatctggacaaaggagggggagcggaagaaactgaagccgcgctggctggactcccggatctacagcgaccccctcgcgctgaaggagttcaaggaattcgccgccggccgcaagagtctcacgctcaacctgatcaccgagatgggccggctccccaccttcatgacccagaagacgcgcgacgccctcgacaacctcgccgtgctgcacaccgccgaagccggcgggcgggcgtacaatcacgccctcagcgagcttcccgaaaccctggagaccctactgctgctcacgctgttagccaccgtgaccgggggcatcttcctcttcctgatgtctggccgcgggatcggcaagatgaccctggggatgtgctgcatcatcacggcctccatcctcctgtggtacgcgcagatccaacctcactggatcgccgctagcatcatcctcgagttcttcttaattgtcctgctgatccccgagcccgagaagcaacggacgccccaggacaaccagctcacctacgtagtgatcgccatcctgaccgtggtggcagcgaccatggccaacgagatgggcttcctcgagaagacaaaaaaggacctcgggctgggcagcatcgctacccagcagcctgagtcaaacatcctggacatcgacctccgccccgccagcgcctggaccctatatgcggtcgccacaacgttcgtgacgcccatgctgcggcacagcatcgagaactcgagcgtgaacgtctccctcacggcgattgccaaccaggccacagtgctggtgggcctggggaagggctggcctctcagcaagatggacatcggggtcccgctgctggcgatcggctgctactcccaggtgaaccccatcacgctcaccgccgccctgctgctcctagtagcccactacgcgatcatcggacccggcttgcaggccaaggccacccgagaggcccagaaacgggccgcggccggcatcatgaagaaccccactgtcgacggcatcacggtgatcgacctcgacccgatcccctacgaccccaaatttgagaagcagctgggccaggtgatgctgctaatactgtgcgtcacccaggtcctgatgatgcgcaccacttgggccctatgcgaggccctgactctggccactggacccatcagcaccctctgggagggcaacccggggcggttctggaacactacgatcgcggtgtctatggccaacatctttcgcggcagctacctggccggcgccgggctactcttctccatcatgaagaataccacaaacacccggaggggcacgggtaacattggcgaaaccttgggagaaaagtggaagtcccgcctgaacgccctcgggaagtccgaattccagatctacaagaagtccggcatccaggaggtcgaccggaccctggcgaaagaggggatcaagcgtggcgagaccgatcaccacgccgtgtcccgggggagcgccaagctgaggtggttcgtggagcggaacatggtcacgcccgagggcaaggtcgtggacctcggctgcgggcgcggcgggtggtcctactactgcgggggactgaagaatgttcgggaggtgaagggcctgaccaagggcggacccggccacgaggagcccatcccgatgagcacctacgggtggaacctcgtgcgcctacagtccggcgtcgacgtgtttttcattccgcccgagaagtgcgacacccttctctgcgacatcggtgaaagctcccccaaccccacggtggaagcgggccggaccctccgcgtcctgaatctcgtagaaaactggctgaacaacaacacccagttttgtatcaaggtcctgaatccctacatgcccagcgtcatcgagaagatggaggcccttcagcggaagtacggcggggccctcgtgcgcaaccccctcagccggaactccacccacgagatgtactgggtgagcaatgcctccggcaacatagtcagctcggtgaacatgatcagccgcatgctgatcaatcggttcaccatgcgccacaagaaggccacgtatgagcccgacgtggacctcggttccggcacacggaacatcgggatagaaagcgaggtccccaacctggacatcatcgggaaaaggatcgagaaaatcaagcaggagcacgagacctcctggcattacgaccaggaccacccctacaagacctgggcgtaccacggtagctacgagacgaagcagactggttccgcgagctccatggtgaatggcgtggtccggctgctcaccaagccgtgggatgtgctccccaccgtgacgcagatggccatgaccgacactactccgttcgggcagcagcgtgtcttcaaggagaaggtggacacgcgcactcaggagcccaaggagggcaccaagaagctgatgaagatcaccgccgagtggctctggaaggagctgggcaagaagaagacgccacggatgtgcacccgcgaggagttcacccggaaggtgcgctcaaacgccgcgttgggggcgatcttcaccgatgagaacaagtggaagtccgcccgggaggccgtcgaggactcccgcttctgggagctcgtagacaaagaacggaacctgcacctggagggaaagtgcgagacgtgcgtctacaacatgatggggaagcgcgagaagaagctaggggagtttgggaaagccaagggctcccgggccatttggtatatgtggctgggagcgcgattcctggagttcgaggccctcgggtttctgaacgaggaccactggtttagccgtgaaaactccctgtctggcgtcgagggggagggcctccacaagctggggtacatcctgcgagacgtgagcaagaaggaaggcggcgcaatgtacgccgacgacaccgcgggttgggacacccggataaccctcgaggacctgaagaatgaggagatggtcacgaaccacatggagggcgagcacaagaagctggccgaggctatcttcaagctcacctatcagaacaaagtggtccgtgtgcagcggcccacgcccagggggaccgtgatggacatcatctcccgccgcgaccagcgcggcagcggccaggtggggacgtatggcctgaacaccttcaccaacatggaggcccaactgatccggcagatggagggggaaggcgtcttcaagaacatccagcatctcaccgtgacggaggaggtggcggtccagaactggctagcgcgggtggggcgcgaacgcctgtcccggatggccatctcgggcgacgactgcgtggtcaagcccctcgacgacagattcgccaacgccctcaccgccctgaacgacatgggcaagatcaggaaagacatccagcagtgggagccgtccaaagggtggaacgactggacccaggtccccttctgcagccaccacttccatgagctcatcatgaaggacggccgcgtgctggtggtgccctgccggaaccaggacgagctgatcgggcgcgcgcgtatttcccagggcgccggttggagcctccgcgagacggcctgcttaggcaagtcctacgcccagatgtggagcctgatgtacttccatcggcgcgacctccggctggccgcgaacgcaatctgctccgccgtgcctagccactgggtcccgacctcccgcaccacctggagcatacacgctaagcacgagtggatgactaccgaggacatgctgacagtatggaaccgcgtgtggatccgcgagaacccatggatggaggacaagacccccgtcgagtcctgggaggagatcccctacctcggaaaacgggaggaccagtggtgcgggagccttatcggcctgacatcccgcgccacgtgggcgaagaacatccaagccgccatcaaccaggtgcggagcttaatcgggaacgaggagtacacggactacatgcctagcatgaagcgctttcggcgcgaggaggaggaggctggcgtgctgtggtga

SEQ ID NO: 24974 - RNA, 9876 nt, synthetic construct
  misc_feature 1..9876: note = derived and/or modified CDS sequence (opt11) from DENV-2__FJ639708__SS-prME
  source 1..9876: mol_type = other RNA
agcgcggggatgatcatcatgctgatccccacggtgatggcctttcacctcacaacccgcaacggggagccccacatgatcgttggaatccaggagaaggggaagtccctgctgttcaagaccgaggacggcgtgaacatgtgcaccctcatggccatggacctgggggagctgtgcgaggacacaatcacctataagtgccccctcctgcggcagaacgagcccgaggacattgactgctggtgcaacagcaccagcacctgggtgacctacgggacctgcacaaccaccggcgagcatcgccgggaaaagcgaagcgtcgccctggtgccccacgtggggatgggcctggagacccggacggagacctggatgtccagcgagggggcctggaagcacgctcaacgcatcgagacctggatcctcagacaccccggcttcacgatcatggccgcgattctggcctacaccatcgggaccacccacttccagagggtcctcatcttcatcctgctgacggccgtggccccctccatgaccatgcggtgcatcggcatcagcaaccgagacttcgtggaaggcgtctccgggggcagctgggtggacatcgtgctcgaacatgggtcctgtgtcaccaccatggcgaagaacaagcccacgctggacttcgaactgatcaagacggaggccaagcagcccgccacactccggaagtactgtatcgaggcaaagctgaccaacacgaccacggagagccgctgtcccacccagggtgagccctccttgaaggaggagcaagacaagcggttcgtgtgcaagcacagcatggttgaccggggctgggggaacggctgcggccttttcggcaagggtgggatcgtcacctgcgcgatgttcacgtgcaagaagaacatggagggcaagatcgtgcaacctgagaaccttgagtacaccatcgtggttacgccccactctggggaggagcacgcggtgggtaacgacacgggaaagcacggcaaggagatcaaggtgaccccgcagagctccattacggaggctgagctaacagggtacggcaccgtcacgatggagtgctctccccgcaccggcctcgacttcaacgagatggttctgctgcagatggagaacaaggcctggctcgtgcaccgccagtggttcctggacctgccgttaccctggctgccaggggccgacaagcaggagtcaaactggatccagaaggagaccctggtcaccttcaagaacccccacgccaagaagcaggacgtggtcgtcctcggcagccaagagggggcgatgcacactgccctgaccggcgcgacggagatccagatgagctctggaaacctactgttcaccggccacttgaagtgccggctgcgcatggacaagctccagctgaaaggcatgagctactccatgtgcaccgggaagttcaaggtggtaaaggagatcgctgagacacagcacggcaccatagtcatccgggtccagtacgagggggacggcagcccctgcaagattcccttcgagatcatggacctggagaagcgctacatcctcggccggctgatcaccgtcaaccccatcgtgacagagaaggactcccccgtgaacatcgaagccgagccgccctttggcgacagttacatcattataggggtcgagccggggcagctaaagctgaactggttcaagaagggctccagcatcgggcagatgtttgaaaccaccatgcggggcgcgaagcgcatggccatcctgggcgacaccgcctgggacttcgggtccctgggcggggtgttcacgagcatcggcaaggccctccaccaggtgttcggggccatctacggcgcggccttctccggcgtcagctggaccatgaagatactgatcggggtgatcatcacctggatcggcatgaactcccggagcacttccctgagcgtgtccctggtcctcgtggggatcgtgacgctgtacttaggcgtcatggttcaagccgacagcgggtgcgtggtctcctggaagaacaaggagctcaagtgcggctccggcatcttcatcaccgacaacgtgcacacctggaccgaacagtacaagttccaacccgagagcccctccaagctggccagcgcgatccagaaggcccaggaggaggggatctgcggcatccgcagcgtgacgcggctggagaacttaatgtggaagcaaatcacccccgagctgaaccacatcctggccgagaacgaggtcaagttgaccattatgaccggggacatcaaggggataatgcaggccgggaagcgctctctgcgaccgcagcccacggagctgaagtactcctggaagacctggggcaaagccaagatgctcagcacggagtcctacaaccagaccttcctaatcgacggccccgagacggcggagtgccctaacaccaaccgcgcatggaacagcctggaggtggaggattacgggttcggcgtattcacaaccaacatctggctcaagctgaaagaaaagcaggacgccttctgcgactccaagctgatgtcggccgccatcaaggacaaccgggcggtccacgccgacatggggtattggatcgagagcgccctcaacgatacgtggaagatcgaaaaggccagcttcatcgaggtgaagaactgtcactggcccaagtcccataccctgtggagcaatggcgtgctggagtccgagatgatcatccccaagaaccttgccggccccgtcagccagcacaactaccgtccgggttatcacacccagatcgcgggcccctggcatctggggaaactggagatggacttcgacttctgtgatggcaccaccgtgatcgtcactgaggactgcggtaaccgtggccccagtctccgcaccaccaccgctagcggcaagctgatcacggagtggtgctgccgcagctgcaccctgcccccgctccgctaccgcggggaggacggctgctggtacgggatggagatccgccccctgaaagagaaggaggagaacctggtgaactctttagtgaccgccggccacggccaggtggataacttcagcctgggcgtgctcggcatggccctgttcctggaggagatgctgcggacccgcgtggggacgaagcacgcgatcctcctggtagccgtatccttcatgaccctgatcaccgggaacatgagcttcaaggacttagggcgggtggtggtcatggtgggcgccaccatggccgacgacattgggatgggtgtgacctacctggcactgctcgcggctttcaaggtccgtcccaccttcgccgccggcctgctgctccggaagctaacctccaaggagctgatgatgaccacgatcgggatcgtgctcctcagccagtctactatccccgagaccgtgctggagctaaccgatgccctggcgctgggcatgatggtgcttaagatcgtgcgaaacatggagaagtaccagctggccgtgacgattatggcgatcctgtgcgtcccaaatgccgtgatcctccagaacgcctggaaggttagctgcacgatcctggcggtggtgtccgtcagccccctgctcctgacctccagccaacagaagaccgactggatccccctggcgctcacgatcaaggggctgaatcccaccgccatcttcctgactaccctctcgcgcacgaacaagaaacggagctggccactgaacgaggcaatcatggcggttggaatggtgtccatcctggccagctccctcctgaaaaacgacataccgatgaccggccccctggtcgccgggggcctgctgacagtatgctatgttctgaccgggcgcagcgcggacctcgagctggagcgggccacggacgtcaagtgggaggaccaggctgaaatctccggcagcagcccaatcctgtcaatcaccataagtgaagacgggtccatgagcatcaagaacgaagaggaggagcagaccctcacaatcctcattcgtacgggcttactcgtgatatccggcctgttcccgatcagtatccccataaccgcagccgcgtggtacctgtgggaagtgaagaaacagcgggccggcgtcctatgggacgttccgagcccgccgcccatgggcaaggcggagctggaggacggcgcttaccgcatcaagcagaagggcatcctagggtacagccaaatcggcgccggggtgtacaaggaggggaccttccacaccatgtggcacgtcacccgtggggccgtgctaatgcacaaagggaagaggatcgagccctcctgggccgacgtgaagaaggacctgatctcgtacggggggggctggaagttagagggcgagtggaaagagggggaggaggttcaggtgcttgcgctggaaccaggcaagaacccccgggccgtccagacaaagcccgggctgtttaagaccaataccggcaccatcggggccgtctccctcgacttctctcccggcacctccggcagccccattatcgacaagaaggggaaggtggtgggcctgtacgggaacggcgtcgtgacccgctccggcgcctacgtgagcgcaattgcgcagacggagaaatccatagaggataaccccgagatcgaggatgatatcttccggaagcgacggctgaccatcatggacctgcaccccggggccggcaagacgaaaagatatctccccgccatcgtccgggaggccatcaagcgcgggctacggactctgatcctcgcgccgacccgcgtggtggccgccgagatggaggaggccctgcgggggctgcccatccgctaccagaccccggcaatccgggcggagcacacggggcgcgagatcgtagacctcatgtgccacgccaccttcaccatgcgcctgctgagccccgtgcgggtgccgaactacaacctcatcatcatggacgaggcccacttcaccgacccggcctccatcgccgcccgcggctacatcagcacgcgagtcgagatgggcgaagccgccgggatctttatgaccgccacgccgcccggctcccgagacccgttcccccagtccaacgcccctatcatcgacgaggagcgggagatccccgagagaagctggaactccggtcacgaatgggtgacagacttcaagggcaaaacggtgtggttcgtcccgagcatcaaagcggggaacgacatagccgcgtgcctgcggaagaacggtaagaaggtgatacagctgtcccgcaagaccttcgacagcgagtacgtgaagacccgaaccaacgactgggacttcgtggtgacaaccgacatctccgagatgggcgccaattttaaggctgagagagtgatcgacccccggcgctgtatgaagcccgtcatcctcactgacggagaggagcgtgtgatcctggccggccccatgccggttacccacagctccgccgcccagagacgcgggcgaatcggccggaaccccaagaacgaaaacgaccagtatatctacatgggtgaacccctggagaatgacgaagattgtgcgcactggaaggaggcgaaaatgctcttagacaacatcaacacgcccgagggcatcatcccgagcatgttcgagcccgagcgcgagaaggtcgacgccatcgacggcgagtacaggctgcgcggggaggcgcgcaagaccttcgtggacctcatgcggcgcggcgacctgcccgtgtggctggcctacaaggtcgctgcggaggggatcaactacgctgatcggaggtggtgcttcgacggcataaagaacaaccagatcctcgaagagaacgtagaggtggagatctggaccaaggagggggagcggaagaaactgaaaccgcgctggctggacgcccggatctactccgaccccctcgccctaaaagagttcaaggagttcgccgcgggtcgcaagagcctgaccctcaacctaatcacggagatgggccgtctgcccacctttatgacccagaagacccgcgacgccctcgacaacttagcagttttgcacacggccgaggccggcgggcgggcctacaaccacgccctctccgagctgcccgagaccctggagaccctcctgctgttgacactgctggccacggtaaccggcggcatcttcctcttcctgatgagcggccgcgggatcggcaagatgaccctggggatgtgctgcatcataaccgcctccatcctcctgtggtacgcacagatccagccgcactggatcgccgccagcatcatcctggagttcttcctcattgtcctgctgatccccgagcccgagaagcagcggacgcctcaggacaaccagttaacatacgtggtcatcgccatactgaccgtcgtggccgcgaccatggccaacgagatgggcttcctggagaagaccaagaaggacctcgggctgggctccatcgccacgcagcagccggaaagcaacatcctggacatcgacctccgccccgcctccgcctggaccctctatgcggtggccaccaccttcgtcacgccgatgctgaggcacagcatagaaaacagctccgtgaacgtgagcctcaccgccatcgcgaaccaggccaccgtcctgatgggccttggtaagggctggcccctctccaagatggacatcggagtgccgctgctggcgatcggctgttactcccaggtgaaccccatcaccttaaccgccgccctgctcctcctggtcgcccactatgctatcatcggacctggcctgcaggccaaggccacgcgcgaggcccagaagagggccgcggcaggcatcatgaagaatccaaccgtcgacgggatcacggtgatcgacctcgatccaatcccctacgaccccaagtttgagaagcagctgggccaagtcatgctgctcatcctgtgcgtgacccaggtgctgatgatgaggactacctgggctctctgcgaggccctgaccctggccacaggaccgatctccaccttgtgggagggcaacccggggcgattctggaacactaccatcgcggtaagcatggccaacatcttccgtggctcatacttggccggggccgggctcctcttttccatcatgaaaaacacgaccaacacccggagaggtaccgggaatatcggggagacgctgggagagaaatggaagagtcgcctgaacgcccttgggaagtccgagttccagatctacaagaagtccggcatccaggaggtggaccggactctcgcgaaggaggggatcaagcgcggcgagaccgaccaccacgccgtgtctcgggggtccgccaagctgcgctggttcgtcgagcggaacatggtgaccccagagggcaaggtggtcgacctcggctgcgggcgcggcgggtggagctactattgcggcgggctgaaaaacgtgcgggaggtgaagggcctgacgaagggagggccaggccacgaggagccaatcccgatgtccacctatgggtggaacctcgtccgcctgcagagcggcgttgacgtgttcttcatcccacccgagaagtgcgacaccctactctgcgacatcggggagtccagccccaacccgaccgtggaggccggccggacgctgcgcgtgctgaacctcgtcgagaactggctaaacaacaacacgcagttctgcatcaaggtccttaatccgtacatgccctccgtcatcgagaaaatggaggcgctgcagcggaagtacggcggggcccttgttagaaacccactcagtcggaacagcacccacgagatgtactgggtttccaacgccagcggtaacatcgtctccagcgtgaatatgatcagcaggatgctgattaaccggttcaccatgcgccacaaaaaagccacctacgagcccgacgttgacctcgggtcaggcacacggaacatcgggatcgagtccgaggtgcccaaccttgacatcattggtaagcgcatagagaagataaagcaggagcacgagacctcatggcattatgaccaggatcacccatacaagacctgggcctaccacggctcatacgagacgaagcagacggggagcgcgagttcaatggtgaacggcgtcgtgcgtctgctcacaaaaccatgggatgtgctgcccactgtcacccagatggcgatgacggacaccacccccttcgggcagcagcgggtgttcaaggagaaagtggacacccgcacgcaggagcctaaggagggcaccaagaagctgatgaagatcacagccgagtggctctggaaggagttagggaaaaagaagaccccccggatgtgcacacgcgaggagttcacccgaaaggtccgctctaatgccgccctgggggcgatcttcaccgacgaaaacaagtggaagtccgctcgggaggccgtggaggactcccgcttctgggagttggtagacaaggagcggaatttgcacctggaaggcaagtgcgagacgtgcgtatacaacatgatggggaagcgcgaaaagaaactcggcgagttcgggaaggccaagggcagccgggccatctggtacatgtggctgggcgcgcgctttctggagttcgaggcactcgggttcctgaacgaggatcactggttcagccgggagaactcgctgtccggcgtggagggtgagggcctacacaaactggggtacatccttcgcgacgtctctaagaaggagggcggcgccatgtacgccgacgacacggcggggtgggacacccggatcaccctcgaggacctgaagaacgaggagatggtgaccaatcacatggagggcgaacataagaaactggccgaggccatcttcaagctcacataccagaacaaggtggtccgcgtgcagcggcccacgcccagaggaaccgtgatggacatcataagccggcgcgatcagcggggctcagggcaagtcggcacgtacgggctgaacacattcacgaacatggaggcccagctgatccgccagatggaaggggagggcgtgtttaaaaatatacagcatctcaccgtgaccgaggaggttgccgtgcagaactggctggcccgggttgggcgcgagcggctgagcagaatggccatctctggcgacgactgtgtcgttaagcccctcgacgaccgcttcgccaacgccctgacagcccttaacgacatgggcaagatccggaaggacatccaacagtgggagccgtccaagggctggaacgactggacccaggtgcccttctgctcccaccacttccacgagctcatcatgaaggacggacgcgtcttagtggtgccctgccggaaccaagacgagctgatcgggcgcgcgcggatctcccagggcgccgggtggtccctccgtgagaccgcctgcctggggaagagctacgcccagatgtggagtcttatgtacttccaccggcgggacctccggctggcggcgaacgccatttgcagtgccgtcccctcccactgggttccaaccagccgaacgacctggtccattcacgctaagcacgaatggatgaccacggaggatatgctgaccgtgtggaaccgggtctggatccgcgagaacccgtggatggaggacaagacgcccgtggaaagctgggaggagatcccgtacctcggcaagcgggaggaccagtggtgcgggtccctgatcggcctgaccagccgtgccacctgggctaagaacatccaggccgccatcaaccaggtgcgctccctcatcggcaacgaggaatacactgactacatgccgagcatgaagcgcttccggcgcgaagaggaagaggccggcgtcttatggtga

SEQ ID NO: 24975 - RNA, 9876 nt, synthetic construct
  misc_feature 1..9876: note = derived and/or modified CDS sequence (opt11) from DENV-2__FJ639709__SS-prME
  source 1..9876: mol_type = other RNA
tccgccggtatgatcataatgcttatccccaccgtgatggccttccacctcactacacgtaacggggagccgcatatgattgtgggcatccaagaaaagggcaagagcctgcttttcaagacagaagacggggtaaatatgtgtaccctcatggctatggacctaggggagctgtgcgaagacaccatcacttataaatgtcccctcttgcgccagaatgagcccgaggacatcgattgctggtgcaacagcaccagcacttgggtgacctacgggacttgcacaactacgggggaacaccgccgggaaaagcgctcggtggccctagtgccccatgtagggatgggcttggagacgcggaccgaaacatggatgtcctcagaaggagcctggaaacacgctcagcgcatagagacttggatcctgcggcacccaggcttcacgatcatggcagcgatcttggcctacaccatcggtactactcacttccagcgggccctcattttcatcctgctgacggccgtagcgccgtccatgacgatgcggtgcataggcataagtaatcgcgacttcgtggagggtgtcagcggcggtagctgggttgacatcgtgttggagcacggttcgtgcgtgacgaccatggccaagaacaaacccacgctggacttcgaactgatcaaaaccgaagcgaaacagcccgccaccttacggaaatactgtatagaagccaaacttaccaacaccacaacggagagccgctgccccacccagggtgaacccagtctgaaagaggaacaggacaagcggttcgtttgtaagcacagcatggtagaccgcggctggggtaacggttgtggcctattcggaaagggcgggatagttacgtgcgcgatgtttacctgcaaaaagaacatggagggcaagatcgtgcagccggagaaccttgagtacaccatcgttgtgacgccacattccggagaggaacacgccgtaggtaacgacacgggaaagcatggcaaggagatcaaggtgaccccgcagtcgtccatcactgaggccgaactgaccgggtacggcaccgtaacgatggagtgcagcccccggactggcctcgacttcaacgagatggtccttttgcagatggagaacaaggcgtggcttgtccaccgccagtggtttctggatcttcccttaccctggcttcctggcgccgataaacagggctccaactggatccagaaagagaccctggtcacctttaaaaacccacatgctaagaaacaagacgtcgtcgtcctcggatcccaggaaggagccatgcatacggccctgaccggtgccacagaaatccagatgtcctccggcaacctgctgtttaccggccacctgaagtgcaggttacgcatggacaaactccaactgaagggcatgagttactccatgtgcacgggcaagttcaaggtggtcaaggagatcgcggaaacgcagcacgggaccatcgtcatccgtgttcaatacgagggagacggcagcccctgcaagatcccgttcgagatcatggacctggagaagcgctacgtgctcgggcggctaatcaccgtcaatccgatcgtgacagagaaggattcacccgtgaacatagaggcggagccgccctttggcgacagctacatcatcatcggcgtcgagccgggccaactgaagctcaactggtttaagaaaggctcgagcattggccagatgttcgagaccaccatgcgcggcgccaagcgtatggccattctgggagataccgcctgggacttcgggtccctcggcggggtgttcacgagcatcgggaaggccctccaccaagtgttcggagccatttacggcgccgccttttccggtgtcagctggactatgaaaatcctgatcggcgtgatcatcacttggattgggatgaactctcggagcacctcactgagcgtgtcgctggtcctcgtaggtatcgtcaccctgtatttaggcgtcatggtgcaggccgactctggctgcgtggtgagctggaagaacaaggaactgaagtgcggctcagggatcttcatcactgacaacgttcacacctggacagagcaatacaagttccaacccgaatcgcccagcaagctggcgagcgccatccagaaggctcaggaggaagggatctgcgggatacgctccgtgacccgcctggagaacctcatgtggaagcagatcacacctgagttgaatcacatcctggctgagaacgaagtcaaattaactataatgaccggcgacatcaaggggatcatgcaggccggcaagcgcagcctaaggccgcaacccacagagttgaagtattcctggaagacctggggaaaggcgaagatgctctcaaccgagtcccacaatcagaccttccttatcgacgggccggaaacggccgagtgccctaacaccaaccgcgcctggaacagcctggaagtggaggactacggtttcggggtattcactaccaacatctggttgaagctgaaggagaaacaggacgccttctgcgactccaaactgatgtctgccgcgatcaaagacaatcgggcagtccacgccgacatgggctattggatcgaatccgccctcaacgacacctggaaaatagagaaagcctccttcatcgaggtgaaaaactgtcactggcccaagtcccacaccctgtggagcaatggcgtactggagtctgagatgattatcccgaagaatctcgcggggccagtcagccagcacaactaccgcccgggctaccacacgcagattgcggggccctggcatctaggcaagctggagatggacttcgacttctgcgacggtacaaccgtaatcgtcacggaggactgcggtaaccggggtcccagtctccgcaccactaccgcatcagggaaactgatcacggagtggtgttgccggtcgtgcaccctgccgccgctccggtacagaggcgaggatgggtgctggtatggtatggaaatcagacccctgaaagaaaaggaagagaacctagtcaactctctcgtcacggcgggccacggacaggtggacaacttcagcctgggtgtcctggggatggcccttttccttgaggagatgctgcggaccagagtgggcacgaagcacgccattctactggtggcggtgtccttcgttaccctcatcaccgggaacatgagcttcaaggacttgggacgggtagtcgtgatggtcggggccaccatgacggatgacatcggtatgggggtcacgtacctggccctgctcgcggcgtttaaggtgcgcccaaccttcgccgccggactgctgctgcggaagctcacgagtaaggagctcatgatgacgaccatcggcatcgtgctactgagccagactaccatccccgaaaccatcctggaactcacggacgccttagcgctagggatgatggtcctcaagatcgtccgtgacatggagaagtaccagctggccgtaacaatcatggccatcctctgtgtcccgaacgcagtgatcttacagaacgcctggaaggtctcctgcaccatcctcgcggtagtgagcgtcagtccccttctcctgacgagcagtcagcagaaaaccgactggatcccccttgcgctaacaatcaaggggctaaaccccacggcaattttcttgactactttgagccgcacgaataaaaagcgctcatggccgctgaacgaagccatcatggccgtcggaatggtgtcgatcctggcctccagcctcctgaaaaacgacatacccatgaccggacccctggtagccggcgggctccttacggtgtgctacgtgctgaccgggcgttccgcggacttggagctagagcgggcgaccgacgtcaaatgggaggaccaggcggaaatctcgggttcctcccctatcttgagcatcaccatctccgaggacggaagcatgtccatcaaaaacgaggaagaggaacagactctcaccatcctgatacgcaccggattgctcgtcatctccggtctgtttccggtgtccattcccattaccgccgcggcctggtacctgtgggaggtcaagaagcaacgtgctggagtgctctgggatgtcccctccccgccgccaatggggaaggcggaactggaggacggagcctaccgcattaaacaaaagggcatactgggctattcccagataggcgccggggtttacaaggagggaacttttcacactatgtggcacgtaacgcgcggtgcggtcctcatgcacaaggggaagcgcatcgagccaagctgggcagacgtcaagaaagacctgatctcctacgggggtggctggaaattggagggagagtggaaagaaggcgaggaagtccaagtcttagcgctggagccagggaagaaccccagggccgttcagaccaaacctggcctgttcaagactaacacagggactatcggcgccgtaagtctagacttctctcccggcacaagtgggagtcccattattgacaagaaaggcaaggtggtcgggctgtacggcaatggggtggtgacccgcagcggggcctacgtgtcagcaattgcgcaaacggagaaatccatcgaagacaaccccgagatcgaagatgacatatttcggaagcgaaggctgaccatcatggatctgcaccccggcgcggggaagaccaagcgctacctccccgcgatcgtacgggaggccataaaacgcggcctgcggaccctgattctcgcaccgacgcgggtcgttgccgccgaaatggaagaggccctgagagggctgcccatcagatatcagacccccgccatccgcgctgaacacacgggccgcgagatcgtcgacctaatgtgtcacgcaacttttacgatgagactgctttcccccgttcgggtgccgaactacaatcttattataatggacgaggcccacttcactgatcccgccagcatcgccgctcgcggctatatctccaccagggtagagatgggagaggctgcagggatcttcatgaccgcaacccctcccgggagcagggacccattcccgcagagcaacgccccgataatcgacgaggaacgggagatccccgagcggtcctggaacagcggccacgagtgggtgactgacttcaaggggaagacagtctggttcgtcccgtccatcaaggcaggtaacgatatagccgcatgcctgaggaagaacggtaagaaggtgatccagctcagtcgcaagaccttcgacagcgagtacgtcaagacgcggaccaacgactgggactttgtggtcaccaccgacatcagtgagatgggggctaacttcaaggccgagcgcgtcatcgatccccgacgctgcatgaagcctgtaatcttaacggatggtgaggaacgcgtgatccttgctgggccaatgccggtcacccattcctcggcggcccaacgccggggccgcattggccggaaccccaagaacgaaaacgaccaatacatctacatgggcgagcccctagaaaacgacgaggactgtgctcattggaaggaggctaaaatgctcctggacaacatcaacaccccagagggcatcatcccgtccatgttcgagccggagagagagaaagtggatgccatcgatggggagtaccggcttcgcggagaggcacgcaagacctttgtggacctcatgcggagaggggacctgcccgtatggctggcatataaggtggcagccgagggcatcaactacgccgaccggagatggtgctttgatggtatcaaaaataatcagatcctcgaggagaatgtggaggtcgaaatctggaccaaagagggcgaaaggaagaaacttaagccccgatggctggacgctcggatctactcagacccgctcgccctgaaggagtttaaggagttcgccgcgggtcgcaagagcttgacgctaaatctgattaccgagatggggagattacccaccttcatgacgcagaagacaagggacgctctcgataacctcgccgtactgcacaccgccgaggctggagggagggcctacaaccacgccttaagcgagctgcccgagacccttgagacgcttctgctgctcacgcttctggcaaccgttaccggcggcatcttcttgttcttgatgtcaggtcgcggcattggcaagatgacccttggcatgtgttgtataatcacagccagcattctgctgtggaacgcgcagatacagccccactggatcgccgccagcatcatattagagttctttttgatcgtgctcttgattcccgagcctgagaagcagcgcacgccccaggacaaccagttaacctatgtggtaatcgctattctgaccgtggtagccgctacgatggccaacgagatgggcttcctggagaagaccaagaaggatttagggctgggttctatcgccacacagcaacctgagagtaacatcctggacatcgatttacgccccgccagcgcttggaccttgtatgctgtcgcaacgaccttcgtaacccccatgctgcgtcactcgatcgaaaactcgagcgtgaacgtctcacttaccgccatcgccaaccaagccacggtgcttatgggtctgggcaaggggtggcccctatcaaagatggacatcggggtccctctgctggcgatcgggtgttactcccaggtcaaccccattaccctcaccgccgccttgctgttactcgtggcccattatgcaataatcggccccggccttcaggcgaaagcaacccgagaggctcagaaacgggcggcagcagggattatgaaaaatccgacggtggacggcatcaccgttattgacctcgatccgatcccctacgaccccaaatttgagaagcaactcggccaggtgatgctgctgatcttgtgcgtgacccaggtgttgatgatgcgcaccacgtgggccctatgcgaggcgctgaccctggccaccggccctattagcaccctctgggaggggaacccgggacgtttctggaacacgaccatcgcggtatcgatggcgaacatcttccgaggaagctacctggccggtgccggtctcctcttttccatcatgaagaacaccaccaacacacggcgcgggactggaaacatcggtgagaccctgggggagaagtggaagagtcgcctaaacgcccttggcaagtcagagttccagacctacaagaagtccggcatccaagaggtggaccggactctcgctaaagagggcatcaaaagaggggaaactgatcaccatgccgtttctagggggagcgctaagctacgctggttcgtcgagcggaacatggtgacgcccgaaggaaaggtagtggacctgggatgcgggcgcggtggctggtcgtattactgcgggggcctgaagaacgtacgggaggtaaagggcctaaccaagggcgggccagggcacgaggagcccattcctatgagcacgtatggctggaacctcgtgcgattacagagcggggtggacgtcttcttcatccctcctgagaaatgcgacaccctgctctgtgacatcggagaaagctctcccaacccgaccgtggaggccggcagaacactgcgcgttctgaacctagtcgagaactggctgaacaataacacccagttctgcatcaaggtgctaaacccctacatgcccagcgtgatagagaaaatggaggcgctgcaacggaagtatgggggcgccctcgttcgcaacccgctgtcccgcaatagcactcatgagatgtactgggtgtcgaacgcctccgggaacatcgtctcatcagtcaacatgatcagccgcatgctgatcaaccggttcacgatgcgccacaagaaggcaacatacgagcccgacgtggatctcggctccggcacgcggaatatcggaatagagagcgagatccctaatctggatatcatcggcaagagaatagagaagatcaagcaagagcacgagacctcgtggcactacgaccaggaccacccgtacaagacctgggcctaccatggaagctacgagaccaagcagacaggctccgcgagctccatggtgaacggggtcgtacggctgctcaccaagccgtgggacgtcttacccaccgttacacagatggccatgaccgacacgactccttttggccaacagcgcgtgtttaaggagaaggtcgatactcgcactcaggagcccaaggagggcacgaagaagctgatgaaaataacggctgagtggctatggaaagagctcggaaagaagaagaccccgcggatgtgtacccgcgaggagttcacccgaaaggttcgcagcaacgcggctctgggcgcgatcttcaccgacgagaacaagtggaagtccgcgcgggaagcggtagaggacagccgcttctgggagttagtggataaggagcggaacttgcacctggaggggaagtgcgagacctgcgtttataatatgatgggcaagcgcgagaagaagctcggggagttcggcaaggcaaaaggatcccgggccatatggtacatgtggctgggggctcgctttctggagttcgaagccctaggcttcctgaacgaagatcactggttcagccgtgagaactcgctgtccggggtggaaggagaagggttacataagctcggctacatattgcgcgacgtcagtaagaaagagggtggggccatgtacgcggatgacacagcgggctgggatacgcggattaccttggaggatctgaagaacgaggagatggtgactaaccacatggagggggagcataagaaattggcagaagccatcttcaagctgacctaccagaacaaggtagtccgcgtgcaacggcccacgccccgcggcaccgttatggatatcataagcagacgcgaccaacgcgggagcgggcaggtcggaacatacgggctgaacacctttacgaatatggaggcccaactgatacgtcagatggagggcgaaggggtattcaagaatatccaacatctgaccgctaccgaagaggtggcagtacagaactggctggcccgggtcggtagagagcgcttatcgcggatggccatctcgggcgacgactgcgttgttaaacctcttgacgaccgctttgctaatgccctgaccgcgctgaacgacatggggaagatccgtaaggatatccagcaatgggagccaagcaagggctggaacgactggacccaggtgccattctgcagccaccacttccacgagctcattatgaaagacggtcgcgtgttagttgtgccatgccgaaatcaggacgaactgatagggcgagccaggatatcccagggtgccgggtggagcttacgcgagaccgcctgcctgggcaagtcgtacgcacagatgtggagtctgatgtacttccaccggcgcgatctccggctggccgccaacgccatttgcagcgccgtgcccagccactgggttccgaccagtaggaccacttggagcatacacgccaagcacgaatggatgacgaccgaggacatgctgaccgtgtggaaccgggtctggatccgcgagaacccctggatggaggataagacccccgttgagtcctgggaagaaattccctacctcgggaagagagaggaccaatggtgcggttctctgattgggctgacgtccagagccacatgggcgaaaaacatccaggccgccattaatcaggtacgcagtctcatcggaaatgaggagtacacagactacatgccgagcatgaagcgctttcggcgcgaggaagaggaggcgggcgtattatggtaa

SEQ ID NO: 24976 - RNA, 9876 nt, synthetic construct
  misc_feature 1..9876: note = derived and/or modified CDS sequence (opt11) from DENV-2__FJ639710__SS-prME
  source 1..9876: mol_type = other RNA
tcggcgggcatgatcatcatgctgatacccacggtgatggccttccacctcacgactcgaaacggggagccccatatgattgtcggcatccaggagaagggcaagagcctgcttttcaaaaccgaagacggcgtaaacatgtgcacgctcatggcaatggacttaggggaactgtgcgaggacactatcacgtacaagtgccccctcctgcgtcagaacgagccggaggacatcgactgttggtgtaactctacatccacatgggtgacatacgggacctgcaccaccacgggcgaacatcgccgggaaaagcgcagcgtggccctggtgccccacgtggggatgggcctcgagacccgcacagagacctggatgtccagcgaaggggcttggaagcatgcccagcgcatcgaaacctggatcctgcggcacccgggctttacgatcatggctgcaatcctggcatatacgatcggcaccacacacttccagcgcgcgctcattttcatcctgctgacggccgttgctccatccatgaccatgagatgcatcgggatcagcaatcgggatttcgtggagggcgtttccgggggctcgtgggtcgacatcgttcttgagcatgggtcctgcgtgaccacaatggccaagaacaagcccacgctggactttgagctcatcaagaccgaagccaaacaacccgccacacttcggaagtattgcattgaggccaagctgaccaacacgaccaccgagagccgctgccccacccagggcgagccctccctgaaggaggagcaagacaaacgattcgtctgtaagcatagtatggtggaccgcggttgggggaacggatgcgggctgttcggcaagggggcgatcgtgacatgtgccatgttcacatgtaagaagaacatggagggcaagatagtccagcccgagaacctagaatacaccatcgtggtgacaccgcatagcggggaagagcacgctgttgggaacgacactggcaagcacggcaaggagatcaaagtcaccccgcagagctccatcaccgaggccgagctgacgggttatgggaccgtgacgatggagtgcagcccccgaaccgggttagactttaatgagatggtgctgctgcagatggagaacaaggcgtggctcgtgcaccgccagtggttcctagaccttccacttccttggctgccaggcgcggacaaacaggaaagtaactggatccagaaggagacactggtgaccttcaagaacccccacgccaagaagcaggacgtcgtggttcttggttcccaggagggcgctatgcacaccgccctgacaggggccactgagatacaaatgagctccgggaacctcttgttcaccggtcatctgaagtgccgcctgcgcatggacaagctccaactgaaaggcatgtcttacagtatgtgcacgggcaagttcaaggtggtgaaggagatcgcggagacgcagcacggaacgatagtgatccgggtgcagtacgagggagacgggtctccctgcaagatccccttcgagatcatggacctggagaagcgctacgtgcttggtcggttaatcaccgtcaaccccattgtgaccgaaaaggattcccccgtcaacatcgaggccgagccgccgttcggcgacagctatataatcataggggtcgagccgggccagttaaaacttaattggttcaaaaaggggagctctatcggccagatgttcgagaccaccatgaggggtgccaagcgcatggccatcctaggcgacacggcctgggacttcgggtccctaggaggggtgttcacaagcataggcaaggcgctccaccaggtgttcggggcaatctacggggcggccttcagtggcgtctcctggaccatgaagatcctgattggcgtgatcataacatggatcgggatgaactcgcggagcacatccctgagcgtatccctgatcctagtcgggatcgttacgttatacctgggggtaatggtacaggccgacagcggatgcgtggtgtcatggaagaacaaggagttgaagtgcgggagcggtatctttatcacggacaacgtgcacacgtggaccgagcagtacaaattccagcccgagagcccctccaagctggccagcgcaatccaaaaggcccaggaagaagggatctgcggcatccgctccgtgacccggctggaaaacctaatgtggaaacaaatcacccccgagctgaatcacatcctagccgagaatgaggtgaagttgaccataatgaccggcgacatcaaagggatcatgcaggccggcaggcggagcctgcgcccgcagcccacggaactgaaatactcctggaagacatgggggaaggcaaagatgcttagcacggagtcctacaaccagaccttcttgatcgacggtcccgaaacgactgagtgccccaatacgaaccgggcctggaactccctggaggtcgaagactatggctttggggtgttcactacaaacatctggctaaagctgaaggaaaaacaggacgccttctgtgactccaagttgatgagcgccgccatcaaggataaccgcgccgtgcacgctgacatgggctactggatcgagtccgcccttaacgacacatggaaaatcgagaaagccagcttcatcgaagtcaaaaactgccactggcccaaatcccacaccttgtggtccaatggtgtcctggagtccgagatgatcatcccaaagaatctcgccggccccgtgtctcaacacaactaccgtccaggctaccacacccagattgcagggccctggcacctaggcaagctggagatggactttgacttctgcgacgggaccactgtaatagtgaccgaggactgcgggaacagggggccctccctcagaaccactacggcctccggcaagctcatcaccgagtggtgctgtcgctcttgcaccctgcccccgctccggtatagaggcgaggacgggtgctggtacggcatggaaatccggcccctgaaggagaaggaagagaacctggtgaactccctggtcaccgctgggcacggacaagtggacaatttcagcctgggagtgcttggaatggctctattcctagaggagatgctgcggacacgtgtcggaacgaagcacgccatcctcctagtggccgtctcgttcgttaccctcatcacagggaatatgtctttcaaggacctcggcagagtggtggtcatggtgggcgccacgatggctgacgacatcgggatgggcgtaacctacctcgccctgctagctgccttcaaggtgcggcctaccttcgcagcgggcctgctgctccgcaagttgacgagcaaggagctgatgatgactactataggcatcgtgctgctgagccagagtaccatccccgagactatcctggaacttacggacgccctggccctgggtatgatggtgttgaaaatcgtccgcaacatggagaagtaccagctggccgtgactatcatggccatcttatgtgtccccaacgccgtcatcctacagaacgcctggaaggtgagctgtaccatcctggcagtcgtgtccgtgagccccctgctcctgacatccagtcaacagaagacggactggataccgctggccctcaccatcaagggcctcaaccccaccgctatattcctgactacgttatccaggaccaacaagaagcggagctggccgctgaacgaggcaatcatggccgtcgggatggtttcgatcctggccagctccctcctaaaaaacgacatccccatgaccggccccctggtcgctggcgggctcctgaccgtctgttacgtgttaacgggccgcagcgccgatctcgagcttgagagggctaccgacgtgaagtgggaggagcaagccgagatttcggggagctcacccatcctgtcgattacgatcagcgaagacggctccatgagcattaagaacgaggaggaagagcagaccctgaccatcttgatccggacagggctgctggtcataagtggtttattcccgattagcatcccgattacggctgccgcctggtacttatgggaggtgaaaaagcaaagagcgggcgttctgtgggacgtcccaagcccgccgccgatggggaaggcggagctggaggatggggcctaccggatcaagcagaaggggatcctgggatactctcagatcggtgccggagtgtacaaggaaggcacgttccataccatgtggcacgtgacgcgcggcgccgtcctcatgcacaaaggcaaacggatcgagccctcctgggcggatgttaagaaggacctgatcagctatgggggcggttggaagctggagggcgaatggaaggagggtgaagaggtgcaggtcctcgccctggagccagggaagaacccccgggctgtccaaaccaagcccggtttatttaagaccaacacagggaccataggagccgtgtccctcgacttcagccccgggacctccggcagccccattatcgataagaaggggaaggtcgtgggactgtacggcaacggggtggtcacccggtccggtgcctacgtgtcagcgattgcccaaactgagaagtccatcgaggacaaccccgagatagaagacgacatcttccgcaagcgacgcctgacaatcatggacctgcaccccggtgccgggaagaccaagaggtacctacccgcaatagtgcgcgaggcgatcaagcggggcttaagaaccctgatcctcgccccgactagagtcgtcgcagccgaaatggaggaggccctgcgcggactgcccatccggtaccagacgcccgcgatccgtgcagaacacacggggcgcgagatcgtggacctcatgtgccacgccaccttcaccatgcggctgttatcccccgtccgcgtcccgaattacaacttgatcatcatggacgaggcccactttacggaccccgcctccatcgcggcccgtggatacattagcacccgcgtggagatgggtgaagcagccggcatctttatgaccgccactccgcccgggagccgagacccgttcccacagtccaatgctcccatcatcgacgaggaacgagagatccccgagcggagctggaacagtggccacgagtggatcacagacttcaaagggaaaacggtctggtttgtgccgagcataaaagccggaaatgacatcgccgcctgcctgaggaagaacgggaaaaaggtgatccagctgtcccggaagacattcgattcagagtacgtaaagacccgcacgaacgactgggacttcgtcgtgaccacagacatcagcgagatgggcgcgaatttcaaggccgagcgcgtgatcgacccccgccggtgcatgaaacccgtgatcctaaccgacggcgaagagcgcgtgatcctggccgggcccatgccggtaacgcacagctccgccgcgcagaggcggggccgcatagggcgcaaccccaagaatgagaacgatcagtacatctatatgggcgagcccttggagaatgacgaggactgcgctcattggaaggaggccaagatgttactggataacatcaacacccccgaagggatcatcccgagcatgttcgaacctgagagagagaaagttgacgcaatagacggtgaataccgtttacgcggcgaggcccgaaagaccttcgtggatctaatgcgccgaggggatctgccggtatggctggcctataaggtcgcagcggagggcatcaactatgcagaccgtaggtggtgcttcgacggcatcaagaacaaccagatcctcgaggagaatgtggaagtcgagatctggaccaaagagggcgagaggaagaagttaaagccgaggtggctggatgcacggatctactccgaccctctagctctgaaggagttcaaggagtttgcggctggcaggaagtccctgacgctcaacttaatcaccgagatgggccgcctgcccaccttcatgacgcagaagacgcgcgacgcccttgacaatctggccgtgttacacaccgcggaagccggggggagggcctacaaccacgcattgtccgaactgcccgagaccctggaaacactccttttgctcacgctcttagccaccgtgaccggcgggatcttcctgttcctaatgagcggtagaggcatcggaaagatgaccctgggcatgtgctgcataatcaccgcgtccatactcctatggtatgcgcagatccaaccgcactggattgcagcctccatcatcctggagtttttcctcatcgttctgctgatccccgagcccgagaagcaacggacaccccaagacaaccagctcacctacgtggtcatcgccatcctgacagttgtagccgcaaccatggccaacgagatgggtttcctggagaagactaagaaagacctggggctagggtccatcgccacccagcagcctgagagtaacatcctggacatcgatttgcggcccgcctcagcgtggacgctgtacgccgtcgccaccactttcatcaccccaatgctccgccactctatcgagaacagctccgtaaacacctctctcactgccatcgctaatcaggcgacggtgttgatgggtctgggcaaggggtggccactctcgaagatggacatcggggtcccgctcctggcgatcggatgctacagccaggtgaaccccatcaccctcaccgcggcactactactcttggtcgctcattacgccatcatcggcccagggctgcaggccaaggccacccgggaagcccagaaaagggcggcagccggcatcatgaagaaccccacggtcgacggcatcacggtgattgacctcgatccgatcccctacgatcccaagttcgagaagcagcttggccaggtcatgctgctaatcctgtgcgtcacccaggtgctgatgatgaggaccacgtgggccctctgcgaggccctgaccctggcgaccggtccaatctccaccttatgggaggggaatccggggcgcttctggaacacgaccattgccgtaagcatggccaacatcttccgggggtcctatctagccggtgccggcctcctcttcagtatcatgaagaacaccacaaacacgcgccgcgggactggcaacatcggggagaccctgggggagaagtggaagagtcggctgaacgcgctcggcaagtctgaatttcagatctacaagaagtccgggatacaggaggttgaccgcacccttgcaaaggagggcatcaagcgcggggagacggaccaccatgctgtcagcagaggctctgccaagctgcggtggttcgtcgagaggaacatggtcacccccgaagggaaagtggtggacctcggctgcggccgcggcgggtggagctactactgcggtggcctgaagaacgtcaaagaagtgaaggggttaaccaagggcggacccgggcacgaggagccgatccccatgtcgacctatggctggaacctcgtgcgcctgcagagcggcgtcgatgtgttcttcatcccccccgagaagtgcgacacgctgctgtgcgacattggcgagtccagccccaacccgaccgtggaggcgggtcggacactgcgcgtactgaaccttgtggagaactggcttaataacaacacccagttctgtatcaaggtgctgaacccatatatgccctcagtcattgagaagatggaggccctgcagaggaaatacggcggcgccttagtgcgcaacccgctgtcccggaacagtactcacgagatgtactgggtgtccaacgccagcgggaacatcgtctcctcggtgaacatgatcagccgaatgctgatcaatcggtttacgatgaggcacaagaaggccacgtacgaaccggacgtggacttaggaagcgggacccgcaacataggtattgagtccgaagtccccaacctggacattatcggaaagcgcatcgagaagatcaagcaagagcatgagaccagctggcactacgaccaagatcatccctacaagacttgggcctaccacggcagttacgaaaccaagcagaccggcagcgcctcgtctatggtgaacggtgtggtccggctgctaacaaaaccgtgggacgtcctgccaacggtaactcaaatggccatgaccgacaccacccccttcggccaacagcgcgtatttaaggaaaaggtggacacccgcactcaagagccaaaggaggggaccaaaaaattgatgaagatcacggccgagtggctctggaaggagctgggcaagaagaagaccccgcgcatgtgcacccgcgaggaattcacccgcaaagtgcgcagtaacgccgccctgggggccatctttacggatgagaacaagtggaaatccgcccgggaagccgtcgaggactcccgcttctgggagctcgtagataaggagcgaaacctgcacctcgaggggaagtgcgagacctgcgtgtacaatatgatgggaaagcgcgagaagaaacttggggagttcggcaaagccaaggggtctcgggcaatctggtacatgtggctgggcgctcgctttttggagttcgaagccctcggattcctgaacgaggaccactggttctcccgggagaacagtctgtccggggttgagggtgaggggctccacaagttgggatacatcctgcgcgacgttagcaagaaggagggcggcgcgatgtacgcggacgacacagcggggtgggacacccggatcacgttagaggacctgaagaacgaagagatggtgaccaaccacatggaaggggagcataagaagctggccgaggccatcttcaagctgacctaccagaacaaggtcgtgagagtacagcggcccacgcctcggggaacagtgatggacatcatcagccggcgagaccagcgggggtcgggccaggtagggacctacggtcttaacacctttaccaacatggaggcccagttaatccgtcagatggagggtgagggggtcttcaaaaacatccaacacctcacggtgaccgaggaggtcgcggtacagaactggctagcccgggtgggccgggagcgactcagccggatggccatctccggggacgactgcgttgtcaagcccctcgacgatcgtttcgccaacgccctgaccgccctgaacgatatgggcaagatccggaaggacatacagcagtgggaaccttctaaaggctggaacgactggacccaggttcccttctgctcacaccacttccacgagctcatcatgaaggacgggcgcgtgttggttgtgccatgccgcaaccaggacgaactgatcggccgtgctcgtatcagccagggggccggttggtccctccgcgagacagcgtgcctagggaaaagctacgcccagatgtggtccctgatctacttccatcggcgcgacttgcgcctagcggcaaacgccatctgcagcgcggtgccctcccattgggttccaacgagccgtaccacctggtccatccatgccaaacatgagtggatgaccacggaggacatgctgactgtgtggaaccgggtgtggatccgcgagaacccctggatggaggacaaaactcccgtcgagagctgggaggagattccctaccttggcaagagagaggaccagtggtgcggcagtctgatagggctgaccagtagggccacttgggccaagaacatccaagcggccatcaaccaggtgcggtcattgataggtaatgaggagtacaccgactacatgcccagcatgaaacggttccggcgcgaggaggaggaggcgggggtgctgtggtga

SEQ ID NO: 24977 - RNA, 9876 nt, synthetic construct
  misc_feature 1..9876: note = derived and/or modified CDS sequence (opt11) from DENV-2__GQ868623__SS-prME
  source 1..9876: mol_type = other RNA
agcgccggcatgatcatcatgctgatccccaccgtgatggccttccacctcaccactcggaatggagagccccacatgatcgtcggaatccaggagaaggggaaaagcctgctgttcaagaccgaggacggcgttaatatgtgcaccctcatggcgatggatctgggggagctgtgcgaggatacgatcacctacaagtgccccctgctgcggcagaacgagcccgaagacatcgactgctggtgcaatagcacctccacctgggtgacgtacgggacctgcacaacgaccggagagcaccgcagggagaagcgcagcgtcgccctggtgccccacgtggggatgggcctcgagacgagaaccgagacctggatgtccagcgagggagcctggaagcacgcccaacgcatcgagacctggatcctgcgacacccgggcttcacgatcatggccgcgatcctggcctacaccatcgggaccacacatttccagcgcgccctcatcttcatcctgctgacggccgtcgccccgtccatgacgatgcggtgcattggcataagcaaccgcgactttgtggagggcgtgtccgggggtagctgggtcgacatcgtgctcgagcacgggtcttgcgtgacaaccatggccaaaaacaagcccacgctggacttcgagctgattaagaccgaggcgaagcagccagccaccctccggaaatattgcatcgaggccaagctgaccaacacgaccaccgagagccgctgccccacccagggtgagccctccctgaaggaggagcaagacaagaggttcgtctgcaagcacagcatggtggatcgggggtgggggaacggctgcgggctgttcggcaagggcgggatagttacgtgcgcgatgtttacgtgcaagaaaaacatggagggtaagatcgtccagccagagaacctggagtacaccatcgtggtaactcctcactccggggaggagcacgccgtcggcaacgacacggggaagcacggcaaggagataaaggtgaccccacagagctccattacagaggccgaattgaccgggtacggcactgttacgatggagtgtagcccccggaccggcctcgactttaacgaaatggtcctgctgcagatggagaacaaggcctggctcgtgcaccgccaatggttcctggatctgcccctcccctggttgccgggggcagacaagcagggctccaactggatccagaaggagactctggtgaccttcaagaacccccacgcgaagaagcaagatgtcgtggtcctcgggtctcaagagggcgccatgcacacggccctgactggagccaccgagatccaaatgagctctggcaacctcctgttcaccggtcacctgaaatgccggctgcgcatggacaagctccagctgaagggaatgagttactccatgtgcactggcaagttcaaggtggtgaaggagatcgccgagacccagcacgggaccatcgtcatccgggtgcagtacgagggcgacggcagcccctgtaagattcccttcgagatcatggacctggagaagcgctacgtattggggcggctaatcaccgtaaacccgatagtaactgagaaggactcccccgttaacatcgaggcggagccgcctttcggggactcgtacatcatcatcggtgtcgagccgggacagctgaagctaaactggttcaagaaagggtccagcatcggccagatgtttgagaccaccatgcgaggcgccaagcgcatggcgatcctgggggatactgcctgggacttcggctccctaggcggggttttcacgagcatcgggaaggccctacaccaggtgttcggcgccatctacggcgcagctttctcgggtgtgtcatggactatgaagatactgatcggcgtaattattacctggatcgggatgaattcccggagcacctccctgtcggtctccctggtcctcgtgggcatcgtgacgctgtacttgggggtaatggtgcaggctgatagcggctgcgtggtctcctggaagaacaaggaactcaagtgcggcagcgggatcttcatcaccgacaacgtgcacacctggaccgagcagtataagtttcaacccgagagcccttccaagctggctagcgccatacagaaggcgcaggaggagggcatatgcggcatccgcagcgtcacgcggctagagaacctgatgtggaagcagatcactcccgagctaaaccatatactcgccgagaacgaagtcaagctcaccatcatgaccggcgacatcaaagggatcatgcaggccgggaagcgtagcctgcggccgcagcccacggaactaaagtactcttggaagacctgggggaaggctaagatgctctctaccgagtcccacaatcagactttcctgatcgacgggcccgagacggccgagtgccccaacaccaaccgcgcctggaactctctggaagttgaggactacggctttggggtcttcaccaccaacatctggctcaagctgaaggagaagcaggacgccttctgcgattccaagctgatgagcgccgcgatcaaggacaaccgggccgtccatgccgacatgggctactggatcgagtccgccctcaacgacacgtggaagatagagaaagccagcttcattgaagtgaaaaactgccactggcccaagtcccacaccctctggagcaacggcgtgcttgaaagtgagatgatcatccccaaaaacctcgcagggcctgtatcacagcacaactacagaccgggctatcacacccagatcgccgggccctggcacctggggaagctggagatggacttcgacttctgcgacgggaccaccgtaatcgtgaccgaggattgcggcaatcgggggccctccctccgcaccaccactgccagcgggaagctcatcacggagtggtgctgtcggagctgcacgttgccaccgctaaggtaccggggcgaggacgggtgttggtacggcatggaaatccgccccctgaaggagaaggaggagaacctggtcaattccctcgtgacagccgggcatgggcaggtggacaacttcagcttgggcgtcctggggctcgcactgttcctggaggagatgctccggacccgcgtgggcaccaaacatgccatcctgctagtggccgtttcttttgtgaccctcatcaccgggaacatgtctgtgaaggaccttggacgggtcgtcgtgatggtcggggccaccatgacggacgacatcggcatgggcgtgacctaccttgctctcctggcggcgttcaaggtgcggcccacattcgccgccggattgctcctgcggaagctgacctccaaggaactcatgatgactaccataggcatcgtgctgctgagccagagcaccatccccgagaccatcctcgaactgacggacgccctggcgctcgggatgatggtcctgaagattgtgcgcgacatggagaagtaccagctagccgtgaccataatggctatcctctgcgtgccgaacgccgtcatcctgcagaacgcatggaaggttagctgtaccatcctagcggtagtctccgtgagccccttactactgacctccagccagcagaagacggactggattcctctcgccttaacgatcaagggcctgaaccccaccgccattttcctcaccacgctgagcaggaccaacaagaagcgctcgtggccgttaaatgaggccattatggcggtgggtatggtctctatactcgcctcctcactgctgaagaacgacatcccgatgacagggcccctcgtggcgggcgggctgcttaccgtgtgttacgtcctgacgggcaggagcgccgacctggagctggagagagccacggacgtaaagtgggaggaccaggctgagatctccggtagcagccccatcctctcgatcaccatcagcgaggacggatccatgagtatcaagaacgaggaggaggagcagacccttacgatattgatccgcaccggcctcctggttatcagcgggctgtttccggtctctatccccatcaccgccgccgcctggtatctctgggaagttaagaagcaacgggccggcgtgctgtgggacgtaccaagcccacctcccatggggaaagcggagctggaggatggcgcctatcgtattaaacagaagggaatcctgggctactcacagataggtgccggggtgtacaaggagggcacctttcacaccatgtggcatgtgacgcgaggagcggtcctaatgcacaagggcaagcgcatcgagccctcctgggcggacgttaagaaagacctgatcagctacggggggggctggaaattagagggggaatggaaggagggggaggaggtgcaggtcctggcactggagccagggaaaaatccccgcgccgtgcagaccaagcccggcctcttcaaaacgaacactggtacgattggtgccgtgtcactggacttcagccccggaacctcaggatcccccatcatagacaagaaggggaaggtagtggggctgtacggcaacggggtggtcaccaggtccggtgcctacgtgagcgccatagcacagaccgagaagtccatcgaggacaaccctgagatcgaggacgacatctttcggaagcgccggctcacgatcatggacttgcaccccggagccgggaagaccaagcgataccttcccgccatcgtgcgggaggctatcaagcgaggcctgcggaccctcatcctggccccgacccgagtcgttgccgccgagatggaggaggccttacgggggctgcccatccgctaccagacgccagccatccgggcggaacataccggccgcgagatcgtagacctgatgtgccacgccaccttcaccatgcgcctgctcagcccggtccgggtgccgaactacaacctgatcatcatggacgaggcccatttcacggaccccgcctctatcgccgcgcgcggatatatctctacccgcgttgaaatgggggaggccgccggcatctttatgaccgctacgccgcccgggagccgcgacccattcccccagtccaacgcccccatcatcgacgaggagagggagatccccgaacgctcatggaactccggccacgaatgggtcacggacttcaagggtaagactgtttggttcgtgccgagcatcaaggcgggcaacgacatcgccgcctgcctgcggaaaaacggcaagaaggtcatccagctctcccggaagaccttcgacagcgagtacgtgaagacccggaccaacgattgggacttcgtggtgaccaccgatatatccgaaatgggtgctaacttcaaggcggagagggtcatcgaccctcggcgctgcatgaagcccgtgatcctgaccgatggcgaggagcgggtcatcctggccgggcccatgccagtcacgcacagctccgccgcgcagcgccggggccgcatcgggcggaatcccaagaacgagaacgatcagtacatctacatgggcgaacccctcgaaaacgacgaggactgcgcgcactggaaggaggctaagatgctgttggacaacatcaatacccccgagggtataatcccgagcatgttcgagcccgaacgagagaaggtggacgccatcgatggggaataccgtctccgcggcgaggctcgaaagacttttgtcgaccttatgcggcgcggcgatctgcccgtgtggttggcctacaaagtggccgcggagggaacgaactacgccgaccggcgctggtgtttcgatgggatcaagaacaaccaaatcctcgaggagaacgtagaggtggagatctggacgaaggagggcgagcggaagaagcttaagccgcgctggctcgacgcccggatatactccgacccactggccctcaaggagtttaaggagttcgccgcaggccgaaagagcctcaccctgaacctgataaccgagatgggtagattgcccacctttatgactcagaagacccgcgatgccctggataacctggccgtcctccacaccgccgaggccggcggacgggcctacaaccatgcgctgtccgagctgcccgagaccctcgagacgttactgctcctgaccctgctcgccaccgtgacgggcggcatcttcctgttcctgatgagcggcaggggtatagggaagatgactctcggcatgtgctgcataatcacagcatccatccttctgtggtacgcgcagatccagccgcactggatcgccgccagcatcatcttagagttcttcttgatcgtgctgctcatccctgagcccgagaagcaacggactccccaggacaaccagctgacctacgtcgtcatcgccatcctgacggtggtcgccgccaccatggccaatgaaatggggttcctcgagaagacaaagaaggacctgggcctgggcagcatcgccactcagcagccggagtctaacatcctcgacatcgatctgcgccctgcctccgcctggaccctgtacgcggttgccacgaccttcgtgaccccaatgttacggcacagcatcgagaacagctccgtgaacgtgagcctcaccgcgatcgccaaccaagccaccgtgcttatggggctcggcaaggggtggcccttgagcaagatggacatcggcgtcccgctgttggcgatcggatgctacagccaggtgaaccccatcaccctgaccgccgccctgctcctgcttgtggcacactacgcgataattggccccggcctccaggccaaagccacccgcgaggcccagaagcgggccgcggccgggattatgaagaaccccacggtcgacggaatcacggtcatcgacctggacccgatcccctacgaccccaaattcgagaaacaactgggccaggtgatgttactgatcctgtgcgtgacgcaggtgctcatgatgcgcaccacgtgggccctgtgcgaggcgctgacactcgccaccggccccatctccaccctgtgggaggggaacccaggtcggttctggaacacgaccatcgcggtgagcatggcgaacatcttccgcggttcctacctagcaggggccggcctcctgttcagcatcatgaagaacaccaccaatacacggcgcgggactggcaacatcggcgagaccttgggggaaaagtggaagagtcgtcttaacgcactgggcaagagcgagtttcagacctataaaaagtcggggatccaggaggtcgaccggacgctggctaaggagggcatcaagaggggcgagaccgatcaccacgcagtcagccggggttccgccaagttgcgctggttcgtggaacggaatatggtcacccccgagggcaaggtagtagacctggggtgcggcagagggggctggagctactactgcggcgggctaaaaaacgtccgggaggtgaaggggctcaccaagggcgggcccgggcacgaggagcccatcccgatgtctacgtacggctggaatcttgtgcgcctgcagagcggcgtcgacgtattctttataccacccgagaagtgcgacacactcctgtgcgacatcggcgagtctagccccaatccgaccgtggaagccggccggacgctgcgcgtccttaacttagtggagaactggctgaacaacaacacccagttttgcatcaaggtgctgaacccctacatgcccagcgtcatcgagaagatggaggcgctgcagcggaaacacgggggcgccctggtccgcaacccgttaagccggaacagcacgcacgagatgtactgggtgtccaacgccagcgggaacatcgtatccagcgtgaatatgatcagccgcatgctcatcaaccggttcaccatgcgccacaaaaaagccacctatgaacccgacgtggacttgggtagcgggacccggaacatcgggatcgagtctgagatccccaatctggacatcatcggcaagcgcatcgagaaaatcaagcaggagcacgagaccagttggcactacgatcaagaccacccctacaagacatgggcctaccacgggtcctacgagaccaagcaaacgggcagcgcgtccagcatggtcaacggagtggtgcggctcctgacgaagccgtgggacgtcctgcccaccgtgacacagatggccatgactgacacgacccccttcggccaacagcgcgtgttcaaagagaaggtcgacacccgcacccaagagcccaaggaggggacgaagaagctcatgaagatcaccgccgaatggctgtggaaggagctgggaaagaaaaagaccccgcggatgtgcacccgtgaggagttcacgcggaaggtgcgctccaacgctgccctcggcgcgatcttcacagatgagaataagtggaagtccgcccgtgaggctgtggaggactcacgcttctgggagttagttgaccgggagcgcaacctgcacctcgaggggaagtgcgagacctgcgtgtacaacatgatgggcaagcgggagaagaagctgggggagttcggcaaagcgaaaggcagccgcgccatctggtacatgtggctgggggcgcgattccttgagttcgaggccctgggcttcctaaacgaggaccactggtttagccgcgagaatagcctttccggggtcgagggcgaaggactgcataagcttggctacatcctccgggacgtgagcaagaaagagggcggggccatgtacgccgacgacaccgcgggctgggacactcgtatcaccctggaggacctgaagaacgaagaaatggtgaccaaccacatggagggtgagcacaagaaactcgccgaggccatcttcaagctgacctaccaaaacaaggtagttcgcgtgcagcgccccacgccccggggcaccgtcatggacatcatcagcagacgtgaccagcgcgggtctggccaagtgggcacctacgggctgaacaccttcacgaacatggaggcccagctaatccgtcagatggagggcgagggggtgttcaagaatatccaacacctgacggccaccgaggaggtcgcggtgcaaaactggctggcccgcgtgggccgcgagcggctcagccgcatggccatatccggcgacgactgcgtcgtgaagcccctggacgaccggttcgccaatgccctgaccgcgttaaacgacatggggaaaatcagaaaggacatccagcaatgggagccaagcaagggttggaacgactggacgcaggtcccgttctgcagccaccacttccacgagttaatcatgaaagacgggcgtgtgctggtggtgccgtgtcgcaaccaagacgagctcatcggccgtgctcgcatcagccagggggccggctggtctctgcgggagaccgcgtgtctggggaagagctatgcccagatgtggtccctcatgtacttccacaggcgggatctgcgcctggcagccaacgccatttgcagcgccgtcccctcccactgggtgccgacaagcagaacaacctggtccatccacgccaagcacgagtggatgacgaccgaggacatgctcaccgtgtggaaccgcgtctggattcgggagaacccctggatggaggacaagaccccagtcgagagctgggaggagatcccctacctggggaaacgcgaagatcagtggtgtggctccctcatcggtctcacgtcccgggcgacctgggccaagaacatccaggccgccatcaaccaggtgcgctccttgattggaaacgaggagtacaccgactacatgccgagcatgaagcggttccgccgcgaggaggaggaggctggtgtcctgtggtaa

SEQ ID NO: 24978 - RNA, 9876 nt, synthetic construct
  misc_feature 1..9876: note = derived and/or modified CDS sequence (opt11) from DENV-2__GQ868624__SS-prME
  source 1..9876: mol_type = other RNA
agtgcgggcatgatcatcatgctgattcccaccgtgatggccttccacctcaccacccgcaacggggagccccacatgatcgtcggtatccaggagaaggggaagtccctgctcttcaaaaccgaggatggcgtgaacatgtgcacgctcatggcgatggatctgggggagctgtgcgaggacaccattacctacaagtgccccctcctgcggcagaatgagcccgaggacatcgattgctggtgcaacagcaccagcacctgggtgacctacgggacctgcaccaccaccggcgagcatcgccgggagaagcgcagcgtcgccctggtgccccacgtggggatgggcctcgagacccggaccgagacctggatgtccagcgagggggcctggaagcacgcccagcgaatcgagacttggatccttcggcacccgggcttcacgatcatggccgcaatcctggcttacaccatcgggaccacccacttccagcgcgtcctcatcttcatcctgttgacggccgtggccccgtccatgaccatgaggtgcatcggcatcagcaaccgcgacttcgttgagggcgtctctggtggcagctgggtggacatcgtgctcgagcacgggtcctgcgtcaccaccatggcgaagaacaagcccacactggacttcgagctgatcaagaccgaagccaagcagcccgccaccctccggaagtactgcatcgaggcgaagctgaccaacacgaccaccgagagccgctgccccacccagggcgaaccctccctgaaggaggagcaggacaaacggttcgtgtgcaagcacagcatggtggaccgcggatgggggaacggctgcggcctgttcggaaagggcggtatcgtcacgtgcgccatgttcacgtgcaagaaaaacatggagggcaagatcgtgcagccggagaacttagagtacaccatcgtggttacgccccactccggggaagagcacgcggtgggcaacgacacggggaagcacggcatggagatcaaggtgaccccgcagagctccatcaccgaggccgagctgactgggtacggcaccgtcaccatggagtgctctccccggaccggcctcgacttcaacgagatggtgctgctgcagatggagaacaaggcctggttagtgcaccgccagtggttcctcgacctgcccctcccctggctgccgggggccgacaagcaggaatcaaattggatccagaaggagaccctggtaaccttcaagaacccccacgccaagaagcaggacgtggtcgtgctcggcagccaggagggcgcgatgcacaccgccctgaccggcgccaccgagatccaaatgagctccgggaacctcctgttcacgggccacttgaagtgccggctgagaatggacaagctccagctgaagggcatgagctactccatgtgcacggggaagttcaaggtggtcaaggagatcgcagagacccagcatggaaccatcgtgatccgggtgcagtacgagggggacggcagcccctgcaagatccccttcgagatcatggacctggagaagcgctacgtcctcggccggctgataaccgtgaatccgatcgtgacggagaaggactcccccgtcaacatcgaggccgagccgcccttcggggactcgtacatcataatcggcgtggagccgggacagctgaagctcaactggttcaaaaagggctccagcatcgggcagatgttcgagaccaccatgcgcggggcgaagcgcatggcaattctgggcgacaccgcctgggatttcgggtccctgggcggggtgttcacgagcatcggcaaggccctccaccaggtcttcggggccatctacggggcagccttctctggcgtgagctggaccatgaagatactgatcggggtgatcatcacctggatcggcatgaactcccggagcaccagcctgagcgtgtctctggtactcgtggggatcgtcacgctgtatctgggagtgatggtgcaggctgacagcgggtgcgtcgtttcatggaagaacaaggagctcaagtgcggcagcggcatcttcatcacggacaacgtgcacacctggaccgagcagtacaagttccagccagagagcccctccaagcttgccagcgcgatccagaaggcccaggaggagggaatctgtggcatccgctccgtcacgaggctggagaacctcatgtggaagcagatcaccccagagctgaaccacatactggccgagaacgaagtgaagctcaccatcatgacgggggacatcaagggcatcatgcaggcagggaagcgctccctgcggccgcagcccacggagctgaagtactcctggaagacctggggcaaggccaagatgctcagcaccgagtcctacaaccagaccttcctaatcgacggccccgaaacggcggagtgcccgaacaccaaccgcgcctggaacagcctggaggtggaggactacggcttcggagtcttcaccacaaacatctggctcaagctcaaggagaagcaggacgccttctgcgactccaagctgatgagtgccgccatcaaggacaaccgggcggtccacgccgacatggggtactggatcgagtcagccttaaacgatacgtggaagatcgagaaggctagcttcatcgaggtaaagaactgtcactggcccaagtcccacaccctgtggagcaacggcgtcctggagtccgaaatgataattcccaagaacctcgccggccccgtgtcccagcacaactaccgcccggggtaccacacccagatagcgggcccctggcacttagggaagctggagatggacttcgacttctgcgacggcaccaccgtgatcgtcactgaggactgcgggaaccggggcccctccctccgcaccacgaccgccagcggcaagctgatcacggagtggtgctgccggagctgtaccttacccccgctccgctaccgcggagaggacggttgctggtacgggatggagatccgcccccttaaggagaaggaggagaacctggtgaactccctcgtgaccgccggccacgggcaggtcgacaatttcagcctgggcgttctgggcatggccctcttcctggaggaaatgctgcgtacccgcgtggggacgaagcacgcgatcctcctggtcgccgtgtccttcgtcaccctgatcaccggcaacatgagcttcaaagacctcgggagggtcgtggtgatggtcggcgctaccatggccgacgacatcgggatgggcgtgacgtacctggccctgctcgcggccttcaaggtacgccccaccttcgccgccggcctgttgctcagaaagctgacctccaaggaactgatgatgaccacaatcgggatcgtcctcctgagccagtccaccatccccgagaccgtgctggagctgaccgacgccctggcgctgggcatgatggtgctcaagatcgtccgcaacatggagaagtatcagctggcagttacgatcatggccatcctgtgcgtcccgaacgccgtgatccttcagaacgcctggaaggtgagctgcaccattctggcggtcgtgtccgtgagccccctgctcctgacctccagccagcagaaaactgactggatccccctggccctcacgatcaaggggctgaaccccacggccatcttcctgaccaccctctcccgcacgaacaaaaagcggagctggccgctgaacgaggccatcatggcggtcggcatggtgtccatactggccagctcccttctgaagaatgacatccccatgaccggcccccttgtggccgggggtctccttaccgtctgctacgtgctgaccggccggagcgctgacctcgagctggagcgggccacggacgtgaagtgggaggaccaggcggagatctccggcagcagccccatcttgtccataaccatcagcgaggacgggagcatgagcattaagaatgaggaggaggagcagacactcactatcctgatccgcacgggactgctcgtaatctccggcctgttcccgatcagcatccccatcactgccgccgcttggtacctgtgggaggtgaagaagcagcgggccggggtgctctgggacgtccccagcccgccgcccatgggcaaggcggagctggaagacggggcctaccgcatcaagcaaaagggcatcctggggtacagccaaatcggcgccggcgtctacaaggaggggaccttccacaccatgtggcacgtgacccgcggcgccgtactcatgcacaaggggaagcggatcgagccgtcatgggctgacgtgaagaaggacctgatcagctatggcggaggctggaagctggagggcgagtggaaggagggtgaggaggtgcaggtcctcgcgttagagcccggcaaaaacccccgggccgtgcagacaaagcccgggctgttcaagaccaacaccggaaccatcggggccgtgtccctcgacttcagccccggcacatccggcagccccatcatagacaagaaggggaaggtcgtgggcctgtacgggaacggcgtggtcacccgctccggcgcgtacgtaagtgcaatcgcgcagaccgagaagtccatcgaggacaaccccgagatagaggacgacatcttccggaagcgccggctgaccatcatggacctgcaccccggggccggcaagacaaaacgctatctccccgccatcgtgcgggaggccatcaagcgcgggctgcggaccctgatcctcgcgccgacccgcgtcgtggccgccgagatggaggaggccctgcggggcctgcccatccgttaccagacccccgccatccgggcggagcacacgggccgcgagatcgtggacctcatgtgtcacgccaccttcaccatgcgcctgctatccccagtccgcgtgccaaattacaacctcatcatcatggacgaggcacacttcaccgatcccgcctccatcgccgcacgcggctacatcagcacgcgggtggagatgggggaggccgccgggatcttcatgaccgccacgccgcccggcagccgagacccgtttcctcagtccaacgcccccatcatcgacgaagagcgggagatccccgaaaggagctggaactccgggcatgagtgggtcacagacttcaagggcaagacggtgtggttcgtgccgagcatcaaggcggggaacgacatcgccgcctgtctgcggaagaacggcaagaaggtcatccaactgtcccgcaagaccttcgacagcgagtacgtaaagacccggaccaacgactgggacttcgttgtcacgaccgacatctccgagatgggcgccaacttcaaggcggagcgcgtcatcgacccccggcgctgcatgaagcccgtgatcttaaccgacggggaggagcgggtcatcctggccggccccatgccggtgacccacagttccgccgcccagcgccgggggcgcatcggccggaaccccaagaacgagaacgaccaatacatctatatgggggagcctctggagaacgatgaggactgcgctcactggaaagaggcgaagatgctactggacaacataaacacgcccgagggcatcatccctagcatgttcgagcctgagcgcgaaaaagtggacgccatcgacggcgagtaccggcttcgcggggaagcccgcaagaccttcgtcgacctcatgcggcgcggcgacctgcccgtgtggcttgcctacaaggtggccgcggaggggatcaattacgccgaccggcgctggtgcttcgacggtatcaagaacaaccaaatccttgaggagaacgtcgaggtggagatctggaccaaggagggggagcggaagaagctgaagccgcgctggctggacgcccggatctactccgaccccctcgccctgaaggagttcaaggagttcgccgctggccgcaagagcctgaccctcaacctgatcacggagatgggccggctgcccacttttatgacccagaagaccagggacgccctcgacaacctggccgtcctgcacacggccgaggccggcgggcgggcctacaaccacgccctctccgagctgcccgagaccctagagaccctcctgctgctcactctgctggccacggtaacagggggcatcttcctcttcctgatgtcaggccgagggatcggcaagatgaccctggggatgtgctgtatcatcaccgcctccatcctcctgtggtacgcgcagatccagccacactggatcgccgccagcatcatcctggagttcttcctcatcgtgttgctgatccccgagcccgagaagcagcggacgccccaggacaaccaactcacgtacgtcgtgatcgccatcctgaccgtggtcgctgcgacaatggccaacgagatgggcttcctggagaagacaaagaaggacctcgggctgggctccatcgccacgcaacagccggagtccaacatcctggacatcgacctccgcccggcctccgcatggactctgtacgctgtggcaaccacgttcgtgacgcccatgctgcggcacagcatcgagaacagctccgtcaacgtgagcctcaccgctattgccaaccaggccacggtgctgatgggccttgggaagggctggcccctctccaagatggacatcggggtcccgctgctggcgatcggctgctactctcaggttaatcccatcactctgacggccgccctgctgctcctggtggcccactacgcgatcatcgggcccggcctgcaggccaaggccacccgcgaggcccaaaagcgggccgcagccggcatcatgaagaaccccaccgtcgacgggatcaccgtgatcgacctcgacccaatcccctacgaccccaagttcgagaagcaacttggccaggtgatgctgctcatcctgtgcgtcacccaggtgctgatgatgcgcaccacctgggccctctgcgaggccctgaccctggccacggggcccatcagtacactctgggagggcaacccggggagattctggaacaccaccatcgcagtaagcatggccaacatcttccgcggctcctacttggccggcgccgggctcctcttcagcatcatgaagaacacgaccaacacccggcgcggcaccgggaacatcggcgagacgttgggcgagaagtggaagtcccgcttgaacgccctcgggaagtccgagtttcagatctacaagaagtccggcatccaggaagtcgaccggaccttagcgaaggaggggatcaagcgcggggagacggaccaccacgccgtgagccgggggtcggccaagctgcgctggttcgtagagcggaatatggtcacccccgagggcaaggtcgtggacctcggctgtgggcgcggcgggtggagctactactgcggcggtctgaagaacgtccgggaggtgaagggcctgacgaagggcggccccggccacgaagagcccatcccgatgtccacgtacgggtggaacctcgtgcgcctgcaatcgggcgtcgacgtgttcttcatcccgcctgagaagtgcgataccctgctctgcgacatcggagagtccagccccaacccgaccgtggaggccgggcggacgctgcgcgtactgaacctcgtggagaactggttaaacaacaatacccagttctgtatcaaggtgctgaacccctacatgccttccgttatcgagaagatggaggcgctgcagcggaagtacggcggagccctcgtgcggaaccctctgagccggaacagcacccacgagatgtattgggtgagcaacgccagcggcaacatagtctcctcagtgaacatgatctcccgcatgctgatcaaccggttcacaatgcgccacaagaaggccacctacgagcccgacgtggacctcgggagcggcacgcggaacatcgggatcgagagcgaaatccccaacctggacatcatcggaaagcgcatcgagaagatcaaggaggaacacgagaccagctggcactacgaccaggaccacccctacaagacctgggcctaccacggctcctacgagaccaagcagacggggagcgcgtccagcatggtaaacggcgtggtgagactgttgaccaagccgtgggacgtgctgcccaccgtgacccaaatggctatgactgacaccacccccttcgggcagcagcgcgtcttcaaggagaaggtcgacacccgcacgcaggagcccaaggaaggcaccaagaagctgatgaagatcaccgccgagtggctctggaaggagctgggcaagaaaaagaccccgcggatgtgcacgcgcgaggaattcacccgcaaggtgcgctccaacgcagccctgggggcgatcttcaccgacgaaaacaagtggaagagcgcccgggaggcagtggaggacagtcgcttctgggagctcgtcgacaaggagcggaatctgcacctggagggcaagtgcgagacctgcgtgtacaacatgatggggaagcgcgagaagaagctcggcgagtttgggaaggccaagggctcacgggccatctggtacatgtggctgggcgcgcgcttcctggagttcgaggcccttggtttcctgaacgaggaccattggttctcccgggagaacagcctgtccggcgtcgagggggagggcctccacaagctggggtacatactacgcgacgtgagcaagaaggaaggcggcgcaatgtacgctgacgacacggcgggttgggacacccggatcaccctcgaggacctgaagaacgaggagatggtgaccaaccacatggagggcgagcacaagaagctggctgaggccatctttaagctcacgtaccagaacaaggtcgtgcgcgttcagcggcccacgccccgggggaccgtaatggacatcatcagccggcgcgaccagcggggctccggccaggtggggacctatggcctcaacacgttcaccaacatggaggcccagctgatccgccagatggagggggagggcgtgttcaagaacatccagcacctcactgtcaccgaggaggccgcggtgcagaactggctggcccgggtggggcgcgagcgcctgagccgaatggccatatccggcgacgactgcgtcgtaaagcccctcgacgaccgctttgccaacgccctgacggctctgaacgacatgggcaagatccggaaggacatccagcagtgggaaccgagcaaggggtggaacgactggacccaggtgcccttctgctcccatcacttccacgagctcatcatgaaggacgggcgcgtcctggtggtgccctgccggaaccaggatgagctgatcgggcgcgcccggatttcccagggcgccggttggtcccttcgcgagaccgcctgcctgggcaagagctacgcccagatgtggtccttgatgtacttccaccggcgcgacctcaggctagcggccaacgccatctgcagcgcggtcccctcccactgggtgccgacaagccgcacgacctggtctatccacgccaagcacgagtggatgaccactgaggatatgctgaccgtctggaaccgggtctggatccgcgagaacccctggatggaggacaaaacgcccgtggagagctgggaggagatcccttacctcggaaaacgtgaggaccagtggtgcggatccctgatcggcctgaccagccgcgcgacctgggcgaagaacatccaggcagccatcaaccaggtgcggtccctaatcgggaacgaggagtacaccgactatatgccgagcatgaagcgtttccggagagaggaggaggaggcgggcgtcctgtggtag

SEQ ID NO: 24979 - RNA, 9876 nt, synthetic construct
  misc_feature 1..9876: note = derived and/or modified CDS sequence (opt11) from DENV-2__FJ639717__SS-prME
  source 1..9876: mol_type = other RNA
agcgctggcatgatcattatgctgatccctactgtgatggccttccacctcaccacccgcaatggggaaccccacatgatcgtgggcatccaggaaaagggcaagagcctgctattcaagaccgaagatggcgtgaatatgtgtaccctcatggcgatggacctgggggagctatgcgaggacaccatcacctataaatgccccctcctgcggcaaaacgagcccgaggatatcgactgttggtgcaacagcactagcacttgggtgacttacgggacctgtaccaccaccggcgagcaccgccgggagaagcgcagcgtagccctggtacctcacgtggggatgggccttgagacccgaaccgagacctggatgtctagcgagggggcctggaagcacgctcagcgcatcgagacctggatcctgcgccatccgggcttcacgattatggccgcgatcctggcctacaccattgggaccacccactttcagcgcgccctcattttcatcttgctgacggctgtcgcgccctccatgaccatgcggtgcatcgggatcagtaaccgcgacttcgtggaaggcgtgagcgggggatcgtgggtcgacatcgtgttggagcacggttcctgcgtgaccactatggccaagaacaagcctacgctggacttcgagctgatcaagaccgaggcgaagcaacccgccaccctgcggaagtattgcattgaagccaagctgaccaacaccaccaccgagagccgctgccccacccagggtgagcccagtctgaaggaggagcaggacaagcgcttcgtatgcaagcacagcatggtggaccgcgggtgggggaacgggtgcgggctattcgggaaaggagggatcgtgacgtgtgcgatgtttacgtgcaagaagaacatggagggcaagatcgtccagcccgagaacctggagtacaccattgtggtaacgccccactccggggaggagcacgccgtcggcaacgacacggggaagcacgggaaggagataaaggtgaccccgcagagctccatcaccgaggccgagctgaccgggtacggcaccgtgacgatggagtgcagcccccggacgggcctcgatttcaacgagatggtcctgctgcagatggagtccaaggcttggctcgtgcaccgccagtggttcctggacctgccactcccctggttgcctggcgccgacaagcagggcagcaactggatccagaaggaaactctggtgaccttcaagaacccccacgcgaagaagcaggacgtcgtggtgctcggttctcaggagggcgcaatgcacacggccttgaccggggccaccgagatccagatgtccagcggcaacctcctgttcaccggccacctgaagtgccggctacgcatggacaagctccagctgaaggggatgtcctacagcatgtgcaccggaaagttcaaggtggtgaaggagatcgccgagacgcagcacgggaccatcgtcatccgggtccaatacgagggcgacgggtccccatgcaagatcccgttcgagattatggatctggagaagcgctacgtgctcgggcggcttatcaccgtcaacccgatcgtgacggagaaagacagtcctgtgaacatcgaggcggaaccgcccttcggcgactcctacatcattatcggtgtcgagccgggccagctgaagctcaactggttcaagaaggggagctccatcgggcagatgttcgagaccaccatgcgcggtgctaagcgaatggccattctcggggacaccgcctgggactttggcagcctcggcggggtattcacgtccatagggaaggccctccaccaagtcttcggggctatctacggcgccgccttcagcggggtctcatggaccatgaagattctgattggagttattatcacctggattgggatgaacagccggtccacctcgctgtccgtgagcctggtcctggtgggcatagtgacgctgtatcttggggtcatggtgcaagccgacagtggctgcgtagtcagctggaagaacaaggagctaaagtgtggctcagggattttcattaccgataacgtgcacacctggaccgagcagtacaagtttcagcctgagagtcctagcaagctggcctccgccatacagaaggcacaggaagagggcatatgcggaatacgatcggtgacgcggctggagaatctaatgtggaaacagatcaccccagagcttaaccacatcctggccgagaacgaggtcaagttaaccatcatgaccggcgacataaaggggattatgcaggccggcaagcggtccctgcgcccgcagcccactgagctgaagtacagctggaaaacctggggcaaggcgaagatgctctccaccgagagccacaaccagaccttcctgatcgacgggcccgagacggcagagtgcccgaacacaaatcgggcctggaactccctggaggtcgaggactacggatttggggtgttcaccacaaacatctggctaaagctcaaggagaagcaggatgccttctgcgacagtaagttgatgtcggccgcgatcaaggacaatcgggccgtccacgcggacatgggctactggatagaaagcgccctcaatgacacgtggaagatcgagaaggccagtttcatcgaggtgaagaactgccactggcccaagagccacaccctgtggtctaatggcgtgctggaaagcgagatgatcatccccaaaaacctagctgggcccgtctcccaacacaactaccgcccgggctaccacacccagaccgcagggccttggcacctggggaagctggagatggatttcgatttctgcgacggtaccacggtgatcgtgaccgaggactgcggcaatcgaggcccgagcctccgcaccaccacggccagcggcaaactgatcaccgagtggtgctgccggtcttgcaccctgcccccgcttcgataccggggcgaggatgggtgttggtacggtatggagatcagacccctgaaagagaaggaggagaacctggtcaacagcctcgttaccgccggacacggccaggtggacaacttctcactgggcgtcctggggatggccctgttcttggaggagatgctgcggacgcgcgtcggcaccaagcacgccatcctcttggttgccgtcagcttcgtgaccctgatcaccgggaacatgtccttcaaggacttaggccgcgtggtcgtgatggtggggacgaccatgacagacgacataggcatgggtgtcacttacctggccctgttggccgcgttcaaggtgcgccccacattcgccgccgggctgctgttacggaagctgaccagcaaggagttgatgatgaccaccatcggcatcgtgctcctgagtcagagcacgatccctgagacgatcctggagctcaccgacgcactggcccttgggatgatggtccttaaaatcgtgcgcgacatggaaaaataccagctggcagtgaccatcatggccatcctgtgcgtcccgaatgccgtgatcctccaaaacgcctggaaggtctcctgcaccatcctggcggtggtgagcgtcagccccctgctcctgacgagctcccagcagaagacggattggatccccctagcgctcaccatcaagggcctgaaccccacggccatcttcctgacaaccctcagccgaactaacaaaaagcgttcctggccgctgaacgaggccatcatggcggtgggcatggtgagtatcctggcttcctcactccttaagaacgacatccccatgacgggtcccctggtcgctggcgggctcctgaccgtgtgctacgtgctgaccggcaggagcgcggacctcgagctggagcgtgccaccgatgtcaagtgggaggatcaggccgagatctcggggagctcccccatcctgagcatcaccatctcagaagatggcagtatgtccattaagaacgaggaggaggaacagactctcactatactgatccgaactggcttactcgtgatcagtgggctgttccccgtttccataccgatcaccgcggccgcctggtatctgtgggaggtaaagaagcagcgggccggcgtgctctgggacgtgccctccccaccgcccatggggaaggctgagttggaggacggcgcgtaccgcatcaagcagaagggaatcctgggttactcccagatcggcgccggagtctacaaggagggcacgttccacaccatgtggcacgtgacccgcggagcggtcctcatgcacaagggcaagcgcatcgagcctagttgggccgacgttaagaaggaccttatctcctacgggggcggctggaagctggagggggagtggaaggagggagaggaggtccaggtgctcgccctggaacccggcaagaacccgcgggcggtccaaaccaagccaggactgttcaagacgaacaccgggaccatcggcgccgtgagcctcgatttctcgcccggcaccagcggctcccctataatcgataagaaaggcaaggtcgtcgggctgtacgggaacggcgttgtgacgcgcagcggggcctacgtctccgccatagcccagaccgagaagtccatcgaggacaaccccgagatagaagacgacatcttccggaagcgccggttaaccataatggacctgcacccaggtgcagggaaaaccaagcgctacctccctgcaatcgtgagagaggccatcaagcgcggcctgcgaacgctgatcctcgcccccacccgcgtggtcgcggctgagatggaggaggccctgcgggggttgcccatccgctaccagacccccgccatccgcgccgagcacaccgggcgcgagatcgtggacctcatgtgccacgcaacgttcactatgcgtcttctgtcccccgtgcgggtcccgaactacaatctcatcatcatggacgaggcccacttcacagatcccgcgtcaatcgccgcccgtggctacatcagcacccgggtggaaatgggtgaggcggccggcatatttatgacggccacgccgcccgggtcccgcgacccgttcccacagagcaatgcccccataatcgacgaggagcgggagatcccggagcgctcctggaataccggccacgagtgggttaccgacttcaaggggaagacggtctggttcgtgccaagtatcaaggcaggcaatgacatcgcggcctgcctgcgaaagaacggcaagaaggtgatccagctgtcccgcaaaaccttcgatagtgagtacgtgaagacccggaccaatgactgggacttcgtggtgacgaccgacatctccgaaatgggggctaatttcaaggccgagcgcgtaatcgacccccggcgctgtatgaagcccgttatccttaccgacggcgaggagcgggtgatcttagcggggcccatgccggtcacccacagctccgccgcacagcgccggggccgcatcgggcggaacccaaagaacgagaacgaccagtacatctacatgggcgagccccttgagaacgacgaggattgcgcccactggaaagaggctaagatgctcctagacaacatcaacacgcctgagggcatcatcccgagcatgttcgagcccgagcgtgagaaggtagacgctatcgacggagagtaccggctgcgcggtgaggcacgcaagaccttcgtggacctcatgaggcgaggggacctgcccgtctggctggcctacaaggtagccgccgagggcatcaactacgcggacagacgctggtgcttcgacgggattaagaacaaccagatactcgaggaaaacgtcgaggtcgagatttggaccaaggaaggcgagcggaagaaacttaagcctcgctggctcgacgcccgcatctactccgaccccctcgcgctgaaggagttcaaggagttcgccgccggccgcaagagcctaaccctcaatctcatcacggagatggggcggctgcccaccttcatgacccagaagacccgcgacgccctcgacaatttggccgtattacacacggccgaggccggcgggcgggcgtacaaccacgccctctccgagctgcccgagaccctggagacccttctgctgttaacgttacttgccaccgttacgggcggaatcttcctcttcctgatgagcggacgcggcatcgggaaaatgaccctgggcatgtgctgcatcatcaccgcctccgtgctactctggtacgcccaaatccaaccgcactggatcgcggcctcgatcattcttgagttcttcctcatagtgctccttatcccggagcccgaaaagcagcggacgccccaggacaaccagctcacgtatgtagtgatcgcgatcctgaccgtagtcgcggccaccatggcgaacgagatggggttcctggagaaaaccaagaaggacctcggcctgggctccatcgcgacacagcagccggagagcaacatcctggacatcgacctccgcccggcctccgcctggaccctgtacgcagtggcgaccacctttgtgacgcccatgttacggcacagcatagagaacagctccgttaacgtcagcctcacagccatagccaatcaggccaccgttctgatggggttaggtaaggggtggcccctctccaagatggatattggcgttccgctcctggctatcgggtgctacagccaggttaaccccataaccctcacggcggccctgctgcttttagtggcccattacgccatcatcggccctggcctgcaggcgaaagccacccgcgaggcgcagaagcgggccgccgcaggcatcatgaagaaccccaccgtcgacggcatcaccgtcatcgacctcgacccgatcccctacgacccgaaattcgagaaacagctgggccaggtcatgctgctcatcctgtgcgtcacccaggtgttaatgatgcgcaccacctgggccctctgtgaggcactgactctggcaacgggccccatctccaccttgtgggaggggaacccgggcagattctggaacaccaccatcgccgtgagtatggcgaacattttccgcggctcttacctcgctggcgccggcctcctcttcagcatcatgaaaaatactacgaacaccaggagagggaccggcaacatcggcgagaccctgggggagaagtggaagtcgcgcctgaacgccctcggcaagagcgagttccagacctataagaagtccgggattcaggaagtcgatcggaccctggccaaggaaggcatcaagagaggggaaacggaccaccacgcggtgagccgagggtccgccaagctgcgctggttcgtggagcggaacatggtcactcccgagggcaaggtggtggacctcggttgcggccgagggggctggtcttattactgcgggggccttaagaacgtccgggaggtgaagggcctgaccaagggcggaccggggcacgaggagcccatcccgatgtccacctatggctggaacttggtgcgcctacagtcgggggtcgatgtgttctttatcccgcccgagaagtgtgataccctgctctgcgatatcggcgagtccagccccaatccgaccgtggaagccggccgcacgctgcgtgtcctgaacctcgtggagaactggctaaacaacaacacccagttctgcataaaggtgctgaacccctacatgcccagcgtcatcgagaagatggaggccctgcagcggaagtacgggggcgcgctcgtgcgcaacccgctgagccggaactccacccatgagatgtactgggtgtctaacgcctcggggaatatcgtctcttcggtaaacatgatctcccgcatgctgatcaaccgattcaccatgcgccacaagaaggccacgtacgagcccgacgtggacctagggagcgggaccagaaacatcggcatcgaatccgagatccccaacctggacatcattggcaagcgcatcgagaaaatcaaacaggaacatgagacctcgtggcactacgaccaagaccacccgtataagacctgggcctaccacgggtcctacgaaacgaagcaaaccggcagcgcctccagcatggtgaacggggtcgtgcggctgctcacaaagccctgggacgtcctgcccacggtgactcagatggcgatgaccgacaccaccccctttggccagcagcgcgtgttcaaggagaaagtcgacacgcgcacccaggagccgaaggagggcacgaaaaagctgatgaagatcacggcggagtggctgtggaaggagctgggcaagaagaagacgccccggatgtgtacccgcgaggagttcacccggaaagtccggtccaacgcggccctgggagccatcttcaccgacgagaacaagtggaagtccgcgcgggaggcggtggaggactcgcgattctgggaactcgtcgacaaggagcgaaacctgcacctggaggggaaatgcgagacgtgtgtgtacaacatgatgggcaagcgtgagaagaagctaggggagttcggcaaggctaagggcagccgggccatttggtacatgtggctgggggcccgcttcctcgagttcgaggcgctcggcttcctaaacgaggaccactggttttcccgggagaactcactgtccggtgtcgaaggcgaggggctacacaaacttggttacattctgcgcgacgtatccaagaaagagggcggggccatgtacgccgacgacaccgccggctgggacacccggatcaccctcgaggatctgaagaatgaggagatggttacgaaccacatggagggcgagcataagaagctggcggaggcgatcttcaagctcacataccagaacaaggtcgtgcgcgtgcagcggcccacgccccggggcactgtcatggacatcatcagcagacgcgaccagcgggggtccgggcaagtaggaacgtacgggctgaacacattcaccaatatggaagcccagctgatcaggcagatggagggcgagggggtattcaaaaacatccagcacctcaccgccacggaggaagtcgccgtgcagaactggctggcgcgagtgggccgcgagcgcctgagccggatggccatctccggcgacgactgcgtagtgaagcctttggacgatcgcttcgccaacgccctgacggccctgaacgacatggggaaaatccggaaggacattcaacaatgggagccgtcaaagggctggaacgactggacccaggtgcccttctgctcccaccacttccacgagctcattatgaaggacgggcgcgtcctggtggtgccctgcaggaaccaggatgaactgatcggccgcgcgagaatcagccagggggccggctggtctttacgtgagaccgcctgtctgggaaagagctatgcccaaatgtggtccctgatgtactttcaccgccgcgacctccgacttgccgcgaacgccatatgtagcgccgtcccttcccactgggtcccgacaagtcgcactacctggtctatccacgccaagcacgagtggatgaccacagaggacatgctgacggtttggaaccgggtctggatccgcgagaacccatggatggaggacaagactcccgtggagagctgggaagagatcccctacttagggaaacgggaggaccagtggtgcggttccctcatcggtctgaccagccgcgcgacatgggctaagaacatccaggctgccataaaccaagtgcggtccctcataggcaacgaggagtacacggactacatgcctagcatgaaacgcttccggcgcgaggaggaggaggccggggtcctgtggtga

SEQ ID NO: 24980 - RNA, 9876 nt, synthetic construct
  misc_feature 1..9876: note = derived and/or modified CDS sequence (opt11) from DENV-2__FJ639718__SS-prME
  source 1..9876: mol_type = other RNA
tccgctggcatgatcatcatgctgatccccaccgtgatggcctttcatttgacaacacgcaatggggagccccacatgatcgtcggtatccaggagaagggcaagtccctgctgttcaagacagaggacggtgttaacatgtgtaccctgatggccatggacctgggggagctgtgcgaggacactatcacctataagtgccccttactgcggcagaatgagcccgaagacatcgactgctggtgcaacagcacaagcacctgggtgacctacgggacgtgcactaccaccggtgagcacaggcgagagaaacgcagcgtcgccctggtccctcatgtggggatgggcctcgaaacccgtaccgaaacatggatgtccagcgaaggggcctggaaacatgcccagcgcatcgaaacctggatactgcggcatcccggctttacgataatggcagcgatcctcgcctataccatcggcaccacccacttccaacgggttctgatcttcatcctgctgacggccgtcgccccctccatgaccatgcgatgtatcggcatatcaaaccgcgacttcgtggagggcgtcagtggagggagctgggtagacattgtgctcgaacacgggtcctgtgtcacgaccatggcgaagaataagcctacgctggacttcgagctgatcaagaccgaggccaagcagcccgccaccctgagaaagtactgcatcgaggccaagctgactaacaccacaactgagtcgcgctgtcccacccagggggagccttccctgaaggaagaacaagacaagcggttcgtgtgcaagcactccatggtggaccgcggatggggaaacggctgtggattatttgggaagggtgggattgtcacgtgcgccatgtttacgtgcaagaaaaacatggagggcaagatcgtgcagcccgagaacctggagtacactattgtggtaactccccacagcggcgaggagcacgcggttggtaacgacacagggaaacacggcatggagatcaaggtcacccctcagtctagcatcaccgaggcagaactgactgggtacggcaccgtcacgatggagtgcagcccgaggaccggcttggacttcaacgagatggttctgctgcagatggagaacaaggcctggctcgtgcacaggcagtggtttctggacctgccactcccctggcttcctggggccgacaaacaggagtccaactggatccaaaaagagacactggtcacctttaagaacccccacgccaaaaagcaggacgtggtagtgctcggcagccaggagggtgcaatgcacacggccctgacaggcgccaccgagattcagatgagctccgggaaccttctgtttaccgggcacctaaagtgccggttgaggatggacaaactccaactgaagggtatgagctactctatgtgtaccggcaaattcaaggtagtcaaggagatcgccgagacccagcacggcaccatcgtgatcagagtgcagtatgagggggacggcagcccctgcaagatccccttcgagatcatggatctggaaaaacgctacgtccttggccggttgatcaccgtgaacccgatcgttacggagaaggactcgccagtcaacatcgaggccgagccgccgttcggggacagctatatcattattggggtagagccgggacaactcaagttaaactggttcaagaagggctccagcatcggacaaatgttcgaaaccaccatgcgcggcgcgaagcgcatggctatcctcggcgacaccgcctgggatttcggtagccttggcggggtgttcacgagcatcggcaaggctctccaccaggtcttcggagccatctacggcgcggcgttctccggcgtgtcttggaccatgaagatcttaatcggggttataataacctggatcggtatgaactcccgaagcacctcactcagtgtgtcgttggtattggtcgggatcgtgaccctgtacctgggcgtcatggtgcaggctgacagcgggtgcgtggtatcctggaaaaacaaggagcttaagtgcggaagtggcatcttcatcactgacaacgttcacacctggaccgagcagtacaagttccagcccgaaagcccctccaaattagcaagcgcaattcagaaggcgcaggaggaggggatctgcggcatcaggagcgttacgaggctggaaaacctcatgtggaagcagataacgcccgagctgaatcacatcctggccgagaacgaggtgaagctcaccatcatgaccggggacattaagggcatcatgcaggccggaaagcgctcgctgcggccgcagcctactgagctgaagtactcctggaagacttggggaaaggccaagatgctctcaactgaatcctacaaccaaactttcctgatcgacgggccagagacggcggaatgtcccaacaccaaccgcgcctggaatagcctggaggtggaggactacgggttcggcgttttcaccaccaacatctggctcaagctgaaggagaagcaggacgcattctgcgactccaagctgatgagtgccgccatcaaggacaaccgcgctgtgcacgcagacatggggtactggatcgagagtgccttgaacgacacgtggaaaatagagaaagccagcttcatcgaggtgaagaactgccactggccaaagtcccacacgctgtggagcaacggcgtcctggagtccgaaatgatcatcccgaagaacctggctggtcctgtatcacagcacaactacagaccggggtaccacacgcagatcgcaggcccctggcacctggggaaacttgagatggactttgacttctgcgatgggacgacagtgatcgttacggaggactgcggcaataggggcccctccctccgcacgactaccgcctcgggcaaactcatcacggagtggtgctgcaggagctgtaccctacctccgctgagataccgaggggaggacggctgctggtacgggatggagatccgccccctcaaggaaaaggaagaaaacctggtgaactccctcgtgaccgctggtcatggtcaggtagacaattttagcctgggggtgctaggtatggccttattcctggaagaaatgctgcggactagagtggggacgaagcacgcgatcctccttgttgctgtctccttcgtgaccctgatcaccgggaacatgagcttcaaagacctcgggcgcgtcgtggtcatggtcggagccactatggccgatgatatagggatgggtgtgacgtacctggcgttactcgcggccttcaaggtgcgccccacgttcgccgccggcctgctgctccgaaagctgacctccaaggagctcatgatgaccactattggaatcgtcctcctgagccagagtactatcccagagaccgtgctggaactcacagacgccttggcactgggcatgatggtgctcaagattgtccgtaacatggagaagtatcagttagccgtgacgatcatggccatcctgtgcgtcccgaacgccgtgatcctccaaaacgcctggaaggtgagctgcaccatcctggccgtcgtgtcagtgagccccttgctcctcacctcctcgcaacagaagaccgactggatccccttggctctcacgattaaggggctcaatcccaccgccatctttctcaccaccttaagccgcacgaacaaaaagcgcagctggccgctgaacgaagccatcatggccgtcggaatggtctccatactagcaagctccctcctaaagaacgacatacccatgacgggtcccctggtcgccggaggcctcctgaccgtatgctacgtgctgaccgggcgcagcgccgacttggagttggagaaagccaccgatgtgaagtgggaggaccaggcagagatctccgggagcagccctatcctgtcaataaccatctccgaggacgggtccatgagcatcaagaacgaggaggaggagcagaccttaaccatccttatccgcacgggtctgctcgtgatttccggcctgttcccaatctcgatccccatcacagccgccgcgtggtacctgtgggaggtgaagaagcaacgtgccggtgtactttgggacgtcccctcgccgccgcctatgggcaaggctgaactggaggacggggcctaccggatcaagcagaaagggatccttgggtactcgcagatcggggccggcgtgtataaagagggcacgttccataccatgtggcatgtgactcgcggtgccgtcctcatgcataaggggaagcggatcgagcccagttgggccgacgtcaaaaaggacctaattagctacggcgggggctggaagctggagggtgagtggaaggagggtgaggaggtacaagtcctcgcgctggagccaggtaagaaccccagggccgtccagaccaagcccgggctgttcaagactaacacaggcaccataggggccgtgagtttggatttcagtccaggcacgtccggcagcccgattatcgacaagaaggggaaggtcgtgggcctgtatggcaatggagtggtcacacggagcggggcctacgtaagcgccatcgcgcaaaccgagaagtccatcgaggataatcctgaaatcgaagacgacatcttccgcaagagacgattgaccatcatggacctgcatcccggtgccggcaaaacaaagcggtacctccccgcgatcgttagggaagctataaagcgggggctgcgcaccttaatcttagcgccgactagggtcgtggctgccgagatggaggaggcactgcgcggcttgccgattcgctaccagactcccgctatccgcgcggagcatacggggcgcgagatagtggacctcatgtgccacgccacctttacaatgcggctactcagccccgtgcgggtgccaaactataacctgattatcatggacgaggctcactttacagatcccgcgtccatcgccgctcggggctacatctcaacgcgcgtggagatgggcgaggccgccgggatcttcatgaccgccacgcctccaggcagccgggacccgttccctcagtccaacgcccccatcatcgacgaggagcgcgagatccccgagcgctcgtggaatagtgggcacgagtgggtcactgacttcaagggcaagacggtgtggtttgtgccgagcatcaaggccggaaacgacatcgccgcctgcctgcgcaaaaacggcaagaaggtcatccagctctcccggaaaaccttcgacagtgaatacgtcaagaccaggaccaatgactgggacttcgtggtcacgaccgacatctcggagatgggcgccaacttcaaggcggaacgagtgatcgacccccgccggtgcatgaagccagtgatcctcaccgacggggaggagcgcgtgatccttgcagggcccatgcctgtgacgcacagctccgctgcccagcggagggggcggatcgggcgcaatcccaagaacgagaacgaccagtacatatacatgggcgagcccctggagaacgatgaggactgcgcccactggaaggaggcgaaaatgttattagacaacatcaatacacccgagggcatcatcccgtccatgtttgagcctgagcgtgagaaggtggatgctatcgacggcgagtaccgcctgcgcggggaggcgcgaaaaaccttcgtcgacctcatgcgccggggcgacctgcccgtgtggttggcctacaaggtggctgcggaggggatcaactatgccgatagaaggtggtgctttgacggaataaagaacaatcaaatcctcgaggagaacgtcgaggtggagatatggaccaaggagggggagcgcaagaaactgaagccgcgatggctggacgctcgcatctactcagaccccttggccctgaaggagtttaaggagttcgccgcaggccgcaagagtcttactctcaacttgatcaccgagatgggacgccttcccacctttatgacgcagaagacccgggacgcgctagataatctggccgtcctgcacacagccgaggcaggcgggcgagcatacaatcacgctttatccgagctgcctgagacactagagaccttgttgctactcacactcctggccacagtgacagggggtatctttttgttcctgatgagcggccggggcattgggaagatgacgctggggatgtgttgcatcatcaccgcctcgatcctactgtggtacgcccagatccagccgcactggatcgccgcatccatcatcctggagttcttcctcattgtcctgttgatccctgaacccgagaaacaacgtactccccaagacaaccagctcacctacgtcgttatcgccatcctgaccgtcgtcgccgcgaccatggccaacgagatgggattcctggagaaaaccaaaaaggaccttgggctgggcagcatcgctacgcaacagcctgagagcaacattctggacatagatctccgacccgccagtgcctggactctttatgcagtagctaccacctttgtcacgcccatgctgcgccacagcatcgagaacagctcggtcaacgtgagcctcaccgcaatcgcgaaccaggccaccgtgctgatgggcctgggaaagggctggcccttatccaagatggacatcggggtcccgctgcttgcgattggctgctacagccaggtgaatcccattaccttaacggccgccctgctgctcctggttgcccactacgcgatcatagggcccgggctgcaggccaaggcaacccgggaggctcagaaaagggcggcggccgggatcatgaaaaaccccaccgtcgacgggattaccgttatcgacctcgacccgatcccctacgaccccaagttcgagaagcaactgggacaggtgatgctgctcatcctgtgcgtcacccaggtgctgatgatgcggaccacctgggccttgtgcgaggccctgacccttgccacggggccaatctccacattatgggagggcaacccagggcgcttctggaacaccaccatcgcggtgagcatggccaacatcttccgtgggagctatcttgcgggggccgggctcctcttttcaatcatgaagaatacgaccaacacccgcaggggtaccgggaacattggcgagacgcttggtgagaagtggaaatcgcgcttgaacgccctaggcaagtcggagttccaaatctataagaagtccggcatccaggaagtagaccgcaccctggcgaaggaggggatcaagcgtggagagacggaccaccacgccgtttctcgagggagcgcgaagctccggtggttcgtggaacgtaacatggtcacgcccgagggcaaagttgtagacctaggctgtgggcggggcggatggagctactactgcggcgggctaaagaacgtcagggaagtgaagggcctaacgaaaggcggtccgggacacgaggagcccatccctatgtccacctacggatggaacctcgtccgcctgcagagcggcgtcgacgtcttctttattccgcccgagaagtgcgataccctgctgtgcgacatcggggagtctagccccaacccgacggttgaggccggccgcacactgcgggtccttaatctcgtggagaactggctgaacaacaacacccagttctgcatcaaggtactgaacccctatatgccttcagtcattgagaagatggaagcgctgcaacgcaagtacggtggggccctcgtgcggaacccgttgagccgcaacagcacacacgagatgtattgggtgtccaacgccagcggcaacatcgtcagcagtgtgaacatgatctcccggatgctgattaatcgcttcacgatgcggcacaagaaggcgacgtacgaacctgacgtggatcttgggagcggcacaaggaatatcgggatcgagtccgagatccccaatctcgacatcatcggcaagagaatcgagaagatcaaagaggagcacgagaccagctggcactacgaccaggatcacccctacaagacctgggcctaccacggctcctacgagaccaagcaaactgggagcgcgtcatccatggtcaacggtgtggtgcgcctgctcacgaaaccgtgggacgtcttacccaccgtaacgcagatggccatgacggacaccaccccattcgggcagcagcgggtgttcaaagagaaagtagacacacgaacgcaagagcccaaagagggcacgaagaagctgatgaagataaccgccgagtggctctggaaagaactcggtaagaagaagaccccaaggatgtgcacgcgggaggagttcacccggaaggtgcgctcgaatgcggccctaggagcaatcttcaccgacgagaacaagtggaagtctgcacgggaagcggtagaggataacagattttgggagctcgtcgacaaggaacgcaacttgcatctggagggcaagtgcgagacatgcgtgtacaacatgatggggaagcgcgagaagaagctcggcgagttcgggaaggccaagggttcccgcgccatctggtacatgtggttgggtgcgcggtttctggagttcgaggctctcgggttcctgaatgaggaccactggttcagtcgcgagaactccctgagcggcgtcgagggggagggcctccacaagctggggtacatactccgggacgtgtccaaaaaggagggcggcgccatgtacgccgacgacacggcgggttgggacaccagaatcaccctggaagacctgaagaacgaggagatggtgaccaaccacatggagggcgagcacaagaaacttgctgaggcaatcttcaagttgacgtatcagaacaaggttgtgcgggtgcagcgccctacgcctcgtgggacggtcatggacatcatcagccgccgggaccagcggggctccggccaggtgggtacttacggcctgaacacattcacaaacatggaggctcagctgatccgacagatggaaggggagggcgttttcaagaacatacagcacctcacggtcaccgaggaggcagccgtgcagaattggctggcccgtgtggggcgggagcgcctgtcacgcatggccattagcggcgacgattgtgtcgtgaaacctctcgacgaccggttcgccaacgcccttacggcgcttaacgacatgggcaaaatcagaaaggacatccagcagtgggaaccgtcaaagggctggaacgactggactcaggtgcccttctgcagccaccacttccacgagctagtcatgaaggacggccgagtgctggtggtcccatgccgtaaccaggacgagttaatcgggcgggctcgcatctcacaaggcgccgggtggagcctccgggagaccgcctgcctgggcaaatcctacgcccagatgtggagcctgatgtacttccacaggcgggatcttcgcctggcggctaacgccatctgctccgccgttcccagccactgggtgccgacaagtcgcacgacctggtctatccacgcgaaacatgagtggatgaccaccgaagacatgctgactgtctggaaccgcgtgtggatccgcgaaaacccctggatggaggacaagactccggtggagtcttgggaggaaatcccatacctcggcaaacgcgaggaccaatggtgcggcagcctgataggcttaacgtcccgcgcgacctgggccaagaacatccaggcagccatcaaccaggtccgcagcctaattgggaacgaggagtacaccgattacatgccgtccatgaagcggttccgccgggaggaggaggaggcgggcgtgctgtggtga

SEQ ID NO: 24981 - RNA, 9876 nt, synthetic construct
  misc_feature 1..9876: note = derived and/or modified CDS sequence (opt11) from DENV-2__GQ868625__SS-prME
  source 1..9876: mol_type = other RNA
tctgcggggatgatcatcatgctgatccccacggtgatggcctttcacttgaccacgcgcaacggggagccccacatgatcgttgggatccaggagaaggggaagtccctgctgttcaagaccgaggacggcgtgaacatgtgcaccctcatggcgatggatctgggggagctttgcgaggacaccatcacctacaaatgccccttactgcggcagaacgagcccgaggacatcgactgctggtgcaactccacatcaacctgggtgacctatgggacgtgcaccacaaccggcgaacatcgccgggagaagcgcagcgtcgccttggtcccccacgtggggatgggcttagagaccagaaccgaaacgtggatgagctctgagggcgcttggaagcacgctcagcgcatagagacctggatcctccggcacccgggattcacgatcatggccgcgatccttgcctacaccatcgggaccacccacttccaacgcgttctcattttcatcctgctgacagccgtagcgccctccatgacaatgcggtgcatcggaataagcaaccgcgatttcgtggaaggcgtctccgggggctcgtgggtggacatcgtgctcgagcatgggagctgcgtcacgaccatggccaagaacaagcccactctagacttcgagctgatcaagacagaggcaaaacagcctgccacgctccggaaatactgcatcgaggcgaaattaaccaacacgacaacggagagccgatgccccacccagggcgagccctcactgaaggaagagcaggataagcgattcgtttgcaagcatagcatggtggacaggggctgggggaacggctgcggcctgttcggcaagggcgggatcgtcacatgcgcgatgtttacgtgcaaaaagaacatggagggcaagatcgtgcagccagagaatctggagtatactatcgtggtcacgccacattccggagaggagcatgcggtggggaacgacacgggcaagcatggcatggagatcaaggtcaccccacagtcttccattaccgaggcagaactgaccggctacggcactgtgacgatggaatgcagccccagaaccggcctcgacttcaatgaaatggtcttattacaaatggagaataaggcctggctcgtgcaccgccagtggttcctggacctgcccctcccctggctgccgggggccgacaagcaagagtccaactggatccagaaggagaccttggtcaccttcaagaaccctcacgccaagaagcaggacgtggtcgtgttgggcagccaggagggggcgatgcacactgccctgaccggcgccaccgagatacagatgtcctccggtaacctcctgttcacgggacacctgaagtgccggcttcgcatggacaagctccaactgaagggcatgagctacagtatgtgcacggggaagttcaaggtggtcaaggagatcgccgagacacagcacggcaccatcgtgatccgggtgcagtacgagggtgacgggagtccttgcaagatccccttcgagataatggacctcgagaagcggtatgtactcggccgcctcatcacagtgaatccgatcgtgacggagaaggactcccccgtcaacatcgaggccgagccgcccttcggagacagctatatcatcatcggcgtggagccggggcagctgaagctcaattggttcaaaaagggatcgagcatcgggcgcatgttcgagacaaccatgaggggtgcgaaaaggatggccatcctgggcgacacggcgtgggacttcggatcactgggcggggtgttcacgagcatcggtaaggccctccaccaggtattcggggccatttacggcgcagccttcagcggcgtgagctggaccatgaagatactgattggggtgatcataacctggatcggcatgaactcccgcagcacctccctgagcgtctccctggtattagtgggtattgtcacgctgtacctgggcgtcatggtgcaggccgactcagggtgtgttgtgtcctggaagaacaaggagctaaagtgcggcagcggcatcttcatcaccgacaacgtgcatacctggaccgagcagtacaaattccagcctgagtccccctccaagctggcctctgcaatccagaaagcgcaggaggaggggatctgcggcatcaggtccgtgacgcgcctggagaacctaatgtggaagcagatcacccccgagctgaaccatatactggccgagaacgaagttaagcttaccatcatgaccggggacatcaagggcatcatgcaagcagggaaacgcagtctaaggccacagcccacggagctgaagtactcctggaaaacctggggcaaggcaaagatgctcagcaccgagtcctacaaccagaccttcctgatcgatggccccgagacggcggagtgccccaacaccaacagggcatggaacagcctggaggtggaagactacggatttggcgtttttaccaccaacatctggctcaagctaaaggaaaagcaggatgccttctgcgactccaagctgatgtcggccgctataaaggacaaccgcgcggtccacgccgacatgggatactggattgagtccgccctcaatgacacgtggaagatcgagaaggccagcttcatcgaggtgaagaactgccactggccaaagtcccacacgctgtggagtaatggcgtcctggagtccgagatgataatccccaagaacctcgccggccctgtcagccagcacaattatcggccggggtaccacacccagattgcgggtccctggcacctaggaaagctggaaatggacttcgacttctgtgacggaacgaccgtcatcgtcaccgaggactgtgggaaccgtggccccagtttgcggaccaccaccgccagcggcaaactgatcacggagtggtgctgccgaagctgcaccctgcccccgctccggtacagaggggaagatggctgttggtacggcatggagatccggcccctgaaggagaaggaggaaaacctggtgaactctctcgtgaccgccggccacggtcaagtcgataacttctcgctgggcgttctaggaatggccctctttctggaggagatgctgcgcacccgggtcgggacgaagcacgcgatcctactagtcgccgtttccttcgtgacgctgatcaccggcaacatgagcttcaaagacctggggagggtcgtggtgatggttggcgccaccatggccgacgatatcggtatgggcgtaacgtatctggccctgctcgctgcattcaaggttcggcccacctttgccgccggccttctcctccgcaagctgacctcaaaggagcttatgatgacaacgattgggatcgtcctcttgagccagtccaccattcccgagacggtgctggagctcaccgatgccctggcgctggggatgatggtactcaagatagtccgcaacatggagaagtatcaactggccgtgacgatcatggccattctctgcgttccgaacgccgtcattctccaaaacgcctggaaagtgtcgtgcaccatcctcgcggtcgtgtccgtcagccccctgctactgacatccagccagcagaagaccgattggatcccgctggcgctcactatcaaggggcttaacccaaccgcaatcttcctgaccaccttatccaggacaaacaagaagcgctcctggccgctgaacgaggccataatggcggttggaatggtttccatactggccagctcgctcctgaaaaacgacatcccgatgaccggccccctggtggccgggggtttacttaccgtatgctacgtgctaactgggcggtccgccgacctcgagctggagcgcgccaccgacgtgaagtgggaggaccaggcggagatctccggcagcagccccatcctctccattaccataagcgaagacggctcaatgagcatcaagaacgaggaagaagagcagaccctcaccattttgatccggactggcttactcgtcatctccggcttgttcccgatctctatcccgatcaccgccgccgcctggtacctgtgggaggtgaagaagcaacgcgccggggtgctctgggacgtccctagccctccgcccatggggaaggcggagctggaagacggggcctaccggatcaaacagaagggcatcctggggtacagccagatcggagccggcgtctacaaggaggggaccttccacacgatgtggcacgtcacccgcggtgcagtcctcatgcacaagggcaagcggatcgagcccagctgggccgatgtgaagaaggaccttatctcgtacggcgggggttggaagctggagggcgagtggaaggagggggaggaggtccaggtgctcgcgctggagcccggcaagaaccccagggccgtccagactaagcctggactgttcaagaccaacaccggcactatcggcgccgtgtccctcgacttctcgcccggaacgtcgggaagccctatcatcgataagaaggggaaggtcgtaggactctatggtaacggagtggtcacccgctccggcgcatacgtgtctgccatcgcgcagaccgagaagtccatagaggacaaccccgagatcgaggatgacatattccgcaagaggcgcctgaccatcatggacctgcaccccggagccggcaagacgaagcggtacttgcccgccatcgtgcgcgaggccatcaagcggggactacgcaccctgatcttagcgccgacccgggtcgtggctgccgagatggaggaggccttgcgaggcctgcccatccggtatcagacccccgcaatccgcgcggagcacacgggacgcgaaatcgtggacctcatgtgccacgccaccttcaccatgcgcctgctgagccccgttagagtgccgaactacaatcttataatcatggacgaggcacactttaccgatccagcgtccatcgctgcaaggggctacatctccacgcgcgtggagatgggtgaagcggccggcatcttcatgactgcgacgccgcccggctcgcgggacccgttcccccagtcaaacgcgcccataatcgacgaggaaagagagatccctgagcggagctggaattccggacacgagtgggtcaccgattttaagggcaagacggtgtggttcgtgccttcaattaaagcggggaacgatattgccgcctgcctgagaaagaacggcaagaaagtcatccagctgtcccggaagaccttcgatagcgagtacgtaaagacccgtacaaacgactgggacttcgtggtcacgaccgacatctccgagatgggagccaacttcaaggccgagcgggtaatcgacccccgcaggtgcatgaagcccgtgattttaaccgatggggaggaacgcgtcatcctggccgggcccatgccggtgacccacagctccgcagcacagcggcgggggcggataggccgtaacccgaagaacgagaatgaccagtacatatacatgggggagcctctggaaaacgacgaagattgcgcccactggaaggaagccaagatgctcctggacaatatcaatacgcccgaggggatcatcccatccatgttcgagcccgaaagagagaaggtggacgccatcgacggggagtatcgcttgcgcggggaggcccggaagacgttcgtcgacctcatgcgccgcggcgacctgcccgtgtggctggcctacaaggtggccgcggaagggatcaactatgccgaccgccggtggtgcttcgacggcatcaaaaataaccagatactcgaggagaatgtagaggtggagatctggaccaaagagggggagcgcaagaagctaaagccgagatggctagacgcccgtatctactctgatcccttggcactcaaggaattcaaggagttcgccgcgggaagaaagtctctcacattgaacctgatcacggagatgggccgcctgccaaccttcatgacccagaagacccgggacgcgttagacaacctggccgtactgcataccgccgaagccggcgggcgcgcttacaaccacgctctaagtgagctgccggagaccctggagaccctccttttattgaccctgctggccacggtgaccgggggcatcttcctctttttaatgagcggccgggggatcggcaagatgaccctggggatgtgttgcatcatcacagcatccatcctcctgtggtacgcgcagatccagccgcactggatcgccgcgagcataattctggagttcttcctcatcgtgctgctgattcccgagcctgagaagcagcgcactccgcaggataatcagctcacttacgtcgtgattgccatcctcaccgtggtggccgcgacgatggccaacgagatgggcttcctggagaagacgaagaaggatctcgggctgggctccatcgccacacagcagccggaaagcaacatactggacatcgacttgcgtcccgcctccgcctggacgctgtatgcagtggccaccacctttgtgacgcccatgctgcgacactctatcgaaaacagctccgtcaatgtgagcctaaccgcgatcgccaaccaggccaccgtgttaatgggtctggggaagggctggcccctatccaaaatggacattggggtcccgctcctggcgattggctgctacagccaggttaaccccataaccctaacggcagccctgttgctcctggtcgcacactacgcgatcatcgggcccggactgcaggctaaggccacccgggaggctcaaaaacgcgccgcggccggtatcatgaaaaaccccactgtagacgggatcactgtcatcgatctcgacccgatcccgtacgacccgaagttcgagaagcagctgggccaagtcatgcttctcatcctgtgtgtcacccaggtgctgatgatgcgcaccacatgggccctctgtgaggccttgaccttagcgacgggtcccatctccaccctttgggaaggcaacccggggaggttttggaacaccaccatagcggttagcatggccaacatcttccgcggcagttacctggcaggcgcgggactcctcttctccatcatgaagaacacgacgaacacgaggcgcggcaccggaaatataggtgagacgctgggggagaaatggaagtcccggctgaatgccctcggcaagtcagagttccagatctacaaaaaatcaggcatccaggaggtcgatcgcaccctggcgaaggagggaatcaagcggggggagacggaccatcatgccgtgagccgcgggagtgccaagctgcggtggttcgtggagcggaacatggtcacaccagagggtaaggtggttgacctaggctgcggcagaggcgggtggtcttattactgcggcgggctaaaaaacgtccgcgaggttaagggactgacaaaaggcgggcctggccatgaggagcccatccccatgtctacctacgggtggaacctcgtgcggctgcagagcggcgtagacgtgttcttcatcccgccagagaagtgcgacacactgctctgcgatatcggggagtccagtcccaacccgacggtggaggccgggagaacgctgcgtgtcctgaacctcgtcgaaaactggctgaacaataacacccagttctgtatcaaggtgctgaatccctacatgccctcggtcatcgagaagatggaggcgctgcaacggaagtatggcggtgccttggtgcgtaaccctctgtcccgtaattctacacacgagatgtactgggtttccaacgccagcgggaacatcgtttcctctgtgaacatgataagtcgaatgctgatcaaccgctttaccatgcggcacaagaaggccacgtacgagccagacgttgacctcgggagcggaacgcgcaacatcggcatagagtccgagatcccaaacctggacattataggcaaacggatcgagaagatcaaggaggagcatgagaccagttggcattacgaccaggatcacccttacaagacctgggcataccacggctcgtacgagacgaaacagacggggagcgcgagtagcatggtcaacggcgttgtccgcctgctcaccaagccttgggacgtcctacccaccgtgacccagatggccatgacggacactacccccttcgggcagcagcgcgtgtttaaggagaaggtcgacacccggacgcaggagcccaaggagggcacgaagaaactgatgaaaattaccgccgaatggctctggaaagagctgggcaagaagaagactccgcgcatgtgcactcgggaggagttcaccaggaaggtgcgctccaacgccgcgctgggcgccatattcaccgacgagaacaagtggaagagtgcccgggaggccgtggaggactcccggttctgggagctcgtcgacaaagagcgcaacctgcatctggagggcaagtgcgagacctgcgtgtacaacatgatggggaagcgggagaaaaagctgggcgagttcggtaaggccaagggcagtcgcgcgatctggtacatgtggctgggcgctcggtttctggagttcgaggcgctagggttcctaaatgaagaccactggttctcccgcgagaacagcctgtctggtgtcgagggggagggcctgcacaagctggggtacatcctgcgggacgtgtcgaagaaggaaggcggcgcaatgtacgccgatgataccgcaggctgggacaccaggattacgcttgaggacctgaagaacgaggagatggtaaccaatcacatggagggggagcataaaaagctggccgaggccatcttcaagctcacgtatcagaacaaagtcgtccgggtgcagcgacctacgccccgggggaccgtaatggacataatcagccgccgggaccagcgcggctctgggcaggtgggaacctacgggcttaacacgttcaccaacatggaggcccagctgatccggcagatggagggggagggcgtgttcaagaatatccagcacctaaccgtcaccgaggaggccgcagtgcaaaactggctagcccgggtggggcgcgagcggctgagccgcatggccatcagcggcgacgactgcgtcgtgaagccactcgacgaccggtttgcaaacgccctgactgcgctgaatgacatgggcaagatccgcaaggatatccagcaatgggagccgagtaaggggtggaacgactggacgcaagtgcccttttgcagtcaccattttcacgagttagtcatgaaggatggcagggtgctggtggtcccctgccgcaaccaggacgagctcatcgggcgggcacgcatctcccagggagccgggtggtccctccgggagaccgcatgcctgggcaagagctacgcccagatgtggtccctgatgtacttccaccgccgggacctccggctagcggccaatgcaatctgcagcgccgtgcccagccactgggtgccgactagccggacgacctggtccatacacgccaagcacgagtggatgaccaccgaggatatgctgaccgtctggaaccgcgtgtggatccgggagaatccttggatggaagacaagacgcccgtcgagtcgtgggaagagatcccctacctcggcaaacgcgaagaccagtggtgcgggtccctgataggcctcacctctcgggcgacctgggccaagaacatccaggccgccattaaccaggtacgctccctaatcgggaacgaggagtacaccgactacatgccgagcatgaagcggttcaggcgcgaggaggaggaggctggcgttctttggtag

SEQ ID NO: 24982 - RNA, 9876 nt, synthetic construct
  misc_feature 1..9876: note = derived and/or modified CDS sequence (opt11) from DENV-2__KF955401__SS-prME
  source 1..9876: mol_type = other RNA
agcgccgggatgatcattatgttaatccccaccgttatggctttccacttgacgacccgcaatggggagccccacatgattgtagggattcaggagaaaggtaagagcctcctgttcaagaccgaagacggggtaaacatgtgcaccctcatggcgatggacctgggggagctgtgcgaagatactatcacttacaaatgccccctcctgcgtcagaacgaaccggaggacatagactgctggtgcaacagtacctcaacatgggttacctacgggacttgtaccacgaccggagaacaccgaagggagaagcgcagcgtggccttagtgccccatgtcgggatgggcctcgagacacggaccgagacgtggatgtcctccgaaggggcctggaaacacgcccaacgcatcgagacatggatcctgagacaccccggcttcactatcatggccgcgatcttggcctacaccatagggaccacccatttccagcgcgtcctcatttttatcctgctgacagccgtggcccccagtatgaccatgcggtgcataggtataagcaaccgcgatttcgtggagggcgtctccggcggctcttgggttgatattgtgctcgaacacggttcctgtgtcacgaccatggcaaagaacaagcccactttagactttgagctgatcaagaccgaggccaagcagcccgctaccctgcggaagtactgcatagaggccaagctgaccaacacgacgaccgagtcgcggtgtcccacacagggggagccgtccttgaaggaggagcaggacaagaggttcgtgtgcaagcacagcatggtggaccgcgggtgggggaatggctgcggcctgttcggtaagggcgggatagtcacgtgtgcaatgttcacgtgcaagaaaaatatggagggcaagatcgtgcagccagagaacctggagtacacgatcgtggtgacgccccattccggcgaggaacacgcggtgggaaacgacaccgggaagcacggcatggagatcaaggtgaccccacaatcgtccatcaccgaagcagagttgacaggctacggcaccgtcacgatggagtgcagcccccggactgggttagacttcaatgaaatggtgcttctgcaaatggagaacaaggcgtggctcgttcatagacagtggttcctggacctgccactgccctggctcccaggggccgacaagcaggagtccaactggatccagaaagaaacccttgtgacgttcaaaaacccccacgcaaagaagcaagatgttgtcgtactcggcagccaggagggcgcaatgcacacggcactcaccggagccacggaaattcaaatgagttccgggaacttgctgttcactggccacctaaagtgtaggctgcgcatggacaaactacaactgaaggggatgtcatacagcatgtgcacggggaaattcaaagtagtcaaggagatcgcggagactcagcacggcacgatcgtgattcgggtgcagtatgagggggatggcagcccctgcaagatccccttcgaaataatggacctggagaagagatacgtactcggcagactgataaccgtgaacccgattgtgacggagaaggattcccccgtcaacatagaggccgagccgcccttcggggatagctacatcataataggagtggagccgggacagctgaagctcaactggttcaagaagggctcctcgatcgggcagatgttcgagactaccatgcgtggggcgaaacgcatggccatattgggcgacaccgcttgggacttcgggagtctaggaggggtgttcacgagcatcggcaaggccctccaccaggtctttggggccatctacggcgtagcgttctccggcgtgagctggacaatgaaaatcctgatcggggtaataatcacgtggatcggcatgaactcgcggtcaacgtccctgagcgtttccctggttctcgtggggatcgtgacactgtacctgggagtaatggtgcaggccgatagcggctgcgtagtatcgtggaagaacaaggagctcaagtgcggctccggcatctttatcaccgacaacgtccacacctggacggaacagtacaaattccagcccgagagtccctccaagctggcgagcgccatccagaaggcgcaggaggaagggatctgtggcatccgctccgtgacgcgcctggagaacctgatgtggaagcagatcacgcccgagctgaatcacatactggcagaaaacgaggtgaagttgaccattatgacgggcgacatcaagggcatcatgcaagccgggaagagatcgctgcggccccagcctactgagctgaagtactcctggaagacgtgggggaaggcgaaaatgctattcacggagagctacaatcaaactttcctgatagatggacccgagaccgctgagtgtccgaacacaaaccgggcgtggaactccctagaggtcgaggattacgggttcggagtgttcactaccaatatctggctaaaattaaaggaaaagcaggacgcattttgcgatagcaagctgatgtccgccgccatcaaggacaatcgggcggtgcacgccgacatgggctactggatcgagagcgcccttaacgacacgtggaagatcgagaaggcgtccttcatcgaagttaaaaactgccactggcccaagagccataccttatggtccaacggcgtgctggagagcgaaatgatcatcccgaaaaacctcgccggccccgtgtcccagcacaactatcggccaggttatcacacccaaatagccggcccctggcacctaggtaagctggaaatggacttcgatttctgcgatggcacgaccgtgatagtgacggaggactgcggaaaccggggaccctctttgcgcaccaccaccgcgtccggcaagctgataacggagtggtgttgtcgaagctgcactctgccccctctccggtaccgaggcgaggacggctgctggtacggcatggaaatcagacccctcaaagagaaggaggagaacctggtaaatagcctggttaccgccggccacggccaagtggacaacttctccctaggcgtgttgggcatggcgttattcctggaggagatgctgcgcacccgcgtcggaactaagcacgccatcctcctggtagccgtcagcttcgtcactttaataaccggaaatatgtctttcaaagatctcgggagagtggtggttatggtcggtgccaccatggccgacgacattgggatgggagtgacttacctggccttactcgccgcgttcaaagttcggcccaccttcgccgccggtctcctgctcaggaaactgaccagcaaggagcttatgatgaccacgatcgggatagtgctcctgtcccagagcaccatccccgagaccgtgctggagctcaccgacgcactcgccctaggcatgatggtgctcaagatcgtccgtaacatggagaagtaccagctggcggtcacgatcatggccatcctgtgcgttccgaacgccgtgatcctccagaatgcatggaaagtctcctgcactatcttggccgtagtgtctgtaagccccctcctcctgacttcctcacagcagaaaaccgactggatccccctggcgctcacaattaagggtctgaacccgaccgccatcttcctaaccaccctcagccgcacaaacaagaaacggtcctggccgctgaacgaggctatcatggccgtcggaatggtgtctatattggcgtccagcctcctgaagaacgacatccccatgacaggccccctggtagctgggggactcctcaccgtgtgctacgtgctgaccgggcgatccgctgatctggagttggagcgggccaccgacgtcaagtgggaggaccaggccgagatctctggctcctcccccatcctgagcatcaccatctccgaggatgggtcaatgtccatcaagaacgaagaagaggaacaaaccctcaccatcctcatccgcactggcctcctcgtcatctcgggtcttttccctattagtattcccatcacggcggcagcctggtacctatgggaggtgaagaagcagcgggccggggtcctctgggatgtgccaagcccgccgccgatgggaaaggccgagctggaggatggtgcgtatcgtatcaaacagaaggggatcctaggttattctcagatcggcgccggcgtgtacaaggaggggacctttcacaccatgtggcacgtaacacggggcgccgtactgatgcacaaggggaagcgcatcgaacccagttgggccgatgttaagaaagatctgatctcatacggcgggggatggaagctggagggcgagtggaaggagggggaggaggtccaggtgctcgccctggagcccggcaagaaccccagagcggtccaaacgaaacccgggttgttcaagacgaacaccgggaccattggcgccgttagcctcgacttctccccaggcaccagtggttcccccatcatcgacaagaaggggaaggtggttggcttatatgggaacggagtcgtgaccagatcgggggcttacgtgtccgctatagcccagaccgagaagtccatcgaagacaaccccgagattgaggacgacatcttccgcaagcgacggctgaccatcatggaccttcaccccggcgcgggcaagacaaagcgatacctacccgccatcgtccgtgaggccattaagcgcgggctgcggaccctgatactcgcccccactcgcgtggtcgcggcggagatggaagaggccctgcgcgggcttccaatccgctaccagacccccgccatccgagcggaacacacaggcagggagatcgtcgacttaatgtgccacgccacatttacaatgaggctgctgtcccccgtgcgggtaccgaactataacctcataatcatggacgaggcccactttaccgatcccgccagcattgccgcccgcggctacatcagcacgcgggtggagatgggcgaggcggccggaatcttcatgactgcaactccgcccggcagtcgtgaccctttcccccaaagcaacgctccgatcatcgacgaggagagggaaatacccgagaggtcctggaacagcgggcacgagtgggtgaccgacttcaagggaaaaaccgtgtggttcgtcccgtccatcaaggccggaaacgatattgccgcctgccttcggaaaaacggcaagaaagtaatccagctgagccgcaagacctttgacagcgagtacgtcaagacacggactaacgactgggatttcgtcgtcacgaccgacatctctgaaatgggggcaaacttcaaggcggagcgggtaatcgacccccggcgctgtatgaaacccgtcatcctgaccgacggggaggaacgggtgatcctggccggccccatgccggtgacccacagcagcgccgcccaaagacgcgggcgaataggccggaaccccaagaatgagaacgaccaatacatctatatgggggagcccctggagaacgacgaagactgcgcccactggaaggaggccaagatgctcctggacaacattaacacgcccgaaggcatcatcccttcgatgttcgagcccgagcgcgagaaggttgacgcgatcgacggcgagtaccggctgcgcggggaagcccgcaagaccttcgtggacctgatgcggcgcggcgatcttcccgtgtggctggcatataaggtggccgccgagggaatcaactatgcggacaggagatggtgcttcgacggtatcaagaacaaccagatcctcgaggaaaacgtcgaggtagaaatctggacgaaggagggtgagcggaagaaactgaagccacgctggctggacgccaggatctacagcgaccccttggccctgaaagagtttaaggagttcgcagctgggcgcaaaagtctgaccctcaacctcatcacggagatgggccggctgcccacctttatgacccagaagacgcgtgatgcgttagataacctagccgtactgcacacggccgaggctgggggccgggcgtacaaccacgcgctcagcgagctgcccgagacattagagaccttgctgttgctaaccctgcttgccacggtgacagggggtatcttcctcttcctaatgtcaggccgcgggatcggcaagatgaccctggggatgtgctgtatcatcacagccagcatactcctgtggtacgcccagatccagccgcattggatcgcggccagcattatcctcgagtttttccttattgtcctgctgatccccgagcccgagaagcagcggacgccccaggacaatcagctcacgtacgtggttatcgccattctcaccgtcgtggcggccacgatggccaacgagatgggttttctggaaaagacaaagaaggacctcggtctgggcagcatcgccacacagcagccggagtcgaacatcctagatatcgacctccgccccgccagcgcatggaccctatacgccgtggccaccaccttcgtgacaccgatgttgagacattccatcgagaacagctcggtgaatgtttccctcacagccatcgccaaccaggccaccgttctgatgggccttgggaagggttggccgctaagcaagatggacatcggtgtgccgttgctggccatcggctgctactcccaagtgaacccgattaccctcacggctgccttgcttctcctggtcgcccactacgccatcattgggcctggccttcaggctaaggccacccgagaggcacagaagagggctgccgcgggcatcatgaagaaccccaccgtggacgggatcacggtgatcgacttggacccgatcccctacgacccaaagttcgaaaagcagctggggcaggtcatgttgcttatcctatgcgtgacccaggtattgatgatgcgcaccacgtgggcattgtgcgaggcccttacgctagcgacggggcccatcagcaccctctgggagggaaatccggggcggttctggaacaccacgatcgcggtctccatggctaacatcttccggggtagctatctggcgggcgcagggcttctcttctccatcatgaaaaacaccactaacacccggcgcggaactgggaacatcggcgagacgttgggagaaaaatggaagtctaggctgaacgccctcggcaagtccgagttccagatctataaaaagtccggtattcaggaggtggatcggactctggcaaaggaggggatcaagcgaggcgagacggaccaccacgccgtgtcccgggggtctgcaaagctgagatggttcgtcgaacggaatatggtcacccccgaaggcaaggttgtagacctcggctgtgggcgtggcgggtggtcctactactgtggagggctgaaaaacgtacgggaggtgaagggtctgactaagggcggccctggccacgaggaacccattccgatgagcacctacgggtggaacctcgtccgtctgcagtccggcgtggacgtgtttttcatcccgcccgaaaagtgcgacaccttgttgtgcgatatcggagaaagctcccccaatccgacagtagaagccggccgaacgttgcgagtcctgaacctcgtcgagaattggctgaacaataacacgcagttttgcattaaagtcctgaacccctatatgcccagcgtaatcgagaagatggaggcgctccaacggaaatacggaggggcgctcgtgcgcaatccgctatctaggaactctacccacgagatgtactgggtcagcaacgcctccggcaacatagtgagctccgtgaacatgatctcacgaatgctgatcaacagatttaccatgcggcataaaaaggccacctacgaaccggacgtcgatctcgggtccggaactcggaacatcgggattgaaagcgagacccctaacctggacatcatcggcaagcgcatagagaagataaaggaggagcatgagacgtcctggcattacgatcaagaccatccctacaaaacgtgggcctatcacggcagctacgagaccaaacaaacgggatccgccagctccatggttaacggcgtggtccggcttctcaccaagccgtgggatgttctgcctaccgttacacagatggcgatgaccgatacgacccctttcggtcagcagagagttttcaaggaaaaggtggacacgcgcacccaggagcccaaagaggggaccaagaagctaatgaagatcaccgccgagtggctctggaaggagttaggcaagaagaagaccccacggatgtgcaccagagaggagttcacccggaaggtgcgcagcaacgcagccctaggggcaatctttacagatgagaacaagtggaaaagcgcgagggaagcagtggaagatagccgcttctgggagctcgtggacaaggagcggaacctgcacttagaagggaaatgcgaaacgtgcgtctacaatatgatggggaaacgcgaaaagaagctcggggagttcgggaaggccaagggcagtcgggctatatggtacatgtggctgggtgcccgctttctagagttcgaggcgctcgggttcttgaatgaagaccactggttcagtagagaaaactccctgtccggcgtagagggggagggcttacacaaacttggctatatcctgcgagacgtgagtaaaaaggagggcggcgcaatgtacgcggacgacaccgccgggtgggataccagaatcaccctcgaggacctgaagaacgaggagatggtcacgaaccacatggaaggggagcacaagaagctagcggaggccatctttaagctcacataccagaacaaggtcgtgcgcgtccagcggccgacgccccgcggaaccgtgatggacataatcagtcggcgagatcagcggggatcgggccaggtggggacgtatggattgaacactttcaccaacatggaggcgcagttgattcgccagatggagggtgaaggagtcttcaagaacattcaacacctcaccgtgacagaggaggccgcggtgcaaaactggctggctagggtcgggagagaacgcctgtcccgtatggcaatctctggtgatgactgcgtcgtgaagcccctagacgaccgcttcgccaacgccctgacggcccttaacgacatgggcaagatccggaaggatatccagcagtgggagccgtcaaagggctggaacgactggactcaggtccccttttgctctcaccatttccacgaactcatcatgaaggatggccgtgtgttggtggtcccatgcaggaaccaggacgaactgattgggcgcgcgcgcatatcgcagggcgcagggtggagcctccgcgagaccgcttgcctgggaaagtcgtacgcccagatgtggagcctgatgtacttccatcggcgcgacctccgactagctgccaatgctatctgctccgcagtccctagccattgggtgccgacttcacgcaccacctggagtatccacgccaagcacgaatggatgaccaccgaggacatgctgactgtttggaatcgggtgtggatacgcgagaacccatggatggaagacaaaacccccgtggagagttgggaggagatcccgtatctgggcaagcgggaggaccagtggtgcgggagcctgatcggcctgaccagtcgcgcgacctgggcaaagaatatacaagccgccataaaccaagtccggagtctcatcgggaatgaggagtacacagactacatgccctccatgaagaggttcagaagggaagaggaggaggcaggcgttttatggtga

SEQ ID NO: 24983 - RNA, 9876 nt, synthetic construct
  misc_feature 1..9876: note = derived and/or modified CDS sequence (opt11) from DENV-2__JF730047__SS-prME
  source 1..9876: mol_type = other RNA
agcgcaggaatgatcatcatgctgatccccacggtgatggcattccacctcaccacccgcaacggggagccccacatgatcgtgggtatccaggagaagggcaagagcctgctgttcaagaccgaggacggcgtgaacatgtgcaccctcatggcgatggacctgggtgagctgtgcgaggacaccataacctataagtgccccctcctgcggcaaaacgaacccgaagacatcgactgctggtgtaattcaacgagcacctgggtgacctacgggacctgcaccacaactggtgagcaccgccgggagaagcgctccgtggcgcttgtgccacacgtggggatgggactggagacccgcaccgaaacctggatgtccagcgagggggcctggaagcacgctcaacgtatagagacctggattctgcggcatccaggcttcaccatcatggccgcgatactggcctatacgatcggtaccacacatttccagcgagccctcatcttcatcctgctgaccgccgttgcgccttccatgaccatgcggtgtatcggaatttcaaatcgcgacttcgtagagggagtttcggggggctcatgggttgacatcgtactcgagcacgggtcgtgcgtgaccaccatggctaagaacaagcccacgctagatttcgagctgatcaagactgaggccaagcagcccgccaccttgcggaagtattgtatcgaggccaagctgacaaatacgaccacggagagccgctgccccacccaaggcgagccctcactgaaggaagagcaagacaaacgcttcgtctgcaagcactctatggtggaccgaggctgggggaatggctgcggtctgtttggcaaggggggcatcgtgacctgtgcgatgttcacgtgcaagaaaaacatggagggcaagatagtccaacctgagaaccttgagtacacaatcgtggtgaccccccactccggagaggagcacgccgtcggcaacgatacgggtaagcacggcaaggaaataaaggtaactccgcagagctccatcaccgaagctgagctgacagggtacggcaccgtgacgatggagtgtagcccccggaccggcctcgacttcaacgagatggtcctgctgcagatggaatccaaggcgtggctcgtgcaccgacagtggttcctcgacctgcccctcccatggctgccgggggccgacaagcagggcagtaactggatacaaaaggagaccctggtcaccttcaagaatccccacgcgaagaagcaggacgtagtggtcttggggtcgcaagagggcgccatgcacacggcgctgaccggcgccaccgagatacagatgtcctcaggcaatctcctgtttaccggccacctgaagtgtcggctgcgtatggataaattgcaactgaaggggatgtcatacagcatgtgcacgggcaagttcaaagtggtgaaggaaatcgccgagacccaacacgggaccatcgtaatcagagtgcagtatgaaggggacggctcaccctgcaagatccccttcgagatcatggacctggagaagcgatacgttctaggccgtctgattaccgtcaatccgattgtcacagaaaaggatagcccagtaaacatagaagcggagccccccttcggcgactcttacatcatcattggtgttgagccgggccagctgaagctcaattggttcaagaaaggaagctccataggccaaatgtttgagactaccatgcgcggcgccaagcgcatggctatcttgggggacacagcctgggacttcggcagcctcggcggagtgttcacttcgatcgggaaggcactgcaccaggtgttcggagctatatacggggcagcgttctccggagtcagttggacaatgaagatcttaatcggcgtgatcatcacctggatcgggatgaatagccgttcaacctccctgtccgttagcttggtcctcgtgggaatagtaacgctgtatctgggcgtcatggtgcaggccgactccggatgtgtggttagttggaagaacaaggagctcaagtgtggcagcggtatcttcataacagacaacgtgcacacctggaccgagcagtataagttccagccagagtcccccagcaagcttgcgtcagccatacagaaggcccaagaggagggcatctgtgggatccgcagcgtaacgcggctggagaatctcatgtggaagcagatcacccccgagctgaaccatatcctggccgagaacgaggtcaagctcaccatcatgaccggcgacattaagggcatcatgcaggccggtaaacggtccctccggccgcagcccacagaactcaaatacagctggaagacatggggcaaggcgaagatgctctccacagagagccataaccagactttcctgatcgacgggcccgagacggcggagtgccctaacaccaaccgcgcctggaactcacttgaagtggaggactacggcttcggggtgttcaccaccaacatctggctcaagctcaaggagaaacaggacgccttctgcgacagcaaactgatgtctgcagcgattaaggacaaccgggccgtccacgcggacatgggctattggatcgagtcagccctcaacgacacgtggaaaatcgaaaaggcgtccttcatcgaggtgaagaactgccattggccaaaaagccacacgttgtggtccaacggagtgcttgagtccgagatgattatccctaagaacctagcggggcccgtctcccaacacaactatcgcccgggctaccacacccagaccgccgggccgtggcacctaggcaaactggagatggactttgatttttgcgacgggaccacggtgatcgttaccgaggactgcggcaaccggggccccagcctccgcacaaccacggccagcgggaaactgatcacggagtggtgttgcaggtcgtgtacactccctccgctccgttaccggggcgaggacgggtgttggtatggcatggaaatcagacctctgaaggagaaagaagagaacctagttaatagcctcgtgaccgccggacacggacaggtggataacttctcccttggggtgctggggatggcgttgtttctggaggagatgctgcggacgcgcgtgggcaccaagcatgctatcctcctggtggctgtcagtttcgtgaccctgatcaccgggaacatgagtttcaaggacctcggccgggtggtcgtcatggtgggaaccaccatgacagacgacataggcatgggtgtaacgtacctggccctgctcgccgcgttcaaagtgcgtccgacgttcgccgccgggctgttattacggaagctaacgtcaaaggagctgatgatgaccaccatcggtatagtgctactgtcccaaagtacgatcccggagaccatcttagaactcacagatgccctggccctgggtatgatggtcctcaagattgtgagggacatggagaagtaccagctggcggtgaccatcatggccatcctgtgcgttccaaacgctgtgatactccagaacgcgtggaaggtcagctgtacgatactggccgtggtgagcgtcagccccttgctcttaaccagctctcagcagaagaccgattggatccccctggcgttgaccatcaaaggtctgaaccccaccgctatcttcctcactactctcagccgcaccaacaaaaagcggtcctggccgctgaacgaggctatcatggccgtgggcatggtgagcatcctagcctcctcgctgctgaaaaacgacatccccatgacgggacccctcgtcgctggcgggcttctcaccgtctgctacgtgctcaccggccgctccgcagacctagagctagaacgggctaccgacgtcaagtgggaggaccaggccgagataagcgggagcagccctatacttagcatcacgatttccgaagacggctcaatgagcatcaagaacgaggaggaggagcaaaccctcaccatcctgatcagaaccggcctgctggtgatttctgggctcttcccggtgagcatccccataaccgcggccgcctggtacctttgggaggtcaagaaacagcgggcaggcgtgctgtgggacgtaccctcccctcctcccatggggaaggccgaactggaggacggcgcgtaccgcatcaagcagaaggggattctaggttacagtcagattggcgccggagtctataaggagggcacgttccataccatgtggcacgtgacccgcggggcggtactcatgcacaagggcaagcgcattgaacctagctgggccgacgtcaagaaagacctcatctcctacggaggcggctggaagttagagggggagtggaaggaaggcgaggaagtccaagtattagccctggaacccgggaagaacccacgggcggtccagaccaagcctggcctgttcaagacgaacaccggcactatcggagccgtgagcttagacttttcccccggcacctcggggtcccccataatcgacaagaaggggaaggtggtcgggctttacggcaatggggtggtgacccgctctggggcttacgtctctgccatcgcccagacggaaaaatcaatcgaggacaaccccgagattgaggacgacatcttcaggaagaggcggctgaccatcatggacttacaccctggggccgggaagaccaagcgttaccttcccgccatcgtgcgggaggccatcaagcgcggcctgcggacgttgatcctcgcccccacccgcgtggtagcggccgagatggaggaggccctgcgcgggctgcccatccgctatcagacccccgccatccgggcggagcatacaggccgcgaaatcgtagatctgatgtgtcacgcgacgtttaccatgcgcttgcttagtcccgtgagggttccgaactacaacctcataataatggacgaggcccacttcactgaccccgcctctattgccgcccgcggttacatcagcacccgggtcgagatgggtgaggccgctggcatcttcatgacggccacgccccctgggtcccgcgacccgttccctcagagcaacgctcccatcatcgacgaggagcgggagataccggagcgctcatggaacaccgggcacgaatgggttaccgatttcaagggcaaaacggtctggttcgtgccgagcatcaaggccggcaacgatatcgcggcctgcctgcggaagaacggcaagaaggtcatccagctgtccaggaaaactttcgacagcgagtatgttaaaacccggacaaacgactgggacttcgtggtgacgacggacatctccgagatgggggccaattttaaggccgagcgcgttatcgaccctcggcggtgcatgaagccggtgatattgactgacggtgaggagcgggtcatactggcgggccccatgccagtcacccacagctccgccgcccagcgccggggacgcatagggcggaaccccaagaacgaaaatgaccagtatatttacatgggcgagccgctggaaaacgatgaggactgcgcccactggaaggaggccaagatgttactggacaacatcaacacgcccgagggcattataccaagcatgttcgagcccgaacgagagaaagtcgacgcgatagacggggagtatcgtttgcggggtgaagcacgtaagaccttcgtggatcttatgcggcgcggggatctccccgtatggttagcctacaaggtggccgccgagggcatcaattacgccgacagacggtggtgcttcgacgggatcaagaacaaccagatcctcgaggaaaacgtggaagtcgagatctggacaaaggagggggagcggaaaaagctgaaaccacgatggctggatgcccgtatatactccgatccgctcgcgctgaaggagttcaaggagttcgcggctggccgtaagtctctgacgctaaacctgatcacggagatggggcggctgcccacatttatgactcagaagaccagggacgcgctcgataacctggccgtgttgcacacggccgaggccggcgggcgggcatacaaccacgcactctccgagctgcccgagacccttgagacactactactgttgaccctactggccacagtcacgggcggcatcttcctcttcctgatgagcggccgcggcatcgggaagatgaccctgggcatgtgctgcatcatcaccgcctccatactcctgtggtacgcccagatccagccgcactggatcgcggccagcattatcctggaattcttcctcatcgtactactgatccccgagcccgaaaagcaacggacaccccaagacaaccagctcacgtatgtggtgatcgctatcctgaccgtcgtggctgccaccatggccaacgagatggggttcctggagaagaccaagaaggatctcggcctgggctccatagctacgcagcagccagagagcaacatactggacatcgacctccggcccgcatccgcctggaccctgtacgcagtagcgaccaccttcgtgacgcccatgctgcgtcacagcatagaaaatagctccgtaaacgtcagcctcacggccatagccaaccaggccacagtgctgatgggtctgggcaaggggtggcccctctcaaagatggacatcggcgtaccgctgctggccatcgggtgctacagccaggtcaacccgataaccctcacggcagccctgctgctcctggtagcccactacgccatcatcggacccgggctgcaggcgaaagcaacccgcgaggcacagaaacgggccgccgcggggatcatgaagaatcccactgtagacggcatcacggtcatcgacctcgaccctatcccctatgaccccaagttcgagaaacagctgggccaggtcatgctgctcatactgtgcgttactcaggtcctgatgatgcgcactacgtgggccctctgtgaagccctgaccctggccactgggccaatttccaccttatgggaggggaacccgggacggttctggaacacgaccatcgccgtgagcatggcgaacattttccgcggatcctatctggcaggggccgggctcctcttcagtattatgaaaaacactactaatacacggcgcgggaccggaaacatcggcgagacgctaggggagaagtggaagtcccgtctgaacgctctcggcaagagcgagttccaaacttacaagaagtccgggatccaagaagtggaccggaccctggcgaaagagggaatcaagcgaggggaaaccgaccatcacgcggtcagccgaggctccgccaagttgcgctggttcgtggagcggaacatggtaacgcccgagggcaaggtcgtagacctggggtgtggccgtgggggctggagctactactgtggcggcttaaagaatgtgcgggaggtgaaggggctcactaagggcgggcccgggcacgaggagccaataccgatgtccacctatggctggaacctagtgaggctccagtcaggggtggacgtcttcttcatcccgcccgaaaaatgcgatactctgttgtgcgacataggtgagtccagcccaaaccccaccgttgaggccgggcgtacgttgagagtgctgaacctcgttgagaactggcttaacaacaacacccagttctgcatcaaggtgctgaacccctacatgccttccgtgatagagaagatggaggccctgcagcgcaaatacgggggtgcgctagtacgcaaccctctgagccggaactccactcacgagatgtattgggtgtccaacgcctccggaaacattgtgtccagcgttaacatgatctcccgcatgctgatcaaccggttcaccatgagacacaaaaaggccacgtacgagcccgacgtggacctcgggagcgggacacggaacattggaattgaaagtgaaatccccaacctggacatcataggcaagcgcatagagaagataaaacaagagcacgagacctcttggcactacgaccaggaccatccctacaaaacttgggcctaccatgggtcctacgaaacgaagcagacgggatctgcttcaagcatggtgaacggcgttgtgcggctactcaccaagccctgggacgttctgccgaccgtcacgcagatggcgatgaccgacacgacccccttcggacaacagcgcgtgtttaaggagaaagtggacacgcgcacccaggaacccaaggaagggacgaagaagctgatgaagatcacagccgagtggttgtggaaggagctggggaagaagaagacgccgcggatgtgcacccgcgaggagttcatccggaaggtcagatccaatgcagcccttggcgccatttttacggacgagaacaagtggaagtcggcgcgggaagccgtggaggattcacgcttctgggaattggtcgacaaggagcggaacctgcatttggagggaaagtgcgagacatgcgtatataacatgatgggtaaacgcgagaagaaactcggggagttcggaaaggccaaaggcagccgggccatctggtacatgtggcttggggcccgctttctggagttcgaggccttgggcttcctaaacgaagatcattggttcagtcgcgaaaactcgctgtccggggtggagggcgagggtctccacaagctgggctacatactccgcgatgtcagcaagaaggagggcggggccatgtacgccgacgacacggcgggctgggatacacggatcacgctcgaggatcttaagaatgaggagatggtgaccaaccacatggagggagagcataagaagctggcggaagcaatcttcaagctcacgtaccaaaacaaggtagtcagagtgcaacgacccacgccgcggggcaccgtcatggacatcataagccggcgcgatcaaagagggagtggacaggtcggcacgtacgggctgaacacgttcacaaacatggaggcccagctaatccgccagatggagggcgaaggggtgtttaaaaacatccaacacttaaccgccacggaggaggtggccgtcaagaactggttggcacgggtgggacgagagcgcctgtcacgcatggcgatctcaggcgacgactgcgtggttaagccactagacgaccggtttgcgaacgcgctgacggccctcaacgatatggggaagatcaggaaagacatccaacagtgggagccatcaaagggctggaacgactggacccaggtgccattctgctcgcaccacttccacgagttgatcatgaaggatgggcgcgtgctggttgttccctgcaggaaccaagatgagcttatcggccgcgcgcgtatcagccagggggccggctggtccctccgcgagaccgcgtgcttgggcaaaagctacgcccagatgtggtccctgatgtacttccaccggcgagatttgcggcttgctgcgaatgcaatctgtagcgcagtgccgtcccactgggtcccgaccagccgcactacgtggtccatacacgccaagcacgagtggatgaccactgaggacatgctcactgtatggaaccgggtgtggatccgcgaaaatccctggatggaggacaagactcccgttgagagctgggaggagatcccctacctcggtaagagagaggaccagtggtgcggctccctgatcgggttaacgagccgcgccacctgggctaagaacatccaggccgcaatcaatcaggtgcgttcgcttataggcaacgaggagtataccgactatatgccgagcatgaagcgcttccggcgcgaggaggaggaggccggggtgttatggtaa

SEQ ID NO: 24984 - RNA, 9876 nt, synthetic construct
  misc_feature 1..9876: note = derived and/or modified CDS sequence (opt11) from DENV-2__JF730048__SS-prME
  source 1..9876: mol_type = other RNA
tccgcaggaatgatcattatgctgatccccaccgtgatggccttccatctcactactcgcaacggggagccccacatgatcgtgggcatccaggagaagggcaagagcctcctcttcaagaccgaggacggcgtgaacatgtgcactctcatggcgatggacctgggtgagttatgcgaagacaccatcacctacaaatgtcccctgctgcggcaaaacgagccagaagatatcgactgctggtgtaactccaccagcacctgggtgacctacgggacctgcaccaccaccggagagcatcgccgggaaaaacgcagcgtcgctctagtaccccacgtggggatgggcctggagactcggaccgagacctggatgagctccgagggagcttggaaacacgcccaacgcatagagacctggatccttcggcacccgggatttaccatcatggccgctatcttggcttacaccattggaaccacccatttccagcgcgccctcatcttcatcttgctgacggccgttgcgccctccatgaccatgcggtgcataggcatctcgaaccgcgactttgtggagggtgtatccgggggcagctgggtcgacatcgtgctcgagcacggatcctgcgtgaccaccatggcaaagaacaagcccacgctggacttcgagctaatcaagaccgaggccaagcagccagccacgctacgaaagtactgcattgaggcgaagctaaccaacacgacaaccgagagcagatgtcctacccagggcgaaccctccctgaaggaggagcaggacaagcggttcgtctgcaagcacagcatggtagaccgcggctgggggaacgggtgcgggcttttcggcaagggtggaatcgtgacgtgcgcgatgtttacgtgcaagaagaatatggagggaaagatcgtccagccggagaacctggagtacaccatcgtggtgacgccccactctggggaggagcatgctgtcggcaatgacacgggaaagcacggcaaagagatcaaggtgaccccgcagagttcgataacggaggccgagcttaccgggtacggcaccgtgactatggaatgcagcccacggacgggcctagacttcaacgagatggtgctgctgcagatggagtctaaagcctggctggtgcacaggcaatggttccttgacttgccactcccctggctgccaggggccgacaaacagggcagcaactggatccaaaaggagacccttgttacctttaaaaacccccatgcgaagaagcaagacgtcgtggtcctggggagccaggagggggctatgcacaccgccctgaccggggccaccgagatccagatgtccagcggcaacctcctgttcaccggccatctgaagtgccggctgcgcatggacaagctccaactgaaagggatgagctactctatgtgcacgggcaagttcaaggtagtaaaggagatagccgaaactcaacacggcaccatcgtcattcgggttcagtacgaaggcgatggctccccctgcaagattcccttcgagatcatggatttggagaaacgctacgtgctaggacggctgatcaccgtcaatccgatcgtgacggagaaggacagccccgtaaacatagaagcggaaccgccctttggcgactcctacatcatcataggggtcgagccgggacagctgaagttgaactggttcaaaaaggggtcatccattggccagatgttcgagactaccatgcgtggcgcgaagcgcatggccatcttaggggacaccgcctgggacttcggcagcctcggcggtgtgttcacatcgatcggaaaagccctccaccaggtgttcggggctatttacggcgccgcctttagcggggtctcgtggaccatgaagatactgatcggcgtaattatcacctggatcgggatgaacagccgaagtaccagcctgtccgtgagcctggtactcgtgggcatcgtgacgctgtaccttggggtgatggtgcaggccgactccggctgcgtagttagctggaaaaacaaggaactcaagtgcggcagcggaatcttcatcaccgacaacgtgcacacctggaccgagcaatataagttccagcccgagtccccctctaagctggcgtccgccatccaaaaggcccaggaggagggcatatgcgggatccgcagcgtaacgcggctcgagaacctcatgtggaagcagatcacccccgaactaaaccatattctggccgagaacgaagtcaagctcaccatcatgaccggcgacataaaggggatcatgcaggctgggaagcgctccctgcggcctcagcccacggagctaaaatattcgtggaagacctggggcaaggcgaagatgctctccaccgagagccataaccagacgttcctgatcgacgggcccgagacggccgagtgcccgaatactaaccgcgcctggaactccctggaggtggaggactatggcttcggggtgttcaccactaacatctggttaaagctgaaagagaagcaggacgccttctgcgactctaagctgatgtccgcagcgatcaaggataaccgggccgtccacgcggatatgggttattggatcgaatctgccctcaacgatacgtggaaaattgagaaagctagtttcatcgaggtgaagaactgccactggccaaagagccacacgctgtggtccaacggcgtgctggagagcgagatgatcatacccaagaacctcgcgggtcccgtatcccagcacaactacagaccgggctaccacacccagacagcaggtccctggcacttaggcaagctggagatggacttcgacttttgcgacgggactactgtgatcgtgaccgaagactgcggaaaccgaggcccaagcctacgcactaccacggccagcgggaaacttataaccgaatggtgctgccggtcctgcacccttcccccgctccgctatagaggcgaggacgggtgctggtacgggatggagattcggcccctgaaggagaaggaagaaaacctggtcaactcactggtgaccgccggccacggccaggtggacaacttctccttaggcgttctggggatggcccttttcctggaagagatgctgcggacgcgcgtgggcaccaagcacgctatcttactggtggccgtcagttttgtcaccctgatcacaggtaacatgtccttcaaggacttaggccgggtggtcgtcatggtggggacgaccatgaccgacgacatcggcatgggtgtcacgtacctggctttgttggctgcgtttaaggtgcgcccaacgttcgccgcagggctgctgcttcggaaactgaccagcaaggagctgatgatgaccaccatcggcatcgtactcctttcacagagcacgatccccgaaaccatcctagaactcaccgatgcgctggcactgggcatgatggtcttgaagatagtccgtgacatggaaaagtaccagttggccgtgaccatcatggccatcctgtgtgtccccaacgccgtgatactccagaacgcctggaaggtatcctgcacaatcctggcggtggtcagcgtcagccccctgctcctgacttcatcccaacagaaaaccgactggatccccctggcactcaccatcaagggcctcaaccccacggcgattttcctcaccacccttagcaggaccaacaagaaacggtcctggcccctgaatgaggccataatggccgtcggcatggtcagcatcctggcctccagcctactgaagaacgacatccccatgacggggcccctggtcgccggcgggctcttaacagtgtgctacgttctgaccggccgctccgcagacctcgagctggagcgggccaccgacgtcaagtgggaggatcaggccgaaatcagcggtagtagccccatattaagcatcacgatctccgaggacggcagcatgtccatcaagaatgaggaggaggagcaaaccctcaccatcctgatccgcaccggcctactcgtgatcagcggtctgttcccggttagcatccccattaccgcggccgcctggtatttatgggaagtcaaaaagcagcgggctggtgtgttgtgggatgtgcccagcccgccgcccatggggaaggcagaactggaggatggcgcgtaccggataaagcagaaggggatcctgggctactcccagattggcgccggggtctacaaggagggaacttttcacaccatgtggcacgtgaccaggggagcggtgctcatgcacaagggcaaacgcatcgagccctcatgggcagacgttaagaaggacttgatatcctacgggggcggctggaagctcgagggtgagtggaaggagggtgaggaagtccaggtgctcgccctggagcccgggaagaacccccgagcggtccagaccaagcccggcctgttcaagacgaacaccgggaccataggtgcggtcagcctcgatttttcaccgggaacttcgggttcgcccatcatcgacaagaagggtaaggtagtcgggctgtacggcaacggcgttgtgacgcgcagtggggcctacgtcagcgccatcgcccagaccgagaaaagtatcgaggacaaccccgagatcgaggacgacatcttccggaagcgccggctgaccatcatggacctgcaccccggcgcggggaagaccaaacgctatttacctgcgatcgtgagagaagctatcaagcggggtctgcggacgctgatactcgccccaacgcgcgtggtggcggcggagatggaggaggccctacgggggctgcccatacgctaccagacccctgccatacgggccgagcatacaggccgcgagatcgtggacctcatgtgtcacgccacgttcacaatgcgacttctgtcccccgtgcgtgtaccgaactacaacctaatcatcatggacgaagcccacttcactgatcccgcttcaatagctgcgcgcggctacatcagcacccgcgtcgagatgggcgaagccgcaggcatcttcatgacggccacgccacccggctcccgggacagtttcccgcagtccaatgcccccatcatcgacgaggagcgggagatccccgagcgcagctggaacaccgggcacgaatgggtcaccgacttcaagggcaagacggtctggttcgtgccctccatcaaggccggaaacgacatcgctgcctgcctgcggaagaacggcaagaaggtgatccagctgtcccgcaagacttttgactccgagtacgtcaagaccagaaccaacgattgggacttcgtagtcacgacagacatcagcgaaatgggagccaacttcaaggccgagagagtaatcgatccccgtcgctgtatgaagccggttatcctcaccgacggcgaggagcgtgtgatcctggcggggccgatgcctgtcacacactccagcgccgcacagcgccgggggcgcatcgggcggaatcccaagaacgaaaacgaccaatacatttacatgggagagcccctggagaacgacgaggactgcgcgcactggaaagaggcgaagatgctactggacaacattaatacgcccgagggtatcatcccatccatgttcgagccggagcgcgagaaggtggacgcgatcgacggggagtaccggctgcgcggcgaggccaggaagactttcgttgacctcatgcggcgcggggacctgccagtttggctggcgtataaagtggccgcagagggcatcaattatgcggaccggcggtggtgtttcgacgggatcaagaacaaccagatcttagaggagaacgtggaagttgagatatggactaaagagggcgagcgcaaaaagttaaagccgaggtggctggacgcccggatctatagtgacccgctcgcccttaaggagttcaaggagttcgccgccggccgcaagtccctgacccttaatctgatcacggagatgggacgactccccactttcatgacccagaagacccgtgacgcgctagacaacctcgccgtcctgcatacggcagaggccggagggcgggcatacaaccatgccttaagtgagctgcccgagaccctggagacactgctgctcctcactctgttggccaccgtcacgggcggcattttcctcttcctgatgtccgggcgcggcatcggtaagatgaccctgggcatgtgctgcattatcaccgccagcattctcttgtggtatgcccagatacagccgcattggatcgcggcctccatcatcctggaatttttcctcatcgtcctgctaatcccagaacccgagaagcagagaacaccccaggacaatcagttaacgtacgtggttatcgccatcctgaccgtggtcgccgctactatggcgaacgagatggggttcctggagaagaccaagaaggatctaggattgggtagcatagccacgcagcagcccgagtccaacatcctagacatagatctccgtccggcctctgcctggacgctgtacgccgtggccacgacattcgtgacccccatgctgcggcacagcatcgagaacagcagcgtgaatgtctccttaaccgccatcgccaatcaagccaccgtgttgatgggattaggcaaggggtggcccctcagcaagatggatatcggcgtgcccctgcttgctatcgggtgttacagtcaggtgaacccgatcaccctcacggcggccctgctgctccttgtggcccactacgccattatcggccctggcctgcaggcgaaggccacccgtgaagcccagaagcgggccgcggctgggatcatgaagaacccaaccgtggatggcatcaccgtcatcgacctcgaccccataccttacgaccccaagttcgagaaacagctaggtcaggtaatgctgctcattctgtgtgttacgcaagttctgatgatgcgaaccacctgggccttgtgcgaggccctgaccctggcgacgggccccatcagcacactctgggagggtaatcccggccggttctggaacaccaccatagccgtttccatggcgaacatcttccgcggcagttacctggccggggccggactcctcttcagcatcatgaagaatacgactaacacccggcgcggtacaggcaacatcggcgagacgctgggggagaaatggaaatcacgcttaaacgccctgggcaagagcgagttccagacctacaagaagtcgggaatccaagaggtggatcggaccctggcaaaggagggaattaagcggggagagaccgaccaccacgcggtttcccggggctccgccaaacttcgctggtttgttgagcgcaacatggtgacaccggagggcaaggtcgtagatctcgggtgcggtcgcgggggctggagctactactgtgggggcctgaaaaacgttagagaggttaagggtctgaccaagggcgggcccgggcacgaggagcccatcccgatgtcgacttacggctggaacctcgtgagactgcagtctggggtcgacgtcttcttcatcccgcccgagaagtgcgataccctgctctgcgatatcggtgagtcgtccccaaaccccaccgtggaggccgggcggacgctacgcgtcttaaaccttgtcgagaattggctgaataacaacacccagttctgcatcaaagtgctgaatccgtatatgcccagcgtgatcgagaagatggaagccctacagcggaagtatgggggcgcgctcgtccgcaaccccttgagccggaactccacgcacgagatgtactgggttagcaatgcgtccggtaacatcgtgtccagtgtcaatatgattagccgcatgctgatcaaccgcttcaccatgcgccacaaaaaggcaacatatgagccggacgtagacctcggctccggaacccggaacatcggaatcgagagcgagatccccaacctggatatcatcggaaagcgcatcgagaagatcaagcaggagcatgagacttcatggcattacgaccaggatcacccttacaaaacctgggcctaccacgggagctatgagaccaaacaaacgggctccgccagttccatggtgaacggggtagtgcggttgctcaccaagccctgggacgtactgccgacagtcacgcagatggcgatgaccgacaccaccccctttggccagcagcgcgtgttcaaggagaaggtggacacacgcacacaggagcccaaggagggcactaagaagctgatgaagattacggcagagtggctgtggaaagagctagggaagaagaagacgccccggatgtgtacccgcgaggagttcacccggaaggtacgcagcaacgccgcccttggcgcaatcttcaccgacgagaacaagtggaaatccgcccgggaggccgtggaggactcacgcttctgggaactcgtggacaaggagcggaacctgcacttggagggtaagtgcgagacgtgcgtctacaacatgatgggcaagcgtgagaaaaagctcggggagttcggcaaggccaagggctcccgggcgatctggtacatgtggctaggggcccgattcctcgagttcgaggcgctcgggttcctgaacgaggaccactggttctcaagagagaactccctgtcgggtgtggagggcgaggggctccataaactgggctacatcttgcgcgacgtcagcaagaaggagggcggggccatgtacgccgacgataccgctggctgggacacccggatcaccctggaggacttaaagaacgaggagatggtgacgaaccatatggaaggggagcacaagaagctggcggaggctatctttaagctcacgtaccagaacaaggtggttcgcgtgcaaaggcccacgcctcggggcaccgttatggatatcatatccaggcgcgaccagagggggagcggacaggtcgggacgtacgggctgaacacattcacaaacatggaggcccagctgatacgccagatggagggggagggggtgttcaaaaacatccagcacctcaccgccactgaggaggtggcggtcaagaactggcttgcgcgggtgggccgcgagcgactgagtcggatggccataagcggcgacgactgcgtggtcaagccccttgatgaccgcttcgccaatgcgctgaccgccctgaacgacatgggaaagatccggaaggatatccagcagtgggagccctcgaagggctggaacgactggacacaggtgcccttctgcagccaccacttccacgaattaataatgaaggacggacgcgtgctggtcgttccatgtcgaaatcaggacgaactgatcggccgcgctcggatctcccagggggccggctggagcctacgcgagacggcttgcctgggcaagtcctacgcccagatgtggtctctgatgtattttcatcggcgcgacctccgtctagccgcgaacgctatctgctccgccgtgcccagccactgggttcccacctcacgtacgacgtggtctatccacgctaagcacgagtggatgaccaccgaggacatgctaacggtgtggaaccgtgtgtggatccgcgagaacccgtggatggaggataagacccccgtagagtcatgggaggagatcccctatctcgggaagcgggaggaccaatggtgtggcagcctgatcgggttaacctccagggccacatgggccaagaatatccaggcagccatcaatcaggtgcgctctctgatcggaaatgaggagtacacagactacatgccctcaatgaagcgtttccgaagggaggaagaagaggccggggtgctgtggtga

SEQ ID NO: 24985 - RNA, 9876 nt, synthetic construct
  misc_feature 1..9876: note = derived and/or modified CDS sequence (opt11) from DENV-2__KF955402__SS-prME
  source 1..9876: mol_type = other RNA
tctgcagggatgatcatcatgctgatcccaaccgtgatggcgttccacctcacgacccgtaacggggagccccacatgatcgtcggtatccaggagaaaggcaagtcacttctgttcaaaaccgaggacggcgtcaacatgtgcacgctcatggcaatggatctgggggagctctgtgaggatactatcacgtacaagtgtccattactgcggcaaaacgagccggaggatatcgactgttggtgcaacagcacctccacgtgggtgacctacgggacctgtacgaccacaggagagcaccggcgggagaagaggtcagtcgccctcgtgccccacgtggggatgggtctggagacccgtaccgagacctggatgagtagcgagggggcctggaaacacgcccagagaatcgagacgtggatcctgcgtcaccctggcttcacgatcatggccgcgattctggcttacaccataggaacaacccacttccaacgcgtcctcatcttcatcctgctgacggccgttgcaccctccatgaccatgaggtgcataggtatctctaaccgcgtattcgtagagggggtgtcggggggcagctgggtagacatcgtcttggagcacgggtcctgtgtgaccaccatggctaagaacaagcccacgctggattttgaactcatcaagaccgaggccaagcagcccgccacgctcagaaagtactgcatcgaggcgaagctgaccaacactaccaccgagtcgagatgccccactcagggcgagccctccctgaaggaggagcaggacaagcggttcgtatgtaagcacagcatggttgaccgcgggtgggggaacggctgcggactgttcggtaagggcgggatcgtgacttgtgccatgttcacgtgcaagaagaacatggagggtaagatcgtgcagcccgagaacctagagtacactattgtagtgactccccactctggggaagagcacgccgtgggaaacgatacgggaaagcacggaatggagatcaaagtaaccccgcaaagctcgatcaccgaggccgagctgaccgggtatggcaccgtgacaatggagtgcagcccacggaccggcctcgatttcaacgaaatggtgctgctgcagatggagaataaggcctggctcgtccatcgccagtggttcttggacctgccgctcccatggttgccgggggctgataagcaagagtcaaactggattcagaaggagaccctcgtcaccttcaagaacccgcacgcaaagaagcaagacgttgttgtgctcggcagccaggagggggcgatgcacacggccctgaccggcgccaccgagatccagatgagcagcgggaacctgctgtttaccggtcatttaaagtgccggttgcgcatggacaaactccagctgaaaggcatgagctactccatgtgcacggggaagttcaaagtcgtgaaggagatcgccgaaacgcagcacggcaccatagtgatcagggtgcagtacgagggcgacggcagcccgtgcaagatacccttcgagatcatggacctggagaaaagatacgtcctcggccgactgataactgtgaacccgatagtaacggagaaggactcccccgtgaacattgaggctgagccgccgttcggggactcttatataattataggcgtggagccaggccagctgaaattgaactggttcaagaagggctccagcatcgggcaaatgttcgagaccaccatgcgaggcgcaaagcgcatggccatcctgggcgataccgcctgggacttcggctccttaggaggggtttttactagcatcggcaaggccctccaccaggtgttcggcgccatctacggggtagcgttctccggtgttagctggaccatgaagatcctgatcggggtgattatcacctggatcggtatgaacagccggagcacctcgctttctgtgagcttagtccttgtggggatcgtgacgctgtacttgggcgtcatggtccaagccgacagcgggtgcgtcgtctcctggaagaataaggagctcaagtgcgggagcggaatcttcatcaccgacaatgtgcatacctggaccgagcagtacaagttccagccagaaagcccctccaagctggcctctgccatccagaaggcgcaggaggaggggatttgcggcatccgcagtgtgacgcgtctggagaacctaatgtggaaacagatcacccccgagctgaaccatatcctggccgagaacgaggtcaagcttactattatgactggggacataaagggaatcatgcaggccgggaagcgcagcctccgcccgcaacccacggagttgaagtattcctggaaaacctggggcaaggccaagatgctgagtaccgagtcctataatcaaaccttcctgatcgacggacctgagacggctgaatgcccgaacaccaatcgcgcgtggaattcactggaggtggaagactacgggttcggcgtgttcacgaccaacatatggctcaagctaaaggaaaagcaggacgcattctgcgactccaagctgatgagcgcggccataaaagacaaccgtgccgtccacgcggacatggggtactggattgagtccgccctcaatgacacgtggaagatagagaaggcaagcttcattgaggttaagaactgccactggccgaaatcgcacaccctgtggagcaatggcgtgctcgagtcagaaatgataatccccaaaaacctcgcagggcctgtcagccagcacaattaccgcccgggataccacacccaaatcgcgggtccctggcacctgggaaagcttgagatggactttgacttctgcgacggcactacagtgatcgtaacggaggactgcgggaataggggcccctccttgcgcactacaaccgcgagcggcaaactgataaccgaatggtgctgccggtcgtgtacacttccgccactgagataccgcggggaggatggctgttggtacgggatggagatccgccccttaaaggagaaggaggagaacctggtgaattccctcgtgaccgcgggccacggccaggtggacaacttcagcctgggcgtcctgggcatggcgctcttcctggaggagatgttgaggactcgagtggggactaagcacgccatcctcctcgtggcggtctccttcgtaacgctgataaccggcaacatgagcttcaaggatctcgggcgggtggtcgtgatggtgggagcgaccatggcggacgacatcggaatgggcgtcacgtacctggcacttttggccgcgttcaaggtgcgccccaccttcgcagcggggctcttactccggaagctaacctccaaggagctgatgatgactacgatcgggatcgtgcttctgtctcaatccaccatacccgaaacagtcctggagctcaccgatgcccttgccctgggcatgatggtgctcaagatcgtccgaaacatggagaagtaccagctggcagtcacaattatggccattctgtgcgtacctaacgccgtcatcctccaaaacgcctggaaggtgagctgcaccattctggcagtggtctcagtcagccccttattactgacttccagccagcaaaagacggactggatccctctggcgcttacgatcaagggactgaaccccaccgccattttcctgaccactctgtcccgcaccaacaagaagcggagctggccgctaaacgaggccatcatggccgtgggtatggtttccatcctagcttcatccctcctgaaaaatgacatccccatgaccggccccctggttgccggcggcctcttaactgtttgctacgtcctgaccggacgcagcgccgatctcgagcttgagcgcgcgacggatgtgaagtgggaggatcaggccgaaattagtggtagttctcccatcctgtccatcaccattagcgaagacgggtccatgtcgattaagaatgaggaggaagagcagaccttaaccatccttattcgaacgggcttactcgtgatctccggcctttttccaatcagcatccccatcaccgctgcggcctggtacctgtgggaggtaaagaagcaacgggccggcgtgctctgggacgttccttcacccccgccaatgggcaaggccgagctggaggacggggcgtaccgaatcaagcaaaagggtatcttggggtacagccagatcggcgccggtgtctacaaagaggggaccttccacacaatgtggcacgtgacgagaggcgccgtgctgatgcacaagggcaaacgcatcgagccctcctgggccgacgttaagaaggacctgatcagctacggggggggctggaagctggagggcgagtggaaggagggggaggaagtccaggtcttagcactcgaacccggcaagaacccacgggcggtccagactaagcccgggctgttcaagacaaataccggcacgatcggagcagtgtcgttggacttcagcccgggaacttccggcagccccatcattgacaagaagggaaaggtagtcggcctttatggtaacggcgtcgtgaccaggtccggagcctacgtcagcgccatcgcacaaaccgagaagtccatcgaggacaaccccgagatcgaggacgacatcttccggaagaggcggctcacgatcatggatctgcacccaggggcgggtaagacgaaacgctacttacccgccatagtgagggaggcaatcaagcgtgggctgagaacgctgatcctggctccaactcgcgtggtcgcggcggagatggaggaggctttaagaggcctgccgattcgctaccagaccccagccattcgagccgagcacacggggcgcgagatcgtggacctcatgtgccacgcgactttcactatgcgcctgctgagccccgtgcgggtccctaactacaacttaatcatcatggacgaggcccactttaccgaccccgccagcatcgctgctcgcggttacatcagcacacgagtggaaatgggtgaggcggccgggatcttcatgaccgccacgccgcccggcagccgcgatccgttcccccagtccaacgcccccatcattgacgaggaacgggagatcccggagagaagttggaactccgggcatgaatgggttaccgacttcaagggaaagactgtctggttcgttccgtcaatcaaggccgggaacgatatcgcggcctgtctgcgcaagaacggcaagaaggtcatccagctttcccggaagaccttcgactcagagtatgtaaagacaagaaccaacgactgggatttcgtggtcacgaccgacatctccgagatgggcgccaactttaaagccgaacgcgtcattgacccccggaggtgcatgaagccggtgatcctcactgacggtgaggagcgcgtgatcctggcgggtcccatgccggtcacccatagctccgccgcccaacgcagagggagaataggccggaatccaaagaacgagaacgatcagtacatctatatgggggagcccttagagaacgacgaggactgcgcccattggaaggaagccaagatgctcctggataatatcaacacgcccgaaggcataataccaagcatgttcgagcccgagcgggagaaggtggacgcgatcgatggcgagtaccggctccgcggggaggcccgcaagaccttcgtagacctcatgagaagaggtgacctgcccgtctggctggcgtacaaggtagctgccgaggggatcaactacgcagaccgacgctggtgtttcgatggtattaagaacaaccagattttagaggagaacgtcgaggtggagatatggaccaaggagggtgagcgaaagaaactgaagccgaggtggctggacgcccggatctattcagaccccctagccctgaaggagttcaaggaattcgccgcaggccgcaagtctctgaccctcaacctgatcaccgagatggggagactgcccaccttcatgacccaaaagacccgcgacgcactcgacaatcttgccgtgctacacacggccgaggccgggggccgggcgtacaaccatgccttatccgagctgcccgaaaccctggagaccctgctactactcacccttttagccacggtcaccgggggcatatttttattcctcatgtcgggcaggggtataggcaagatgacactggggatgtgctgcatcataaccgcctcaatactcctgtggtacgcgcagatccagccgcactggatcgcggcctcgatcatcttggagttctttcttatcgtgctgctaatccccgagcccgaaaaacagcggacgccacaagacaatcagttaacgtacgtggtcatcgcgatcctgaccgtggtggcagccaccatggcgaacgagatgggtttcctggagaagaccaagaaggacctcgggctgggctccatcgccacgcaacaaccggagagcaacatcctggacatcgatctaaggcccgcctccgcttggactctgtacgccgtcgctaccacctttgtgacccccatgctgcggcacagcattgagaacagctccgtgaatgtcagcttgactgccatagccaatcaagcgactgtgctgatgggattagggaagggctggcccctctcaaagatggacatcggggttccgctgctggcaatcggctgctacagtcaggtgaaccctataaccctcactgcagccttgctgctcctggtggcccattatgccattatcgggcccggcctgcaagcaaaggccacccgcgaggcccagaagcgggccgcagcgggtataatgaagaaccccacagttgacgggatcaccgttatcgacctcgaccctatcccctacgaccctaaattcgaaaagcaactgggccaggtgatgctgctcatcctgtgtgtgacgcaggtcctgatgatgagaaccacctgggccctctgcgaagcgctgaccctggccacggggcccatctccaccttgtgggagggcaaccctgggagattctggaacacaaccatcgccgtgagcatggcgaacatcttccgaggcagttacctggccggcgctggcctccttttctccatcatgaagaacactaccaacacccggcggggaacagggaacatcggcgagactctgggcgaaaagtggaagtcacgcctgaacgcactggggaaatccgagttccagatctacaagaagagtggcatccaggaggtggaccggaccctcgccaaggaggggatcaagcgcggcgaaaccgaccatcacgcggttagccgcgggtccgccaagctgcggtggttcgtggaacggaacatggtgacccccgagggcaaagtggtggacctaggctgcgggcgcggtgggtggtcgtactactgcggagggctgaaaaacgtgcgtgaagtcaagggactaacgaagggcggtcccggccacgaggaacccatcccgatgtccacatacgggtggaatctagtgcgtctgcagtccggcgtggatgtcttcttcatcccgcccgagaagtgcgacaccctgctttgcgacatcggggaatcctcacccaatccgacggtcgaggccggccggacgctaagagtgctgaacctcgtcgagaactggctgaacaataatacccagttctgcataaaggttctcaatccttatatgccaagcgtgatcgaaaagatggaggccctgcagcggaagtacggaggagcgctcgtccgcaacccactaagccgaaacagtacccacgagatgtactgggtctccaatgctagcgggaacatcgtgtcttcagttaacatgatatcccgcatgctgatcaatcggttcaccatgcgccacaaaaaagccacctacgagccagacgtggacctcggctctggcacgcgcaacatcgggatagagtcagagactcccaacttagatatcatcggcaagcggatcgagaaaatcaaagaagaacacgaaacctcctggcattatgaccaggatcacccatacaagacctgggcctatcacggctcctatgagactaagcagaccgggagcgccagctcgatggtgaatggtgtcgtacgactactgaccaagccgtgggacgtgttaccaaccgtcacgcagatggcgatgaccgacactacccccttcgggcagcagcgcgtgttcaaggagaaggtggatacccggacccaggaacccaaggagggtaccaagaaacttatgaaaatcaccgccgagtggttgtggaaggaactaggcaagaagaagacgccgagaatgtgcacgcgtgaggagttcaccagaaaagtccgctccaacgccgccctgggtgccatattcaccgatgagaacaagtggaagtccgcgcgagaggccgtggaggactcccgattctgggagctcgttgacaaggagcggaacctgcaccttgagggtaagtgtgaaacgtgcgtgtacaacatgatggggaagagagaaaagaaactcggtgagtttggaaaagcgaagggtagccgggccatctggtacatgtggctcggagcccgctttctagagttcgaggcgctcggctttctgaacgaggaccactggttttcccgggagaacagcctgagcggcgtagaaggggagggtcttcataaactggggtacatccttcgtgacgtctctaagaaggaaggcggcgccatgtacgccgacgacactgccgggtgggacacacggatcaccctcgaggatctaaaaaacgaggagatggtgacgaatcacatggagggcgaacacaaaaagctggcggaggcaatattcaagctcacctaccagaacaaggtggtccgcgtgcagaggcccacgcccagagggaccgtgatggatatcattagccggcgcgaccagcgcggctcggggcaggtcggcacgtacggtctgaacacatttaccaacatggaggctcagcttatccgacagatggagggggagggcgtgttcaaaaacatccagcacctcaccgtgacggaggaggccgccgtgcagaactggctagcgcgagtcgggcgggagcgcctaagccggatggccatttccggcgacgactgcgtggtcaagccactcgacgaccgcttcgccaacgccttgaccgccctgaacgacatgggcaagatccggaaagacattcagcagtgggaacccagcaaagggtggaacgactggacccaggtgcccttctgctcccaccacttccatgagctcattatgaaggatggtcgagtgctggtcgtgccttgccggaaccaagacgaactgattgggcgcgcccgtatcagccaaggcgccgggtggtccctccgcgagaccgcctgcctggggaagagctacgctcagatgtggagcctgatgtacttccaccggagggacctccgcctggcggcaaacgccatctgcagcgctgttccatcccactgggtcccaacgagccgcaccacctggtccatccacgccaagcacgagtggatgaccaccgaggacatgctgacggtctggaaccgggtgtggatccgcgagaatccttggatggaggacaagacccccgtcgagagttgggaggagatcccctatctcggcaagcgggaggaccagtggtgcgggtccctgatcggcctgaccagccgcgccacctgggcgaagaacattcaggccgccatcaaccaggtgcggtcccttatcggaaacgaagagtacacggactatatgccgtctatgaagcgcttccggcgcgaggaggaggaagccggcgtgctatggtaa

SEQ ID NO: 24986 - RNA, 9876 nt, synthetic construct
  misc_feature 1..9876: note = derived and/or modified CDS sequence (opt11) from DENV-2__FJ898460__SS-prME
  source 1..9876: mol_type = other RNA
accgccggcgtgatcgtcatgctgatccccaccgccatcgcgttccacctcaccacccggaacggggagccccacatgatcgtgggcagacaggagaaggggaagtccctgctgttcaagaccgaggacggcgtgaacatgtgcaccctcatggccatcgacctgggcgagctatgcgaggacaccatcacctacaagtgccccctcctgcggcagaatgagcccgaggacattgattgctggtgtaacagcaccagcacttgggtgacctacgggacgtgcacaaccacgggcgagcatcggcgcgagaagcggtccgtggccctggtgccccacgtcgggatgggcctcgagacccgcaccgaaacctggatgagcagcgagggagcctggaagcacgtacaaaggatcgagacgtggatcctgcggcacccgggctttaccattatggccgcgatcctggcctacaccatcgggaccacgcacttccagcgggctctcatcttcatccttctgaccgccgtggcgccctccatgaccatgcgctgcatcggcatctccaaccgggacttcgtcgagggtgtgagcgggggctcctgggtggacatagtcttggaacacgggtcctgcgtgactacaatggctaagaacaagcccaccctggacttcgagttaatcaagaccgaggccaagcagcccgctaccctccgcaagtactgtatcgaggccaagctgacgaacaccaccacagagtcccggtgcccgacgcagggggagcccagcttaaacgaggagcaggacaagcgcttcatctgcaagcacagtatggtcgaccgaggctgggggaatggctgcgggctgttcggcaagggcgggatagtgacctgcgctatgttcacgtgcaagaagaacatggagggcaaggtggtgcagcccgagaacctggagtacaccatcgtcatcacgcctcactcgggggaggagcacgccgtgggcaacgacaccgggaaacacggcaaggagataaagattacgccgcagtccagcatcaccgaggccgaactgacagggtacggcacggtcaccatggagtgcagcccccggaccggtctcgacttcaatgagatggtactgctgcagatggaggacaaggcctggctcgtgcaccggcagtggttcctggatctgccactcccatggctcccaggggccgacacccaaggcagcaactggatccagaaggagacgttggtgaccttcaaaaacccccacgcgaagaagcaggacgtcgtggtcctcgggagccaggagggcgccatgcacaccgccctgaccggagccacagagatccagatgagctctggcaacctcctattcaccggccacttgaagtgtcgcctccgtatggacaaactccagctgaagggaatgtcctacagcatgtgcaccggcaagttcaaaatagtgaaggagatcgccgagacccagcacggaacgatcgtgatccgcgtccaatacgaaggcgacggctcaccttgcaaaattccctttgagatcacggacctggaaaagcggcacgtgctcgggcgcctgatcaccgtgaacccgattgtcaccgagaaggatagccccgtgaacatcgaggcggagccgcccttcggcgactcgtacatcatcatcggggtggagccgggacaactgaagctaaactggttcaagaaggggagctccatcggtcagatgtttgagacgaccatgcgcggtgccaagcggatggccatcctcggggacaccgcctgggacttcgggagcctcggaggggtctttaccagcatcggtaaggcactccatcaggtattcggagctatttacggcgcggccttcaacggggttagctggacgatgaagatccttatcggcgttatcatcacctggatcgggatgaactcccgcagcacctcactgagtgtgtcgctggtgctcgtcggcgtcgtgaccctgtacctgggggccatggtccaggcggacagcggctgcgtggtgtcctggaagaacaaggagctcaagtgcggctcgggcatcttcattacggataacgtacacacctggaccgagcaatacaagttccagcccgagtcccccagcaagttagccagcgccatccagaaggcccacgaggagggaatctgtgggatccggtccgtgacccgcctagagaacctcatgtggaagcagattacgcccgagctgaaccacatcctgagcgagaacgaggtgaagctcaccatcatgaccggcgatataaagggaatcatgcaggccggcaaacggtccctgcgcccgcagcccaccgagctcaagtacagctggaaaacgtggggcaaggcgaagatgctctccacggagagccacaaccagacgttcctgatcgacgggcctgagaccgccgagtgtccgaacacgaaccgggcctggaactcccttgaggtcgaggactacggcttcggggtgttcagcaccaacatctggctcaagcttcgcgagaagcaggacgtcttctgcgattccaagctgatgagcgccgccattaaggacaaccgcgcggtccacgccgacatgggctactggatcgagtcggccctcaacgacacgtggaagatggaaaaggccagcttcatcgaagtgaagtcctgtcactggcccaagtcccacactctatggtccaacggcgtcctcgagagcgagatgatcatccccaagtccttcgccgggcccgtcagccagcacaattataggccgggctaccacacccagacggcgggcccctggcacctaggcaagctggagatggactttgacttctgcgaggggaccaccgtcgtggtcaccgaagactgcggcaatcggggccccagcctgcgcacgaccacggcctccggaaagctcatcaccgaatggtgctgtcggagctgcacgctgccccctttgcgctaccggggcgaggacgggtgctggtacggcatggagatccgccccctaaaggagaaggaggagaacctggtgaattccctggtgaccgccgggcacggccagatcgacaacttcagcctcggcgtcctgggtatggcgctgttcctcgaggagatgctgcggacccgagtgggcaccaagcacgcgatcctgctagtggccgtctccttcgtgacgctgatcaccgggaacatgagcttccgagacctggggcgcgtgatggtcatggtaggggccaccatgaccgacgacatcggcatgggcgtgacgtacctcgcccttctggccgcgttcaaggtgaggccaacgttcgccgccgggctcttactgcggaagctcacctccaaggaactgatgatggccaccattggcatcgccctgctcagccagtcgacgatgcccgaaaccattctggagctgaccgacgcgctcgccctggggatgatggtgctgaagatcgtgcgcaacatggagaagtaccagctcgccgtcaccataatggcgatcagctgcgtcccaaacgccgtgatcctccagaacgcgtggaaggtctcctgcacgatactggccgccgtcagcgtcagccccttgctgctgaccagctcccagcagaaggccgactggatacccctcgcactaaccatcaagggtctgaaccccaccgccatcttcttaaccaccctgagtcggaccagtaaaaagcgcagctggccgctgaacgaggctatcatggcagtgggcatggtatcgatcctcgccagcagcctgctgaagaacgacatccccatgaccgggccgctcgtggccggcgggctgctgacggtttgttacgtgctcaccggccggtccgccgacctggagctggagagagccgccgacgtaaagtgggaggaccaggccgagattagcgggtccagccccatcctctccatcaccatcagcgaggatggctccatgagcataaagaacgaggaggaggagcaaaccctaacgatcctgatccggaccggattactggtgatctccggggtgttcccggtcagcatccccatcaccgcggccgcctggtacctctgggaggtgaagaagcagcgtgccggtgttctctgggatgtccccagcccgccgcccgttgggaaggccgagctggaggacggcgcgtaccggatcaagcaacgcgggatcctgggctatagccaaatcggcgcgggggtgtacaaggagggcaccttccacaccatgtggcacgtcacacggggggccgtgctcatgcaccgcggcaagcggatcgagcccagctgggccgacgtgaagaaggaccttatcagctatggggggggctggaagctggagggggagtggaaggagggcgaggaagtccaggtgctcgccttagaacccgggaagaacccccgcgcggtgcaaacaaagcccgggatcttcaagaccaacaccgggacgatcggtgccgtaagtctggacttcagccccggcacgtccgggagccccatcgtggaccggaagggaaaggtggtcgggctctacggaaacggcgtggtgacccggtccggggcctacgtgagcgccatcgcgcagactgaaaagagcatcgaggataatcccgagatcgaagacgacattttccggaagaagcgcctgacgatcatggatctacaccccggcgccgggaagacaaagcgttacttacccgctatcgtgcgagaggcaatcaagcggggcctgcgcactctgatcctggccccgactcgcgtggtcgcggccgagatggaggaggccctccgggggctgcccatccgctaccagacgccggccatccgggccgagcacaccggccgcgagatagtggatctgatgtgccacgcgaccttcaccatgcggctcctgtcccccgttcgggtcccaaactacaacctgatcataatggatgaggcccacttcacggaccccgcaagcatcgccgcccggggctacatctccacccgcgtggagatgggggaggcggccggcatcttcatgaccgccacgccgcccgggagccgggacccgtttccccagtccaacgcgcccatcatggatgaggagcgcgagatcccggagcggtcatggaattctggtcacgagtgggtaactgacttcaaggggaagaccgtctggttcgtgccgagcatcaaagcgggcaacgacatagccgcctgtctcaggaaaaacggcaagaaggtgatccaactgagtcggaagaccttcgacagcgagtacgtcaagacccgcgcaaacgactgggacttcgtggtgacgacggatatttccgagatgggagccaacttcaaagctgagcgggtcatcgacccccgtcggtgcatgaagcccgtgatcctgaccgacggcgaggagcgcgtaatcctcgccgggcccatgccggtaacccacagctccgcggcacagcggcgcggccgcatcgggcgcaacccgaagaacgagaacgatcagtatatctacatgggcgaacccctggagaacgacgaggattgcgcccactggaaagaggcgaagatgctgctcgacaacatcaatacgcccgagggcattatcccgagcatgtttgagcccgagcgcgagaaggtggatgccatcgacggggagtaccggctgagaggcgaggctcggaagacctttgtagacctaatgcgtcgcggggacctccccgtctggctggcttacaaggtggccgccgaggggataaactacgctgaccgcaagtggtgcttcgacgggatcaagaacaatcagatcctggaggagaacgtggaggtcgagatctggaccaaagagggcgaacggaagaagctcaagcctcgctggctggatgcccggatctactccgaccccctcgccctcaaggagttcaaggagttcgcggccggcagaaagagcctgaccctgaacctcataaccgagatggggcggctgcccacctttatgactcagaaggcccgcaatgcactggacaaccttgccgtgctgcacaccgcggaggccggcggccgggcctacaaccacgccctgtccgaactccccgagacgctggagaccctgctcctgctcaccctcctggccaccgtcacgggcggcatcttcctgttcctcatgagcggaaagggcattggtaaaatgaccctgggcatgtgctgtatcattaccgcgagtatcctgctttggtacgcccagatccagcctcactggattgccgccagcatcatcctggagttcttcctgatcgtgctcctgatccccgaacccgagaagcagcgcacgccccaggacaaccagttgacctacgtggtcatcgccatcctcacggtggtggccgccaccatggccaacgagatggggttcctggagaagacgaagaaagacctgggcctcggcagcatcaccacacaggagtccgaaagcaatatccttgacatcgacttacggccggcctccgcctggaccctctacgcggtcgccactaccttcgttacgcccatgttgcgccatagcatcgagaacagtagcgtgaacgtgtccctgaccgcaatcgccaaccaggctacggtgctcatggggctggggaaggggtggcccctgagcaagatggacatcggcgtgcccctcctggccatcgggtgctactcccaggtcaacccgattacattaacggccgccctcttgctcctcgtggcccattatgcgatcatcggcccggggctgcaggcgaaggccacgcgggaggcccagaagcgagccgcagccgggatcatgaagaatcccaccgtcgacggcatcaccgtcatcgacctggagcccatcccgtatgaccccaagttcgagaagcagctaggccaggtcatgctgctgatcctctgtgtgacacaggtactgatgatgcgaaccacctgggccctgtgcgaggccctcaccctggccacgggccccatcagcaccctgtgggagggaaaccctggccgcttctggaacaccactatcgcggtgagcatggccaacatcttccgcggaagctacctcgccggggccggcctgctgttctcaattatgaagaacacgacgaacacccggcgcgggaccggcaacatcggagagacgctcggggagaagtggaaatcccggctgaacgctctgggcaagtcagagttccagatctacaaaaagtccgggatccaggaggtggaccgaaccctcgcgaaggagggaatcaagcgcggggaaacagaccaccacgccgtctcccgcggcagtgccaagttaagatggttcgtggagcgcaacatggtgaccccggagggcaaggtcgtggacctgggatgcggccgcggcggctggtcctattattgcggagggctcaaaaacgtgcgcgaggtcaaagggctgacgaagggtggccccgggcacgaggagcccgtccccatgtctacgtacgggtggaacctggtgcggctccagtctggggtcgacgtgttcttcacgccgcccgagaagtgcgataccctgctgtgcgacatcggcgagtcctcgcccaaccccacgatcgaggctggccgcacactccgggtgctgaacctggtggaaaactggctcaacaacaacactcagttctgcatcaaagtgctgaacccgtacatgccgtccgtgatagagaaaatggaaaccctgcagcgcaagtacgggggcgcgctcgtccggaacccgctgagccgcaactccacccacgagatgtactgggtgagcaacgccactgggaacatcgtgtccagtgtcaacatgatctcacgtatgctgatcaaccgcttcaccatgaagcacaagaaggccacctacgagccggacgtggacttaggctcagggacccgtaacatcggcatcgagtccgaaacacccaacctggacatcatcggcaagcgcatcgagaagattaagcaggagcacgagaccagctggcattacgaccaggaccacccctacaagacctgggcctaccatgggtcctacgagaccaaacagactggcagcgcctccagcatggtgaacggggtcgtgcgcctgctgaccaagccctgggacgtggttcctatggtgacccagatggccatgaccgacacgactcccttcggccagcagagggtgttcaaggagaaggtcgacaccagaacccaggagccgaaggagggcacgaagaagctaatgaagatcacagccgagtggctgtggaaggagctgggtaaaaaaaagacgccccggatgtgcacccgagaggagttcacgaagaaggtgcggtccaacgccgccctcggcgccatcttcaccgatgagaacaagtggaagagtgcgcgcgaagccgtggaggacgggcgcttctgggagctggtagaccgcgagcggaacctgcacctcgagggtaagtgcgaaacctgcgtgtacaacatgatggggaagcgcgagaagaagcttggcgagtttggcaaagccaagggctcccgagcgatctggtacatgtggctgggcgcgcgcttcctggagttcgaagccctggggttcctgaacgaggaccactggttttcccggggcaacagcctctccggtgtcgagggagagggcctgcaccgactgggctatatcctccgggaagtgggcaagaaggagggcggcgccatgtacgccgacgacaccgccgggtgggacacgagaatcaccctggaggacctgaagaacgaggagatggtgaccaaccacatgaaaggcgagcacaagaagctcgcggaggctatcttcaagctgacctatcagaacaaggtcgtgcgagttcagcgcccgacgccacggggcacagtcatggacatcatctcccgccgggatcagcgcgggagcggccaggtagggacctacggcctgaacaccttcacgaacatggaggcccagctcatccgccagatggagggagagggtatcttcaagagcatccagcacctaaccgccaccgaggagatcgccgtgcagaattggctggcgcgtgtcggccgcgaacgcctgtcccgcatggccatcagcggggacgactgcgtagtgaagcccatcgacgaccggttcgccagcgccctgaccgcccttaacgacatgggcaaagtccgcaaggatatccagcagtgggagcccagccgggggtggaacgactggacgcaggtgccgttctgctcccaccacttccacgagctcgtgatgaaagacggccgcgtcctggtggtgccctgccggaaccaggacgagcttatcggccgcgcgcgcatcagccagggggccggatggtccctcaaggagaccgcctgcctaggtaagagctacgcccagatgtggactctgatgtacttccaccgccgggacctccgcctggccgctaacgccatttgctccgctgtccccagccactgggtgcccacttccaggaccacgtggagcatccacgccaagcacgagtggatgaccaccgaggacatgcttgcggtttggaaccgcgtctggatccaggagaacccgtggatggaggacaagacccccgtggaaagttgggaggaggtgccctacctgggcaagcgagaggaccagtggtgcggcagtctgatagggctgacgagccgcgccacctgggccaagaacatccagaccgccattaaccaggtccggagtctcatcggcaatgaggagtacaccgactacatgccaagcatgaagcgcttccgccgggaggaggaggaggccggtgtgctgtggtga

SEQ ID NO: 24987 - RNA, 9876 nt, synthetic construct
  misc_feature 1..9876: note = derived and/or modified CDS sequence (opt11) from DENV-2__FJ882602__SS-prME
  source 1..9876: mol_type = other RNA
actgctgggatgatcatcatgctaatccccaccgccatggcgtttcacctgaccacccgcaacggtgaacctcacatgatcgtgagccggcaggaaaaaggcaagagccttctgtttaagaccgaagacggcgtcaacatgtgcaccctcatggccatggatctgggcgagctgtgtgaggacaccatcacctataactgcccacttttacgccagaacgagcccgaggatatcgactgctggtgtaacagcaccagtacctgggtgacctatgggacctgcactgccaccggcgagcaccggcgcgagaagcggagcgtcgccctggtcccccacgtgggcatggggctggagacccggaccgagacttggatgtccagcgaaggcgcttggaagcatgcgcaacgaatcgagacctggatacttcggcacccggggttcaccatcatggcagccatcctcgcatacaccatcggcaccacctacttccagagggtgctgatctttatcttactgacggccgtcgccccctccatgaccatgcgctgcatcgggatatcgaaccgcgatttcgtggagggcgtgtccggaggtagctgggtggacatcgtgctcgaacatggcagctgcgtgactaccatggccaaaaataagcctacgctggacttcgagctgatcaagaccgaggccaagcagcccgccacgttacgcaagtattgcatcgaggcgaagctgaccaacaccaccacagcaagtaggtgcccgacacagggagaaccctccctaaacgaggagcaagataagcgctttgtctgcaagcattctatggtggaccggggctggggcaacgggtgtggattattcgggaagggcgggatcgtgacttgcgcgatgtttacatgtaagaaaaacatggaagggaaaatcgtgcagcccgagaacctggagtacaccatcgtgatcacgccgcactccggggaggagaatgccgtggggaatgacacgggcaaacatgggaaggagatcaaggtcaccccgcaaagctcaatcaccgaggcggagctgaccggctacggaactgtaaccatggaatgtagcccccgcaccggcttggactttaatgagatggtgcttctacagatggaaaataaggcgtggttagtccaccgacaatggttcctggacctgcccctcccttggctgccgggcgccgacacccaggggagcaactggatccagaaggagactttggtaacgttcaagaatccgcacgccaagaagcaagatgtagtagtgctcggcagccaagagggggcgatgcacaccgccctgaccggcgcgaccgagatccagatgtcatccgggaacctcctatttacgggccatctgaagtgcaggctgcggatggacaagttacagcttaaaggaatgtcttactccatgtgcaccggaaagtttaaggtggttaaggagatcgctgagacccagcacggcaccatcgtgatacgcgtccagtacgagggggatggcagcccctgtaagatccccttcgaaatcatggatcttgagaagcggcacgtgcttggccgcctgatcaccgtgaacccgatcgtcaccgagaaggactcgcccgtgaatatcgaggccgagccgccgttcggcgactcttacatcatcataggcgtggaaccggggcagctcaagttatcctggttcaagaaggggagctccatcggtcagatgttcgagaccaccatgcgcggcgccaagcggatggccatcctgggcgatacggcatgggacttcgggagcctgggaggagtcttcacctccattggcaaggctttgcaccaggtatttggggccatctacggcgcagctttcagtggcgtgtcctggaccatgaagatcctgattggggtcgtgatcacctggattggcatgaatagcaggtctaccagcttaagcgtggctttggtcctagtgggggtggtcacattataccttggcgttatggtgcaagccgatagcgggtgtgtcgtgtcgtggaagaacaaggagctgaagtgcggatctggcatcttcattaccgacaacgtgcacacctggacggagcagtataagttccagcccgagagcccgtccaagctggccagtgccatccagaaggcgcacgaggaggggatatgcggaatccggagtgtaacccgcctggaaaatctcatgtggaagcaaattacccccgagctgaaccacatcctatccgaaaatgaggtgaagttaaccataatgacgggggacatcaagggcatcatgcaggccgggaagcggtccctgcggccccaacccaccgagctgaagtacagctggaagacgtggggcaaggccaagatgctctcaaccgagccccacaaccagacgttcctgattgatggcccagaaaccgccgagtgccccaataccaaccgggcctggaacagcctggaggtggaggattacgggttcggagtctttactacgaacatctggctcaaactaaaggaacgtcaagacgtattctgtgactccaagctgatgtcggcagccattaaagacaaccgggccgtacacgccgatatggggtactggatcgaaagcgccctgaacgacacctggaagatcgagaaggccagcttcattgaggttaagtcctgccattggcccaagagccataccctatggtccaacggcgtgctggagagcgagatgatcatacccaagaacttcgctggcccagtgtcgcagcacaattatagacctgggtaccacacccagaccgccggcccctggcacctcgggaagctggagatggatttcgacttttgcgagggcacgacagtggtggtgacggaagactgcgggaacagaggccctagcttgcgcacgacgaccgccagcggcaagctcatcaccgagtggtgctgccggtcctgcaccctcccgcctctgagataccgaggggacgacggctgctggtacgggatggagatccgccccttgaaggagaaggaagagaacctagtcaacagcctggtaacggcgggctatgggcagattgacaatttctccctgggcgtactgggaatggccctgttcctcgaggagatgctgcggactcgagtagggacgaagcatgcggtgctgctcgtagccgtcagcttcatgaccctgatcacgggcaacatgtcctttagagacttggggcgggtggttgtaatggtgggcgccgcgatgacggatgacatcggcatgggcgtaacctacttggccctgctggcggcattcaaggtccgacccacctttgccgctggcctcctgctccggaagctcacaagcaaagaactgatgatgactactattgggatcgtactgctttcccagagcaccatccccgagacgatcctggagctgaccgacgccctcgccctgggcatgatgatcctgaagatcgtgcgcaatatggaaaagtaccagcttgccgtgaccatcatggccatactctgcgttcccaacgccgtcattctgcagaacgcctggaaggtcagctgcaccatcctcgctgtcgtcagtgttagccccctactgctcacgagtagtcaacagaaggccgactggatccccctggcgctgaccatcaagggactcaaccccacggccatcttcttgaccacgctttctcggactaacaaaaagcgctcctggcctctcaacgaggccattatggccgttgggatggtttcgattttagcctccagcctgctcaaaaacgatatccccatgacaggccctctcgtagccggagggctgttaaccgtttgttatgtcctcacaggcaggtccgccgacctggaacttgagcgcgccgcagacgtgaggtgggaggaccaagccgaaatctctgggtcaagccccatattaagtatcacaatctccgaggacgggagcatgtcgatcaagaatgaggaggaggaacagaccctgaccatcctcatccgcacgggactgctcgtgatcagcggcctgttccccgtctccatccccatcaccgcggcggcttggtacctgtgggaggtgaaaaagcagcgggccggggtgctgtgggacgtcccttctcctccgcccgtggggaaggccgagctcgaggacggggcgtacaggataaagcagaagggaatcctgggctattcccagatcggcgcaggcgtttacaaggaggggaccttccacaccatgtggcacgtcacaagaggggccgtgctcatgcacaaggggaagcgcatagagccgagctgggccgacgtgcgtaaagacctcatctcctacggcgggggttggaaactggagggggagtggaaggaaggggaggaagtccaggtgcttgccctcgagcctggcaagaacccgcgcgcggtgcagacgaagcccggactcttcaaaacaaacaccggcaccatcggggccgtcagcctggacttctcaccgggaacgagcggatcccccatcgtcgacaagaaggggaaggttgtcgggttatacgggaacggcgtggtgacccgcagcggcacctatgtctccgccatcgcacaaacagagaagtcgatcgaggacaaccccgagatcgaggatgacatcttccgcaagcggaggctgactattatggatctgcacccaggtgcgggcaagaccaagcgctaccttccggcgatcgtgcgcgaggccatcaagcgcgggctgcgcaccctcatcctggcccccacccgcgttgtcgccgcggaaatggaggaggccctccggggcctacccatccgctaccagactccagcaatccgggccgaacacaccggtcgcgagatcgtggacctgatgtgccacgccacctttaccatgcggctcctttcccctgtgcgcgtccccaactacaacctgatcatcatggacgaggcgcacttcacggacccggccagcattgccgctcggggctacatcagcacccgcgtggagatgggcgaagccgcggggatatttatgactgccacacctcccggctcccgggaccccttcccccagagtaacgcccccatcatggatgaggagcgcgagatcccggaacgttcttggaacagcgggcatgagtgggtgacggacttcaagggcaagaccgtctggtttgtgccctccatcaaggccgggaacgacatcgcagcctgtctccgcaagaacggcaagaaagtcatccagctgagccggaagaccttcgactccgagtacataaaaacacgcacaaacgattgggatttcgttgtaacgaccgacataagcgaaatgggagccaacttcaaggcggaacgcgtgatcgatccccgccggtgcatgaagcccgtgatcctgactgatggggaggagcgcgtgatcctcgccgggcctatgcctgtgacacattcctcagctgcccagcggagaggacgcatcgggcggaacccaaagaacgagaacgatcagtacatctacatgggggagcccttagaaaacgatgaggactgtgcccactggaaggaagccaaaatgcttctcgacaacataaacacccctgaaggcatcatacccagcatgttcgaaccagagcgcgaaaaggtcgatgccatcgacggggaataccggctacgcggtgaggcgcgaaaaaccttcgtagacctgatgagacgaggcgacctgcctgtttggctggcctaccgcgtcgccgccgaggggataaactacgctgaccggcgctggtgctttgacggcataaagaacaatcagattctggaagaaaacgtggaagtagagatctggaccaaggagggggagcgcaagaaattaaagccccgctggctagatgcgcggatctacagcgaccccctggccctcaaagagtttaaggagttcgcagccggcaggaaatcccttacgctgaacttgataaccgaaatgggccggctgcccacctttatgactcagaaagcgcgcaacgcgctggataaccttgccgtgctgcataccgccgaggccgggggacgggcgtataaccacgccctgagcgagctccccgagaccctggagacgctgctcctgctgacattgctcgccacggtgaccgggggcatctttcttttcctcatgtccggcaaggggatcggaaagatgacactggggatgtgctgcatcataacggcctccatactattgtggtacgcccaaatccaaccccactggattgcagcgtccataatcctggagttcttcttaatagttttacttatccccgagcccgagaaacagcgaacaccgcaagacaaccaactgacttacgtggtgatcgcaattctcaccgtagtggctgccaccatggcgaacgagatgggcttcctcgaaaagaccaagaaagacctgggcctcggcagcattgccactcaacagcctgagtccaacatcctggacatcgacctgcggcccgccagcgcctggaccctctacgcggtggcgaccacattcatcaccccaatgctgcgacatagcatcgaaaattcaagcgtcaacgtgagcctgacagccatagccaatcaggccacggtgctcatgggtctggggaagggctggcccctgtcgaagatggacatcggagtccctttactggcgatcggctgctactcccaggtgaaccccatcaccctgacggccgcgttgctgcttctggtggcccattacgccatcatcgggcccggcctgcaggcgaaagccacccgggaggcccagaagcgggctgccgcgggcatcatgaagaacccaacggtcgacgggatcaccgtcatcgacctggaccccatcccctacgatcccaaattcgagaagcagctcggccaagtgatgcttctcgtcctctgtgtcacacaggtgctgatgatgcgcaccacgtgggctctgtgcgaagccctaactctggccacaggtccaataagcaccctgtgggagggaaaccccgggcggttctggaacacaaccatcgcagtctccatggcgaacatcttccgaggctcttacctcgccggcgcagggctgttattttccattatgaaaaacacgaccaacacccggcgcggcaccgggaacacgggcgaaaccctcggggagaagtggaagaaccgccttaatgctctgggtaagtcggagttccagatctacaaaaagtccggcatccaggaagttgaccgcaccctcgccaaggagggaatcaagcggggcgagacggaccaccatgccgtgagccgggggtccgccaagttaagatggttcgtcgagaggaacctggtgacgcccgagggaaaggtggttgacctcgggtgcggccggggcgggtggagctattactgcggtgggcttaagaacgtgcgcgaggtcaagggtctgaccaagggcggtcccggccacgaggaaccgatccccatgagtacctatggatggaacctcgtgaggctgcagagtggggtcgacgtgttctttacgccgcccgagaagtgcgacactctgctctgcgacatcggggagtcgagccctaaccccacggtggaagcaggccgcacccttcgggtgctaaacctcgtggagaattggctgaacaacaatacacagttctgtataaaggtacttaatccatacatgccgtcagtgatcgagaaaatggaggcgctgcagcgcaaatacggtggtgcgttggtgcggaaccccctgagccgcaacagcacccacgagatgtactgggtctccaacgccagcggaaatatcgtgtcctctgtcaatatgatctcacggatgttaatcaaccggttcacgatgaggcacaagaaggcaacctatgaacctgacgtagacctcggtagcggcacacgtaatattgggattgagtctgagaccccaaaccttgatattatcggcaaaaggatagaaaagatcaagcaggagcacgagacgtcttggcattatgaccaggaccacccgtacaaaacctgggcttaccatggttcctacgagacaaagcagacggggagcgccagtagcatggtgaacggcgtagtccggctgctcactaagccatgggacgtgatcccaatggtcacgcagatggcgatgaccgataccacgcccttcgggcagcagcgcgtcttcaaagagaaggtggacacgaggacccaggagcccaaggagggaaccaagaagctgatgaaaatcactgccgagtggctgtggaaggagctaggcaagaagaagacgcctaggatgtgcacccgggaggagttcacccgcaaggtgcgatccaacgcggcactgggggccatctttacggacgaaaacaagtggaagtccgcgcgcgaggcagtagaggattcccggttttgggaacttgtggacaaggagaggaacttacacctggagggcaagtgcgaaacgtgcgtatacaacatgatggggaagcgggagaagaagctgggcgagttcgggaaagccaagggcagccgcgcaatctggtatatgtggctcggcgcgaggtttctcgagtttgaggccctggggttcctcaacgaagaccactggttcagcagggaaaacagcctgtccggcgttgaaggagaggggctgcacaagctcgggtacattcttagagacgtgagcaagaaggagggcggcgctatgtacgccgacgacaccgccgggtgggacactcgaataacgctggaggacctgaagaacgaggaaatggtcaccaatcacatggaaggtgaacacaagaaactggcggaagccatcttcaagctgacttaccagaacaaggtggtgcgagtacaacggcccacgccccgtgggactgtgatggacatcatcagccgtcgcgaccagagaggctcaggacaggtggggacctacggcctcaacacctttaccaacatgggggcccagctgatcagacaaatggagggcgaggaggtattcaaggggatccagcacctgacggccactgaagagatcgcagtacagaattggctcgcgagagtgggccgagagcggttgtcgcgtatggccatctcaggtgacgactgcgtagtaaagccgttagacgaccggtttgcaagcgccctcaccgcattaaacgacatgggtaaagtgaggaaagatatacagcagtgggagccttcccgcggctggaacgactggacccaggtcccattctgctcacaccacttccacgagctgatcatgaaagatgggcgggtacttgtggtaccctgccgcaaccaggacgagttaatcggccgcgcgcgaatctcccagggggcaggctggtctctgagagagacggcatgcttgggcaagtcttatgcccagatgtggtccctgatgtacttccaccggcgcgatctgagactcgcagcgaacgccatctgttccgcagtgccgagccactgggtgcccacgtcccgcaccacctggagcatccacgcccggcacgagtggatgaccacggaggacatgctgaccgtctggaatcgcgtgtggatccaggaaaacccgtggatggaggacaaaacccccgtcgagtcctgggaggagatcccgtacctcggaaagcgagaagaccagtggtgcggctcgctcattggtctgacatcacgagcgacgtgggccaagaacatccagacagccatcaaccaggtgcgcagcctcataggtaacgaagagtacaccgactacatgccctctatgaagcggttcagacgggaggaggaagaggccggagtgctctggtga

SEQ ID NO: 24988 - RNA, 9876 nt, synthetic construct
  misc_feature 1..9876: note = derived and/or modified CDS sequence (opt11) from DENV-2__GQ252676__SS-prME
  source 1..9876: mol_type = other RNA
acagcaggggtaataataatgctaattccgacggcaatggcattccatttgaccacacgaaacggagaaccccacatgatcgtaagtaaacaggaaaaaggaaaaagcctactattcaaaaccgaagaaggtgtgaacatgtgcacgctaatggccatggacctcggggaactctgcgaagatacaataacgtataactgccctcttctacgacaaaacgaaccggaagacatcgactgttggtgcaacagcacgagcacatgggtcacctacggaacatgcacggcaacgggagagcacaggcgtgagaaaaggtccgtggcactcgtgccgcatgtagggatgggactagagactcgcaccgagacctggatgagtagcgaaggcgcgtggaaacacgcccagcgcatagaaacatggattctccgccaccccgggttcacgataatggccgccatcttagcgtacaccatcggaaccacatacttccagagggtcctaatcttcatcctcctgacagcggtcgcgccgtccatgacaatgcgctgcataggaatctccaatcgggacttcgttgaaggagtaagcggaggcagttgggtagatatcgtactggaacacggcagctgcgtgacgacaatggctaaaaataaaccaacactggacttcgaattaataaagacagaggcaaagcagccggccacactacgaaaatactgcatcgaagcaaaactcacgaacactacaacagcaagtcgatgtccgacacaaggcgaaccaagcctgaacgaggaacaagacaaacggttcgtatgcaagcactctatggtcgaccgcggatggggtaatggatgcggactattcggcaaaggagggatcgtgacgtgcgcaatgtttacctgcaagaagaacatggaaggcaagatagtacagccagaaaacctggaatacaccatagttgtaacaccacactctggcgaagagaacgctgtcggcaacgacaccggaaaacatggcaaagagataaaggtgactccacagagctcgatcactgaggctgaacttactggatatggtacagttaccatggagtgctcaccgcgaacgggccttgatttcaacgaaatggtactgctccaaatggagaataaagcatggctagtacaccgccagtggttcttggatttaccactgccctggctcccaggcgccgacattcaaggtagtaattggattcaaaaggagacactggtgactttcaagaatccacacgccaagaaacaggacgtggtcgtgcttggatcgcaagaaggtgccatgcacacggcccttacgggcgccacagaaatccaaatgagctccggaaacctcctattcacgggtcacctcaaatgccgcctccgaatggacaagctccagttgaaaggaatgtcatacagcatgtgcacagggaaattcaaggtcgtgaaggaaattgctgaaacccagcacggtacgatcgtggtacgagtccaatacgagggcgatggaagcccgtgtaaaatcccattcgaaatcatggacttagagaaaaggcacgtgctgggcagactgataaccgtaaacccaatagtcaccgagaaggacagcccagttaacatcgaggccgagccaccctttggtgacagctacatcataatcggcgtagaacccggtcagctaaagttgagctggttcaagaaggggagttcaataggacagatgttcgagacaacaatgcgcggagccaaaaggatggcaattctcggagataccgcctgggactttggctcgttgggtggagtattcaccagcataggcaaggcgctacaccaggtatttggcgcgatctacggcgccgccttctcaggggtctcctggacaatgaaaatactcatcggcgtcgtaattacctggatagggatgaactcgcgttcaaccagcctcagtgtgagcctagtgctggttggagttgtgacgttatacctaggagtcatggtgcaggccgacagcgggtgcgtggtcagctggaagaacaaggaactgaaatgcgggagcggcatatttataaccgacaatgtgcacacttggaccgagcaatacaaatttcagccagagagtccaagcaagctagcctctgcaatacagaaagcacatgaagaaggaatatgcggcattcgaagtgtaacccgacttgagaaccttatgtggaagcaaataacgcctgaactaaaccatatcctcagcgaaaacgaagtcaaactgtccataatgacaggcgatataaaaggtataatgcaggctggcaaacgtagcttacgacctcaaccaacggaattaaaatacagttggaaaacttggggcaaggctaagatgctgagtaccgagccacacaaccaaacgttcctaatagacggcccagaaacagcggagtgcccaaacactaacagagcatggaactcactagaagtcgaagactatggctttggggttttcaccacaaacatctggttgaagttgaaagaaagacaggacgtattctgcgacagcaaactaatgtccgcagccatcaaggacaatagagcagtgcatgcggacatgggatactggatagaaagcgcactaaacgatacctggaagattgaaaaagcgagcttcatagaagtgaaatcctgccactggcctaagagccatacattgtggtccaatggagtactggaatccgaaatgataatccccaagaatttcgcaggaccagtctcacaacacaactatcgccccggataccacacgcaaacagccggtccctggcacttaggaaagctagagatggacttcgatttttgcgaagggacaaccgtagtagtgacggaagactgtggaaaccgtggcccctcgctcagaactacgaccgcaagcggtaaacttataacagaatggtgctgccggtcttgtacactcccaccgctccgctatcgtggggaagacggctgctggtacggaatggagattcgcccgctgaaggagaaggaagaaaacctggtcaactcgctcgtgacggcgggacacggccaaatagacaacttcagcctaggcgtactaggaatggctctattcctcgaagaaatgttacgcacaagggtcggaacaaaacatgcagtcttgctcgtagcggtgagttttatgacgctgataacgggcaacatgtcatttcgagacctaggacgcgttatggtcatggtaggtgcagcgatgacagatgacatcgggatgggagtgacatatctcgcgctcctggcggcattcaaagtaagacccacatttgccgcaggccttttgctacgtaaactcacatcgaaagaactcatgatgacaacgatcggcatcgtcctactcagtcagtccacgatccccgaaacaatcctagaattgacagatgcactggcactcgggatgatgatactaaagatagtcagaaatatggagaaataccagctcgcagtcacgatcatggctatcctatgcgttccaaatgccgttatcctacagaacgcctggaaggtcagctgcacaatattagcagcagtgtcagtctcacctctattgctcacgagtagtcaacaaaaggccgactggatacccctagctctcacaataaagggacttaacccgacggcaatcttcctaacgactctaagccggacaaataagaaacgcagctggccactcaacgaagcaatcatggcagtcggaatggttagtatattggcgagcagcctactaaagaacgatatacccatgacggggccactcgttgccggcggcctcctcaccgtgtgctacgtacttacaggccgatctgcagacctagaactcgaacgggccgcagacgtacgctgggaagatcaggcagaaatctctggaagcagcccgatacttagtattacaatctctgaggacgggtccatgagtatcaaaaatgaggaagaggaacaaaccctgaccatcctaatccgaacaggactcctggtcatctcagggttgttcccagtcagcattcccataacggcggcggcatggtatttatgggaggtcaagaaacagcgagcaggggtcctctgggacgtaccttcgccaccacctgtcggcaaggcagaactagaagacggtgcgtatcgaatcaagcaaaaaggcatactaggatacagccaaataggcgcaggggtctacaaagaaggcaccttccatactatgtggcatgtaacacggggtgctgtcctaatgcacaagggaaaacggatcgaaccgagctgggcagacgtacgaaaggatctgatatcctacggaggaggctggaagctggaaggtgaatggaaagaaggagaagaagtacaggtccttgcccttgaacccggcaaaaatccaagggctgtccaaacaaagcccgggcttttcaagactaacaccggcactattggggccgtctctctagatttcagccctggcacaagcggatcgccaatcgtggataagaaaggcaaggtagtggggctctatggcaacggagtcgtgaccagaagtggaacctacgtgagcgcgatagcacagactgagaaaagcatagaagacaacccggagatcgaagacgacatatttagaaagaagagattaacaatcatggatcttcaccctggggcaggtaaaacgaaaagatatctacccgcaatcgtgcgtgaggctatcaaaagaggcctacgaacactaatcctcgcaccaacccgcgttgtggcggcggaaatggaagaagccttaagggggctacccataagatatcaaactccagcgataagagcagagcacaccggcagagagatagttgaccttatgtgccacgccaccttcacgatgcgtcttctctcacccgtccgcgtacccaactacaacctcataataatggacgaggcccattttaccgaccccgcatccatcgccgcgcgaggctacattagcacacgagtagaaatgggagaggccgccggcatcttcatgacagcaactccacccgggagccgagaccccttcccccagtcaaacgcccccatcatggacgaagagagggagatcccagaacgcagctggaacagcggccatgaatgggttacagacttcaaaggaaaaacagtgtggtttgttccatctatcaaggcaggaaacgacattgcagcctgcctccggaaaaatgggaaaaaggtaatccaactctcacggaaaacgttcgactcagaatacatcaaaactcgcaccaacgactgggacttcgttgtgactactgacatctccgagatgggggccaacttcaaggcggagcgcgtgattgatccacggcgatgtatgaaaccggtgatactcacagatggtgaagaacgcgtcatcttagcagggccgatgcccgttacacatagtagtgcagcacagagacgaggccgcataggcagaaaccccaaaaacgagaacgaccaatacatctacatgggggagcctctggagaacgacgaagactgcgctcattggaaagaagcaaaaatgcttttggataacatcaacaccccagaagggataataccgtcaatgtttgaaccagagagggaaaaagttgacgccattgacggcgaatataggctcagaggtgaggcgagaaaaactttcgtcgacttgatgcgcagaggggatctaccagtatggctggcctaccgcgtagctgccgagggaatcaattacgctgaccgtcggtggtgcttcgatggaataaagaacaaccaaattcttgaggaaaacgtcgaagtcgagatctggacaaaagaaggtgaaagaaagaaactaaagccacgttggctcgatgcccggatctactcagacccgctggcgttaaaagagttcaaggagttcgcagccgggaggaaatcactcacgctcaacctaataaccgaaatggggagactccctaccttcatgacccagaaagcccggaacgccctcgacaacctcgcagttctccacacagcagaggcaggcggccgggcgtacaaccatgcactatcggagctaccagagacactggaaacactgctcctattaacgttgcttgcaacagttaccggcgggatcttcctcttccttatgagtgggaagggcataggcaaaatgactctgggcatgtgctgcataataaccgccagtatactcctctggtatgcacagatacaaccccactggattgcagcatccataattctagagttctttttgatcgtactcttaataccagagcccgaaaaacaaaggacgccgcaggataatcaactgacctatgtggtcatcgcaatactaactgtagtggcggccacaatggccaacgaaatgggtttcttagagaaaacaaagaaagattttggccttggctcaatagccacgcagcagccagaatcaaatattctcgatatagacctacgcccagccagcgcatggactctctacgcagtagcgaccaccttcatcacgccaatgctacgacacagcatagagaatagcagtgtcaacgtatctctaacggccattgcaaatcaggccactgtcctaatgggactcggcaaaggatggccactcagcaaaatggatataggtgtacccctactggccatcgggtgctactcccaagtcaacccgatcacacttactgcagcgctcttacttctggtggcgcactacgcaataatcggaccaggactccaggctaaagcaacacgagaagctcagaaacgagcagcggctgggatcatgaaaaaccccacagtcgacggaatcaccgtcatcgatcttgaccccatcccctacgacccgaagttcgaaaagcaactgggtcaggtgatgctcctagtactatgcgttacccaagtgcttatgatgaggacgacttgggcgctatgtgaggcgctgaccctggcaacagggcccataagcacactatgggagggaaatccaggccgattttggaacacaacaatagccgttagcatggcgaatatctttagaggtagttaccttgctggggcgggcctactattctcgatcatgaaaaacacaacaaacaccaggagaggcactggcaacacgggcgagaccctcggagagaagtggaagaatcgcctaaattccttaggtaagtccgagtttcagatatacaaacggtcagggatccaggaagtggaccgaacattggccaaagagggcattaagcggggagaaactgaccatcatgctgtatcaagaggctccgcgaaactgaggtggtttgtagaacgcaacctggtaaccccagaaggtaaagttgtcgatcttggctgcggtagaggaggatggtcatattactgcggaggtctcaaaaatgtccgtgaagtcaagggcttgaccaagggcggacccgggcacgaagaaccgatacctatgtcaacgtacggatggaatcttgtcagactacaaagcggagtcgacgttttctttacacctcccgaaaagtgcgacaccttgctatgcgacataggcgaatctagtccaaacccaaccgtggaagcgggacgaacacttcgggtcctaaatttggtggaaaactggctcaacaacaacacccagttctgcatcaaggtactgaacccatacatgccgtctgttattgagaaaatggaaacactgcagcgaaagtacggaggggccctagtccgcaatccgctatctagaaacagtacgcatgagatgtactgggtatcaaacgcgagcggaaacattgtatcgagcgtaaatatgatatcccgtatgctaataaacagattcacgatgagacacaagaaggcgacatatgaacctgacgtcgatctaggcagcggtacaagaaacattgggatagaaagcgagactccgaacttagatataataggcaaacgaatagagaaaatcaagcaagaacatgaaacgagctggcattacgaccaggaccacccctacaaaacatgggcctaccacggttcgtacgagaccaagcagacgggaagtgcaagcagcatggtaaatggagttgttagacttcttacaaagccatgggacgtaatacccatggtaacacaaatggccatgacggacaccacacccttcggccaacagcgagtcttcaaggaaaaagtcgacacccgcactcaagaaccaaaagagggaaccaagaaactcatgaaaataacagccgagtggctctggaaggaactagggaagaagaagacgccacgcatgtgcacccgcgaagagttcgcccgaaaagtccggagcaacgcggcgcttggagcaatctttacagacgaaaacaaatggaaaagcgcacgcgaagccgtcgaagatagcaggttctgggaacttgtggacaaagaaaggaatctccatctcgaggggaagtgcgagacctgtgtatacaacatgatggggaaaagagagaagaaaatcggagagttcggcaaagcgaaaggcagccgagcgatatggtacatgtggctcggcgccaggttcctggagtttgaagcactaggtttcttaaacgaggaccactggttctcaagagaaaacagcctcagcggcgttgaaggggaaggcctacacaaactaggctatatcctgagggaagtgtccaaaaaggagggcggggcaatgtacgcggacgacaccgccggctgggacacgcgaataacattggaggacctcaaaaatgaggagatggtaacaaaccacatggaaggggaacacaagaaactagcagaagcaatattcaagctaacctaccagaataaagtagtccgcgtccagagaccaaccccgcgaggtacagtaatggatataatctcacgcagagatcaaagagggagcggccaggtgggtacatacgggctaaacactttcaccaacatgggagcgcaactgatccgccagatggagggggaaggcgtattcaaaggcattcagcacctcactgcaacggaagaggtagcggtgcaagactggctagcgcgtgtcggacgagaacgcctttctagaatggctatttctggagacgattgcgtggtcaagcctctagacgaccgattcgcatccgccctaacggcgttgaacgatatgggcaaagtccgaaaggacatacaacaatgggaaccaagcagggggtggaacgactggacacaagtccctttctgttcacaccatttccacgaactcatcatgaaggacggaagagttttggtagtaccgtgtcgcaaccaagatgaactcattggccgcgcacgaatatcacaaggggccggatggtccctacgggagaccgcctgcctcgggaagtcatacgcccagatgtggtcgcttatgtatttccaccgccgagacctgagacttgcagctaacgcgatttgcagcgcggtgccgagccattgggtacctacaagtcgaacaacgtggagcattcacgcaaggcacgaatggatgactacagaggacatgctgaccgtatggaatagagtgtggatacaagaaaacccgtggatggaagacaagacaccggtagaaagctgggaagaaatcccgtacctcgggaaaagagaggatcaatggtgcggctctctaataggcctaacaagccgggcgacatgggccaaaaacatccagaccgctataaaccaagtccgaagcctaataggtagcgaagaatacaccgactacatgcctagcatgaaacgcttccgtcgcgaggaagaggaggccggcgtgctatggtag

SEQ ID NO: 24989 - RNA, 9876 nt, synthetic construct
  misc_feature 1..9876: note = derived and/or modified CDS sequence (opt11) from DENV-2__GQ252677__SS-prME
  source 1..9876: mol_type = other RNA
accgctggcgtgatcatcatgctgatacccacagccatggcgttccacctcaccacccgcaacggcgagccccacatgatcgtgtcgaagcaggagaagggcaagtccctgctatttaaaaccgaagagggagtgaacatgtgcaccctcatggcgatggacctgggcgaactctgcgaggatacaatcacctacaactgccctctcctgcggcaaaacgaacccgaggatattgactgctggtgtaacagcacatccacctgggtgacctacggcacctgcaccgcgaccggcgagcaccgccgggagaaacgctccgtcgccctggtgcctcacgtgggcatggggcttgaaactcggaccgaaacctggatgtccagcgagggcgcctggaagcacgcgcagcggattgagacctggatcctgcggcaccccgggttcaccattatggccgccatcctggcctacaccatcggcacaacctacttccagcgcgtcctcatatttatcctattaacggctgtggccccctccatgaccatgcggtgcatcgggatcagcaatcgcgacttcgtggagggcgtgagtggcggttcatgggtcgacatcgtgttagagcacggctcctgcgtgaccaccatggccaagaacaagcccacgctggactttgaacttatcaagaccgaggcgaagcaacctgccacactccgaaagtactgcatagaagcgaagctgacaaacactaccacagcctcgcgctgcccgacccagggggagcccagcctgaacgaggagcaggacaagcggtttgtgtgcaagcacagcatggtggatcggggttggggcaacgggtgcggcctctttgggaagggagggatcgtcacgtgcgccatgttcacgtgcaagaagaacatggagggcaagatagtgcaacccgagaaccttgaatacacaatcgtggttacgccccatagcggtgaagagaatgccgtgggcaatgacacgggcaagcacgggaaggagattaaggtcaccccacagagcagcatcactgaggcagagctgaccggctacggcaccgttacgatggagtgtagcccccgtaccggtctcgacttcaacgaaatggtgctgctgcagatggagaataaggcgtggctcgtgcacaggcaatggtttctggacctgcccctcccttggttacctggcgcagacatccaggggtccaactggatccagaaggagaccctggtcaccttcaagaacccccacgccaagaagcaggacgtcgtcgtgctcggcagccaggagggggccatgcacacggcgctgaccggcgcgaccgagatccaaatgtcctcgggcaacctacttttcaccggtcacctgaaatgccggctgcgcatggacaagctacagctgaagggcatgtcttactccatgtgtaccgggaagtttaaggtggtcaaggagatcgcggaaacccagcacggcactatcgtggtccgggtccaatatgagggtgacgggagcccctgcaaaatccccttcgagattatggacctcgagaagcgtcacgttcttggccggctgatcaccgttaacccgatagttacggaaaaagactctcccgtgaacatcgaggccgagccgcccttcggtgacagctacatcattatcggtgtcgagccggggcagctaaagctatcctggttcaagaaaggcagctccatagggcaaatgttcgagaccaccatgcgcggcgccaaacgcatggctattctgggcgacaccgcgtgggacttcgggagcctagggggcgtcttcacgagtatcggcaaggcactccaccaagtgttcggcgcgatctatggcgccgctttcagcggcgtgtcctggaccatgaagatactaatcggtgtcgtgattacctggataggtatgaacagccggtcgacgagcctttccgtgagcttggtcctcgtgggggtagtaacattgtatttaggcgtgatggtacaggccgattccggctgcgtcgtaagctggaagaacaaggagctgaagtgcggtagcggtatcttcatcacggacaacgtgcatacctggaccgagcaatacaaatttcagcccgagtcacccagcaagttagcgtccgccatccagaaggctcatgaggagggaatctgcgggatccgctcagtaacccgactggagaaccttatgtggaagcagattacccccgagttaaaccacatcctgtccgagaacgaggtgaagctgagcattatgaccggggacatcaaaggcatcatgcaggcagggaagcgctccctgcggccgcaacccacagagctcaagtacagctggaagacgtggggcaaggccaagatgttgtccaccgagccccacaatcagacattcctgatcgatggcccggagacagccgaatgccccaacaccaatcgcgcgtggaactcgctggaggtggaggactacgggtttggcgtgttcaccaccaacatctggctcaaactgaaggaaagacaggacgtgttttgtgactccaaactgatgagtgccgcgattaaggacaacagggccgtgcacgccgacatggggtactggatcgagagcgccctcaatgatacttggaagatcgagaaggccagctttattgaagtaaaatcttgccactggccgaaaagccacacgctgtggtccaacggcgtgttagagagcgagatgatcataccaaagaacttcgcgggcccggtgagccagcacaattaccgcccagggtaccacacccagaccgcgggcccctggcatttgggaaagctggagatggacttcgacttctgtgaggggaccacagtcgtggtgactgaagactgcgggaaccgcgggcccagtctgcgaaccaccaccgcgagcggcaagctcatcaccgagtggtgctgccgctcctgtaccctgccccccctccggtaccgaggggaggatggctgctggtatgggatggagatccgaccgctaaaagagaaagaggagaacctggtcaatagcctggtgaccgcagggcacgggcagattgacaacttttcactcggcgtgctgggaatggcgctcttcctcgaggaaatgttacgcacgagggtagggacgaaacatgccgtgctgctcgtggccgtctctttcatgacccttattactggcaacatgtccttcagggacctagggagggtgatggtaatggtcggcgccgccatgaccgacgacatcgggatgggcgtgacgtaccttgcgctgctggccgcattcaaagtccgccccactttcgccgcggggctcctgttgcgcaaactgacgagcaaggaactgatgatgaccacgatcgggatcgtcctgctctcccagagcaccatcccggagaccatcctggagctgacggatgcgctcgcgctgggcatgatgatactgaagatcgtgcggaacatggagaagtatcagctcgccgttacgatcatggccatattatgcgtgcccaacgccgtcatactccaaaatgcttggaaggtaagttgcaccatcttggcagccgtgagcgtgagcccgctgctgctcacctccagtcagcagaaggccgactggatccccctagctctgaccatcaagggactgaacccgacggccatcttcctgaccaccctgagccgcacgaacaagaagagatcctggccgttaaacgaagccatcatggcggtcggaatggtgtctatccttgccagttctttactcaagaacgacatcccaatgacgggacccctggtggccggtgggctactcacagtgtgctacgttttaaccgggagaagcgccgatcttgagctcgaacgagccgcggacgtgagatgggaggaccaggccgaaatttccggcagctccccgatccttagcattaccatatctgaggacggtagcatgtccatcaagaacgaggaggaggagcagactttaaccatcctgattcgaaccggcctgctggtaatcagtggcttatttcccgtgtccatccccatcaccgcggccgcatggtacctatgggaagtgaagaagcaaagggcaggcgtactatgggacgtgcctagcccgccgccggtgggcaaggccgagctcgaggacggcgcgtaccggattaaacagaagggcatactgggatattcacagattggcgccggcgtctataaggaggggacgttccacactatgtggcatgtgacccgcggcgctgttctcatgcacaaggggaagagaattgagccgagctgggccgacgtgcgcaaggacctcatctcttacggcgggggatggaagctggagggggagtggaaggagggggaggaggtccaggtcctggcccttgaacctggcaaaaaccccagggctgtgcaaaccaaacccgggctgttcaagaccaacacaggtactatcggggctgtgagcctggatttctctccgggtaccagcggttcccccatcgttgacaagaaagggaaggtcgtcggattgtacggcaacggcgtggtcactagaagcggcacgtatgtgtccgccatagcgcagaccgaaaaatccatcgaggacaaccccgagatcgaggacgacatcttccgcaagaaacgcctgaccatcatggacctgcaccccggggcgggcaagaccaagcggtatctaccggccatcgtgagagaagccataaagcggggtctccgaacgctgatcctggcacccaccagggtcgtggccgccgagatggaggaggccctccgcggactgcccatccgataccagacccccgcgatcagagcagagcacacggggcgagagatcgtagacctcatgtgccatgccacgttcaccatgcggctcctgagcccggtccgcgttcccaattacaatctgatcatcatggacgaagcacacttcactgacccagcctcaatcgccgcccggggatacatcagcactcgcgtggagatgggagaggccgcggggattttcatgacggccacgccgccaggcagtcgggacccttttccccagagcaacgcccccattatggacgaggagagagagattcccgagcgatcctggaatagcgggcacgagtgggtcaccgacttcaagggaaagaccgtatggttcgtcccctccatcaaggccgggaatgatatcgctgcctgcctccggaagaacggcaagaaggtcatccagttgtcccgtaagaccttcgactccgaatatatcaagacccgcaccaacgactgggactttgtcgttaccacggacatttctgaaatgggcgccaacttcaaagcagagcgtgtcatcgacccccggaggtgcatgaagcccgtgatactgaccgatggggaggaacgcgtgatcctggccggcccgatgcccgtcacccactccagcgcggcgcagcggcgcgggagaatcggccgcaatcccaaaaacgagaacgaccaatacatatacatgggggaacccttggagaatgacgaggactgcgcccattggaaggaggccaaaatgttactcgacaacatcaacaccccggagggcattattccctccatgttcgagcccgagcgtgagaaagtggacgccatcgacggtgagtaccggctgcgcggagaggcgcggaagactttcgtggacctgatgcgccggggcgacttgcctgtatggctggcctatagggtagccgcagaggggatcaactacgccgaccgtcgctggtgcttcgacggcataaagaacaatcaaatcctggaggagaacgtcgaggttgagatctggacaaaggagggagagagaaagaaattgaagccccgatggctggacgccagaatctacagcgacccccttgctctcaaggagttcaaggaattcgccgcgggccggaagtccctgaccctcaacctcatcaccgaaatgggacggctgcccacgttcatgacccagaaagcccgcaacgccttagacaacctagccgtgctgcacaccgcagaggcggggggccgggcatataaccacgccctgagcgagctccctgagaccctggagacactgctcttgctgaccctcctggctaccgtcaccgggggcatcttcttgtttctcatgtccggtaagggcatcggcaagatgacgctcgggatgtgctgcatcatcacagcctctattctgctctggtacgcacagatacaaccacactggatcgcggcatccattatcttggagttctttttaatcgtcctcctcatccctgagcccgaaaagcagcgcacgccgcaagacaatcagctgacctacgtggtaattgccatcctcaccgtggtggccgccacgatggcaaacgagatgggcttcctggaaaagaccaagaaggactttgggctgggatcaatagccacccagcaacccgagtcgaacatcctggacatcgacctgcggcccgcctccgcctggaccttatacgctgttgcaactacattcatcaccccaatgctgcgccatagcatcgagaacagtagcgttaacgtgtccttaacggccatcgcgaaccaggctacggtcttgatgggcttggggaaagggtggcccctgagcaagatggatatcggggtaccattactcgcgataggctgctactcccaggtgaaccccatcaccctgacggccgccctgctcctgctggtcgcccactacgccatcatcgggcccggccttcaggcaaaggccacccgtgaggcgcagaagcgcgccgccgccggaatcatgaaaaacccgacggtggacgggatcaccgtgatcgaccttgaccccatcccctacgaccccaagttcgaaaagcaactgggccaagtcatgctcttggtcttgtgtgttacccaggtgctcatgatgcggaccacgtgggccctgtgcgaggccctgaccttggcaaccgggccgatcagtactttatgggagggcaaccccggcagattctggaacacgaccatcgctgtatctatggccaacatcttccgcggctcgtacctggccggcgccgggctgctgttcagtattatgaagaacacaaccaatacgcggcgcggcaccggtaacaccggcgagaccctgggcgagaagtggaagaaccggctcaactccttaggaaagtccgaattccagatctacaagcgcagcggcatacaggaggtggaccggactctggccaaggaggggatcaaacgcggcgaaaccgaccaccacgcggtgtcccggggatcagccaagttacgctggttcgtggaaagaaacctggtaaccccagaaggcaaggtcgtagacctgggctgcgggcgcggcgggtggtcctactactgtggagggctcaagaacgtgagggaggtgaaagggctgaccaagggtgggcctggccacgaggagccaatccccatgagcacttacggttggaacttagtgcggctccaaagtggcgtggatgttttcttcacgccgcctgagaagtgcgacaccctgctgtgcgatatcggcgagagcagcccgaatccgaccgtggaggctggccgtacgctccgcgtgctaaatctggttgagaactggttgaacaacaacacccagttctgcataaaggtgctaaacccctatatgccgtccgtgatcgagaaaatggaaacccttcagcggaaatatggcggggcactggttcggaaccccctctcgcgcaactccactcacgagatgtactgggtgagcaacgcctccggcaacatcgtgagctccgtcaacatgatcagccgcatgctaatcaatcggttcaccatgcggcacaagaaggcgacctacgagcccgacgtcgacctggggtccggcacccgcaacatcgggatcgagagcgaaacccccaacctcgatataatcggcaagagaattgagaaaattaaacaggagcacgaaacctcatggcactacgaccaggaccacccgtacaagacgtgggcctaccatggcagctacgagaccaagcagacggggtccgccagcagcatggtgaacggcgtggtgcgcctgctgaccaagccgtgggacgtgatccccatggtcacccagatggccatgacggacactaccccttttgggcagcagcgggtgtttaaggaaaaggtagacacgaggacccaggagccaaaagagggcaccaagaaactcatgaagatcaccgccgagtggctctggaaggagctacgcaaaaagaagacgccacgtatgtgcacccgggaggagttcgcgcgcaaagtccggagcaacgccgcactcggcgcaatcttcaccgatgaaaacaaatggaaatccgcccgcgaggcggtggaggacagccggttttgggagctggtggacaaagagcggaacctgcaccttgagggcaagtgcgagacctgcgtttacaacatgatgggtaaacgagagaaaaagatcggcgagttcggcaaggctaagggttcccgcgctatctggtacatgtggttaggagcccgtttcttggagttcgaggcgctcggcttcctgaacgaagaccactggttcagccgcgagaattcgctttccggggtggagggagaggggcttcacaagcttggctacatcctaagggaggtgtcgaagaaagagggcggcgcaatgtacgccgacgacacggctggctgggacacccgcatcactctcgaggacctcaaaaacgaagaaatggtcacgaaccacatggaaggggagcacaagaagcttgccgaagctatctttaaactcacgtatcagaacaaagtggtccgagtgcagaggcccacaccccggggaaccgtgatggacatcatctcacgcagagaccagcgggggagcggccaggtaggaacgtatggccttaacacatttaccaacatgggggcccagctgatccgccagatggagggagagggcgtgttcaaaggtatacagcatctcaccgccaccgaggaggtggcagttcaggattggctggcccgagttggccgcgagagactgtcccggatggcgatctcaggggacgactgtgtggtcaaaccgctcgacgaccggttcgcttccgcactgacggcactcaatgatatggggaaggtgcgcaaggatatccagcaatgggagcccagtcggggctggaacgactggacccaggtgcccttctgctcccaccattttcacgagctcatcatgaaggatgggcgcgtcctggtggtgccctgcagaaatcaggacgagctaataggccgcgcccggatcagccagggagcgggctggtcgctccgtgagacggcctgccttggaaagtcatacgcccagatgtggagtctgatgtacttccaccggcgcgacctccggctagccgccaacgcgatctgtagcgccgtgccctcccactgggtgcccacctcgcgcacgacttggtccatacatgcccggcacgagtggatgaccaccgaggacatgctgaccgtatggaatcgggtttggattcaggaaaacccctggatggaggacaagacgcccgtggagtcttgggaagagatcccttatctcgggaaacgcgaagaccaatggtgtggcagcctgatcgggttaaccagccgggccacttgggcgaagaatatacagacggctatcaaccaggtgcgcagcctcatcggttccgaggagtacacagactacatgccgtctatgaaaaggttccgtcgggaggaggaagaggctggcgtcctgtggtga

SEQ ID NO: 24990 - RNA, 9876 nt, synthetic construct
  misc_feature 1..9876: note = derived and/or modified CDS sequence (opt11) from DENV-2__FJ898438__SS-prME
  source 1..9876: mol_type = other RNA
accgtgggcgtcatcgtcatgttgatccccaccgccatggccttccacctcaccacccgcaacggggagccacacatgatcgtgggccggcaggagaagggcaagtccctgttgttcaagacggaggacggcgtcaacatgtgtaccctcatggcaatcgacctgggggagctgtgcgaggacaccataacctacaagtgccccttgctgcgccagaacgagcccgaggacatcgactgctggtgcaatagcacctctacctgggtgacctacgggacctgttccaccacaggcgagcatcggcgcgagaagcgttcagtggccctagtcccccacgtggggatgggcctcgagacccgcaccgagacatggatgtcaagcgagggggcctggaagcacgtgcagaggatcgagacctggatcctacgccaccctgggttcacgatcatggccgccatcctggcgtacaccatcgggacaacccacttccagcgtgccttgatcttcatactgctgacggccgtcgccccatcgatgactatgcgctgcatcggcataagcaatcgcgatttcgtggagggcgtgtccggcgggagctgggtcgacatcgtgctcgagcatgggtcctgcgtgaccacgatggcaaagaacaagcccacgctggactttgagctgatcaaaaccgaggccaagcagcccgctaccctccgcaagtattgcatagaagccaagttgacaaacacgaccaccgagtctcggtgcccgactcagggggaaccctctctgaacgaggaacaagacaaacggttcatatgcaagcacagcatggttgatcggggatgggggaacggctgcgggctgttcggaaagggcgggatcgtcacgtgcgccatgttcacgtgcaagaagaatatggagggcaaggtggttcagcccgagaactttgaatataccatcgtgatcacgcctcattccggggaggaacacgcggtgggcaacgacacgggcaagcacggcaaagagatcaagatcacaccacagagctccatcaccgaggccgagctgaccgggtacggcaccgtaacgatggagtgcagcccccggactggcctggacttcaacgagatggtactcctgcaaatggaggacaaggcttggctggtgcaccggcaatggttcctcgacctgccactgccctggctacctggggccgacacccagggctccaactggatacaaaaggagacgctggtcacgttcaagaacccccacgccaagaagcaagacgtggtcgtgctggggagccaggagggcgcaatgcacaccgccctcactggggccaccgagattcagatgagctcaggcaatcttctgttcacgggccacctcaagtgtcgcctgcggatggacaagttacagctcaagggaatgagctactccatgtgcaccggcaagttcaagatcgtcaaagagatcgccgaaacccagcatggtaccatcgtcatccgcgttcagtacgagggcgacggaagcccctgcaagatccccttcgagataacggacctggagaagcggcacgtgttggggcgcctcattacagtcaacccaatcgtaactgagaaggactcccccgtcaatatcgaggccgagccgccattcggcgacagctatatcatcatcggtgtcgagccgggccagctgaagctgaactggttcaagaagggctccagcattggccagatgttcgagactactatgcgcggagcaaagcggatggccatcttgggggacaccgcctgggacttcggtagcctcgggggcgtctttaccagcatcgggaaggcactgcaccaggtgtttggggccatttacggcgcagccttctccggggtcagctggaccatgaagatactcatcggcgtgatcatcacgtggatagggatgaactcacgcagcacctccctgagcgtgtccctggtcctggtgggcgtggtcaccctctacctgggggcaatggtgcaggccgactccggctgcgtggtctcctggaagaacaaggaacttaagtgcggcagcgggatcttcatcaccgacaacgtgcacacgtggaccgagcagtataagtttcagcccgagagcccctctaagctcgcgagcgccatccagaaggcacacgaggagggcatctgcggaatccggtccgtgacccgcctggagaacctgatgtggaaacaaatcacccccgagctcaatcacatcctgagcgagaatgaagtcaagctcacgattatgacgggcgacataaaggggatcatgcaagccggcaagcggtccctccgcccgcagcccaccgagctgaagtacagctggaagacatgggggaaagccaagatgctgtccacggagagccacaaccagaccttcctcatcgacggacccgaaaccgcggagtgcccgaactccaacagagcctggaacagcctcgaggtggaggattacggcttcggagtgtttactacgaacatctggctgaagctacgcgagaagcaggacgtcttctgcgactctaagctgatgagcgctgccatcaaggacaatcgggccgttcacgctgacatgggctactggatcgagtccgccctgaacgacacctggaagatggagaaggccagcttcatcgaggtgaagtcctgtcactggccgaaaagccacacactctggtccaacggcgtactcgagagcgagatgatcatccccaagaactttgccggacccgtgtcacagcataactacaggccgggttaccacacgcagaccgctgggccctggcacctgggcaaactcgagatggacttcgatttctgcgaggggacgacggtggtcgtgactgaagactgcggtaatcggggaccttccctgcgcaccacgaccgcatctgggaagctgatcaccgagtggtgctgccggtcctgcaccctcccgcccctacgctaccgtggcgaggacgggtgctggtacggcatggagatccgccccctcaaggagaaggaggaaaacctcgtaaattctttggtcactgccgggcacggccagattgacaacttttccctcggcgtcctcggcatggcgctattcttagaagagatgctccggaccagaatcggaaccaagcacgccatactgctggtcgccgcaagtttcgtcactctcatcacggggaacatgagtttcagagaccttggtcgcgtaatggtgatggtcggggccaccatgacagacgacatcggcatgggcgtgacctaccttgccctcctggccgcgttcaaggtgcgccccacgtttgccgccgggctgctcctgcggaagctgacgtccaaggagttaatgatggccaccatcggtatcgccctgctgtcccaaagcactatcccggagacgattttagaactgaccgacgcgctggccctcgggatgatggtattaaagatcgtgagaaatatggagaagtaccagctggccgtgactatcatggccatctcctgcgtcccgaacgctgtcatcctgcagaacgcatggaaggtgagctgcactatcctggccgccgtctccgtgagccccctgctcctaacatcctcgcagcagaaggccgattggatccccttagccctaaccatcaagggcctgaaccccactgccatcttcctgaccacgctctcccggaccagcaagaaacgctcctggccgttgaacgaggcagtgatggcagtgggcatggtgagcatcctggccagctccctcctgaagaacgacatccccatgaccggtccgctggtcgcaggagggttactcaccgtgtgctacgtgctgacaggccggtccgccgacctggagctggaacgcgccgccgacgtaaagtgggaggatcaggcagaaatctcggggtcttctcccatcctgagcatcaccatctccgaggacggcagcatgtccattaagaacgaggaggaggagcagaccctcaccatcctgatcaggactggcctactcgtgatttcaggggtgttcccggtctccatcccaattaccgcggctgcgtggtacctgtgggaggtgaagaagcagcgcgccggcgtgctgtgggacgttcccagcccgccgcctgtgggcaaagccgagctcgaggatggcgcgtaccggatcaagcagcgcggcatccttggctactcccagatcggcgccggggtgtacaaggagggaacattccacacaatgtggcatgtcacccgaggggcggttctgatgcatcgcggcaagcggatcgaacccagctgggccgacgtgaaaaaggaccttatctcttatgggggcggctggaagctcgagggggagtggaaggagggggaagaggtccaggtgctggctctcgagcccgggaagaacccccgcgcggtacagacgaagcccggtatcttcaaaacaaatacggggaccatcggcgccgtcagcctggacttcagccccggcacgtcggggtcccccatcgtggaccggaagggcaaggtggtagggctgtacggcaacggtgtggtgacaagaagcggggcctacgtgtctgccatagcgcagaccgagaagtccatcgaggataaccccgagatcgaggatgatatcttccgaaagaagcgcctcaccatcatggacctgcaccccggagcggggaagacgaaacggtacttgcctgccatcgtacgcgaggccattaagcggggcctgcgtaccctgatcctggccccgacccgcgtcgtcgcggcagaaatggaagaggccctgcgggggctccccatccgctaccaaacccccgccataaagacagagcacaccgggcgggagatcgtggacttaatgtgtcatgcgacctttaccatgcgccttctcagccccgtgcgggtccccaactacaatctcatcatcatggacgaagcacactttacggacccggcgtccatcgccgcccgcggatatatcagcacccgcgtggagatgggggaggcggccggcatcttcatgaccgccacgccgcccgggtcccgcgacccgttcccccaaagcaacgcacccatcatggacgaggagcgggagatccccgaacgctcctggaacagcggacacgagtgggtgacggatttcaaggggaagaccgtctggttcgtgccgtccatcaaggccggcaacgacatcgcggcctgcctacggaagaacggcaagaaggtgatccaactcagccgtaagaccttcgactccgagtacgtcaagactagagccaacgactgggattttgtggtgacgaccgacatcagtgagatgggtgccaacttcaaggccgagcgcgtcattgacccccggcgctgcatgaaacctgtgatcctgacggacggcgaagaacgggtgatactggcggggcccatgccggtcacccactccagcgcagcccagcgccggggacgcatcgggcgcaaccccaagaacgagaatgaccagtacatttacatgggcgagcccctggagaacgacgaggactgcgcccactggaaggaggccaagatgctgctggacaacatcaacactcccgagggcataatcccgtccatgttcgagcccgagcgggagaaggtggatgctatcgacggggagtaccgcctccggggcgaggcccgcaagaccttcgtggatctaatgcggcgcggggacctgcccgtctggctcgcctacaaggtggccgccgagggcataaattacgcggacaggaagtggtgtttcgacggaattaagaacaaccagattctcgaggagaatatggaggtggagatctggaccaaggagggcgagcggaagaaattaaagccgcggtggctcgacgcccgtatctacagcgaccccctggccctgaaggagttcaaggagttcgccgcggggcggaagtccctcaccctgaacctgatcactgagatggggcgcctccccaccttcatgacccagaaggctcggaatgccctggacaacctcgccgtattgcataccgccgaggcgggcgggcgcgcctacaaccacgccttgagcgagctgcccgagacgttggagaccctgctactcctgaccctgttggccacagtaactggagggatcttcctgtttttaatgtccgggaagggcatagggaagatgacgttgggcatgtgttgcatcatcaccgccagcatcttactgtggtatgcgcagatccagccgcactggatcgccgcctcgatcatcctcgagttctttctgatagtcctgctcatccccgagcccgagaagcagcggacgccccaggacaaccaactgacctacgtggtaattgccatcctgacggtcgtggccgcgacaatggccaacgagatggggtttttagagaagaccaaaaaggacctgggcctgggctctatcaccacgcaggaaagcgagtccaacatcctcgacatcgacctacgccctgccagcgcctggaccctctatgccgtggctacaaccttcgtaacgcccatgctacggcactcaattgagaactcctccgtgaacgtgagcctgacagccatcgccaaccaggccaccgtcctgatggggctcggcaaggggtggcccctgagcaagatggacatcggcgtgcccctgctcgcgatcggttgctattcacaagtgaacccgatcaccctgactgccgccctgctcctgctggtcgcccactacgccatcataggccccggacttcaagcgaaggccacgcgcgaagcccaaaagcgggccgcagcggggatcatgaagaaccccaccgtggacggcatcaccgttatcgacctggagcccattccgtacgaccctaagttcgagaagcagttagggcaggtcatgctcctgattctatgcgttacccaggtgctgatgatgcgcaccacctgggccctgtgcgaggccctgacccttgccaccggccccatctccactctgtgggaggggaaccccggtcggttctggaacaccaccatagccgttagcatggccaacatctttcgtggctcctacctggccggcgccggactccttttcagtatcatgaagaacacgaccaacacccgccgggggaccggcaacatcggagagacgctgggagagaagtggaagagtcgcctcaacgcgctgggaaagagcgagttccagatctataagaagtccgggatccaagaggtggaccggaccctggcgaaggagggcataaagcgaggggagaccgaccatcacgccgtgagccgtggctcagcgaagctccggtggttcgtagagcggaacatggtgaccccggagggcaaggtggtcgacctggggtgcggaagagggggatggagctactactgcggtggcctgaagaacgtgcgggaggtgaagggcctcacgaagggcgggcccgggcatgaggagcccatccctatgagcacctacgggtggaatctggtcaggctgcagtccggggtggacgtatttttcactcccccagaaaagtgcgacaccctcctgtgcgacatcggcgagagctcccccaatcccacgatcgaggccggccggacgttacgcgtccttaaccttgtcgagaactggctaaacaataacacccagttctgcatcaaggtgctcaacccatacatgcccagcgtcatcgagaagatggagacactgcaacggaaatatgggggcgcgctggtgcgaaaccccctctccagaaattcgacccacgagatgtactgggtgtcaaacgcgacgggcaacatcgttagctccgtaaacatgataagccgcatgctgattaaccggttcaccatgaagcacaaaaaggcaacctacgagccggacgtggacctgggctccgggacccgcaacatcggcatagagagcgaaatccccaacctggatatcatcggcaagcggatcgagaaaatcaaacaggagcacgagacgtcctggcactacgaccaggaccacccctataagacctgggcctaccacgggtcatacgagaccaagcagaccggtagcgcttcatccatggtcaacggggtggtgcgcctcctgacgaagccctgggacgtagtgccgatggtgactcagatggccatgaccgacacaacgcccttcggccagcagcgcgtcttcaaggaaaaagtggacacccgtacccaggaacccaaggagggcaccaagaaactgatgaagatcacggcggagtggctctggaaggagctggggaagaagaagacgccccgcatgtgcacacgcgaggagtttaccaggaaggtgcgatctaacgctgccctgggcgccatcttcacggacgagaacaagtggaagtccgcccgcgaggcggtcgaggacgggcggttctgggagctcgtggaccgcgagcggaacctccatcttgagggcaagtgtgagacgtgcgtgtacaacatgatggggaagcgcgaaaagaagctcggggagttcggaaaggccaaggggagccgggcgatctggtacatgtggctgggagcccgcttcctggagttcgaggcgctcgggttcctgaacgaagaccactggttcagccggggcaactccctcagtggggtcgagggggagggcttgcaccggctggggtacatcctgcgggacgtgggcaaaaaggagggcggagccatgtacgccgacgacaccgccgggtgggacacccgtatcacactcgaggaccttaagaacgaggagatggtcaccaaccatatgaagggcgagcacaagaagctagctgaggcgatattcaagctcacctaccagaacaaggtggtgcgggtccagcgcccgacaccccgcggtaccgtgatggacataatctcccgccgggaccagcgcgggagcgggcaagttggaacctacggcctgaacacattcaccaacatggaggcgcagctgatccgccagatggagggcgaaggcatcttcaagtccattcaacacctcacggccactgaggagatcgctgtgcaaaactggttggcccgggtaggccgtgagaggttaagccgcatggcgatcagtggggatgactgcgtggtcaagccaatcgatgacaggttcgccagcgccctcacagccctgaacgacatgggaaaggtgaggaaggacatccagcagtgggagccttcccgggggtggaatgactggacccaggtgccgttttgttcccaccacttccacgagcttgtaatgaaggatggccgcgtgctcgtggtcccctgccggaaccaggacgagctcatcggccgcgcacgtatctcccagggggcgggctggtcgcttaaggagacggcctgcctcgggaagagttatgcccagatgtggaccctgatgtactttcatagacgggacctgcgcctcgccgccaacgcgatctgcagtgccgtgccctctcactgggtgcctaccagccggacaacctggtccatccatgctaagcatgagtggatgacgaccgaggacatgctggccgtctggaaccgcgtctggatacaggagaacccgtggatggaggacaaaaccccggtggaaagctgggaagaggtcccctacctgggcaagcgggaagaccaatggtgtgggagcctcatcggtctgacctctagggcgacgtgggccaagaacatccagaccgccatcaaccaggtgcggagcctgatcggcaacgaggagtacaccgattacatgccctctatgaagcgcttccgtcgggaagaggaggaagccggggtgttgtggtga

SEQ ID NO: 24991 - RNA, 9876 nt, synthetic construct
  misc_feature 1..9876: note = derived and/or modified CDS sequence (opt11) from DENV-2__GQ199893__SS-prME
  source 1..9876: mol_type = other RNA
accgcgggtgtgatcgtcatgctcattccaacggccatggctttccaccttaccacccgcaacggggagccacacatgatcgtgggccggcaggagaaggggaagtctctgctgtttaagaccgaggacggtgtgaacatgtgcacgctcatggccatcgatctgggcgaactgtgcgaagacaccatcacatacaagtgcccactgctccggcagaacgagcctgaggacatagactgttggtgcaattctaccagcacctgggttacgtacgggacctgtaccaccacgggggagcaccggcgcgagaagcggtccgttgccctggtgccacatgtcggcatgggcctcgaaacccgcacggagacctggatgagctctgaaggggcctggaaacacgtgcagcggatcgagacttggatcctccgtcaccctggcttcaccatcatggccgcgatcctcgcctacactatcgggaccacgcacttccagaaggcactcattttcatcctgctgaccgccgtggcgcccagcatgaccatgcggtgcatcggcatctccaacagggactttgtcgagggtgtgtcgggtggctcctgggtggatatcgtcctcgagcacggtagctgcgtgaccacgatggcaaagaacaagcccaccttggacttcgagttaatcaagaccgaggccaagcagcccgcaaccctccggaagtactgcatcgaggccaagctgacaaacaccaccaccgagtccaggtgccccacgcagggagagcccagcttgaacgaggagcaggacaagcggttcatctgcaagcacagcatggtagaccgcggctgggggaatggctgcggactattcggcaaaggcgggatcgtcacctgcgcgatgttcacgtgcaagaagaacatggagggcaaggtggtgcagcccgagaacctggagtacaccatcgttatcacgccccacagcggggaagagcacgccgtggggaacgacacgggaaagcacggcaaggaaataaaaattaccccgcagtcgagcatcacagaggccgagctgaccgggtacggaacggtgaccatggagtgcagcccccggacagggctcgacttcaacgagatggtcctgctgcagatggaagacaaggcgtggctcgtgcaccgccagtggttcctggacctgcccttaccctggctgcctggtgcagacacccagggctcgaactggatacagaaggagacgctagtgaccttcaagaacccccatgcgaagaagcaggacgtcgtggttcttgggtcccaagaaggagccatgcataccgccctgaccggagccactgagatacagatgagcagcggcaacctcctgttcaccggccacctgaaatgccggttgcgcatggacaaactacagctgaagggaatgtcctactccatgtgcaccggcaagtttaagatcgtgaaggagatcgccgaaacccagcacggaacgattgtgattcgggtccagtacgagggcgacggcagtccctgcaaaatccccttcgagatcactgacctggaaaagcgccacgtactcgggcggctgatcactgtgaacccgatcgtcaccgagaaagacagccccgtgaacatcgaggctgaaccccccttcggcgactcctatatcatcatcggtgtggagccgggccagctgaagctcaactggttcaagaaggggagctcgattggccagatgtttgagacgacaatgcgcggggccaagcgcatggccatcctaggggacaccgcatgggatttcggcagcctcggcggcgtcttcacctcgatcgggaaggccctccaccaggtcttcggtgcgatctacggcgccgccttcagcggggtgtcctggacgatgaagatcctgatcggcgtcatcatcacctggatcgggatgaatagccggtccacgagcctgtcggtgagcctggtgctcgtcggcgtggtgaccctttacctgggggccatggtccaggcagactccggttgcgtggtgagctggaagaacaaggagctcaaatgcggctctgggatctttatcacggacaacgtccatacctggaccgagcagtataagttccagcctgagagccccagcaagctggcctccgccatccagaaggcccatgaagagggtatctgcgggatccgcagcgtgacccggctggagaatctcatgtggaagcagatcactcccgagctgaaccacatactgtccgagaacgaagtgaagctcactatcatgacgggcgacatcaaggggatcatgcaagccggcaagagatcgctgcggccgcaacccactgagctgaaatactcctggaagacgtggggcaaggcgaagatgctcagcactgagtctcacaaccagactttcctgatcgacgggcccgagaccgccgagtgcccgaacacgaaccgcgcctggaatagtctggaggtagaagactatggcttcggggtattcaccaccaacatctggctcaaactgcgggagaagcaggacgtgttctgtgacagtaagctaatgagcgccgccataaaggacaaccgcgcagtccatgccgatatggggtactggatagagtccgccctcaatgacacctggaagatggagaaggccagcttcatcgaggtgaaatcctgccattggcccaaaagccacaccctgtggtccaacggggtgctggagagcgaaatgatcatcccaaaaaacttcgcagggcccgtctcccagcacaattaccggccgggctaccacacgcagaccgcaggaccctggcacctcggcaaactggagatggacttcgacctgtgcgaagggaccaccgtagtggtcacggaggactgcggtaaccgcgggcccagcctccggaccaccaccgcttctgggaaactgataacggaatggtgctgcagatcctgcactctgcctccgctccggtaccgcggcgaggacggctgctggtatggcatggagatccggcccctgaaggagaaggaggaaaacctggtgaattcgcttgtgactgccgggcacgggcagatagataacttctccctgggggtgctggggatggccctcttcctggaggaaatgctgcgcacccggattggcacgaagcacgcgatcctcctggtggccgtgagcttcgtaacactgatcactgggaacatgtcctttcgcgacctaggccgggtcatggtgatggtcggggccaccatgacggacgacatcggcatgggagtgacctacctggccctcttggccgcgttcaaggtgcgccccaccttcgccgcaggactgcttctccgcaaacttaccagcaaggaactgatgatggccacgatcggcatcgcgctcctgtcccagagcaccatccccgagacaatcctggagctcacagacgcgctggcactggggatgatggtcctcaagatcgtgcggaacatggagaagtaccagctggccgtaaccatcatggccatctcctgcgtccccaacgccgtaatcttgcagaatgcctggaaggtgtcctgcacaatcctcgccgccgtctcagttagcccgctgctgcttacctcaagccagcagaaggccgattggattcccctcgcgctgaccatcaagggcctcaaccccaccgccatcttcttaaccactctgtcccgcacctctaagaagcggtcctggcccctcaacgaggcaataatggcagtcggcatggtgagcatcctcgcctccagccttctcaagaacgacatccccatgacggggcccctggtggcgggcgggctgctcaccgtttgttacgtgcttaccgggcgcagcgccgacttagagctcgagcgagccgccgacgtgaagtgggaggaccaggccgaaatcagtggtagctcccccatcctgtctataaccatttccgaggatggcagcatgtccatcaagaacgaggaggaagaacagactctgaccatcctcattcgcaccggcttactggtgatcagcggggttttcccggtgagcatccccataacggcggccgcctggtacctctgggaggtaaaaaagcagcgggcaggcgtgctgtgggacgtgccctccccgccccctgttgaaaaagccgagctggaagacggggcgtatcgcataaagcagcggggcatactcgggtactcccagatcggcgccggcgtatacaaggaggggaccttccacaccatgtggcatgtgaccaggggcgccgtcctgatgcaccgagggaagcgcatagagcccagctgggccgacgtgaagaaggacctcatatcctacggcgggggctggaagttggagggcgaatggaaggaaggagaggaggtgcaggttctggccttggagcccggcaagaacccccgggcggttcagaccaagcccggtatcttcaagactaatacgggcacaataggggccgtgagcctcgacttcagtcccggcactagcggatcccccatcgtcgacaggaaggggaaggtggtgggcctatacgggaacggcgttgtgacccgaagcggagcttacgtgtccgccatcgcacagacggagaagtccatcgaggacaacccggagatcgaggacgatatcttccgcaagaaacggctaaccatcatggacctacaccccggggcaggcaagaccaagcgctacctccccgccatcgtccgtgaggcgatcaagcgagggctgcggacacttatcctagcccccacgcgcgtggtggcggccgagatggaggaggccttgcgcgggctgcccatacggtaccagacacccgccattaagacggagcacaccggacgcgagatcgtagacctcatgtgccacgcaacctttacgatgcggctgctgagtcccgtacgcgtacctaactacaacctgatcatcatggacgaggcgcacttcaccgatcccgcctccatcgcagcccggggctacatcagcacccgcgtcgagatgggcgaagctgcgggcatcttcatgacggccacgccccccggctcgagggacccatttccccagtccaatgcccccatcatggacgaagaacgagagatccccgaacgttcctggaattcagggcacgaatgggttaccgacttcaagggcaagaccgtgtggttcgtcccaagcatcaaggccggaaacgacatcgcggcgtgcctgcgcaagaatggtaagaaggtcatacagctgagtcggaagacgttcgactccgagtacgttaaaacccgcgcgaacgactgggacttcgtcgtgaccaccgacatcagcgagatgggtgccaacttcaaggccgagcgggtgattgaccccaggagatgcatgaagcccgtcatcctcacggacggagaggagcgcgtaatcctggctggtcccatgccggtaactcactccagcgccgcgcagcggcgcggccggatcggccgcaaccccaagaacgaaaacgaccagtacatctacatgggggaaccactcgaaaacgacgaggactgcgcccactggaaagaggccaagatgctcctggacaacatcaacacccccgagggcatcatcccatccatgttcgagcccgagcgagaaaaggtcgacgcgatcgatggcgagtacaggcttcgcggggaggcccggaagaccttcgtggacctcatgcgccggggagaccttcccgtttggctggcctacaaggtcgccgccgaagggatcaattacgcggaccgcaagtggtgtttcgacggcatcaagaacaaccaaatcctcgaggagaacatcgaagtggagatctggacgaaggagggagagcggaagaagctgaagccgcgctggctggatgcgcgcatctactcggaccccctcgccctgaaggagttcaaggagttcgcagcgggccgcaagtccctgaccctcaacttgatcacggagatgggccgtctgcccaccttcatgacacagaaggcccgcaacgcgttagacaacctagccgtgctgcacaccgccgaagccgggggacgggcctacaatcacgccctcagcgagctgcccgagacactggaaaccctcctgctgctcacgctgctcgccacagtcactgggggcatcttcctcttccttatgtccggaaaggggatcggcaagatgaccctggggatgtgctgtattatcaccgccagcatcctcttgtggtacgcacaaatccagccgcattggatcgccgcatccatcatcctggagttcttcttgatcgtgctattaatacccgagcccgagaagcagcgcacgccccaagacaatcagctcacatacgtcgtgatcgccatcctcaccgtggttgccgcgacgatggccaacgagatgggttttctggaaaagacgaaaaaggacctcggactgggcagcatcaccacgcaggagagcgagtccaacatcctggatatcgatctccggccggctagcgcctggaccctgtacgccgttgccacgaccttcgtgacccccatgctacgccacagcatcgagaacagctccgtcaatgtgagcctgaccgccatagctaatcaggccacggtgctgatggggctgggcaaaggctggcccctctccaagatggacatcggggtccccctgctggctattgggtgctacagccaggtgaacccgatcaccctcaccgccgccctgctgctcctggtggcccactacgcgatcatcgggcctggcttgcaggccaaggccacccgggaggcacagaagcgcgctgccgcgggcatcatgaagaaccccacggtcgacgggataaccgtgatcgacctcgagcccataccgtacgaccccaagttcgagaagcagttaggccaggtgatgttgctcatcctgtgcgtcacccaggtgctaatgatgcggaccacgtgggccctctgcgaggccctgaccctggctaccggacctatcagcaccctctgggagggcaaccccgggaggttctggaacacgaccatcgccgtaagcatggcaaatatcttccggggctcctacctggccggtgcagggctcctgttcagcataatgaagaacactaccaatacgcgccgcggtaccggtaacatcggcgagactctgggcgagaagtggaagtcccggctgaacgccctcggaaagagcgagttccaagtctacaagaagtccggcatccaggaggtggacagaaccctggctaaggaggggataaagcgaggcgagacggaccaccacgcggtaagccgggggtccgcgaaactgcggtggttcgttgaaaggaacatggtaaccccggagggcaaggtggtcgacctcgggtgcgggcggggcgggtggtcttactactgcggcgggctgaagaacgtgcgcgaagtgaagggcctgaccaagggcggtcctggccatgaggaacccatccccatgtcaacttatggatggaacctcgtccggctacagtcgggcgtggacgtgttcttcactccgcccgagaaatgcgataccctgctctgcgacatcggggagagctctcccaacccgaccatcgaggccggacgcaccctgcgggtcctgaacctcgtcgaaaactggctgaacaacaacacccaattctgcatcaaggtgctgaacccctacatgccgagcgtcatcgagaagatggaagccctccagcgcaagtacggcggggcgctggtgcggaacccgcttagtcgtaacagcacgcacgaaatgtactgggtttccaatgccacaggcaacatcgtcagctccgtgaacatgatcagccggatgctgattaaccgcttcaccatgaaacacaagaaggccacctatgagcccgacgtggacctcggttccggcacgcggaacatcgggatcgagtccgagatccccaacctcgatatcatcggcaagcggatcgagaagatcaagcaggagcacgagacctcctggcactacgaccaggatcacccctacaagacctgggcctatcacggcagctacgagacaaagcagactgggtctgccagctccatggtgaatggcgtggttcgtctgctcaccaagccctgggacgttgtgccgatggtgacacagatggcgatgacagacaccacccccttcggacaacagcgagtctttaaggagaaggtggacacccgcactcaggagcccaaagagggcacgaagaagctaatgaagatcaccgccgagtggctgtggaaggagctcggcaagaagaagacgccccggatgtgcacccgcgaagagttcacacggaaggtgcgcagcaacgccgcgctgggggcgatcttcactgacgaaaacaagtggaagtcagcgcgggaggccgtagaggatggccgcttctgggaacttgtggaccgagagcgtaacttgcacctggagggaaagtgcgagacctgcgtgtacaacatgatgggcaagcgggagaagaagctaggtgagtttggcaaagccaagggctctagggccatctggtatatgtggctcggggcgcggtttttggagttcgaggccctgggcttcctcaacgaggaccactggttcagtagggggaacagccttagcggcgtcgagggcgagggcctgcaccggctcggctacatcctgcgagacgtcgggaagaaggagggcggggccatgtacgccgacgacaccgccggttgggatactcgtatcaccctggaggacctcaagaacgaagagatggtcacaaaccatatgaaaggggagcacaagaagctggcggaggcaatcttcaagctgacataccagaacaaggtggtgcgcgtccagcggccgacgccccgcggaaccgtaatggacatcatctccagacgcgaccagcggggcagcggccaggtcggcacctacggactgaacaccttcacgaatatggaggcccagttaatcaggcagatggagggcgagggaatctttaagtccatccagcatctcaccgccactgaggagatcgccgtccagaactggctcgcacgcgtgggaagagagcgcttaagccggatggccatctcgggcgacgactgcgtcgtaaaacccatagatgaccgcttcgcctcggccctgaccgccctcaacgacatggggaaggtgcggaaggacatccagcagtgggagccatcccgcggctggaacgactggactcaggtgccgttctgctctcaccactttcacgagctggtaatgaaggatgggcgggtcctggtggtcccctgccgcaaccaggacgagctgataggccgggcacgcatcagtcagggcgccgggtggagtctgaaggagaccgcctgcctgggcaagtcttacgctcagatgtggaccctcatgtacttccaccggcgcgacctgcgcctggccgcgaacgccatctgcagcgccgtaccgccccactgggtgcccacctcccgaaccacgtggagcatccacgcgaagcacgagtggatgaccaccgaggacatgctcgcagtctggaaccgggtgtggattcaggaaaacccctggatggaggacaagacccccgtggagagttgggaagaggtcccttacctgggaaagcgcgaagaccagtggtgcggttctctgatcgggttgacctcccgggctacctgggccaagaacatccagaccgccatcaaccaagtgcgcagccttatcggcaacgaggagtacaccgactacatgccgagcatgaagcggttccgccgtgaggaggaggaggccggcgtgctgtggtaa

SEQ ID NO: 24992 - RNA, 9876 nt, synthetic construct
  misc_feature 1..9876: note = derived and/or modified CDS sequence (opt11) from DENV-2__GQ199894__SS-prME
  source 1..9876: mol_type = other RNA
acagccggcgttatcgtcatgttgatcccaaccgccatggcgttccacctcaccacccgcaacggggagcctcacatgatcgttggcagacaggagaaggggaagagtctcctgttcaagacagaggacggagtaaacatgtgcaccctcatggcaatcgacctaggggagctgtgtgaggacaccatcacctacaaatgccccctcctgcgccagaacgagcccgaggatatcgactgctggtgcaacagcaccagcacctgggtgacttacggaacctgcaccaccacgggcgagcaccggcgcgagaagcggtccgtggccctggtgccgcatgtaggcatgggactcgagacccgcaccgaaacctggatgagctcggagggggcttggaagcacgtgcagcggatcgagacgtggatcctacgccacccgggcttcacgatcatggccgcgatcctggcatacaccatcgggacgacgcatttccagaaggcgctcatattcatcctgctcaccgccgtggcacccagcatgacaatgcggtgcattgggatctccaaccgcgactttgtcgagggtgtgagcggaggctcctgggtggacatcgtcctcgagcacgggagctgcgtgacaacgatggccaaaaacaaacccaccctggacttcgagctgatcaagaccgaggccaagcagcccgctaccctccgcaagtactgtatagaggcaaagctgacgaacaccacaaccgaatcccgatgcccaactcagggagaacccagcctgaatgaagaacaggacaagcggtttatttgcaagcactccatggtggaccgcggatgggggaacggctgcgggctgtttggcaagggcgggatcgtgacgtgcgccatgttcacctgcaagaagaatatggaaggcaaggtggttcagcctgagaatctggagtacaccatagtgataactccccattcgggggaggagcatgccgtgggcaacgacacggggaagcatggaaaggagatcaaaatcaccccgcagtccagcatcaccgaggccgagcttaccgggtacggcacggtcaccatggagtgctcaccacggaccggcctcgactttaacgaaatggtcctgttgcagatggaggacaaggcgtggctcgtgcacagacagtggttcctggacctccctcttccctggcttccgggggccgacacccaaggctccaactggatccagaaggaaaccctcgtaacctttaagaatccgcacgcaaagaagcaggacgtggtggtcctggggtcacaggagggggccatgcacaccgccctgaccggggccacggagatccagatgagcagcggcaacttactgttcaccggccacctgaagtgtcgactgcgcatggacaagctccagctgaagggaatgtcgtacagcatgtgtaccggtaaattcaagatcgtgaaggagattgctgagacccagcacgggacgatcgttatccgggtccagtacgagggcgacggctctccgtgcaaaatccccttcgagattaccgacctagagaagcgccacgtgctcgggcggctgatcacggtgaacccgatcgttaccgagaaggatagcccagtgaatatcgaggcggagccgcccttcggcgactcctatatcatcatcggggtggagcccggccagctgaagctcaactggttcaaaaaggggagctccatcggccagatgttcgaaacgaccatgcgcggcgcaaagcgcatggccatcctgggcgatacagcctgggatttcggcagcctcggcggggtcttcacctccatcggtaaggccctccatcaggtatttggagcgatttatggcgcggcctttagcggggtgtcctggacgatgaagatcctgatcggcgtaatcatcacctggattgggatgaacagccggtcgaccagtctgtcggtgagcttggtactggtcggagtcgtgacgctatacctgggggcaatggtccaggccgacagcggctgcgtagttagctggaagaacaaggaactaaagtgcggcagcgggatctttatcacggacaacgtccacacctggaccgagcagtacaagttccagccagagagcccgtcgaagctggcttccgccatccaaaaggcccacgaggaggggatctgtgggattcgaagtgtgaccagattggagaacttgatgtggaagcaaatcacgccagagctgaaccacatcctgagcgagaacgaggtcaagctgaccatcatgacgggtgacattaaggggatcatgcaggcggggaagcgaagtctgaggccgcaacccaccgagcttaagtactcctggaagacgtggggcaaggcaaagatgctctcaactgagtcacacaaccagaccttcctgatcgacgggcccgagaccgcagaatgcccgaacacgaaccgggcctggaactcactggaagtcgaggactacggcttcggagttttcaccaccaacatctggctcaagctgagagagaagcaagacgtgttctgcgattccaagctgatgagcgccgccatcaaggataaccgcgccgtccacgccgatatgggatactggatagagtccgccctcaacgacacctggaaaatggagaaggccagctttatcgaggtgaaaagctgccattggcccaagagccacaccctgtggtccaatggagtgctggagagcgagatgatcatccccaagcacttcgctgggccagtatcccagcacaactaccggcccggctaccatacgcagacagcggggccctggcacctcggcaaactggagatggacttcgacctctgcgaagggacgactgtggtggtcacggaggattgcggcaaccgcggccccagcttgcggaccactaccgcctcagggaagctaatcacggaatggtgctgccgctcctgtaccctgcccccgttacggtaccgcggagaagacgggtgttggtacggcatggaaatccggcccttaaaggagaaggaggagaacttagtgaacagcctagtgactgccgggcacggccaaatcgataacttctccctgggcgtcctcgggatggccctcttcctggaagagatgctgcgcactcgtatcggcacgaagcatgcgatcctccttgtggccgccagcttcgtgaccctgatcacggggaacatgtcgttccgagacttgggacgggtcatggtaatggtgggggccaccatgacggacgacatcggcatgggcgtgacctacctggccctgctcgcggccttcaaggtgcgtcccacattcgccgcaggcctgctgctccgtaagctgacaagcaaggagctgatgatggccacgatcggcatcgcgcttcttagccagagcaccattcccgagaccatattggagctcactgacgccttggccctggggatgatggtactaaaaatcgtccggaacatggaaaagtaccagctggccgtgacgattatggccatcagctgcgtgccgaacgcggtcatacttcagaacgcctggaaggtgtcttgcacgatcctcgcggccgtgtccgtcagccccctgcttctcaccagcagccaacagaaggcggactggatccctctagccctgaccatcaagggcctcaaccccacggccatcttcctgacgaccctgtcacgcactagcaagaaacggtcctggcctctcaacgaggccattatggcggtgggcatggtcagcatcttggcgtccagcctgctcaagaatgacatccccatgacgggtcccctggtggccggcggtttgctcacagtgtgctacgtgctgaccggccgcagcgcggacctggagttggagagagccgcggacgtgaagtgggaggatcaggcagagatctccgggagctccccaatcctgagcatcacaatttcggaggacgggtctatgtccatcaaaaacgaggaggaggaacaaacgctgacaatcctcatccgcacaggcctgctggtgatcagcggggtcttccccgtgagtatccccataaccgccgccgcttggtacctatgggaagtcaaaaagcaacgggccggagtgctctgggacgtgccgtcgccgccgccggttgagaaagctgagctggaggacggagcctatcgcatcaagcaacggggcatcctcggatactcccagatcggcgcaggagtgtacaaggaggggacctttcacacgatgtggcatgtaacgcgcggagccgtactcatgcaccgggggaagagaatcgaacccagctgggctgacgtcaagaaggacctcatctcctacggcgggggctggaagcttgagggcgaatggaaggagggggaggaggtccaggttttggccctggaacccggcaagaacccccgggcagtccagacaaagcctggcatttttaagaccaacaccggcacaataggggccgtgagcctcgacttcagccccggcacctctggctcccccatcgtggaccgcaaggggaaggtcgtaggactgtacgggaacggcgtggtcacccggtccggcgcctacgtctccgcgatagcacagacggaaaagtccatagaggacaaccccgagatcgaggacgacattttccgcaagaaacggttaaccatcatggacctgcaccccggggccggcaaaaccaagcgctacctgcccgcgatcgtgcgggaagccattaagcgtgggctgcggaccctgatcttagcgccgacgcgcgtcgtggccgcagagatggaggaggctcttcgcggtctgccgatccggtaccagactcccgccatcaagacggagcacacagggcgcgagatagtcgacctcatgtgccacgcgacgttcacgatgcggctgctgagccccgtccgggtgcctaattataacctcataatcatggacgaagcccacttcaccgatcccgcttccatcgcagcccgcggctacatctccacccgcgttgaaatgggcgaggcggccgggatctttatgacagcaacaccccccgggtcccgcgacccgttcccccagagcaacgcacctatcatggacgaagagcgcgagatccccgagcggagctggaacagtgggcatgaatgggtcaccgacttcaagggaaagaccgtgtggttcgtgccttccatcaaggctggcaacgacatcgcggcatgcctgagaaagaatggaaagaaagtcatccagctgtctcggaagacgttcgattccgaatacgtgaagactcgcgccaacgactgggactttgttgtcaccaccgacatctcagagatgggcgctaacttcaaggccgagagggtgatcgacccccgccggtgcatgaagcccgtgatcctcacggacggggaggaacgcgtcatcctggccggccccatgccggtgacccactccagcgctgcccagcggcgcgggcgaataggccgcaaccccaagaacgagaacgatcagtatatctacatgggggagccgcttgagaacgacgaggattgcgcccactggaaggaggcgaagatgctcctggacaacatcaatacccccgagggcatcatcccgtccatgtttgagcccgagagagaaaaggtggacgccatagacggcgaataccgcctgcgcggggaggctcggaagaccttcgtcgacctcatgaggcgcggcgatctgcccgtgtggctggcctacaaggttgccgcggaggggatcaactacgccgaccgcaagtggtgcttcgacggcattaagaataaccagatccttgaagagaacatcgaagtagagatctggacgaaggagggcgagcggaagaagctgaagccgcgctggcttgacgcccgaatctacagcgaccccctcgccctgaaggagtttaaggagttcgcagccggcagaaagtccctgactttaaacctgatcaccgagatgggccggttgcccaccttcatgacgcaaaaggcacgcaatgccctcgataacctggccgtgctgcacaccgcggaggcagggggtcgggcttacaaccacgccctgagcgaactgcccgaaaccctggagaccttactgctgctcacactgctggccaccgtgacgggtgggatatttttgttcctcatgtcgggcaaggggatcggcaagatgacgctggggatgtgctgcataatcaccgcgtcgattttgctgtggtacgcacagattcagccccactggatcgccgcctccatcatccttgaattcttcctgatcgtgctgctgattcccgagccagagaagcagcgcacgccacaggacaaccaactcacctacgtggtcatcgccatcctgaccgtagttgcggccaccatggccaacgagatgggattcctggagaagacgaagaaagacctcgggctcggcagcatcaccacccaggagagcgagtccaatatcctggacatcgacctccgcccggccagcgcctggacgttatacgcggttgccacgaccttcgtgacacccatgctgcgccacagtatcgagaacagctcggtgaacgtcagcctcaccgccatcgctaaccaggcgacggttttgatgggcttgggcaagggttggcccctctccaagatggacatcggggttcccctgctggcaatcggttgctacagccaggtcaacccgatcacactcaccgccgccctgctgctcctggttgcccactacgcgatcatcggtccgggcctgcaagctaaggcgacccgggaggcccagaagcgcgccgcggccggcatcatgaagaaccccacagtggacggaatcacggtaatcgacctcgaacccatcccgtacgacccaaagttcgagaagcagctgggccaagtgatgctgctcatcctatgcgtgacccaggtgctgatgatgcggaccacgtgggcgctctgcgaggcgctgaccctggcgacagggccgatctctacactctgggagggaaatcccgggcgtttctggaacacgacaattgccgtgagcatggccaacatcttccggggctcctacctggccggagccgggctgctgtttagcataatgaagaacaccacaaacacacgccgcgggaccggtaacatcggcgagaccctgggagagaagtggaagtcccggctgaacgcgctgggcaagagcgagttccaggtgtacaagaaatccggtatacaagaggtcgaccgaactctggctaaggaggggatcaagaggggagaaactgaccaccacgcggtgagccgcgggtccgccaagctgagatggttcgtggagcgcaatatggtcaccccggagggaaaggtggtggatctcggttgcggccggggcggttggagctactactgcggtgggctgaagaatgttcgtgaggtgaaggggcttaccaaaggcggacccggtcacgaggagccgatccccatgtccacttacgggtggaatttagtacggctgcaaagcggcgtcgatgtgttcttcacgccgcccgagaagtgcgacaccttgctttgcgatataggcgagtcctcccccaaccccaccatcgaggccggccgcaccctgcgtgtactgaatctcgtggagaactggttaaacaacaacacgcaattttgtatcaaggtgctaaacccgtacatgcccagcgtgattgaaaagatggaggccctccagcgaaagtacgggggggcactggtccggaacccgttatcgcgcaacagcacgcatgagatgtactgggtgtccaacgccaccggcaacatcgtcagctccgtcaacatgatcagcagaatgctgatcaatcgcttcaccatgaagcacaagaaggccacgtatgagccggacgtagacctcgggtccggcacgcgaaacattgggatcgagagcgagatccccaacctggacatcattggaaagagaatcgaaaaaatcaagcaggaacacgagaccagttggcattacgaccaggaccacccctacaagacatgggcctaccacggcagctacgaaacgaaacagaccgggtccgctagctccatggtgaacggcgtcgtgcggttgttgaccaagccctgggacgtggtcccgatggttacccagatggccatgacggacactacccccttcgggcagcaacgcgtattcaaagaaaaggtcgatacccggacccaggaacccaaggagggcaccaaaaagttgatgaagattaccgccgagtggttatggaaggagctcggcaagaagaagacgccccggatgtgcacacgcgaggagtttacgcggaaagtgcgttcgaacgcggcactgggtgcaatcttcaccgatgaaaacaagtggaagtccgccagagaggcggtggaggatggccggttttgggagctcgttgaccgggagcgcaacctccacttggagggaaagtgcgagacctgcgtctacaacatgatgggcaaacgggagaaaaagctgggggaattcggaaaggccaagggcagccgcgcgatttggtacatgtggctcggggcccggttcttagagttcgaggctcttggcttcctcaacgaggaccactggttctcccgcgggaacagcttaagcggcgtcgagggggaggggctgcacagactgggctacatcttacgcgatgtcgggaaaaaagagggcggagcgatgtatgcagacgacaccgcgggatgggacacgcggatcaccctggaggacctcaagaacgaagagatggttacgaaccacatgaaaggggagcacaagaagctggcagaagcgattttcaagctgacctaccagaacaaggtcgtgcgagtgcaacgccctacgcccagaggcaccgtcatggacattatcagtaggcgcgaccaacgtggcagcggccaggtaggcacatatgggctcaacacgttcacgaacatggaggctcagctgatccgccagatggagggcgagggcatctttaagtccatccagcacctgacagccaccgaggagatcgcagtgcagaactggctcgcccgggtcgggcgggagcgcctgtcgaggatggctatctccggcgacgattgcgtcgtcaagcccatcgacgaccgtttcgctagcgccttaacagcactcaacgacatgggcaaggtccgtaaggacatccagcagtgggagccttccagaggctggaacgactggacccaagtgccgttctgcagccaccactttcatgagttagtgatgaaggacgggagagtgctggtggtgccctgccgaaaccaggacgaactaatcggtcgggcccgcatttcccagggtgcagggtggagcctgaaagagaccgcctgcctgggtaagtcctatgcccaaatgtggactttaatgtatttccaccgtcgcgatctgcgcctggcggccaatgccatctgctctgccgtgccgccccattgggtcccgacgtcccgcaccacgtggagcatccacgcgaagcacgagtggatgaccaccgaggacatgctcgccgtgtggaaccgggtctggatccaggaaaacccctggatggaggacaagacccccgtagagtcttgggaggaagtaccctacttggggaagcgcgaggaccagtggtgtgggagccttatcgggctgacgtcaagggctacctgggccaagaatatccagacggccatcaaccaggtcagaagcttgatcggcaacgaggagtacaccgactacatgccgagtatgaagcggttccgccgggaagaggaggaggcgggcgtgttatggtga

SEQ ID NO: 24993 - RNA, 9876 nt, synthetic construct
  misc_feature 1..9876: note = derived and/or modified CDS sequence (opt11) from DENV-2__FJ898439__SS-prME
  source 1..9876: mol_type = other RNA
acagccggggtgatcgtcatgctaatccccaccgccatggctttccacctcaccacccgaaatggggaaccccacatgattgtggggcggcaggaaaaggggaagtccctgctgttcaagaccgaagacggcgtgaacatgtgcaccctcatggccatcgacttaggcgaactgtgcgaggatactatcacctacaagtgccccttgctgcggcagaacgagcccgaggacatcgattgctggtgcaacagcaccagtacttgggtcacgtacgggacgtgctccaccaccggcgaacacaggcgcgagaagcgtagcgtggccctggtaccccatgtagggatgggcctcgagacccggacagagacctggatgagcagcgagggggcctggaagcacgtgcagcggatagagacctggatcctccggcatccaggattcactatcatggcggcgatactggcgtacaccatcgggaccactcatttccagcgggccttaatcttcatcctgctgactgcggtggcccccagcatgaccatgcgttgcatcggcatatcaaaccgggacttcgttgagggcgtgtccggtggaagctgggtggacatcgtacttgaacacggttcgtgcgtgacaaccatggccaagaacaagcctacgctggacttcgagttaataaagaccgaggcgaagcagcccgccaccctccgcaaatactgcatcgaggccaagttaaccaacacgaccaccgagagccggtgcccgacccagggcgagccgtccctgaatgaggagcaagacaagcgcttcatctgcaagcacagcatggtggaccggggctgggggaacggctgcggcctgttcggcaagggcgggatcgtcacatgcgcgatgttcacgtgtaagaaaaatatggagggcaaggtggtccagcccgagaacctggagtacaccatcgtcataacgccccactccggagaggagcatgccgtgggcaacgacacggggaagcacggcaaggagatcaagataacgccccagagctcgatcaccgaggccgagctgaccgggtacgggaccgtgacgatggagtgcagccctcgcaccggactcgacttcaacgagatggtcctcctgcagatggaggacaaggcctggctcgtacatcggcagtggttcctggacctgcccttgccgtggttaccgggggccgacacgcagggctccaactggatccaaaaggaaaccctggtgacgttcaaaaacccgcatgcgaagaaacaggatgtcgtggttctagggagccaggaaggtgccatgcacaccgccctaaccggggccaccgagatccagatgagctccggcaacttattatttacaggccacctgaagtgccgactgcggatggacaaattgcaactgaagggcatgagctactccatgtgcacaggcaagttcaaaatcgtgaaggaaatcgctgagacccagcacggaaccatcgtaatccgcgtccagtacgaaggcgacggcagcccatgcaagatccccttcgagattacggacctggagaagcggcacgtgctcgggaggctgatcaccgtgaatcctatcgtaaccggcaaggacagtcctgttaacatcgaggcggagccgcccttcggggacagctacatcatcatcggcgtcgaacccgggcagcttaagttaaactggttcaagaagggttcgagcatcggccagatgttcgaaaccacgatgagaggggccaagcggatggccatcctgggcgataccgcctgggatttcgggtccttaggtggggtcttcacgtcgatcggtaaggccctccaccaggtctttggcgctatatacggggccgccttctccggcgtgagctggacaatgaagatactcataggggtaatcattacgtggatcggcatgaactcccgcagcacctccctgagcgtgtccctggtactcgtcggggtggtgaccctgtacttaggagccatggtccaggcggacagcggctgcgtggtgtcgtggaaaaacaaggagcttaagtgcggttcgggtatcttcatcaccgacaacgtgcacacttggaccgagcagtacaagttccagccggagtccccctccaagctagccagcgccatccagaaggcccatgaggaggggatctgcggcatccgctccgttacccgcctggagaacctcatgtggaagcaaatcacccccgagctgaaccacatcctgagcgaaaatgaggtgaagctcacgatcatgacaggggacatcaagggcatcatgcaggccggcaagcgatcactgcgcccacagccgacggagctgaagtatagctggaagacctgggggaaagcgaagatgctatccacggagtcacacaaccagaccttcctgatcgatggccctgagactgcagagtgcccgaacaccaaccgtgcctggaactcgctagaggtcgaggactacgggttcggcgtcttcaccactaatatctggctcaagctgcgcgagaagcaggatgtgttctgcgactccaagctgatgtccgccgcaatcaaagacaaccgggcggtccacgccgacatgggctactggatcgagagcgccctcaatgacacctggaagatggagaaagcctccttcatcgaggtcaagagctgccactggcccaagtcccacaccctatggagtaacggggtgctggagtcggagatgatcatccccaagaacttcgccggccccgtatctcagcataattaccgtccggggtaccacacccagacggcgggcccctggcacctcggtaagctggagatggacttcgacctgtgcgaaggcaccaccgtggtggtcaccgaggactgcggtaaccggggtcccagcctccgcacgacaaccgcctccgggaagttaatcaccgagtggtgctgcaggagctgcacgctgccacccctgcgctacagaggggaagacggttgctggtacgggatggagatccgccctttgaaggagaaggaggagaacctggtgaactccctcgtaaccgccggacacggccaagtcgacaacttcagcctgggggtgctgggcatggccctcttcctggaggagatgctgcggacccgcatagggacgaagcacgcgatactactggtggccgcctctttcgtgacgctgatcaccggcaacatgagcttccgtgacctagggcgcgtaatggtaatggtcggcgccaccatgaccgatgacatcgggatgggggtaacgtacctggctctgctcgccgccttcaaggtgcgccccactttcgccgcaggtctgttgctacggaagctgacgtccaaggagctcatgatggccacgattgggatcgcgctcctcagccagtccacgatccctgagaccatcctggagttaaccgacgccctggcactgggcatgatggtcctcaagatcgtacgcaacatggagaagtatcaacttgccgttaccatcatggccatcagctgcgtcccgaacgcggtgatcctgcagaacgcctggaaggtatcctgcacgatcctcgccgccgtcagcgtgtcacccctcctgctcaccagctcccagcagaaggcggattggatccccctggctctgacgatcaaggggctcaatccaactgccatcttcttgaccaccctgtcccggacctcgaagaagagaagctggccgctcaatgaagccgtcatggccgtggggatggtgtccattctggcgtctagcctgctcaagaacgatatcccaatgacgggccccctggtcgcaggcggcctactcacggtgtgctacgtgctgaccgggcgatctgccgacttagagctcgaacgcgccgccgacgtcaagtgggaagaccaggcagaaataagcggctccagcccaatcctgtccatcacgattagcgaggacggctccatgagcatcaagaacgaggaggaggagcaaaccctgacgatactcatacgtactgggctgctggttatctccggcgtgttcccggtgagcatccccatcactgccgctgcatggtacctctgggaagtaaagaagcaaagggccggggtactgtgggacgtccccagcccgccgcccgtggagaaagcggagctggaggatggcgcatatcggatcaagcagcgagggatcctcggatactcccagatcggggccggagtttacaaggagggtaccttccacaccatgtggcacgtgacgcgcggcgcggtgctgatgcaccgcggcaagagaatagagccctcctgggcggacgtgaagaaggacttaatcagctatgggggcggctggaagctcgagggggagtggaaggagggcgaggaggtccaagtcctggccctggagcccggcaagaacccccgcgcggttcagaccaagcccggcatctttaagaccaacaccgggaccatcggcgcagtctccctcgacttcagccccggcacctccgggtcgcccatcgttgaccggaagggcaaagtggtcgggctctacggcaacggcgtggtgacccgctccggggcctacgtcagcgcgatcgcccagacggagaagagtatcgaggacaaccccgagatagaggacgacatcttccggaaaaagagactgactataatggaccttcaccccggtgctgggaagaccaagcggtacctgcccgccatagttcgcgaggccatcaagcggggcctgcggaccctgatcctcgcgccgacccgcgtggtcgccgccgagatggaggaagcactgcgggggctgcccatacgctaccagacgcccgcgatcaagactgagcacaccggccgggagatcgtggatctcatgtgccacgcgaccttcacgatgagactgctgtcccccgttcgggtcccaaattacaacttgatcatcatggacgaggcacattttaccgatccggccagcatcgccgccaggggctacatctccaccagggtggagatgggagaggcggccggcatcttcatgaccgcaacgccaccggggagtcgcgacccgtttccccagtccaacgcccccatcatggacgaggagcgggagatccccgagcgcagctggaacagcggccacgagtgggtgaccgacttcaaagggaagactgtctggtttgtgcctagcattaaggcgggtaacgacatcgcagcctgcctccggaaaaacgggaaaaaggtgatccagctgtcccgcaagaccttcgacagcgagtacgtgaagacgcgggccaatgactgggacttcgtggtgaccaccgacatctccgagatgggagcaaacttcaaggctgaacgggtcattgaccctaggcgctgcatgaaacccgtcatcctgacggacggcgaggagcgagtgatactggctgggcccatgccggtaacgcacagctccgccgcccagcgccggggccgcattgggcgcaaccccaagaacgagaacgaccagtacatctatatgggagaacccctggaaaacgacgaggactgcgcccactggaaggaggcgaagatgctcttagataacatcaacacccccgagggcatcattccgagcatgtttgagccggagcgggaaaaggtggacgccatcgacggggaatacagactgcggggcgaggcgcgcaagaccttcgtggacctcatgcgccgcggggacctgccggtctggctggcctacaaggtggccgcggaggggatcaactacgccgacaggaagtggtgtttcgacgggattaagaacaaccagatcctcgaggagaacatggaggtggagatctggaccaaggagggcgagcgcaagaagctgaaaccccggtggctggacgcccgcatatactccgaccccctcgccttgaaggagttcaaggagttcgcggcgggccgcaagtcgctgacgctcaatctgatcacggagatggggcgcctgcccaccttcatgacccagaaggcccgaaacgcgctcgacaacctggccgtcctgcacacggcggagacaggcgggaaggcgtacaaccacgccctctccgagttaccagagaccctggagacccttctactgctgaccctgctggccaccgtgaccggcggcatcttcttgttcctgatgagtgggaagggcatcgggaagatgaccctgggaatgtgctgcataataaccgcctccatcctcctttggtacgcgcagatccagccgcactggatcgccgcctcgattatcctcgagttcttcctcatcgtcctccttataccagagcccgaaaaacagaggacgccccaggacaatcagttgacgtacgtggtgatcgccatcctgaccgtagtggccgcgacaatggctaacgagatggggttcctagagaagacgaagaaggacctcggcttcggcagcatcaccacccaggaatccgagtctaacatcctggacatcgacctccggccggcatccgcctggaccctctacgccgtggccacaacgttcgtcacccccatgctgcgccactcgatcgagaactcctctgttaatgtgtccctgacagccatagccaaccaggccacggtactaatgggactgggcaaaggctggcccctgtcaaagatggatatcggcgtgcccctcctggcgatcgggtgttacagccaggtgaacccgatcaccctgactgcggccctcctgctgcttgtcgcccactacgccatcgtgggcccgggcctgcaggccaaagccacccgggaggcacaaaagcgcgcggccgcagggatcatgaagaacccgacggtagacggtatcaccgttatcgacttagagccaatcccgtatgaccccaagttcgagaagcagctcggacaggttatgttactgatcctctgcgtaacccaagtcctgatgatgcggaccacgtgggccctgtgcgaggccctcaccctggccaccggccccatcagcaccctgtgggaagggaacccaggccgcttctggaatactacaatcgccgtttctatggcaaacatctttcgggggagctacctcgccggagcaggcctactgttctccatcatgaagaacaccaccaacacgcgccgcggcaccggcaacatcggcgagactttgggggagaagtggaagtcccggctgaacgccttaggtaagtccgagttccagatctacaagaaaagtgggatacaggaggtggacaggaccttagcgaaggagggcattaagcgcggggagacggaccatcacgccgtttcccgcggctccgccaagctgcggtggttcgtggagcgcaacatggttaccccggagggcaaggtcgtggacctggggtgtggccgcggtgggtggtcctactactgcggcggcttgaagaacgtgagggaggtcaaggggctgaccaagggtggccccgggcatgaggagcccatccctatgagcacctacgggtggaacctagtgcggctccagagcggggtggacgttttcttcacgccgccggagaaatgcgacacgcttctgtgcgacatcggggagtccagccctaaccccaccatcgaggctggtcgtaccctccgggttctgaacctagtggagaactggctcaacaacaacacccagttctgcatcaaggtcctgaacccgtacatgccatccgtgatcgagaagatggagacgctgcagcggaaatacgggggcgcgttagtgcgaaaccccctgagccgcaactcaacccacgaaatgtactgggtcagcaacgcgaccgggaacatcgtgagtagcgtgaatatgatctcccggatgctgataaatcgatttaccatgaagcacaagaaggccacgtacgagccggacgtcgacctgggcagcgggacccggaacatcggcatcgagtcagagatcccaaacctcgacatcatcggcaagcggatagagaagatcaagcaggagcacgagacctcctggcactacgaccaggaccacccttacaagacctgggcctaccacgggtcctacgagacgaagcagaccggcagtgcctccagcatggtgaacggggtagttcggctgctgacaaagccctgggacgtggtgcccatggttactcagatggccatgacggacaccaccccgttcggccagcagcgcgtgttcaaagagaaggtggacacccgcacgcaagagcccaaggagggcaccaagaaactcatgaagattaccgcggagtggctatggaaggagctggggaagcggaagaccccgaggatgtgcacgcgggaggagttcacccgcaaggttcggtccaacgccgccttaggcgcaatctttaccgacgagaacaagtggaagtccgccagagaggcggtggaggacgggcggttctgggagctggtagaccgcgagcgaaacctgcacctcgagggcaagtgtgagacctgcgtctacaacatgatggggaagcgcgagaagaaacttggcgagttcggcaaggccaagggatcccgggccatttggtacatgtggctgggcgcccgctttctcgagttcgaggcgcttgggttcctgaacgaggaccattggttcagccggggcaacagcctgtccggggtggagggcgaggggctacaccgccttggatacatcctgcgggacgtaggcaagaaggagggcggggccatgtacgccgacgataccgccgggtgggacaccagaatcaccctggaggacctgaagaacgaggagatggtgacgaaccatatgaagggcgagcataagaagctcgcggaagcgatcttcaagctgacgtatcaaaacaaagtggtccgagtgcagcgcccgacgccccgggggaccgtgatggacattatcagccgccgagaccagcgcggatccggccaagtcggtacctacggcctgaacacgttcaccaatatggaggcccagctcatacgccaaatggagggcgaagggatcttcaagagcatccagcacctgaccgccaccgaagaggtagcagtgcagaactggttagcgcgggtcgggcgcgagcggctctcccgcatggcgatcagcggcgacgactgtgttgtgaagcccatcgacgaccgattcgctagtgccctgacagccctgaacgacatgggtaaagtccgcaaggacatccagcagtgggagcccagccgagggtggaacgactggacccaggtgcccttctgttcccaccacttccacgagctcgtgatgaaggacggccgcgtcctggtggtgccctgccggaatcaggacgagctgatcggccgcgcccgcatcagccagggggcagggtggtccctcaaggagaccgcctgcctgggcaagtcatacgcacagatgtggaccctgatgtacttccaccgccgggatctgcgcctggctgccaacgcgatatgctccgccgtccccagccattgggttcccacctcccggacgacatggagcatccacgccaagcacgagtggatgaccactgaggatatgttggccgtttggaaccgcgtctggatccaggagaacccgtggatggaggataagacgcctgttgagagctgggaggaggtcccctacctcggtaagagggaggaccaatggtgtgggagcctaatcggcctgacctcacgcgcaacctgggcaaagaacatccaaaccgccatcaaccaggtccggtccctcatcggcaacgaggaatacacggactacatgccctcgatgaagcgcttccgccgcgaggaggaggaggccggggtgctgtggtga

SEQ ID NO: 24994 - RNA, 9876 nt, synthetic construct
  misc_feature 1..9876: note = derived and/or modified CDS sequence (opt11) from DENV-2__GQ868588__SS-prME
  source 1..9876: mol_type = other RNA
acggcgggcatgatcatcatgctgatccccaccgttatggcctttcacctcacaacccggaacggcgaaccccatatgatcgtgtcgcggcaggaaaagggcaagtcactgcttttcaaaaccaaggatgggaccaacatgtgcaccctgatggcgctggacttgggggagctctgcgaggacaccattacttataagtgccccttcctgaagcagaacgaacccgaggacattgattgctggtgcaacagtacctccacgtgggtgacctatgggacctgcaccacgaccggcgagcaccgtcgggagaagcgctccgtggccctggttccccacgtgggcatgggcctggagacccggaccgagacgtggatgtccagcgagggtgcctggaaacacgcccaacgcatcgagacgtggatcctgcgacatcccgggttcaccattatggctgcgattcttgcatataccatcggcacgacacacttccaacgcgtgttaatcttcatcctcttgaccgctatcgccccttccatggccatgcggtgcatcgggatctccaaccgcgacttcgtcgagggggtgtcaggcgggtcatgggtagacatagtcctagagcacggctcctgcgtgaccaccatggccaagaacaagccaaccctcgacttcgagctgatcaagaccgaggcaaagcagcccgccaccctgcggaagtactgcattgaggccaagctgacgaacaccaccaccgacagtcgctgtccaacacagggggagcctaccctgaacgaggaacaggacaagcggttcgtatgcaagcactcgatggtcgaccgcggttggggcaacggatgtgggttattcgggaagggcggtatagtgacctgcgcgatgttcacgtgcaagaagaacatggagggcaagatcgttcagcctgagaacttggagtatacggtcgtaatcacgccccacagcggtgaggagcacgccgtggggaacgacacgggtaaacacggcaaggaggtcaagatcaccccgcagtccagcatcaccgaggccgaactgacgggctacggtacagtgactatggagtgcagcccccgtaccggcctcgacttcaatgagatggtgctgcttcagatggaggacaaggcctggctcgttcatcgccagtggttcctagacctgcccttgccctggctgccgggcgccgacacacaggggagcaactggatccagaaggagaccctggttacttttaagaacccccacgcaaagaagcaagatgtggtcgtgctcggcagccaggagggtgccatgcacactgccctcacaggcgccaccgagatccaaatgagcagcgggaacctactattcacaggccatctgaagtgccgactgcgcatggacaagctgcagcttaagggcatgtcatacagcatgtgcaccgggaaattcaagatcgtaaaggagatagccgagacgcagcacggcacgatcgtgattcgggttcagtacgagggagacggctccccctgcaaaatccctttcgagatcatggatctggagaagaggcacgtcctcggccggctgattaccgttaacccgatcgtcactgagaaggacagcccagtcaacatcgaagcggagccccccttcggggactcctacatcatcatcggtgtggaaccggggcagttaaagttggactggttccgcaagggcagctccatcgggcagatgttcgagacgaccatgcgcggcgccaagcggatggccatcctgggcgatacggcctgggacttcggaagcctgggtggggtgttcacctccatcggcaaggcgctccatcaggtatttggcgcgatttacggcgccgccttcagcggcgtctcctggaccatgaagatactgatcggggtgattatcacctggatcggcatgaactcgcgctcgacgagcctgtcagtctcgctggttctcgtggggatcgtcaccctgtacctgggcgtgatggtgcaggctgactccgggtgcgtcgtgtcgtggaagaacaaggagttaaagtgtgggtccggaattttcgtaacagacaacgtccacacctggacggagcagtacaagtttcagcccgagtcgcccagcaaactagcgtccgccatccagaaggctcacgaggaggggatctgcggcatacgcagcgttactcgcctcgagaacctcatgtggaagcagataacttccgagctcaaccacatcttatcggaaaacgaggtgaagctcaccattatgaccggggatattaaggggataatgcaagtcgggaagcgctcccttcgcccccagccgaccgagctgcggtatagctggaagacgtggggcaaagcgaaaatgctctccacggaacttcacaatcagacctttctgattgatgggcccgagaccgcggagtgcccgaacacaaaccgcgcgtggaactcgctcgaggtggaggattacggattcggcgtcttcaccaccaacatctggctgcgactgcgcgagaagcaggatgtcttttgcgactccaaattgatgagcgccgccatcaaggacaaccgggccgtacacgctgacatgggttactggatcgagagtgcgctgaacgatacctggaaaatcgagaaggccagcttcattgaggtgaagtcctgccactggcccaagagtcacaccctgtggtctaacggagtcctcgagtctgagatggtgattcccaagaacttcgccggcccggtgtcccaacataacaaccgtcccgggtatcacacacagactgccggcccgtggcacttggggaagctggagatggacttcgacttctgcgagggtaccactgtcgtggtaaccgaggagtgcggaaatcggggtcccagcctccgcaccaccaccgcctcaggcaaactgatcacggaatggtgctgccggtcctgcaccctgccgcccctgcgataccgaggggaggatggctgttggtacggcatggaaatccggccgctgaaagagaaggaggagaacctcgtcagctcgttagtgaccgcaggacacggccagatcgacaacttcagcctaggtatcctaggaatggccctattcttagaagaaatgctgcgaactcgcgtggggaccaaacacgcgatcctccttgtcgccgtgtccttcgtgaccctgatcaccggcaacatgagcttccgtgatctcgggcgggtaatggtgatggtgggggcaaccatgaccgacgacatcgggatgggcgtcacctacctggccctgctcgcagcgttcaaggtgcgccctaccttcgcggcgggccttttgctccggaaactgacgtccaaagagctgatgatgacgaccatcgggatcgttctcctttcccaatccagcattcccgagacaatccttgaactcaccgacgcccttgccctgggcatgatggtgctcaagatggtgcgaaacatggagaaatatcagctggcagtcacgattatggccatcctgtgtgttcccaatgcggtgatcctgcagaatgcctggaaggtttcgtgcacgatcctggccgtggtgagtgtttccccgctgctcctgaccagctcgcagcaaaaggcggactggatccccctggccctcaccatcaaggggctgaaccccacggcgatcttccttaccaccctctcgcggacctccaagaagcgcagctggccactgaatgaggcgatcatggccgttggcatggtgtccatcctggcgagcagtctcctgaagaacgatatacccatgacgggcccccttgtcgccgggggactcttaaccgtgtgctacgtgctgacagggcggtccgccgacctcgagctggagcgcgccacggacgtcaagtgggacgaccaggccgagatcagcggatccagccccatcctgtccatcaccatcagcgaggacgggtcaatgagcatcaagaacgaggaggaagagcagaccctcaccatcctgatcaggaccggcttactggtgatttccggcctgttccccgtcagcatcccgatcacagccgcggcctggtacctgtgggaggtcaagaagcagagggctggcgtgctgtgggatatccccagcccgccgcccgtgggtaaagccgagctcgaagacggggcctaccggattaagcagaaggggatactggggtacagccagatcggagccggcgtatacaaagaggggactttccacaccatgtggcacgtcacacgcggcgctgtgttaatgcacaaagggaagaggatcgagccctcctgggccgacgttaaaaaggacttaatcagctatggtgggggctggaaactggaaggtgagtggaaggagggggaggaggtccaggtgctcgctctagagcccggcaaaaatccgcgggccgtccagaccaaacccgggttgttccggacgaacaccggtaccatcggtgcggtgagtctagactttagccccggcacctccggttcacccatcgtcgacaagaaggggaaggtcgtgggcctgtacgggaacggcgttgtcacgcggagcggcgcctacgtgtcagccatcgcccaaaccgagaaatcaatcgaggacaacccggagatcgaagacgacattttccgtaagcgccggctgaccatcatggacttacaccccggagccggcaagaccaagaagtacctacccgccattgtgcgggaagccatcaagcgggggctgaggacgctgatacttgcccccacccgcgtcgttgcggctgaaatggaggaggcgctccggggcctgccaatccgctatcagactcccgctattcgggccgaacacacagggcgcgagatcgtggatttaatgtgtcacgctacgttcaccatgcggctgctgtcgccaatacgcgtcccgaactacaaccttattataatggatgaagcgcacttcaccgacccggctagcatcgccgcccggggctacatcagtacccgagtggagatgggcgaggccgcggggatcttcatgacggccacgcccccaggctctcgcgaccccttcccgcagagcaacgcccccatcatggacgaggagcgcgaaatccccgagcggtcttggaactccgggcacgagtgggtgaccgacttcaagggcaaaaccgtctggttcgttcctagcattaagacggggaacgacatcgccgcctgcctgcgcaagaacggcaagcgggtgatacagctgtcccgcaagacctttgacagcgagtacgtcaaaacgcgaaccaacgattgggacttcgttgtcacgaccgacatttccgagatgggcgctaacttcaaggcggagagggtcatagacccgcggcgatgcatgaagcccgtgatcttgaccgacggggaggaaagagtgatactggcgggccccatgcccgtcacccacagcagtgcggcacaacgacgcgggcggatcggccgcaacccgcggaacgagaacgaccagtacatttacatgggggagcccctggaaaatgacgaggattgcgctcactggaaagaggccaagatgctcctggacaacatcaatacgcccgagggtatcattccgagcatgttcgagcccgagcgagaaaaggtggacgcaatcgacggcgagtatcggctgcgcggggaagcccggaagaccttcgtggaccttatgcgccggggcgatctgcccgtctggctggcgtacaaggtggcctccgaggggatcaactacgccgaccgccggtggtgctttgacggcacccggaataaccagatcctcgaagagaacgtggaggtcgaaatctggactaaggaaggagagcggaaaaaactgaagccccgatggctggacgcccggatctacagcgacccgctcgcgctcaaggagttcaaggagttcgcagccggccgtaaatccctgacgctcaatctgatcacagagatgggccggttacccaccttcatgactcagaaggcccgcgacgccctcgacaacctggccgtgctacacacggcggaggccggtggcaaggcctacaaccacgctctcagcgaactgcccgagaccctggagaccctcctgctgctcaccctactggcgaccgtcaccgggggcatcttcctcttcctgatgtccgggagggggatcggaaagatgaccctggggatgtgctgcatcatcaccgccagcatcctgctgtggtacgcccagattcagccccactggatcgccgccagcataatcctggaattctttctcatcgtgctgctgattccagagcccgagaaacagcgaacgccccaggacaaccagctcacgtacgtgatcatcgcgatcctgaccgttgtggccgccaccatggctaatgaaatggggttcctggagaagaccaaaaaggacttgggcttgggccacatcgccacgcagcagcccgagtccaacatcctggacatcgacctccggccggcgtctgcctggaccctgtacgcagtggccaccaccttcataacgcccatgctgcgccactccatcgagaacagcagtgtcaatgtgtctttaaccgccatcgcaaaccaggccaccgtgctcatgggcctaggtaagggctggcccctctccaagatggacatcggcgtccccctgctggccatcgggtgctacagccaggttaacccgatcaccctcacggccgctcttctcctcctggtggcccactacgccatcatcgggcccggactgcaagccaaagccaccagagaagcgcagaagcgggccgccgccggcatcatgaaaaaccctaccgtcgatgggatcaccgtgatcgacctagaccctataccatatgacccgaaatttgagaagcagctgggccaggtgatgctgctcgtcctgtgcgtgacccaggttttaatgatgcgaacaacctgggccttgtgcgaggcgcttaccctagccacgggtcccgtctccaccctctgggaaggcaaccccgggcggttctggaacaccacgattgctgtgagcatggccaatatcttccgcggatcctacctggccggagcgggcctcctcttctcgatcatgaaaaacacgacctccacccggcggggaaccgggaacatcggcgagacactgggcgagaagtggaagtccaggctgaacgcactcggcaagagcgaattccagatctacaagaagtccgggatccaggaggtcgaccgcactctggccaaggagggtataaagcgcggcgagaccgaccaccacgccgtatcccgcgggagcgccaagcttcggtggtttgttgaaagaaatctcgtgaccccggagggtaaggtcgtggacctgggctgcgggcggggcgggtggtcctactactgtggtgggttgaaaaatgtgcgcgaagtcaagggcctcacgaaaggtgggcccggccatgaggagcccataccgatgagcacatatgggtggaacttagtgcggctacagagcggcgtggacgtcttctttgttccgcccgagaagtgcgacaccctcctgtgcgatatcggggagagcagccccaaccctacagtggaggcgggccgcaccttgcgggtcctcaacctggtggagaactggctcaataacaacacgcaattctgtgtgaaagttctgaacccgtacatgccatccgtgatcgagaggatggagaccctgcagcggaagtatggcggggccttggtccgcaacccactgagtcgcaacagtacgcatgagatgtactgggttagcaacgcctcgggcaacatcgtgagctccgtgaacatgatcagccgcatgctcatcaaccgcttcaccatgcggcacaaaaaggccacgtacgagccggacgttgacctggggtccggcacccgcaacatagggattgagtcggagacccccaacctggatatcatcgggaagaggatcgaaaagatcaaacaggagcacgaggcatcctggcactacgaccaggaccacccctacaagacctgggcttatcacggcagctacgagacgaagcagaccggatcggcaagcagcatggtgaacggcgtggttcgactcctaaccaaaccatgggacgtggtgcctatggtcacccaaatggccatgacggacaccacccccttcgggcagcagcgggtgttcaaagagaaggtggacacgcgtacgcaggagcccaaggaggggaccaaaaagctgatgaagatcacggctgaatggctatggaaagagctgggcaagaagaagacgccccggatgtgcacgcgcgaggagtttaccaagaaggtcagaagcaacgcggccctgggggccattttcaccgacgagaataagtggaaatccgcacgggaggccgtggaggacaatcggttctgggagcttgtagacaaggagcgcaacctccacctcgaggggaagtgcgaaacatgcatttacaacatgatggggaagcgggagaagaagcttggcgaattcgggaaggcgaaggggagccgcgcgatctggtacatgtggctgggtgctcgcttcctggagttcgaggcccttgggttcttaaacgaagaccactggtttagccgggagaactccctcagcggcgtggagggggagggcctccacaagctggggtacatactgcgggaggtgtctaagaaagagggcggtgccatgtacgctgatgacacggctggttgggacacccgcatcacgatcgaagacctcaagaatgaggagatgatcaccaaccacatggctggcgaacacaagaagctggccgaagcgatctttaagctgacgtaccaaaataaggtggtgcgggtgcagaggccgactccccgcgggaccgtcatggacatcattagccggcgcgaccagcggggatccggccaggtggggacttacggcctcaacaccttcaccaacatggaggcccagttgatccgccagatggagggggagggcatcttcaagagcatccagcacttaacggcctccgaggagatcgccgtgcaggactggctcgtcagagtcggtcgcgagcgcttaagtcgcatggcgatcagcggcgacgattgcgtggtgaagcctctggacgaccggtttgcgagagccctcaccgccttgaatgacatgggcaaggtgcggaaggatattcagcaatgggagcccagccgcggctggaacgattggacccaggtgccgttctgctcccaccacttccatgagctgatcatgaaagacggccggatactcgtagtgccctgcaggaaccaagacgagctgatcgggcgcgcccgcatctcccagggcgccgggtggtctctgagggagacagcgtgcctcggtaaatcatatgcccagatgtggtccctgatgtactttcaccgccgggacctgcgcctcgccgcgaacgctatctgcagcgctgtgccctcccactgggtgcccaccagccgcaccacttggtccatccatgcctcacacgagtggatgacgaccgaagacatgctgactgtgtggaaccgggtgtggatcctggagaacccgtggatggaagacaaaacccccgtcgagagctgggaggaaataccctacctcggcaagcgtgaagaccaatggtgcggttccctgatcggcctcacgagccgtgccacctgggccaagaacatccaaaccgccatcaaccaagtacgatcattaatcgggaacgaagagtacaccgattacatgcccagcatgaagcggttccgtcgcgaggaggaagaagcgggcgtgctgtggtga

SEQ ID NO: 24995 - RNA, 9876 nt, synthetic construct
  misc_feature 1..9876: note = derived and/or modified CDS sequence (opt11) from DENV-2__GQ868590__SS-prME
  source 1..9876: mol_type = other RNA
acagcgggcatgattatcatgcttatccccaccgtgatggccttccacctcaccacccgaaatggcgagccccacatgatcgtgagcagacaggagaagggcaagagcctactgttcaagaccaaggacggcaccaatatgtgcacccttatggcgatggatctgggcgagctttgcgaggacaccatcacctacaaatgcccattcctgaagcagaacgaacccgaagacatagactgctggtgcaacagcacctccacctgggtgacctacgggacctgcaccacgaccggtgagcaccggcgggagaagcgcagcgtagccctggtgccacacgtgggcatgggactggaaacccggaccgagacgtggatgtccagcgaaggcgcatggaagcacgcccagcggatcgagacctggatcttacggcacccggggttcaccatcatggccgcgatcctggcctacacaattggcaccacgcacttccaacgcgtgctgatattcattctcttaaccgccatcgccccatccatgaccatgcggtgcatcgggattagcaaccgcgatttcgtcgagggtgtatccggcgggagctgggtggacatcgtcctcgaacacggctcttgtgtgacgaccatggcgaagaacaagcccaccctcgacttcgaactcatcaaaaccgaggctaagcaaccagccaccctgcggaagtactgcatcgaggctaaactcaccaacaccacgacggacagccggtgccccacccaaggggagccgaccctgaacgaagaacaggacaagcggttcgtgtgcaagcactccatggtcgaccgcggttggggaaatggctgcggactcttcgggaaaggcggcatcgtgacctgtgctatgtttacgtgcaagaagaacatggagggcaagatcgtgcagcccgagaacctagagtacactgtagttatcacgccccactctggggaggagcacgcagtgggcaacgacaccggcaagcacgggaaggaagtcaagatcaccccccagtcctcgatcacggaagccgagctgaccggctacggaaccgtcaccatggaatgctccccccggacaggcctggacttcaacgagatggttctcctgcagatggaggataaagcctggctggtccaccgccaatggtttctcgacctgcccttaccctggctacccggtgctgacacccaggggagcaactggatccagaaggaaacgctagtgaccttcaagaatccccacgcaaagaagcaggacgtggtcgtacttggctcccaggagggtgcgatgcatactgccttaaccggcgccaccgaaatccagatgagctcggggaacctgttattcaccggccacctcaagtgtcggctgcgtatggacaagctgcagttaaagggtatgtcctatagcatgtgcacgggtaagttcaagatagtaaaggagatcgctgaaactcagcacggcaccatcgtcatccgagtgcagtacgagggggacggcagcccatgcaagatcccctttgagatcatggatctggaaaagagacacgtcctggggcggttaatcaccgtaaatcctatcgtgacggaaaaggacagcccagttaacatcgaggccgagccccccttcggggactcctacattatcatcggcgtggagccggggcagctaaagctggattggttcaagaagggcagttccatcgggcagatgttcgagaccacaatgcgcggggcgaagcgcatggccatcctcggcgacaccgcctgggacttcgggagtctgggcggcatgtttaccagcattggcaaagccttgcaccaggtcttcggggccatctacggcgcggccttcagcggagtcagttggaccatgaagatattgatcggggtcatcatcacctggataggaatgaacagccgttctaccagcctaagtgtgtcgctagtgctcgtcgggatcgtgactctctacctaggcgtcatggttcaagctgactccggatgcgtggtctcctggaagaacaaggagctgaagtgcggctccggcatcttcgtgaccgacaacgtgcacacctggaccgagcagtacaagttccagccagagagcccttccaaactcgcgtccgcgatacagaaggcccacgaggaggggatctgtggaatccgcagtgtcacccggctggaaaacctaatgtggaagcagatcacccccgagctcaaccacattctaagtgagaacgaggtcaagctgaccataatgaccggggatacgaagggaataatgcaggtcgggaagcgctcgcttcggccacagcccaccgagctacgctactcctggaagacctggggcaaggccaaaatgctacctaccgagctccacaatcagacgttcctgatcgacggccccgaaaccgccgagtgcccaaacacaaaccgggcctggaacagcttggaggtcgaggactatgggttcggcgtgttcaccacgaatatctggctccgcctgcgggaaaaacaagatgtcttctgcgactccaaactgatgagtgcagccattaaggataaccgcgctgtccacgctgacatggggtactggatagagtccgcgctaaacgacacgtggaagatcgaaaaggcgagctttatcgaggtgaaatcttgccactggcccaagagccacaccctgtggtccaacggcgttctagagtctgagatggtcataccaaagaacctcgccggtccggtgtcccagcacaacaaccggcccggttaccacacacagaccgccgggccctggcatctggggaaactggaaatggatttcaacttttgtgagggcacgaccgtggtagtgaccgaggagtgcggaaaccgcgggcccagcctccggactacgacggcaagcggcaagctgatcaccgaatggtgttgtcgcagctgcacccttccccccctccggtaccgcggggaggacggttgctggtacggaatggagatccggcccctgaaggagaaggaagagaacctggtgagctcgctcgtcacagccggtcacgggcagatagacaacttctctctcggcatcctgggcatggccctattcctggaggagatgctccgtacccgggtagggactaaacatgccatcctcctggtggctgtctcctttgtgaccctgataactggcaacatgagttttagagacctcggtcgcgtgatggtcatggtcggagccaccatgaccgatgacatcgggatgggcgtgacctatctggcgctactcgcggcttacaaagtccggcccacgttcgcggccggcctgttattacgcaagctgactagcaaggagctgatgatgaccaccatcgggatagtcctgctatcccaaagctcaattccggagacgatcctggagcttaccgacgctctggcactgggcatgatggttctcaagatggttcggaacatggagaagtaccagctcgctgtcacaatcatggctatactgtgcgtacctaacgccgtcatcctccaaaacgcatggaaggtgtcctgcaccattctggccgtcgtcagcgttagcccgctgttattaacgagctcgcagcagaaggccgactggatccccctagccctcaccatcaagggattaaacccgacggcgatcttcctgaccacattatctcgcacctccaagaaacgatcgtggcccctgaacgaggcgattatggccgtcggcatggtttccatcttagcgagctccctcctgaagaacgacattccaatgaccggccccctggtggcgggaggacttctgaccgtgtgctacgtgctgacgggtcgcagcgcggaccttgagctggagaaagccactgacgtaaagtgggacgaccaagccgagatcagcggcagctccccgatcctgtccatcaccatcagcgaggacgggtccatgagcataaaaaacgaggaggaggagcagaccttaaccattctgatcaggacgggtctgttagtcatctcaggcttatttcccgtgtctatacccatcaccgccgccgcatggtacctgtgggaggtaaagaagcagcgcgctggggtcctctgggacgtgccttcccctccgcccgtgggcaaggctgagctggaggacggggcctaccggatcaagcaaaagggcattctgggatattcacagattggagctggcgtctacaaggaggggacctttcacaccatgtggcatgtgacgcgcggcgcggtgttgatgcataaagggaagcggatcgagccgtcatgggctgacgtcaagaaggacttgatatcatacggtggtgggtggaagcttgaaggtgagtggaaagagggcgaggaggtacaggtgctcgccctggagcccggcaagaatcccagagccgtccagacgaagcctgggctgttccggaccaacaccggtacgatcggggctgtatccctcgactttagccctgggacctccggcagccccatcgtggacaagaagggtaaagtcgtgggtctgtacggcaacggggtggtcacacgctccggcgcatatgtgagcgctatcgctcaaaccgagaagagcatagaggacaaccccgagatcgaggatgatatttttagaaagcggcggctgacgatcatggacctgcaccctggagccggcaagacaaagaagtacctcccggccattgtgcgcgaagcgatcaaaagggggctgaggaccctgatactggcccctacccgggtagtggccgcggaaatggaggaggcgctgcgcggcctgccgatcaggtatcagacgcccgcgatccgggcagagcacactgggcgcgagatagttgacctcatgtgtcacgcaaccttcaccatgcgtctgctaagccccatccgggtgcccaactacaacttgatcataatggacgaggcccacttcacagatcccgcgagcatcgccgcgcggggttacatctccacccgtgtggagatgggcgaggcggccgggatcttcatgaccgcgaccccgcccgggagccgggaccccttcccccaatccaacgcccccatcatggatgaggagcgagagatccccgagcggtcctggaacagcggccacgagtgggttaccgacttcaagggcaagaccgtttggttcgttcccagcatcaaaacggggaacgatatcgccgcgtgtctgcgcaagaatggcaagcgggtcatccagctgtcccgcaaaacgttcgactccgaatacgtaaagacccgaaccaatgactgggacttcgtagtgacgacggacatctccgagatgggcgctaacttcaaggcggaacgcgtcatcgatccccgccgctgcatgaagcccgtgatcttaacagacggggaggaacgggtgatactagccggcccgatgcctgtcacccacagctccgctgcccagcgccgggggcgcatcggcaggaacccccgtaacgagaatgaccagtacatatacatgggggagcccctagaaaacgacgaagactgcgcccactggaaggaggccaagatgctattggataacattaacacccccgagggcatcatccccagcatgttcgggcccgagcgcgagaaggtggatgccatcgacggtgaataccggctgcgcggcgaagcccggaagaccttcgtggagttgatgcgccgcggggatctacccgtctggctcgcgtacaaggtggcgtccgagggcatcaactatgccgaccgcagatggtgcttcgacgggacccgcaacaatcagatcctcgaggagaacgtggaagttgagatctggactaaagagggcgagaggaagaaactgaagccacggtggcttgacgcccggatctacagtgaccccctcgccctaaaggaattcaaggagttcgccgcgggtaggaaatccctgaccctcaacctgatcacggagatggggcggctgccaacgttcatgacccagaaggcccgcgacgcccttgacaacttggccgtgctccataccgccgaggcaggcgggaaggcctacaaccacgcccttagcgaactgcccgagacacttgagaccctcctgctgctcacgctgctcgccaccgtcaccggcggcatcttccttttcctgatgagcggacggggcatcgggaagatgaccctgggcatgtgctgcatcattacggctagcatcctcctgtggtacgcccagatccagccacactggattgctgccagtataatactggaattctttctcatcgtgctcctaatcccggagcccgagaagcagcgcactcctcaggacaaccagctcacctatgtgatcatcgccatcctaaccgtggtggcggccacgatggccaacgagatggggttcttggagaagaccaagaaggacctaggcctgggccatatagccacacagcagcccgagagcaacatcctggacatcgacctcagaccggcgtcagcatggaccttgtatgcggttgccacgacgttcataactccaatgctgcgccactccattgagaatagctccgtcaatgtaagcctcactgctatcgcaaaccaagcaacggtgcttatggggttagggaagggatggccgctctccaaaatggacatcggcgtcccgttgttagccatcgggtgctacagccaggtaaacccgatcactctaacggcagccctgcttctcctggtggcgcattatgcgataatcggccccggcctgcaggccaaggctacccgtgaggcccaaaagcgcgctgcggcagggatcatgaagaacccgacggtcgatggcatcacggttatcgatctcgaccctatcccctacgaccccaaattcgagaagcagctgggccaggtaatgctgctcgtactgtgcgtgacccaggtactgatgatgcgtaccacctgggccttgtgtgaagcgctgaccctggccactggacctgtgagcaccttgtgggaggggaaccctggtcggttttggaacactactatcgccgtgagcatggccaatatcttccgaggctcctacttagcaggggccggtctccttttcagcatcatgaagaatactacctcaacgcggcgcggcaccggcaacattggcgaaacactgggtgaaaagtggaaaagtcgtttaaacgcgctcgggaagtccgagttccagatctacaagaagtcgggcatccaagaagtggaccgtaccctggctaaggagggcataaaacgcggcgagacagaccaccacgccgtttctcgcgggagcgccaagctccggtggttcgtggaacgtaatttggtaacccccgaaggaaaagttgtggacctggggtgcgggcggggagggtggtcctactactgcggcgggctaaagaatgtgcgcgaggtcaaggggctcactaagggcggccctgggcatgaggagccgatacccatgtccacctacggctggaacctagttcggctgcaatccggggtggacgtctttttcattccgccggagaagtgcgacaccttgctttgcgacatcggcgagtcgagtccgaatcccacggtcgaggccggccgcaccctgcgggtgctcaacctagtcgagagctggctgaataacaacacccagttctgcgtcaaggtccttaacccgtacatgccaagcgtcattgagcgcatggaaacactgcaacggaagtacggtggggcgctagtgcgcaaccccctatctcggaacagcactcacgagatgtattgggtgtccaacgctagcgggaacgtcgtgtccagcgtgaacatgatctcccgcatgctcatcaaccgctttaccatgcggcataaaaaggccacctacgagcccgacgtcgatctgggcagcggcacccgcaatataggcatcgagtccgagacgcccaatctggacatcattggaaaacggatcgaaaagataaagcaggagcacgaggccagttggcattacgaccaggaccatccctacaagacctgggcatatcacgggtcctacgagaccaaacagaccggaagcgcctcgagcatggtgaacggagtagttcgcctgctgaccaaaccctgggacgtcgtgcccatggtcacccagatggccatgaccgacaccacgcccttcgggcaacagcgggtgttcaaggagaaggtggacacgcgaactcaggaaccgaaagagggcaccaagaaattgatgaaaatcaccgccgagtggctctggaaggagctcgggaagaagaaaacgccccgcatgtgcacccgggaagagttcactaagaaggtccgatcaaacgccgcgctaggcgccattttcacggatgaaaacaaatggaagagtgctagggaagcagtggaagacaatcgcttctgggagctggttgacaaggagcggaacctgcatctggaagggaagtgcgagacctgcgtatacaatatgatgggcaaacgcgagaagaaactcggcgagttcggtaaggccaagggatcccgggcgatttggtacatgtggctgggtgctaggtttctggagttcgaagctctcggcttcctgaacgaggaccattggttcagccgcgagaacagcctgagtggggtggagggggaggggctacacaagctgggctacatcctgcgggaggtaagtaagaaggaaggcggagccatgtacgccgacgacaccgcgggctgggacacacgcatcaccatagaggatctcaagaatgaagaaatgattacgaaccacatggctggggaacacaagaagctggctgaagccattttcaagctgacctatcagaacaaggtcgtgagggtccagcgccccacacccatcggcaccgttatggacatcatttccagacgcgaccaacgaggaagcggtcaggttggcacctacggtctcaacacctttacgaacatggaagctcagctgatacggcagatggagggcgaggggatctttaagtccatccagcacctgacggccagtgaggagatcgctgtccaggactggctcgtgcgcgtgggccgggaacgcctctcccggatggccatttcgggggacgattgtgtagtgaaaccgctggacgaccgcttcgcgcgggcgctaacagctctaaacgacatgggtaaagtgcgcaaggacatccagcaatgggaaccatcccgagggtggaacgactggacacaggtacccttctgtagccaccattttcatgagctgatcatgaaggacggtcggacgttggtggtcccctgccggaatcaggacgagcttatcggccgcgcccggatcagtcagggggcagggtggagcctaagggagaccgcatgcctcggcaaatcctacgcgcagatgtggtcgctgatgtacttccaccggcgcgacctgcggttggccgccaacgctatctgttccgcagtcccaagccactgggtgcctacgtctcgcacaacatggagcatccatgcgagccacgagtggatgaccacagaggacatgttgactgtgtggaacagagtctggatcctggagaacccctggatggaggacaagacccccgtcgagtcctgggaggagatcccgtatctcgggaagcgcgaggaccagtggtgcggttctctgatagggctaacctcccgagccacgtgggcaaagaacatccagaccgccataaaccaggtccgctctcttataggcaacgaggaatacactgactacatgccctccatgaagcgctttcggcgcgaagaggaggaggcgggggtcctgtggtaa

SEQ ID NO: 24996 - RNA, 9876 nt, synthetic construct
  misc_feature 1..9876: note = derived and/or modified CDS sequence (opt11) from DENV-2__GQ868497__SS-prME
  source 1..9876: mol_type = other RNA
actgcaagcgttattgtcatgctgatacctactgtgatggccttccacctcacaactcgcaacggcgaaccccacatgatcgtaggccggcaagaaaagggaaagtccctgttgttcaagacagaagacggtgtcaacatgtgcacccttatggcgatcgacctcggagagctgtgcgaagacacgatcacctacaagtgtcccctcctgcgccagaatgagcccgaggatatagactgctggtgcaacagcacctctacatgggtcacatacgggacctgtagcaccaccggggagcaccggcgggagaagaggtccgtcgccctggtgccccacgttggcatggggctcgagacacgcacggagacatggatgagctctgagggcgcttggaaacacgtgcagcggattgagacctggatcctgcgccacccagggttcacgatcatggctgcaatccttgcctataccataggcaccacccacttccagcgcgccctcattttcattctgctgacggccgtcgctccctccatgaccatgcgctgtatagggatatcaaaccgggatttcgtggagggagtgtccggcgggagttgggtcgacatcgtgctcgagcatggcagctgcgtgaccacgatggccaagaacaaacccactctggacttcgagctgatcaagacagaggctaagcagcccgccactcttaggaagtactgcattgaggccaaactgacgaacacgaccaccgagtcccgatgcccgacccagggtgagcccagcctgaacgaagagcaagacaagcgctttatctgtaagcattctatggttgaccggggctgggggaacggctgcggtttattcgggaaaggcggaatcgtgacctgcgccatgtttacgtgcaagaagaacatggaggggaaggtgatgcagccggaaaacctggaatacacaatcgtgataactccccacagcggggaggagcacgctgtggggaacgatacaggaaaacacggaaaggagataaagatcacgccacagtcctcaattacagaagcagaactgaccggctacgggacggtaactatggagtgtagcccccggaccgggctagacttcaatgaaatggtgctgttacagatggaggataaggcctggctcgtacatcggcagtggttcctggacctccccctaccatggttgccgggcgctgacacccaggggagtaactggattcagaaggagaccctggtgacgttcaaaaatccccatgcgaagaaacaggacgtcgtggttttaggcagccaggagggggcgatgcacacggcgctgacgggagccacggagatccagatgtcctcagggaacctgctgttcacgggccacctgaaatgccgacttcggatggataagctccaactgaagggaatgtcctacagtatgtgtacaggtaaattcaagatcgtgaaggagatcgctgaaacccaacacggcaccatcgtgattagagtccagtacgaaggcgacggttccccctgcaagatcccgttcgagatcacggatcttgaaaaacggcacgtcctgggccgcttaatcaccgtaaacccaatcgtgactgagaaggacagcccggttaacatagaggcagagccgcccttcggagattcatacatcatcattggggtggagccagggcagctaaagcttaactggtttaagaagggctcttccatcgggcagatgtttgagaccacgatgcgaggcgcgaaacggatggcgatccttggagacaccgcttgggactttggatccctaggcggcgtctttaccagtatcggcaaagccctccaccaggtgttcggggccatctacggcgcggcctttagcggcgtgtcctggacaatgaagatcctgattggtgtaattatcacgtggatcggcatgaactcccggtctacctcactgtccgtgtcgctggtgttagtcggggtcgtgaccctgtacctcggcgctatggtacaggcggactccgggtgtgtagtaagctggaaaaacaaagaattgaaatgcggcagcggcatcttcatcacggataacgtccatacgtggactgagcagtacaagtttcagcccgagtccccgagcaagctggcgagtgccatacagaaggcccacgaagaggggatttgcggaatacggtcagtgacccgcctggagaacttgatgtggaaacaaattacccccgagcttaaccacatcctgtccgaaaacgaggtaaagctaacaatcatgacgggggacattaaggggatcatgcaagctggcaagcggagcctgaggcctcagcccacagaattgaagtatagttggaagacatggggaaaggctaagatgctaagcaccgagtcgcacaaccagaccttccttatcgacggtcccgaaacggcggaatgccccaacacgaaccgggcatggaacagcctggaggtcgaggactacggtttcggcgtgttcactacaaacatttggttgaaattaagggagaagcaggacgtattctgcgactccaagctcatgtcagccgccatcaaagacaaccgggccgttcacgctgacatggggtattggattgagtccgccttaaacgacacctggaagatggagaaagcaagcttcatcgaggtgaagagttgccactggcccaaaagtcataccctgtggagtaatggcgtgctggagtcagagatgatcatcccaaagaacttcgcagggcccgtctctcaacacaattaccgaccaggctaccatacccagactgcgggcccctggcacctcggcaaacttgagatggacttcgacttctgcgagggcactaccgtggtagtcacagaggactgcgggaaccgagggccgtctctgaggacgactactgcgtctggtaaactgataacagagtggtgctgccggtcctgcacgctgccacccctgcgataccgtggggaggacgggtgctggtacggaatggagattaggccgctcaaggagaaggaggagaacctcgtgaattccctagtgaccgcgggacacgggcagatcgacaattttagccttggcgtcttaggcatggccctgttccttgaggagatgttgcggacccgcatcgggactaagcatgcgatcctgcttgtagcggcctctttcgttacgcttatcaccggcaacatgtcgttccgggacctggggcgtgtcatggtgatggtgggcgccactatgaccgatgatataggaatgggagtcacgtacctcgcactgctggcggcgttcaaggttagacccacatttgccgccggactcctgctacgtaagctcaccagcaaagagctcatgatggccaccatcggaatcgcactgctcagtcagtctacgatcccggagacgatactggagctaacagacgcgctagccttagggatgatggttcttaaaatcgttcgtaacatggagaaataccaattagcagtaacgatcatggctatctcatgcgtccccaacgcagtgatcctccaaaacgcgtggaaagtgagctgtacaatcctggctgcagtatccgtcagcccactcttgctaacctcgagccagcagaaggcagactggatccccctcgcgctgactataaagggcctgaaccccaccgccattttcctcacaaccctatcacggacgtctaagaagcgctcttggccgctgaacgaagccgtgatggccgtcggcatggtgtccatcctagccagctctcttctcaagaacgatatccccatgaccggcccccttgtggcgggcgggttgctgacagtctgttacgtcctaacagggcgtagtgccgacctcgaactagagcgcgccgccgacgtgaaatgggaggatcaggcagagatcagcgggagcagtccgatcctgtcgatcaccataagtgaggacgggtcaatgtccgtgaaaaacgaggaagaggagcaaacactcacgatcctgatccggacgggcctcctagtgatctctggcgtgttcccggtctccatccctatcaccgctgcggcctggtatctgtgggaagtgaaaaagcagcgcgcgggggttctttgggacgtcccgtcccctccgccagtcgaaaaggcagagcttgaagacggcgcataccgaatcaagcagcgtgggatcctgggctacagtcagatcggagcgggcgtgtataaggagggcacgttccacacgatgtggcacgtcacccggggcgcagtgcttatgcaccggggtaagcggatcgagccaagttgggccgacgtgaagaaggacctgatatcatatgggggcgggtggaaactggagggcgagtggaaggagggcgaagaggtacaagtgctagccttggagccagggaagaacccccgagctgtgcagaccaagcccggtattttcaagactaataccgggactataggagccgttagcctcgatttctcccccggcacctccggctccccgattgtagatcggaaaggaaaggtggtcgggctttatggtaacggtgtggtcacccgcagcggcgcgtatgtctcggccatcgcgcagacagaaaagtccatcgaagacaacccagagatcgaggatgacatcttcaggaaaaagagacttacaataatggacctgcatcccggggccggtaaaaccaagaggtatctcccggccatcgtgcgcgaggccatcaagagaggcctgcgtaccctgatactggccccgacccgggtcgtcgctgcggagatggaggaggccctccgagggctgcccatccgctaccagacacccgctattaagacagaacataccggccgggagatcgtggacttaatgtgccatgccacgtttacgatgcgcctcctgagccccgtccgggtaccgaactacaacctgataataatggacgaggcgcacttcactgaccccgcctccatagccgcgcgcgggtatatcagcacccgggtggaaatgggcgaggccgccggtatattcatgaccgccacgccgcccggttcccgcgacccgttcccccagagcaatgctccaatcatggacgaagagcgggagatccccgagagatcctggaacagcggtcacgagtgggtgaccgactttaagggtaagaccgtctggttcgtgccgagcatcaaggccggtaatgacatagctgcctgtctccgaaagaacggtaagaaggttatccaactgagcaggaagaccttcgattcagaatacgtcaaaacgagagccaacgactgggactttgtggtaaccaccgatatcagcgagatgggcgccaactttaaagccgagcgcgtcatcgacccccggaggtgtatgaaacccgtgatcttgactgacggcgaggagcgggtgatcctcgcagggccgatgccggtgacgcactccagcgccgcccagcggaggggccgaatcggacgtaaccccaaaaacgaaaacgatcaatacatttacatgggcgagcccttagagaacgacgaagattgcgcccactggaaggaagccaaaatgcttctcgacaacatcaacacccccgaggggatcattccgtccatgttcgagccagaacgggagaaggtcgatgcgattgatggcgaataccgcctgcggggcgaggcacgtaagacattcgtggacttgatgaggcgcggggatttgcctgtgtggttagcgtataaggttgccgcagagggaatcaattacgcggacaggaaatggtgctttgacgggataaagaataatcagatcctggaggagaacatggaggtggagatctggaccaaggagggtgagcgcaagaagctcaagccgcggtggttagacgcccgcatttattcggaccctttagcactcaaagagttcaaggagttcgcggcagggcggaagtccctgacgttaaacctcatcaccgagatgggccgcctgccgacattcatgactcaaaaggcccgcaacgccctggacaacctggcagtattacacacggccgaggccggcgggagggcctataaccacgccctgagcgagttacccgagaccctggaaactctgctcctgctaaccctactggccacggtaaccggtgggatcttcctgttcctgatgtccggcaagggaatcggcaagatgactctggggatgtgctgcatcatcacagcaagcattctactctggtatgcccagatccagccgcattggatcgcggcttctatcatcctggagttctttttgattgtcctccttattcccgaacctgaaaaacaacggacaccccaggacaaccagctgacttacgtggtcatcgctatcctcacagtagtggccgcaactatggccaatgaaatggggttcctggagaagactaaaaaggacttgggcctcgggtcaatcacgactcaggagagcgaatctaacatactcgacattgacctgcgcccagcctcggcctggaccctctacgccgtggcgaccacctttgtaactccaatgttgcggcactccatcgagaacagctcggtgaacgtgagcctgaccgccatagccaatcaggctactgtcctcatggggctgggaaaggggtggcccctgtccaaaatggatatcggcgtcccgctcttagccattgggtgctacagtcaggtgaaccccatcacgctgacagccgcccttctactgctcgtcgcacattacgccattatcggccctggattacaggcgaaggcaacccgagaggctcagaaaagagccgccgcaggcatcatgaaaaacccgaccgtggatgggataacggtcatcgacctggagcctatcccttacgaccctaagttcgagaagcaactcggccaagtgatgctgctgatattgtgtgtcacacaggtactgatgatgaggaccacatgggccctgtgcgaggccctcactctggctacgggccccatctccacgctctgggagggcaatcccggccggttctggaacaccacgatcgccgtcagcatggcgaatatcttccgcggctcttatctcgccggggctggcttactcttcagcatcatgaagaacaccaccaacacgcgtcgggggacgggcaacatcggggagaccctcggcgagaagtggaagtcccgcctgaacgcgctcggcaagtcagaattccagatctacaaaaagtccgggatccaagaagtagaccggaccctcgcgaaggagggtatcaaacggggggagactgatcatcacgcggtgagccgcggctccgccaaattacgctggttcgtcgagcggaacatggtaacgccagaagggaaagtggtcgatttggggtgcggcagaggcggatggagctactattgtgggggccttaaggacgtacgggaagtgaaggggctgacgaagggcggcccgggtcatgaggaacccataccgatgagcacctatggatggaatctggtccgcctccaatccgggattgatgtgttctttacccctcccgagaagtgtgacacgctgctgtgcgatataggcgaaagctcacccaatcctactatcgaagcaggaagaaccctcagggtgctgaacctggtcgagaactggctcaacaataatacacagttctgcattaaggtgctgaacccgtatatgcccagcgtgatcgagaagatggagaccttacagagaaagtacggaggcgcgctcgtacgtaatccgttatctcggaactcgacgcacgagatgtactgggtctcaaacgcgaccggtaacatagttagctctgtcaacatgataagccgcatgctcatcaaccggtttaccatgaaacacaagaaggccacctacgagccggacgtggacctaggctccggaactcgaaacatcgggatcgagtctgagatacctaatctggacatcatcgggaagcgaatcgagaagattaagcgcgagcatgagacctcctggcattatgatcaggaccacccgtataagacctgggcctaccacggctcttatgaaaccaagcaaacgggctccgcgagttcgatggtcaatggggtcgtgcgcctgctcactaagccctgggacgtggtcccaatggtgacccagatggcaatgaccgacacgaccccgttcggccagcaacgtgtgtttaaagagaaggtagacacccgcacccaggagcccaaagaggggacgaagaagctcatgaagataaccgcggaatggttgtggaaggagctcggcaagaagaaaacccctaggatgtgcacccgtgaggagttcacgcggaaggtgaggtctaacgccgccctcggggctatcttcaccgatgagaataagtggaagagcgcccgcgaggcggtggaagacgggcgcttctgggagctggtcgaccgggagagaaacctacacctcgagggcaagtgcgagacctgcgtgtacaacatgatgggcaagcgggagaaaaagctgggcgagttcgggaaagccaagggctctcgcgccatttggtacatgtggctgggcgcgcgcttcctagagttcgaagcgttaggattcctgaacgaggatcactggtttagtcgcggaaatagcctcagcggggtggagggcgagggattacacaggctgggctatattctccgcgacgtaggaaagaaggaggggggcgccatgtacgcggacgacacggctggctgggatacgcggatcaccctggaggatttgaaaaacgaggagatggtgacaaaccacatgaagggcgagcacaagaaattggccgaagccatatttaagctgacctaccaaaacaaggtggtacgcgttcagaggcctacgccacgcgggacagtgatggatataatcagccggcgcgatcagcggggctccggtcaggtgggcacatacggcctgaacactttcacgaacatggaagcccagctcatcaggcagatggagggggagggaatattcaaatcgatccagcatctgactgccactgaggaaatcgccgtgcagaattggttagccagggtcggcagagagcgcctcagccggatggcgatcagtggggacgactgcgtggtgaagcccatcgacgaccgcttcgcctctgctcttaccgctctcaacgacatgggtaaggtccgtaaggacatccagcaatgggagcccagccgcgggtggaatgactggacccaggtgcctttctgcagccatcatttccacgagctcgtgatgaaggacggtcgggtcctggtggtgccgtgccgtaaccaagacgaattgatcggacgggcccgcatatcccagggggcaggctggagcctaaaagagacggcttgcctggggaaatcctacgcccagatgtggactctcatgtactttcatcggagggacctccgtctcgctgccaacgcgatctgctcagcggtccctagtcactgggtgcccactagccggaccacatggtccatacatgccaagcacgagtggatgactacagaggacatgctggccgtgtggaaccgggtctggattcaggagaacccctggatggaggacaaaacccccgtcgaatcgtgggaggaggtaccctacctaggcaagcgcgaggatcagtggtgcggtagcctgatcggcctaacttcccgggcgacctgggccaaaaatatccagacggcgatcaaccaggtccggagcctcattgggaacgaggagtacacagactacatgcctagcatgaaacgcttcagaaaggaagaggaggaggcaggcgtgctgtggtga

SEQ ID NO: 24997 - RNA, 9876 nt, synthetic construct
  misc_feature 1..9876: note = derived and/or modified CDS sequence (opt11) from DENV-2__GU131959__SS-prME
  source 1..9876: mol_type = other RNA
accgcgggcgtgatcgtcatgctgatcccgaccgtgatggccttccatctcaccactcggaacggggaaccacacatgatcgtgggccggcaggagaagggcaaatcactgctgttcaagaccgaggacggcgtcaacatgtgcaccctcatggcgattgacctaggggagctgtgcgaggacaccatcacctacaaatgcccgctcctacgccagaacgagcccgaggacatcgactgctggtgcaacagcacgtccacctgggtgacctacgggacctgctccaccaccggcgaacaccggcgcgagaagcggagcgtggccctggtcccccacgtggggatgggcctcgaaaccagaaccgagacctggatgtccagcgagggcgcctggaagcacgtgcagagaatcgagacctggattctacgccatccgggcttcacgatcatggccgccatcctggcgtacacaatcgggaccacccactttcagcgggcgctcatattcatcctgctgacggctgtcgccccctccatgaccatgcggtgcatcggcatcagcaaccgggacttcgtggagggcgtgtccggcggctcgtgggtcgacatcgtcctcgagcacggatcctgcgtgaccaccatggcgaaaaacaaaccaacattggacttcgagctgatcaaaaccgaagccaaacagcccgccaccctccgcaaatattgcatcgaagccaagctgaccaacacgaccaccgagagccgttgcccgactcaaggcgagccgtccctgaacgaagagcaggacaagcgctttatctgcaagcatagcatggtcgaccgggggtggggcaacggctgtgggctgttcggcaagggagggatcgtgacgtgcgctatgtttacgtgcaagaagaatatggaaggtaaggtggtacagcccgagaacctggagtacacaatcgtgattacgccccactccggggaggagcacgctgtgggcaacgacacagggaagcacgggaaggagatcaagattaccccgcagagctctataaccgaagccgagctgaccgggtacgggaccgtcacgatggagtgttctccccgcaccggcctcgacttcaacgagatggtgctgctgcaaatggaggacaaggcctggctcgtgcatcggcagtggttcctggacctgcccctcccgtggctgccgggtgccgacacccagggttccaactggatccagaaggagactctggtcacgttcaagaatccccacgccaaaaagcaggacgtagtcgtgctcgggtcacaggagggcgctatgcacaccgccctgaccggggcaaccgagatccagatgagctctggcaacctcctgttcacgggccacctcaagtgccgcttacgaatggataagctccagctgaagggcatgtcgtactccatgtgcaccggaaagttcaagatcgtgaaggagatcgccgaaacacagcatgggaccatcgtcatccgcgtgcagtacgagggagacggcagcccttgtaagatccccttcgagattacggatctggaaaagcggcacgtgctcggtcggctgatcacagttaacccgatcgtcaccgaaaaggactcccccgtgaacatcgaggcggagccgcccttcggtgacagctacatcatcatcggcgtcgagccgggccaactgaagctcaactggttcaagaaggggtccagcatcggccagatgttcgagaccacaatgcggggcgcgaagcggatggccatcctgggggacaccgcctgggacttcggctctctcggtggggtgttcaccagcatcgggaaggccctccaccaagtgttcggggcgatatacggagccgccttctccggcgtcagctggaccatgaagatattaatcggcgtgatcatcacctggattggaatgaacacccgctccacctcactttccgtatctctggtactcgtgggcgtggttaccctgtacctgggggccatggtgcaagccgactccggatgcgtggtcagctggaagaacaaggagctcaagtgcggcagtgggatcttcattacggacaacgtgcacacctggaccgagcagtacaagttccagccggaaagccctagcaagcttgcgagtgccatacagaaagcccatgaggagggcatttgcgggatccggagcgtgacccggctcgaaaacctcatgtggaagcaaatcacgcctgaactgaatcacattctatccgagaacgaggtcaagctcaccatcatgacgggcgacataaaggggatcatgcaggccggcaagcggagcctgagaccgcagcccaccgagctcaagtattcctggaagacgtggggcaaggccaagatgcttagcaccgagtcccacaaccagaccttcctaatcgatgggcccgagaccgcggagtgccctaacacgaaccgggcctggaacagcctggaagtggaggactacggctttggggtgtttaccaccaacatctggctcaagctccgcgagaagcaggacgtcttttgcgactccaagctgatgagtgcggccatcaaggacaaccgggccgtgcatgcggacatgggatattggatcgagtccgccctcaacgagacctggaagatggagaaggccagcttcattgaagtgaagtcctgctactggcctaagtcgcacaccctgtggtccaacggcgtcctggagtccgaaatgatcatccccaagaacttcgccgggcctgtgtcccagcacaactatcgccctggctaccacacgcagaccgccgggccctggcacctaggaaagttggagatggacttcgacctgtgcgaggggaccaccgtggtcgtaacggaggactgtggtaacaggggccccagcctccgcaccaccactgcgagcgggaagctgatcacggagtggtgctgccgctcttgtaccctgcccccgttgcgctaccggggggaggatgggtgctggtacggcatggagattcgccccctgaaggaaaaggaggagaatctggtcaacagcctcgtcaccgccgggcacggccagatcgataacttctccctgggcgtgctggggatggctttattcctggaggagatgctgaggacccgcatcggcacgaagcacgccatcttgctggtggcagctagcttcgtcaccctgattaccggtaacatgtccttccgggacctcggcagagtgatggtgatggtcggggccaccatgacggatgacatcggcatgggcgtgacctacctagcattactcgccgcgttcaaagtgcgccccactttcgccgccgggctgctgctccgcaagctgacgagcaaggagttgatgatggcaacgatcggcatcgccttactgtcacagagcaccatccccgagaccatcctagagttgacggacgcgctggctctggggatgatggtcctcaagatcgtgaggaacatggagaagtaccagctggcggtgacgatcatggccatctcctgtgtcccgaacgcggtaatcctgcagaacgcgtggaaggttagctgtaccatcttggcagcagtctcagtgagccccctgttgctcacatcctcgcagcagaaggccgattggatacccttggctctgactatcaagggcctcaacccaacggccattttcctgaccaccctgtcccggaccagcaagaagcgctcctggcccctcaacgaggccgtcatggccgtgggcatggtgagcatcctggcctccagcctgctcaagaacgatatccccatgaccgggcccctggtcgcgggcgggctgctgaccgtgtgctatgtgcttaccggccggagcgccgatctggagctcgaacgcgcagctgatgtcaagtgggaggaccaggccgagatcagtgggagttcccccatcctaagtatcaccatctccgaggacggctctatgtccatcaagaacgaagaagaggagcagacgttaaccatcctcatccggaccggcttactggtgatctccggggtgtttcccgtctccatccccatcaccgcagccgcatggtatctctgggaggtgaagaagcagcgtgccggcgttctgtgggacgtcccaagcccgccgcccgtggagaaagccgagctggaggacggggcgtaccggatcaagcagcgtggcatactcggttactcccagatcggcgccggggtttataaggaggggacctttcacacaatgtggcacgtcacacggggcgccgttttaatgcatcgcgggaagcggatcgagcccagctgggccgacgtgaagaaggacctgatctcgtatggcgggggctggaagctcgaaggggagtggaaggagggggaggaggtccaggtgctagccctggagcccggcaagaacccgcgcgcggtgcaaaccaaaccaggtatctttaaaaccaacacgggaaccatcggggccgtcagtctcgacttctcccccggcaccagcggctcccccatcgtcgaccggaaggggaaagtggtaggcctgtatggaaacggcgtcgttacccgcagcggcgcttacgtatccgcaattgctcagacggagaaatccattgaggataaccccgaaattgaagacgacattttccgaaagaaacgtctcaccatcatggacctccaccccggggccggcaagaccaagcggtacctgccggccatcgtacgcgaggccatcaagcggggattgcgcaccctgatcttagcccccacgcgcgtggtcgcggccgagatggaggaggccttgcgaggcctccccatccgctaccagacccccgccatcaagaccgagcacaccgggagagagatcgttgacctcatgtgccacgccacgttcacaatgcggctgctgagccccgtgcgggttccgaactataacctcatcatcatggacgaagcgcacttcaccgaccccgcctctatcgcggcccgcggctacatcagtactcgggtggagatgggcgaggcagcggggatctttatgacagccacgccgcccggctcccgcgatccgttcccccagagcaacgcccccatcatggacgaggagagggagatccccgagcgctcatggaacagcggccacgagtgggtgaccgacttcaaggggaagacggtatggtttgtgccttccatcaaggccgggaacgacatcgcggcctgcctacggaagaacggcaagaaggtgatccagctgtcacgcaagacgttcgactccgagtacgtcaagacccgggccaacgactgggactttgtggtaaccaccgatatatcagagatgggcgccaacttcaaagccgagcgcgttatcgacccacggcggtgcatgaagcccgtgatcctcacggacggggaggaacgggtcatcctggctggccccatgccggtcacccactccagcgccgcccagcgccggggccgcatcggccgcaacccaaagaatgagaacgaccagtacatctacatgggggagcctctagaaaatgacgaagactgcgcccactggaaggaggctaagatgctcctggacaatatcaacacccccgaaggcattataccttctatgttcgagcccgaacgggagaaggtggatgcgattgatggtgagtacagactgcgcggggaggcccggaagacgttcgtggacttaatgcgccgaggcgacctccccgtctggctcgcatacaaggtggccgccgaggggatcaattatgcggaccggaagtggtgcttcgacggcatcaagaacaaccagatcctcgaggagaacatggaggtggagatctggacgaaggagggggagaggaagaaactgaagccccggtggcttgacgcccgcatctacagcgaccccctcgcccttaaggaattcaaggaattcgccgcgggacggaagtcattaaccctcaacttaatcaccgagatgggccgcctgccaaccttcatgacgcagaaggcacggaacgcccttgacaacctggcagtactgcacaccgcagaggccggcgggcgcgcgtacaaccacgccctcagcgagctgcccgagacccttgagacactcctgctgctcacgttactggccaccgtgaccggcggcatcttcctattcctgatgtccgggaaggggataggcaagatgaccctgggaatgtgctgtatcatcaccgccagcatcctcctgtggtatgcgcagatccagccgcactggatagccgcttccattatcctggagttcttcctcattgtcctgctgatccccgaacccgagaagcagcgaaccccccaggacaaccagttaacctacgtggtgatcgccattctgaccgtcgtagccgcgacaatggccaacgagatgggcttcctggagaagacgaagaaggatctcgggttaggctccattacaacccaagagtccgaatccaatatcttagacatagacctccgcccagccagcgcctggacgctgtacgccgtagcgacgaccttcgtcacccctatgctgcggcactccatcgagaatagctccgtgaacgtgagcctcaccgccatcgccaaccaggccacagtcctaatgggcctggggaagggctggcccctcagcaaaatggacatcggggtacccttgctggccattggttgttactcacaggtcaacccaatcaccctcacagcggccctgctgctcctggtcgctcactatgccatcatcggacccggcctgcaggcaaaggccaccagagaggcacagaagcgagcggccgcgggcatcatgaagaatcccacggtggacgggatcacggtcatcgacctcgagcccatcccgtatgaccccaagttcgagaagcagctgggccaggtcatgctgctcatcctgtgcgtgacccaggtcctgatgatgcgcacgacttgggccctctgcgaggccctgaccctggccaccgggcccatctcgaccctctgggaaggcaatcccgggcggttctggaacacgaccatcgccgtcagcatggcgaacatcttccgcggttcgtacttggctggcgccgggctactgttcagcatcatgaagaataccacaaacacgcgccggggcaccgggaatatcggcgagaccttaggtgagaagtggaaatccagactgaacgccttgggcaaaagcgaatttcagatctacaagaagtccggtatccaggaagttgacagaaccctggccaaggaggggatcaagcgcggtgagacggatcatcatgcggtaagccgggggtccgccaagctgcgctggttcgtggaacgaaacatggtgaccccggagggcaaggtagtcgatctcggctgcgggcgtggcgggtggtcgtactattgcgggggactcaaggacgtgcgggaggtgaagggcctgaccaagggcgggcccggccatgaggagcccatccccatgtccacctacgggtggaacctcgtgcgcctgcagagcggtatagacgtgttctttacgccgcccgagaaatgcgacaccctcctgtgtgacatcggggagtcgtcccccaatccaaccatcgaggctggtaggacgctgcgcgtgctgaacctcgtcgagaattggctgaataacaacacccagttctgcattaaggtgctcaacccgtacatgcccagcgtgatcgagaagatggagacgctccagaggaagtacggaggtgccctggtccgcaaccccctgtcccgcaatagcacccacgaaatgtactgggtatccaatgcgacggggaacatagtgagctccgtcaacatgatcagccgcatgttaatcaacagattcactatgaagcataaaaaggccacgtacgagccggacgtggacctcggtagtggcacccgcaacattggcatcgagtcggagatccccaaccttgacatcatcggcaagcgaatcgaaaagatcaagcaggaacatgagacctcatggcactacgaccaggaccacccctacaagacctgggcctatcacggcagctacgaaacgaagcagacggggtccgccagctccatggtgaacggcgtggtccgcctactcacaaagccctgggacgtggtcccaatggtgacccagatggcgatgacggacaccacccccttcgggcaacaacgcgtgttcaaggaaaaggtcgacacgcggacgcaggagccaaaggagggcacaaagaagctcatgaagatcaccgcggagtggctgtggaaggaactcggaaagaagaagacgccaagaatgtgtacgagggaggagtttacccgcaaagtgcggagcaatgccgccctgggggccatcttcaccgacgaaaacaagtggaaaagtgcacgcgaggcggtcgaggacggcaggttctgggagctggtcgaccgcgaacggaacctacatctggagggcaagtgtgaaacctgcgtgtataacatgatgggcaagcgcgagaagaagctgggggagttcggcaaggccaagggcagccgggccatctggtacatgtggctcggggcacgctttctggagttcgaggcgctgggattcctcaacgaggaccattggttcagtcgggggaacagcctgtctggcgtcgagggggagggtctgcaccgcctcggctacatcctgagggacgtgggaaagaaggagggcggggccatgtatgccgacgacacagcaggctgggacacacgcatcaccctggaggaccttaagaacgaagagatggtgaccaaccacatgaagggggaacacaaaaagctggccgaggcgatctttaagcttacataccagaacaaggtcgtgcgggtgcagcgtccgacgccccggggcaccgtcatggacataataagccgccgggaccaacgcggcagcggccaggtaggcacttacggtctcaacactttcaccaacatggaggcccaactgatccgacagatggagggcgagggcatctttaagtcaattcaacacctaacggccaccgaggagatcgccgttcagaactggctcgcccgggtcgggcgcgagcggctaagccgcatggcgatttccggcgacgactgtgtggtgaagcccatagacgatcggttcgcctcggccctgacggccctcaacgacatggggaaagtccgcaaggacatccagcagtgggagccctcccgtggctggaacgactggacacaggtgccattctgcagtcaccacttccacgagctagtgatgaaggacggtcgcgttctggtggtgccctgtcgaaaccaggacgagctcatcggccgcgcccgaatctcgcagggcgcggggtggagcctgaaggagacagcctgtttgggtaagtcctacgcccagatgtggaccctaatgtacttccaccgccgggacttgcgcctggccgccaacgcgatctgcagcgccgtaccctcccattgggtgcccaccagccggacgacctggtccatacacgccaagcacgagtggatgaccaccgaggacatgcttgccgtgtggaatcgcgtctggatccaggagaacccgtggatggaggacaagacgccggttgaatcgtgggaggaggttccataccttgggaagcgcgaggaccaatggtgcggctccctgatcgggctcaccagccgggcgacctgggccaagaacatccagaccgcgatcaaccaggtcagaagcctgatcggaaacgaggagtacacggactacatgcccagcatgaagcgattccgcaaggaggaagaggaggccggcgtactgtggtga

SEQ ID NO: 24998 - RNA, 9876 nt, synthetic construct
  misc_feature 1..9876: note = derived and/or modified CDS sequence (opt11) from DENV-2__GQ868515__SS-prME
  source 1..9876: mol_type = other RNA
accgcgggagtgatagtcatgttaattcccaccgtgatggcattccatctgaccaccagaaacggggaacctcacatgatcgtcggccggcaggaaaaggggaagtccctgctgtttaagaccgaagacggtgttaacatgtgcaccctcatggcgatcgatttgggggaactgtgcgaagacaccatcacctacaagtgccccctcctgcgccaaaacgagcccgaggacatagactgctggtgcaacagcaccagcacctggattacctacgggacctgttccaccaccggcgagcatcgccgcgagaagcggtcagtcgccctggtgccccatgtcgggatgggactcgagacccgcacagaaacctggatgagcagcgagggggcctggaagcacgtgcaacggatcgagacctggatactccgccatccgggctttacaatcatggccgcgatcctggcgtacactatcgggaccacccatttccagcgggccctcatttttatcctgctgacggcagtggccccatctatgaccatgcgctgcataggcatctcgaatcgggactttgtcgagggcgtcagcgggggctcctgggtggacatcgtccttgagcacgggtcctgcgtgaccaccatggcgaagaacaaacccaccctggacttcgaattgattaagaccgaggcgaagcaacccgccaccctccgcaaatactgcatcgaggctaagctgactaacacgacgactgaatcccggtgcccgacgcagggagagccctccctgaacgaagaacaggacaagcggttcatttgcaagcacagcatggtggaccggggctgggggaacggctgcgggctgttcggcaagggcggtattgtcacgtgcgctatgttcacgtgcaagaagaacatggagggcaaggtggtgcagcccgagaacctcgagtacaccatcgtcatcacgccccactccggcgaggaacacgcggtcggcaatgacactgggaagcatggcaaagagatcaaaatcaccccgcagagctccatcaccgaggccgaactgacggggtacggaaccgtgacgatggagtgtagcccccgtactggcctcgacttcaacgagatggtgttgttacaaatggaggacaaggcctggctcgtacaccgacaatggttcctggacctgcccctcccttggctgccgggcgcagacacccagggctccaactggatccagaaggagactcttgtaacgttcaaaaatccccacgccaaaaagcaggatgtcgtggtcctgggaagccaggagggtgcgatgcataccgccctcaccggggccacagagatacagatgagctccggcaacttactgttcactggtcatctgaaatgccgcctgcgaatggacaaactgcagctgaaggggatgagctactcgatgtgcaccggcaagttcaagatcgtgaaggagatcgccgaaacccagcatgggaccatcgtgatacgcgtgcggtacgagggcgacggttctccctgtaagatccccttcgagatcacggattccgagaagcgccacgttcttgggcgcttaatcaccgtgaacccgatagtgacagaaaaagattcccccgttaacatcgaggccgaaccacccttcggcgactcctacatcatcatcggagtggagccaggccagctgaagttaaattggttcaagaaggggagctccatcggtcaaatgtttgaaacgacgatgcggggcgcgaagcgcatggctattctcggggacacggcctgggactttggcagcctcgggggcgtgttcacctccatcgggaaggccctgcaccaggtgttcggcgccatttacggcgctgccttcagcggggtctcttggactatgaagatcctcatcggcgtaatcatcacgtggatagggatgaactcaagatctaccagcctgtccgtctcgcttgtattggtcggcgtggtgatactctacctgggagcaatggtccaggccgactccggctgtgtggtgagctggaagaacaaggagcttaagtgcggcagcggcatcttcattacagacaacgtccatacctggacggagcagtacaaattccagcccgagtcccccagcaagctcgcttccgccatccagaaggcccacgaagagggcatctgcgggatccgctcggtaacgcggctggagaacctgatgtggaagcaaatcacccccgaactcaaccacatcctgtccgagaatgaggtaaaactgacgatcatgacgggggacatcaaggggattatgcaggccggcaagcgcagcctccggccgcagcccactgagctgaagtattcctggaagacgtggggcaaggccaagatgctgagcaccgagtctcacaaccaaacgttcctcatcgacgggcccgagaccgcggagtgcccgaacaccaatcgcgcctggaatagtttggaggtcgaagactacggtttcggagtgttcacgacgaacatctggctgaagttgcgcgagaagcaggacgtgttttgtgattccaagctcatgtccgccgccataaaggacaatagggccgtccacgcagacatgggatactggatcgagtccgccctgaacgacacctggaagatggagaaggccagcttcatagaggttaaatcctgccactggcccaagagtcacaccctctggtccaacggggtactggagtctgagatgatcatccccaagaacttcgcaggaccagtcagccagcacaactatcggccgggctaccacacccagaccgcgggaccctggcacctgggcaagctcgagatggacttcgacctgtgcgaggggacaaccgtggttgtcaccgaggactgtggcaaccgcggccctagtcttcggaccacaacagccagcggaaagctaatcaccgagtggtgctgcagatcttgcaccctgccgccgcttcggtacaggggcgaagacgggtgctggtacgggatggagatccggcctctcaaggagaaggaggagaacttggtgaacagcctggtcacggcggggcacgggcagatcgataacttctctttgggcgtgctggggatggccctgttcttggaggaaatgttacgcacgaggatcggcaccaagcacgccatcctgctcgtggcggcctcattcgtgacccttatcactggtaatatgtcattccgcgacctgggccgcgtgatggtgatggtgggggcaaccatgaccgatgacatcggcatgggtgtcacgtacttagccctgttagcagcgttcaaagtgcggcccacgtttgcggccggactcctcctgcgcaagctcaccagcaaggagttaatgatggccacaattggcatcgcccttctctcccagagcaccatccccgagtcaatcctagagctgaccgacgccctcgcgctagggatgatggtgctgaagatagtccgaaacatggagaagtatcagttggccgtgaccatcatggccataagctgcgttccgaacgcagtcatcttgcagaacgcgtggaaagtgtcctgcacgatcctggccgcagtgagcgtaagccccttgctgcttaccagcagccagcagaaggccgactggatacccctcgcactgaccatcaagggtctgaaccccaccgccatcttcttgaccacactgagccgcacgagtaagaagcgaagctggccgttaaacgaagccgtgatggccgttggcatggttagtatcctggcctcatccttactgaaaaacgatatccctatgactgggccgctcgtggcaggcgggctgctgacagtatgctacgtactcaccggccgatccgcagacctagagctggagcgggcggccgacgtaaagtgggaggaccaggcagagatctcggggagcagccccatactgagtattactatcagcgaggacggctccatgtcgatcaagaatgaggaggaggaacagacccttactatcctaatccgcaccggcttgctggtcattagcggtgtcttcccggtgagcatcccgatcacggcggcggcctggtacctgtgggaggtcaagaagcagagagccggcgtactctgggacgtgcccagtcccccgcccgtcgagaaggccgagctggaggacggggcgtacagaataaagcagcggggcattctggggtacagccagataggcgccggcgtgtacaaggaggggaccttccatactatgtggcacgtgacacgcggcgcggtcctcatgcaccgggggaagcgcatcgagccctcctgggccgacgtaaagaaagacctgatcagctatggcgggggctggaagctggagggtgagtggaaggagggcgaggaagtgcaggtcctcgcactggagcccgggaagaacccccgagcggtgcagaccaagcccgggatcttcaaaacaaacaccggcaccataggggccgtgtccctggatttcagcccgggcacttccggcagccccatcgtcgatcgcaaagggaaggtagttggcctctatggcaacggcgtcgtgacgcggagcggcgcttatgtcagcgcaatcgcacaaaccgaaaagtccatcgaggacaaccccgagatcgaagacgacattttccgcaaaaagcgtctgaccataatggacctgcaccccggagccggaaagaccaagcgctacctccctgccatcgtccgggaggccatcaagcgcgggcttcgcacgctgatactcgcaccgacgagggttgtcgcggccgagatggaagaggccctccgcggcctgcctatccggtatcagaccccagcaatcaagactgagcacacgggtcgcgagatcgttgacctgatgtgccatgccaccttcacaatgagactcctgtctcccgtgcgcgtgccaaattacaacctgatcattatggacgaggcacacttcaccgacccggcgagcattgccgcacggggctacatctcgactcgcgtagagatgggcgaggccgctgggatcttcatgacagccaccccgcccggcagccgggatccgtttccccagtcaaacgcacccatcatggacgaggagcgggaaatccccgagcggagctggaactccgggcatgagtgggtaaccgacttcaagggcaagacggtgtggttcgtcccgtctatcaaggccggtaacgacatcgcggcctgtctcaggaaaaatggcaagaaggtgattcagctgagcaggaagaccttcgacagcgagtacgtcaagactcgcgccaatgattgggactttgtagtaaccaccgacatctccgaaatgggcgcgaacttcaaggctgagcgtgtgatcgacccccgccggtgcatgaaacccgtcatcctgacggacggcgaggagcgcgtgatactcgcagggccaatgcccgtgacccatagcagtgcagcccagcgacgcgggcgaattggccggaaccccaagaacgagaacgaccaatatatctacatgggagagcccctagagaacgacgaggactgcgcccactggaaggaggcgaagatgctgctagacaacatcaacacccctgaaggcattatcccaagcatgttcgagcccgagcgcgagaaagtcgacgccatcgacggtgagtaccggctgagaggggaggcccggaaaacgttcgtggacctgatgcgccgtggcgacttgcccgtgtggctggcttacaaggtcgccgccgaggggatcaactacgcggaccgcaagtggtgcttcgatggcatcaaaaacaaccaaatcctggaggagaacatggaggtggagatctggaccaaggagggggagcggaagaagctcaagccgcgatggctggacgcccggatctactccgaccccttggccctcaaggagttcaaggagttcgcggcgggccgcaagagcctgaccctgaacctcattaccgagatgggccggctgcccaccttcatgacccagaaggcacgcaacgccctggacaacttggcagtactgcacacagccgaggccggaggccgagcctacaaccacgccctgagtgagctccccgagaccctggagacgctgctcctactgaccctcctggccaccgtcaccggaggcatcttcctgttcctcatgtctggcaaggggatcggcaaaatgacgctgggaatgtgctgcatcatcaccgctagcatcctgctctggtacgcccagatccaaccccactggattgccgcctccatcatactggagttctttctgatcgtgctcctgatccccgagccagaaaagcaaaggacaccccaagataatcaactgacctacgtcgtgatcgctatcctcaccgtggtcgctgctacgatggccaacgagatgggcttcctggagaagaccaagaaggatctggggctcggcagcatcactactcaagagtcggaaagcaatatcctggacatagatctgcggccggcgtccgcctggacgctatatgccgttgccaccacctttgtgacccccatgctgcgccactccatcgagaactcctccgtaaacgtgtccctgaccgccatcgcgaaccaggccaccgtgctcatgggcctgggaaaggggtggcccctttctaaaatggacatcggggtccctttactggcgatcggctgttactcccaggtgaacccgatcaccctgaccgcggccttactgctgctcgtggcccactacgccatcatcgggccaggtctgcaagccaaagccacgcgtgaggctcagaagcgcgctgccgcgggcattatgaagaacccgaccgtcgacgggataaccgtgatcgacttagagcctatcccgtacgaccccaaatttgagaagcaactcggccaagttatgctgctgatcctgtgcgtcacccaggttctgatgatgagaacgacatgggccttatgcgaagccttaactctggccaccggcccgatatccacactgtgggagggcaaccccggtcgcttctggaacaccaccatcgctgtgtccatggccaacatctttcgtggcagctaccttgccggagccgggctgctgttcagcatcatgaagaacaccactaatacccggcgcgggaccggtaatatcggcgagaccctcggcgagaagtggaagtcccggttgaacgccttagggaagtcggagttccagatctacaagaagagtggcatccaagaggtcgaccgcactttggcgaaagaggggatcaagcggggcgagacagatcaccacgccgtctcacgcgggagcgcaaagctgcggtggttcgtggaacgcaacatggtcacaccagaaggtaaggtggtggatttaggttgtggccgaggcgggtggagctactactgcggcgggctcaaggacgtcagagaggtgaagggcctgaccaagggcgggccagggcacgaggagcccatccccatgtccacgtacggatggaacctcgtccggctccagagcggcatcgatgtcttcttcaccccgcccgagaagtgcgacaccctgctgtgcgacatcggggagtccagccccaacccaaccattgaggccggaagaacgctccgggtgctgaacctggtggagaactggctcaacaacaatacccagttttgcatcaaagttctgaacccctacatgccctccgtgatcgagaaaatggagaccctgcagcgcaagtacggcggggcccttgtgcggaaccctttaagccggaacagcacgcacgaaatgtactgggtcagcaacgcgacggggaacatcgtgtccagcgtgaacatgatatcccggatgctcattaaccgcttcacgatgaagcacaagaaggccacctacgagccggatgtggaccttgggagcggcactcggaacattggcatcgaatccgagatccccaacttggacatcataggcaaacgcatagagaaaattaagcaggagcacgaaaccagctggcactacgaccaggatcatccctacaagacatgggcgtaccacggctcctatgagacaaagcagaccggcagcgctagtagcatggtcaacggcgtggtgcgcctgctaacaaagccctgggacgtggtgccgatggtcacacaaatggccatgaccgacaccactcccttcggccaacagcgggtgtttaaggagaaggtggacacccgcacccaagagcccaaggagggcaccaagaagctaatgaagattacggcggagtggctgtggaaggaattaggaaagaagaaaacaccccggatgtgcacccgcgaggagttcacccggaaagtccgctccaacgccgcactcggggccatcttcaccgacgagaacaagtggaagtccgcacgggaggcggtggaagacggtagattctgggagttggtggaccgggagcgcaacctgcacctggaagggaagtgcgaaacgtgcgtctacaatatgatggggaagcgggagaagaagttgggggagttcggcaaggccaagggctcccgtgccatctggtacatgtggctgggcgcccggttcttggagttcgaggctcttggcttcctgaacgaagaccattggttctcccgcgggaacagcctctcgggcgtggagggggagggactgcaccggcttggctacattctccgcgacgtggggaagaaggagggtggggccatgtatgcagacgataccgccggctgggacaccagaatcacccttgaggacctaaagaacgaggaaatggtcacaaatcacatgaaaggggagcacaagaagttagccgaggcaatcttcaagttgacctatcagaacaaggtggttagagtgcagcgcccgacgccgcgcggcaccgtgatggatattatcagccggcgagaccagcgcggctccgggcaggtcggcacgtacggcctgaacacctttaccaatatggaggcgcagcttattcggcagatggagggcgaagggatattcaagaacatacaacacctcaccgctacggaagagatcgccgtccaaaactggctggcccgtgtgggacgggagcgcctcagccgaatggcgatctccggcgacgattgcgtcgtgaagcccatcgacgacagatttgccagcgccctgaccgcgcttaacgatatgggaaaggtacggaaggacattcagcagtgggaacccagccgcggctggaatgactggacccaggtgccgttctgctctcaccacttccacgagctagtgatgaaggacgggcgggtactggtcgtaccatgccgcaaccaagacgagcttatcggtcgggcacgcatctcccagggcgcggggtggagccttaaagagaccgcgtgtctggggaagtcctacgcacaaatgtggacgttaatgtatttccaccggcgcgacctcaggctggccgccaacgcgatctgcagcgctgtgccctcccactgggtccccaccagccgcaccacgtggtcgatccacgcgaagcacgagtggatgactacagaagacatgctggcggtatggaaccgggtgtggatccaggagaacccgtggatggaggacaagacccccgtcgagagttgggaggaggttccctacctcgggaagcgcgaagaccagtggtgcgggagcctgattggtctgacctcccgggcgacctgggccaaaaacatacagaccgccataaatcaggttcgcagcctcatcggcaacgaggagtataccgattacatgccttccatgaagcgcttccggaaggaggaggaggaggccggcgtcctgtggtga

SEQ ID NO: 24999 - RNA, 9876 nt, synthetic construct
  misc_feature 1..9876: note = derived and/or modified CDS sequence (opt11) from DENV-2__GQ868516__SS-prME
  source 1..9876: mol_type = other RNA
accgcgggcgtcatcgtgatgctgatccccacggtgatggccttccacttgacgacacgtaacggggagccacacatgatcgtgggcagacaggagaagggcaagtccctcttgtttaagaccgaggatggcgttaatatgtgcaccctcatggccatagacctgggagagctgtgtgaagacactatcacctacaaatgccccctattgcgccagaatgagccggaggacatcgactgctggtgtaacagtactagcacctggataacctacgggacctgctctacaaccggcgagcacagacgcgaaaagcggagcgtggccctggtgccccacgtcgggatgggactcgagacccgcaccgagacctggatgtcctctgagggggcctggaaacacgtgcagaggatcgagacctggatcctacgccatccgggcttcaccatcatggccgctattctggcgtacacgatcgggaccacccacttccagcgggcactcatcttcatccttttaactgccgtggctccctccatgaccatgcgctgcatcggcatcagcaatagggacttcgtggagggcgtctcgggtggctcatgggtcgatatcgtactcgagcacgggtcctgcgtgaccacaatggcgaaaaacaagcctactctagactttgagctgatcaagaccgaggctaagcagcccgcgaccctccggaagtactgcatcgaagccaagctgacaaacacgaccaccgagagccgttgcccgacacagggcgagccttcccttaacgaggagcaggacaagcggtttatctgcaagcacagcatggtagaccgcggctggggtaatggctgtgggctgttcggcaagggcgggatcgtcacttgtgcgatgttcacgtgtaaaaaaaacatggaaggcaaggtagtgcaacctgagaacttagagtacaccatcgtcatcacgccccattctggtgaagagcatgcagtaggcaacgacacggggaagcacgggaaagaaatcaagatcacgccccagagttccatcacagaggcagagctgaccgggtacggaaccgtgacgatggaatgcagtccccgcaccggactcgacttcaacgagatggttttgctgcagatggaagacaaggcctggctcgtgcaccggcagtggttcctggacctgcccctcccctggcttccgggggccgacacccagggctccaactggattcagaaggaaaccctggtgacgttcaagaacccccatgccaagaaacaggatgtcgtggtcctcggaagccaggagggcgctatgcacaccgccctgaccggggccaccgagatccagatgagcagcggcaatctcctgttcacaggccacctcaagtgcagacttcggatggataaattgcagctgaaggggatgagctattccatgtgcaccggcaagttcaagattgtcaaggagatagccgagacccagcacgggacaatcgtaatccgcgtccaatacgagggtgacggctctccctgcaagatcccctttgagatcacggacctggagaagcgacatgtattagggaggctgatcaccgtgaacccaattgtgaccgagaaggattcgcccgtaaacatcgaggccgagcctcccttcggcgacagctacatcatcatcggcgtggagccgggccagctgaaactcaactggttcaagaaggggagttccatcggccagatgttcgaaaccaccatgcgcggcgcgaagcgtatggctatcctgggggacaccgcctgggacttcggaagtttgggaggtgtcttcacctctatcgggaaggccctccaccaggtcttcggggccatctatggcgcggcgttttctggagtgagctggaccatgaaaatcctgataggcgtcatcatcacgtggatagggatgaactccaggagtacctccctttctgtgtccctggtactcgtcggagtggtgatcctttatctgggggccatggtccaggccgactcaggctgcgttgtctcctggaagaacaaagaattaaagtgcggctccgggatcttcatcaccgacaacgtacatacttggacagagcagtacaagtttcagcccgagtccccctccaaactcgcgagcgctatccagaaggcccacgaagagggtatctgcgggatccgttcggtgacccgattggagaacctcatgtggaagcagatcacccccgagcttaaccacatacttagtgagaacgaagtgaaattgaccatcatgacgggagatatcaaggggataatgcaagccggcaaacggtctttacgcccgcagcccaccgagcttaagtacagctggaagacctggggcaaggccaagatgctgtccaccgagtcacataatcaaacgttcctgattgatgggcccgagaccgcggagtgccctaataccaaccgggcatggaactccttggaggtcgaggattacggcttcggggtgttcaccacgaacatctggttgaagctgcgtgagaagcaagacgtgttctgtgacagcaagctgatgagtgccgcgatcaaggataaccgggcggtccacgcagacatgggctactggatcgagagcgccctcaatgacacctggaagatggagaaagcctccttcatagaggtaaagtcgtgccattggcccaagtcccacaccctgtggagcaacggagttctggagtccgaaatgatcatccccaagaacttcgcagggcccgttagccagcacaactaccgcccgggataccacacccagacagccggcccatggcacctcggcaagctggaaatggatttcgacctatgcgaaggcactacagtagtggtcactgaggactgcggaaaccggggtccgagcctcaggaccacgaccgcgtcgggtaagctgatcaccgagtggtgctgccggagctgcaccctgcccccgctccgctaccgtggcgaagacgggtgctggtacggcatggagatccgcccactgaaggagaaagaggaaaatctggtgaactctctcgtgacggccggccacggccagatcgacaacttcagcctcggcgtccttgggatggcgctctttctggaggagatgctgagaacccgcatcggcaccaaacacgccatcctcctggtggcagcttcctttgtgaccctgatcaccgggaacatgagcttccgggatctaggccgggtcatggtgatggtgggggccacaatgactgacgatatcggcatgggcgtgacctacctggccttactcgctgcgtttaaagtgcgccctacctttgcagccggtttgctactacggaagttaaccagtaaggagctcatgatggccaccatcggtatcgccctcctgagccaatccaccatccctgaatctattctggagctcacagacgctctggccctggggatgatggtgcttaagatcgtccgtaatatggaaaagtaccagttggccgtgaccatcatggccatttcatgtgtaccgaatgccgtcatcctgcagaacgcttggaaggtgagctgcaccattctcgccgcagtgagcgtctcgcccctgctattgacatcaagccagcagaaggcggattggatcccacttgcgctgacgatcaagggcctgaacccaaccgccattttcctgaccaccctatcccggacgtcgaagaaacgctcatggccgctcaacgaggccgtaatggcggtcggcatggtttccatcttggcaagctccctgctcaaaaacgacatccccatgacgggccccctggtcgcgggcgggttgctcacagtctgctacgtgctgacaggccggagcgccgacctggagctcgagcgcgctgccgatgtgaagtgggaggaccaagccgagatctccgggagctcacccatcttgagcatcacaatctccgaggacggcagcatgtccataaagaacgaagaggaggagcagaccttaaccatccttatccgcaccggcctgctggtcatttccggggtctttcctgtttctatcccaatcacggcggccgcttggtacctctgggaggtcaagaagcaacgcgccggcgtgctgtgggacgtcccatcgccgcctcccgtcgagaaggccgaactggaagatggggcgtaccgaataaagcagcgcggcatcttggggtattcccagatcggagccggcgtgtacaaggaagggaccttccatactatgtggcacgtgacccggggcgccgtcctgatgcacagaggtaaaaggatagagccctcctgggccgacgtgaagaaggacctgatctcctacggcgggggctggaaactagagggagagtggaaggagggggaggaggtgcaagtgctggcactggaacccggcaagaacccccgcgcagtgcaaaccaagcccggtatcttcaagacaaacactggcacaatcggtgccgtgagtctggacttctccccaggcaccagcggcagtcccatcgtcgaccgaaaaggaaaggtggtgggcctgtatggcaacggcgtcgtgacccgcagcggtgcctacgtcagcgcgatcgcgcagacagagaagtccatagaggacaaccccgagattgaggacgatattttccgaaagaaacgcctgaccatcatggacctccaccccggggccggcaaaacgaaaagatacctgcccgccatcgtccgtgaggccatcaaacgcgggctccgcacgctgatcctcgccccgacccgcgtggttgctgccgagatggaggaggccttgcggggcctgccgatcaggtaccagacccccgctataaagacagaacacacggggcgggagatcgtcgatctcatgtgccacgcgaccttcaccatgagactgctttctccggtgagagtcccgaactacaatctcatcatcatggacgaggcgcacttcaccgaccccgcctccatagccgcacgcggctacataagcacccgagtcgagatgggggaggccgcggggatcttcatgaccgccaccccgccaggctccagagacccgttcccacagagcaacgcccccatcatggacgaggagagagaaatcccagagagatcctggaacagcgggcacgagtgggtgacggacttcaagggcaagacggtgtggtttgtaccctccatcaaggccgggaatgatatcgcggcctgcctgcggaaaaacggcaagaaggtgatccagctgagccgcaagaccttcgacagcgagtacgtgaagacccgagctaacgactgggactttgtcgtgacgacggacatctcggagatgggcgccaacttcaaggcagagcgggtgatcgacccgcggcgctgcatgaaacccgtcattttgaccgacggggaggaacgggtcatcctcgccggccccatgccggtcacccactcaagcgccgcccagcgacgggggagaatcggtcgaaatccaaagaacgaaaatgaccagtacatttacatgggtgagccgctagagaacgacgaggactgcgcccactggaaggaggccaaaatgctcctggacaacataaatacgccggaggggattatcccgtccatgttcgaacccgagcgtgaaaaggtggacgctatcgacggcgagtaccgcttgcgtggggaggcacgcaagacgttcgtggacctcatgcggcgcggagacctgccagtctggctagcgtataaggtcgccgccgaagggataaattacgcggaccgcaaatggtgtttcgacggcatcaaaaacaaccaaatcctcgaggaaaacatggaagtggagatttggactaaggagggggaacgcaagaagttgaagccgcggtggctcgacgctcggatctacagcgaccccctcgccctaaaggagttcaaggagttcgccgcaggcagaaagtcccttaccctcaacctaattaccgagatgggacgcctgcccacgttcatgacgcagaaggcccggaacgccctcgacaacttagccgtcttacataccgctgaggcagggggccgcgcatacaatcatgctctctcagaactgcccgagacactggagacgctcctgctgctcaccttgttggctaccgtcaccggtggcatcttcctcttcctgatgtccgggaaggggatcggcaagatgacgctggggatgtgctgcataatcacggcgagcatattattatggtacgcgcagatacagccccactggatcgctgcctccatcatcctggaattcttcctaattgttctgctgatccccgaacccgaaaagcagcggacgccccaagacaaccagctcacctacgtcgttatcgccatcctgacggtggtggcagctacgatggccaacgagatgggcttcctagaaaaaaccaaaaaggaccttgggctgggttctatcactacccaggagagcgagtccaacattctggacattgacctcaggccggcttcagcctggactctgtacgctgtggcaaccactttcgtgacccccatgctgcgtcatagtattgaaaattcatccgtcaacgtgtcactcactgcaatagccaaccaggctactgttctgatgggcctgggaaagggctggccgctctcaaagatggacatcggggtccccctactggcgatcggctgctacagccaggtgaacccgataaccctcacagccgcattactgctcctggtcgcccactacgcgatcatcggccccggtttgcaggccaaagcgacgcgtgaagcccagaagcgggccgcagcaggcatcatgaaaaaccctacagtcgacgggatcaccgtcatagacctcgagcccatcccgtacgacccgaaattcgagaaacagctgggccaggtgatgctgctcatcctatgcgtcactcaggtactgatgatgcgaacgacctgggccctatgcgaggccctgacattagccaccggtcccatctccacgctctgggagggcaacccagggcgtttttggaacaccactatagccgttagcatggcgaatatattccgtggctcctacctggccggcgccgggctcctgttcagcatcatgaagaacaccacgaacacccgccgcggcaccgggaacatcggcgagacactgggcgaaaaatggaagagtcgcctgaacgccctcggaaagagcgagtttcagatctacaaaaagtccggtatccaggaggttgatcgcactctagctaaagaagggattaagcgcggggaaacggaccaccacgccgtgagtagaggatccgccaagctgcgctggtttgtggaacggaacatggtcaccccggagggcaaggtcgtggatctaggctgcgggcgcggcggttggagctattattgcggcgggttgaaggatgtccgggaggtgaagggcctaaccaaaggcggtcccggccatgaggagcctattcccatgagtacgtatggatggaacttagtacggctgcagtcgggcatcgacgtcttctttaccccgccggagaagtgcgataccctgctctgtgatatcggagaaagctcccccaatcccaccatcgaggccggtcgtacgctgcgggttctcaacttggtggaaaactggctgaacaacaatacccagttctgcatcaaggtcctgaacccgtacatgcctagcgtgatcgagaagatggagaccctacagcggaagtacggcggggcgctggtccgcaaccctctgtcccgtaacagcacccacgagatgtactgggtctccaacgcgacagggaacattgtgagcagtgtaaacatgatcagccgcatgttaattaatcggtttactatgaagcataaaaaagcgacctacgagccggacgtagacctcggatccggcactagaaatattgggatcgagagcgagatacctaacctagacattatcggcaagcggatcgagaagatcaaacaggagcacgaaacctcctggcattacgaccaggaccacccctacaagacgtgggcctaccacggcagctacgagaccaagcagaccgggtctgccagctccatggtgaatggcgtggtccgcctgctgaccaagccctgggacgtggtgcccatggtaacgcaaatggcgatgaccgataccacccccttcggacagcaaagggtattcaaagagaaggtagatactcggacccaggagcccaaggagggcaccaagaaactgatgaagatcaccgcagagtggttatggaaagagctcggcaagaaaaagacgccccgcatgtgtacgcgggaggagttcacccgcaaggtccggagtaacgccgcgctgggggccatattcaccgacgagaacaagtggaagtctgcacgagaggctgtggaagacggccggttctgggagctggtcgatagggagcggaatctacatctcgaggggaagtgcgagacgtgcgtctataacatgatgggcaagcgcgagaagaagctgggggagtttggtaaagcgaagggctctagagccatctggtacatgtggctcggggctcgtttcctggagtttgaggcattaggcttcctcaacgaggaccactggttcagccgtgggaactccctgtcgggcgtggaaggggagggtctgcaccgcctcggctacatcttgcgggacgtggggaaaaaggaaggcggggccatgtacgccgacgacaccgccggctgggacacccgcatcaccctggaggacctgaaaaacgaggaaatggtcacgaaccacatgaagggggagcacaagaagctggccgaggcgatctttaagctgacctaccagaataaggtggtccgggtgcaacgccctactccacggggcaccgtgatggacatcatctccagacgggaccagcggggctcgggtcaagtcggcacgtacgggcttaataccttcaccaacatggaggcccaactgatccgccagatggagggcgagggcatcttcaagaatattcagcaccttaccgccacggaggagatcgccgtgcagaactggctggcacgggtggggcgcgagcgtctgtcccgcatggcgataagcggagacgactgcgtcgtgaagcccatcgatgacaggttcgcaagcgccctgaccgcgctcaacgacatgggcaaggtgcgcaaggacatccagcagtgggagccgagccgaggctggaacgactggacgcaggtcccgttctgctcccatcactttcacgagttggtgatgaaggatgggagagttcttgtcgtgccatgtcggaaccaagacgaactcatcgggcgcgcccgcatcagccaaggcgcggggtggagcctcaaggagaccgcctgccttggcaagagctatgcccaaatgtggacgctgatgtatttccacaggcgggatcttcgcctggcagccaacgcgatctgcagtgccgtaccgagtcattgggtcccgacctcccggacaacctggagcatccacgcaaagcatgagtggatgaccacggaggacatgctcgccgtgtggaaccgcgtgtggatccaggaaaacccctggatggaggacaagacccccgtcgagtcctgggaggaggtgccttacctggggaagcgggaggatcagtggtgcggaagcctgatcggtctcacctcacgcgcgacctgggccaaaaacatccagaccgccattaaccaggtgcggtccctgataggcaacgaggagtacaccgactacatgcccagtatgaagcgtttccgcaaagaggaggaggaggccggcgtcttatggtga

SEQ ID NO: 25000 - RNA, 9876 nt, synthetic construct
  misc_feature 1..9876: note = derived and/or modified CDS sequence (opt11) from DENV-2__GU131975__SS-prME
  source 1..9876: mol_type = other RNA
acagcgggagtcatcgtcatgctgattcctaccgtgatggcctttcacttaaccacgcgaaacggggagccccacatgattgtgggcaggcaggagaaaggcaagagcctgctttttaagaccgaggacggggtcaacatgtgcaccctcatggcgatcgatctgggggagctgtgcgaggacaccattacgtacaagtgcccgttactgcgccagaacgagcccgaggacatcgactgttggtgcaattccacttctacctggatcacatacgggacctgttccacgaccggagagcaccgtcgcgaaaagcggtccgtggcactggtcccgcacgttggaatgggcctcgagacccggaccgagacctggatgtccagcgagggcgcctggaagcatgtacagcggattgagacctggatcctgcgccacccgggtttcaccatcatggcggccattctggcgtataccattggtaccacccactttcagcgggccctaattttcatcttgctgacggccgttgcgccctccatgaccatgcgctgcatcggtatcagtaaccgggacttcgtcgagggagtctccgggggcagctgggtcgatatcgtcctcgagcacggttcctgcgtgaccaccatggcaaaaaataagcccactcttgacttcgagctgatcaagacggaggcgaagcaacctgcaaccctccgcaagtactgcatcgaagccaaactgacaaacacgacgaccgaaagcaggtgcccgacccaaggtgagccctccctaaacgaggagcaggacaaacggttcatctgcaagcactccatggtggaccgcggctgggggaacggctgcgggttattcggaaagggcgggatcgttacttgcgccatgtttacctgcaagaagaacatggagggcaaagtggtgcagccggagaacctggaatataccatcgtcatcacgccacactccggggaggagcatgcggtgggcaatgatacggggaagcacggcaaagagatcaagataacgccgcaaagctccatcaccgaggccgagttaaccggttacggcaccgttacgatggagtgcagccctagaacaggcctcgacttcaacgaaatggtccttctgcaaatggaggacaaagcttggctcgtgcatcggcagtggttcttggacttgcccttaccgtggctgcctggggccgacacccagggttccaactggatccagaaggagaccctcgtgacctttaaaaacccacacgccaagaagcaagatgtcgtcgtactcgggtcgcaagagggcgcgatgcacaccgccctgaccggggccaccgagatccagatgtcgtccggcaacctcctgttcacgggccacctaaagtgtcgacttagaatggacaagctccagctgaaaggtatgagctacagcatgtgcaccggcaaattcaagatagtgaaagaaatcgcggaaacgcaacatgggaccatcgtgatccgcgtccagtatgagggcgacgggagcccctgcaagatccccttcgagataaccgatctcgagaagcggcacgtcctagggcgcctgatcaccgtcaacccgattgttacggagaaggactccccggtgaacatagaggccgagccgccgtttggtgacagctacatcattattggggtggaacccggccagctgaaactcaactggttcaagaaggggtcctccatcggccagatgttcgagacgacgatgcggggtgcgaaaagaatggccattctgggggacaccgcctgggatttcggctccctaggcggggtgttcaccagcatcggcaaggcgctccatcaggtgttcggtgccatatatggagcggccttcagtggtgtgagttggaccatgaagatccttatcggcgtgataatcacgtggattgggatgaactcgcgcagcacatccttaagcgtgtccctggtgttggtcggtgtggtcattctgtacttgggggccatggtacaagccgatagtggctgcgtagtttcctggaagaacaaagagctcaaatgcggatctggcatattcattaccgacaacgtgcatacctggacggagcagtacaagtttcagcccgagtcaccctccaagctggcgtccgcaatccagaaagctcacgaagaagggatctgcggaatcagatcggtgactcgcctggagaacctcatgtggaagcagatcacccccgaattgaaccacatcctgtcggagaacgaggttaaacttaccataatgacgggcgacataaaggggatcatgcaggccggcaagagatccctgcggccgcagccaaccgagctaaaatactcttggaagacctggggcaaggccaaaatgctcagtaccgaaagccataaccagacgttccttatagacggacccgagactgcggagtgcccgaacaccaaccgtgcctggaactccctggaggtcgaggactacggcttcggggtattcaccactaacatctggttgaagctgagggagaagcaggatgtgttctgtgactccaagttgatgtcggccgccatcaaggacaaccgagccgtccacgcggatatgggatactggattgagagcgcactaaatgacacctggaagatggagaaagcctcttttatagaggtcaagagctgccactggcctaagtcccacaccctgtggagcaatggcgtgttagaaagcgagatgatcatccccaagaattttgccggtcccgtgagccagcacaactacaggcctggctaccacacccagaccgcagggccctggcacctcgggaagcttgagatggactttgacctgtgcgaggggacgacggtcgtggtgaccgaggactgcggcaatagaggccccagcctaagaaccacgactgcgtctgggaagctgatcacagaatggtgttgccggagctgtaccctgccccctctcaggtaccgtggggaggatgggtgctggtacggcatggaaatccggcccctgaaggagaaggaggagaacctggtgaactccctcgtaacggcggggcatggccagatcgacaacttcagccttggcgtcctggggatggccctattccttgaagagatgcttaggacccgcatcgggaccaagcacgccattctcctggtggcggcctccttcgtgactttaatcacagggaacatgtcgttcagggacctcggtcgagtcatggtgatggtcggggctaccatgaccgacgatatcggcatgggcgtcacgtacttagccttactcgcagcgttcaaagtgcgcccaaccttcgccgccgggctgctgctccggaagctcaccagcaaggaactgatgatggccaccatcggcatcgccctccttagccaatccaccatcccggaatcgatcctggagctcacggacgcgttggccctaggaatgatggtgctcaagatcgtgcgcaacatggagaagtaccagcttgcagtgactatcatggccatatcctgcgtgccgaacgccgtaattcttcagaacgcgtggaaggtgagctgtaccatcttagccgccgtttccgtcagccccctgctgttgacctctagccagcagaaggccgactggatcccattggcgctaacaataaagggcctcaaccctaccgccatcttcctgaccacgctgagtcggacgagtaaaaagcgctcctggcccctcaatgaggcagtgatggctgtcgggatggtgtcgatcttggctagcagcctgctgaagaacgatataccaatgaccgggcccctggtagcgggagggctgcttaccgtctgctacgtgcttacgggacggagcgccgacctggaactcgagagggccgctgacgtgaaatgggaggaccaggcggagatctccgggagctcccctatcctgtcgattacaatctccgaggatggaagcatgtcaataaagaatgaagaggaggagcagaccctgactatcttgatccgcacgggcctgctggtgatcagcggagtattcccggtctcaatacccatcaccgcggccgcctggtatctctgggaggtcaagaaacagagagcaggcgtgctgtgggacgtacccagcccgccgcccgtcgagaaggcggaactggaggacggggcgtaccggatcaagcagcgcggaatcctcgggtactcacagattggcgcaggggtttacaaggagggaaccttccacaccatgtggcatgtgacccggggtgccgtcttaatgcaccgcgggaagcgaatcgagccctcctgggctgacgtgaagaaagatctgatctcctatggcgggggctggaaactcgaaggcgagtggaaggagggggaggaagtgcaggtcttggcactggagcccggcaagaacccccgcgcggtgcagacgaagcccgggatcttcaagacaaatacgggaaccatcggggccgtgtctctcgatttctcccccggcactagcggatccccaatcgttgaccggaaggggaaggtcgtgggcctgtatggcaacggggtcgtaacgcgaagcggcgcttacgtgagtgccatagcgcagaccgagaagagcatcgaggacaacccagagatcgaggacgacatcttccggaagaagcgcctgacaatcatggaccttcaccccggcgccggtaagactaagcggtacctgccagccatcgtccgcgaggcaatcaagcggggcctccgcactttaatcttagccccgaccagggtcgtggcggccgaaatggaggaggctctgcggggccttcccatcagataccagacccccgccatcaagactgagcatacggggcgggagattgtcgatctcatgtgccacgcaaccttcaccatgaggctgctgagcccggttcgggtgccgaattacaatcttataatcatggacgaggctcacttcaccgaccccgcctccatcgccgcacgcgggtacatcagcacgcgtgtcgagatgggcgaggccgcggggatcttcatgaccgctacgccgcccggcagtcgcgacccattcccccagtcaaatgcccccatcatggacgaagaacgggagattcccgagcgatcctggaactccgggcacgagtgggtaaccgacttcaaaggcaaaacggtgtggttcgttccgtcaatcaaggctgggaatgacatcgcggcgtgcctgcggaagaatgggaagaaggtgatacagctgagccgtaagaccttcgactcagagtacgtgaaaactagggccaacgactgggacttcgtcgtcaccacggacatctcggagatgggcgccaacttcaaggccgaacgcgtgatcgacccccggagatgcatgaagccggtgatcctcaccgacggggaggagcgggtgatcttagcgggccctatgccggtgactcactccagcgcggcccagcgccgggggcgcataggccgtaatcccaagaacgagaatgatcagtacatctacatgggggagccgctggagaacgacgaggattgcgcccactggaaggaagccaaaatgctactggataatattaacacccccgagggcatcatcccgtctatgttcgagcctgagagggagaaggtcgatgcgatagatggcgaatacagactgaggggggaggcccgcaagacgtttgtggaccttatgcggcgcggggacctgcccgtgtggctggcgtataaggttgcagccgaggggattaattacgcggacaggaagtggtgcttcgacggcattaaaaacaaccagattttggaggagaacatggaagtggagatctggacgaaggagggggagcgcaagaagctgaaaccgcggtggctggacgctcgaatctacagcgacccccttgccctgaaggaattcaaggagttcgccgccggcagaaagagcctgactctcaacctgatcaccgagatggggaggcttcccacgttcatgacccagaaagcgcggaacgccctagacaacctggccgttctgcacactgcggaggcggggggacgcgcctataaccacgcgctctctgagttacccgaaaccctggagacactcctgctgctcacgctgttagcgaccgtgaccgggggcatctttctcttcctgatgtccggcaaagggattgggaagatgacgctggggatgtgctgcatcattaccgcaagcatcctcctgtggtacgcgcaaatccagccgcactggatcgcagcgagcatcatccttgaattctttctcatagtgctgctgattcccgagcccgagaagcagcggacgccccaggacaaccagctaacctacgtcgtgatcgcgatactcaccgtggtcgccgccacgatggcgaatgagatgggcttcctcgagaagactaagaaggacttagggctgggctcgatcacgacccaggagagcgaatccaacatactggacatcgaccttcgcccggcaagcgcctggactctctatgccgtggctaccacctttgtgactcccatgctgcggcactctatcgaaaacagcagtgtcaacgtgtcgttgactgccatcgccaaccaagccactgtgttaatgggcttagggaagggctggcccctctcgaagatggacatcggtgtgcccctgcttgcgataggatgttacagccaggtgaacccgatcaccctgaccgcagccctgctactcctggtggcgcattatgccatcatagggcctgggctgcaggcgaaggccacgcgcgaagcccagaaacgcgccgcagcggggatcatgaagaacccgacggtcgacgggatcaccgtgatcgatctagagcctatcccctatgaccctaagttcgagaagcaactgggccaggtgatgctgctcatcctgtgcgtaacccaggtgctaatgatgcgcacgacctgggccttgtgcgaggccctaacgttggccacggggcccatatccacgctctgggaaggcaaccccggtcggttctggaacactaccatcgccgtgagcatggcgaacatatttcgtggctcttacttagccggagccgggctcctgttctcgatcatgaagaacaccacaaacacccgccggggcaccgggaacatcggggagaccttgggcgagaagtggaagtcccgcctgaatgcactaggcaagagcgagttccaaatatacaagaagtccggcattcaggaagtcgaccggacgttagcgaaggaggggatcaagcgcggcgagaccgaccaccacgccgtgagccgggggtccgccaagctacgctggttcgttgagaggaatatggtcaccccggaaggtaaggtggtggacctcggctgtgggcgcggcgggtggtcgtactactgcggcggcctgaaggacgttcgtgaggtgaagggattgacgaagggcggccccggccacgaggaacccatccctatgagcacgtacggctggaacctcgtccgcctgcagtccggcatcgacgtcttcttcacaccgcctgaaaagtgcgacacactcctctgcgacattggcgagagctccccgaacccaactatagaggcaggccggacgctgcgcgtgctaaacctcgttgagaactggctgaataacaatacccagttctgcatcaaagtcctgaacccgtacatgcccagcgttatcgaaaagatggaaacgctacagagaaagtacggcggggcgctcgtgcgcaaccctctgtcgcggaactcgacacacgaaatgtactgggtgagcaacgcgaccggcaatatagtgagctccgtaaacatgatcagcaggatgctgatcaaccggttcactatgaagcataagaaggccacctacgagccggacgtagacctcgggtctgggacccggaacatcgggatcgagagcgagatccccaacctcgacatcatcggtaaacgtatcgaaaagatcaaacaagaacacgagacctcctggcactacgaccaagaccacccctacaagacgtgggcctaccacggcagctacgagaccaagcagaccgggtccgcgagttccatggtgaacggcgtggtccgcctgctcaccaagccctgggacgtggtgcctatggtgacgcaaatggccatgaccgataccacccccttcggccagcagcgcgtattcaaagagaaggtggatacccggacgcaggaacctaaagagggcaccaagaagctcatgaagattaccgcggagtggctgtggaaggagctcgggaagaagaagacgccgcgcatgtgtacccgtgaggaattcacccgcaaggtgagaagcaacgcggccttaggcgctatcttcaccgatgagaacaagtggaagagcgctcgcgaagcggtggaagatggacggttctgggagctggtggacagagagcgcagcctccacttagaagggaagtgcgagacgtgcgtttacaatatgatgggcaaacgcgagaagaagctgggggaattcggcaaggccaaaggcagccgggcaatttggtatatgtggctcggggctcgcttcctggagttcgaggcgctagggttcctcaacgaagaccattggttctcccgggggaactcgctttccggcgtggaaggggagggcctacatcgcctcggctatatcctgcgggatgttgggaagaaggaagggggtgcgatgtacgctgacgacaccgctggctgggacacccgcatcaccttagaggacctcaaaaacgaggagatggtaaccaaccacatgaagggggaacacaagaagcttgccgaggccatcttcaagctcacttaccagaataaggtggtcagagtgcagcgcccgacgccccgcggaactgtgatggacataatcagccgccgggaccagagaggctctgggcaggtcggcacgtacgggctcaacaccttcaccaacatggaggcccagctgatccgccagatggaaggcgagggcatctttaagaacatccagcacctaaccgccactgaggagatcgccgtacaaaactggctagctcgggtcgggcgcgagagactgagcagaatggcgatcagcggagacgactgcgtcgtgaagcctatagacgacaggttcgccagcgcactgaccgccctcaacgacatggggaaagtacggaaagacatccagcaatgggagccctctcggggctggaacgactggacccaggtcccgttctgctctcaccacttccacgagctggtgatgaaggacgggcgcgttctcgtcgttccatgccgtaaccaggacgaactcattggcagggcacggatcagtcagggcgcggggtggtctctgaaggagactgcctgcctgggcaagtcctacgcccagatgtggacgctgatgtatttccatcggagggacctgcggctggccgcgaacgcgatttgtagcgccgtgccctcccactgggtccccacctcaagaaccacctggtccatacatgccaagcacgaatggatgaccacggaggacatgctggccgtgtggaaccgcgtgtggatccaagagaacccgtggatggaagacaagaccccggtcgagtcttgggaggaggtgccttacctgggtaagcgggaggaccagtggtgcggctccctcatcggcctgacctcccgagccacttgggccaaaaacatacaaacagccatcaaccaggtgcggagcctgatcggcaacgaagagtacaccgattacatgccatctatgaaacgctttaggaaagaggaggaggaggcaggcgtcctctggtga

SEQ ID NO: 25001 - RNA, 9876 nt, synthetic construct
  misc_feature 1..9876: note = derived and/or modified CDS sequence (opt11) from DENV-2__JN819422__SS-prME
  source 1..9876: mol_type = other RNA
accgcgggcgtaatcgtcatgcttatcccaactgccatggcgtttcatctcaccacccgcaacggggaaccccacatgatcgtgggccggcaagagaagggaaagtcattgcttttcaagaccgaggacggcgtgaacatgtgtaccctcatggccatcgacttaggcgagttgtgtgaagacaccatcacatacaagtgtccgcttctacgacaaaacgagcccgaggacattgactgctggtgcaacagcaccagcacctgggtcacctacggaacctgtaccacaaccggcgagcatagacgcgaaaagcggtctgtcgccctggtgccacacgtcggtatggggctcgaaactcgaactgagacctggatgagttccgagggggcgtggaagcatgttcaacggatagaaacgtggatcttgcgtcacccgggcttcacaatcatggccgctatcctggcctacaccatcggtacaacgcacttccagaaggcgttaatattcattttgctgacagccgtggcgcccagcatgaccatgcggtgtataggcatctcgaaccgcgacttcgtcgagggagtcagcggagggtcctgggtggacatcgtcctggagcatggaagctgcgttaccacgatggccaagaataaacccaccctcgattttgagcttatcaagaccgaggccaagcagcctgcgaccctccggaagtattgcatcgaggccaaattaacgaatactactacagagtcacgctgcccaacccagggggagcccagcctgaatgaggagcaagacaaacggtttatttgtaagcactccatggtggataggggctggggaaacggctgtgggttatttgggaagggcggtatcgtgacctgcgccatgtttacgtgcaagaaaaacatggagggaaaggtagtgcagcccgagaacctggagtacaccatagttatcacaccccacagcggggaggagcatgccgttggcaatgatacggggaagcacggtaaggagataaagattacaccccagtcgagcataaccgaagccgagctgaccgggtacggtacggtaaccatggagtgtagcccccggacgggcctggatttcaacgaaatggtcctgctgcaaatggaggacaaagcctggcttgtgcatagacagtggttcctggatctccccctcccctggctgccaggggccgatactcagggcagtaactggattcaaaaggaaacgctggtcacgttcaagaacccccacgcaaagaagcaggacgtcgtggtcttaggatcccaggaaggtgccatgcacaccgcactgaccggtgccacggagatccagatgtctagcggcaatctcctgttcacaggccaccttaagtgccggctgagaatggataagctccagttgaaagggatgtcctatagcatgtgcaccggcaaattcaaaatcgtgaaagagatcgcggagacgcagcacgggacgatagtcatccgggtccagtacgagggcgatggctccccgtgcaagattccgttcgaaatcaccgacttagagaagcgccatgttttagggcggttaatcacggtgaacccaatagtcaccgagaaagacagccctgtcaacattgaggcggaacccccgttcggagatagttatatcattatcggagtcgaacctggccagctgaagctcaattggttcaagaaggggtcctccatcgggcagatgttcgagacgacaatgcgcggcgcgaaacgtatggcaattctaggggacaccgcctgggacttcggcagcctcgggggcgtatttacctccatcgggaaagcgctacatcaggtgtttggcgcgatctacggagcagccttctcaggggtatcctggacgatgaaaatcctaattggcgtcatcatcacctggatcggtatgaatagtcggagcaccagcctgtccgtgtcgttagtgcttgtcggtgtggtgactttatacctgggggccatggtacaggcagactccggctgcgtggtgagctggaagaacaaggaacttaagtgtggctccgggatcttcatcacggacaacgtccacacctggaccgaacaatacaagttccagcctgagtctcccagcaagctggcctccgcgatacagaaggcccacgaggaaggcatatgtgggatacgcagcgtcacacggctggagaacctaatgtggaagcagatcacgcccgaattaaaccatatcctatctgagaacgaggtgaaactgactatcatgaccggcgacattaagggtatcatgcaggccggcaagcgcagccttcggccacaacccaccgagctgaaatactcctggaagacttggggtaaggcgaagatgctcagcaccgagtcccacaaccagacctttctgatcgacggacccgagaccgcggagtgcccgaacaccaaccgcgcctggaacagcctagaggtcgaggactacggtttcggggtgttcacaaccaacatctggctcaagctgagagagaagcaggacgtgttctgcgattccaagctgatgagcgcggccatcaaagacaaccgtgcggtccacgccgacatgggatactggatcgaatcagcactgaacgacacctggaaaatggaaaaagcgagcttcatagaggtgaagtcctgccactggcccaagtcacacaccctgtggagtaatggcgtgctcgaaagcgagatgattattcccaagaacttcgccgggcccgtcagccagcacaactaccggccgggttatcacacgcagaccgcggggccctggcacctcggcaagctggagatggacttcgacttgtgcgagggcaccacggtcgtagtgactgaggactgtggcaaccgcggccccagcctgagaacgaccaccgcaagcgggaagctgattacagagtggtgctgccgctcctgcaccctgcccccgctccggtaccgcggcgaggacggatgctggtacggcatggaaattcggcccctgaaagagaaggaggagaacctggtgaacagcctcgttactgcggggcacggccagatcgacaacttctccttgggtgtgttgggtatggcactcttcctggaggagatgctgcgaactcggatcggaacgaagcatgctattctgctagtcgccgtgagcttcgttaccctgataacggggaacatgagcttccgcgacctcggcagggtgatggtgatggtcggcgcgaccatgacggacgatatcggcatgggcgtcacctacctggctctactcgccgcgttcaaggtacgtccgactttcgcagccgggctcctgctgcgcaagctgacctcgaaggagctgatgatggcaaccataggcatcgcgctcttgtcgcagagcacaatccccgagaccattctggagctcacggacgctctggctctggggatgatggtcctcaaaatcgtacgcaacatggagaagtaccagttagcggtgacgattatggccatctcttgcgtcccgaacgccgtcatcctgcaaaacgcttggaaagtgtcttgtacaatcctcgccgccgtctccgtgagcccactgcttctcacctcaagccagcagaaagctgactggatccccttagctttaaccatcaagggcttgaaccccacggcgatcttccttaccacactgtcccggaccagcaagaagagatcctggccgttgaatgaagcaatcatggccgtcggcatggtgtctatcttagcctccagcctgctcaagaacgatatccccatgacggggcccctggtggcgggcgggctgctcactgtttgctacgtgctgaccggccgctcggccgacctggagctagagagagccgccgacgtgaaatgggaggaccaggccgagattagcggcagctcccccatcttatccattacaatctctgaggacggtagtatgagtatcaagaacgaggaggaggagcagaccctgaccatcctcatccgtaccggcctcctggtcatcagcggggtgttcccggtgtctatacccatcaccgcggccgcctggtacctatgggaagtcaagaagcaaagggccggggtgctgtgggatgtgccgagtccaccgccagtcgaaaaggcggagctggaggacggggcgtatcgcattaaacagcggggcatcctcgggtactcccagatcggcgccggcgtatacaaagaggggacctttcacacgatgtggcacgtgacacgaggcgcggtcctgatgcaccgggggaagaggatcgagccctcatgggccgacgtgaaaaaggatctgatctcctatggcgggggttggaagttggaaggcgagtggaaggagggggaggaggtccaggtccttgccttagagcccggcaagaacccccgggcggtccagacaaaacccgggatcttcaagaccaacacgggcaccataggggccgtttcattggatttctcccccggcacctctggctcccccatagtcgacaggaaagggaaagtggttggcttatatggtaacggggtggtcacccggagcggcgcctacgtgtccgccatcgcccaaacggaaaagagcatcgaagacaaccccgagatcgaggacgacatattccgcaagaagaggctgaccattatggatctacacccaggggccggaaagaccaagcgctacctgccagccatcgtccgggaagccatcaagcgtgggctgcgtaccctgatcctcgccccgacgcgagtggtggccgcagagatggaggaggccctgcgcggactgcccatccggtaccaaacccccgccatcaagacgcagcataccggtagggagatcgtcgacctcatgtgccatgccacgttcacgatgagattgctcagcccagttcgtgtgcccaattacaacctcatcattatggacgaagcgcatttcaccgacccagcctccattgccgccagagggtacatctcgacacgcgtagagatgggcgaggctgcgggtatcttcatgaccgccacgccacccggctcccgcgacccgttcccccagtcaaacgccccgatcatggatgaggagcgcgagatccctgagaggtcctggaactctgggcacgagtgggtgaccgacttcaaaggcaagaccgtgtggttcgtgccgtctataaaagctgggaacgacatagcagcctgtctgcgcaaaaacggcaagaaggtgatccagctgagcagaaagaccttcgactcagagtatgtgaagacacgcgcaaacgattgggacttcgtcgttaccaccgatatcagcgaaatgggagccaacttcaaggccgagagggtgattgacccccgccggtgcatgaagcccgtaatcctcacggacggggaagaacgcgtgatattggcggggcccatgcctgtaacccattccagcgccgcgcagcggcgcgggcggatcggccggaatcccaaaaatgagaacgaccaatacatttacatgggtgagcccttggagaacgacgaggactgcgcccactggaaagaggccaaaatgctcctcgacaacattaatacccccgagggcatcatcccgtccatgttcgagcctgagcgcgagaaagtcgacgccatcgatggcgagtaccggctgcgcggagaggcccggaagacattcgtggacctgatgcgcagaggcgacctgccagtgtggctggcgtacaaagtcgccgccgaaggaataaactacgcagatcgcaagtggtgcttcgatggcatcaaaaacaaccagatcttagaagagaacatagaggtcgagatctggaccaaggagggcgagaggaagaaacttaagccccgctggttggatgcccggatctactccgaccccctcgccttgaaggagttcaaagagtttgcggcgggccgcaagtccctgaccttaaatctgataacagaaatggggcggcttcctacattcatgacgcaaaaggccagaaacgccctcgacaacttggccgttctgcatacggcagaggccggaggccgggcctacaaccacgcgctcagcgagctccccgagacgctggagaccctcctactgctcactttactggctaccgtcaccggaggcatcttccttttcctgatgtccggtaagggggtgggcaagatgactctggggatgtgctgcatcatcacggccagcatcctactctggtatgcacagatccaaccccactggatagccgcaagtatcatcttagagttcttcctcatcgtactgctgatccccgaaccagagaagcagcgcacgccccaggataaccagctcacatacgtggtgatcgccatcttaaccgtggtggccgcgacaatggccaacgagatgggtttcctggagaagacgaagaaggacctcgggctgggctccatcaccacccaggagagcgagtccaacattctggacatcgatttgcggcccgccagcgcttggaccctgtatgcggtcgccactacttttgtcaccccaatgctgcgacactccatcgaaaattcatctgtgaacgtgagcctaaccgccatagccaatcaggcgacggttcttatgggactcgggaagggctggccactcagcaaaatggacataggcgtgcccctgctagcgatcggttgttatagccaggtgaacccgataacactgaccgccgccctgctgttgctggtcgcacactacgccatcatcgggcccggactacaagcgaaggcaacccgcgaggcgcaaaaacgggccgcggcgggcattatgaagaaccccaccgtggacggaatcaccgtcatcgacctcgagcccataccgtatgaccccaagttcgaaaagcagctgggccaggtcatgctgctcatactgtgcgtaacccaggtgctgatgatgcgtaccacgtgggctctatgcgaggccctgacgctggccacagggcccatttctactttatgggagggaaacccaggcagattctggaacacgaccatcgcagtcagcatggcaaacattttccggggaagctacctggctggtgccggcctcctgttttcgatcatgaaaaacaccaccaacacgcgaaggggcaccgggaacatcggcgagaccctgggagagaagtggaagtcccggttaaacgcgctaggcaagtctgagttccaggtgtataagaagtcgggaatccaggaagtggaccgtacgctggcgaaagaggggataaagcggggcgaaacggaccatcacgccgtctctcgcggatccgccaaacttcggtggttcgtggagcgcaacatggtgacgccggagggcaaggtcgtggacctcggctgtgggcggggcggttggtcctactactgcggcgggctgaagaatgtgcgagaagtaaaagggctgaccaagggcgggcccggccatgaagaacctatccccatgagcacctacgggtggaacctcgtgcgcctgcaaagcggcgtggacgtcttcttcactcctcccgaaaagtgcgataccctcttgtgcgacatcggggagagctccccgaatcccaccatcgaggccgggagaaccctccgtgttctcaatctcgtggagaactggctcaacaacaatacccaattctgtatcaaggtcctgaacccgtacatgccttccgtgatcgagaaaatggaagccctccagcgcaagtacggcggggcgttagtgaggaacccactgagtcgcaacagcacacatgagatgtactgggtctcgaacgccacgggtaacatagtgagctcggtgaacatgataagccggatgctgatcaatcgcttcaccatgaagcacaagaaggcgacgtacgagcctgacgtcgatttggggtcaggcacgcggaacatcgggattgaaagcgagatcccaaacctggatatcatcggcaagcgaatcgagaagatcaagcaggagcacgagacaagctggcactacgaccaggatcacccctacaagacctgggcttaccacggctcatacgagaccaagcagacagggtcggctagctcgatggtgaacggcgttgtccggctgttgaccaaaccctgggatgtggttccgatggttacccaaatggctatgaccgacacaacgcccttcggtcagcagcgcgtgttcaaggagaaggtggacacccgcacgcaggagcctaaggaaggcacgaagaagctaatgaagatcaccgccgaatggctgtggaaggaactaggcaagaaaaagacgccgcggatgtgcactcgtgaggagttcactcgcaaggtccgcagcaacgccgccctgggggccattttcaccgacgagaacaaatggaagtcggcgcgagaggccgtggaggatgggcgattctgggaactggtggaccgagagagaaacctccacctggaagggaaatgcgagacctgcgtctacaacatgatgggcaagcgggagaagaagctgggggagttcgggaaggccaagggcagccgtgccatctggtatatgtggctaggggcccggtttctggagttcgaggcactgggcttcttaaacgaggaccattggttctcgagggggaacagcctgagtggcgttgagggggaaggtctgcatcgcctcggctacatcctgcgggacgtcgggaaaaaggagggcggggccatgtacgcagacgataccgccggctgggatacgcggatcaccttagaggacctcaagaacgaggaaatggttactaaccacatgaagggggagcacaagaaacttgctgaggctatctttaaactgacctaccaaaacaaggtggtccgcgttcagagaccgacgccccgcggtaccgtgatggacattatcagtcggcgtgaccagcggggtagcgggcaggtcggtacttacggactcaacacctttacgaacatggaggcccagctcatccgccagatggagggcgaaggaatctttaagtccatacaacacttaaccgccacagaagagatcgcggtgcaaaactggttggcacgcgttggtcgagagaggttgagccgtatggccatctcgggcgacgactgcgtggtgaagccgatcgacgacagatttgcctcagccctaaccgccctcaacgacatggggaaggtccggaaagacatccagcaatgggaaccctcccgcggttggaacgactggacgcaagtgccattctgtagccaccacttccacgagctggttatgaaggatggccgggtgcttgttgtcccctgccgtaaccaggatgagctcatcggccgggcgcgcatttcacaaggagccggatggtcgctgaaagaaaccgcctgccttggtaaaagctacgcgcagatgtggaccctcatgtacttccaccgccgtgaccttcgactggccgctaacgccatctgcagcgccgtgccgccccactgggtcccgacctcccggactacgtggtcaattcacgccaagcatgagtggatgacaaccgaggacatgctcgcggtgtggaaccgggtatggatccaggaaaacccctggatggaagacaagacgcccgtagagagttgggaggaggtaccctatttggggaaaagagaggaccaatggtgcggcagcttaatcgggctcacttcccgggccacctgggccaagaatatccagaccgccatcaaccaggtgcgcagcctgatcggcaacgaggagtacaccgactacatgccgagtatgaagcggttccgcagggaggaggaggaggctggagtcttgtggtag

SEQ ID NO: 25002 - RNA, 9876 nt, synthetic construct
  misc_feature 1..9876: note = derived and/or modified CDS sequence (opt11) from DENV-2__GU131955__SS-prME
  source 1..9876: mol_type = other RNA
accgcaggcgtgatcgtgatgctaatcccaaccgtgatggctttccacctcaccactcggaacggggagccccacatgatcgtgggccggcaggagaaggggaagtccttactgtttaagaccgaggacggagtcaacatgtgcaccctcatggctatcgacctgggggaactgtgcgaggacacgatcacctacaagtgccccctcctgcgccagaacgagcctgaggacatcgactgctggtgcaactccactagcacttgggtgacctacggaacctgctccaccaccggcgagcacaggcgcgagaaacggagcgtggccctggtcccacacgtcggaatgggcctcgagacgcgaaccgagacgtggatgagcagcgagggggcatggaagcacgttcagcggatcgagacctggatactgcgccatcccgggtttactatcatggccgctatcctggcgtacactatcgggaccacccacttccagcgggccctcatattcatcctgctgactgcggttgcccctagcatgaccatgcgctgcattggcatcagcaaccgggacttcgtggagggcgtgtccgggggcagctgggtggacatcgtgctcgaacacgggtcctgcgtgacaacgatggcgaagaacaagcccaccctcgacttcgagctgatcaagaccgaggccaagcagcccgccacactccgcaagtactgcattgaggctaagctgaccaacaccaccaccgagagtcgctgtccgacccagggcgagccctccctgaacgaggagcaggacaagcgcttcatttgtaagcacagcatggtcgaccggggttggggcaacggctgcggcttgttcggcaagggcggtatcgtgacgtgcgctatgtttacttgcaaaaagaatatggagggcaaagtggtccagcctgagaacctggaatacaccatagtgatcacgccccattccggggaggaacacgccgtgggcaacgatacagggaagcacggcaaagagatcaagatcaccccgcagtcctccatcactgaggccgaactcaccggctacggcactgtcacgatggagtgcagccctcgaacaggcctcgacttcaacgagatggtgttgctgcagatggaggacaaagcgtggctcgtacatcgccagtggttcttagacctaccgctcccctggttgccgggtgcggacacgcagggctccaactggatccagaaggagaccctggtcacgttcaagaacccccacgccaagaagcaggacgtggtcgtgttggggagccaagagggggcgatgcacaccgccttaacgggtgccaccgagatccagatgagctccggcaacctcttgttcacgggacacctgaagtgccgtctgcggatggacaaactccagctgaagggcatgagctacagtatgtgtaccggcaagttcaagattgtgaaggagatcgccgagacccagcacgggaccatcgtcatccgcgtgcagtacgagggcgacggtagcccctgcaagatccctttcgaaataaccgacctagagaagaggcacgtactcgggcgcctgattaccgttaaccctattgtgaccgagaaggactcccccgtgaacatcgaagccgagccgcccttcggcgacagctacatcatcatcggggtcgagccgggtcagctaaaactcaactggttcaagaaggggtccagcatcggccagatgttcgagacaacgatgcgcggcgcaaagcggatggcgattttaggggacaccgcctgggacttcggctcccttgggggcgtgtttaccagcatcgggaaggccctccaccaagtgttcggcgccatatacggcgcggccttctccggggtcagctggaccatgaagatactgatcggcgtgattatcacgtggatcgggatgaactcccgcagcacctctctgagcgtgtccctggtcctcgtaggcgtggtcaccttatacctcggggccatggtgcaggccgacagcggctgcgtggtctcctggaagaataaggagttaaagtgcggaagcgggatcttcatcaccgacaacgtgcacacgtggaccgagcagtacaagttccagcccgaaagcccctccaagctggcaagcgccatccagaaggctcacgaggagggcatctgcgggatccggtccgtcaccagactggagaacctcatgtggaagcaaatcacccccgagctgaaccatatattatctgagaacgaggtcaagctcacgattatgaccggagacataaaggggatcatgcaggccggcaagcggtccctgcgcccacagcccaccgaactgaagtattcatggaagacctggggcaaggccaaaatgctctccacggagagccacaaccagacgttcctgatcgatgggcccgagaccgcggagtgcccgaacaccaaccgggcctggaactccttagaggtagaggactacgggttcggggtgttcacgactaacatctggctcaagctgcgcgagaagcaggacgtcttctgcgacagcaagctgatgtccgccgctatcaaagacaatagagctgtgcatgcggacatgggctactggattgagagcgccctcaacgatacctggaagatggagaaagcctccttcatcgaggtcaagagctgccactggcccaagtcccacacactgtggagcaacggcgtgctggagtccgaaatgattatccccaagaacttcgccgggcccgtaagccagcacaactaccgcccgggctaccatactcaaacggccgggccttggcatctcggcaagctggagatggactttgatctgtgtgaaggaaccactgttgtcgtgaccgaggactgcggcaaccggggccccagcctccgcacgaccaccgcgtcggggaagcttatcaccgaatggtgctgccggagctgtacgctgccgccgctacgataccggggggaagacgggtgctggtacgggatggagatccgccccctgaaggagaaggaggagaaccttgtgaactccctcgtcaccgcaggacacggccagatcgacaactttagcctgggtgtgctggggatggccctcttcctggaggagatgctgcggacccgcatcgggacaaagcacgccatcttgctggtggcagccagtttcgttacgctgatcaccggtaacatgtccttccgggacctcggtcgcgtgatggtgatggtcggcgcaaccatgaccgacgacatcggcatgggagtgacttatctggctctgctcgccgcttttaaggtgaggcccaccttcgccgccgggctgctgctccggaagctgacctccaaggagctgatgatggcaaccattggcatcgcgctcctgagccagtccacgatcccggagaccatcctggagctcaccgacgcgctggcactagggatgatggtcctcaagatcgtccgcaacatggagaagtaccagctggccgtgaccatcatggccatcagctgcgtccccaacgcggtgatcttacaaaacgcatggaaggtgagttgcacgatcttagccgccgtcagcgttagccccctgcttctcaccagctcccagcagaaagccgactggattcccctggcgctgaccattaaaggcctcaacccgaccgccattttcctgacgaccctgagccggactagcaaaaagcgcagctggccgctcaacgaggccgtcatggcagttggcatggtgtccatcttagccagcagcctgctcaagaatgatatccccatgaccgggccccttgttgcgggcgggttactcactgtgtgttacgtgctgactggccggtccgccgacctggagctcgagcgcgccgccgacgtcaagtgggaggaccaggccgagatcagcgggtccagccccatactgtccattacaattagcgaggacggctccatgtcaatcaagaacgaggaggaggagcagaccttgacgatcctcatccggacgggactgctcgtgatctccggggtgttcccggtcagcatccccattacagcggccgcctggtacctctgggaagtgaagaagcagcgcgccggggtgctgtgggacgtccccagcccgccgcccgtggagaaagccgaactggaggacggcgcgtaccggatcaagcagcgcggcatcctcgggtacagtcagatcggcgccggcgtgtacaaggaggggacctttcacaccatgtggcacgtaacgcggggcgcagtgctgatgcacagggggaagcggatcgagccctcgtgggccgacgtcaagaaggacctgatcagttacggcgggggctggaagcttgagggcgagtggaaggagggggaggaggtccaggtgctggccctggagcccggcaagaatccccgcgccgtgcagaccaagcccggcatctttaaaaccaacaccggcacgattggggctgtcagtctcgacttttccccagggacctccggcagccccatcgtggaccgtaaggggaaggtagtcggcctgtacgggaacggcgttgtgacgcgctccggcgcctacgtcagcgccatcgctcagaccgagaaatcaatagaggacaatccagaaatcgaggacgacatcttccggaagaagcgcctgacgatcatggacctccaccccggggctggtaaaaccaagcggtacctgccagccatcgtgagggaagccattaagagagggctgaggaccctgatcctcgccccgacacgcgtggtcgcggccgagatggaggaggccctgcgggggctgcccatccggtaccaaacgcccgctataaagaccgagcacacgggcagggagatcgtggacctcatgtgccacgccaccttcacgatgcgcctgctgtcccccgtgcgggtcccgaactacaacctcataatcatggacgaggcacacttcaccgaccccgcgagcatcgccgcacgcggctacatttccacccgggtggagatgggcgaggccgcggggatcttcatgactgccacgccgccgggaagccgcgacccgttcccgcagagtaacgcccccataatggacgaggagagggagatcccagagcgcagctggaactccgggcacgagtgggtgaccgactttaaggggaagaccgtctggttcgtgccgagcattaaggccggcaacgatattgcggcttgcttgcgaaagaatggcaagaaagtgatccagctttcccgaaagacgtttgacagcgagtacgtcaagacccgggcaaacgactgggacttcgtggtgactaccgacatctccgagatgggcgcaaatttcaaggccgagcgcgtcatcgacccccggcgctgcatgaagcctgtcattctcaccgacggggaggagcgggtgattctggcgggcccaatgccggtcacgcacagctccgccgcccagcgtcgggggcgcatcggtcggaatcccaagaacgagaacgaccagtacatctacatgggggagcctctcgagaacgatgaggactgcgcccactggaaggaggccaagatgttactagacaacatcaacaccccagagggcatcatcccgagcatgttcgagcctgagcgtgaaaaggtggacgcaattgacggagagtaccgccttcgcggggaggcccgcaagaccttcgtggacttaatgcggaggggcgacctgcccgtatggctggcatacaaggtggctgccgaagggatcaactatgcagaccggaagtggtgcttcgacggtatcaagaacaaccagatcctcgaggagaacatggaggtggagatatggacgaaggagggggaacgcaagaagctgaagccgagatggctggacgcccgaatatactccgacccccttgcccttaaggagtttaaagagttcgccgcgggtcgcaagagcctgacgctcaacctgatcacggagatgggacgcctgcccaccttcatgacccagaaggcccggaacgccctcgacaatctggctgtcctgcacacggcagaggccgggggccgcgcctacaaccacgccctttccgagctgccggagacactggagaccctcctgctactcacactgctggccacggtgacggggggcattttcctctttctgatgagcggcaagggcataggtaagatgaccctgggaatgtgctgcatcatcaccgcctccatccttctgtggtacgcgcagatccaaccacactggatcgccgcctcaatcatcctggagttctttctcatcgttctcctgatccccgaacccgagaagcaacggaccccgcaagacaaccaactcacgtacgtggtgatcgctatactgaccgtcgtggccgcgaccatggccaacgagatgggtttcttagagaagaccaagaaggacctcggtctgggctcaatcacgacccaggagagtgagagcaatatactggacatcgacctccgcccggcctcagcctggaccctgtacgccgtggcgaccacgttcgtcacgccaatgctgcggcattccatcgagaactccagcgtgaacgtgtccctcaccgccatcgcaaaccaggcgaccgtcctgatgggcctggggaagggctggcccctcagcaagatggacataggtgtgcccctgctggcaatcggatgttatagtcaggtcaacccgatcacgctcaccgccgctctgctgctcctggtcgcccactacgccatcatcggtcccggactgcaggcgaaagccacccgcgaggcacagaagcgggccgccgcgggcatcatgaaaaacccgacagtggacggaataacggtgatcgatctcgagcccataccgtacgaccccaagttcgagaagcagctgggtcaggtcatgctgctcatcctgtgcgtgacccaggtgctgatgatgcgcaccacctgggccctctgcgaggcccttacgctggccacagggcccatcagcaccctctgggagggcaaccccgggcggttctggaacacaacgatcgccgtctctatggcgaatatcttcagaggaagctacctggccggcgccggactcctattctccatcatgaagaataccactaacacccgccggggcacggggaatataggcgaaaccctgggtgaaaagtggaagtcccgcctgaacgcgctcgggaagtccgagtttcagatctataaaaagtccggcattcaggaggtagatcggaccctggcgaaagagggaataaaacgcggcgagaccgaccaccacgcggtgagtagagggagcgctaagctgcgctggttcgtcgagcggaacatggttacgccggagggcaaggtggtcgacctcggctgcgggcgcggcgggtggtcctactattgcggcgggctgaaggacgtgcgggaggtgaagggcttaaccaagggggggccaggccacgaggagcccatccctatgagcacctatgggtggaacctcgtccgactccagtcaggtatcgatgtgttcttcaccccgcccgaaaaatgcgacacgctgctctgcgacatcggcgagtcatcacccaaccctaccatcgaggccggccggaccctgcgcgtgctgaacctcgtggagaattggctgaacaataatacccagttctgtatcaaggtgctgaacccgtatatgccctccgtgatcgagaagatggagaccctccagcggaagtatggcggggccctcgtccgcaaccccctgagccggaactccacgcacgagatgtactgggtgagcaacgcgaccggcaacatagtgagttcagtaaacatgatctcccgcatgctgatcaaccggttcacgatgaagcacaagaaagccacttacgaaccagacgtggacctcggaagcggcacgaggaacatcgggatcgagtccgagatcccaaacctggacatcatcggcaagcggatcgagaagataaagcaggagcacgagacatcatggcactacgaccaggaccacccgtacaagacctgggcttaccacggctcctacgagaccaagcaaacgggtagtgcatccagcatggtgaacggcgtagtgcgcttactcaccaagccctgggacgtggttcccatggtgacccagatggccatgaccgacacgacccccttcgggcagcaacgcgtgttcaaagaaaaggtagacactcgtacccaggagcccaaagagggcacaaagaagctgatgaagatcaccgcggagtggctgtggaaggagctcgggaagaagaagacgccacggatgtgcacccgggaggagttcacgcgtaaagtgcggagtaacgccgccctgggtgccatcttcaccgacgagaacaagtggaagagtgcgcgcgaggcagtggaggacggccggttctgggagctggtcgaccgtgagcggaacctccacctggaggggaaatgcgagacctgcgtgtataacatgatgggcaaacgcgaaaagaagctgggcgagttcggcaaggccaaggggagccgggccatctggtacatgtggctcggggcccgcttcctggagttcgaagcgctgggcttcttgaacgaggaccattggttcagccgggggaacagcctgtccggcgtggagggggagggcttgcaccgcctaggctacatcctgcgggacgtcggcaagaaagagggcggggccatgtatgccgacgacaccgccggctgggacacacgcatcaccctggaggacctcaaaaacgaggagatggtgactaaccatatgaagggggagcacaagaagttagccgaagcaatctttaagctgacctaccaaaacaaagtcgtgcgggtgcagcgcccgacgccacgggggaccgtaatggacatcatcagccgccgggaccagcgcggctccggacaggtgggcacctacggcctcaacaccttcacgaacatggaggcccagctgattcgccagatggagggcgagggcatcttcaagtctatacagcacctgaccgccacggaggagatcgccgtgcagaactggctcgcccgggtggggcgcgagcggctgtcccgcatggcgatcagcggcgacgactgcgtggttaagcccattgacgacaggttcgcatccgctctgactgccctcaacgacatggggaaggtccgcaaggatatccagcagtgggagcctagccgcggatggaacgactggacgcaagtgccgttctgctcccaccacttccacgagctggtgatgaaggacggacgcgtcctggttgtgccctgccggaatcaggacgaactcattggccgggctcggatcagccagggcgccgggtggtccttaaaagagactgcttgcctgggcaagagctacgcccagatgtggaccctcatgtactttcaccgccgggacctgcgcctggccgccaacgcgatatgttccgccgtccccagccactgggtccccacctcccggaccacatggagcatccacgccaaacacgagtggatgaccaccgaggacatgctcgcagtgtggaaccgcgtctggatccaggagaacccgtggatggaggacaaaacacccgtagagtcctgggaggaggtgccctacctggggaagcgtgaagaccagtggtgcggtagcctgatagggttgacttctcgcgcgacatgggccaagaacatccaaacagccatcaatcaggtcaggtcactgatcggtaatgaggagtacaccgactacatgccgtcaatgaaacgctttcgcaaggaggaggaagaggccggcgtgctgtggtag

SEQ ID NO: 25003 - RNA, 9876 nt, synthetic construct
  misc_feature 1..9876: note = derived and/or modified CDS sequence (opt11) from DENV-2__KJ189311__SS-prME
  source 1..9876: mol_type = other RNA
accgctggcgtgatcgtcatgctgatcccgacagtgatggcgttccatttgaccactcgtaacggcgagccgcatatgatcgtgggcagacaggagaaaggtaagtcgctgctgtttaagaccgaagacggcgtcaacatgtgcaccctcatggcgatagacctgggagagctgtgcgaagacacaatcacctacaaatgccccctccttcgccagaacgagcccgaggacatcgactgttggtgcaactcaaccagcacctggatcacatacgggacctgctccactaccggtgagcaccggcgggagaagcggagcgtagccctggtgccccacgtcgggatgggtctcgagactcgcaccgagacctggatgtccagcgaaggtgcctggaagcacgtgcagcggatcgagacctggatcctgcgccacccgggcttcaccatcatggcagccatcctcgcgtacaccatcggtaccacccacttccaacgcgcgctcatcttcattctactaactgccgtagcaccctccatgaccatgcgctgcatcggcatcagcaaccgggacttcgtcgaaggcgtgtccgggggctcttgggtggacatcgtcctcgaacacgggtcctgcgtgaccaccatggcgaagaacaagcccacgttagacttcgagctgattaagaccgaggccaagcagcccgccaccctccgaaagtactgcatagaggcgaagctgaccaacacgaccactgagagccgatgcccaacacagggtgagcccagcctgaacgaggaacaggataagcgcttcatctgcaagcacagcatggtggaccgggggtgggggaatggctgcgggctgttcggaaaagggggaatcgttacgtgcgccatgttcacgtgtaagaagaacatggagggcaaggtggtgcagcccgagaacctggaatacaccatcgtcataacgccacattccggggaagagcatgcggtgggcaacgacacggggaagcatggcaaagagatcaagataacgccgcagagctccatcaccgaggccgagcttactgggtacggtaccgtgacgatggaatgcagccctcgcaccggcctcgacttcaacgagatggtcctactgcaaatggaggacaaggcctggctcgtacatcggcagtggttcctggacctgcccctgccctggctgccgggtgccgacacgcagggctccaactggattcagaaggagacgctggtcacgttcaaaaacccccacgccaagaagcaggatgtcgtggtcctcggaagccaggagggtgcgatgcacaccgccctgaccggagctaccgagatacagatgtccagcggcaacctcctgttcacgggccacctgaagtgccgtctgcggatggacaagctccagttaaaagggatgagctactccatgtgcaccggcaagttcaagattgtgaaggagatcgccgagactcagcacgggaccatcgtgatccgcgtccagtacgagggagacggaagcccatgcaagataccgttcgagatcacggaccttgagaagaggcacgtcctcgggcgcttgatcaccgtgaacccgatcgtcaccgaaaaggattcccccgttaacatcgaggccgagccgcccttcggcgacagctatataataatcggggtggagccgggtcagctgaagctcaattggttcaagaagggatccagcatcggtcagatgttcgagaccacaatgcgcggcgcgaagcgcatggccatcctgggggacaccgcctgggacttcggctctttaggtggggtctttaccagcatcggcaaggctctccaccaggtgttcggggccatctacggcgcggccttctcaggggtgagctggaccatgaagatcctgatcggcgttatcatcacgtggatcgggatgaactcccggagcacctccctgagcgtgagtctggtgttggtcggggtggtgatcctatatctgggggccatggtccaggccgacagcggctgcgtcgtgtcctggaaaaacaaggagctcaaatgcggcagcggtatcttcatcaccgacaatgtccacacttggacggagcagtacaagtttcagcccgagagcccctctaagctggcgagcgccatccaaaaggcccacgaggagggcatctgcgggatccggtcggtgaccagactggagaacctcatgtggaagcagatcactcccgagctgaaccacatactgagcgaaaacgaggtgaagctcaccatcatgacgggcgatataaaaggaatcatgcaggcaggcaagcggtccctgcgccctcagcccaccgagctgaagtacagttggaaaacctggggaaaggccaaaatgctctccaccgagtcgcacaaccagacgttcctgattgacgggccggagaccgcggagtgtccgaacaccaaccgtgcttggaactccctggaggtcgaggactacggcttcggggtcttcaccacgaacatttggcttaagctgcgtgagaagcaagatgtgttctgcgattcaaagctgatgtctgccgccatcaaggacaaccgggcggtccacgcggatatgggctactggatcgagagcgccctcaatgacacctggaagatggagaaggcctccttcatcgaggtcaagagctgccactggcccaagtctcacaccctgtggagcaacggcgtactggagtccgagatgatcatccccaagaacttcgccgggcccgtgagtcagcacaattaccgcccgggctaccacactcaaaccgccgggccctggcacctcggcaagctggagatggacttcgacctgtgcgaggggacgaccgtagtggtcaccgaggactgcggcaacaggggccccagcctccgcaccacgaccgcgtccgggaagctgatcacggagtggtgctgccgatcatgcaccctgcccccgctccggtatcggggcgaggacggatgctggtacggcatggagatccgccccttaaaggagaaggaggaaaacttggtgaattccctggtgacggccggtcacggccagatcgacaacttcagcctgggggttctcgggatggccctgttccttgaggagatgctgagaacgcgcatcggaacaaagcacgccatcctcctggtcgcggcatcattcgtgaccctgatcacggggaacatgagcttccgggacctcggaagagtgatggtgatggtgggggccaccatgaccgacgacatcgggatgggagtcacctacctggccctgttggccgcgtttaaggtgagacccacgttcgccgccgggctgctactccggaagctgacatccaaagagctcatgatggccaccatcggaatcgccctcctgagccagtcaacaatcccagagagcatcttggagctgacggacgcgctggccctgggcatgatggtcctcaagatcgtccgcaacatggagaagtaccagctggcagtgaccatcatggccatatcctgcgtcccgaacgccgtcatcctgcagaacgcgtggaaagtgagctgcactatcctggccgcagtgtcggtctcacctctgctactaacgtccagccagcagaaggccgactggatccccctggcgttgacgatcaagggcctcaatcccaccgccattttcctgacaacactgtcccggacgagtaagaaacgctcatggccactcaacgaggccgtgatggcagttggcatggtgagcatcctggcaagctccttgctcaagaacgacatccccatgacaggacccttagtggcgggcgggctgctcaccgtctgctatgtgctgaccggccggagcgccgaccttgagctcgagcgtgccgccgacgtgaaatgggaggatcaggccgagatctccgggagcagtcctatactgagtatcacaatctccgaagatggaagtatgtccatcaagaacgaggaggaagaacagaccctgaccatcctcattcggaccggcctgttagtcatcagcggtgtgttcccggtgagtatccccatcacagcggcggcctggtacctttgggaggtcaagaaacaacgcgccggcgtgctgtgggacgtccccagcccgccccccgtggagaaggccgaactggaggatggggcttaccggatcaaacagcgcggcatcttagggtactcccagatcggcgccggcgtatacaaggagggaaccttccatacgatgtggcatgtgacccggggcgccgtcctgatgcaccgcgggaagcggatagagcccagctgggccgacgtgaaaaaagacctgatctcctacggtggtggatggaagctcgagggcgagtggaaggaaggggaagaagtgcaggtccttgccctggagcctggcaagaacccccgcgcggtacaaaccaagcccggtatattcaagacgaacaccggcacgatcggtgcggtgagcctcgacttctccccgggcactagcgggtcccccatcgtcgaccggaagggtaaggttgtggggctgtacggaaatggcgtcgttacgaggagcggcgcctatgtaagcgccatcgcgcagaccgagaagtccattgaagacaacctggagatagaggacgacatcttccggaagaagcgactcacaatcatggacttgcacccgggggccggcaagaccaagcggtacttgcccgcgatcgtacgcgaggccatcaagcgggggctgcgcacgctcatactggccccgacccgcgtggtggcggccgagatggaggaggcccttcggggcctccccatccgctaccagacccctgccatcaagaccgaacacacgggccgggagatcgtcgacctgatgtgccacgccaccttcaccatgcgcctgctcagccccgtgagagtgcccaactacaacctgataattatggacgaagcgcactttaccgacccggcctccatagcagcgcgcggttacatcagcacaagagtcgagatgggcgaggccgccgggatcttcatgacggcgacgcctcccggtagccgcgaccccttcccgcagagtaacgcccccatcatggacgaggagcgggagatccccgaacgctcctggaacagcggacacgagtgggtgaccgacttcaagggcaagacggtgtggttcgtcccctccatcaaggctgggaacgatatcgcggcctgcctccggaagaacggtaagaaggtgatccagttgagccgcaagacctttgacagcgagtatgtgaagactcgggccaacgactgggatttcgtggttaccacggacatcagcgagatgggcgccaacttcaaagccgagcgcgttatcgatccgcggagatgtatgaagccagtcattcttaccgacggggaggaacgggtgattctggcgggccccatgcccgtcactcattccagcgccgcccagcgacgcgggcggatcggccgcaacccgaagaacgagaacgaccagtacatctacatgggagagcccttagagaacgacgaggactgcgcccactggaaagaggctaagatgctgctggataacatcaacactcccgagggaatcatcccctccatgtttgagcccgaacgggagaaggtcgacgcgatcgacggagagtaccggctccgcggggaagcccgaaaaacgttcgtcgacttaatgcggagaggcgacctgcccgtgtggctcgcctacaaggtcgctgccgaggggatcaactacgcagacagaaagtggtgtttcgacggcatcaagaacaaccagatcttggaggaaaatatggaggtggagatctggactaaggagggggagcgcaaaaaactgaaaccccggtggctcgacgcacgcatctacagcgacccgctggccctgaaggagttcaaggaattcgccgcgggccggaagtccctcaccctcaacctgatcaccgagatgggcaggctccccacgttcatgacccagaaggcccggaacgccctggataacctggccgtgctccacaccgccgaggcgggaggtcgggcctacaatcacgcgctgagcgagctgcccgaaaccctcgaaacgctcctgctcctgaccctgctcgccaccgtcaccgggggaatattcctgttcctgatgtccggcaagggtataggaaagatgacgctaggaatgtgctgcatcatcaccgccagcatcctgctgtggtatgcgcagatccagccccactggatcgccgccagcatcatcctcgaattcttcctgatagtgctgcttatcccggagcccgagaagcagcgaacgccccaggacaaccagctgacctacgtcgtgattgccatccttaccgtggtcgcggcgacgatggcaaacgaaatgggcttcctggagaagaccaagaaggacctgggactgggctccataaccacccaggagagcgagtccaatatcctcgacatcgacctgcgccccgcgagcgcgtggactctgtatgccgtggcgaccaccttcgtgacaccgatgctccggcactccatcgagaatagctcggtcaatgtgagcctgacggccatcgcaaatcaagccacagtgctgatgggcctcgggaaaggctggcccctgtccaagatggacatcggggtccccctgctggcgattggctgttacagccaagtgaaccccatcaccctaactgctgccttgctcctgttggttgcccattacgccatcatagggcctggcctccaggcgaaggccacgcgcgaggcccaaaagcgggccgcagcgggaatcatgaagaaccccaccgtcgatgggatcaccgtgatcgacctggaacccatcccctacgatccgaagttcgagaagcaactgggccaggtgatgctcctgatcctgtgcgtcacccaggtgctcatgatgcgcacgacctgggcattatgcgaagcgttgaccctcgcgaccgggcccatctccacgctttgggagggcaaccccggtcgtttttggaacactacgattgccgtgagcatggcgaacatcttccgcggctcttacctggccggtgcggggctcctgttcagcatcatgaaaaacaccaccaacacccgccggggcaccgggaacatcggcgagaccttgggcgaaaagtggaagtcgcgcctcaacgccttgggcaagagcgagttccagatatacaagaagtccggcatccaggaggtcgaccgcacgttagctaaagaggggatcaagcgcggcgagaccgaccaccacgccgtgagccgcgggtcggccaagttacggtggttcgtggagcggaatatggtcacccccgagggcaaggtggtggacctcggctgtgggcgcggcggatggagctactactgcggcgggctgaaggatgttagggaggtgaagggcttgaccaagggcgggccgggccacgaagagcctatccccatgagcacgtacgggtggaacctggtgcgactgcagtcaggcatcgacgtcttctttacgccccccgagaagtgcgatacccttctgtgcgacatcggggagtcgtcacccaaccccactatagaagctggccggacgctgcgggtgctcaacctcgtggagaactggctgaacaacaacacacagttctgcatcaaggtcctaaatccatacatgccgagcgtcatcgagaagatggaaaccttacagcggaagtacgggggggcactggtaaggaaccccctgtcccggaactctacacacgagatgtactgggtctcgaacgcgaccggtaacatcgtaagctccgtgaatatgatcagccgcatgctcatcaaccggttcacgatgaaacacaagaaagccacctacgagcccgacgtcgacttggggtccggcacccgcaacatcgggatcgagagcgagatcccgaacctggacatcatcggcaagcggattgagaagatcaagcaagagcacgagacatcctggcactacgaccaggaccacccgtacaagacgtgggcctaccacggatcatacgagaccaagcaaaccgggtccgcaagctccatggtaaacggggtggtccgcctcctcaccaagccatgggacgttgtacccatggtcactcagatggccatgaccgacaccaccccgtttgggcagcagcgcgtattcaaggagaaggtggacacgcggacccaggagcctaaggagggcaccaagaagttgatgaagatcaccgcggagtggctctggaaggagttaggcaagaagaagacgcccaggatgtgcacgcgggaggagttcaccagaaaggtgcgaagcaacgcagccctgggggccatattcaccgacgagaacaagtggaagagtgcccgcgaggctgtggaggacgggcgattctgggagctcgtggatcgggagcggtcgctgcacttggaaggaaagtgtgagacgtgtgtctacaacatgatgggcaagcgcgagaagaagctcggtgagttcggcaaggccaaaggaagccgggccatctggtacatgtggctgggcgcccgtttcctggagttcgaagcactcggcttcctgaacgaggaccactggttctcacggggtaacagcttgtccggcgtggagggggaaggcctccatcgcctggggtacattctgcgggacgttgggaaaaaggaaggcggggccatgtacgccgacgacacagccggctgggacacccgcatcaccttggaggacctgaaaaacgaggagatggtcacgaaccacatgaagggggagcataagaagttggccgaggctatctttaaactaacttaccagaacaaggtggtccgggtccagcgccccaccccccggggaaccgtgatggatatcatcagccgccgcgaccagcgcggctccggtcaggtaggaacgtacgggctgaacaccttcaccaacatggaggctcagctgatacgccagatggaaggggaagggatatttaagaacatccagcacttaaccgccacggaggagattgccgtgcagaactggctggcccgggttgggcgcgagcggctgagccgcatggcgatctccggggacgactgtgtcgtgaagcccatcgacgaccggttcgccagcgccctcaccgcccttaacgacatgggtaaagtacgcaaagacatccagcaatgggagccctcccggggctggaacgactggacccaggtccccttctgcagccaccacttccacgagctggttatgaaggacgggagggtattagtcgtgccctgccggaaccaagacgaattgatcggccgcgcccggatcagccagggcgcaggttggagcctgaaggagacggcctgcctcggtaagtcctacgcccagatgtggacgttgatgtacttccaccgccgggacctgcgcttggcggcaaacgcgatatgcagcgccgtgccctcccactgggtccccaccagccggaccacctggagtatacacgccaaacacgagtggatgaccaccgaggatatgctagccgtgtggaaccgagtgtggatccaagaaaatccctggatggaggacaaaaccccggtcgagagctgggaggaggtgccctacctggggaaacgggaagatcagtggtgcggctctctcatcgggctcacctcccgcgcaacctgggcaaagaacatccagacggccatcaaccaggtacggagcttgatcggtaacgaggagtacaccgactacatgccctccatgaagcgcttccgcaaggaggaggaggaggcaggcgtcctctggtga

SEQ ID NO: 25004 - RNA, 9876 nt, synthetic construct
  misc_feature 1..9876: note = derived and/or modified CDS sequence (opt11) from DENV-2__KJ189370__SS-prME
  source 1..9876: mol_type = other RNA
actgcgggcgtgatagtcatgctgatcccaaccgcaatggcgtttcacttaaccacccggaatggggaaccccacatgatagtgtcccgtcaggaaaaaggcaaatccctgctgttcaaaaccgaggacggggtgaatatgtgcaccctcatggccatcgacctgggcgaactgtgcgaggacaccattacttacaaatgccccctactgcgccagaatgaacccgaggatatcgactgttggtgcaacagcacctccacctgggtcacatatgggacctgcacgaccaccggcgagcaccggcgggagaagcggagcgtggccttagtgccgcacgtcggcatggggctcgagacccgcaccgagacttggatgtctagcgagggcgcctggaagcacgtgcagcggatcgagacgtggatcctgcgccaccctgggttcaccataatggccgctatcctggcttacacaatcggcaccacgcacttccaacgggccctcatcttcatactcctcacggccgttgccccctccatgaccatgcgctgcattgggatcagcaatcgggacttcgtcgaaggggtgtctggagggagttgggtggacatcgtactcgagcacgggtcgtgcgttaccacgatggccaagaacaagcccaccttggacttcgagctgattaagaccgaggccaaacaacctgccaccctgcgcaaatactgcatcgaggccaagctgacgaacaccaccaccgagagcagatgcccgacccagggggagccatcgttaaacgaggaacaggacaagcgtttcatctgcaagcacagcatggtggaccggggctggggcaacgggtgcggcctcttcgggaagggcggtatcgtaacctgcgcgatgttcacgtgcaagaagaacatggagggaaaggtggtgcagccggagaacctggagtacaccatagtcatcacgccccatagcggggaggagcacgccgtcgggaacgacaccggcaagcacggaaaggagatcaagatcaccccacagagctccatcaccgaggccgagctgaccggctacgggacggtgaccatggagtgcagcccccgtaccggcctggactttaacgagatggtcctgcttcagatggaggacaaagcctggctcgtccaccggcaatggttcctggacctgcctctcccgtggctgccgggcgccgacacccaggggtccaactggatccaaaaggagacgctggtgacctttaaaaaccctcacgcgaagaagcaggatgtagtggtcctcggcagccaggagggggcgatgcatacagcactgaccggggccacggagatccagatgagctccgggaacctcctgttcacaggccacctgaaatgccgcctgcggatggacaaattacaactgaagggcatgtcatactcgatgtgcaccggaaagttcaagatcgtgaaggaaatcgccgagacacagcacggcacgatcgtgatccgcgtccagtacgaaggagacggctccccgtgcaagatccccttcgagattaccgaccttgaaaagagacacgtcctcggccgcctgatcactgtgaacccaatcgtcaccgagaaagactcccccgtcaacattgaggcggagccgcccttcggtgatagctatatcataatcggcgttgaaccggggcagctgaaattgaactggttcaagaagggttccagcatcgggcagatgttcgaaacaacgatgcgcggcgcaaagcggatggcgattctgggcgacaccgcgtgggacttcgggtccttaggaggggtcttcacatccatcggcaaggccctccaccaggtattcggggcgatctacggcgccgccttttccggagtaagctggactatgaagatcctgatcggtgtcattatcacctggatcggcatgaactcgcgcagcacctccctgtcggtaagtctggtgttggtcggagtagtgaccctgtacctgggcgccatggttcaggcggactctgggtgcgtggtgtcatggaaaaataaggagctaaaatgcggtagcggcatcttcatcaccgacaatgtccacacctggaccgagcagtacaagttccagcctgagagcccctccaagctggccagcgccatccagaaggcccacgaggaagggatctgcggcatcagaagcgttacccgcctcgagaatctaatgtggaagcagatcacgcccgagctgaaccacatcctgagcgagaacgaggtgaagctcaccatcatgaccggcgacatcaaggggatcatgcaggccgggaaacggtccctcaggccacagcccacggagctgaagtatagctggaagacgtggggcaaggcgaagatgctctccacggagagccacaaccagaccttcctgatcgatggccccgagacagccgaatgcccgaacaccaaccgggcctggaactccctggaagtcgaggactacgggttcggcgtgttcaccaccaacatctggcttaagctaaaggagaagcaggacgtattctgtgacagcaaactaatgagtgctgcaatcaaggacaaccgcgcggttcatgccgatatgggttactggatagagagcgcactcaacgacacctggaagatggagaaagcatcctttatagaggtcaagagctgccactggcccaagagccatactctgtggagcaacggcgtgctggagtctgagatgatcatccccaagaacttcgccggccccgtgagccagcacaactaccggccggggtaccacacgcagacggctggcccctggcacttgggcaaactcgaaatggacttcgacctgtgcgagggaacgacagttgtggtcactgaggactgtgggaaccggggccccagcctgcggaccaccaccgcctccggcaagttaatcacggagtggtgctgccgctcgtgcaccctgcccccgctccggtaccgcggggaggacgggtgttggtacgggatggagatccggccccttaaggaaaaggaagaaaacctggtcaattccctcgttaccgccggccacgggcagattgacaacttttccctgggcgtcctgggcatggctctcttcctggaggagatgctgaggacccggatcgggactaagcacgcaatcctccttgtggccgtgtcctttgtcacgctgatcaccggcaatatgagcttccgcgatttagggcgggtgatggtaatggtcggagctactatgactgatgacatcgggatgggcgtaacctacctcgcccttctcgccgcctttaaggtgcgacccacgttcgccgccggcctgctgctccggaagctaacgtccaaggagttaatgatggccacgatcgggattgccttactgagccaatccaccatacccgagaccatcctggagcttaccgatgctttggccctaggcatgatggtcctcaaagtggtgcggaacatggagaagtaccagctggccgtcaccatcatggccatcagctgcgtgcctaatgcagtgatcctgcagaacgcatggaaggtctcatgcaccatcctcgcggcagtgtcagtttctcccctactattaacctcttcccagcagaaggccgactggatccccctggcgctgactatcaaagggctcaaccccacagccatattcctgaccaccttaagccgcacgtcaaagaaacggagctggccactcaatgaggccattatggccgtgggcatggtgtccatactagctagcagtcttttgaagaatgacatccccatgactggccccttagtagcgggcgggctgctcaccgtatgctatgtgctgacagggagatccgccgacctggagttagaacgggccgcagacgttaagtgggaagaccaggccgagatcagcgggtccagccccatcctgtccataaccatatcagaggacgggtcaatgtccatcaagaacgaggaggaggaacaaacgctgacaatccttattcgtaccggcctgctcgtgatctcaggcgtcttcccggtcagcatccccatcaccgcagcggcctggtacctctgggaggtgaagaaacagcgggccggtgtgctgtgggacgtccctagcccgccgccggttgagaaggcagagttggaggacggcgcctaccgcataaagcagcgtgggatcctcggctacagccagattggggctggcgtctacaaagagggcaccttccacaccatgtggcacgtcacacgcggggccgtgctgatgcatcggggcaagagaatcgagccctcatgggcggacgtgaagaaggaccttatctcgtacggcggagggtggaagttagagggcgaatggaaagagggagaggaggttcaggtgctggctctggagccggggaagaacccccgggcggtccaaaccaaacccggcatcttcaagaccaacacggggactataggtgcggtctcactcgacttcagtcccgggacttccggatcgcccatcgtggaccggaagggaaaggtggtcgggctttatggcaacggggtggtaacccgatccggcgcttacgtcagcgccattgcgcagacggaaaagtccatcgaggacaaccccgaaatcgaggacgacatcttccgcaagaagcggctgaccatcatggacctccatcccggggccgggaagaccaagcgctatctgcccgcgatcgtgcgtgaggcaatcaaacgggggctccgcaccctaatattggccccgacgcgcgtggtcgcggccgagatggaggaggccctgcgcgggctgcccattcggtaccagacccccgccataaaagccgaatacaccggccgcgagatcgtggacctcatgtgccacgctacattcacgatgcggcttctgtcccctgtgcgggtacctaactacaacctcatcatcatggatgaggctcacttcaccgaccctgccagcatcgcagcccgggggtatattagcacccgcgtagagatgggggaggctgcaggcatctttatgacggcgacgccgcctgggagtcgggacccgttcccacagagcaacgccccaattatggatgaggagcgcgagatccccgagagaagctggaactccggccacgagtgggtcaccgacttcaaggggaagaccgtctggttcgtgccgagcatcaaagcgggtaacgacatcgccgcctgcttgcgcaagaacggcaagaaggtgatccagctgtccaggaagaccttcgacagcgagtacgtgaagacgcgcgccaacgactgggacttcgtcgtgaccaccgacatctccgagatgggtgcgaacttcaaagcagagcgggtaatcgacccccgcagatgcatgaagcccgtgatcctcaccgacggagaggagcgcgtcatcctggccggccccatgccggtcacccacagcagtgccgcccagcggcgcggacgcatcgggcgcaatcccaaaaacgagaatgaccaatacatctacatgggcgagcctctagaaaacgacgaggactgcgcccactggaaagaggccaagatgctcctggacaacatcaacacacccgaggggatcatccccagcatgttcgagcccgagcgcgagaaggtggacgctatcgacggcgaatacaggctgcgtggcgaggccagaaagaccttcgtggacctcatgcgccgcggggacttgcctgtttggctcgcgtacaaggtagccgcggagggcattaactatgccgatcgcaagtggtgcttcgacgggatcaagaacaatcagatcttagaggaaaacatggaggtcgaaatctggaccaaggagggcgagcggaagaagctaaaaccccgctggctggacgccaggatttactccgacccgctcgccctgaaggagttcaaagagttcgccgccggccgcaagagcttaacgctgaacctgatcaccgagatgggtcgcttacccacctttatgacccagaaagcccgcaacgccctcgacaacctagcagtgctgcacacggcggaggccggagggcgggcctacaaccacgcactctctgagctgcccgaaacactggagaccctcctgttgctaaccttactggcgacagtgacaggcgggatcttcctctttctgatgagcggcaagggcatcgggaagatgaccctgggtatgtgctgcataatcaccgcgtccatcctcctgtggtacgcccagattcagccgcactggattgcagcctcgattatccttgagttctttctcatcgtactactgatccctgagcccgaaaagcaacgcacaccccaggacaatcagctcacatacgtggtgatcgctatcttaaccgtagtagcagcaaccatggccaacgagatgggattccttgagaagacgaaaaaggacctcggcctggggtcaatcaccacccaggaatccgagagcaacatcctggacatcgacctccggccggcctccgcctggactctatacgcagtggccaccactttcctgacgccgatgctccgccacagcatcgaaaattcctccgtaaacgtgtccctgaccgctatcgccaaccaggccaccgtgctgatgggcctgggcaaagggtggcccttgagcaagatggacatcggcgtccccctgctcgcgattgggtgctattcccaggtgaacccgatcacgctgacggctgccctcctcctgctggtggcacattacgcaatcataggccccgggttacaggcaaaagccacccgggaggcccagaaacgtgccgcggccggcattatgaagaaccctacagtcgacggcatcacagtgatagacctggaccccatcccgtacgaccccaagtttgagaagcagctggggcaggttatgctcttaattttatgcgtcacacaggtgctcatgatgcggactacctgggccctgtgcgaggccctcaccctcgcgaccggccccatcagcaccctgtgggagggcaacccgggcaggttttggaacaccacgattgcggtgtccatggccaacatcttcagagggagttacctcgccggagcaggcctcttgttttccatcatgaagaacaccacctctacccgccgcgggacgggcaacatcggggagacccttggcgaaaagtggaaaagccggctcaacgcgctgggcaaatctgagttccagatctacaagaagtccgggatccaggaggtcgatcgcacccttgccaaagagggcatcaagcgcggtgagaccgaccaccacgcagtcagccgaggctccgctaagctccggtggttcgtggagaggaatatggtcacgccggaggggaaggtggtagacctgggatgcgggcgcgggggctggagctattactgcgggggtctgaagaacgtcagggaggtcaagggtctcacgaagggtggtcccggacatgaggagcccatccccatgagcacctatggttggaacctggtgcggctgcagtcaggggtcgacgttttcttcaccccgcccgagaagtgcgacacgctcctgtgcgacatcggcgagtcttcccctaaccccaccattgaggccgggcgcaccctgcgggtgctcaacttggtcgagaattggctgaataacaacacccagttctgcatcaaggtcctaaacccgtatatgcccagcgtgatcgaaaagatggaggcactgcagcggaagtacggtggtgccctggtccgcaaccccctgtcccggaacagcacgcacgagatgtactgggtatccaacgccacggggaacatcgtatcgtccgtcaacatgatcagccgcatgcttataaatagattcacaatgaagcataagaaggccacgtacgagccggatgtggacctgggctccgggacgcggaacatcggcatcgagtcggaggtgcccaacctggacataatcgggaagcgcatcgaaaagattaagcaggagcacgagacttcctggcactacgaccaagaccacccctataaaacctgggcctatcacggcagctacgagaccaagcagaccgggtccgcgagctccatggtcaatggggtggtgcggctcctgacgaagccttgggacgtcgttccgatggttacccaaatggcgatgaccgacaccacgcccttcggccagcagcgcgtcttcaaggagaaagtagacactcgcacccaggaacctaaagaggggacgaagaagctgatgaagataacggcggagtggttatggaaggagctgggaaagaagaaaacgccccgtatgtgcacccgagaggagttcactcgcaaggtacgctccaacgcggccttgggcgcgatctttacggacgagaacaagtggaagtccgcccgggaggccgtcgaggatgggcgcttctgggaactcgtcgatagagagcgcaacctacatctagagggcaagtgcgagacctgtgtctacaacatgatggggaagagagaaaagaagctcggcgagttcgggaaggcaaagggcagccgcgcgatctggtacatgtggctgggcgctcggttcctcgagtttgaagccctaggcttcctgaacgaggatcattggttcagccgcggcaattcgctgagcggggtagagggggaggggctccataggctgggctacatcctgcgcgaggtgggcaagaaagaaggcggggccatgtacgccgatgacaccgcggggtgggacacccggatcacgctcgaggacctgaagaacgaagagatggtcaccaaccacatgaagggcgagcataagaagctggcagaggccatcttcaagctcacttaccagaataaggttgtgcgtgtccagcggccgacgcctcgggggacggtgatggacatcatctcccgccgcgaccagcggggcagcggccaagtcgggacctacggcctgaacaccttcaccaatatggaggcccagctgatcagacagatggagggggagggcattttcaagtccatccagcatctaacggccaccgaagaaatagcggtccagaactggctggtgcgtgtgggccgagagcgcctgagccggatggccatctcaggggacgactgcgtcgtaaaaccaatcgacgatcgctttgccagcgccctcaccgcacttaacgatatgggcaaggtgcggaaggacatccagcagtgggaaccctcccgcgggtggaatgactggacacaggtcccgttctgtagccaccacttccacgagctggtgatgaaggacggccgggtgctcgtcgtgccctgccgcaaccaggatgagctgatcgggcgagcgaggatctcccaaggagctggatggtctctgaaagagacggcctgcctggggaagtcctacgcccagatgtggaccttgatgtacttccatcggcgggatctgcgtctcgccgctaacgctatctgctctgccgtgccctcccactgggtccccacttcccgcaccacctggagcatccatgccaagcacgagtggatgactaccgaagacatgctggcagtgtggaaccgggtgtggatccaagagaacccgtggatggaagacaaaacccccgtcgagagttgggaagaggtgccctacctgggcaaacgcgaggaccagtggtgcgggagcctgatcggcctgacctcccgggccacgtgggctaagaacatccagacagcgatcaaccaggtccgcagcttaatcgggaacgaagagtataccgattacatgccctccatgaagcggtttcgccgagaggaggaggaagccggcgtcttatggtga

SEQ ID NO: 25005 - RNA, 9876 nt, synthetic construct
  misc_feature 1..9876: note = derived and/or modified CDS sequence (opt11) from DENV-2__EU482620__SS-prME
  source 1..9876: mol_type = other RNA
accgcaggcgtcatagtgatgctcataccaacggcaatggcattccacctcaccacacggaacggtgaaccccatatgatcgtcggccggcaggaaaaagggaaaagtctattgtttaaaaccgaagatggcgtaaacatgtgcacacttatggcgatagacctaggcgaattatgcgaagatacaataacgtacaaatgcccgctcctacgccagaacgaaccagaagatatcgactgctggtgcaacagcacttcaacgtgggtaacatatgggacctgtacgactacaggcgaacatcggcgtgaaaagagatcggtcgccctagtcccgcatgtaggcatggggcttgaaacacgaaccgagacctggatgtcctcggaaggagcgtggaaacacgttcagaggattgagacttggatacttagacatcctggcttcacaatcatggctgccatcttagcatacactatcgggacgacgcacttccaaagagccctgatcttcatcctgttaacagcagtggcccccagtatgaccatgaggtgcataggaatttccaatcgagatttcgtcgaaggcgtcagcggcgggtcatgggtagacatcgtactggaacacgggtcgtgtgtaacaaccatggccaagaacaaaccgaccctcgacttcgaattgatcaaaacagaggccaaacaaccagcaaccctgcgaaagtactgcatagaagccaaactcacaaacaccacaacggagtcacggtgccctacgcaaggagagcctagtctaaacgaggagcaggacaaacgctttatatgcaaacacagcatggtcgatcgcgggtggggcaacgggtgtggcctcttcggaaaagggggcatagtgacatgcgcgatgtttacttgcaagaaaaacatggaaggaaaagtagtccaacccgaaaatctcgaatacacaatagtgataacccctcatagtggcgaggaacatgccgtcgggaacgacaccggcaagcacggaaaagagataaaaatcacaccccaatcctcgataacggaggccgagctaaccggatacggcacagtgaccatggagtgctccccaagaaccgggttagactttaacgagatggtcctcttgcaaatggaggacaaagcatggctagtccacaggcagtggttcctggaccttccactaccctggcttccaggagccgacacccagggttcaaactggatccaaaaagagaccctggtaacgtttaagaatccccacgccaaaaagcaggacgtagtagtactgggcagccaagaaggtgccatgcacacagcattgaccggggctaccgaaatacagatgtcctcaggcaatctattattcacgggccatcttaagtgtcgactccgcatggacaaactacagcttaaaggaatgtcatactcaatgtgcacgggcaaatttaaaatcgtaaaggaaatcgccgaaacacaacatgggacgatagttatccgggtccagtacgaaggcgatggaagtccatgcaaaataccgtttgagatcacagacctggaaaaacgacacgtcttagggcgtctaataacagttaacccaatagtgacggaaaaggacagtccagtcaacatcgaggccgagccacccttcggagacagctacatcataataggcgtagagcccggacagctaaagctaaactggttcaaaaaggggagcagcatcggccaaatgttcgaaacgaccatgcggggagcgaaaagaatggcgatcctcggggacaccgcatgggatttcggatcgctcggaggagtgtttaccagcatcggaaaagcgctacatcaagtattcggagccatatacggagcagcgttctcaggggtgagctggacgatgaagatactcataggtgtaataatcacatggataggaatgaacagccgctcaacaagcctctcggtctcgcttgtcctagtcggcgtcgtcacactctaccttggagcggtcgtacaggccgactcgggatgcgtcgtgtcatggaagaacaaagaactcaagtgcggctccggcatattcataacagacaacgtgcatacatggacggaacagtacaaatttcagcccgaaagtcctagcaaactcgcatctgctatccagaaagctcacgaggaaggcatatgcgggatacggtccgtaacgcgactagagaacttaatgtggaagcagatcacgccagagctaaatcacattctatccgaaaatgaagtaaagctcaccatcatgacgggagatattaaaggcatcatgcaagctggaaaacgctcccttaggccgcaaccaacagaactgaaatactcttggaaaacctggggaaaggcaaaaatgctctctacagagagtcacaaccagaccttcttaatcgacggccctgagacggccgagtgcccaaacaccaacagggcttggaactctctcgaagtagaggactatgggttcggcgtcttcacgacaaatatctggctcaagttgcgagaaaagcaagacgtattttgcgacagcaagctcatgagcgcggcaatcaaagataacagagccgtgcacgccgatatgggatattggatcgagagcgcactgaacgatacatggaagatggaaaaggcgagcttcattgaggtaaagagctgtcactggccaaaaagtcacacactatggagcaatggagtcctagagtctgaaatgataattccgaaaaatttcgcggggcccgtaagccaacacaactacaggcccggctaccacacacaaacggcgggaccttggcacctagggaagctagaaatggatttcgacttttgcgaaggaacaaccgtagtcgtgaccgaggactgcgggaatcgcggcccatccctacgaacgaccacagccagcggaaaactaattacggagtggtgttgccgaagctgcacactcccaccgctaagataccgcggagaagacgggtgctggtacggaatggaaatcagacccctgaaagaaaaagaagaaaacctggtgaacagcctcgtgacggcagggcatggacagattgacaacttcagtcttggagtactaggaatggcgttgttcttagaagagatgcttcggacaagaatcgggacaaaacacgcgatccttctcgtagcggtatcgttcgtcacactaatcaccggtaacatgtcgttccgggatctcggaagagtgatggtcatggttggcgcgacaatgaccgacgacatcggcatgggcgtcacgtacctagccttgcttgccgcgttcaaagtaagacccaccttcgctgcaggccttctgctgagaaaacttacatctaaggagctaatgatggctacaatcgggattgcactcctctcccaaagcacaattccagaaacgatactagaacttacggacgcactcgcgctaggaatgatggtcctcaagatagttaggaacatggagaaatatcagcttgccgtgacaatcatggccatttcctgtgtgccgaacgcagtcatactgcaaaacgcatggaaagtcagttgtacaatattggccgccgtcagcgtaagccccctcctgcttacatccagccagcagaaggctgattggataccacttgccctaacgattaaaggactcaatccaacagcgatcttcttaaccactctcagccgaacaagcaaaaagcgaagttggccgttaaatgaggctatcatggccgtgggtatggtcagtatcctcgcatcatccttactcaagaacgacatcccgatgactgggccactggtggcaggagggctgctaacagtgtgctacgtcctgaccgggcggagcgcggacctcgaattagagcgagcggctgacgtaaagtgggaggatcaagcagaaatcagcgggagtagcccaatactgtcgataaccatcagcgaggatggctcaatgagtatcaaaaatgaagaagaggaacaaaccctgacgatcttaatcaggactggactcctggtcataagcggcgtcttcccggtatcaataccgataaccgcggcagcatggtacctatgggaagtcaaaaagcaaagggctggagtgctctgggacgtacccagtcccccgccggtggagaaagccgaactggaagatggagcctaccgaattaaacaacgaggtatactaggatatagtcaaatcggggcaggggtctacaaggaaggaacgttccacacaatgtggcacgtaacaagaggggcggtgctcatgcacagggggaaaaggattgaaccgtcgtgggccgacgtgaagaaagatctaatttcatatgggggcgggtggaaactagaaggggaatggaaagaaggagaagaagtacaagtgctggcactcgagccgggtaaaaacccacgggccgttcagacgaagccaggcatattcaagaccaacacgggaacgataggtgcagtctcactggatttttcacccggaacatccggatccccgatcgtcgaccgaaaggggaaggtagtggggctctacgggaacggtgtggtgacccgctccggcgcttatgtaagcgcgatagcccaaaccgagaagtccatcgaggataaccccgagattgaggatgacatctttagaaagaagcggctcactatcatggacctccatccaggagcagggaaaaccaaaagatacctaccagcgatagtacgagaggctataaaacgtgggctacgcaccttgatcctggccccaacacgagtcgtagcagccgaaatggaagaggcactacgtgggctaccaattcgctatcagacaccggctatcaaaacggagcacacaggccgtgaaattgtcgacctaatgtgccacgccacatttacaatgagactgttatcccccgtccgagtccccaactataaccttataataatggacgaggcgcatttcacggaccccgcatcgatagctgcccgaggctacatctccacgcgtgttgaaatgggcgaggctgccggcatattcatgacagcaacaccgcccggttctcgcgacccgtttccacagtctaatgctccaatcatggacgaggaacgagaaataccagaacggagttggaactcggggcatgagtgggtaacggacttcaaaggaaaaactgtttggttcgtgcccagcataaaagccgggaacgatattgccgcatgtctacgaaagaacggtaagaaagtaatccagctgagccggaaaacgttcgacagtgaatatgtcaaaacaagagcaaacgactgggactttgtagtcacaaccgatatttcggagatgggggcaaacttcaaggcagaacgagtcatagacccgcgaagatgcatgaaaccggtaattctaacagatggcgaagaacgagtcatcctcgcagggcccatgccagtaacacatagtagtgcggcccagcggcgcggccgcatcggccgaaacccgaaaaacgagaatgaccaatacatctacatgggagagcccctcgaaaacgacgaagattgcgcacattggaaagaagcaaaaatgttattggacaacataaacacaccagagggaataataccgtccatgttcgagccggaacgcgagaaagtcgatgcaatagacggagaataccggctccggggcgaagctaggaaaacattcgtggacctcatgcggagaggagatctgccagtgtggctcgcctacaaagtcgctgcggagggaataaactacaccgaccgcaagtggtgctttgacggaataaagaacaaccagatactggaggagaacatggaagtcgagatatggacgaaagagggtgagaggaaaaagctgaaaccaagatggttggacgcgcgaatctacagcgacccgctcgcccttaaagaatttaaagagtttgcagcaggccgaaagagcctgaccctcaacctaataacagaaatggggcgcctaccaacatttatgacccaaaaggcacggaacgcacttgacaacctggccgtcctccatacagccgaggctggtggccgcgcctataatcatgcgctatcggaactgccagagacattagagaccctactactcctcacgttattagctacagtaacgggcggaatattcctcttcctcatgtcaggaaaagggataggcaagatgaccctgggtatgtgctgtattataacggcaagcatcttactatggtatgcccaaatacagccacattggatagccgcgagcatcatcctggagttcttcctaatagtactgctaataccggagcccgaaaaacaacggaccccgcaggacaaccaactaacttacgtggtcatcgcgatactcacagttgttgctgcgacaatggccaatgaaatgggatttctggagaaaacaaagaaagatctgggacttggatccataaccacgcaagaaagcgagagcaacattctagacatcgacttacgaccagcttcggcctggacgttatacgctgtagcaacgaccttcgtcacacccatgctacgccattcgatcgaaaattcgtccgtgaacgtctccttgaccgcgatcgcgaaccaagcaactgtgctcatggggctcggtaaaggttggcctctctccaagatggatatcggggtcccgctcctcgcgatcggctgctacagtcaagtgaaccccatcacccttacggcagccctcttacttctggtcgcgcactatgcaatcattggccccgggctacaagcgaaagcaaccagggaagcccaaaagcgagcagcggcaggcattatgaaaaacccaacggtcgatggcataacggtcatcgacttagaaccaatcccttatgacccgaaattcgagaaacaactggggcaagtaatgctgctaatcctgtgtgtcacccaagtcctaatgatgaggaccacgtgggcgctgtgcgaggccctcaccctagccacggggcccataagcactctttgggaagggaatccagggcggttctggaacaccacgatagcggtctccatggcaaacatctttcgtgggagctacctggcaggggctggcttgctcttttcaattatgaaaaacacaacgagcacgaggagagggactggaaacatcggagaaacgctgggggagaagtggaaaagccgcctaaacgcccttggaaaaagcgagttccagatttacaagaagagtggaatacaagaagtggataggacccttgcgaaggagggaataaagcgcggagagaccgatcaccacgcagtatctcgaggatcggcaaagctaagatggtttgtcgaaaggaacatggtaacccccgaaggcaaggtggtcgatctcggatgcggaaggggaggatggagttactactgcggagggctcaagaacgtgcgcgaagtgaaaggattaacaaaaggcgggccggggcacgaagaacccatcccaatgtccacgtatggatggaacctcgtgcgcctacagagcggagtggatgtatttttcaccccaccagagaaatgtgacacgctgctgtgtgacattggcgaatcgagtccaaatccgaccattgaagccggccgcacactcagggtgctaaacctcgtcgaaaactggctcaacaacaacacgcaattctgcattaaggtgctgaacccatacatgccctcagtcatcgagaagatggaggcactccaaagacaatacggtggcgcacttgtgcgaaaccccctaagccgtaacagcacccacgaaatgtactgggtaagtaacgccaccggcaacatagtatccagtgtaaacatgatcagtagaatgctcataaaccgattcacaatgaagcacaagaaagcaacctacgagccagacgtagacctcggcagtggaacgcgaaacatagggatcgaatcagaaatccccaacctcgacatcattggaaaaagaatcgagaaaataaagcaagaacacgaaataagctggcactacgaccaggaccatccatacaagacgtgggcctaccacggttcatatgaaactaaacaaacgggaagcgcgagttcaatggtaaatggtgtagtacgcttactcaccaaaccctgggacgtagtgcccatggtaacccaaatggccatgacagacacaacccccttcgggcagcagcgcgtctttaaggagaaggtagatacccggacccaggagccaaaagaaggaactaagaaactaatgaaaatcaccgccgagtggctgtggaaagaactgggcaagaagaaaacaccgaggatgtgcacaagggaagagttcacccggaaagtcagaagcaatgcggcactcggcgccatcttcacagacgagaataagtggaaaagcgctcgggaggccgtcgaagacggtcgcttctgggagctagtggacagagagagaaacctccacctggagggcaaatgcgaaacatgcgtatacaacatgatgggcaaacgcgagaagaaacttggggagtttggcaaagccaaaggctcgagagcgatatggtacatgtggctgggcgccagattcttagagttcgaagccttagggttcctaaacgaagatcattggttcagccggggaaattccctttccggggtggagggggaaggactccacaggctgggatatatactcagagacgtcggcaaaaaggaaggaggggcaatgtacgctgacgatacagcaggatgggacactaggatcacgttagaggatttgaaaaatgaagagatggttactaaccatatgaaaggcgaacacaagaaactggctgaagcaattttcaaactaacgtaccagaataaggtagttagagtgcagaggccgacaccaagagggaccgtcatggacatcataagtcgacgcgaccagagaggaagcggccaggtagggacatacggactcaacacgttcaccaacatggaagcacaactgattcggcaaatggagggcgaaggcatctttaaatccatacagcacttgacggccacagaggagatcgctgtacagaactggctagcacgtgtgggtcgcgaacgcctaagccggatggcaatatcaggagatgactgcgttgtcaagcctatagacgaccgcttcgccagcgccctgactgcactaaatgacatgggcaaagtaagaaaagacatccaacaatgggagccatcacgcgggtggaacgactggacgcaagtacctttctgctctcaccatttccacgagctagtcatgaaagacggcagagtgctagtggtgccatgtaggaaccaagacgaattgataggccgggcacgaatctcccaaggggccggatggagcctcaaagaaactgcctgtctcgggaaatcctatgcacagatgtggacactaatgtacttccatcgtcgcgacctccgcctggcagcaaacgcaatctgctcagcagtccccagtcactgggtcccaacgtcacggaccacatggtcgatccacgccaaacacgagtggatgactacggaggatatgctagcggtctggaaccgggtttggatacaggaaaacccgtggatggaggataagacaccggtagagagctgggaagaggtgccatacctcggaaaacgagaagaccaatggtgcggatcgctaataggcctcacatcccgagcaacctgggcgaagaacatacagaccgccatcaatcaggtacgttcattaatcggaaacgaggagtatacggactacatgccgagcatgaaaaggttccggcgagaggaggaagaagcaggggtgttatggtaa

SEQ ID NO: 25006 - RNA, 9876 nt, synthetic construct
  misc_feature 1..9876: note = derived and/or modified CDS sequence (opt11) from DENV-2__FJ373300__SS-prME
  source 1..9876: mol_type = other RNA
accgcgggcgtgatcgtcatgctgatcccgaccgccatggcgttccacctcaccacacgcaacggggagccccacatgatcgtggggaggcaggagaaagggaaatccctgctgttcaagaccgaggacggcgtgaacatgtgcaccctgatggccatcgacctgggggagctgtgcgaggacaccatcacctataagtgccccctcctgcggcagaacgagcccgaggacatcgactgctggtgcaacagcaccagcacctgggtcacctacgggacttgcaccactacaggcgagcaccggcgcgagaagagatccgtggccttggtgccgcacgtcgggatgggcctcgagacccgcaccgaaacctggatgagcagcgagggggcctggaagcacgtgcagcggatcgagacctggatcctgcgccaccctggtttcaccatcatggccgcgatcttggcctacaccatcgggaccacgcacttccagcgggcccttatcttcatcctgctgaccgccgtggcgcccagcatgaccatgcgctgcatcggcatcagcaaccgggacttcgtcgaaggcgtaagcgggggcagctgggtggacatcgtcctcgagcacgggagctgcgtgaccacgatggccaagaacaagccaaccctggacttcgagctgatcaagaccgaggctaagcaacccgccaccctccgcaagtactgcatcgaggccaagctgacgaacaccaccaccgagtctcggtgcccgacgcagggcgaacccagccttaacgaggagcaggacaaacgtttcatctgcaagcactccatggtggaccgaggctgggggaacggctgcgggctgttcggaaagggcggcatcgtgacctgcgcgatgttcacgtgcaagaagaacatggagggcaaggtcgtgcagcccgaaaacctcgagtacactatagtcatcacgccccatagcggtgaggagcacgccgtgggcaatgacaccgggaagcacggcaaggaaataaagatcaccccgcagtccagcatcacggaggccgagctgaccgggtacggcacggtgaccatggagtgcagccccaggaccggcctcgacttcaacgagatggtccttctacagatggaggataaggcctggctcgtgcaccggcagtggttcctggacctgcccttaccctggctgccgggggccgacacccagggcagtaactggatccagaaggaaacgctggtgacattcaagaacccccacgcgaagaagcaggacgtcgtcgtactcgggtcccaggagggcgccatgcataccgccctgaccggggccaccgagatccagatgtcgagcggcaacctcctgttcacaggccacctgaagtgcagactgcggatggataagctccagctgaaggggatgagctacagcatgtgcaccggaaagttcaagatcgtgaaggagatagccgaaacccagcacggaacgatcgtgatcagagtccagtacgaaggcgacggctccccgtgcaagatacccttcgagatcaccgacctcgagaaacggcacgttctcgggcgtctgatcactgttaacccgatcgtcaccgagaaggactcgcccgtgaatattgaggcggagccgcccttcggcgattcctacatcatcatcggggtggaaccgggtcaactgaagctcaactggttcaagaaggggagctccatcggccagatgttcgagacgaccatgcgcggcgccaagcggatggcaatcctgggagacaccgcttgggacttcggctcactcgggggcgtgttcacctccatagggaaggcactccaccaggtgttcggcgcgatctacggcgcggccttcagcggggtgtcctggacgatgaagatcctgatcggcgtcatcatcacctggatcgggatgaatagccgctccacctctctgtccgtgagcttggtgctagtaggcgtagtgacactgtacctgggggccgtagtgcaggccgactccggctgcgtggtcagctggaagaataaggagctcaagtgcggctccgggatattcatcacggacaacgtgcacacctggaccgagcagtacaagttccagcccgaatctcccagcaaattggcgtcagccatccagaaggcccacgaagaggggatctgcggcatccgttcggtgacgcgcctggagaacctgatgtggaagcagatcactccggagctgaatcacatcctgtccgagaacgaggtcaaactcacgatcatgacgggcgatattaagggcaccatgcaggccggcaagcggagcctgcgcccgcagcccacagagctgaagtactcctggaagacctggggcaaggcgaagatgctcagtacagaatcgcacaaccagaccttcctaatcgacgggcccgagacggccgagtgcccgaacaccaaccgggcctggaactcactggaggtggaggactacggcttcggggtgttcaccaccaacatatggctcaagcttcgcgaaaagcaggacgtcttctgcgacagtaagctgatgagcgccgccataaaggacaatcgggcggtgcacgccgacatgggctactggatcgagtccgccctcaacgacacctggaagatggagaaggccagctttatcgaggtgaagtcctgccactggcccaagtcgcatacgctctggtccaatggagtcctggagagcgagatgatcatccccaagaacttcgccgggcccgtgtcccagcacaactacaggccgggctaccacacccagaccgcggggccctggcacctcggcaagctggagatggacttcgacttttgcgaggggaccaccgtggtcgttaccgaggactgcggcaaccggggtccatctctgcgcaccaccactgccagcggaaagctcatcaccgagtggtgctgccgttcctgcaccctgcccccgctgcgctatcggggagaggacgggtgttggtacggcatggagatccgccccctcaaggagaaggaggagaacctcgtgaacagcctggtgaccgccgggcacgggcagattgacaacttctcactcggcgtgctggggatggccctgttcctcgaggagatgctgcggacgcgcatcggaaccaagcacgccatccttctcgtcgccgtctcgttcgtgaccctgatcaccgggaacatgtccttcagagacttaggccgcgtgatggtcatggtgggggccacgatgaccgacgatatcggcatgggcgtgacctacctcgccctgctggccgcgttcaaggtccgccccaccttcgccgccgggctcctgttgcggaagctcacgagcaaggagctgatgatggccaccatcggcatcgccctgctctcccaaagcaccatccccgagaccatcctggagctgacggatgcgctcgccctggggatgatggtgctgaagatcgtgcgcaacatggagaagtaccagctcgccgtcaccatcatggccatcagttgcgtgccgaacgccgttatcctgcagaacgcttggaaggtcagctgcaccgtactcgccgccgtcagcgtcagccccctcctgcttacctcaagccagcagaaggccgactggatccctctcgcgctgactatcaaggggctgaaccccaccgccatattcctcaccaccttatcccggactagcaagaagcgctcctggccgctgaacgaggccatcatggccgtgggtatggtctcgatcctcgcctcgtctctgctgaagaatgatatacccatgaccgggccgctagtcgcgggcgggctcctgaccgtgtgctacgtcttaaccggcaggtcggccgatctggagctcgagcgcgccgccgacgtgaaatgggaggaccaggccgagatctccgggtcgtcccccatcctcagcatcaccatctctgaggacggcagcatgtccatcaagaacgaagaggaggagcagaccctgacaatcctgatccgcaccggcctgctggtgatctcaggggttttccccgtgtccatccccataaccgcggccgcatggtacctatgggaggttaaaaagcagcgcgccggcgtcctctgggacgtgcccagcccaccgccagtagagaaggccgagctggaggacggggcataccggatcaagcagaggggcatcctgggttactcccagatcggcgccggcgtctacaaggaggggacgttccacaccatgtggcacgtgacgcggggcgccgtgctcatgcatcgcgggaagagaatcgagcccagctgggctgacgtcaagaaggacctgatctcctacggcggaggctggaagcttgagggcgagtggaaagagggggaagaggtccaggtgctcgcgctggagcccggtaagaacccccgcgcggtccaaaccaagcccgggatatttaagacgaacaccggcaccatcggggccgtgagcctggacttctcccccggcacaagcggctcccccatcgtggaccggaagggtaaggtcgtaggcctctacggtaacggcgtggtcacgcgcagcggcgcctacgtgtccgctatagcgcagaccgagaagtccattgaggacaatccggagatcgaagacgatatcttccggaagaaaagactaactatcatggaccttcaccccggggccggcaagaccaagcggtacctccccgccatcgtgcgcgaggccatcaagagggggctgcgcacgctcatcctggccccgacccgcgtcgtggccgccgagatggaggaggccctccggggcctccccatccgctaccagacccccgccatcaagaccgagcacacggggcgggagatcgttgacctgatgtgccacgccaccttcaccatgcgcctcctgagcccagtccgggtgccgaactacaacctgatcatcatggatgaggcgcactttaccgaccccgcctccatcgccgcccggggctacatctcgacgcgggtggagatgggcgaggccgctgggatcttcatgaccgccactccacctggctcccgcgaccccttcccccagagcaatgccccgatcatggacgaggaaagggagatccccgaacgctcgtggaacagcgggcacgagtgggtcaccgacttcaagggcaagacggtgtggttcgtgccgagtatcaaggccgggaacgacatcgcggcctgcctccggaagaatggcaagaaggtcatccaactgagccgcaagaccttcgactccgagtacgtgaagacccgggccaacgactgggacttcgtggtcaccacggacatcagcgagatgggcgccaactttaaggccgagcgcgtgatcgaccccagaagatgcatgaaacccgtgatcctgaccgacggggaagagcgggttatcctcgcgggccccatgccggtgacccactccagcgccgcccaacgccgggggcgcatcggccgcaaccccaagaacgagaacgaccagtacatctacatgggggagccccttgaaaacgacgaggactgcgcccactggaaggaggcaaagatgctactcgataacatcaacacccccgagggaatcatcccgtccatgttcgagcccgagcgggagaaggtggacgcgatagacggcgagtaccgcctacggggggaggcccgcaagacctttgtagacctaatgcgacgcggcgacttgcccgtgtggctggcttacaaagtagccgccgaagggatcaactacgcggaccggaaatggtgcttcgacggcatcaagaacaaccaaatcctcgaggagaacatggaggtagagatctggaccaaggagggggagcgtaagaagctcaagccgcggtggctggacgcacgcatttacagcgaccccctggccctcaaggagttcaaggaattcgccgcgggccggaagtccctgaccctgaacctcattacagaaatgggccgcctgcccacgttcatgactcagaaggcccggaacgctctggacaacttggccgtgctgcacaccgccgaggccgggggccgcgcctacaaccacgcccttagcgagctccccgagaccctggagacgctcctcctgctaaccctcctggccaccgtaaccgggggcatcttcctgtttctcatgtccggcaaggggatcggcaagatgaccctggggatgtgctgcataatcacggcgtcaatcctgctctggtacgcacagatccagccgcactggatagccgcctccatcatcctggaattcttcctgattgtgctgctgatcccggagcccgagaagcagcgtacgccccaagacaaccagttaacctacgtggtcatcgccatcctcaccgtggtggccgcgacgatggccaacgaaatgggcttcctggagaagaccaagaaggacctggggctaggcagcattaccacccaggagtcggaatccaacatcctggacatcgatctacgaccggccagcgcctggacgctctatgccgtggcgaccaccttcgtgacgccaatgctgcggcactccatcgaaaacagctccgttaacgtcagcctgacggccatagccaaccaggccaccgtgctcatgggtctggggaagggttggcccctgtccaagatggacatcggcgtgcccctcctggcgatcggctgctacagccaggtcaacccgatcaccctgaccgccgccctcctgctgcttgtggctcactacgccatcatcggcccaggcctgcaggcgaaggccactcgcgaggcccagaagcgggccgcagcgggcattatgaagaaccccacagtggacgggatcaccgtcatcgacctggagcccatcccgtacgaccccaagttcgagaagcagctcggccaagtgatgctgctgatcctgtgcgtgactcaggtcctgatgatgcgcacgacctgggctctctgtgaggccctcaccctggccaccgggccaatctcgacgctgtgggagggcaaccccgggagattttggaacaccacgatcgccgtgagcatggcgaacatcttccgcggctcctacctcgcaggcgcagggctgctgttcagcatcatgaagaataccacgtcgacccgccggggcaccgggaacataggtgagactctcggcgagaagtggaaatcccgcctgaacgccctcggaaaatccgaatttcagatctataagaagtcaggcatccaggaggtggaccggacgctcgcgaaagaggggatcaagcgcggcgagacagaccaccatgccgtcagtcgggggagcgccaaacttagatggttcgtggagcggaatatggtgaccccggagggcaaggtcgtggacctaggctgcgggcgcggcgggtggtcctactattgcggcgggctcaagaacgtgcgggaggtgaagggcctgaccaagggcgggcccggccacgaggagcccattcccatgtctacgtacgggtggaatctggtgcgactccagagcggcgtggacgtattcttcaccccgcccgagaagtgcgacaccctgctgtgcgacatcggcgagagcagccccaaccccaccatcgaagccggacggacgctccgtgtgcttaacctggtagagaattggctcaataacaacacgcagttttgcatcaaggtccttaacccgtacatgccctccgtgatcgaaaagatggaggccctgcagcgacagtacggcggggcgctggtgaggaaccccctgagccggaactccacccacgagatgtactgggtcagcaatgccaccggtaacatcgtgtcctcagtgaacatgatctcccgcatgttaataaaccggttcaccatgaagcacaagaaggccacgtacgaaccggatgtcgatctggggagcggcacgcgcaacatcgggatagagtccgagatcccgaacctcgacatcatcggcaagcggatcgaaaagatcaagcaggagcacgagataagctggcactacgaccaggaccatccctacaagacctgggcctaccatggatcctacgagaccaagcagacgggtagcgcgtccagcatggtcaacggagtggtcagactgctgacgaagccctgggacgtcgttccgatggtcacccagatggcgatgacagacacgacgcccttcgggcagcagcgcgtgttcaaggagaaggtggatacccggacgcaggagcccaaggagggcacgaagaaactcatgaagatcaccgccgagtggctgtggaaggagctgggcaagaagaagacgccccggatgtgcactcgggaagagttcacgaaaaaagtacgctccaacgccgccctcggggctatcttcaccgacgaaaacaagtggaaatccgcaagagaggccgtggaggacggtcgcttctgggagctggtggaccgggagcgcaatctgcacctcgaggggaaatgcgagacctgcgtctacaacatgatgggcaagcgcgagaagaagctgggggagttcggcaaggccaagggctccagggctatctggtacatgtggctaggtgcgagattcttggagttcgaggccctgggcttcctgaacgaggaccactggttcagccgcgggaacagcctctccggggttgagggtgaaggcttacaccggttggggtacatcctccgcgacgtcgggaaaaaggagggcggggccatgtacgcggatgacaccgccggctgggacacgcggatcaccctggaggacctgaagaatgaagagatggtgacgaaccacatgaagggggagcacaagaagcttgcggaggccattttcaagctgacctaccagaataaggtcgtccgcgtgcagcggccgacgccgcgcggcaccgttatggacatcatctcccggcgcgaccagcggggctccggacaagtcggcacctacgggctgaacacgtttacgaatatggaagcccaactcatccgccagatggagggcgagggcatcttcaagagcatccagcacctcaccgccactgaggagatcgccgtgcagaactggctggcgagggtgggccgagagagactctcccggatggccatcagcggcgacgactgcgtcgtgaagcccatcgacgaccgcttcgcctccgcgttgacggcccttaatgacatggggaaggtgcggaaggatattcagcagtgggagcccagccgcggctggaacgactggacgcaggtaccgttttgctcccaccactttcacgagctcgtaatgaaggacgggcgggtgttagtcgtgccctgccgaaaccaggacgagcttatcggccgggcgcgcatcagccagggcgccgggtggtccctcaaggagaccgcctgcctgggcaagagttacgcccagatgtggaccctgatgtatttccaccggcgcgacctccgactggccgcgaacgctatctgctccgccgtcccgtctcactgggtccccacctcccgcacgacatggagcatccacgcaaagcacgaatggatgacaaccgaggacatgctggcggtgtggaaccgggtgtggatccaggagaacccgtggatggaggacaagacccccgtagagtcctgggaggaggtgccctatctcggaaaacgcgaagaccagtggtgcggcagcctgatcgggttaacgagccgggccacctgggccaagaacatccagaccgccatcaaccaggtgcgctcgctcatcggcaacgaggaatataccgactacatgcccagcatgaagcgatttcgccgcgaggaggaggaggccggcgtcttgtggtga

SEQ ID NO: 25007 - RNA, 9876 nt, synthetic construct
  misc_feature 1..9876: note = derived and/or modified CDS sequence (opt11) from DENV-2__EU596495__SS-prME
  source 1..9876: mol_type = other RNA
accgcgggcgtcatagtcatgctgatcccgaccgccatggcattccacctcaccacccgcaacggggagccccacatgatcgtgggccggcaggagaaggggaagtccctgctgttcaagactgaggacggcgtgaacatgtgtaccctcatggccatcgacctgggggagctgtgcgaggacaccatcacctataagtgccccctactgcgtcagaacgagcccgaggacatcgactgctggtgcaactccaccagcacctgggtcacatacgggacctgcaccacgacgggcgagcaccggcgggagaagcggtccgtggccctggtaccccacgtcgggatgggcctcgagacccgcaccgagacttggatgagcagcgaaggcgcctggaagcacgtgcagcggatcgagacctggattttacgccacccggggttcaccataatggcggcgatcctggcatacaccatcgggaccacgcactttcagcgggccctcatcttcatcctgctgaccgccgtggcgccgagcatgaccatgcgatgcattgggattagcaaccgggattttgtcgaaggcgtgagcgggggcagctgggtggacatcgtcctcgagcacgggagctgcgtgactacgatggcaaagaacaaacccaccttggacttcgagctgatcaagaccgaggccaagcaacccgccaccctccgcaagtactgcatcgaggctaagctgacgaataccacaaccgaatcccggtgcccgacgcagggcgagcccagcctgaacgaggagcaagacaagcgattcatctgcaagcactccatggtggaccggggctgggggaacggctgcggcctgttcggcaaaggcggcatcgtgacctgcgctatgttcacgtgcaagaagaacatggagggcaaggtggtgcaacccgaaaacctggaatacaccatagtcatcacgccccactcgggggaggagcacgccgtgggcaacgacaccgggaagcacggtaaagagatcaagatcaccccacagagtagcatcaccgaggccgagctgacagggtacggcacagtgaccatggagtgtagcccccggaccggcttggacttcaatgagatggtcctgctgcagatggaggacaaagcctggctggtgcatcggcagtggttcctggatctgcccctcccttggctgccgggggctgacacccaaggcagcaactggatccagaaggagacgctggtgactttcaagaacccccacgcgaagaagcaggatgtcgtggtcctcgggtcgcaggagggcgcgatgcacaccgcactgacaggggcaacggagatccagatgagcagcggcaacctcctcttcaccggccacctgaagtgccggctccggatggacaagctccagctgaaggggatgtcctattccatgtgcacagggaagttcaagatcgtgaaggagatcgccgagacgcagcacggaacgatcgtgatccgcgtccagtacgagggcgacggctccccctgtaagatcccgttcgagatcaccgacctggaaaaacggcacgtcctcgggcgcttaatcactgtgaaccccatcgttaccggcaaagacagccctgtgaacattgaagcggagccgccattcggtgactcctacatcataataggcgttgagccggggcagctgaagctcaactggttcaaaaagggcagctccatcggccagatgttcgagacgaccatgcggggggccaagcggatggcaatcctgggcgacaccgcctgggacttcgggtcattgggcggggtcttcacctccatcggcaaggccctccaccaggtatttggcgcgatctacggtgcagccttctccggcgtgtcatggaccatgaaaatcctgatcggggtcatcatcacctggataggaatgaattcccgctcaacgtcactctcagtgagcctggttcttgtcggggtggtgactctgtacctgggcgccgtcgttcaggctgattccggctgcgtggtctcatggaagaacaaggagttaaagtgcgggtctggcatcttcattacggacaacgtgcacacctggaccgagcagtataagtttcagcccgaaagcccaagcaagctggcttccgcgatccagaaggcccacgaggagggaatctgcggcatccgcagcgtgacccgcctggagaacctcatgtggaaacagatcacacccgagctgaatcacatcctgtccgagaacgaggtcaagctcaccatcatgacgggggacatcaaaggcatcatgcaggccggcaagcgttccctgcgcccgcaacccaccgagttaaagtactcctggaagacttgggggaaggcgaagatgctcagcaccgagtcacacaaccagaccttcctgatcgacgggcccgagaccgccgagtgcccgaacacgaaccgagcttggaacagcctggaggtggaggactacgggttcggcgtgttcaccaccaatatctggctcaaactgcgcgagaagcaggacgtcttttgcgattccaagctgatgtcggccgctatcaaggacaaccgagcggtgcatgccgacatgggctactggatcgaatcggccctcaacgatacgtggaaaatggagaaggcctcgttcatagaagtgaagtcctgccattggccgaagagccacaccctgtggtccaatggggtcctggagagcgagatgatcatccccaagaacttcgccgggcccgtgtcccagcacaattaccgcccggggtaccacacgcagaccgcaggcccgtggcatctcgggaagctggagatggacttcgacttttgcgagggcaccaccgtggtcgtgacggaggactgcggcaatagagggccatcactacgcaccacgactgccagcggaaagctcattacggagtggtgctgccggtcttgcaccctgccgccgcttcgataccgcggggaagacgggtgctggtatgggatggagatccgcccattgaaggagaaggaggagaacctggtaaacagcctggtcaccgccggtcatggccagatagacaacttctccctcggggtgctggggatggccctgttcctcgaggagatgctgcgaacccgcattgggacgaagcacgcgatcctgctcgtggccgtctcgttcgtgaccctgatcaccggcaacatgagcttccgggaccttgggcgcgtgatggtcatggtgggtgccaccatgactgacgacattgggatgggggtgacctacctcgctctcttagcagcgttcaaagtccgccccaccttcgcagcgggcctcttgctgcggaagttaaccagcaaggagctgatgatggccaccatcgggatcgccttgctctcccaatcgaccatccccgagacgatcctggagctgaccgacgcgctcgcccttggcatgatggtgttaaagatagtgcgcaacatggaaaagtaccaactcgccgttacgatcatggccatcagttgcgtgccgaacgccgtgattctgcaaaatgcgtggaaggtcagctgcaccatcctggccgccgttagcgtcagtccccttctgctgaccagctcccagcagaaggccgactggatccccctcgcgctcaccatcaagggccttaaccccacggccatcttcctcaccactctgtcccggaccagcaaaaagcgctcctggccgctgaacgaggccatcatggccgtggggatggtaagcatactcgccagcagcctgctgaagaacgatatccctatgacaggccccctcgtagccggagggctgctgaccgtgtgctatgtcctcaccgggcggagcgccgacctcgagctggagcgcgccgcagacgtaaaatgggaggaccaagctgagatatccggaagctccccaattctcagcatcaccatcagtgaggacgggtcgatgagcatcaagaacgaggaggaagagcaaacgctgaccatactcatccggacggggctcctggtcatctcaggcgtgttcccggtctccatccccatcaccgcggctgcctggtacctgtgggaggtcaagaagcagcgggccggggtgctctgggacgtccctagcccgccgcccgtggagaaggccgagcttgaggacggcgcgtaccggatcaaacagcgtggtatcttaggctacagccagataggcgcaggggtgtacaaggaaggcaccttccacacgatgtggcacgtcacccgcggggcggtgctcatgcatcggggcaaacgtatcgaacccagctgggccgacgttaagaaggacctgatttcctacggtggaggctggaaactagagggagagtggaaggaaggcgaggaagtccaggtgctcgccctggagccagggaaaaatccccgcgcggtgcagacaaagccaggcatcttcaagaccaacacggggaccatcggcgccgtcagtcttgacttctcccccggcacgagcgggtcacccatagtggaccggaagggcaaggtggtcgggctctacggcaacggcgtagtcacccgcagcggtgcctatgtatctgccatcgcgcagacggagaagtccatcgaggacaatcccgagatcgaggacgatatcttccggaagaagcgcctgaccatcatggacctgcaccccggcgccgggaagaccaagaggtatctccccgccatcgtgcgcgaggccatcaagcggggtctgcggaccctgatcctggccccgacgcgcgtagttgcggccgagatggaggaggccttgcgggggctgccgatccgctaccagacccccgcaatcaagaccgagcacacgggacgtgagatcgtggatctgatgtgccacgccacgttcaccatgcgcctcctctcacccgtgcgggtaccgaactacaacctgatcatcatggacgaggcgcacttcaccgaccccgcctccatcgcggcccgcggctatatcagcacccgggtcgaaatgggggaggccgcgggcatcttcatgactgccacgccgcccgggtcccgcgacccgttcccacagagcaacgcgcccatcatggacgaggagcgggagatccccgagcgctcctggaacagcggccatgagtgggtgaccgacttcaagggcaagaccgtttggttcgtgccgtccatcaaggcaggcaacgacatcgcggcctgtctccggaagaatggcaagaaggtcatccagttatcacgcaagacattcgactctgagtacgtcaagacccgggccaatgactgggactttgtggtgaccacagacatctctgagatgggggccaacttcaaggccgagcgtgtcatcgacccacgccgctgcatgaagcccgtgatcttaacggacggcgaggaacgggtgatcctagcggggccgatgcccgtcacccattccagcgctgcccagcgccgggggcgcataggtcgcaaccccaagaacgagaacgaccagtatatctacatgggcgagcccttagagaatgacgaagactgcgcacattggaaggaggccaagatgctgttggacaacatcaacacccccgagggcatcatcccgtccatgttcgagcccgagcgggagaaggtagacgcgatcgacggggaataccgcctgcggggcgaggcccgcaagaccttcgtcgacctgatgagacgcggggacctccccgtatggcttgcatacaaggtggccgccgagggcatcaattacgcggacagaaagtggtgcttcgacgggatcaagaacaatcaaatactggaggagaacatggaggtggagatctggacgaaggagggcgagcgcaagaagctcaaaccgcggtggctggacgcccgcatctactctgatcccctggctctcaaggagttcaaggagtttgccgcgggtcggaagtccctgaccctgaacctgatcacagagatggggcgattacccaccttcatgacgcaaaaggctcggaacgccctggacaatctcgccgtacttcacaccgcggaggcgggtggccgggcatacaaccacgccctaagcgagctccccgagaccctggagacccttctgctgttaacgctcctggccaccgttaccggcggcatcttcctgttcctcatgtccgggaagggaatcgggaagatgaccttaggcatgtgctgcatcattactgccagcatcctgctctggtacgcgcagatccagccgcactggatcgccgcctccattatcctggagttcttcctgatcgtcctcttaatccccgagcccgaaaagcagcggacgccccaggacaaccagctgacttacgtggtcatcgccatactcaccgtcgtagccgcgaccatggccaacgagatggggtttctggagaagacaaagaaggacttgggcctcggcagcataaccacgcaggagtccgagtctaatatcctggacatcgatctgcgcccggcttctgcctggactctatacgccgtggcgacgacctttgtcacccccatgctgcggcactctatcgagaacagctccgtgaacgtgagcctgactgccatcgccaaccaggccacggtcctcatggggctgggcaaggggtggcccctgagcaagatggacattggcgtgcccctgctggcgatcgggtgctactcacaagtaaacccgatcacactgacggccgcgcttctactcctcgtcgcccactatgccatcatcggccccggcctgcaggcgaaggccacacgcgaggcccagaaacgggccgccgcggggataatgaagaaccccacggttgacggcataaccgtgatcgacctggagcccatcccgtacgacccgaagttcgagaagcagcttgggcaagtcatgctgcttatactctgcgtaacccaggtgctgatgatgcgcaccacgtgggccctctgtgaggccctcaccctggccacaggccccatatccaccctgtgggaggggaatcccggccggttctggaacacgaccatcgccgtcagcatggcgaacatcttccgcggctcctacctggccggggccggcctactgttcagcatcatgaagaacaccacctccactcgccggggtaccggcaacataggtgaaaccctcggggagaagtggaagtcccgcctgaacgctctgggtaagtcagaattccagatctataagaagtccgggatccaggaagtggaccggaccctcgcgaaggagggcatcaagcgcggggagacggaccaccatgccgtctcacgggggagcgccaagctgcgctggttcgtcgagcggaacatggtgaccccggagggcaaggttgttgaccttgggtgtgggcgcgggggctggagctactattgtgggggcctcaagaacgtgcgggaggtgaagggcctgaccaagggcgggcccggtcacgaggagccgatccccatgtcgacctacggctggaacctggtgcgcttgcagagtggggtggacgtattcttcacgccgcccgagaagtgtgacaccctgctatgtgacatcggcgagtccagccccaaccccaccatcgaagccggccgaaccctccgcgtcctcaacctggtggaaaactggctcaacaataacacccagttctgcatcaaggtgttgaacccctacatgccctcagtcatcgagaagatggaggccctgcagcggcagtacgggggcgcactcgtgcgcaaccccctgagccggaactccacgcacgaaatgtactgggttagcaacgccaccgggaacatcgtctccagtgtgaacatgatcagccgcatgctgatcaaccgtttcaccatgaagcacaagaaggccacctacgagccggacgtcgacctgggcagcgggacgcgcaatatcggcatcgagtccgaaatacccaatctcgacataatcggcaagcggatcgagaaaatcaagcaggagcacgagataagctggcactatgatcaggaccacccctacaagacctgggcataccacgggtcttacgagacaaagcagaccggctcggcgtccagcatggtcaacggggtggttcggctgctgacgaagccctgggacgttgtaccgatggtgacccagatggccatgaccgacaccacgccattcggccagcagcgcgtcttcaaggaaaaggtggatacccggacccaggagcccaaagagggcacaaagaaactcatgaagattacggccgagtggctatggaaggagctggggaagaagaagacgccccgtatgtgcacccgggaggagttcacgaagaaggtgcgctccaacgccgccctcggagccatcttcaccgacgagaataaatggaagtcagcgcgcgaggcggtcgaggacgggcgcttctgggagttggtggaccgggaacgcaacttacacctcgagggcaagtgcgaaacgtgcgtgtataacatgatggggaaacgggagaagaagctgggagagttcggcaaagcgaaagggtctcgcgctatatggtatatgtggctgggcgcgcggttcttagagttcgaggcactgggcttcctgaacgaagatcactggttcagccgcggcaacagcctctccggggtcgagggcgagggcctgcaccgactgggctacattctccgcgacgtcggcaagaaagagggcggggccatgtacgccgacgacaccgcgggatgggacactcggatcacgttggaggatctgaagaatgaggagatggtaaccaaccacatgaagggcgagcacaaaaaactagcggaggcaatcttcaagctcacctaccagaacaaggtggtcagggtacagcggccgactccccgcggcacggtaatggacatcatttcccggcgcgatcaacgggggtccggccaggtagggacctacggcctgaacacctttacgaacatggaggcccagctcatccgccagatggagggcgaggggatattcaagagcatccagcacctgacagccaccgaggaaatcgccgtgcagaactggctggcacgcgtaggccgggagcgactctcccggatggccatcagcggcgacgactgcgtggtgaagcctatcgacgatcgcttcgcctccgccctgacagccctgaacgacatgggcaaggtgcggaaggacatccagcagtgggaacccagccgcgggtggaacgactggacccaagtgccgttctgctctcatcatttccacgagctcgtcatgaaggacggccgggtgctggtcgtcccgtgccgcaatcaggatgagctaatcggccgggccaggataagccagggggcgggctggtccctcaaggagacggcctgtctcggcaagagctacgcacagatgtggaccctgatgtatttccatcggagagacctccgactggccgcgaacgcgatctgctccgccgtgccctcacattgggtgccaacctcacgcaccacctggtcgatccacgccaaacacgagtggatgacgaccgaggacatgttagcagtctggaatcgggtttggatccaggagaacccttggatggaggacaagacccccgtggagtcgtgggaggaggtcccttacctaggcaagcgcgaagaccagtggtgcgggtccctgatcggccttaccagccgggccacgtgggccaagaacattcagaccgcaatcaaccaggtgcgcagcctcatcggcaatgaagagtacaccgactacatgcccagcatgaagcggttccgacgcgaggaggaggaggcaggggtgctgtggtga

SEQ ID NO: 25008 - RNA, 9876 nt, synthetic construct
  misc_feature 1..9876: note = derived and/or modified CDS sequence (opt11) from DENV-2__EU596497__SS-prME
  source 1..9876: mol_type = other RNA
accgccggcgtgatcgtcatgctgatacccaccgccatggctttccacctcaccacccgcaacggggagccccatatgatagtgggccggcaggagaagggcaagtccctgctgttcaagaccgaggatggcgtgaacatgtgtaccctaatggccattgacctgggggagctgtgcgaggacaccataacctacaagtgcccactcttacgccagaatgaacccgaagatattgactgctggtgtaactccaccagcacctgggtcacctacgggacatgcaccaccacgggggagcaccgccgcgagaagcgctccgtagctctggttccccacgtcgggatgggcctagagacccgcaccgagacctggatgagcagcgagggggcctggaaacatgtccagcggatcgagacgtggatcctgcgccacccgggcttcaccatcatggcagcgatcctcgcctataccatcgggacgacgcatttccagcgggccctcattttcatactcctgaccgcggttgcgcccagcatgaccatgagatgcataggcataagcaaccgggatttcgtcgaaggcgtgagtgggggctcgtgggtcgacatcgtcctcgaacatgggagctgcgtgaccacgatggctaagaacaaacccaccctggattttgagctgatcaagaccgaggccaaacagcccgccaccctccgcaagtactgtatagaagcaaagctgacgaacactatcactgagtcccggtgcccgacccagggcgagcccagtctgaacgaggagcaggataagaggtttatctgcaagcactccatggtggaccggggctggggaaacggatgcgggctcttcggtaagggcgggatcgtcacgtgcgcgatgttcacgtgcaagaaaaatatggaaggcaaagttgtgcagcccgagaatctggaatacaccatcgtcataacgcctcacagcggggaggagcacgctgtgggcaacgacactgggaagcacggcaaggagataaagatcaccccgcagtccagcatcactgaggccgaactgaccgggtacggaacagtgacgatggagtgctctccccggactggactcgatttcaacgagatggtcctgctgcagatggaggacaaggcctggctcgtgcaccggcagtggttcctggatctgccgctcccatggctgccgggggccgacacccaagggagcaattggatccagaaagagaccctggtgacgttcaagaatcctcacgcgaagaagcaggatgtcgtggtgctcgggagccaggagggggccatgcacactgcactgacgggggctacggaaatccagatgagcagcggcaacttgctgttcacgggccacttaaagtgccgcctgcggatggacaagttacagctgaagggaatgtcctatagcatgtgcaccggcaagtttaaaattgtgaaagagatcgccgagacccagcacggtaccatcgtgatccgcgtccaatacgaaggcgacggctccccctgcaagatccccttcgagatcacggacctggagaagaggcacgtgctcggccgcctgatcaccgtgaatcctatcgtcaccgagaaggacagccctgttaacatcgaggcggagcctccattcggcgattcctacatcatcatcggggtcgagccgggacagctaaagctcaactggttcaagaaggggagctccattggccagatgttcgagaccacgatgcgcggcgctaaacggatggcgatcctgggggacacagcgtgggactttgggagcctcgggggcgtctttacctcaatcgggaaggctctgcaccaggtgtttggcgcgatctacggcgccgccttcagcggagtgtcttggaccatgaagatcctgatcggtgtcatcatcacttggatcggtatgaatagtcggtccacgtccctgtctgtgagcttggtgctcgtcggcgttgtgaccctgtatctgggggccgtcgtgcaggcagactccggctgcgttgttagctggaagaacaaagagctcaagtgtggctccggaatcttcattacagacaacgtccacacgtggaccgaacagtataaattccagcccgagagccccagcaagctggcctctgcgatccagaaggcccacgaggagggcatttgcgggatccgctcggtcacgcgcctcgagaaccttatgtggaagcagattacccccgagctgaaccacattttgtccgagaatgaggtaaagctcacgatcatgaccggggacatcaaggggattatgcaggcgggcaagcgtagtttgcgcccgcagcccacagagttgaagtactcctggaagacctgggggaaggcgaagatgctaagcacggagtcccacaaccaaaccttcctgatcgacggtcccgaaacggcagagtgcccgaacaccaatcgggcctggaactccctggaggtcgaggattacggattcggcgtgtttacgaccaatatctggctaaagcttagagagaaacaggacgtcttctgcgactccaagctgatgagcgccgccatcaaagacaaccgggcggtgcacgccgacatgggctattggatcgagtccgccctcaacgatacctggaagatggagaaggccagctttatagaggtgaagtcctgtcactggcccaagagctacaccctgtggagcaatggcgtactggagtctgagatgatcatccccaagaactttgcagggcccgtatctcagcacaactaccgcccgggctaccatacccagacggcggggccctggcacctcggcaagttagagatggatttcgatttctgcgaggggacaaccgtcgttgtcaccgaggactgcggcaacagaggcccgagcctgcgcacgaccacggccagcgggaagctcatcaccgagtggtgctgccggtcctgcacgctgcccccgctgcgctaccggggcgaagacggatgctggtatggcatggagatccgccccctcaaggagaaagaggagaacctggtgaactccctggtcaccgcggggcacggccagatcgataacttcagtctcggtgtgttagggatggctcttttcctcgaagagatgttgcggacccgcatcggaaccaaacacgcgatcctgctagtggccgtctcattcgtcacactgataacaggcaacatgtcctttcgggacctggggagggttatggtcatggtgggggccaccatgacggacgacatcggcatgggagtgacgtacctcgcgctcctcgccgccttcaaggtcaggccaaccttcgctgcggggcttctgctgcggaagctcactagtaaggagttaatgatggcgaccatcggtatcgcgctgctctcccaaagcactatacccgagactatcctggaactgacagatgccctcgcactggggatgatggtgctgaagatcgttcggaacatggagaagtaccagctcgccgtgaccataatggccatctcctgcgtgccaaacgcagtgatactgcagaacgcgtggaaagtaagctgcacaatcctcgccgccgtgtccgtcagcccgctactgctgacctccagccagcagaaggctgactggatccccctcgcccttacgatcaagggcctaaacccaaccgctatcttcctcacgaccctatcccggaccagcaagaagcgctcctggccgctcaacgaggccatcatggccgtgggtatggtgtcaatcctcgcctccagcctgctgaaaaacgacatccccatgaccgggccactcgtcgcgggcggattgctgacggtgtgctacgtgctcacaggcagaagcgccgacctggagctggaacgcgctgccgacgtgaagtgggaggaccaggccgagatttcggggagcagccctattctcagcatcactatctccgaggacggaagcatgtccatcaagaacgaggaggaggagcaaaccctgacgatcctgatccggaccggtctcttggtgatcagcggggtgttccctgtctccatccccataaccgcggccgcctggtacctgtgggaggtgaagaagcaaagagccggcgtgctttgggatgtcccctcaccaccgccagttgagaaagccgagttggaggatggggcataccggattaagcagcgcggcatcctggggtactcgcagatcggcgctggagtgtacaaagaagggactttccacaccatgtggcatgtgactcggggcgcagtgctcatgcaccgggggaagcggatagagcccagctgggccgacgtgaaaaaggacctgatctcctacggggggggctggaagctggaaggcgagtggaaggaaggggaggaggtccaggtgttagccctggagcccggcaagaacccccgcgcggtgcagactaaacctggaatttttaagaccaacaccggcacgatcggggcagtcagcttggacttctcgcccggcaccagcggctcccccatcgtggaccggaagggcaaagtggtaggcctgtacgggaacggcgtggtgaccaggagcggcgcgtacgtctccgccattgcacagaccgagaaatcgatcgaggacaaccctgagatcgaggatgacattttccgaaaaaagcgcctgacgatcatggacctgcaccccggggccgggaagactaagcggtacctccccgccattgtgcgcgaggccattaagcgggggcttcggacactgatcctggccccgacccgcgtggtcgctgccgagatggaagaagcactccgcggcctgcccatacgctaccaaacgcccgccattaagaccgaacacacagggcgggagatcgtggacctgatgtgccatgcaaccttcacgatgagattactgagccccgtacgggtcccgaactacaacctgataataatggacgaagcgcacttcaccgaccctgcctcaatcgcggcccgcggctacatcagtacgcgggttgaaatgggcgaggccgctgggatcttcatgaccgccacaccgcccgggtcccgagaccctttcccgcagagcaacgcccccatcatggacgaagagagggagatacccgagcgttcctggaatagtggacatgagtgggttaccgacttcaaaggcaagaccgtctggttcgtgccgagtatcaaggctggtaacgacatagcggcctgcctccggaagaacggtaagaaggtgatccaactgtcacgcaagaccttcgatagtgagtacgttaagacgcgggccaacgactgggacttcgtcgtgaccaccgacatcagtgagatgggcgccaacttcaaggccgagcgcgtcatagacccccggcgctgcatgaagcccgtgatcctgacggacggggaggagcgcgtgatcctcgcgggtccgatgccggtcacccacagcagcgccgcccagcgccgggggaggatcggccgcaaccctaaaaacgagaacgaccagtacatatacatgggggagcccctggagaacgacgaggactgcgcgcattggaaggaggccaagatgctgctcgacaacatcaacacgccagagggcatcatcccctccatgtttgagccagagcgggagaaggttgacgcgatcgacggagagtaccgcctgcgcggcgaggccaggaagaccttcgtagaccttatgcggcgcggcgatctccccgtatggctggcctacaaggtggccgcagaggggattaattatgcggaccggaaatggtgcttcgacgggatcaaaaacaaccagatactggaagagaacatggaagtggagatctggaccaaggagggggaacgtaagaagcttaagccgcggtggttagacgctcgcatctacagcgacccactggccctcaaggagttcaaggagttcgccgcgggcagaaagtccctcacgctgaatctcatcaccgagatgggcagactgcctaccttcatgacccaaaaagcccgaaacgccttggataacctggccgtcctgcatactgctgaggccgggggccgcgcctacaaccacgccttgagcgagctccccgaaacactggaaacccttctcttgttgaccctactggccacggtgaccgggggcatcttcctgttcctcatgagtggcaaggggatcggcaagatgacgctagggatgtgctgcatcatcaccgccagcatccttctctggtacgcgcagatccagccacattggatagcagcctccatcatcctggagttttttctgatcgtcctcctgatccctgagccggaaaagcagcggacgccgcaggacaaccagctgacctatgtagtgatcgccatccttaccgtcgtggccgcgaccatggccaatgagatgggcttcctggagaagaccaagaaggacctcgggctcgggagtattaccacccaggagagcgagtccaacatcctggacatcgacctgcgaccggccagcgcgtggactctttacgctgtggcgaccacgttcgtcaccccgatgctgcggcactccatagaaaacagctccgttaacgtgagtctgaccgccatagcgaatcaagccaccgtcctcatgggcctggggaagggctggcccctgtccaagatggatatcggggtccccctcctggcgattggctgttacagccaggtgaatccaataacgctgaccgccgccctcctgctgctcgtcgcccattacgcaatcattggcccgggcctgcaggcgaaggcaacccgcgaagcacagaaaagagccgccgcgggaatcatgaagaatccaaccgtggatgggatcacggtgatcgatttagagccaatcccctacgatcccaagttcgagaagcagctcggccaggtcatgctgctgatcctctgcgtgacccaggtgctcatgatgcgcaccacctgggcgttgtgcgaggccctcaccctggccaccgggcccatctcgaccctgtgggagggcaaccccggtcgattctggaatacgacgatcgcggtctcgatggctaacatcttccgcggctcctacctagccggcgccggtctgcttttcagcatcatgaagaacaccacctccactcgccggggtacggggaacatcggcgagacactgggcgagaagtggaaaagccgcctgaacgccttagggaagtctgagttccaaatctacaagaagtccggcattcaggaagtggaccggacccttgcgaaggaggggatcaagcgcggcgagaccgaccaccacgccgtgtcccgggggagcgccaagctgcgctggtttgtcgagcgcaacatggtgacgccggagggcaaagtggtggacctgggctgcgggcgcggcggttggtcctattattgtggggggctcaagaacgttcgggaagtgaagggcttaaccaaaggcggccccggccatgaagagcccatccctatgagcacctacgggtggaacctggtcaggctccagagcggagtggatgtgttctttaccccgcccgagaagtgcgacacgttactgtgcgacatcggcgagtccagccccaacccaaccatcgaagcaggccgaaccctccgcgtcctgaacttggtcgagaactggctaaacaacaacactcagttctgcattaaggtgctgaacccatacatgccctccgttatcgagaaaatggaggccctgcagagacagtatggcggggcgctcgtacgcaacccactgagccggaacagtacccacgagatgtattgggtaagcaacgccactggcaatatcgtatccagcgtaaacatgatctcccgcatgctgatcaacaggttcaccatgaagcataagaaggccacatacgagccggacgtggacttagggtcaggcaccagaaatatagggatagagtccgagatccccaacttagacatcatcggcaagcggatcgagaagatcaagcaggagcacgagattagctggcattacgaccaagaccacccctacaagacgtgggcctaccacggctcgtacgagaccaagcagactggttcagcctcctcaatggtcaacggcgtggtgcgcctgctgaccaagccctgggacgtagtgccgatggtgacgcaaatggcaatgaccgataccacccccttcgggcagcagcgcgtcttcaaggagaaagtggacacgcggacccaggagcccaaggagggcacaaagaagctgatgaaaatcaccgccgagtggctatggaaggagctgggcaagaagaagactccccgcatgtgcacccgggaggagttcaccaagaaggtgcgctccaacgcagctctcggggccatctttaccgacgagaataagtggaagtccgccagagaagccgtcgaagacggccgattctgggagctggtggaccgggagcgcaatctgcacttagaggggaagtgtgagacgtgcgtgtacaacatgatgggaaaacgggagaagaagctgggggagttcggaaaggcgaagggtagtagggccatctggtacatgtggctgggggcacgcttccttgagttcgaggccttgggctttctgaacgaagaccactggttcagccgcggtaacagcctatcaggtgtcgagggggaaggactgcaccggctggggtatatcttgcgcgacgtgggtaagaaggaaggcggggccatgtacgccgatgacaccgccggctgggacacccgaatcaccctggaagacttaaagaacgaggagatggtcacgaaccacatgaagggggagcataagaagctcgcagaggccattttcaagctgacctaccagaacaaagtcgtgcgcgttcaacggccgacgccccgcggcaccgtgatggatattatcagccgtagagaccagcggggatccggccaggttggcacgtacggattgaacaccttcaccaacatggaggctcagttaatccgccagatggagggcgaaggtatcttcaaaagcatacagcacctcaccgccacggaagagatcgccgtccaaaattggttggcgcgcgtggggcgggagcgcctatcgaggatggccataagcggcgacgattgcgtcgtcaaacccatcgacgatcgctttgcctccgccctgaccgccctgaatgacatggggaaggtgcgcaaggacatccagcagtgggagcccagccgcggctggaacgactggacccaggtgccgttctgcagtcatcacttccacgagctcgtcatgaaggacgggagggtgctggttgtgccctgccgcaatcaagatgagctgatcggccgcgcgcgcatcagccagggcgccgggtggtccctcaaggagaccgcgtgcctggggaagagctacgcccaaatgtggacgctgatgtacttccacaggcgcgacctccgcctggccgcgaacgccatctgctccgccgttccgagccactgggtgcccacctcccgcaccacctggagcatccacgccaagcacgagtggatgacaacggaggacatgctggcggtctggaatcgggtgtggatccaggagaatccgtggatggaggacaagacacctgtcgagtcatgggaggaggtcccctacctaggcaagcgcgaggatcagtggtgcggcagcctgatcgggcttaccagccgggcaacctgggccaaaaacatccagacggccatcaaccaggtgaggagcctaatcggcaacgaggagtataccgactacatgcctagcatgaagcgatttcgccgcgaggaggaggaagcgggggtgttgtggtga

SEQ ID NO: 25009 - RNA, 9876 nt, synthetic construct
  misc_feature 1..9876: note = derived and/or modified CDS sequence (opt11) from DENV-2__EU569695__SS-prME
  source 1..9876: mol_type = other RNA
accgcgggggtaatcgtcatgctgatccccacagccatggcattccatctcaccacgaggaacggcgaaccccatatgatcgttgggagacaagaaaaaggaaagtcccttctgtttaagacagaggacggagtgaacatgtgcaccctcatggctatcgacctcggggaattatgcgaggataccatcacctacaagtgtcccctcctacgccagaacgagcctgaggacattgattgctggtgcaatagcaccagcacctgggtgacgtacggaacctgcacaacaaccggggagcacaggcgcgagaagcggtccgtggctctggtgccccacgtcgggatgggcctcgagacccgcaccgagacttggatgagcagcgagggggcttggaaacacgtgcagagaatcgagacctggatcctgcgtcacccgggctttaccatcatggccgctatcttggcatacaccatagggaccacgcacttccagcgggctctcatctttatcctactcacggccgtagcgccttccatgaccatgcgctgcataggcatctcaaaccgggacttcgtcgagggcgtgagcggaggaagctgggtggacatcgtcctcgagcacgggagctgcgtgacgacgatggccaagaataagcccacccttgacttcgaactgatcaaaaccgaggccaaacagcccgccaccctccgaaaatactgcatcgaggctaaactgaccaacaccaccactgaatcccggtgcccgacgcaaggcgaacccagcctgaacgaggagcaggacaagcgcttcatctgcaagcactccatggtggaccgcggctgggggaacggctgcggccttttcgggaaaggcggcatcgtgacctgcgcgatgttcacgtgcaagaagaatatggaaggcaaggtggtgcagcccgagaacctggagtacaccatcgtcatcacgccccatagcggggaagagcacgcggttggcaacgacaccgggaagcacggcaaagaaatcaagatcacaccgcagtcctcgatcacggaagccgaactgactgggtatggcacggtgaccatggagtgctcgccccggaccggcttggacttcaatgaaatggtcctcctgcaaatggaagacaaggcatggctggtgcacaggcagtggttcctggacctgcccctcccctggttgccaggggctgatacacagggatctaactggatccagaaggagacgctggtcaccttcaagaacccgcatgcaaagaagcaagacgtcgtggtgctcggatcccaggagggcgccatgcacactgcattaactggcgccacggagatccagatgagcagcggcaacctccttttcaccggccacctgaagtgccgcctgcggatggacaagttgcagctgaaggggatgtcctacagcatgtgcaccggcaagtttaaaatcgtgaaggaaatcgccgagacccagcatggtacgattgtgatccgcgtgcaatacgagggagacggctccccctgcaagatccccttcgagatcaccgacctggagaaacggcacgttttggggcgcctgattacggttaacccgatcgttacggagaaggatagccccgtgaacatcgaggcggaaccgcccttcggcgactcatacatcatcatcggggtggagccgggccagctgaaactaaactggttcaagaagggtagctccataggccaaatgttcgagacgaccatgcgcggcgctaagcggatggcaatcctgggagacaccgcctgggacttcggcagcttaggaggtgtcttcacctcgattgggaaggccctccatcaggtcttcggcgcaatctacggggcagcgttcagcggcgtgtcttggacgatgaagatcctcatcggcgtcatcatcacgtggatcgggatgaacagccgctccacttcgctttctgtaagcctagtgctcgtcggggtggtaaccctgtacctgggtgccgtcgtgcaggcggactccggctgcgtggtatcatggaagaacaaggaacttaagtgcggctccggtatctttatcacggacaacgttcatacctggaccgagcagtacaaatttcaacccgagagccctagcaagctggcgtccgcaattcaaaaggcccacgaggagggcatctgtgggatccggagcgttacgcgactggagaacctcatgtggaagcaaatcacgcccgaactgaaccacattctgtccgagaatgaggtcaagctcaccatcatgaccggcgatatcaaggggatcatgcaggcgggcaagcgcagcctccgcccgcagcccaccgaactgaagtactcttggaagacgtggggcaaggcgaagatgttgtcaactgagtcccacaaccagaccttcctgatcgacgggcccgagacagccgagtgcccgaacacgaacagggcctggaatagcctagaggttgaggactacggattcggggtgtttacgaccaacatctggctcaagctgcgcgaaaagcaggacgtcttctgcgactccaaactgatgtccgccgccatcaaggacaaccgagcggtgcacgccgacatgggatactggattgaatccgctctcaacgacacctggaaaatggaaaaggcctccttcatcgaagtgaagtcctgccactggcccaagagccacaccctgtggtccaacggggtcctggagagcgagatgatcatccccaagaacttcgcgggacccgtgtcccaacacaactaccgcccgggttaccacactcagaccgcgggaccctggcacctcggaaagctggagatggacttcgatttctgcgaggggaccacagtggtcgtcaccgaagactgcggcaatcggggcccgagcctgcgcacaacaaccgccagcggcaagctcattactgagtggtgctgccggtcctgcaccctgcctccgttacgctatcggggcgaggacgggtgctggtacggcatggagatccgcccactcaaggagaaggaggagaacctcgtgaactcgctggtcaccgccgggcacggccagattgacaacttctccctcggggtgctggggatggctctgtttctcgaggagatgctgcggacacgcattggcaccaagcacgctatcctgctcgtggcggtctcgttcgtgaccctgatcaccgggaacatgtcattccgggacctgggccgcgtgatggtcatggtgggggccacgatgacggatgacatcggcatgggcgtgacctacctcgcgctgctggccgcgtttaaggtccgccccaccttcgccgccgggctcctgctgcggaaactcaccagtaaggagctcatgatggccacgattggaatcgcacttttgtcccagagcacgattcccgagaccatcctggaactgaccgacgctctcgcactggggatgatggtgctgaagatcgtgcgtaatatggagaagtatcagctcgccgtgacgatcatggccatttcatgcgttcccaacgccgtgatcctgcagaatgcgtggaaggtgagctgcaccatcctggccgccgtgtccgtcagccccctcctgctgacatccagtcagcagaaggccgattggatcccactcgcgctaaccattaagggcctgaatccgactgccatcttcctaaccaccctgtcccgaacgtctaagaagcgctcttggcccttgaacgaagccatcatggccgtgggaatggtgtccatccttgcctcctcacttctgaagaacgatattccgatgacggggcccctcgtcgccggcggattgctgacggtatgctacgtgctcactggcaggtctgcggacctggagctggagcgcgccgccgacgtcaagtgggaggaccaagccgagatatccggcagcagccccatcctttcaatcaccatatcagaggatggctcaatgtccatcaagaacgaggaggaagaacagacgctgaccatcctgatccggaccggcctcctggtgatctccggggtgttcccggtgtccattcccataaccgcggccgcttggtacctgtgggaggtgaaaaagcagcgtgccggcgtactctgggacgtccccagtccgccgcccgtggagaaggcagagctggaggatggagcgtacaggatcaagcaaagggggatcctggggtactcccagataggcgcgggcgtgtacaaagagggtactttccatacaatgtggcacgtcacccggggtgccgtactcatgcaccgcgggaagcgcatcgagcccagctgggccgacgtgaagaaggacctcatctcctatggcggaggctggaagctggagggcgagtggaaggagggggaggaggtgcaggtgctagcgttagagccaggaaaaaatccaagagcggtgcaaacaaaacccggcatcttcaaaaccaacacgggcacaatcggagccgtcagcctggatttttcccccggcaccagcggctcccccatcgtggaccggaaggggaaagtggttggcctctacgggaacggagtggtaacccgcagtggcgcctatgtttccgccattgctcagactgagaagtccatcgaggacaatcccgagatcgaggacgacatcttccgcaagaagcgcctgaccatcatggacctgcacccgggggccggcaaaaccaagcggtatcttcccgctatcgtgcgtgaggcaatcaagcgcggtctgaggaccctaatcctggccccaacccgcgtggtcgcggccgaaatggaggaagccctccggggcctgccaatccgctaccagacacccgccatcaagaccgagcacaccgggcgggaaattgtggacttgatgtgccacgccacttttaccatgcgactcctgagccccgtgcgggttccgaactacaacctgatcatcatggacgaggcgcacttcaccgaccctgcctccatagccgcccgcggctacatctcaacccgggtagagatgggcgaagctgcgggaatcttcatgacggccacgccgcccggctcccgagacccattcccccagtctaacgcccccattatggacgaggagcgcgagatccccgaacgctcttggaacagtgggcacgaatgggtgaccgacttcaagggcaaaacagtctggttcgtgccgtctatcaaggccggcaacgacatagctgcctgcctccgcaagaacggcaagaaggtgatccagctgtcccgcaaaacgttcgactccgagtatgttaagacccgggcgaacgactgggacttcgtggtaaccaccgacatatcggaaatgggtgccaacttcaaggccgaacgggtaatcgaccccaggcgctgcatgaagcccgtcatcctgacggacggggaggagcgggtgatcctcgcgggccccatgccagtcacacactccagcgccgcccaacggcgggggcggataggcagaaaccccaagaacgagaacgaccaatacatctacatgggggagcccctggaaaacgacgaggactgcgcccactggaaggaggccaagatgttgctggacaacattaatactcccgagggtatcatcccatcgatgtttgaacccgagcgggagaaggtggacgcgatcgacggcgagtatcgccttcgcggggaggcgcgcaagaccttcgtcgacctaatgcggcgcggcgacttacccgtctggctggcctataaggtggccgccgaagggatcaactacgccgaccggaagtggtgcttcgacgggattaagaacaaccagatactggaggagaacatggaggttgagatctggacaaaggagggggagcgcaagaaactcaaaccaaggtggctggacgcccgcatctacagcgaccccctggccctcaaggagttcaaagagttcgccgcgggccggaaatcccttaccctgaacctcatcaccgagatgggccgcctgcccaccttcatgactcagaaggcacggaacgccctagacaacctcgccgtcctgcacaccgccgaagcaggcggcagagcctacaaccacgccttaagtgagctccccgaaaccctcgagacgctactccttctcacgctgctggccaccgtgaccggtggcatattcctgttcctcatgtccggcaaaggcatcggcaagatgaccctggggatgtgctgtatcataaccgcctcaatactgctctggtacgcgcaaatccagcctcattggattgccgcatccatcatcctggaattcttcttgatagtcctgttaatccccgagcccgagaagcagcggacccctcaagataaccagctgacctacgtggtgatcgccatcttaaccgttgtagccgcgaccatggccaacgagatgggcttcctggagaagacaaagaaggacttggggctcggcagcataaccacccaggagagcgagtccaacatcctggacatcgacctgcgtccggccagcgcctggacgctctacgccgtggcgacgacattcgtcacccccatgctgcggcactccatcgagaacagctccgtgaacgtttcactgactgcagtagcgaaccaggccacggtgttaatgggcctggggaaaggctggcccctgtccaagatggacataggggtgcccctcctcgcgatcggctgctactctcaggtcaacccgattacactgaccgccgccctcctgctgctagttgctcactacgccatcatcggccctggcttgcaggcaaaggccacacgggaagcccagaagcgggcggccgcgggcatcatgaagaacccgacggtggacgggatcaccgtgattgatctggagcccatcccctacgaccccaagttcgagaagcaactaggacaggtaatgctgctgatactctgcgtaacgcaggtcctaatgatgcgaactacgtgggctctgtgcgaggccctaaccctggccaccggccctatctccacattatgggagggcaatccaggccggttttggaacacaaccatcgccgtgagcatggcgaacattttccgcgggtcctatctcgcaggtgctgggctgttatttagcatcatgaagaacaccacctccacgcgcagaggtaccggaaacatcggcgaaacgctcggcgagaagtggaagtctcgcctgaacgcgctggggaagtccgaattccagatatacaagaagtccggaattcaggaagtagaccggaccctcgccaaggaagggattaagagaggcgagacggaccatcacgccgtctcccgggggagcgccaagctccgctggttcgtggaacgtaacatggtcacccctgaggggaaggtcgtagacctgggctgcgggcgcggcggctggtcctattactgcggcgggctcaagaacgttcgggaggtcaagggcctgaccaagggcgggccaggccacgaggagcccatccccatgagcacctacgggtggaacctggtcagactccagtcaggcgtcgacgttttcttcacgccgcctgagaagtgcgacacccttctgtgcgacatcggggagtcaagccccaaccccacgattgaggccggtcggactctccgcgtgctgaacttggtggaaaactggctcaataataacactcagttctgtatcaaagtcctaaacccttatatgccctcagttatcgagaagatggaagcactgcagcggcagtatggcggggccctcgtgcgcaatcccctgagccggaactccacacacgagatgtactgggtcagcaacgccaccggcaacattgtgtctagcgtgaacatgatctcacggatgctgatcaaccgtttcaccatgaaacataagaaggccacctacgagccggacgtagacctggggagcggcacacgcaacatcgggatcgaatccgagattcccaacctcgacatcatcggcaagcggatcgaaaagatcaagcaggagcacgagatcagctggcattacgaccaagaccacccatacaagacctgggcctaccacggctcctatgagaccaagcaaaccggttctgcctccagcatggtgaacggagtggtccgcctgttgacgaagccctgggacgtggtgccgatggtaacccagatggcgatgaccgacaccacgcccttcgggcagcagcgcgtgttcaaggaaaaagtagacacacgaacccaggagcccaaggagggcaccaaaaagctcatgaagatcacggccgagtggctatggaaggaactgggcaagaagaagacgcctcgcatgtgcacccgggaagagttcactaagaaggtccgctccaacgccgccctcggggctatcttcacagacgaaaacaagtggaagtccgcacgggaagcagttgaggacggccgcttctgggagctggtcgaccgggagcgcaatctgcacctcgaaggcaagtgcgagacctgcgtctacaacatgatgggcaagcgggagaagaagctaggtgagttcgggaaggccaagggctcgcgagccatctggtacatgtggctgggggcccggttccttgagttcgaggcactggggttcctgaacgaggaccactggttctcccgtgggaacagtttgtccggcgtggaaggggaggggctacaccggctcggctacatcctccgcgacgtcggcaaaaaggagggtggggccatgtacgcagacgacaccgcgggctgggacacccggataactctggaggacttgaagaacgaggagatggttaccaaccacatgaagggtgaacacaagaagctcgccgaggctatctttaagctgacttaccaaaacaaggtggtccgcgtgcagcgacccacgccccgcggcacagttatggacattatcagccggcgcgatcagcgcggctccgggcaggtcggcacctacggtctgaacacattcacgaacatggaggcccagctcatccgccagatggagggcgaaggcatattcaagtcgatccaacacctaaccgccaccgaggagattgccgtgcagaattggctggcgcgcgtggggcgggagcgcctctctcggatggccatctctggcgatgactgtgtcgtgaagcccatcgatgatcgcttcgcctccgccctgaccgccctcaacgacatgggtaaggtgcgcaaagatatccaacagtgggagccctctcgcggctggaatgactggacacaggtgccgttctgctcacaccacttccacgagctcgtgatgaaagacgggcgagtgctggtcgtcccatgccgcaaccaagacgagctgattgggcgggcgcgaatcagccagggcgccgggtggtcactcaaagagacggcctgcctgggtaaatcttacgcccaaatgtggaccctgatgtacttccataggcgcgacctccggctggccgcgaacgccatctgctctgcggtgcccagccactgggtccccacctcccgcaccacctggagcatccacgccaagcacgagtggatgaccaccgaggacatgctagcggtatggaaccgggtgtggatccaggaaaacccgtggatggaggacaagacgcccgtcgagtcctgggaggaggtgccatacctcggaaagcgcgaggaccagtggtgtggcagcctgattggcctgaccagccgggccacctgggctaagaacatccagaccgccattaaccaggtgcgctcccttatcggcaatgaggagtacaccgactacatgccatcgatgaagcggtttcgccgcgaggaggaggaggccggcgtcctgtggtga

SEQ ID NO: 25010 - RNA, 9876 nt, synthetic construct
  misc_feature 1..9876: note = derived and/or modified CDS sequence (opt11) from DENV-2__EU482623__SS-prME
  source 1..9876: mol_type = other RNA
accgctggggttatcgtcatgctgatcccaaccgccatggcgttccacttgaccacccgcaatggggaaccgcacatgattgtgggtcggcaggagaagggaaagtccctgctgttcaagaccgaggacggcgttaacatgtgtaccctgatggccattgacttgggggagctgtgcgaggacactatcacctacaagtgccccctcctgcgacaaaatgagcccgaagatatcgactgctggtgcaacagcacgtctacttgggtcacctacgggacttgcaccaccacgggcgagcatcggcgcgagaagcgttccgtggctctggtgccccacgtcggcatgggcctcgagacccgcaccgagacctggatgagcagtgagggggcctggaagcacgttcagagaatcgagacttggatcctgcgccatccgggcttcaccataatggccgcaatcctggcctacaccatcgggaccactcactttcagcgggccctcatcttcatactgctgaccgcggtggcgcccagcatgacaatgcggtgtatcggcatctccaaccgggactttgtcgagggagtgagcgggggctcctgggtggacattgtcctcgagcacgggagctgtgtgaccacgatggccaaaaacaaaccgaccctcgacttcgagctgattaagacggaagccaagcagcccgctaccttgcgcaagtactgcatcgaagccaagttgacaaataccaccaccgaatcccgatgcccgacccagggagagccaagtctgaacgaggaacaggacaagagatttatttgtaaacactccatggtggaccggggatgggggaacggctgcggcctgttcgggaagggagggatcgtgacgtgcgcgatgttcacgtgcaaaaagaacatggagggaaaggtggtgcaacccgagaatctggagtatacgattgtcatcacgccccacagtggcgaggagcacgccgtcggcaacgatacggggaagcacggcaaggagatcaagatcacaccgcagtccagcattactgaggccgagctgactggctatggcacggtgaccatggaatgtagcccccggacgggcctcgacttcaacgagatggtcctgctgcagatggaggacaaggcctggttagtgcaccgtcagtggtttctggacctgcccctcccctggctgccgggcgcagacacccaggagagcaattggatccagaaggagacgctggtgacctttaagaacccccacgcgaagaaacaggacgtcgtggtcctcggcagtcaggagggggccatgcacacggccctgaccggcgccaccgaaatacagatgagtagcggcaacctcctgttcaccggccacctgaaatgccgcctgaggatggacaagctccagctgaagggtatgtcgtattccatgtgcactgggaaattcaagatcgtaaaagagatcgccgagacgcagcacggcacgatcgtgatccgcgtccagtacgagggggacggctctccctgcaagatcccgttcgagattaccgacctggagaaacgacacgtgttaggcaggcttatcacggtgaacccgattgtgaccgaaaaggacagtcccgtgaacatcgaggccgagccgccgttcggggactcctacatcatcattggcgtagagcctgggcagctgaagctcaactggttcaagaagggctcatccatcgggcaaatgttcgaaacaaccatgcgcggcgctaaacgcatggccatcctgggcgataccgcctgggacttcgggagcctgggcggagtgttcacctcaatcggcaaggcattacatcaggtattcggcgcgatctatggcgcggcattctccggagttagttggaccatgaagatactgatcggggtaatcatcacctggatcggcatgaacagcaggtctacaagcctgtccgtgtcactggtgctcgtaggcgtggtgaccctgtatttaggtgccgtcgtgcaggctgactccgggtgcgtggtcagctggaagaataaggagttaaagtgcggctccggcatctttataacggacaacgtgcatacctggaccgagcagtataagttccagcccgagagcccctctaagctggcctccgctattcagaaagcccatgaggaggggatctgcggcattagaagtgtgacccgcctggagaatctgatgtggaagcaaatcacgcccgagctcaaccacatcctgtccgaaaacgaggtcaagctcaccatcatgaccggtgacatcaagggcatcatgcaggcggggaagcggtcgctccgcccgcagcccaccgagctgaagtactcctggaaaacctggggcaaggctaagatgctcagcaccgagtcccacaaccagacattcctgatcgacggccccgagacggctgagtgcccaaacacgaacagagcatggaactctctggaggtggaggactacggctttggcgtgttcaccaccaacatctggctcaagctgcgagagaagcaggatgtcttctgcgactccaagttaatgagcgccgccattaaggacaaccgggcggtgcacgccgacatggggtactggatagagtccgccttgaacgacacctggaagatggaaaaggccagctttatcgaagttaagtcctgccactggccgaaaagccacacgctgtggtccaacggcgtcctggagagcgaaatgatcatccccaagaactttgccggccccgtatcccagcacaactatcgcccgggttaccacacgcagacagcgggtccgtggcacctgggaaagctggagatggacttcgacttctgcgagggcaccaccgttgtcgtgacggaggactgcggtaacagaggcccgtcccttcgcaccaccaccgcaagcggcaaactcatcacggagtggtgctgtcggtcctgcaccctccccccgctgcgctaccgtggggaggacggctgctggtacgggatggagatacgccccctcaaggagaaagaggaaaatctggtgaacagcctggtaaccgccggccacgggcagatcgataacttctctctcggcgtactcggcatggcattactcctggaagagatgctgcggacgcgcatcggcacgaagcatgcgatccttctggtggctgtgtctttcgttacactgatcaccggcaacatgtccttccgggacctcgggcgagtgatggtcatggtgggcgccaccatgacggacgatataggtatgggcgtgacctacctggccctgttggccgcgtttaaggtgcgacccaccttcgccgcgggccttctgttgcggaagctgacatccaaggagctaatgatggccacaattgggatcgccctcctgagtcagagcaccatccccgagaccatcctggaactcaccgacgctctggccctaggcatgatggtcctcaagatagtgcgcaacatggagaagtaccagctggccgtgacgatcatggctatctcctgtgttccgaacgccgtgatcttgcagaacgcatggaaggtaagctgcaccattctcgccgccgtgtctgtcagccccctgcttctcacctccagccaacagaaggccgactggatccccctggcgctgacgatcaaggggctcaaccccactgccatcttcctgaccaccttatctagaacctcaaagaagaggtcttggccgctcaacgaggccataatggcggtcggcatggtgagtatactggcctcctcgctgttaaagaatgacatccccatgacgggtcccttggtcgccggcgggctgctcactgtatgctacgttctgaccgggcgcagcgccgacttagagctcgagcgagctgccgacgtcaagtgggaggatcaggccgagatcagtggtagcagtcctatcttaagcataaccatcagcgaagacgggagcatgtccatcaagaatgaggaggaggagcaaacgctgactatcctcattcggaccggcctgctggtgatcagcggcgtgtttccagtttcgatccccatcaccgcggccgcttggtatctctgggaggtgaagaagcagcgcgctggggtgttatgggacgtccccagcccaccacccgtggagaaggcggaactggaggacggcgcataccggatcaagcagcgcgggattctcggctactcccagatcggtgcaggtgtgtacaaggaggggaccttccacacgatgtggcacgtaacccgtggggcagtgctgatgcacaggggcaaacggatcgagcccagctgggccgacgtaaagaaggacctgatttcgtacggcggcgggtggaagctcgagggcgaatggaaagagggagaggaggttcaggtgttggccctggagccggggaaaaatccccgggccgtgcaaaccaagccaggaatcttcaagacgaactctggcacgatcggcgcagtctccctcgacttcagcccagggacctccggcagccccatcgtggaccggaaggggaaggtggtcgggctctacggcaacggagtggtgacccgatccggcgcgtacgtcagcgccatagcgcagaccgagaagtccattgaggacaaccctgagatcgaagatgacatcttccggaaaaagcgcctgaccataatggatttacaccccggcgccgggaagaccaagcggtacctgcccgccatcgttcgcgaagccatcaagcggggcctgcgcacgttaatcctcgcaccgacccgcgtggtcgcggcagagatggaggaggccctgagaggattacccatccgataccaaactcccgccattaagaccgagcacaccggtcgtgagatagtggatctcatgtgccacgcaaccttcacgatgcgcctgctgtccccggtccgggtccccaactataatctcatcatcatggacgaagcgcatttcaccgatcccgccagtatcgccgcccgcggatacatctccacaagagtggagatgggggaggccgccggaattttcatgaccgccactccgcccgggtcaagagacccgttccctcagtcgaacgctcccatcatggacgaagagagagagataccagagagaagctggaactccggccacgagtgggtgaccgacttcaaggggaaaacagtgtggttcgtcccgagcattaaggccgggaacgacatcgccgcatgcctgaggaaaaatgggaagaaggtgatacaactgagccgcaagacgttcgacagcgagtacgttaagacgcgtgcgatcgattgggacttcgtggtaactacggacatctctgagatgggcgccaacttcaaggccgagcgcgtcatcgacccgcggcgctgtatgaaacccgtgatcctcacagacggggaggagcgggtgatccttgcggggcccatgccggtcacgcacagctcggcggcgcagcgccgaggccgaatcggacgcaaccccaaaaatgagaatgatcaatacatttacatgggcgagcctctggagaacgatgaggattgcgcacactggaaggaagccaagatgctcttagataacatcaacacgcccgagggaattatcccgagtatgttcgagcccgagcgggagaaggtggacgctatcgacggagagtaccgcctccggggtgaggcccgcaagaccttcgtggatctcatgaggcgcggtgacttacccgtctggctggcctataaggtggccgccgagggcatcaactatgccgaccggaagtggtgctttgacggcatcaagaacaaccagatcctcgaggagaacatggaggtggagatctggaccaaggagggcgagcgcaaaaagttgaaaccgcggtggctggacgcccgcatctactccgaccctctcgctctgaaggagttcaaggagttcgccgccggacgcaagagcctgacgctcaacctcatcaccgaaatgggcaggctccccacctttatgacacagaaagcccggaacgccctggacaacttagcggttctgcacaccgccgaagcgggcgggcgcgcctacaatcacgccctctccgaactacccgagaccctagaaaccttacttctgctaacccttttagccacggtgaccggcgggatcttcttgttcctgatgagcggaaagggtattggcaagatgaccctcggcatgtgttgcatcataacggcctccatcctcctgtggtacgcgcagatccaaccgcattggatcgctgcaagcatcattctggagttcttcctcatcgtcctcctgatccccgagcccgagaagcagcggacgccccaggacaaccaactcacatatgtggtgatcgctatcctgacggtcgtggctgcgacgatggcaaacgagatggggttcttggagaaaaccaagaaggatctcggcctggggagcataacgacccaggagtcagagtcaaacatcctggacatcgacctccgcccggcgtcggcatggaccctctacgccgtggcgaccacgttcgtcacccccatgctgaggcacagcatcgagaactcgtcggtgaacgtgtccctcaccgccatcgccaaccaagcaaccgtcttgatgggcctgggcaaaggttggccgctcagcaagatggatattggcgtgcccctgctggcgattgggtgctactcccaggtaaaccctatcacgctcaccgccgccctcctgttgctggtcgcccattacgccatcatcggccccgggctgcaggcaaaagccacccgcgaggcccaaaagcgggccgccgcgggcataatgaagaaccccacggtggacggtatcacggtgatagacctcgaacccatcccgtacgatcccaagttcgagaagcagcttgggcaagtcatgctgctcatactgtgcgtaacccaggtactcatgatgcgcaccacttgggccctctgcgaggccctgacgctggctaccggccccataagcaccctctgggaggggaaccccggccggttctggaacactaccattgccgtctccatggcgaacatatttcgcggcagctacctggccggggccggactccttttctccatcatgaagaacaccaccagcacccgccgggggaccggcaacattggagaaaccctgggggaaaaatggaagagtcgcctgaacgccttgggcaagagcgagttccagatctacaaaaagtccgggatccaggaggtggatagaaccttggcgaaggagggcatcaagcgcggggagacagaccaccacgccgttagccgtggctccgccaagctccgctggttcgtcgagcggaacatggtgacgccagaggggaaggtggtcgacctaggctgcgggcgcgggggctggagttactactgcgggggcctgaaaaatgtgcgggaggtgaaaggactcactaagggcggccccgggcacgaggagcccatccccatgagcacctacggctggaacctagtccgactgcagtccggagtggacgtattcttcaccccgccggaaaagtgcgacacgctgctctgcgacatcggagagagctccccgaaccccactatcgaggcagggcggaccttgcgcgtcttaaacctcgtggagaactggctaaacaacaacacccagttctgcatcaaggtactgaacccgtacatgccctctgtcatcgagaagatggaggccctccagcggcagtacggcggcgcattagtacgcaaccctctgagtcggaacagcacccatgagatgtactgggtgtccaacgcgacggggaacatcgtctcatccgtgaacatgatcagccgcatgcttatcaacaggttcaccatgaaacataagaaggccacctacgaaccggacgtagacctaggctccgggactcgcaacatcggcatagagagcgagatccccaacctggacatcatcgggaaacggatcgagaagataaagcaggagcacgagatctcctggcactacgaccaggatcacccctacaagacgtgggcctaccacggcagctacgagaccaagcaaaccggctccgccagcagcatggtaaacggcgtggtgagactactcaccaagccctgggatgtcgttccgatggtgacgcagatggcgatgaccgacaccaccccattcggccaacaacgcgttttcaaggagaaggtggacactcggacccaagagccgaaggaagggaccaagaagctgatgaaaatcaccgctgaatggctttggaaggagctcgggaagaaaaagacgccacgcatgtgcacccgggaggagttcaccaagaaagtacgcagcaacgccgccctgggcgcaatcttcaccgacgaaaacaaatggaaatccgcgcgggaggcggtcgaggacggccgtttctgggagctcgtagaccgggagcgtaatctccacctggagggcaagtgcgagacgtgcgtgtacaacatgatggggaagcgggagaagaaactgggcgagttcgggaaggcgaagggaagtagggccatctggtacatgtggctcggggcgcggtttctggagttcgaggccctagggttcctcaacgaggaccactggttcagccgtggcaactcactgtcgggggtcgagggcgaggggctgcatcggctcggctacatcctgcgcgacgtgggcaagaaagaaggcggcgccatgtatgccgacgacaccgccggatgggacacccggataacgttggaggaccttaagaacgaggagatggtcacgaaccacatgaaaggcgagcacaaaaaactggcggaggccattttcaagttaacctaccagaacaaggtggtgcgcgtgcagcggccgacgccccgtgggaccgtgatggacataatctccaggcgggaccagcggggctctggccaggtggggacgtacggcctcaataccttcacaaacatggaggcccagctgattcggcagatggagggggagggcatcttcaagtccatccagcacctgaccgccacggaggaaatcgccgtccagaactggcttgctcgcgtgggccgggagcgcctgtcccgcatggccatctccggggacgactgcgtagtcaaacccattgacgaccgcttcgccagcgccctgactgctctcaacgacatgggcaaggtccgcaaggacattcagcagtgggagccctcccgcgggtggaatgactggacccaagtaccgttctgctcgcaccacttccacgagttggtgatgaaagacggccgggttctggtggtcccctgtcgcaaccaggacgaactcatcggaagggcgcgcatcagccaaggcgccggctggtccctgaaggagaccgcctgcctggggaagtcctacgcgcagatgtggaccctcatgtacttccaccggcgcgacctgcggctcgctgcgaatgccatctgcagcgccgtcccctcccattgggtacccacttcgcgcaccacctggtccatccatgccaagcacgagtggatgaccacggaggatatgttggccgtctggaaccgcgtgtggatccaggaaaacccttggatggaggacaagacgcccgtcgagagctgggaggaggtcccctacctgggcaagcgcgaggaccagtggtgcgggagcctgatcggcctcacctcccgggcgacctgggccaaaaacattcagaccgccatcaaccaggtgcgcagcctgataggaaacgaggagtataccgactacatgccctccatgaaacggttccgccgcgaggaggaggaggcgggcgtcctgtggtga

SEQ ID NO: 25011 - RNA, 9876 nt, synthetic construct
  misc_feature 1..9876: note = derived and/or modified CDS sequence (opt11) from DENV-2__EU569698__SS-prME
  source 1..9876: mol_type = other RNA
actgcgggcgttatcgtcatgctgatccccaccgccatggcgttccatctcaccacccgcaatggggagccacacatgatcgtgggccggcaggagaaaggaaaatccctactcttcaaaaccgaggacggcgtgaacatgtgcaccctcatggccatcgacctgggggagctctgcgaggacacgatcacctacaaatgccccctcctgcgccaaaacgagcccgaagacatcgactgctggtgcaactcaacctcgacttgggtcacctacgggacctgtaccacgacgggtgaacaccgccgcgagaagcgatccgtggcgttagtaccccacgtcgggatgggcctcgagacccgcacggagacctggatgtcctcggagggggcctggaagcacgtgcagcggatcgagacgtggatcctgcgccacccgggcttcaccatcatggccgcgatcctggcgtacactatcggaaccacgcactttcagcgggccctcatcttcatcctgctgaccgccgtggcgcccagcatgaccatgcgctgcatcggcatctccaaccgggacttcgtcgagggagtctccgggggctcttgggttgacattgtcctcgagcacgggagctgcgtgactacgatggccaagaacaagcccaccctggacttcgagctgatcaagaccgaagctaagcagccggccaccctccgcaagtactgcatcgaagccaagctgacgaacaccaccactgagtcccggtgcccgacgcagggcgagcctagcctgaatgaggagcaggacaagcgcttcatctgcaagcactccatggtggaccggggctggggaaacggctgcggactgttcggcaagggagggatcgtgacctgcgcgatgttcacgtgcaaaaagaacatggaaggcaaggtggtgcagccagagaacttagaatacaccatcgtgatcacgccccacagcggggaggagcacgccgtgggcaacgacaccgggaagcatggaaaggagatcaagatcaccccgcagtccagcattaccgaggcggagctgaccgggtacggcaccgtgaccatggagtgcagcccccggactggcctcgacttcaacgagatggtcctgttacagatggaggacaaagcctggctcgtccaccggcagtggttcctggacctgccgctcccgtggctgccgggagccgatacacagggaagcaattggatccagaaggagactctggtgaccttcaagaatccccacgcgaagaaacaagacgtcgttgtcctcgggtctcaggaaggcgccatgcataccgcccttaccggcgccacggagatccagatgagcagtggcaacctcctgttcaccggtcacctgaagtgccgcctgcggatggacaaactccagctgaaggggatgagctactccatgtgcaccgggaagtttaagatcgtgaaggaaatcgctgagacgcagcacgggaccatcgtcatccgagtccagtacgagggcgacggctccccctgcaaaatcccattcgaaatcaccgacctggagaagcggcacgtcctcgggcgcctgataactgtgaacccgatcgtcaccgaaaaggacagccccgtgaacattgaggcggagccgccatttggcgactcttatatcatcattggtgtggaaccgggccagctgaagctcaactggtttaagaaagggagctccatcggacaaatgttcgaaacgaccatgcggggcgccaagcggatggctatcctgggagatacggcctgggacttcggcagccttgggggcgtcttcacctccatcgggaaggccctccaccaggtcttcggcgcgatctacggcgccgcgttcagcggcgtgtcctggacgatgaaaatcctgatcggcgtcatcatcacctggatcgggatgaatagccgctccacgagcctgtccgtaagcctggtgcttgtcggcgtggtgaccctttacttaggggccgtcgtgcaggcggactccggctgcgtggtctcatggaagaacaaggagctaaagtgcggcagtgggatcttcattacggacaacgtgcatacgtggaccgagcagtacaaattccagcctgagtctcccagtaaactggcctccgcgatccagaaggcccacgaagagggcatctgcgggatccggtcggtaacccgcctggaaaacctcatgtggaagcagattactcccgaattaaaccacatcttgtccgagaacgaggtaaaactcaccatcatgaccggcgacatcaaagggatcatgcaggccggcaagcggagccttcgcccgcagccgaccgaactgaagtactcttggaaaacgtggggcaaagcgaagatgctaagcaccgagtcccacaaccagacgttcctgatcgatgggcccgagacagcggagtgcccgaacacgaaccgagcctggaactccctggaggtggaggactacggctttggggttttcaccaccaacatctggctcaagctgcgcgagaaacaggacgtcttctgcgattcgaagctgatgagcgccgcgatcaaggataaccgcgctgtgcacgccgacatgggctactggatcgagtctgccttgaacgatacctggaagatggagaaggccagcttcatcgaggtgaagtcctgccactggcccaagagccataccctgtggtccaacggcgtcctggagagcgagatgatcatccccaagaacttcgccgggcccgtgtcccagcacaactaccgcccgggctaccacacgcaaacagcaggaccctggcatctgggcaagctggaaatggacttcgacttttgcgaggggaccactgtggtcgtaactgaggattgcggcaaccggggccccagcctgaggaccacaaccgccagcggaaagctgatcacggaatggtgctgccggtcctgcaccctgcccccgctgcgctaccggggcgaggacgggtgttggtacggcatggagatcagacccctcaaggagaaggaggagaatctggtgaactctctggtgaccgccgggcacggccagatagacaacttcagtctcggggtgctggggatggccctgtttctcgaggagatgctgcggacccgcatcgggacgaagcacgcgatcctactcgtggctgtcagcttcgtaaccctgatcaccgggaacatgagcttccgggacctgggccgcgtgatggtcatggtgggtgcgaccatgacggacgacatcggtatgggtgtgacctacctcgccctgctagccgcgttcaaggtccgcccaaccttcgccgccgggctcctgctgcgtaagttgaccagcaaggagctgatgatggccacgataggcatcgctctcctctcccagtcgaccatccctgagaccatcctggagttaaccgatgcactcgccctggggatgatggtgctgaagatagtgagaaacatggagaagtaccaactcgcggtcacgatcatggcgatatcctgcgtcccgaacgccgtgatcctacaaaacgcgtggaaggtcagctgcaccatcctggcggccgtgtccgtcagccccctcctgctgacctccagccagcagaaggccgattggatcccccttgcgctgaccatcaagggcctgaaccccactgcaatcttcctcaccaccctgtcccggaccagcaagaagcgctcctggccgctgaacgaagccatcatggccgtgggcatggtgagtatcctcgccagtagcctgcttaagaacgacatccccatgactgggcccctcgttgcgggcggattgctgaccgtgtgctacgtgctcacaggccgtagcgccgacttggaactggagcgcgccgcggatgtcaaatgggaggaccaggccgagatctccggctcatcccccatcctcagcatcaccatcagtgaggatggctccatgtccatcaagaacgaggaggaggaacagacgctgacgatccttatacgtaccgggctccttgtgatctcgggtgtcttcccggtctccatccccattactgcggccgcttggtacctgtgggaggtaaagaagcagcgcgcaggcgtactctgggacgtccccagcccgccgcccgtagagaaggccgagctggaagacggggcgtatcggatcaagcagcgcggcatcctggggtactcccagatcggcgccggcgtatacaaggaggggacttttcacacaatgtggcacgtcacacggggcgccgtgctcatgcatcgcgggaagcgaatcgagcccagctgggccgacgtgaagaaggacctgatctcctacggcgggggctggaaactggagggcgaatggaaagagggggaggaggtacaggtgttagcccttgagcccggcaagaacccccgcgcggtgcagaccaagcccgggatcttcaaaaccaatacaggcaccataggagcggtcagcctggacttttcccctggaactagcggctccccgatcgtggaccggaaaggcaaggtggtggggctctacggcaatggtgtggtgacacgcagcggcgcctacgtctccgcaatcgcgcagacagagaagtccatcgaggacaatcccgagatagaagatgacatcttccggaagaagcgcctgaccatcatggacctgcaccccggggccggcaaaaccaagcgctatctaccggccatcgtgcgcgaagcgatcaagcgggggctacgcacgctgatcttagccccgacgcgtgtggtcgcggccgagatggaggaggctctccgtggactgcccatccgctaccagacacccgccataaagaccgagcataccggaagagagatcgtggatctgatgtgccacgcaacgttcaccatgcgcctcctgagccccgtgcgtgtcccgaactacaatctgattatcatggacgaggcgcacttcaccgatccagcgtccatcgctgcccgcggctacataagcacccgggttgagatgggcgaggccgcggggattttcatgacggccacgcctccgggctcccgcgacagcttcccgcagtccaacgcccccatcatggacgaggaacgtgaaatccccgagcgcagctggaactccgggcatgagtgggtgaccgacttcaagggtaaaaccgtctggttcgtgcccagcattaaagccggtaacgacatcgcggcctgcctgcggaagaacggtaagaaggtgatccagttgtcccgcaagacgttcgacagcgagtacgtcaagactcgagccaacgactgggatttcgtggtgaccaccgacatctccgaaatgggcgccaactttaaggccgaacgcgtgatcgacccgcggcgctgcatgaagcccgtgatcctgacggacggggaggagcgcgtgatcctcgcggggcccatgcccgtcacccacagctccgccgcccagcgccgagggcgcatcgggcgcaacccgaaaaacgagaacgaccagtacatctatatgggggagcctctggagaatgacgaagactgcgcgcactggaaggaggcaaagatgctgctcgacaacatcaacacccctgagggaatcatacccagcatgtttgagcccgagcgggagaaggttgacgcgatagacggcgagtaccgtctgcgcggtgaggcccgcaagaccttcgtagacctcatgcgtcgcggcgacctgcccgtctggttggcctacaaagtggccgcggaaggcattaattacgcggaccggaagtggtgcttcgacggcatcaagaacaaccagatcctggaggaaaacatggaggtggagatctggactaaggagggggagcgaaagaaactcaagccccggtggctggacgcccgcatctactccgacccgctggccttgaaggagttcaaggagtttgccgcgggccgtaagagcctgaccctgaacctaatcaccgagatgggccgcctgccgaccttcatgacccagaaggcgcggaacgccctggacaacctcgccgtcctacacaccgccgaagccggtggccgcgcctacaaccacgccctgagtgagctccccgaaacactggagaccctgctcctgctgacgctactggccaccgtgaccgggggcatcttcctgttcctcatgagcggaaaagggatcggcaagatgacactggggatgtgttgcattattaccgccagcatcctcctgtggtacgcgcagatacagccccactggatcgccgctagcatcatcctggagtttttcctgattgtgcttctgatcccggagcccgagaagcagaggacaccccaggacaaccagctgacctacgtggtgatcgccatcctaacagttgtggccgcgaccatggcgaacgagatgggcttcctggagaaaaccaagaaagacctggggctcgggagcatcaccacacaggagtccgaaagcaacatcttggacatcgatctgcgccccgcctccgcctggaccttatacgcggtggcgacgaccttcgtcacgccgatgctgcggcacagcattgagaactccagcgtgaacgtgtccctgacagccatcgccaaccaggccacggtcctcatgggcctggggaaggggtggcccctgagcaagatggacatcggggtgcccttgctggcgatcggctgctactcccaggtgaaccccatcaccctgaccgccgcccttttgctgctcgtcgctcattacgccattatcgggccgggcctgcaggccaaggcgacgcgcgaggcccaaaagcgggccgccgctggtatcatgaagaacccgactgtggacgggatcaccgtgatcgacctggagcccatcccctacgacccgaagttcgagaagcaattaggccaggtcatgctgctcatcctctgcgtaacccaggtcctgatgatgcggacgacgtgggcactgtgtgaggccctaaccctggcgaccgggccgatcagtactctgtgggagggtaaccccggccggttctggaacacgaccatcgccgtctccatggcgaacatcttcaggggctcctacctcgccggcgccgggctgctgttctcgatcatgaagaataccacgagcacccgccggggcacagggaacatcggcgagaccctcggcgagaagtggaagtcccgcctgaatgccctgggcaagagcgagttccaaatctacaaaaagtcaggcatccaggaggtggaccggaccttggcgaaggagggaatcaagcgcggcgagactgaccatcacgccgtgagccgggggtctgccaagctgcgctggttcgtagagcggaacatggtcacccccgagggaaaggtcgtcgacctggggtgcgggcgcggcggatggagctactattgcggtgggcttaaaaacgtgcgggaggtcaaaggcttaacaaagggcgggccggggcatgaggagcccatccccatgagcacatacgggtggaacctggtccggctccagagcggggtggatgttttcttcacgccgccggagaagtgcgacaccctgctgtgcgacatcggagagagctcccccaaccccaccatcgaggccggccggaccttacgcgttctgaacctggtggagaactggttgaacaataacacccagttctgcatcaaagtgctgaacccctatatgccgagcgtaatcgagaagatggaagccctgcagagacagtacggcggcgcgctcgtgcgcaaccctctgtcccggaacagcacgcacgagatgtactgggtgagtaacgccacgggcaacatcgtaagctccgtgaatatgatcagccgcatgttgatcaaccggttcactatgaagcacaagaaggccacttacgagcccgacgtagacctggggtccggaacgcgcaatatagggatagagagcgagatcccgaacctcgacatcatcgggaagcggatcgagaaaatcaagcaggagcacgaaatcagctggcattacgaccaagaccacccgtacaaaacctgggcatatcacggaagctacgaaaccaagcagacggggagtgccagctccatggtcaatggcgtggtacgcctgctgacgaagccctgggacgtcgtaccaatggtgacccagatggcgatgaccgacaccacaccgtttgggcagcagcgcgtcttcaaggaaaaggtagacacacggacccaagagcctaaggaaggtaccaagaagctcatgaagatcacggccgagtggctgtggaaggagctgggcaagaagaagacgcccagaatgtgtacccgggaggagttcaccaagaaagtgcgcagcaacgcggccctcggggccatcttcacggacgagaacaagtggaaatccgctcgggaggccgtcgaggacggccgcttctgggagttagtggaccgggagcgcaacctgcacctcgaggggaagtgtgagacctgtgtgtacaacatgatgggcaagcgggagaagaagctgggggagttcggcaaggccaagggcagccgcgcaatctggtacatgtggctgggggcgcggttcctcgagttcgaggccctgggcttcctgaacgaggatcactggttcagccgcgggaactctctcagcggcgtcgagggggagggcttacaccggctgggctacatcctgcgggatgtggggaagaaggagggcggggccatgtacgccgacgacaccgccggctgggacacccgcatcacgttagaggacctgaagaacgaggagatggtcaccaatcacatgaagggggagcacaagaagctggcggaggccatcttcaagctgacctaccagaataaagtggtccgggtccagcggcccacccctcgcggcacagtgatggacatcatatcccgacgcgaccagcgtggcagcgggcaggtcggcacatatgggctgaacaccttcaccaacatggaagcccaacttataaggcaaatggagggcgagggcatcttcaagtccatacagcatctgaccgctaccgaggagatcgccgtccagaattggctggcgcgcgtggggcgtgagagattgagccggatggccatctccggcgacgactgcgtggtaaagccaatcgacgaccgcttcgcaagcgctctgactgccttaaacgacatggggaaggtacggaaggacatccaacagtgggaacccagtcgcggctggaacgactggacccaggtgcccttctgctcgcaccacttccacgagctcgtcatgaaggacgggcgggttctggtggtcccgtgcagaaaccaggacgagctgatcgggcgcgcgcgcatctcccagggcgccggttggagcctcaaggaaacggcctgtctgggcaagtcctatgcgcagatgtggacgctgatgtacttccaccggcgcgatctccggctggccgcgaacgccatctgcagtgcggtgcctagccactgggtgcccaccagccggaccacctggtccatccacgcaaaacacgagtggatgacgacggaggacatgctcgcggtctggaaccgagtgtggatccaggagaatccttggatggaggacaagaccccggtggagagctgggaggaggtcccctacctggggaagagagaagaccagtggtgcggcagcctgatcgggctgacctctcgggccacgtgggccaagaacattcaaaccgccatcaaccaggtgcgctcgctgatcggcaacgaggagtacaccgactacatgccatcaatgaagcggttccgccgtgaggaggaggaagcaggcgtactgtggtga

SEQ ID NO: 25012 - RNA, 9876 nt, synthetic construct
  misc_feature 1..9876: note = derived and/or modified CDS sequence (opt11) from DENV-2__EU569699__SS-prME
  source 1..9876: mol_type = other RNA
acagcgggggtgatcgtgatgctgatccccaccgccatggcattccatctcaccacccgcaacggggaaccacacatgattgtaggccgtcaggaaaaggggaagtccctgctgtttaagaccgaggacggcgtgaacatgtgtacccttatggccatcgacctaggggagctgtgcgaggacaccattacctataagtgccccctcttgcgccagaatgagccggaggacatcgactgctggtgtaactcgaccagcacgtgggtcacctacgggacctgcaccacgacgggcgagcaccggcgcgagaagcggtcggtggccctggtgccccacgtcgggatgggcttagagactcgcacagagacctggatgagctccgagggggcctggaagcacgtacagcggatcgagacgtggatcctgcgccaccccggcttcaccatcatggccgcgatcttagcgtataccatcgggactacacatttccagagggccttaatcttcatcctgttaaccgccgtggcgccaagcatgaccatgagatgcatcggcatatccaaccgggacttcgtagagggcgtaagcggagggtcctgggtagacatcgtgctcgagcacggtagctgcgtgaccactatggccaagaacaagcccaccctggacttcgagcttatcaagaccgaggccaagcaacctgccacccttcgcaagtactgcattgaggccaagctgacgaacaccactaccgaatctcggtgcccgacgcagggcgagcctagcctgaacgaggagcaggataagagattcatctgcaagcattccatggtggatcggggctggggtaacggctgcgggctgttcggaaagggcgggatcgtgacctgcgcgaagttcacgtgtaagaaaaatatggagggtaaggtagtacagcccgaaaatctagaatacaccatcgtaataacaccccacagcggggaggaacacgcggtgggcaacgataccgggaagcacgggaaggaaatcaagatcaccccgcagagcagcatcacagaagccgagctgaccgggtatggcacggtgacgatggaatgcagcccccgaaccggcctcgacttcaatgagatggtattgttgcagatggaggacaaggcatggctcgtgcaccggcagtggttcctggacttgcccctcccgtggctgccgggggccgacacgcaggggagcaactggatccagaaggagacgctcgttaccttcaaaaacccccacgcgaagaagcaagacgtcgtggtcctcgggagccaggaaggcgccatgcacaccgcgctgacgggggcaaccgaaatccaaatgtcgagcggcaacctcctctttaccggtcatctgaagtgtcgattacgtatggacaagctccagctcaaggggatgtcttacagcatgtgtaccggtaagttcaagatcgtgaaggagattgcagagacccaacacgggacgattgtgattcgcgtccagtatgaaggagacggctccccctgcaagatccccttcgagattaccgacctggagaagcgacatgtcctcgggcgtctgatcaccgtcaaccccatcgtcaccgagaaggacagccccgtgaacattgaggcggagccgcccttcggcgactcctacatcatcatcggggtggaaccaggccagctgaaacttaactggttcaagaaaggcagctccatcggacagatgttcgagacgaccatgcgcggagccaaacggatggctatcctgggggacacagcgtgggatttcggcagcctcgggggtgtttttacctccatcgggaaagccctccaccaagtgtttggggcaatctacggcgccgctttcagtggcgtgtcctggacaatgaagatcctgatcggcgtgatcatcacgtggatagggatgaacagccgctcaacgagcctgagtgtgagcctggtgctcgtcggcgtagtgaccctgtacctgggagccatggtccaggccgactccggctgtgtggtcagctggaagaacaaagagctcaagtgcggctctgggatcttcatcactgataacgtccacacatggaccgagcagtacaagttccagccggagagcccctctaagctggcatccgctatccagaaagcccacgaggaggggatttgcgggatacggagcgtgactaggctcgagaacctcatgtggaagcagatcacgccggagctgaatcacatcctttccgaaaatgaggtgaaattgactatcatgaccggcgacattcgggggatcatgcaggccggcaaacgcagcctgcgtccgcagcccaccgagctgaagtactcctggaagacttgggggaaggctaaaatgttaagcacagagtcccacaaccagaccttcctgatcgacggtcccgagaccgccgagtgcccgaacactaaccgcgcctggaacagcctggaagttgaggactatggcttcggtgtattcaccaccaacatctggctcaaacttcgagacaagcaggatgttttctgcgacagtaagctgatgagcgccgctatcaaggataatcgcgctgtccacgccgacatgggctactggatagaatccgccctcaacgacacgtggaagatggagaaggcatcattcatcgaggtgaagtcctgccactggccaaaaagccacaccctttggtccaacggcgtcctggagagcgagatgatcatacccaagaacttcgctggcccagtcagccagcacaattaccgacccggttatcacacgcagaccgcggggccctggcatttaggcaagctggagatggactttgacctttgcgaggggacgaccgtggtagtcacggaagactgcggcaaccgcggccccagcctccgaacaaccaccgcatcggggaagctgatcactgagtggtgctgccgctcctgtaccctgcctccactccggtaccgcggcgaggacgggtgctggtacggcatggagatcaggcccctcaaggagaaggaggagaacctagtgaacagcttggttaccgccggccacggacagatcgacaacttcagcctgggcgtcctaggtatggccctcctgctcgaggagatgctccggactcggatcggcacgaaacacgcgatcctgctggtcgccgtgagcttcgttaccttaattaccgggaacatgtccttccgcgatctcggccgcgtgatggtcatggtaggcgcgacgatgacggacgatatcgggatgggcgtaacctatcttgccctactggccgctttcaaggtcaggcccacctttgccgccggattactcctgcgcaagctgacctccaaggagctcatgatggctacgatcggcatcgccctactgtcccagagcaccatccccgagaccatcctggagctcacagacgcactagccctcgggatgatggtccttaaaatagtgcggaacatggagaagtatcaactggccgtaactgtgatggccatcagttgcgtgccaaacgccgtgattctccaaaacgcgtggaaggtgagctgtaccatcctggccgccgtctccgtcagtcccctactcttaacaagctcacaacaaaaagccgactggatccccctggcgctcaccatcaagggtcttaaccccacggcgatctttctgaccaccctctcacgcaccagcaagaagcggtcatggccgctgaacgaggccatcatggccgtgggcatggtaagtatcctggcctcctcactccttaagaacgacattcccatgacaggtcccctcgtggcgggcggtctgctgaccgtgtgctacgtgttgaccggccgatcggctgacttggagctcgaacgagccgccgatgtcaagtgggaggaccaggccgagatcagtgggagttcccccatcctatcgatcaccatatccgaggatggtagcatgtcaatcaaaaacgaagaggaggagcagacactcaccattctgatccgcaccggcctgttagtaatcagcggggtcttcccggtcagtatccccatcaccgctgccgcatggtacctgtgggaggtaaagaagcaacgggcaggagtgctgtgggacgtgcccagtcccccaccggtggagaaggccgagctcgaggacggggcgtacagaatcaagcaacggggcatcctggggtactcccagataggtgccggagtgtacaaggaagggaccttccacacgatgtggcacgtcactcgaggcgccgtgctgatgcacagggggaagcgcatagagccctcctgggcggacgtcaaaaaggacctaatttcgtacggtgggggctggaagctggaaggggagtggaaggagggcgaggaggtccaggtgttagcactcgagcctgggaagaacccccgagcggtgcagactaagcccgggattttcaagaccaacactggcaccatcggggcggtcagcctggacttctccccgggcacttcaggctcccccatcgtggaccgcaaggggaaggtggttggcctttacggaaacggcgtggtgacccgcagtggcgcctacgtctccgccatcgcgcagacggagaagtccatagaggataaccccgagatcgaggacgacatcttccgtaagaaacggctcactatcatggacttacaccctggggccggcaaaaccaaacgatacctgcctgccatcgtgcgggaggcgatcaagcgtgggcttcgcacgctcatcctggccccaacgcgcgtggtcgcggcagagatggaggaggccctgcgcggcctacctatccggtaccagaccactgccatcaaaaccgagcacacggggcgcgagatcgtcgaccttatgtgtcacgcgaccttcactatgcggctgctgagccctgttcgagtcccaaattataacctgatcatcatggacgaggcccacttcaccgacccggcgtccatagccgcccggggctacatttccacgcgcgtagagatgggcgaggccgctgggatcttcatgaccgccaccccgcccggatcccgggatcccttccctcagagcaacgctcccatcatggatgaggaacgagagattcccgagagatcgtggaactcgggtcacgaatgggtgacagacttcaaaggcaagacggtctggttcgtgccatccatcaaagccgggaacgacatcgcggcgtgcttacgcaagaatggcaagaaggtgatccagctctcgcggaagaccttcgactctgagtatgttaaaacccgcgccaacgactgggacttcgtggtgacaactgatatctcagagatgggagccaactttaaggccgagcgtgtaattgaccctagaaggtgcatgaaacccgtaatacttaccgacggagaggagcgcgtgatactggcgggccccatgcccgtcacccactcaagcgccgcccaacggcgcgggcgaatcgggcggaaccctaagaacgaaaatgaccaatacatctacatgggagagcccctcgagaacgacgaggactgcgcccattggaaagaggccaaaatgctactggataacatcaatactcccgaaggcataatcccctccatgttcgagcccgagcgcgagaaggttgacgcgattgacggcgagtacagattgcgtggtgaggccagaaaaaccttcgtggacctgatgcgtcgcggggacctcccagtgtggctcgcctacaaagtggcggccgagggaatcaactacgcggatcgtaagtggtgtttcgacggcatcaaaaacaatcagatcctggaggaaaatatggaagtggagatctggaccaaagagggcgagcggaagaagctaaagcctcggtggctcgatgcccgaatctatagcgatcctctggccttaaaggagttcaaggagttcgcagcgggccgcaaatccttgactctgaacctaatcacggagatggggcggctccctacgtttatgacccagaaagcccgcaacgcccttgacaacctggcggtcttacacacggccgaggccggaggccgggcctataaccacgccctaagcgaactgccggaaaccctcgagacgttactgctcctgaccctactcgcaaccgttaccggagggatcttcctgttcttaatgagcggcaagggcatcgggaagatgaccctcggaatgtgctgcatcattaccgcgtccatcctgctctggtacgcgcagatccagccccactggatcgctgccagcatcatcctcgaatttttcctgatcgtcctgctcatcccggagcccgagaagcagcgcacaccccaggacaaccagctgacttatgtggttatcgccatactgaccgtcgtggcggcgacgatggccaacgagatgggatttttggagaagaccaagaaagacttgggcctgggcagcatcaccacccaagaatctgagtccaatattttagacatagacctgcggcccgctagcgcctggacgctgtatgccgtggctaccacctttgtaaccccgatgctccgccattctattgaaaattccagtgttaacgttagccttacagccatcgccaaccaggctaccgtgctgatgggcctcgggaagggctggcccctgtccaagatggacatcggtgtgcccctgctcgcgataggctgctacagccaggtgaaccccatcaccctgaccgccgccctgctgctgttagtcgcgcactacgccataatcgggccggggctccaggcgaaggcgactcgggaggcacagaagcgcgcagctgcgggcatcatgaagaaccctaccgtcgacggtatcaccgtgatcgacttagagccaatcccttacgatcccaaattcgagaagcagttaggccaggtaatgctcctcattctctgcgtgacacaggtgctgatgatgcggacaacctgggcgctgtgcgaggccctaaccctcgcaactggccccatctccaccctgtgggagggcaaccccgggcgcttctggaacaccacgattgccgttagcatggcgaacatcttccgcggctcctacctggccggcgccgggctcctattcagcattatgaagaacaccacgaacactcggcggggcaccgggaacatcggcgagaccttgggagagaagtggaagtctcggctcaatgcgctgggtaagagcgagttccaaatatataagaagtccggcatccaagaagttgatcgaaccctggcgaaggagggaataaagagaggcgagaccgaccaccacgccgtcagtcgcgggtccgccaaacttcggtggttcgtcgagcgcaacatggtgacgccggagggaaaggtggtagaccttggctgcgggcgaggcggttggtcctactactgcggcgggcttaagaatgttcgagaggtgaagggactcaccaagggagggccgggccacgaggagcccatccccatgtcgacgtatgggtggaatctggtcagactacagagcggcgtggacgtgttcttcacaccgcccgagaagtgcgataccctcctgtgcgacattggcgagagctcccccaaccccaccatcgaggccggccgaactctgcgggtgctcaacctggtggagaattggctcaataataacacgcagttttgcataaaggtgctcaacccctatatgccctcggtcatcgagaagatggaggccctgcaacgcaaatacggcggagcgttagtacggaaccccctgtcccgcaattccacacacgagatgtactgggtatccaacgcaaccggcaacattgtctcgtcagtgaacatgataagccggatgttaatcaaccgtttcactatgaagcacaagaaggcaacgtatgagcccgacgtggacctgggctccggcacccgaaacatcgggatcgaaagcgagatccccaatttagacatcatagggaagcgcatcgagaagatcaagcaagaacacgagacctcctggcactacgaccaggaccacccatataagacctgggcgtaccacggcagctacgagacgaagcagaccggatccgccagctcaatggtcaacggcgtggtgcgcctcctgacaaaaccgtgggacgtcgtgcccatggtgactcagatggcgatgacggacaccaccccgttcgggcagcagcgggtattcaaggaaaaggtcgacacaagaacgcaggaaccaaaagagggtaccaaaaagctgatgaagatcaccgcggagtggctgtggaaggagcttggcaagaagaagacgcctcgaatgtgcacgcgcgaggagtttacccggaaagtgcgctcgaacgctgctcttggggcgatctttacggatgagaataagtggaagtccgcgcgggaggccgttgaggacggcagattctgggaactcgtggacagggaacgtaatcttcacctggaggggaagtgcgagacctgcgtttacaacatgatgggtaaacgggagaagaaattgggggagtttggaaaggccaagggatcacgggccatctggtacatgtggctgggggcgcggttcctggagttcgaggccctcggattcctgaacgaggaccactggttcagccgcgggaatagcctctccggtgtcgagggggagggcttacaccggctgggctacatcctgcgcgacgttgggaagaaggaaggcggggccatgtatgccgacgacacggccggctgggacacccggattactttagaggaccttaagaacgaggagatggtaacaaatcacatgaagggggagcacaagaagctggctgaggccatcttcaagctaacgtaccagaacaaagtggtgcgggtgcagcgaccgactccccgcggcaccgtcatggacatcatctcccggcgcgatcaacgcggatctgggcaagtagggacctacgggctgaacacgtttacgaacatggaagcccagcttatccggcagatggagggcgagggcatttttaagtcaatccagcacctgaccgccattgaagagatcgcagtccaaaattggctggcgcgcgtggggcgggagcgcttatcgcggatggccatatccggcgacgattgcgtaatcaaacctatcgacgacagattcgcatccgccctcaccgctttgaacgacatgggtaaggtccgcaaggatatccagcagtgggaaccgagtagaggctggaacgactggacacaggtgcccttctgctctcaccacttccacgagctggttatgaaggacgggcgggtcctggtggtgccgtgccgcaatcaggacgagttaattggcagggcacgcatatcccagggcgccgggtggagcctgaaggagaccgcctgcctcggcaagtcctacgcccagatgtggaccctgatgtacttccatcggcgagacctgcggctcgcggcgaatgccatctgcagcgcagtcccttcccactgggtgcccaccagccgtactacatggtccatccatgcaaagcacgaatggatgaccaccgaggacatgttagcggtgtggaaccgggtatggatccaggagaacccctggatggaggataagacaccggtggagagctgggaagaggttccctatcttgggaagcgcgaggaccagtggtgcggctccctcatcgggctgaccagcagggccacttgggccaagaacatacagaccgccattaatcaggtccgcagcctgattggaaacgaagagtacaccgactatatgcccagtatgaagaggttccggcgtgaagaggaggaggccggcgtgctctggtga

SEQ ID NO: 25013 - RNA, 9876 nt, synthetic construct
  misc_feature 1..9876: note = derived and/or modified CDS sequence (opt11) from DENV-2__KF955366__SS-prME
  source 1..9876: mol_type = other RNA
accgcgggcgtcatcgtgatgctgatccccactgccatggccttccaccttaccacccgcaatggggagccgcacatgatcgtgggccggcaggagaaggggaagtccctgctgttcaagaccgaagacggcgtgaacatgtgcaccctcatggccatagacctgggggagctttgcgaagacaccatcacctacaagtgccccttactgcgccagaacgagcccgaggacatcgactgctggtgcaacagcactagcacctgggtgacgtatgggacatgcacaaccaccggcgagcaccggcgcgagaagcggtcggttgctctagttccccacgtcgggatgggcctcgaaacccgtaccgagacctggatgagctccgagggggcctggaagcatgtgcaacggatcgagacttggattctccgccaccctggcttcaccatcatggccgcgatcctggcctacaccatcgggaccacgcatttccagcgggccctcatcttcatcctgttaaccgccgtggcgcccagcatgaccatgcgctgcatcgggatctccaaccgggatttcgtcgagggcgtgagcgggggctcctgggtggacatcgtcctcgagcacggaagctgcgtgaccacgatggccaagaacaagcccacactggacttcgagttgatcaagaccgaagccaagcaacccgccaccctccgcaagtactgcatcgaggcgaaacttactaacaccacaaccgagtcccggtgcccgacgcagggcgagccaagcctgaacgaggagcaggacaagcgcttcatctgcaagcactccatggtggaccgaggctggggaaacggctgcgggctgttcggcaaagggggcatcgttacctgcgctatgttcacatgcaagaagaatatggaaggcaaggtcgtgcagcccgagaatcttgaatacaccatcgtcatcacaccccacagcggggaggagcacgccgtgggcaacgacaccgggaagcacggcaaggagatcaagatcacaccgcaatccagtatcaccgaggccgagctgaccgggtacggcacggtgaccatggagtgcagcccacggacaggcctcgacttcaacgaaatggtgctgctccagatggaggacaaggcctggctcgtccacagacagtggttcctggacctgcccctcccctggctgcctggggcggacacccagggaagcaactggattcagaaggagactctggtgacgttcaagaacccacacgcgaagaagcaggacgtcgtggtccttgggtcacaggagggcgctatgcacaccgccctgaccggggccacggagatccagatgagcagcggcaatctcctgtttaccggccacctgaagtgcagactccggatggacaagctccagctcaaggggatgtcctacagcatgtgcactggcaagttcaagatagtcaaggaaattgccgagacccagcatggaacgatcgtgatcagggtccagtacgagggggatggctccccctgtaaaatccccttcgagataaccgacctggagaagaggcacgtgttagggcggctgatcacagtgaacccgatcgtcacagagaaggacagcccggtgaacatcgaggctgagcctcccttcggagactcatacatcatcataggggtggagccaggccagctgaagctaaactggttcaagaaggggagcagcatcggacagatgttcgaaactaccatgcgtggggccaagcggatggctatcctgggggacaccgcctgggacttcggaagcctcgggggcgtctttacctcgatcggaaaagcactccatcaggtgttcggcgcaatctacggcgccgccttcagcggggtttcctggacgatgaaaatcctgatcggcgtcatcataacctggattgggatgaatagtcgctccaccagcctgtccgtctcgctggtgctcgtcggtgtggtaaccctctacctgggggccgtcgtgcaagcggactccgggtgtgtggttagctggaaaaacaaggagctcaagtgcggctccgggatcttcataacggacaacgttcacacctggaccgaacagtacaagttccaacccgagagcccgagcaagttagcctccgccattcagaaggcccacgaggagggaatctgcgggatacgcagcgtgacccgcctggagaacctcatgtggaaacagatcacacccgagctgaaccacatcctctccgagaacgaggtcaagctcaccatcatgacgggcgacatcaaggggatcatgcaggcgggcaaacggagcctgcgcccgcagcccacagaactgaagtactcctggaaaacgtggggcaaggcgaagatgctctctaccgaaagccacaaccagaccttcttaatagacgggcctgaaaccgccgagtgcccgaatacgaaccgggcctggaactcactcgaggtggaagactacggcttcggggtgttcaccaccaacatctggcttaaactgcgcgagaagcaggacgttttctgcgattccaaactcatgagcgcagccatcaaagacaaccgggcggtacacgcggatatgggctactggatcgaatcagccctgaacgacacatggaagatggagaaagccagcttcatcgaagtgaagtcctgccactggcccaagagccacaccctgtggtccaacggagtcttggagagcgagatgatcatccccaagaacttcgccgggcccgtgtcccagcacaattaccgcccgggctaccacacgcagaccgctgggccctggcacctcggcaagctagagatggacttcgacttctgcgaggggacgaccgtggtcgtgacggaggactgcggcaaccgtggcccctccctgcgaaccaccaccgcctctgggaagctcatcacggagtggtgctgccggtcctgcaccctgcctccgctgcgctaccggggtgaggacgggtgctggtacggcatggagatacgccccctcaaggagaaagaggagaacctggtgaacagcctggttaccgccgggcatgggcagatcgacaacttctccctcggcgtgctcgggatggctctgttccttgaggagatgctgcggacccgcatcggaacgaaacacgcgatactgctcgtggccgtcagcttcgtgaccctgatcacagggaacatgtccttccgtgacctgggccgcgtgatggtcatggtgggtgccaccatgacggacgacatcggtatgggcgtgacgtaccttgccctgctggccgcgttcaaggtccgtcccacctttgccgccggcctcctgttacgcaagttaacctcgaaggagctcatgatggccacgatcggaatcgccctgttgtcccagtcgaccatccccgagaccatcctggagctgaccgatgcgctcgccctggggatgatggtgctgaaaatcgtgcgcaatatggagaagtaccagctcgccgtcaccatcatggcgatttcctgcgtgccgaacgccgtgatcctacagaacgcgtggaaggtctcatgcactatcctggccgccgtcagcgtcagccccctcctgctcacgtccagccagcagaaggccgactggatccccctcgctctgaccatcaagggcctcaaccccacggccattttcctcaccacactttccaggaccagcaagaagcggagttggccgctgaacgaggccatcatggccgtgggcatggtgagcattctcgcctccagcttgctgaagaacgatatccccatgaccggccccctcgtcgcgggcgggctgctgaccgtgtgctacgtgctcaccggccggagcgccgacttagagctggagcgtgcggccgatgtcaaatgggaggaccaggccgagatatcagggtcatcccccatcctcagcatcaccatttccgaggacggcagcatgtcaataaagaacgaggaggaggagcagacgctgaccatcctgatccggacaggcctcctggttatcagcggggtgttccctgtctccattcccatcaccgcggccgcctggtacctgtgggaggtgaagaagcagcgggccggcgttctttgggacgtcccctcaccgccgcccgtggagaaggccgaactagaggacggagcgtaccggatcaagcagcgcggcatcctcgggtactcccagatcggagccggcgtgtacaaggagggcacgttccatacgatgtggcatgtcacccggggcgccgtgttaatgcacagagggaagagaattgagcccagctgggccgacgtgaagaaggacttaatctcctacggcggaggatggaagctggaaggcgagtggaaggagggggaggaggtccaagtgttagccctggagcccggcaagaatccacgcgcggtgcagacaaagcccgggatctttaaaaccaatacgggcaccatcggggcggtcagcctagacttcagtcccggcacctccggctcccccatcgtggataggaaagggaaggtggtcggcctctacgggaacggcgtggtgacccgcagcggtgcctacgtctctgccatagcgcagacggagaagtccatcgaggacaaccccgagatcgaggacgatattttccggaagaagcgcctgaccatcatggacctgcaccccggggccggaaagaccaagcggtatctccccgccatcgtgcgcgaggctatcaagcgggggctgcgcacgctcatcctggccccgacgcgcgtggtcgcggccgagatggaggaggccttacggggcctgcccatacgttaccagacgcccgccattaagaccgagcataccgggcgggagatcgtggacctgatgtgccacgccacgtttaccatgcgcctcctgagccccgtacgcgtcccgaactacaacctcatcatcatggatgaggcacacttcaccgaccccgcctccatcgccgcccgcgggtacatcagcacacgggtggagatgggcgaggccgcggggattttcatgacggcaacctcccccggcagccgcgacccgtttccgcaaagtaacgcccccatcatggacgaggagcgggagatccccgagcgcagctggaactccggccacgagtgggtgaccgactttaaaggcaagaccgtctggtttgtgccgagcataaaggccgggaatgacatcgcagcctgcttgcgcaagaacggcaagaaggtgatccagctgtcccgcaagaccttcgactccgagtacgtcaagactcgggccaatgactgggacttcgttgtgacaactgacatctccgagatgggcgccaacttcaaggccgagcgcgtaatcgacccgcggcgctgtatgaagcccgtaatcctgacggacggcgaggagcgggttatcctggcggggcctatgcccgtcacccacagctccgcagcccagcgccggggacgcatcggtcgcaacccgaaaaacgagaacgaccagtacatctacatgggagagcccttggagaacgacgaggactgcgctcactggaaagaggcgaagatgctgctcgacaacattaatacgcccgaaggcatcatccccagcatgttcgaaccggagcgggaaaaggtggatgcgatcgatggcgagtatcgtctgcgtggggaggccagaaagaccttcgtggacttaatgcggcgcggcgacctccctgtctggctggcctacaaggtggctgctgaggggatcaactacgcggatcggaagtggtgcttcgacggcatcaagaacaaccagattctggaggagaacatggaggtggagatctggacgaaggagggggagaggaaaaagctcaagcccaggtggctggatgcccgaatctactccgacccgctggccctcaaggagttcaaagagttcgccgcgggccggaagtcgctgaccctgaaccttatcaccgaaatgggccgcttgcccaccttcatgacgcagaaggccaggaacgcgctggataatctcgccgtattgcacacggcagaggcagggggccgcgcatacaaccacgctttgtccgagctccccgagaccttagagaccctgctgctgctcacgctcctggccaccgttaccggaggcatcttcctgttcctcatgtcaggcaagggtatcggcaagatgaccctagggatgtgttgcatcataaccgccagcattctgctgtggtacgcgcagatccagccccactggatcgctgccagcatcatcctagagttcttcctgatcgtgctcctgatcccggagcccgagaagcaaagaacaccccaggacaaccagctgacctatgtggtgattgccatactcacagtagtggccgcgacaatggccaacgagatgggcttcctggaaaagacgaagaaggacctggggctcggcagcatcaccacccaagagtctgaaagcaatatcctggacatcgacctgcgccccgcctccgcctggactctctatgccgtagcgacaaccttcgtcactccgatgctgcgccactctattgaaaattctagcgtcaacgtgtccctgacggccatcgcgaaccaggccaccgtcctcatgggcctcgggaagggttggcccctgagcaagatggacatcggggtgcccctcctggcgatcggttgttacagccaggtgaaccccatcactctgaccgccgccctcctgcttctcgtcgcccactacgccatcatcgggccgggcctgcaggcgaaggctacccgcgaggcgcagaagcgggccgccgcagggatcatgaagaaccccaccgtggacgggatcaccgtgattgatctggagcccattccctacgaccccaagttcgaaaaacagctcgggcaggtcatgctgctgatcctctgcgtgacccaggtcctgatgatgcgcaccacgtgggccctgtgtgaggccctcaccctcgccaccgggccaatcagcaccctgtgggagggcaatcctgggcggttctggaatacgactatcgccgtctctatggcgaacatcttccgcggcagctacctggccggcgccgggttactgttctccatcatgaagaacactactagcacgcgccggggtaccgggaacatcggcgagacactcggcgagaagtggaagtcccgcctgaacgccctggggaaaagcgaatttcaaatctacaagaagtcaggcatccaggaggtggaccggaccctcgcgaaggaagggataaagcgcggcgagaccgaccatcacgccgtaagccgggggagtgctaagttgcgctggtttgtcgaacggaacatggtaacacccgaaggcaaggtggtcgacctgggttgtgggcgcggcgggtggagctactactgcggcgggctcaaaaacgtccgggaggtgaagggattgaccaaaggcggcccgggccacgaagaacccatccccatgagcacctacgggtggaaccttgtgcgcctccagtccggcgtggacgtattcttcacgcccccggagaagtgcgacacactgctgtgcgacataggggagagctcccccaatcccaccatcgaggccggccgcaccctccgcgttctgaacctggtggagaactggctcaacaacaacacccagttctgtatcaaggttttgaacccctacatgcccagcgtcatcgagaagatggaggccctgcagaggcagtacggcggggcgctcgtgcgcaacccactttctcggaatagcacgcatgagatgtactgggtgtccaacgctaccggcaatatcgtcagctccgtgaacatgataagcagaatgctcatcaatcggttcacaatgaagcataagaaggccacttacgagccagacgtggacctggggtccggcacacgcaacatcgggatcgaaagcgagattccgaatttggacataattggcaagcgaatcgagaagataaagcaggagcacgagatctcctggcattacgaccaggaccacccctacaagacctgggcttaccatgggagctacgaaacaaagcaaaccgggtccgccagctccatggtcaacggcgtggtgcgcctgctgacgaagccctgggacgtcgtgcccatggtgacccaaatggcgatgaccgacaccacgccgttcggtcagcagcgcgtcttcaaggagaaagtggatacccggacccaggaacccaaggagggaaccaagaagctcatgaagatcacggccgagtggctgtggaaagagctgggcaagaagaagacgccccggatgtgcacccgggaggagtttaccaagaaggtgcggagcaacgccgccctcggcgccatattcacggacgagaacaagtggaaatccgcgcgtgaggccgttgaggacggacgcttctgggaactggtggaccgggagagaaacctgcacctcgaggggaagtgcgaaacctgtgtatataacatgatgggcaaacgtgagaagaagctgggggagttcggcaaggccaagggtagccgcgccatctggtacatgtggctgggcgcgcggttcctcgagttcgaggctctgggcttcctcaatgaggaccactggttcagtcgcgggaactccctcagcggcgtggaaggtgagggcttacaccggctgggctacatcctccgggacgtcgggaagaaggagggtggtgccatgtacgcagacgacactgccggctgggacacacggattacgctggaggacttgaagaatgaggagatggtcacaaatcatatgaagggggagcacaagaagttggcggaggcaatcttcaaacttacatatcagaacaaagtggtgcgcgtccagcggcctaccccgcggggcacggtaatggacatcatttcccggcgcgatcagcggggcagcgggcaggtcggcacttacgggctgaacacctttaccaatatggaggcacagctcatccgccaaatggagggcgaagggatcttcaagtccattcaacatctgacggccactgaggagattgctgtccagaactggctcgctcgcgtgggacgggaacgcctaagccggatggcaatatccggcgacgactgcgtggtcaagccaatcgacgaccgcttcgcatcggccctgaccgccctgaatgacatggggaaggtgcggaaggacatccagcagtgggagcccagtagaggctggaacgactggacccaggtgcccttttgcagtcaccacttccacgagctcgttatgaaggacgggcgggtgctggtggttccgtgtcgcaaccaggacgagctgataggccgggcacgcatctctcagggggccggatggagcctcaaggagacagcctgcctagggaagtcctacgcccagatgtggaccctgatgtacttccaccggagagatctccggctggccgcaaacgccatctgctcagcagtgccaagtcactgggtgcccaccagccgcaccacctggtccatccacgccaagcacgagtggatgacgacagaggacatgctggcggtttggaaccgcgtgtggatccaggagaacccctggatggaggacaagaccccggtggagagctgggaggaggtcccctacctcgggaagcgcgaggaccagtggtgcggcagcctaatcgggctgacatccagggccacgtgggctaagaacatccagaccgccattaaccaggtgcgcagcctcatcggcaatgaggagtacaccgactacatgccgtctatgaagcggttccgccgcgaggaggaggaggccggagtgctgtggtga

SEQ ID NO: 25014 - RNA, 9876 nt, synthetic construct
  misc_feature 1..9876: note = derived and/or modified CDS sequence (opt11) from DENV-2__EU569700__SS-prME
  source 1..9876: mol_type = other RNA
accgcaggcgtgattgtaatgctaatcccgacggcgatggcattccatctgaccacccgcaatggagagccgcacatgatcgtgggccggcaggaaaaggggaagtccctgctgttcaagaccgaggacggggttaatatgtgtaccttaatggcgatcgacctgggcgagctgtgcgaggacaccatcacctacaagtgcccgctactccgccagaatgaacctgaggacatcgactgctggtgcaacagcacctccacctgggtaacctacgggacttgcactaccactggtgagcaccgcagagagaagcgctccgtggccttagttccccacgtcggtatgggattggagacccgcaccgagacctggatgagctcagagggtgcctggaagcacgtgcagcggatagagacatggattctgagacatccgggcttcactataatggccgcgatcctggcgtacaccatcgggaccacgcacttccagcgggccctcatcttcatcctgctgaccgccgtggcgcccagcatgacgatgagatgtattggaatatcaaaccgggacttcgtcgagggcgttagcggaggtagctgggtggacatcgtcttggagcacggtagctgcgtgaccaccatggctaagaataagcccaccctggactttgaactgatcaagaccgaggctaagcaacctgcgactctacgtaagtactgtatcgaggcaaaacttactaacaccaccactgaatcccgttgcccgacgcaaggagagccctctctcaacgaggaacaggataaaaggttcatctgcaaacattccatggtagaccggggctgggggaatggctgcgggctgttcggcaaaggcggcatcgtgacctgtgcgatgttcacgtgcaagaagaacatggaaggcaaggttgttcagccagagaatctggagtacacgatcgtcatcacgccacatagtggagaggagcacgctgtgggtaacgacactgggaagcacggcaaggaaatcaagatcaccccgcaatcctcgataaccgaggccgagctgaccgggtacgggaccgttacaatggagtgcagcccgcggaccggattggacttcaacgagatggttctactgcagatggaggacaaggcctggctagttcaccgtcagtggttcctggatttgcccctcccatggttacccggggccgacacccagggcagtaattggattcagaaagagacgctggtaacattcaagaatccccacgcgaagaagcaagacgtcgtggtcttggggtcccaagaaggggccatgcacacggccctgacaggcgccaccgagatccagatgtcatcaggcaacctcctgttcaccggccacctgaagtgccgcctccggatggataaacttcaactgaaggggatgtcttactccatgtgcaccggcaagttcaaaatcgtgaaagagatcgcagagacccagcacggaacgattgtgatccgcgtacaatacgagggtgacggttccccatgtaagatcccgttcgaaatcacggacctggaaaagcggcatgtgctcggacgactgatcaccgtgaacccgatcgttacagaaaaagactcgcccgtaaatatagaggcggagccaccctttggcgactcctacatcataatcggggtggagccgggccagcttaagctcaactggttcaaaaaggggagctccatcgggcagatgttcgagacgacaatgaggggcgccaagagaatggccatcctgggggacacggcctgggacttcggatcgttagggggcgtgttcacgagcattggtaaggcattacaccaggtattcggggcgatttatggcgctgccttctcgggggtgtcctggaccatgaagatactgataggcgtaatcataacatggattgggatgaactcacgcagtaccagcctaagcgtgtccctggttctggtcggcgtagtcacactgtacctgggagccgttgtgcaggcggatagcggctgcgtagtctcatggaagaacaaggaactgaagtgcggctccgggatcttcataacagacaacgtgcacacttggaccgaacagtataagtttcagcccgagagccccagcaagctggcttccgcgatccagaaagcgcacgaggagggcatctgcggtatccggagcgttaccagacttgagaatctaatgtggaagcagatcacgcccgagctgaaccacatccttagtgagaatgaggttaagctcaccatcatgaccggcgacatcaaggggatcatgcaggcaggtaagcggagcctgcgcccgcaacccaccgagctgaaatacagctggaagacgtggggcaaggcgaaaatgctgagcaccgagagccacaaccaaaccttcttgatcgacggacccgagactgccgagtgtccgaacacgaaccgggcatggaactcactcgaggtggaggactatggcttcggggtatttaccaccaatatctggttaaagctgcgcgaaaagcaggacgtattttgcgactccaagttgatgagtgccgctattaaggacaaccgggcggtgcacgccgacatgggctactggatcgaaagtgcactcaacgacacgtggaagatggagaaagccagctttatcgaggtgaagtcctgccactggcccaaatcccacaccctgtggtcaaatggcgtcctggagtctgaaatgatcatacccaagaacttcgccgggccggtgtcacaacacaattatcgcccgggctaccacacgcagacagcaggaccatggcatctcggcaagctggagatggatttcgacttctgcgagggtacgacggtggtcgtgacggaagactgcggcaaccgtggtcccagcctgcgcaccaccacggcgagcgggaagctcatcacggaatggtgctgcagatcatgcaccctgccgcccctgcgctaccgaggggaggacgggtgttggtatggcatggagatcaggcccctcaaagagaaggaggagaacctggtgaacagtctcgtcacggccgggcacggtcagatcgacaatttctccctcggagtacttgggatggccctgttcctagaggagatgcttcgaacccgcatcggaacgaagcatgcgatcttactggtagccgtcagcttcgtgaccctaatcaccggaaacatgtccttccgggacttaggccgcgtgatggttatggtgggcgcaaccatgacagatgatattggcatgggggtgacatacctcgcgctgctagcagcgttcaaggtacgtcccaccttcgcagccggcctcctgcttcggaagctcaccagcaaggagctgatgatggctactatcgggatcgccttgctctcacagagcacaattccggagaccatcctggagctgacggatgccttggccctggggatgatggttctcaaaatcgtaagaaacatggagaaataccaactcgccgtcacgatcatggcgatctcctgcgttccgaatgccgtcatcctgcagaatgcgtggaaggtcagctgcactattcttgcagccgtgagcgtcagcccccttctgttaacctccagccagcagaaggcggattggatccccctcgcgctgaccatcaaggggctgaaccccaccgctatattcctcacgaccctgtcacggaccagtaagaagcgatcctggccgctgaatgaggcaatcatggccgtaggcatggttagcatcctcgcctctagcctgcttaaaaacgacatccccatgacggggcccctagtggcaggcgggcttcttactgtttgctacgtcctcaccggacggagcgcggacctggagctcgagcgcgcggccgacgtcaagtgggaggaccaagccgagatttccggtagctctcccatcctcagcatcacgatctctgaggacggcagtatgtcaatcaagaacgaagaggaagaacagacgcttaccatactgatccggacaggtctcctggtgatcagcggggtcttcccggtctccatccccataaccgccgccgcgtggtacctgtgggaggttaagaagcagcgggccggcgtgctctgggacgtgcctagcccgccgcccgtggagaaagcagagctggaggatggggcataccggattaaacagcgcggcatcctgggatactcgcagatcggcgccggggtttataaggaagggactttccacacgatgtggcacgtcacccgaggcgccgtgcttatgcaccgcgggaagcggatcgagccgagctgggccgacgtgaagaaggaccttatctcgtatggcgggggctggaaattagagggcgagtggaaggagggggaggaggtacaggtgctcgccctggagcccggcaaaaacccccgcgcggtacagaccaaaccgggcatctttaaaaccaatactggcaccatcggtgcggtgtcgctggacttctcccccggcaccagcggtagtcctatcgtcgaccgcaagggcaaggtggtcggcttatacgggaacggcgtcgtgacccgcagcggcgcttacgtgtccgcaatcgcccagacagagaaatccatcgaggataacccagagatagaggacgacatatttcggaaaaagcgcctgaccattatggaccttcatcctggggccggcaaaaccaagagatacctaccggcaatcgtgcgcgaggccatcaaacggggcctgcgcaccctcatcctggccccgacgcgcgtggttgcggccgagatggaagaggccctccgagggctgcccatccgctaccagacccccgccattaagacggaacacaccggacgggaaatcgtggacctgatgtgtcatgctacattcaccatgcgcctcctgtcgcctgtgcgggtaccgaactataacctgataataatggacgaggcgcacttcaccgacccggcctctatcgccgcccgaggctacatcagcacccgggtggagatgggcgaggccgcaggtatctttatgacggccacaccacccggctcccgcgatccattcccccagagcaatgccccgattatggacgaggagcgggagatccccgaacgctcctggaactctggccacgaatgggtgaccgacttcaagggaaagaccgtctggttcgtgccgtctatcaaggccggaaacgacatcgcggcttgtttacgtaagaatggcaagaaggtcatccagcttagtcgcaagacgtttgattccgagtacgtgaaaactcgggccaatgactgggactttgtcgtaaccaccgatatcagcgagatgggtgccaattttaaggccgagcgcgtcatagatccccggcgctgcatgaagcccgtgatcctgacggacggggaggagcgggtgatcctcgcgggccccatgccggtcacgcattccagcgccgcacagagacgggggcgcataggacgcaacccaaagaacgagaacgaccaatacatttacatgggggagccactagaaaacgacgaagactgcgcacactggaaggaggctaagatgctgctcgacaacattaacaccccggagggcatcatcccgagtatgttcgagccagagcgggagaaggttgacgcgatcgacggcgaatacaggcttcgcggggaggcacgcaagacctttgtggacctgatgcgtcgcggcgacctcccagtctggctagcgtataaggtggccgcagaagggattaactatgcagaccgcaagtggtgtttcgacggtatcaagaacaaccagatcctggaggaaaatatggaagtggagatatggacgaaagaaggggaacgtaagaagctcaaaccgcgatggttggatgctcgcatatacagtgaccccctggcccttaaggagttcaaggagtttgccgccggccggaagtccctgaccctgaacctcataacggagatgggccgcctgccaacctttatgacgcagaaagcacggaacgcactggataaccttgccgtcctgcacaccgccgaggccggaggccgagcgtacaaccatgcgctgtcagaacttcccgaaactctggaaactcttctcctgctaacgctccttgcaaccgtgaccgggggcatattcctgtttttaatgtccggaaaggggatcggtaaaatgacactgggaatgtgctgcatcatcaccgccagcatactactatggtatgcgcagatacaaccacactggattgccgcttccatcatcttggagtttttcctgatcgtgctcctgatacctgagcccgagaagcagaggacaccacaggacaaccaacttacctacgttgttatcgccatcctcaccgttgtggccgcgaccatggccaacgagatgggcttcctcgagaagacgaagaaggatctggggctcggaagtatcaccacccaggagagcgagtccaatattctggacatcgacttgcgccccgcctcggcctggactctctacgcggtggccaccactttcgtcacccccatgctaagacattccatcgagaactcgtccgtcaacgtgtcgctgactgccatcgccaaccaggccacggtgctcatgggcctggggaaaggatggcccctatcaaagatggacatcggggtgcccctacttgctatcggctgctacagccaggttaacccgattacgctgaccgccgctctcttgctcttagttgcccactacgccattataggacctggccttcaggcgaaggccacacgggaagcgcagaagagggcggccgcgggcatcatgaagaaccctacggtggacgggataaccgttatcgacctggaacccatcccgtatgaccctaagtttgagaaacaactggggcaggtcatgctgcttatcctctgcgtgacccaggtcctcatgatgcgcactacatgggccctgtgcgaggccctcaccctggcaaccggaccaatttccacgctctgggaaggcaatcccggtcggttttggaacacgaccatcgcggtctcgatggcaaatatttttagaggttcctaccttgccggcgccggcctgttgtttagcatcatgaagaacaccacatccacgcgcaggggcaccgggaacatcggcgaaaccctcggagagaagtggaagtcccgcctgaacgccttagggaagtccgagttccagatctacaagaagtccggcatccaagaggtcgatcgcaccctcgccaaggaggggatcaaacgcggcgagacggatcaccatgctgtttccagagggagcgccaagctacgctggttcgtcgagcgtaacatggttaccccggaggggaaggtcgtggacctgggatgcggtcgcggagggtggtcctactattgcggcgggttgaaaaatgtccgggaggtaaaggggctgaccaagggcggacctggccacgaggagcccatccccatgagtacgtacggctggaatttggtccggctccaaagcggggtagatgtcttcttcacgcccccggagaagtgcgatacacttctgtgtgacatcggggagtccagcccaaaccccaccatcgaggccggcagaacactccgagtcttaaacctcgtcgagaactggttaaacaacaacacgcagttctgcatcaaggtgctgaacccatatatgccctccgtcatcgagaagatggaggccttacagcggcaatatggcggggcgttggtacgcaaccccctgagccgaaacagcacgcacgaaatgtactgggtgtcaaacgccaccggaaacattgtctcatctgtgaacatgatctcccgcatgttaataaatcggttcaccatgaagcacaagaaggccacctacgagccggacgtggacttaggctcgggtacgcgcaacatcggcatcgaatccgagatccccaacctcgatatcattggcaagcgcatagagaagatcaagcaagagcacgagatcagctggcactacgatcaggaccacccgtacaagacctgggcctaccacggctcgtacgagaccaaacagaccgggagcgcctcgtccatggtaaatggcgttgttaggctcctgacgaaaccctgggacgtcgtgccgatggtgacccagatggcgatgactgacaccacgcccttcgggcagcagcgcgtcttcaaggagaaggtagatacgcgaacacaggaacccaaagagggcacaaagaagctaatgaaaataacggccgaatggctctggaaggagctcggaaagaaaaagactccgcgcatgtgtactcgggaggagttcacgaagaaggtgcgatccaatgccgccctcggggccattttcactgacgagaacaagtggaaatccgcgcgagaagccgtcgaggacggccgcttctgggagctcgtggatcgcgagcgcaacctgcatctcgagggcaagtgcgagacctgcgtatacaacatgatgggaaagagagagaaaaagctgggtgagttcggcaaggccaagggcagccgcgctatttggtatatgtggcttggggcgcgcttcctcgagttcgaagccctcggattcctgaacgaagaccattggtttagccgggggaacagcctgtccggcgtagaaggtgagggcctgcaccggctgggttacatactacgcgacgtagggaagaaggagggcggagccatgtatgctgacgatacggccggctgggacacccgcattacattggaggacctgaagaatgaggagatggttaccaatcacatgaagggggagcataagaagctagcggaagcgatttttaagctgacctaccagaacaaagtggttcgtgtccagcggccaacgccccgcggcaccgtaatggacataatcagccgccgcgaccagcgaggctccggacaggtgggcacctacgggttaaacacgttcaccaatatggaagcccagcttatcagacagatggagggggagggcattttcaaaagcatccagcacctgacggctacggaggagatagctgtccagaactggctggcgcgcgtggggcgggaacgcttatcccggatggcaatttcaggtgacgactgcgtggttaaacccatagacgaccgcttcgcctccgccctgacagcgctcaacgatatggggaaggtgagaaaggacatccagcaatgggaaccgagccgtggctggaacgactggactcaggtgccattctgttcgcaccacttccacgagcttgtgatgaaagacgggcgggttctagtcgtcccctgccgcaatcaggacgagctcataggtcgtgcgcgcatcagccaaggcgccgggtggagcttaaaggaaacggcctgcctcggcaagagttacgcccaaatgtggactctgatgtatttccaccgacgtgacctccggctggcagcaaacgctatttgctcagccgttcccagccactgggtgcccacctccaggacgacatggagcatacacgccaagcacgagtggatgacgaccgaggatatgttagcggtctggaacagggtttggatccaggagaatccgtggatggaggataaaacgccagtggagtcctgggaagaggtcccctacctcggaaagcgcgaagaccagtggtgcggcagtctgatcggtctgacgagccgcgccacgtgggccaagaacattcagaccgcaataaaccaagtgcgctcccttatcggcaacgaggagtacacagactacatgccctccatgaaacgcttcaggcgcgaggaggaggaggcaggcgtgctgtggtga

SEQ ID NO: 25015 - RNA, 9876 nt, synthetic construct
  misc_feature 1..9876: note = derived and/or modified CDS sequence (opt11) from DENV-2__KF955369__SS-prME
  source 1..9876: mol_type = other RNA
accgccggagtgatcgtgatgctgatccccaccgccatggcgttccacctcaccacgaggaacggggagccccatatgatcgtgggcaggcaggaaaaggggaagtctctgctgttcaaaaccgaggacggcgtgaacatgtgtaccctcatggccatcgacctgggggagctgtgcgaggataccatcacttacaaatgccccctcctgcgccagaacgagcccgaggacatcgattgctggtgcaacagcaccagcacctgggtgacctacgggacctgcaccaccacgggcgagcaccgtcgcgagaagcggtccgtggcgctggtgccccacgtggggatgggcctagagacccggacagagacgtggatgtcaagcgaaggcgcctggaagcacgtacagaggatcgagacctggatcctgcgccacccgggcttcaccatcatggccgctatactggcctacaccatcgggaccacgcactttcaaagggccctcatcttcatcctcctgaccaccgtggcccccagcatgaccatgcgctgcatcggcattagcaaccgggacttcgtcgagggcgtctcaggcggtagctgggtggacatcgtcctcgagcacgggtcttgcgtgactactatggcgaagaacaagcccaccctggacttcgagctgatcaagaccgaagccaagcaacccgccacgttgcgcaagtactgcatcgaggccaagctgaccaataccaccacggagtcccggtgcccgacccagggcgagcccagcctcaacgaggagcaggacaagcgcttcatctgcaagcactccatggtggaccggggctgggggaatggctgcggtttatttggcaagggcggcatcgtgacgtgcgcgatgttcacatgcaaaaagaacatggagggcaaggtggtgcagcccgagaaccttgagtacacgatcgtcattacaccccacagcggggaggagcacgcggtgggtaacgacaccgggaagcacggcaaggagatcaagatcaccccgcagtccagcatcaccgaggccgaactgacggggtacggtactgtgaccatggagtgttcacctagaacaggcctcgacttcaatgagatggtcctgctgcagatggaggacaaggcatggctcgtccacagacagtggttcctggacctgcccctcccctggctgcctggggccgatacgcagggaagcaattggatccagaaggagactcttgtgacattcaagaacccccacgccaagaagcaggatgtcgtggtcctcgggtctcaagagggcgcgatgcacacagcattgactggggccactgagattcagatgtcatctggaaacctcctgttcaccggccacctgaaatgccgcctgcggatggacaagttacagctgaaagggatgtcctacagcatgtgcaccggcaaattcaagatcgtgaaggagatcgccgagactcagcatggcaccattgtcattcgcgtccagtacgagggcgacggctccccctgcaagattcccttcgagatcaccgatctggagaaacggcacgttctcgggcgcctcatcaccgtgaacccgatcgtcacggagaaggacagtcccgtgaacatcgaggccgagccgccctttggcgactcctacatcatcattggggtggagccaggccaactaaagctcaactggttcaagaaggggagctccatcggccagatgtttgagaccactatgcgcggcgctaagcggatggccatcctaggcgacaccgcctgggacttcggcagcctcggaggcgtcttcacctccatcgggaaggccctccaccaggtattcggggccatctacggtgctgccttcagcggggtttcctggaccatgaagatactgatcggtgtcatcatcacgtggattggcatgaacagccgctccacaagcctgagtgtgagtctggtactcgtcggcgtagtgaccttatacctaggggccgtcgtgcaggcagactccgggtgcgtggtcagctggaagaacaaggagctcaaatgcggcagcgggatcttcatcaccgacaacgtgcacacctggaccgagcaatacaagttccagcccgagagcccctctaagctggcgtccgccatccagaaggcccatgaggagggtatctgtgggatcaggagcgtcacgcgcctggagaacctcatgtggaagcagataacccccgagctgaaccacatcttatccgaaaacgaagtcaaactcaccatcatgaccggcgatatcaaggggatcatgcaggccggcaagcggagcctgcgcccgcagcccacggagctgaagtactcctggaagacctggggcaaggccaagatgctgagcaccgagtcccataaccagaccttcctgatcgacgggccggagacggctgagtgcccgaacaccaacagggcctggaacagcctggaggtggaggactatgggttcggggtgttcaccaccaacatctggctcaagctgagagaaaagcaggacgtcttttgcgacagcaagctgatgagcgccgccataaaggacaacagagccgtgcatgctgacatgggctactggatcgagtccgcgctgaacgatacctggaagatggagaaagccagcttcattgaggtgaagtcctgtcactggcccaagtcacatacgctgtggtccaacggcgtactggaaagcgaaatgatcatccccaagaactttgccgggcccgtgtcccagcacaattatcgccccggctatcacacccagaccgccgggccctggcacctcggcaaattagaaatggatttcgacttctgcgagggcacaacggtggtcgtgaccgaggactgcggcaaccggggccctagcctgcgcaccaccacggcgagcgggaagctcatcaccgagtggtgctgccggtcctgcaccctgcccccgctacgctacagaggcgaggacggctgctggtatggcatggagatccgccccctcaaggagaaggaggaaaacctggtcaactccctggttaccgccgggcacgggcagatagacaacttctccctcggcgtgctggggatggccttgttcctcgaggagatgctacggacccgcatcggcaccaagcacgcaatccttctcgtggcggtctccttcgtgaccctgattaccggaaacatgtccttccgggacttaggccgcgtgatggtcatggtgggggccaccatgaccgacgacataggtatgggggtgacctatctcgccctactggcagccttcaaggtgcgtcccaccttcgcagccgggctgttactacggaaactcacgagcaaggagctgatgatggccacgatcgggatcgctttactctcccagtccaccatccccgaaacaattctggagctgacggatgccctcgcgctcgggatgatggtgctgaagatcgtgcgcaacatggagaaatatcagctcgccgtcaccatcatggccatctcgtgcgtaccaaacgcagtaatcctgcagaacgcctggaaggtcagctgcaccatcctggcagcagtgtccgtcagccccctcctactgacttccagccaacaaaaggcggactggataccgctcgccctgactatcaaggggctgaaccccaccgcgatcttcctaaccaccctgtcccggacgagtaagaagcgctcttggccgctgaacgaggccatcatggccgtcggtatggttagcatcctcgcctccagcctgctgaagaatgacatccccatgacaggacccctcgtggccggcgggctgctgaccgtgtgctacgtgctcaccggtcggagcgcggacctcgaattggagcgcgccgccgacgtcaagtgggaggatcaggctgaaatcagcgggtcgtcccccatcctatcaatcacgatctcagaggacggcagcatgtccataaagaacgaggaggaagaacagaccctaaccatcctgatccggaccggcctcctggtgatcagcggggtgttcccggtctccatccccatcaccgccgcggcctggtacctgtgggaggtgaaaaagcaacgcgcgggcgtcctgtgggacgtccccagcccgccgcccgtggagaaggccgagctggaagacggggcgtaccgcataaaacagcgcggcatcctgggctactcccagatcggcgcgggcgtgtacaaggaggggacgttccacaccatgtggcatgtcaccagaggcgcagtgctcatgcaccgcggcaagcggatcgagcccagctgggccgacgttaagaaggacctgatcagctacggtgggggctggaagctggaaggtgaatggaaggagggcgaggaggtacaggtgttagccctggagcccggcaagaacccccgcgccgtgcagaccaagcccgggattttcaagacaaacacgggcaccatcggggcggtcagcctggacttttcccccgggaccagcggctcccccatcgtggaccgcaaggggaaggtggttggcttgtacgggaacggagtggttacgcgcagcggagcttacgtctccgctatcgcgcagaccgagaagtccatcgaggacaaccctgagattgaggacgacatctttcggaaaaagcgcctgaccatcatggacctgcaccccggagcgggcaagaccaagcggtacttgcctgcaatcgtgcgagaggccataaagagaggactgcgcacattgattctggctccgactcgcgtagtcgccgcggagatggaggaggcgctccggggcctacccatccgctaccagacccccgccatcaagaccgagcacacggggcgggagatcgtggacctgatgtgccacgccacctttaccatgcgcctcctgagccccgtccgtgtcccgaactacaaccttatcatcatggacgaggcccacttcaccgaccccgcgtccatagccgcccgcggatacatcagcacgcgggtcgagatgggcgaggccgccgggatcttcatgacagcaacgccacccggctcccgcgaccctttcccccagagcaacgcccccatcatggacgaggagcgggagatccccgaacgctcctggaacagcgggcacgaatgggtgacagacttcaagggcaagacagtctggttcgtgccgtccatcaaggccgggaacgatattgccgcatgcctccggaagaacggcaagaaagtgatccagcttagccgaaaaacctttgattccgagtacgtgaagacccgggctaacgactgggacttcgttgtgaccactgacatctccgagatgggcgccaacttcaaggccgagcgcgtcatcgacccccggcgctgcatgaagcccgtgatcctgactgacggggaggagcgggtgatactcgcgggacccatgccggtcacacattccagcgcggcccagcgccggggtcgcatcggccgcaaccccaagaacgagaacgaccagtacatctacatgggggagcccctagagaacgacgaggactgcgctcactggaaggaggccaagatgctgctggacaacattaacacccccgaggggatcatcccgtccatgttcgagcccgagcgggagaaggtcgacgccatcgacggcgaatatcgtctgagaggggaagcccgcaagacgttcgtggacctcatgaggcgcggcgacctgcccgtctggttagcctataaggtcgccgccgaggggatcaactatgccgaccggaaatggtgcttcgatggaatcaagaacaaccagatcctggaagagaacatggaggtagagatctggaccaaggagggggagcgcaagaagctcaagccgcggtggctggacgctcgcatctacagcgaccccctcgccctcaaggagtttaaggagttcgccgcgggccggaagtcgttgaccctcaacctcattaccgaaatgggccgcttacccacgttcatgacccagaaggcgcggaacgccctggataacttggctgtcttacacaccgccgaggcagggggccgcgcgtacaaccacgccttaagcgagttgcccgagaccctggagacgctgctcctgctgaccctcctggccaccgttaccgggggaatcttcctattcctcatgagcggaaaggggatcggcaagatgaccctggggatgtgctgcattatcaccgccagcatcctgctctggtacgcccagatccagccgcactggatcgcggcttccatcatcctggagttctttctgatcgttctccttatacccgagcccgagaagcagcggacgccccaggacaaccagctgacttatgtggttatcgccatcctcaccgttgtggccgccacgatggcgaacgagatgggcttcctggagaagaccaagaaagatctgggcctcggcagcatcaccactcaggagagcgagtccaacattctggacatcgacctgcgcccggccagcgcatggacgctgtacgccgttgcaaccaccttcgtcacccccatgcttcggcatagcatcgagaacagctccgtgaacgtgtccctgacggctatcgccaaccaagccaccgtcctcatgggcttggggaagggctggcccttatccaagatggacatcggggttcccctcctggcgatcggctgctatagccaggtgaaccccatcaccctgaccgcggccctgctgttactcgtggcgcactacgccatcatcgggccgggcctacaagccaaggcgacgcgcgaggcccagaaacgggccgctgcagggatcatgaagaaccccaccgtggacgggatcaccgtgatcgacctcgagcccattccttacgaccccaagttcgagaagcagctcggccaggtcatgctgctcatcctctgcgtgacccaagtgctgatgatgcgcacgacctgggccctgtgcgaggcgctcaccctggccaccggaccgatctccacgctgtgggagggcaaccccggccggttctggaacaccaccatcgctgtctctatggcgaacatctttcgcggctcctacttagcgggtgccgggttgctgttcagcatcatgaagaacaccacgtccacccggcggggcacggggaatataggcgaaacactcggcgagaagtggaaatctcggctgaacgccctgggtaagtccgagttccagatttacaagaagtcaggcattcaagaggtggaccggaccctggccaaggaggggatcaagcgcggcgagaccgaccaccacgctgtgtcccgggggagcgccaagctccgctggtttgttgagcggaacatggtgactccggagggtaaagtggtagacctgggctgcggacgcggcgggtggtcctactattgtggtgggctcaaaaacgtccgggaggtgaagggcttaactaagggcgggcccggccacgaagaacccattcccatgtcgacttacgggtggaacctggtccgactccagagcggcgtggacgtattctttacaccacccgagaagtgcgacaccctcctatgcgacatcggagagtccagccccaaccccacaatcgaggccggccggacactccgcgtactcaacctggtggagaactggctcaacaacaacacgcagttctgtatcaaggttctgaatccgtacatgccctccgtcattgagaaaatggaggccctgcaacggcagtacggcggcgcattggtgcgcaaccccctgtcgcggaactcaacccacgaaatgtactgggtgagcaacgcgaccggcaacattgtctcgagcgtgaacatgatttccaggatgctgatcaaccggttcaccatgaagcacaagaaagccacctacgagccggacgtggacctggggagtggcacccgcaacattgggatcgagtccgagattcccaacttggacatcatcggcaagcggatcgagaagatcaagcaagaacatgagatcagctggcactacgaccaggatcacccctacaagacctgggcgtatcacggttcctacgaaaccaagcagactggtagcgcctccagcatggtcaacggcgtggttcgactgctgaccaagccctgggacgtagtgccgatggtaacccagatggccatgaccgatacgacccccttcgggcaacagcgcgtgttcaaggagaaggtggacacccggacccaggagcccaaagagggcacgaaaaagctcatgaagattaccgcggagtggctgtggaaggaactgggcaaaaagaagacaccccgaatgtgcacccgggaggagttcacgaaaaaggtgcgctccaacgctgccctgggggccatcttcaccgacgagaacaaatggaaatccgcccgggaggcagtcgaggacggccgcttctgggaactggtggatcgggagcgcaacctgcacctcgaggggaaatgcgagacgtgcgtgtacaacatgatgggcaagcgggaaaagaagctgggagagttcggcaaggccaaggggtcccgcgccatttggtatatgtggctcggggcccggttcctcgagttcgaggcgctgggcttcctgaacgaggaccactggttcagccgcgggaacagcttatcaggtgtcgagggggagggactccaccgtctgggctacatcctccgagatgtggggaagaaggagggcggggcgatgtacgcagacgacaccgccggctgggatacgcggatcacgctggaagaccttaagaacgaggagatggtaaccaaccacatgaaaggcgagcacaagaagctcgccgaggcgatcttcaagctcacctaccagaacaaggtggtgcgcgtccaacgcccgacgccccgcggcacagtgatggatatcatctctcggcgtgaccagcggggaagtgggcaggtcggcacctacgggctaaacactttcactaacatggaggctcagttaatccgccagatggagggcgagggcatcttcaagagcatccagcacctgacagccactgaagaaatcgccgtccaaaactggcttgcccgtgtggggcgggagcgcctcagccggatggctataagcggcgacgactgcgtcgtcaagcctatcgacgatcgctttgcatccgccctcaccgcgctgaacgacatggggaaggtgcggaaggacatccagcaatgggagccgagccgcggctggaacgactggacccaagtgccgttctgctcccaccacttccatgagctcgtcatgaaggacggccgggtcctggttgttccctgccgcaaccaggacgagctgattggccgggcccgcatctcgcagggcgcgggttggtccctcaaagagaccgcctgcctgggcaagtcgtacgcccagatgtggaccctgatgtacttccacagacgcgacctccggctggcagccaacgcgatctgctccgcagtgccctcgcactgggtgccgacatcccgcacgacgtggagcatccacgccaagcatgagtggatgaccactgaggacatgctggccgtttggaatcgggtgtggatccaggagaacccgtggatggaagacaagacccccgtggagtcctgggaagaggtcccctacctcgggaaacgcgaggaccagtggtgcggctcgctaattggtctgacgagccgcgcgacgtgggccaagaacatccagaccgcaatcaaccaggtgcgatcgctcatcggcaacgaggagtatacggactacatgcccagcatgaagaggttccgccgcgaagaggaggaggccggcgtgctgtggtga

SEQ ID NO: 25016 - RNA, 9876 nt, synthetic construct
  misc_feature 1..9876: note = derived and/or modified CDS sequence (opt11) from DENV-2__EU569702__SS-prME
  source 1..9876: mol_type = other RNA
accgccggcgtcatcgtcatgctgatccccaccgccatggcattccacctcaccacccggaacggggagccccacatgatcgtgggtcggcaggagaaggggaagtccctgctgtttaaaaccgaggacggcgtgaacatgtgcactcttatggccatcgacctgggggagctgtgcgaggacacgatcacctacaagtgccccctcttgcgccagaatgagcccgaggatatcgactgctggtgcaactctacctcaacctgggtcacgtacgggacatgcaccacaacgggcgagcaccggcgcgagaagcggtccgtggccctggtgcctcacgtcgggatgggcctcgagacaagaacagagacctggatgagctccgagggggcttggaaacacgtgcagcgaatcgagacctggatcctgcgtcaccccggctttaccatcatggctgcgatactggcctacaccatcgggaccacgcactttcagcgggccctaatcttcatcctgctgaccgccgtggcgcccagtatgacgatgcgctgcatcggcatctccaacagagacttcgtcgagggagtgagcggcggatcctgggtggacatcgtcctagagcacgggagctgcgtgactacgatggccaagaacaagcccaccctggacttcgagctgataaagaccgaggctaagcagcccgccaccctcagaaagtactgcatcgaggccaagctgacgaacaccaccaccgagtcccggtgcccgacgcagggcgagcccagcctgaacgaggaacaggacaagcgcttcatctgcaagcactccatggtggacaggggctgggggaacggctgcgggctgttcggcaagggcgggatcgtaacctgcgcgatgttcacgtgtaagaagaacatggagggcaaggtagtgcaacccgagaacctcgagtacaccatcgtcatcacgccccacagcggggaggaacacgcagtgggcaatgacaccgggaagcacggaaaggagatcaagatcactccgcagtccagcatcaccgaggcagagctgaccgggtacggaacggtgacaatggagtgcagcccccgtaccggcctcgacttcaacgagatggttctactgcagatggaggacaaggcctggctcgtccatcggcagtggttcttggacctgcccttaccctggctgccgggggccgacacccagggcagcaactggatccagaaggagacgctggtgacattcaagaaccctcacgcgaagaagcaggatgtcgtggtcctcgggtcccaggagggagccatgcatacggcactgaccggtgccacggagattcaaatgagctcgggcaacctcctgtttaccggccatctcaagtgccgcctgcggatggacaagttacagttgaaagggatgtcctacagcatgtgcaccggcaagttcaagatagttaaggagattgccgagacccagcatgggacgatcgtgatccgggtacagtacgagggcgacggcagcccctgcaagatccccttcgagatcaccgacctagaaaagcggcacgtgctcgggcgcctcatcacagtgaacccgatcgtcaccgaaaaggacagccccgtgaacatcgaggcagagccaccctttggcgactcctacattatcatcggcgtggagccgggccagttgaagctgaattggttcaaaaaggggagcagtatcggacagatgttcgagacgaccatgagaggcgcaaagcggatggccatcctgggggacaccgcctgggatttcggcagtttgggtggtgtcttcacgtccatagggaaggccctacaccaggtgttcggcgccatctacggcgccgccttctctggggtgtcctggacgatgaagatcctaatcggcgtcatcatcacctggatcgggatgaacagcagatcaaccagcctgagcgtgagcctggtgctcgtcggcgtggtgaccctgtacctgggggccgtcgtgcaggcggactccggctgcgtggtcagctggaagaacaaggagctcaagtgtggctcagggatcttcatcacggacaacgttcatacctggaccgagcagtacaagttccagcccgagagcccctccaagctggcctccgccattcagaaggcgcacgaggagggcatctgcgggatccggagcgtgacccgcctggagaacctcatgtggaagcagatcacgcccgagctgaaccacatcctgtccgaaaacgaggtcaagctcactatcatgactggcgacatcaaggggatcatgcaggccggcaaacggtcgctgcgcccgcagcccaccgagctgaagtactcctggaagacgtggggtaaggccaagatgctcagcaccgagtcccacaaccagacattcctgatagatggtcccgagaccgccgagtgcccgaatacgaaccgggcctggaacagcctggaggttgaggactacggcttcggggtattcaccacgaacatctggctcaagctgcgcgagaagcaagacgtcttctgcgattccaagctgatgagcgccgccatcaaagacaaccgggcggtgcacgccgacatgggctactggatagagtcagcactcaacgacacctggaagatggagcgcgcgagcttcatcgaagtgaagagctgccactggcccaagagccataccctgtggtccaacggcgtcctggagagcgagatgatcatccccaagaacttcgccgggcctgtgtcccagcacaactaccggccgggctaccacacgcaaaccgcggggccctggcacctgggcaagctggagatggacttcgacttctgcgaggggacgaccgtggtggtgaccgaggactgcggcaaccgcggccccagcctgcgtaccaccaccgccagcggtaagctcatcacggagtggtgctgccgctcctgcaccttaccccccctgcggtaccgcggcgaagacgggtgttggtacggcatggagatccggcccctcaaggaaaaggaggagaatctggtgaactccctggtcaccgccgggcacggccagatcgataatttttccctcggcgtgctggggatggccctgtttctcgaggagatgctgcgcacccggatcggcacgaagcatgcgatcctgctcgttgccgtcagctttgtgaccctgatcaccgggaacatgagcttccgcgacctgggtcgcgttatggtcatggtgggggccacgatgacggacgacatcggcatgggcgtgacgtacctcgccctgctggccgcgttcaaggtccggcccaccttcgccgccgggctccttctgcgcaagttaacctcgaaggagctcatgatggccacgatcggcatcgccctgctctcacagagcaccatccccgagaccatcctggagctgaccgacgcgctcgccttggggatgatggtactgaagatagtacggaacatggagaagtaccagctcgcagtcacgatcatggccatctcctgcgtgcctaacgccgtaatactgcagaacgcgtggaaggtcagctgcacaatcctggccgccgtatccgtcagtcccctcctgctgacttccagccaacaaaaggctgattggatacccctcgcgctgacgatcaagggcctgaaccccacggccatctttctcaccaccctgtcccgcaccagcaagaagcggtcctggccgctgaacgaagccatcatggccgtgggcatggtaagcatcctcgcctcgagcctgctgaagaacgatatcccgatgacggggcccctcgtcgcgggcgggttacttaccgtgtgctacgtgctcactggccgcagcgccgacctggagctggagcgggccgccgacgtcaagtgggaggatcaggccgagatatccggcagctcccccatcctcagcatcaccatctccgaagacggcagcatgtccatcaagaacgaggaggaggagcagacgctgaccatcctcatccgaaccggcctcctggtgatcagcggggtgttcccggtgtccatccccatcaccgcggccgcttggtacctgtgggaggtcaagaagcagcgggccggtgttctctgggacgtccccagcccgccgcccgtggagaaggccgagctggaggacggggcgtaccgcatcaagcaacggggcatcctgggttactcccaaatcggcgccggcgtctacaaggaggggacattccatacgatgtggcacgtgacacgcggcgccgtgctcatgcaccgggggaagcgcatcgagcccagctgggccgacgtgaagaaggacctgatatcctacggcgggggctggaagttagaaggcgagtggaaggagggggaggaagtccaggtgttagcgctggagcccggcaagaacccccgggcggtgcagaccaagcccgggatcttcaagaccaacacgggcaccatcggcgccgtcagcctggacttctcccccgggaccagtggctctcccatcgtggaccgcaaggggaaggtcgtcggtctctacgggaacggcgtggttacccggtctggcgcctacgtctccgccatcgcgcagacggagaagtcgatcgaggacaaccccgagatcgaggacgacattttccgcaagaagagactgaccatcatggacctgcaccccggggccggcaagacgaagcgctacctccccgccatagtgagagaggccataaaacgcgggctccgcaccctgatcctcgccccaacgcgagtggtcgctgccgagatggaggaggccctccgaggccttcccatcagataccagacccctgccatcaagaccgagcacaccgggcgcgagatcgtggacctgatgtgccacgccacgttcaccatgcgtctcctgagccccgtacgcgtgccgaactacaacctcatcatcatggacgaggcgcacttcacagaccccgcctccatcgccgcccggggatacatcagcacccgcgtggagatgggggaagccgccgggatcttcatgacggccacgccgcccggttcccgggacccgttcccccagagcaacgcccccattatggatgaggagcgcgagatccccgagcggtcctggaacagcgggcacgagtgggtgactgacttcaagggcaagaccgtctggttcgtgccttctatcaaggccggcaatgacatcgcggcctgcttacgcaagaacggcaagaaggtgatccagctgagccggaagacgttcgactccgagtacgttaagacgcgcgccaacgactgggatttcgtggtgaccactgacatcagcgagatgggcgcgaatttcaaggccgaacgggtcatcgacccccgcaggtgcatgaagcccgtcatcctgacggactccgaggagcgcgtgatcctcgcgggtcccatgcccgtcacccacagctccgccgcccagcggcgcggccgcatcggtcgaaacccgaagaacgagaacgaccagtacatctacatgggggagcccctggagaacgacgaggactgcgcccattggaaggaagccaagatgctgctcgacaacatcaacacgcccgaggggatcatcccgagcatgttcgagcccgagcgcgagaaggttgacgcgatcgacggtgaataccggttgaggggcgaggcccggaaaaccttcgtggacctcatgcggcgcggcgacttaccggtctggctggcctacaaggtagccgccgagggcattaactacgcggaccgcaagtggtgctttgacgggatcaaaaacaaccagatcctggaggaaaatatggaggttgagatctggacgaaggagggagagaggaagaaattaaagccgcgctggctggacgcccgcatttactccgaccccctggccctcaaggagttcaaggagttcgccgcggggcgcaagtccctgaccctgaacctcatcactgaaatgggcaggctgcccaccttcatgacgcagaaggcccgcaacgccctggacaacctcgccgtgctacacaccgccgaggcgggcgggcgggcctataaccacgccctgtccgagctccccgagaccctggagaccctgctcctgctgacgctccttgccaccgtgaccggcgggatcttcctgttcctcatgagcgggaagggcatcgggaagatgaccctgggcatgtgttgtatcattaccgcctccatcctcctctggtacgcgcaaatccagccacactggatcgccgctagcatcatcctggagttcttcctgatcgtcctcctgatccccgagcctgagaagcagcgcacaccccaggacaaccaacttacctacgtggtaatcgccatcctgacggtcgtggccgcgaccatggccaacgagatggggttcctggagaagacgaagaaggacctgggcctcgggagcatcaccacgcaggagtcagagagcaacatccttgacatcgacctgaggccggcctccgcctggaccttgtacgccgtggcgacgacgttcgtcacccccatgttgcgccactccatcgaaaactccagcgtgaacgtgtccttaaccgctatcgccaaccaggccacggtcctcatgggcctgggcaagggatggcccctgtcgaagatggacatcggcgtgcccctgctggcgatcgggtgttactcccaggtgaatccgatcaccctgaccgccgccctcctcttgctcgtggcccactatgcgatcatcggccccggtctgcaagcgaaggcgacccgggaggcccagaagcgagccgccgcgggcataatgaagaaccccacggtggacggcatcactgtgattgacctggagcccattccgtacgaccccaaattcgagaagcagcttgggcaggtcatgttgctcatcctatgcgtgacccaggtgctgatgatgcggaccacgtgggccttatgtgaggccctcacccttgccactggccccatcagcaccctgtgggaagggaaccccggccgcttctggaacacgaccatcgccgtcagtatggcgaacatcttccgtgggtcctacctcgccggcgccggtctgctgttctccattatgaagaacaccaccagcaccagacgcgggaccggcaacatcggcgagactctcggggagaagtggaaatcccggctgaatgctctgggcaagagcgagttccagatctacaaaaagtcagggatacaggaagtggaccgcaccctcgcgaaggagggcatcaagcgcggggagacggatcaccacgccgtgagccgcggctcggccaagctgagatggttcgtcgaacgcaacatggtcacgccggaggggaaggtggtcgacctgggctgcggtcgggggggctggagctactactgcggtggcctcaagaacgttagagaggtgaaggggctgaccaagggcggccccgggcacgaggagcccattcccatgagcacctacggatggaacctggtccggctccagtccggggtcgacgtcttcttcacgccgcccgagaagtgcgacaccctgctgtgcgacatcggcgagtcttcccccaaccccaccatcgaggccgggcgcaccctccgggtcctcaacctggtggagaactggctgaacaacaacacccagttctgcatcaaagtgctgaacccgtacatgcccagcgtcatcgagaagatggaggccctgcagcgccagtacggcggcgcgctcgtgcggaaccccctttcccgcaacagcacacacgagatgtattgggtgtccaacgccaccggaaacattgtcagctccgtgaacatgatcagccgcatgctgatcaaccgcttcaccatgaagcacaagaaggccacctatgagccggatgtggatctgggcagcgggacgcggaatatcggcattgagagcgagatccccaaccttgacatcatcgggaagcgcatcgaaaagattaagcaggagcacgagatctcttggcactacgaccaggaccacccctacaagacatgggcctatcatggcagctacgagacaaagcagaccggatccgccagctccatggtcaacggagtcgttagactgctgacgaagccctgggatgtggtgccgatggtcacccagatggcgatgacggacaccacacctttcggccagcagagagtctttaaagagaaagtggacacccgcacccaggagcccaaggaagggactaagaagctaatgaagatcacggcggagtggctgtggaaggaactgggcaagaagaagacgccccggatgtgtacacgcgaggagtttaccaaaaaggtacggagcaacgccgccctcggggccatcttcacggacgagaacaagtggaagtccgcgcgcgaggcggtcgaggacgggcggttctgggagcttgtggaccgcgagcggaacctgcacctcgagggcaagtgcgagacctgcgtgtacaacatgatggggaagcgggagaaaaagctaggggagttcgggaaggccaagggaagtcgggcaatctggtacatgtggttgggcgcgcgattcctcgagtttgaagccctggggttcctgaacgaggaccattggttcagccggggcaactccctcagcggggtcgagggcgaggggctgcacagacttggctatatcctccgcgacgtgggcaagaaggagggcggcgcgatgtacgcagacgacaccgccggttgggacaccagaatcacgctggaggacctgaagaacgaggagatggtcacaaaccatatgaagggcgagcacaaaaaactcgcggaggccatctttaagctgacctaccagaacaaggttgtacgggtgcagcgcccgacgccccggggcacggtgatggacatcatctcccgccgggaccagcgtggcagcgggcaggtggggacctacggcctaaacaccttcaccaacatggaagcccaactgatcaggcagatggagggggaaggcatcttcaaaagcatccagcacctgacggccactgaggagattgcagtacagaactggttagctcgggtgggccgcgagcggctctcgcgcatggccatctccggggacgactgcgtggtcaagcctatcgacgaccggttcgccagcgctctgaccgctctgaatgatatgggcaaggtccgcaaagacatccagcagtgggagccctcgcgggggtggaacgactggacccaggtgccgttttgcagccaccacttccacgagctcgtaatgaaggacgggcgcgtgttagtggtcccatgccggaaccaggacgagctgatcgggcgcgcgcggatctcccagggcgctggctggagcctcaaggagacggcctgcctggggaagtcctacgcccagatgtggaccctgatgtacttccaccgcagggatctccgcctggccgcgaacgccatctgcagcgccgtgccttcccactgggttcccaccagccggaccacctggtccatccacgccaagcacgagtggatgacaactgaggacatgttagcggtctggaatcgcgtttggatccaggagaacccatggatggaggacaagaccccggtcgagagctgggaggaggtcccctacctcggcaagcgggaggaccaatggtgcgggagcttaatcggcttgaccagtcgcgctacgtgggccaagaacatccagaccgcgataaatcaagtgcggagcctcatcgggaacgaagagtacaccgactatatgccatccatgaagcgcttccgccgggaggaggaggaagccggggtcttgtggtga

SEQ ID NO: 25017 - RNA, 9876 nt, synthetic construct
  misc_feature 1..9876: note = derived and/or modified CDS sequence (opt11) from DENV-2__EU482624__SS-prME
  source 1..9876: mol_type = other RNA
accgcgggggttatagttatgttgatcccgacagctatggcattccacttaacaacacgcaatggggaaccccacatgatcgtcggacgccaagaaaaaggaaaatccttactatttaaaaccgaagatggagtcaacatgtgcaccctaatggcgatcgacctaggagaattatgcgaggacacaatcacctataaatgcccactgctgcgtcaaaatgagcccgaggacattgattgttggtgcaacagcacgtcaacgtgggtcacctatggaacctgtaccaccaccggagaacaccgcagggaaaaacgaagtgtggcattagtgcctcacgtagggatgggtttggagacacggacagaaacctggatgtcatccgaaggagcatggaaacacgtacaacgcatcgagacgtggatcctacggcacccgggattcacaatcatggctgcgatactagccaacaccatcggaacaacccacttccagcgcgcactaatatttatcttactaacggcggtcgccccctcaatgacaatgcggtgcataggtatcagcaacagagattttgtggaaggagtctcagggggctcctgggtagacatcgtgctcgaacacggcagttgcgtaactactatggccaaaaataaaccgaccttggacttcgaactaataaaaacagaagcgaaacagcccgcaacactccgcaaatactgcattgaagcgaaacttacaaacacgacaaccgaaagccggtgtcctacccaaggagagcccagcttaaacgaagaacaagacaaaagattcatctgcaaacactcaatggtagaccgagggtgggggaacggctgcggccttttcggcaaaggaggtatcgtcacttgcgcgatgtttacgtgcaagaaaaacatggaggggaaagtcgtacagccagagaacctggaatataccatcgtgataacaccacattccggcgaggagcacgctgtggggaacgacacgggaaaacacggtaaagagatcaagataacaccacagagcagtatcacggaagcggaactgacgggatacggtacagtaacgatggaatgcagcccccgcaccggactggacttcaacgagatggtcctcctgcagatggaggacaaagcctggctggtccaccgtcaatggttcctagacctgcccttaccttggctccccggtgcggacatccaaggctcgaattggatccagaaagaaaccctggtgacattcaaaaacccacatgcgaagaaacaagacgtcgtggtactagggtcccaagagggcgcaatgcatacagcgctaacgggagcaaccgagatacaaatgagctcgggcaatctcctctttacaggtcacctaaaatgccggctgaggatggacaaactgcaattgaagggcatgtcgtactccatgtgcacagggaaatttaagatcgtaaaggaaatcgcggaaacccaacacggaacaatagtaataagagtacagtacgagggcgacgggtcaccgtgcaaaattccgttcgagattacggacctagagaagcgacacgtactaggccgactgatcacggtaaatcccatcgttacagaaaaagactcccccgtcaacatcgaagctgagcctccattcggggacagctacatcataataggcgtcgaaccgggccaactaaagctgaattggttcaagaaagggagttcgataggccaaatgttcgaaactaccatgaggggcgcgaagcggatggccatacttggggacacggcgtgggacttcggaagcctaggaggggtcttcacttcaatcggtaaggcactacaccaagtttttggcgccatatatggagccgccttcagcggggtcagctggaccatgaaaatcctcattggagtcatcatcacatggatcggcatgaacagtcggagcacaagcctatcggtgagcctcgtactcgtaggggtcgtcaccctctatttgggggccgtagtgcaagcagacagcggatgtgtagtatcgtggaagaacaaagaactgaagtgtgggtccggaatattcattaccgacaacgtgcacacatggacggagcagtacaaatttcaacctgagtcaccatccaagctcgccagtgctatccaaaaggcccacgaggagggcatatgcggaatccgatcagtaaccaggctggaaaaccttatgtggaagcagataacccccgagctcaaccacatactctcagagaacgaggtcaaactaaccataatgaccggggacatcaagggcataatgcaagcaggcaagagaagcctgaggccccaaccgacggagctcaaatactcgtggaaaacctgggggaaagccaaaatgttaagcaccgaaagccacaaccaaacattcctcatcgatggcccagaaacggcggaatgtccgaatactaaccgagcatggaactccctagaggttgaggactacgggttcggagtgttcaccacaaatatatggcttaagttgcgggagaaacaagacgtcttctgcgacagcaaactcatgagtgcggcgataaaagacaaccgggcagtacacgccgatatgggctactggatagaatcggccctcaacgatacctggaaaatggaaaaagcatcattcatagaagtgaaatcctgccactggcccaaatcccacacactgtggagcaatggtgtactcgaatcagagatgatcatacccaaaaacttcgcaggcccagtatcacaacataactaccgccctggataccacacacagactgccggcccatggcatctcggaaaactggaaatggacttcgatttctgcgagggtaccacagtggtggtgactgaggactgtggtaatcgtggccctagcttgcgaaccacaaccgcaagtggaaaactaattacagagtggtgttgcaggtcctgcaccttacccccactcaggtatcgcggggaagatggatgttggtacggcatggagatcaggccgctaaaagaaaaggaagaaaacctagtcaatagcctcgttactgcaggtcacggtcaaatcgacaacttctctctaggggtactcggaatggcacttttcctggaggaaatgctacgaacgaggatcggcaccaaacatgcgatcctgctagtggcagttagctttgtaacgctcataacggggaacatgtcgttccgggacttgggaagagtcatggtcatggtgggcgccaccatgactgacgacataggaatgggagtaacgtacctcgcactgttagccgcgttcaaggtacggcccaccttcgcagccgggctcctactgcgaaaactaacatcaaaagaattgatgatggcgaccattggaatagccttgctgagtcaaagcacaattcccgagaccatactagagcttacggacgcgctcgcactaggtatgatggtacttaaaatcgtacgaaatatggagaaataccagctcgcagtaacaataatggccataagctgtgtcccaaacgcggtcatactacaaaacgcctggaaggtgagctgcacgatattagcggcggtcagcgtttcgcctctgcttctcacatcctcacaacagaaagcagattggattcctctcgcgcttacaatcaagggactcaacccaaccgcgatattcctaactacactgtcgcgtacctcgaagaagagaagctggccactaaacgaagctataatggctgtcggaatggtatcaatactcgcgagtagtcttctaaagaacgacatccccatgacagggcctttggtagcgggcggtctgctaacggtatgttacgtcctcacaggccgaagtgcagatcttgaattagaacgcgcagccgacgtaaaatgggaggatcaagccgaaatctcaggcagctcacccatactctctataactatttccgaagacgggtcaatgagcatcaaaaatgaagaagaagaacagaccctaacgatcctgattagaacgggcctgttggtaatcagcggcgtcttccctgtcagtataccaataaccgcggctgcctggtacctctgggaagtgaagaagcagagagcaggagtcctctgggatgtccctagcccacccccggttgagaaagccgaactggaagacggcgcctatcggattaaacagcggggaatacttggctacagccaaatcggagctggagtatacaaagagggcacattccacacaatgtggcacgttacaaggggagccgtattaatgcatagaggaaagcgcatcgaaccctcctgggcagacgtcaagaaagacctaatatcctatggcggcggctggaaactcgaaggagaatggaaagagggtgaagaagtacaggtacttgcgctcgagccgggcaaaaatcccagagcggtccagaccaaacccgggatattcaagactaacactggaaccattggggcggtaagcctcgatttctcgcccgggacatcagggagcccgattgtcgaccgaaagggtaaggttgtcggactctatggcaacggagtggtcacccgtagcggagcttatgtctctgccatcgcgcagacagaaaagagcatcgaagataacccggagattgaagacgatatattccgtaagaagcggctgacaataatggacctccacccaggagcgggcaagacaaaacgctatctcccagctatagtccgtgaagccatcaaacgagggttaagaactcttatactcgcccccacacgggtagtcgcggcggaaatggaggaagcattacgaggactacccatacgataccaaacaccagcgataaaaaccgagcacacgggtagagaaatcgtagatctcatgtgccacgcgacgtttaccatgcgtctactgtcgccagtacgggtccctaactacaacctgataataatggatgaagcacacttcaccgacccagcgtccatagcagcacggggctacatatcaacccgagtagagatgggagaagccgccggaatattcatgactgcaacaccacccgggtcccgagatccattcccacaatcaaacgcaccaatcatggacgaagagagagaaatcccagagcgttcatggaatagcggacacgaatgggtcactgacttcaagggcaagaccgtctggttcgtcccttcgattaaggccggtaacgatatagcagcctgcctacgcaaaaacggcaagaaagtcatacaacttagccggaagacatttgacagcgaatatgtaaaaacgagggctaatgactgggatttcgtggtcacgacggatattagcgaaatgggagcgaacttcaaagccgaaagagtaatcgatccccgacgatgcatgaagcccgtgatcctaactgacggcgaagaacgggtgatactcgcgggaccgatgcccgtaacccattccagcgcggcacagcgacggggccggattggccgaaaccccaaaaatgaaaacgaccagtacatttacatgggcgagccactcgagaacgacgaggattgtgcacattggaaagaggcaaaaatgctgctcgataacataaacacaccagaaggtataatacccagcatgttcgaacctgagcgtgaaaaagtggacgccatagatggcgagtatcggttaaggggcgaagccagaaagactttcgtagacctaatgcgacgcggagatctacccgtttggttggcctacaaggtagcggccgagggaataaactacgccgacagaaaatggtgcttcgatggtatcaaaaataaccaaatcctagaggagaacatggaggttgaaatatggaccaaagaaggcgaaaggaagaagctcaaaccacgctggctagacgcgagaatatacagcgacccactagctctcaaggagttcaaagagttcgcagctggacgaaagtctctgacactgaacttaataacggagatgggacggctccccaccttcatgacacagaaagccagaaacgcacttgacaacctcgccgtgctgcacaccgccgaagccggagggagggcatacaaccatgcactcagtgaactgccagaaaccctagagacacttctcctcctcacactgttagcgaccgtcaccggaggcatattcctattcctaatgtcaggcaagggtatagggaagatgacgctgggaatgtgttgcattataaccgcaagtatactactatggtacgcacagatacagccccactggatagcggccagtatcatcctagagttcttcctcatcgtcctccttattccagaaccggagaaacagcgcacgccacaagacaaccagctaacctacgtagttatagcaatactcaccgtagtggcagcaacaatggccaacgagatgggttttctcgagaaaacgaagaaggatctgggactcgggtccataaccacccaagaaagcgagtccaacatactagacatagacctacggcccgcatcggcgtggacactatacgcggtggctaccacattcgtaacacctatgctcaggcacagcatcgaaaattcctcggttaatgtctcgctcaccgcaatagcaaaccaagcgacagtcttgatgggcctgggaaaaggatggcctctaagtaagatggacataggagtcccactactcgctataggctgttactcacaagtgaacccaataacactaacagcagcactcctcctactcgtagcgcactacgccatcatcggtccaggtttgcaggcaaaggccacccgcgaagcccagaaaagagcggcggcaggaataatgaagaatccaaccgtggacggaattacagttatcgacctcgaacccataccatacgacccaaagttcgagaaacaactgggacaagtcatgctcttaatcctatgcgtcacgcaagtactcatgatgcgcacaacctgggcactctgcgaggccctgactctggccaccggtccgatcagtacattgtgggaaggaaaccccggacgattctggaacaccaccatcgccgtttcaatggcaaatatattccgaggaagctatcttgcaggcgcgggtctcttgttctcaataatgaagaataccacttcaacccgacgaggcacaggaaatataggagaaacgctaggagaaaagtggaaaagtcgtctgaatgctctaggcaaaagtgagttccagatatacaagaaaagtggcatacaggaagtcgatcgaacgttggccaaggaaggtatcaagcgcggggaaaccgatcaccacgcggtctcgcgaggatcggctaaactgcgctggtttgtggaacgaaacatggtgacgcccgagggaaaagtagtcgacctgggctgcggtcgagggggatggtcatactactgcggaggcctcaaaaacgttagggaggtaaagggactaacaaaaggcggcccggggcacgaagaaccgataccaatgtcgacatacgggtggaatctcgtgcgccttcagtctggcgtcgatgtattctttacaccaccagagaaatgcgatacgctgttatgcgatattggtgaatcaagtcccaatccgacgatagaggcagggcggactttaagagtgctcaatctagtcgaaaactggctgaacaacaacacacaattctgtataaaggtgctgaacccgtatatgccctccgtcatcgagaagatggaagcgctacaacgccaatacggaggggcccttgtccgtaacccgctatcccgtaacagcacacatgaaatgtactgggtcagtaacgcaacaggaaacatcgtttcctctgtgaacatgatctcgcgaatgctaatcaatcgattcaccatgaaacacaagaaggcgacatatgaaccggacgtggatctcggctccgggaccagaaacattggcattgaaagcgaaattcccaacctggacataataggcaaaaggattgagaaaataaagcaggagcacgaaatcagctggcattacgatcaggaccacccgtacaagacatgggcttatcacggaagctatgaaactaagcaaacaggatctgccagcagcatggtcaatggggtcgtacggctgttaactaagccctgggatgtggtaccaatggttacgcaaatggcaatgacagatacaacgccattcggacagcagcgagtcttcaaggagaaagtagacactaggactcaagaaccgaaagaaggcacgaagaaattgatgaagataacggctgaatggctatggaaagaactggggaaaaagaagacaccgcgaatgtgcaccagagaagagtttaccaagaaagtccgcagcaacgccgcgctcggcgccattttcactgatgaaaacaagtggaagtccgcaagggaagccgtcgaggacggccgcttctgggagctcgtggacagagaacgcaacctccacctcgaaggaaaatgcgagacttgcgtatataacatgatgggtaaacgagagaagaagctcggggaatttggcaaagcaaaaggaagccgggcaatctggtatatgtggctgggtgccaggttcctggaatttgaagcactggggttcctaaacgaggaccactggttcagtaggggaaattcattatcgggagtcgaaggagagggtctccatagattagggtacatcctgcgcgatgtcgggaagaaagaaggaggagccatgtacgccgacgacacggccggatgggacacgcggattaccctggaggacctaaagaatgaggagatggtgaccaaccacatgaaaggagaacacaaaaagttggctgaagcaatatttaagctcacctaccaaaacaaggtcgttcgggtacagcgcccgaccccacgcgggacagtcatggacattataagccgtagagatcaacgcgggtcaggccaagttggaacatacggcctcaataccttcactaacatggaagcacagctcatcaggcagatggagggagaaggaatattcaagagcatacaacatctcactgcaacagaggagatagccgtgcagaactggctcgcgagagtcggaagagaacgcctaagcagaatggccatatcaggcgatgactgcgtggtcaaaccaatagacgaccggttcgcatccgcactaactgccttaaacgatatgggcaaagtgcgtaaagacatccaacaatgggaacccagcagagggtggaatgactggacacaagtcccgttctgctcacaccatttccatgaattagtcatgaaagacggccgtgtgctagtagtaccatgcaggaaccaagatgaactaataggacgagcccgaatcagccaaggagcaggatggagtttgaaagaaacggcgtgccttggaaagtcatacgcccaaatgtggactctaatgtacttccaccgacgcgacctacggctggctgctaacgccatatgcagcgcggtgccgtcacattgggtaccaactagccgtaccacgtggtcgatccacgccaagcacgagtggatgaccactgaagacatgcttgcggtatggaacagggtctggatacaagagaacccctggatggaagacaaaacacctgtggagagctgggaggaggttccataccttggaaaaagagaagaccaatggtgtggtagtctcataggactgacgagcagggctacctgggccaagaacatccaaaccgcaattaatcaagtgcgcagcttgatcggaaacgaagaatacaccgactacatgccatcaatgaagagatttcgaagagaagaagaggaagcaggcgtcctatggtaa

SEQ ID NO: 25018 - RNA, 9876 nt, synthetic construct
  misc_feature 1..9876: note = derived and/or modified CDS sequence (opt11) from DENV-2__EU596500__SS-prME
  source 1..9876: mol_type = other RNA
accgcgggcgtgattgttatgctgatccctaccgcaatggcgttccacttgactaccagaaacggggagccccacatgattgtgggccggcaggagaaggggaagtccctgctgttcaagaccgaggacggcgtaaacatgtgcacactaatggccatcgacctgggggaactgtgcgaggacaccatcacatacaagtgccccctcctgagacagaacgagcctgaggacatcgactgctggtgcaacagcaccagcacctgggttacgtacgggacctgcaccaccacgggcgagcaccggcgcgagaagcggtccgtggccttggtaccccacgtcgggatgggcctcgagactcgcaccgagacctggatgtctagcgagggggcctggaagcacgtgcagcggatcgagacttggatccttcgccacccggggttcactatcatggccgcgattctagcctacaccatcgggaccacgcactttcagcgggccttaatcttcattctgttaactgccgtggcgccaagcatgaccatgcgctgtataggcatcagcaaccgggacttcgtcgaaggcgttagcggcggctcctgggtggacatcgtccttgagcacgggagctgcgtgaccacgatggccaaaaacaagcccaccctggacttcgagttaataaagaccgaggccaagcagccagccactctcaggaagtactgcatcgaggccaagctgacgaacacgaccacggagtcccggtgcccgacgcagggcgagcccagcctgaacgaggagcaggacaagcgcttcatctgcaaacactcaatggtggaccggggctgggggaacggctgcggattattcggcaagggcggcatagtgacctgcgcgatgttcacgtgcaagaagaacatggagggcaaggtagtgcagcctgagaacttggaatataccatcgtcatcacgccccactctggggaggagcacgctgtgggcaatgacaccgggaagcacggcaaggagattaagatcactccgcagtccagcatcaccgaggccgagctgaccgggtacggcacggtgaccatggagtgcagcccccggacaggcttagacttcaacgagatggtcctgttacaaatggaggacaaggcctggctcgtgcaccggcagtggttcctggacctgccactcccctggctgccaggcgctgatacccagggctcaaactggatccagaaggagacgctggtgaccttcaagaacccccatgcgaaaaagcaggacgtggtggtcctcggatcccaagagggcgccatgcatacagccttgacgggggccacggagattcagatgagcagcggcaacctcctattcaccggccacctgaaatgccgcctgaggatggacaaattgcaactgaaggggatgtcctactcaatgtgtaccggcaagtttaagatcgtgaaggagatcgcagagacccagcacgggacgatcgtgatacgagtacagtacgagggcgacggcagcccctgcaagatccccttcgaaatcaccgacctggaaaaacggcatgtgctcggtcgcctgataaccgtgaacccgatcgtgaccgagaaggacagccccgtgaacatcgaggcggagccgcccttcggggactcctacatcataatcggggttgagcctggccagctgaagctcaactggttcaaaaaggggagctccatcggccagatgttcgagacgaccatgcgcggcgccaagcgaatggccatcctaggggacaccgcatgggatttcggctcacttggcggggtcttcacctccatcgggaaggccctccaccaggtgttcggggcgatttacggcgccgcgttcagcggggtgtcctggacgatgaagatcctaatcggcgtcatcatcacatggatcgggatgaacagccgctccacatctctgtccgtgagcctcgtgcttgtcggcgtcgtgaccctgtacctgggggccgttgtgcaggccgactccggctgcgtggtcagctggaaaaacaaagagctcaagtgcggatccgggatctttatcacagacaacgtgcacacctggaccgagcagtataaattccagcccgagagccccagcaagctagcctccgccatccagaaggcccatgaggagggcatctgcgggattcggagcgtgacccgcctggagaacctaatgtggaagcagatcacccccgagctgaaccatatcctgtccgagaacgaggtcaagctcaccattatgaccggcgatatcaaggggatcatgcaggccggaaagcggagcctgcgcccgcagcccaccgagctgaagtacagctggaagacatggggcaaggccaaaatgctcagcaccgagtcgcacaatcagaccttcctaatcgacggacccgagaccgcggagtgcccgaacactaaccgggcttggaatagcctcgaggtggaggactacggatttggggtgttcactaccaacatctggctaaagctgcgcgagaaacaggacgttttctgcgactccaagctgatgagcgccgccatcaaggacaaccgggcggtacacgctgatatgggctactggatcgagtccgccctcaacgatacctggaagatggaaaaggccagcttcatcgaggtcaagtcctgccactggcccaaaagccacacgctgtggtccaacggtgtcctggagtcagagatggtaatccccaagaacttcgccgggcccgtgtcccagcacaactaccgcccgggctaccacacccagaccgccggcccctggcacctcggcaagctggagatggacttcgacttctgcgaggggacaaccgtcgtggtgacagaggactgcggcaaccggggcccaagcctgcgtaccacaaccgcctcggggaagctcatcacggagtggtgctgcagatcctgcacactacccccgctgcgctaccggggcgaggacgggtgctggtacggcatggaaatccgccccctcaaagagaaggaggagaacctggtcaactcgcttgtgaccgccgggcatggacagatcgacaacttctccctcggcgtgctgggtatggccctgttcctcgaggagatgctgcggacccgcatcggcacgaagcacgcgatcttactagtagccgtgtcctttgtaaccctgatcacggggaatatgtccttccgtgacctcggccgggtcatggtgatggtcggggccactatgacggacgatatcggcatgggcgtgacctatctggccttactggccgcgttcaaggttcgcccgacgtttgccgccgggttactgctacgaaagctcacctcgaaggagctgatgatggcgacgatcggcatagcgctgctctcccagagcactatccccgaaaccatcctggagctgaccgatgcgctcgcattgggaatgatggtgttaaaaatcgtccgcaacatggagaagtaccaattagccgttacgattatggccatctcctgcgtgccgaacgcagtgatcctccagaacgcttggaaggtctcttgcaccatcctggccgccgtctccgtgagccccttgctgctgacctccagccagcagaaggcggactggatccccctcgcgctcaccatcaagggcctgaacccaacagccattttcctcaccaccctgtccaggacctcgaagaagagatcttggccgctgaacgaggccatcatggctgtaggcatggtcagcatcttagcctcctcactgctgaagaacgacatacccatgacggggcccctcgtggcgggcgggctgctgaccgtctgctacgtgctcacgggccggagcgccgatctggagctggagagagccgctgacgtaaagtgggaggaccaggccgagatctccggaagctcccccatcctgtcaatcaccatatcagaagacggcagcatgagtatcaagaacgaggaggaggagcagacgctgaccatcctcatccgaaccgggctcctggtgatcagcggcgtctttccggtgtccatccccattactgcggctgcctggtatctgtgggaggtgaagaagcagcgcgctggcgtcctctgggacgtacccagcccaccgcccgtcgaaaaggccgagctggaggacggggcgtaccgaatcaaacagcgcgggattctggggtactcacaaatcggcgccggcgtgtataaggaagggacctttcacacaatgtggcatgtgacccgcggcgctgtgctcatgcatcgcgggaagcggatcgagccctcgtgggcggacgtcaagaaggacctgatatcatacggcggaggctggaagctggaaggcgagtggaaggagggggaggaagtccaagtgctcgcccttgagccgggaaagaacccccgagcggtccaaaccaagccaggcatcttcaagaccaacacgggcaccatcggggccgtgagccttgacttctcccccggcaccagcggctcccccatcgtggaccggaaggggaaggtcgtgggactgtacgggaacggcgtggtcacccgcagcggggcctatgtgtccgcaatcgcgcagacggaaaaatccatagaggacaatccagagattgaggacgacatcttccggaagaaacgcctgaccatcatggacctgcaccccggagccggcaagaccaagcggtacctccccgccatcgtgcgcgaagccatcaagagaggactgcgcacactgattctggccccgacgcgcgtcgtggcggccgagatggaggaggccctccggggcctgcccatacgctatcagacccccgccattaagaccgagcacactgggcgggagatcgtggacctcatgtgccacgccacgttcaccatgcgcctcctaagccccgtacgggttccaaactataaccttatcatcatggacgaggcgcactttaccgaccccgcctccattgccgcccgcggctacatcagcacccgggtagagatgggcgaggccgcgggaattttcatgacggctacgccgcccggctctcgcgaccccttcccccagtcgaacgcccccatcatggacgaagagagagaaatccccgagcgctcctggaacagcggccacgagtgggtcaccgacttcaaggggaaaaccgtgtggttcgtgccatctatcaaggccgggaacgatatcgcggcttgcctgcggaagaacggcaagaaggtaatccagcttagccgcaagacattcgactccgagtacgtgaagacccgggccaacgactgggacttcgtggtcacgacggacattagcgagatgggcgctaacttcaaggccgagagggtgatcgacccccggagatgcatgaagcccgtgatcctgacggacggggaggagcgggtcatcctcgcaggcccgatgccggtgacacactccagcgccgcccagcgccgggggcgcatcggccgcaaccccaagaatgagaatgaccagtacatctacatgggcgagcccctggaaaacgacgaagattgcgcccactggaaggaggctaagatgctgctcgataacatcaacacccccgagggcatcataccaagtatgttcgagccggagcgggagaaagtggacgcgatcgacggcgaataccgcctgcgcggtgaggcccgcaagactttcgtcgacctgatgcggcgcggcgacctccctgtgtggctcgcctataaggtggccgccgaggggatcaactatgcggaccggaaatggtgcttcgacggcataaagaacaatcagatcctggaggagaacatggaggtagagatctggacgaaagagggggagcgcaagaagctcaagccgcgatggctggacgcgcggatttactccgaccccctggccctcaaggagttcaaggagttcgccgcgggccggaagtcgctgaccctgaacctcatcacggagatgggccgccttcccaccttcatgacgcagaaagctcgaaacgccctggacaaccttgccgtgctgcacactgccgaggccggcggccgcgcctataaccacgccctcagcgagctccccgagaccctggagactttgctcctgctcacgctactggccaccgtaaccgggggcatcttcctgttcttaatgagcggcaagagcatagggaagatgacgctgggcatgtgttgcatcatcacggcctccatcctgctctggcacgcgcagattcagccgcactggatagccgccagcatcatactggagtttttcctgatcgtgctcttgatccccgagcccgagaagcagcggacgccgcaagataaccagctgacctatgtggtcatcgccatcctcaccgtcgtggccgcgacaatggccaacgagatgggtttcctagagaagacgaagaaggacctgggcctcgggagcattaccacacaagagtccgaaagcaacatactggacatcgatttacgcccggcctccgcctggactctctatgccgttgcgacaaccttcgtgacacccatgctgcggcatagtatcgagaactcctcagtgaatgtctccctgaccgctatcgccaaccaggccacagtgctcatgggccttggaaaggggtggcccctgagcaagatggacattggtgttcccctctttgcgatcgggtgttactaccaggtcaatcccatcaccctaaccgccgcgctgctcctgctagtagcccacaacgccatcatcggccaggggctccaggcgaaggcgaccagggaggcccagaagcgggccgccgcggggatcatgaaaaatcccacggtggacggcatcaccgttattgacctcgagcccattccttatgacccaaagttcgagaagcaactaggccaggtgatgctcctgatcctgtgcgtaacccaggtgctcatgatgcgcaccacgtgggccctgtgcgaggccctgaccctcgccaccggccccattagtaccctgtgggaggggaaccccggccggttttggaacacgacgatcgcagtcagcatggcgaatatcttccgcggatcctacctggccggcgccggcctcctgttcagcatcatgaagaacacaacctccacgagaaggggcacgggcaacataggggaaacccttggagagaagtggaagtcccgcctcaacgcgctgggcaagtccgagttccagatctataagaagtccgggatccaggaggtggaccgtactcttgcgaaggagggcatcaagcgcggggagacagaccaccacgccgtctcccggggcagcgccaagctcaggtggttcgtcgagcggaacatggtgacgccggaagggaaggtcgtagacctgggctgcggccgcggaggctggtcgtactattgcggggggctgaagaacgtaagagaggtcaaggggctcaccaagggcggccctgggcacgaggagcccatcccgatgtctacctacggctggaatctggtgcgcctgcagagcggggtggacgtcttcttcacgcccccggagaagtgcgacaccctcctgtgcgatatcggcgagtcctcacccaatcccaccatcgaggccgggcggaccctgcgcgtgctcaatctggtggagaactggctgaacaataacacccagttctgcatcaaggtgctcaacccttacatgccttccgtaatcgagaagatggaggctctgcagcggcagtatggcggcgcgctcgtccgcaaccccctcagcaggaactcgacgcacgagatgtactgggtgtctaacgctaccgggaacatcgtgtcaagcgtgaacatgatctctcgcatgctgatcaaccggtttactatgaagcacaagaaagccacctatgagcccgacgtcgatcttggttccgggacgcgcaacatcggcatcgagaatgagatcccgaacctggacatcatcgggaaacggatcgagaaaatcaagcaggagcatgaaatctcctggcactacgaccaggaccacccctataagacctgggcctaccacggcagctacgaaaccaagcagaccggctccgccagctccatggtgaacggtgtggtccgcctcttaacgaagccctgggatgtggtgccaatggtcacccaaatggccatgaccgacaccacgccgttcggccaacaacgcgtgttcaaagaaaaggtcgacacccggacacaagagccaaaggaggggaccaagaagttgatgaagattacggccgagtggctctggaaggagctgggcaagaagaagaccccccgcatgtgtacccgggaggagttcacccgcaaggtccggtcgaacgccgccctcggcgccatctttacggacgagaacaagtggaagtccgcccgtgaggccgtggaggatggacggttctgggagctcgtggatcgagagcgaaacttgcaccttgaaggaaagtgcgaaacatgcgtctacaacatgatgggaaagcgcgagaagaagttgggcgagttcggaaaggccaagggcagccgagccatctggtacatgtggctgggggcgagattcctggaattcgaagccttggggtttctaaacgaggaccactggttctcccggggcaactctctgtcaggggtggagggcgaggggctccacagattgggctacatcctgcgggacgtcggaaagaaggagggcggcgctatgtacgccgatgacaccgccgggtgggacacccgcatcacgctcgaggacttaaagaacgaggagatggtgaccaaccacatgaagggcgagcacaagaagctggcggaggccatcttcaagctgacctaccagaacaaggttgtgcgggtgcagcgccccacgccgcgggggacggtgatggacatcatctcccgccgtgaccagcgcggcagcggccaggtcggaacctacggccttaacaccttcaccaacatggaggctcaactgatcagacagatggagggggaaggcatcttcaagtccatccagcacctcacggccaccgaggagatcgccgtgcaaaactggcttgcgcgtgttggccgcgagcgcctgagccgcatggcgatctccggcgacgactgcgtcgtgaagcccatcgacgaccggttcgcctcagcactcaccgcccttaatgacatgggcaaggtgcgcaaggacattcagcagtgggaaccctcccgggggtggaacgactggacccaggtccccttctgctcccaccacttccacgagcttgtgatgaaggacggccgcgtgctcgtcgtaccgtgccggaaccaggacgagctgataggacgcgcccggatcagccagggagcaggatggagcctgaaggagacggcctgcctggggaagtcctatgcccagatgtggacgctgatgtacttccaccgcagagatcttcgcctcgccgcgaacgcaatttgcagcgcagtaccttcccactgggtcccaacgagccgaacaacgtggtccatacacgccaagcacgaatggatgacaacggaggacatgctggcggtgtggaaccgtgtttggatccaggaaaacccctggatggaagacaagaccccagtagagagctgggaggaggtgccctacttgggtaagcgggaggaccagtggtgcggctccctcatcgggctaacctcgcgggccacgtgggccaagaacatccaaaccgccatcaaccaggtccggagcctgatcgggaacgaagagtataccgattacatgccctccatgaagcgcttccgccgggaggaggaggaggccggcgttctctggtga

SEQ ID NO: 25019 - RNA, 9876 nt, synthetic construct
  misc_feature 1..9876: note = derived and/or modified CDS sequence (opt11) from DENV-2__EU482626__SS-prME
  source 1..9876: mol_type = other RNA
actgcgggcgtcatcgtcatgctgatccccactgcaatggcgttccaccttaccacgcgtaacggggaacctcacatgatagtcggccggcaggaaaaagggaaatccctgctgtttaagactgaagacggcgtgaacatgtgtaccctcatggccatagatctgggggagctgtgcgaggatacaatcacatataagtgccccctcctgcgccagaacgaacccgaagacatcgattgctggtgcaacagcactagcacctgggtcacctacgggacttgcaccaccacgggcgagcaccgtcgagagaagcggtccgtagccctggtcccccacgtcggcatgggccttgaaacccgcactgagacctggatgtctagcgagggggcctggaagcacgtacagaggatcgaaacctggatcctgcgccacccaggtttcaccataatggccgcgatcctggcctatactattggcaccacgcacttccagcgagccctaatctttatcctgctgaccgccgtggcgcctagcatgaccatgagatgtatcggcatctcaaaccgggacttcgtcgaaggtgtaagtgggggctcttgggtcgacatcgtcctggagcatggtagctgcgtgaccacgatggccaagaacaaacctacattagactttgagctcatcaagacagaagcaaaacaacccgccactctacgcaagtactgcatcgaggccaagctgacgaacaccaccaccgaaagccggtgcccgacccagggcgagccaagcctgaatgaggagcaggacaagcgcttcatatgcaagcactccatggtggatcgaggctgggggaacggctgtgggctgttcggcaaaggagggatagtgacctgcgcgatgtttacttgtaagaagaacatggagggcaaggtagtgcagcccgagaacctggaatacactatcgtgatcacgccccacagcggggaggaacacgccgtgggtaatgacacaggaaaacacggaaaggagatcaagatcaccccgcagtcctccattaccgaggcggaactgaccggatatggtacggtgacaatggaatgcagcccaagaaccggcttggactttaatgagatggtcttactgcagatggaggacaaagcctggctcgtgcatcggcagtggttcctggacctgcccctcccgtggctgcccggggccgacatccagggcagcaattggattcagaaggagaccctagtgacattcaagaacccacacgccaagaagcaggacgtagtggtgctagggtcccaggagggagccatgcacaccgccctgaccggggcaacagagattcaaatgtcgtccggcaacttactcttcacaggccatttaaagtgcaggctgcggatggacaagctccagttgaaggggatgtcctactcaatgtgcaccggcaaatttaaaatcgtcaaggagatcgcagagacccaacacgggaccatcgttatccgcgtccagtacgaaggcgatggatctccctgtaagatccccttcgagatcacagacctggagaaacggcatgtgctggggcgactgattaccgtgaacccgatcgtcaccgagaaggacagccccgtaaacatagaagcagagcctcccttcggagattcttacattatcattggtgtcgagccgggtcagttaaaactcaattggttcaagaaagggagctccattgggcagatgttcgaaactaccatgaggggcgcgaagcggatggccatcctcggggacaccgcctgggacttcggcagcctcggaggcgtcttcacctccataggcaaggcccttcaccaggtgttcggcgcgatctacggagcggcatttagcggggtgtcatggactatgaaaattctgatcggcgtcatcatcacgtggatcggaatgaacagtcgctccacctcgctgtctgttagcctggtgttagttggcgtggtgaccctgtacttgggggccgtcgtccaggctgactctggctgtgtagtgagctggaaaaacaaggagttaaaatgcggatccgggatcttcattaccgacaacgtacacacgtggaccgaacagtacaagttccagccggaatccccctcgaaattagccagtgccatacagaaagcccacgaggagggaatctgcgggatcaggtccgtgacaaggctggaaaatttaatgtggaagcagatcacccctgagctaaatcacatcctatccgagaacgaggtgaaattgacgatcatgactggggacataaaggggatcatgcaggccggcaagcgatcactgagaccgcagccgacccaacttaaatactcgtggaagacgtggggtaaggcgaagatgctcagcactgagtcccataaccaaacctttctgatcgacgggcccgagaccgcggagtgtcctaacacaaacagggcctggaatagcctagaggtcgaggactatggcttcggggtcttcacgacaaacatatggctcaagctgcgcgaaaagcaggacgtcttctgcgactccaagctgatgagtgccgccattaaagacaatcgggctgtgcacgccgacatgggctactggattgagtccgccctaaacgacacctggaagatggaaaaagccagctttatcgaagtgaagtcctgccactggcccaagagccacactctatggagtaacggcgtcctggagagtgagatgatcatacccaagaacttcgccgggccggtgagccaacataactaccgcccgggctaccacacccagacagccgggccatggcacctcgggaagctggagatggattttgatttctgcgaggggacgaccgtagtcgtgaccgaagactgcggcaatcggggtcctagccttcgcacgactaccgcctccgggaaactaatcacagagtggtgctgccggtcgtgcacgctgcccccgctccgctaccggggtgaggatggctgctggtatggcatggagattcgccccttaaaggagaaggaagaaaatctggtgaatagcctggtaaccgctgggcatgggcagatcgacaacttctctctcggcgtactcgggatggccctgttcttagaggaaatgttgcggaccaggattggcaccaagcacgcaattctgttagtggccgtttccttcgtgacgctgataaccgggaacatgtccttccgggacctgggccgcgttatggtcatggttggggcgaccatgaccgacgacataggcatgggggtgacgtatctcgcactgttagccgcgttcaaggtgcgcccaaccttcgccgccggcctcctgctgcgaaagttaaccagcaaggagctgatgatggcaactatcggcatcgcactgttaagtcagagcaccatccccgagaccatcctcgagctgaccgacgcgctcgccctggggatgatggtgctaaagatcgtccgcaatatggaaaagtaccaactagccgtcaccatcatggccatcagttgcgtgcccaatgcagtgatactccagaacgcttggaaggtcagctgcacaatcctggccgccgtgagtgtcagcccccttctgctgacatccagtcaacagaaagcggattggatccccttggcactgaccataaaaggccttaatcccaccgccatcttcctcacgactctttcccgcaccagcaagaagcgctcctggccgctgaatgaagcgattatggcagttggaatggtatccatcctcgcctcgagcctcctcaaaaacgacatccctatgaccgggccattagtcgcgggcgggttattaactgtgtgctacgtcttaaccggccggagcgccgacctagagctggagcgcgccgccgacgtcaaatgggaggaccaggcagagatctcggggtctagccccatcctcagcatcaccatcagcgaagacggcagcatgagtatcaagaatgaagaggaagaacaaaccctcacgatcctgatccggaccggcctcttagtgatcagcggggtgttcccagtctccatccccatcaccgcggccgcgtggtacctgtgggaggttaagaagcagagagcaggcgtgctctgggacgtccccagcccgcctccagtggagaaggccgagcttgaggatggcgcgtaccggatcaagcagcgtggcatcctgggctattcccagatcggcgccggtgtgtacaaggagggtaccttccacacaatgtggcacgtcactagaggggcagtgctcatgcacaggggcaagcggatcgagccatcatgggccgatgtgaagaaagacctgatcagttatggcgggggctggaaactggagggcgaatggaaggagggggaggaggtccaggtcctcgccctggagccaggcaagaacccccgcgctgtgcagaccaaacccgggatcttcaagaccaacaccggaacgatcggggccgtgagcctggacttctcaccgggtaccagcggctctccgatcgtggaccgcaaagggaaggtggtaggcctctacgggaacggcgtggtgacccgaagcggcgcctacgtttcggcaatcgcgcagacggagaagtcaatcgaggacaacccggagatcgaggacgacatcttcaggaagaagcgccttacgataatggacctgcaccccggcgccgggaagaccaaacggtacctccccgcaattgtgcgcgaggccatcaagagggggctgcgcactctgatactggctcccacccgcgtggtcgcggctgaaatggaagaggccctccggggactccccatccgttaccagacccccgccattaagactgagcataccggacgcgagattgtggacctcatgtgtcatgctaccttcacgatgcgcctcctgagccccgtccgggtcccgaactacaacttaatcataatggacgaggcacacttcacggaccccgcctccatcgctgcccgaggttatatcagcactcgtgttgaaatgggggaagccgcggggatcttcatgacggctacgccgcctgggtccagggacccgttcccccaaagcaacgcacccatcatggatgaggagcgggagattccggagcgatcctggaatagcggtcacgagtgggtgaccgacttcaaaggcaagaccgtgtggttcgtcccatccataaaggccgggaacgacatcgcggcctgtctacggaagaatggcaagaaggtgatccagctgtctcgaaaaaccttcgattccgagtacgtaaagacgcgggccaacgactgggacttcgtagtgaccaccgacatcagcgagatgggagccaactttaaggccgagcgtgtcatcgatccccggcgctgcatgaagccggtgatcctgactgacggggaggagcgggtgatactagcaggacccatgccggtcactcactctagcgccgcacagagacgggggcgcatcggtaggaatcccaagaacgaaaacgaccagtacatctacatgggggaaccgctggagaatgatgaggactgtgctcactggaaggaagccaagatgttactcgacaacatcaacactcccgagggcatcatcccgagtatgtttgagccagagcgcgagaaggttgacgcaatcgacggagagtaccgattacgcggggaagcccgcaaaaccttcgtggatctgatgcggaggggcgacctacccgtctggctggcctacaaagtggccgccgaggggatcaactacgccgatcgcaagtggtgcttcgacggtatcaagaacaaccagatcctggaggagaatatggaggtggagatctggaccaaggaaggagaacgcaagaagctaaagccgcggtggcttgacgcccgaatttacagcgacccattggcgctcaaggagttcaaggaatttgccgcggggaggaaatcgttgactctgaacctcatcaccgagatggggcgcctgccgaccttcatgacgcagaaagcccgtaatgccctggacaatcttgccgtcctgcacacggccgaggccggcgggcgcgcctacaaccacgcactgagcgagctcccagagacattagagacactactcctgctgacactgctggccacggtgactggtggaatcttccttttcttaatgtccggtaaagggatcggcaagatgaccctggggatgtgttgcatcatcaccgcaagcatcctgttatggtatgcccaaatccagccacattggatcgccgcctccatcatcttggagtttttccttatcgtgctcctgatccccgaacccgagaagcagcgcacgccccaagataaccagctgacgtatgtcgtgatcgcgatcctcacagttgtagccgcgaccatggccaacgagatgggattcctggagaaaaccaagaaggacctgggtctaggcagtatcacgacacaagagagcgagtccaacattctggacatcgatctgcgcccagcgtccgcctggaccctttacgccgtggcgaccacattcgtcacacccatgttgcggcacagtatcgagaacagcagtgtgaacgtgagcctcacggctatcgctaaccaagccaccgtgcttatgggcctgggaaagggatggccactgagcaaaatggacattggcgtgcccctcctggccatcggctgctacagtcaggtgaacccgatcacgctgaccgccgccctccttctgctggtcgcccactatgccattataggacccggtttacaggcgaaggccacccgcgaggcccagaaaagagcagccgcgggcattatgaaaaatcctaccgtggacgggatcactgttatcgatctggagcctatcccgtacgaccccaaattcgagaagcagttaggccaggtgatgctgctgatcctatgcgtgacccaagtgcttatgatgcgcaccacctgggcactgtgcgaggccctcacgctggctaccggacccatctccaccctgtgggagggcaaccccgggcgcttctggaacacgacgatcgccgttagcatggcgaacatcttccgcggatcctacttagccggcgcagggctcctcttcagcatcatgaagaacacgacttcaaccagacggggtacgggcaacataggcgagaccctgggggagaaatggaagtctcgcctgaacgccctggggaagtccgagttccagatctacaagaagtccggaatccaagaggtggatcggaccctcgcaaaggaagggatcaagcgcggcgagaccgaccaccacgcggtctcccgggggagcgccaagctacgctggttcgtcgagagaaatatggtgacaccggagggcaaggtggtcgacctgggttgcgggcgcgggggctggtcgtactactgcggtggcttaaagaacgtgcgggaggtaaagggtctgacaaagggcggccccgggcatgaggagcccattcccatgagcacctacggttggaacttggttagattacagtcaggagtcgacgtgttcttcacaccgcccgagaaatgcgacacgctactgtgcgacatcggggagtcatcgccgaatcccacaatcgaggccggccgtaccctccgcgttctgaacctggtggaaaactggctcaacaataacacccagttctgtatcaaggttctgaacccctacatgccctcggtcatagagaagatggaggctttgcaacggcagtatggcggggcgctcgtgcgcaatcctctgtcccggaactccacccacgaaatgtactgggtgtcaaacgccaccgggaacatcgtatcaagcgtgaacatgatctccaggatgttaatcaaccgattcaccatgaaacacaagaaggccacctatgagcctgatgttgaccttggatctggcactcgcaacatcggtattgagtccgagatccccaacctcgacatcatcggcaaaagaatcgagaagatcaagcaagagcacgagattagctggcactacgaccaggaccacccttacaagacgtgggcctatcatggttcctatgagaccaaacagactgggagcgcttccagcatggtcaatggcgtggtgcgtctcctaacaaagccctgggacgttgtcccgatggtgacccagatggcgatgaccgatactacgcccttcggccaacagcgcgtatttaaggagaaagtagacacacgaacacaggaaccgaaagagggcaccaaaaagctcatgaagataaccgccgaatggctctggaaggagctgggcaagaagaagacgcccaggatgtgtacccgggaagagttcaccaagaaggtgcgctccaacgccgcactcggtgctatctttaccgacgagaacaagtggaagtccgctcgggaggctgtcgaagacggccgcttttgggagctggttgaccgtgagcgaaacctgcatttagagggaaagtgcgagacgtgcgtgtacaacatgatgggcaagagagagaaaaagctgggggagttcggcaaagctaagggctcccgggccatctggtacatgtggttgggggcgcggttccttgagttcgaggcgctgggcttcctgaacgaggatcattggttcagtaggggaaactctctctcaggggtcgagggggaaggccttcaccgcctgggctacattctccgcgacgttggcaagaaggagggcggggccatgtacgctgacgatactgctggctgggacacccggattaccctggaggaccttaagaatgaggaaatggtcacgaaccacatgaagggggagcacaagaaactcgctgaagccatatttaagctgacctaccagaacaaggtcgtgcgcgttcagcggccgacaccccgcggtactgttatggatattatcagccggagggatcagcggggctccggacaagtaggcacttatgggctgaataccttcaccaacatggaggcccagctaatcaggcaaatggaaggcgagggcatttttaagagtatccagcacctcaccgctacggaggaaatcgccgtccaaaactggctggcgagagtggggcgggaacggctctcgcggatggcgatttctggcgatgactgcgtggtgaagcccatagacgacaggttcgcgtccgccctgactgccctgaacgatatgggaaaggtgcgtaaggacatccagcagtgggagccctcacgtgggtggaatgactggacacaggtgccgttctgctcccaccatttccatgagctcgtcatgaaggacgggcgggtgctagttgttccttgccggaaccaagacgagctgatcggccgggcgcgcatcagccagggcgccgggtggtcactaaaggagacggcctgtctgggaaagagctatgcccagatgtggaccctgatgtacttccaccggcgcgacctaaggcttgcagcgaatgctatctgcagtgccgtgcccagccattgggtgcccacctcccgcacaacctggagcatccacgccaagcacgagtggatgactacggaggacatgctggcggtttggaatagggtctggatccaggagaacccgtggatggaggacaagacccccgtggagtcctgggaagaggtcccctacttggggaagcgcgaggaccaatggtgcggcagtctaattggtctaaccagccgggcaacgtgggccaagaacatccagaccgccataaatcaggtgcgctcactcatcggcaacgaagaatacacagactacatgccctcaatgaagcggtttcgccgcgaagaggaggaggccggggtgctatggtaa

SEQ ID NO: 25020 - RNA, 9876 nt, synthetic construct
  misc_feature 1..9876: note = derived and/or modified CDS sequence (opt11) from DENV-2__EU482629__SS-prME
  source 1..9876: mol_type = other RNA
accgcgggcgttatcgtgatgctgatccccacagcgatggcgttccatctcaccacgagaaatggggagccacacatgatcgtcggccggcaggagaagggtaagagtctgcttttcaaaaccgaagacggcgttaacatgtgtaccctgatggccattgacctgggggaactctgtgaagacaccatcacctacaaatgcccgttgctgcgacagaacgagcccgaggacatcgactgctggtgcaatagcacctcgacgtgggtcacctacgggacctgcacgactacgggcgagcacaggcgcgaaaagcgctcggtcgctttagttccacacgtcgggatgggcttagaaaccagaactgagacctggatgagctccgagggcgcgtggaagcacgtccagcggatcgagacctggatcctgcggcaccctggctttacgatcatggccgcgatcctggcctacaccattgggactacccacttccaacgtgcgcttatatttatccttctgaccgccgtggccccaagcatgaccatgcgctgtattggcatttccaaccgtgacttcgtggagggtgtgagcggggggtcctgggtggacatcgtcctcgagcacggtagctgcgtgaccacgatggcaaagaacaagcccacactggacttcgagttaattaagacagaggccaagcagcccgccaccttgagaaagtactgtatcgaggccaagctgacgaacaccacgaccgagagtcgctgtccgactcaaggggagccttcgttaaacgaggagcaggacaagcgtttcatatgcaaacacagcatggtggatcggggctgggggaacggctgtgggctattcggcaaaggtggcatcgttacttgtgcgatgttcacatgtaaaaagaacatggagggcaagatcgtacagccggagaatttggagtacacgatcgtgataacgcctcactctggggaggaacatgcggtcggcaacgacaccgggaaacacggaaaggagataaaaataaccccacagtcaagcataacagaagccgagctaacagggtacggtactgtgaccatggaatgctcacctcggaccggtcttgacttcaatgagatggtgctgctccagatggaggataaggcctggctcgtccaccggcagtggtttctggacttgcctctgccttggctgccgggcgccgacacgcaggggagcaattggatccagaaagagacgctggtcaccttcaagaacccccacgcgaaaaaacaggacgtggtcgtgctcgggtcccaggagggtgccatgcacaccgccctgaccggggctacggagatccaaatgagcagcggcaacctcctgtttactggccatcttaaatgtcgcctgcggatggacaagctccaattaaaagggatgtcgtacagcatgtgcaccggcaagtttaagatcgtcaaggagatcgctgagacccagcatggcacaatcgttattcgcgtacagtatgagggcgatggctccccctgcaaaatccccttcgaaatcactgacctggagaaaaggcacgtcctcgggcgcttgataaccgtgaacccaatcgtgacagagaaggacagccccgtcaacatagaagcggagccgcccttcggcgattcctatataataatcggggtggagccgggacagctgaaactcaactggtttaaaaagggttcttccatcgggcagatgtttgagacaaccatgcgcggcgcgaagagaatggccatcctcggggatactgcctgggacttcggcagtctcgggggagtgttcacctcaataggtaaggcgctccaccaggtcttcggcgcgatatacggggccgcattcagcggggtttcctggacgatgaaaatcctgatcggcgttatcattacctggatcggaatgaacagccgctccacctctctatccgtcagccttgtgctagtgggcgtggtgaccctgtacctgggggccatggtgcaagcagactccggctgtgtcgttagctggaagaacaaggaactcaaatgtggaagtgggatctttatcacggataacgttcatacctggaccgagcagtacaagtttcagcccgagtctccaagcaagctggcctccgccatccaaaaagcccatgaggaaggcatttgcgggatacggagcgtcacgcgtttagagaacttgatgtggaagcagatcacgcccgagctgaaccacatcctgtccgaaaacgaagtgaagctcacgatcatgaccggagacatccgggggatcatgcaggccggcaagcgcagtctgcgaccacagcccaccgagcttaagtattcatggaaaacgtggggcaaggcgaaaatgctcagcaccgagtcacacaaccagacgtttctgatcgacgggcccgagaccgctgagtgcccaaacacgaatcgcgcctggaactcactggaagtagaggattatggatttggggtcttcaccaccaacatctggctgaaactgcgggagaagcaagacgtgttctgcgactccaagctcatgagcgccgcaatcaaggacaaccgcgccgttcatgccgacatgggctactggatcgaatccgccctaaatgacacctggaagatggagaaggcgagctttatcgaggtcaaatcctgccactggccgaagagccacaccctctggtccaacggcgttttagagagcgagatgatcataccaaagaactttgccgggcccgtgtcccagcacaattataggccaggctatcacacgcagaccgcgggaccctggcacctagggaaactggagatggatttcgacctgtgcgaagggaccactgtcgtagtgacggaggactgtggaaaccgcggccccagcttgcgaaccaccacagcaagtggcaagctaatcacggagtggtgttgccgctcctgcaccctacctcctttgcgttaccgaggcgaggacgggtgctggtacggaatggagattcggcccctgaaggaaaaagaagagaatctggtcaacagcctcgtgaccgccggacacggccagattgataatttctctctgggcgtcctggggatggccctgttcctggaggaaatgcttcgcacccggatcggtacgaaacatgcaatactcctggtcgccgtgagtttcgtgacattgatcaccggaaacatgtcctttaaggaccttggcagggtcatggttatgatgggggccaccatgactgacgacattggaatgggcgttacctaccttgccctgctcgcggcgttcaaggtccggccgacgtttgccgctggtctgctacttagaaagctgacgagcaaggagctcatgatggcgacaatcggcatcgccctcctgtcacagagcactatccccgaaaccatccttgagctcacggacgcgctggcgctaggcatgatggtgttaaaaatcgtgcgtaacatggaaaagtaccagctggctgtcacgataatggccatcagttgtgtcccaaatgccgtgattttacagaacgcgtggaaggtcagctgtactatcttggcggccgtatccgtgagcccgctgctgttgacgtccagtcaacagaaggcggactggatccccctcgctctgactatcaaaggactgaaccctacggctatcttcttgacaacactgtcccgcaccagcaagaaacgctcctggccacttaatgaagcgatcatggcggtcggcatggtgagcatcctggccagcagcctgctcaagaacgacattcccatgacggggcccctggttgcgggaggcttactcaccgtgtgctacgtgttaaccgggcggagcgccgacttggagctcgagcgcgccgccgatgtcaagtgggaggaccaggccgagatctctggaagctcgcccatacttagcatcaccatcagtgaggacggctcgatgtccatcaaaaatgaggaagaggagcaaacactgactatcctcataaggaccggcctgctggtcatcagcggggtgtttcctgtaagtatccccatcaccgcggccgcctggtacctctgggaagtgaagaagcagcgcgcgggcgtgctgtgggacgtcccaagccctcctcccgtggagaaggctgaattagaagatggggcgtaccggataaagcagcgtggcatcctagggtactcacagatcggcgccggagtatacaaggaggggaccttccatacgatgtggcacgtaacccggggggctgtgctgatgcacagagggaagcggatcgagcccagctgggctgatgtgaagaaagacctaatctcctacgggggtggctggaagctggaaggagagtggaaggaaggggaggaggttcaggtgcttgccctggaacccggcaaaaatccccgagccgtacagacgaagccggggatcttcaagaccaacacgggcacaatcggggcagttagcctcgacttttcccccgggaccagcggctcgccgatagttgaccggaaggggaaagtggtgggactctatgggaacggcgtggttacccgaagcggcgcatatgtctcggccatcgcgcagacggagaaatccatcgaggataacccggagatcgaagacgacatcttccggaagaaacgcctcaccatcatggacctccaccccggagcaggaaagaccaaaagatatctgcccgccattgtgcgcgaggcgattaagagggggctacgcaccctgatcctggccccgacgcgggttgtcgcggctgagatggaagaggcactgcggggtctgccgatccgctaccagacaaccgccatcaagaccgagcacaccggccgcgagatcgtggacctaatgtgccacgccaccttcactatgcgtctgctgtcccccgttcgagtccccaactacaacttgatcatcatggacgaggcacacttcaccgacccggcatcaatagccgcccgcggctacatctccacgagagtggagatgggggaagccgcgggcatcttcatgacggcgacgccgcccggctctcgcgacccgttcccacagtcaaacgccccaatcatggacgaagagcgggagatccccgagcgctcatggaactcagggcacgaatgggtgaccgacttcaagggcaagacggtctggtttgtaccctccatcaaggccggtaacgacatagcggcttgtctgcggaagaatgggaagaaagtgatccagctatcgagaaaaaccttcgactccgagtatgtcaagacgcgagccaacgactgggatttcgtggtgaccacggatattagcgagatgggcgccaactttaaggccgagcgagtcattgacccgcgacgatgcatgaaaccagtgatcttgaccgatggtgaggagcgggtgatcctggcggggcccatgcccgtgacccattccagcgcggcgcagcggcgtgggcggatcggacgtaacccgaagaacgagaatgatcagtacatctatatgggtgaacccctagaaaatgacgaggactgcgcccactggaaggaggccaagatgctgttggacaacatcaacacccccgagggcattatcccgtccatgttcgagccggagagggagaaggtcgacgcgatcgatggtgagtaccgcctgcgcggggaggctcggaagacgttcgtggatctaatgagaaggggcgacctgcccgtctggctggcctacaaggtggccgcggaggggatcaactatgcggaccgcaagtggtgtttcgacggcatcaaaaataaccaaatccttgaggaaaacatggaggtggagatctggactaaggagggggagcggaagaagctgaagccgcgttggctggatgcgcgcatatacagtgatccgctcgccctgaaggagttcaaggagtttgccgcggggcggaagtccctgaccctcaacctgataaccgagatgggccggctgcccactttcatgacgcaaaaggcccggaacgctttagataacttagccgtgttgcacactgccgaggcagggggccgagcctacaaccacgctctctcggagctgccggaaacccttgagaccctcctactgctcactctgctggccaccgtaaccgggggcatcttcctcttcctgatgtccggcaagggtatcggcaagatgaccctggggatgtgctgtatcatcacggccagcatcctcctatggtacgcacagattcagcctcactggatcgccgcctccatcattctggaatttttcctgatagtcctgttaatcccggaacccgaaaagcaacgcacgccccaagataaccagcttacatacgtcgtgatcgccatcctgactgtcgtggccgcgactatggctaacgaaatgggcttcctcgagaaaaccaaaaaggacctcgggctaggatcgatcaccacccaggagagcgagagtaatatcctggatatcgacctccgcccggccagcgcctggacactgtacgcagtggcgacgacattcatcacaccgatgctgcggcactccatagaaaatagctccgtcaacgtctctcttacggccattgctaatcaagccaccgtgcttatgggcctgggcaagggttggcccctcagcaagatggacatcggggtccccctactggcgatcggctgctactcacaggtgaaccccatcaccctaaccgccgccctgctgctccttgtagcccactacgcgatcatcgggccagggctgcaggccaaggccactcgcgaggcccagaagcgcgcggcggcggggataatgaagaatcccaccgtcgacgggatcaccgtcatcgacctagaacctatcccatacgacccaaagtttgagaagcagctgggccaggttatgctgctcatcctgtgcgttacccaggtgctgatgatgcgcacgacctgggcgctgtgcgaggccctcaccctagccacgggcccaatcagcacgttatgggaaggcaaccccggccggttctggaacaccaccatcgccgtgagcatggcgaacattttccgcggttcttacttagccggcgccgggctccttttctcaatcatgaagaataccacaaacacccgccggggcaccgggaacatcggcgaaaccctaggcgaaaagtggaagtcccgcctgaacgccctcgggaagagcgagttccagatctataagaaaagtggcatccaagaggtagaccggacgttggccaaggaggggattaagaggggcgagaccgaccaccacgccgtaagtagagggtccgccaagctgcgctggttcgttgagagaaatatggtcacgcctgaggggaaggtggtggacctcggctgcggtcgcggcggttggagctactactgcggcgggcttaagaacgtacgggaggtgaagggccttaccaagggtggaccgggccacgaagagcctatccccatgagtacgtacgggtggaatctcgtgagactgcagagcggggtagacgtgttctttacgccgccggagaagtgcgacactcttctctgtgatatcggtgagagctcacccaaccccaccatcgaagctggccgaacgttacgcgtgctgaacctcgtcgagaactggctgaacaacaacacgcagttctgcatcaaggtgctcaacccttacatgccttcagtgatcgaaaagatggaggccctccagcggaagtacggcggcgcgctggtccgcaacccactctcccggaacagcacacatgaaatgtactgggtgtccaacgccacagggaatatagtgagctccgtcaacatgatctcgcggatgctgatcaacagattcacgatgaagcataagaaggcaacgtacgagccagacgtagacctcggttcgggtactcgaaacatcggtatcgagtcggagatacccaacctggacataattggcaagcggatagaaaagatcaagcaggagcatgagacctcctggcactatgaccaagatcacccctataagacttgggcctatcacggcagctacgagacgaaacaaactggctcggcctcgtccatggtgaacggcgtcgtacgcttactgacgaagccctgggacgtcgtgcccatggtaactcagatggcaatgacggataccacgccgttcgggcaacagcgcgtgttcaaagaaaaggtcgacactcggactcaggagccaaaggagggaacaaagaagttaatgaagatcaccgccgagtggttgtggaaagaactcggaaaaaagaagacgcccaggatgtgtacgcgagaggagttcacccgcaaagtgcggagcaacgctgccctaggtgccatcttcacagacgagaacaaatggaagtccgcacgggaagccgtagaggacggtcgattctgggagctggtcgaccgggagaggaacctccacctcgagggcaagtgtgaaacctgcgtttacaacatgatgggcaagcgcgaaaaaaaactgggggaattcggaaaggcaaagggcagccgggcaatctggtacatgtggctcggggcgcgcttcctggagtttgaggccttgggtttcttgaatgaagaccactggttctcacggggtaactccctgagcggggtggagggggagggtctgcacaggctgggctacatcctgcgggacgtcggaaaaaaggagggtggcgcgatgtatgcggacgatacggccggctgggacactcgcataacccttgaggacctcaagaacgaagagatggtgaccaaccacatgaagggggagcacaagaagcttgctgaggcaatcttcaagctgacgtaccagaacaaagtggtccgggtgcagcgccccaccccgcggggcaccgtcatggacatcatatcccgccgggatcagcgcggcagcggccaggtcggcacctatgggctgaatacattcacgaatatggaagcccagctgatccgccagatggagggagagggaatctttaagtccatccagcatttgactgcaacggaagagatcgccgtgcagaattggttggcccgggtggggagagagaggcttagccgcatggccatctccggcgacgactgcgttgtgaaacccatcgatgatcgattcgcaagcgccctgacggccttaaacgacatggggaagatccgcaaggacatccagcaatgggagccctcccggggctggaacgactggacccaggtgccgttttgtagccaccatttccacgagctggttatgaaggatgggagagtgttagtagtgccctgtagaaaccaagacgaactcatcggcagggcgcgcatctcccagggcgcgggatggagcctcaaggagaccgcctgcctcggaaaatcctacgctcaaatgtggaccctcatgtatttccatcgccgggaccttcgcttggctgcgaacgcgatttgcagcgccgttcccagccattgggtccccacctcgcggacgacctggtccatccacgcaaagcatgagtggatgaccaccgaagacatgcttgcggtgtggaaccgggtatggatccaggagaacccctggatggaggataagacgccggtcgagagctgggaggaagtgccgtacctgggcaagcgggaggaccagtggtgcggctcccttatagggctcacctctcgcgcgacttgggccaagaacatacagaccgccatcaaccaagtacgcagcctcattggcaacgaagaatacactgactacatgccctcgatgaagcgattccgccgtgaagaagaggaggcgggcgttctgtggtga

SEQ ID NO: 25021 - RNA, 9876 nt, synthetic construct
  misc_feature 1..9876: note = derived and/or modified CDS sequence (opt11) from DENV-2__FJ390390__SS-prME
  source 1..9876: mol_type = other RNA
accgcgggagtgatcgtcatgttgattcccaccgccatggcttttcacctcaccacccgcaacggggagccccacatgatcgtcggccggcaagaaaaagggaaatccttgctcttcaagaccgaggatggcgtcaacatgtgcaccctcatggcaatcgacctgggggagctgtgcgaggataccatcacctacaaatgccccctcctgcgccagaacgaacccgaggacatcgactgctggtgcaacagcactagcacttgggtcacctacgggacatgcacgacgacgggggagcatcgtcgcgaaaagcggtccgtggccctggtcccccacgtaggaatgggcttagagacccgtacggagacctggatgagctctgagggagcctggaaacacgtgcagcggattgagacctggatactgcgccaccctggatttacgatcatggccgccattctggcctacacgatcgggactacccacttccagcgggccctcatcttcatcctactgaccgccgtggcgcccagcatgacgatgagatgcataggcatcagcaaccgggacttcgtggagggcgtcagcgggggatcctgggtggacatcgtcctcgagcacgggtcatgcgtgaccacgatggccaaaaacaagcctaccctggacttcgagcttataaagacggaggcaaaacaaccagccaccctccgcaagtactgcatcgaggccaaactgactaacaccaccactgagtcccggtgtccgacgcagggcgagcccagcctaaacgaggagcaggacaaacgctttatttgcaagcactccatggtggaccggggctggggtaacggctgtggtctgttcggcaagggcggtattgtgacttgcgcgaagttcacttgtaagaagaacatggaggggaaggtggtgcaacccgagaacctggagtacacaatcgtcatcactccccacagcggggaagagcacgccgtgggcaacgacaccgggaagcacggaaaggagatcaagatcactccgcagtccagcataacagaggccgagctcaccgggtacggcacggtgaccatggagtgtagcccccgcaccggcttagacttcaacgagatggtactgctgcaaatggaggacaaagcgtggctcgtgcacaggcagtggttcctggacctgcccctcccttggcttccgggggcagacacccagggcagcaattggatacagaaggagacgctggtaactttcaagaacccccacgccaagaagcaggatgttgtggtactcgggagtcaggagggggccatgcacactgccctgaccggggctacggagatccagatgagcagcggtaacctcctgttcactggacacctgaaatgccgcctgcggatggacaaactccagcttaaagggatgtcatacagtatgtgcaccggtaaattcaaaatcgtgaaggaaatcgccgagacccagcacgggactatcgtgattcgggtccaatacgagggagatggctccccttgcaaaataccctttgaaatcaccgacttagaaaagcggcacgtgctcggcaggctgatcactgttaacccgatcgtaaccgagaaggactcacccgtaaacatcgaggcggagccaccttttggcgactcctacatcatcatcggggtggagccgggccagctgaagttaaactggtttaagaagggaagctccatcggccagatgttcgagactaccatgcgcggcgccaagcggatggccatacttggggacaccgcgtgggacttcggatccctcgggggcgtatttacgtccatcggtaaggccctacaccaggtgttcggcgcgatatacggtgccgccttttcaggtgtcagttggactatgaagatcctgatcggtgtcatcatcacgtggatcgggatgaacagccgctccaccagcttgagcgtgagcctggtgcttgtcggtgtggtgaccctgtacctgggggcaatggtccaggcggattcgggctgtgtggtgtcgtggaagaacaaggagctcaagtgtggctccgggattttcatcaccgacaacgtccacacgtggaccgaacagtacaagttccagcccgagagcccaagcaagctggctagcgccatccaaaaggcccacgaagagggcatttgcgggatccggagcgttacccgcctggagaatctcatgtggaagcagatcacgcccgagctgaatcacatcttgtccgaaaacgaggtcaagctcactataatgaccggcgacatccgggggatcatgcaggcgggcaagcgcagcctgcggcctcaacctactgagttgaaatactcgtggaagacgtggggcaaggctaagatgctctcaaccgagtcccacaaccagacgttcttgatcgacggccccgaaaccgccgagtgcccgaacacgaaccgcgcctggaactccctggaggtagaggactacggcttcggggtttttactaccaacatttggctcaagttgcgggataaacaagacgtgttctgcgacagcaagctgatgagcgcagccatcaaggacaaccgcgcggtccacgccgatatgggctactggatcgagtccgccttgaacgacacctggaagatggagaaggccagcttcattgaggtcaagagctgccattggcccaagagtcacaccctatggtctaatggtgtgctggaaagtgagatgatcatccccaagaacttcgctgggcctgtctcgcagcacaattaccggccgggctaccacacgcagaccgcggggccctggcacttaggcaagctcgagatggacttcgacctgtgcgaaggcaccaccgtggtggtcacggaggactgcggaaatagagggcctagcctccgaaccaccaccgccagcgggaagctaatcacggagtggtgttgccggtcgtgtacccttcccccgctgcggtaccgcggcgaggacggttgctggtatggaatggagataaggcccttgaaggaaaaggaggagaatctggtgaacagcctcgtgaccgcggggcacggccagatcgacaacttctccctgggcgtcttggggatggccctcctgttagaggaaatgctccgcaccaggattggtacgaaacacgcgatcctgctagtggccgttagcttcgtcaccctcatcaccgggaacatgagtttccgcgacctgggcagggtgatggtgatggtcggggccaccatgacggacgacatcggcatgggagtgacttacctcgctctccttgccgcgttcaaggtgcggcccacattcgctgcaggactgctactccgaaaactgaccagcaaagagctcatgatggccacgattggcatcgccctcctttcccagagcaccattcccgaaaccatcctcgagcttaccgacgcgctggccctcgggatgatggttctgaagatcgtccggaacatggagaagtatcagctggccgtgacggtcatggccatatcctgcgtgcccaacgccgtgatcctccagaacgcgtggaaggtcagctgcaccatcctggcagccgtgtccgtatcgcccttattactgacctcctctcagcaaaaggccgactggatccccctggcgctcacgatcaagggtctgaatccaacggcgatattcctgaccactctctcccgcaccagcaagaaacggtcctggccgcttaacgaggccattatggccgtgggcatggtgagcatacttgcctccagcctcctgaagaacgacatccccatgacggggcccttagtcgcaggcgggctcctgacagtatgctacgtgctgaccggacgcagtgccgatctcgagctggagcgagccgccgacgtgaaatgggaggaccaggccgaaatatccgggtcgtcgccgatcctatcaatcactattagtgaggacggcagcatgtccatcaagaacgaggaggaagagcagacgctcaccatcctgatccgcaccgggctgctcgttatttctggggtgtttccggtatccatccccatcaccgcggccgcatggtacctgtgggaagtcaagaaacagcgggccggagtactgtgggatgtcccatcaccgccacccgtggagaaagcggagctcgaggacggggcgtatcgcatcaagcagcggggcatcctggggtactcacagataggcgccggcgtctacaaggaaggcaccttccacacgatgtggcacgtcacccgcggcgccgtgctgatgcaccgcgggaagcgcattgagcccagctgggccgacgtgaagaaggacctaatcagttacggcgggggctggaaattagagggcgagtggaaagagggcgaggaggtccaggtgttggccctcgaacccgggaaaaacccccgggccgtgcagaccaagcccggaatcttcaagaccaacacggggaccatcggggccgtaagcttagacttctcccccggcacctccggcagtcccatcgttgaccgcaaggggaaggtggtaggcctgtacggcaacggcgtcgtcaccaggagcggcgcctatgtctccgccatcgcgcagacggaaaagtctattgaggacaacccggagatcgaagacgatatctttcgcaagaagcggctcacaatcatggacctgcacccgggggccggtaagaccaagagatacctgcccgccatcgtgcgggaggccatcaagcgcgggctgcgcaccctcatcctggccccgacgcgggtagtcgcggccgagatggaggaagccctgcgaggcctacctataaggtaccagaccactgcgatcaagaccgagcatacggggcgggagattgttgaccttatgtgccacgcgacgttcactatgcggctgttgagccccgtgcgcgttccaaactacaacctgatcatcatggatgaggctcatttcaccgacccggcgtccatcgccgcacggggctacatctctaccagggttgagatgggggaggccgcaggcatcttcatgactgccacgccgccgggctcccgggatccattcccgcagagtaacgcccccattatggacgaagagcgggagatccccgagcggtcctggaacagcgggcacgagtgggtgacagactttaaggggaagacggtctggtttgtgccatccatcaaggccggaaacgacattgcggcttgcttacgcaaaaacggtaaaaaggtgatacagctcagccggaagaccttcgactccgagtacgtcaagacccgcgccaacgattgggacttcgtcgtgaccacggacatcagcgagatgggcgccaacttcaaggccgagcgggtcatcgacccgcgacggtgtatgaagccagtaatactgaccgacggggaagagcgcgtaatcctcgcgggccccatgccagtaacccattccagtgcggcccagcggcgcgggcgcatcggccgcaacccgaagaacgagaacgaccagtacatttacatgggggagcccctcgaaaacgacgaggactgtgcgcactggaaggaagccaaaatgctcctggacaacatcaacacccccgagggcattatcccttccatgtttgaaccggagcgcgagaaagtggacgcgatcgacggcgaataccggctccgcggggaggcccggaagacgttcgtggacctgatgcgccgtggcgatttgcccgtctggctagcctacaaggtagccgccgaggggatcaattacgcggatcgcaagtggtgcttcgatggcatcaagaacaaccagatcctggaggagaacatggaggtggagatctggaccaaggagggggagcggaagaaactgaaaccccggtggctcgatgcccggatctacagcgatccgcttgccctgaaggagttcaaggagttcgccgcgggccgcaagtccctcaccctgaacctaatcaccgagatgggccgactccccacgttcatgacgcaaaaggccaggaacgccctggacaacttagctgtcctccacaccgccgaggccggcggccgggcctataaccacgctctttccgagttaccagagaccttggagacgctcctgctcctgaccttgctagccacggtgaccggcggcatctttctttttctcatgtccggcaaggggatcggcaagatgaccctcgggatgtgctgcatcatcacggccagcatcctgctgtggtacgcgcagatccagcctcactggattgccgcatccatcattttagagttctttttgattgtcctgctcatcccggagccggagaagcagaggacgccccaagacaaccagctgacttatgtggtgatcgccatcctgacggttgttgccgcgactatggcgaacgagatgggcttccttgaaaagaccaagaaggatctcgggcttggcagcatcaccacgcaggagtctgagtccaacatcctggacatcgacctgcgccccgccagcgcctggacgctctacgccgtggcgacgaccttcgtcaccccgatgttaaggcactccatcgagaatagttctgtcaacgtgtcccttacggcaatagccaatcaggccacagtactaatgggcttggggaagggctggccactgtctaagatggacatcggcgtgcccctgctcgctatcggctgttacagccaagtgaaccccatcacactaaccgccgccttactcctgttggtcgcccactatgccatcatcgggccgggcctccaggcgaaggccacgagagaggcccagaagcgtgccgccgcgggcatcatgaagaaccccaccgtggacggtataaccgtgatcgacctggagcccatcccctacgaccccaagtttgagaaacagttgggccaggtcatgttactgatattgtgtgtgacccaggtgctcatgatgcggactacctgggccctgtgcgaggccttaaccctcgccaccgggcccatctccacgctgtgggagggaaaccccgggcgtttttggaacacaaccatcgcggtcagtatggcgaacatctttcgaggctcctacctggcaggcgccggactcctgttttctatcatgaagaacaccacgaacacccggcgcggcacggggaacatcggcgagacccttggcgagaagtggaagtcccggctcaacgccctgggcaagtcagagtttcagatctataaaaaatccggcattcaggaggtggaccgcacgctggccaaagaggggataaagcggggcgagacagaccaccacgcagtgagccgagggtccgcgaaactccggtggttcgtcgagcgaaacatggtgacccccgaggggaaggtagtcgacttgggctgcgggcgaggcggatggtcatactactgtggcgggctgaagaacgtccgagaggtgaagggcctaacgaagggcgggccaggccacgaggagcccatcccgatgtccacatatgggtggaacctggtacggctgcagtccggagtggatgtgttcttcactccacccgagaagtgcgacaccctcctctgcgacataggggaaagctcccccaatcccacaattgaggccggccgcaccctgcgggtgctcaacttggtcgaaaattggctgaacaacaacacgcaattctgcataaaggtcctcaatccctacatgcccagcgtcatcgaaaagatggaggctctgcagcgcaagtacggcggggcgttggtgcggaaccccctgtcccgcaacagcacacacgagatgtactgggtttccaacgccaccggtaacatcgtgagctccgtgaacatgatcagcagaatgctcatcaaccgcttcaccatgaagcacaagaaagccacgtatgaaccggacgtggacttagggtctggtacccgcaacatcggtatcgaaagcgagataccgaacctggacatcatcggtaaacgcatcgagaagatcaagcaggaacacgaaacttcctggcactacgaccaggaccacccctacaagacttgggcctaccacggcagctacgagacaaaacagaccgggtcagccagctccatggtgaacggcgtggtgcgacttctgaccaagccctgggacgtcgtgcccatggttacccagatggcgatgacagataccaccccgttcggccagcagcgggtgttcaaagagaaggtggacacgagaacccaggagccaaaggagggcactaagaagctgatgaaaatcaccgccgagtggctctggaaggagctaggcaagaagaagacgccccggatgtgcacgcgcgaagagttcacacgcaaggtgcgctcgaacgccgcactgggggccatattcactgacgagaataagtggaagtccgcccgggaggccgtcgaggacggccgcttctgggagctcgtagatcgggagcgcaacctgcacttagagggaaaatgcgagacctgtgtatacaatatgatgggcaaacgggagaagaagctcggggagttcggcaaggccaagggcagccgcgcgatatggtacatgtggctgggagcacggtttctggagttcgaggccttagggtttctgaacgaggaccactggttctccagaggaaacagcctcagcggcgtcgagggtgagggcttacatcggctgggctatatcctgcgcgatgtcgggaagaaagagggcggggcaatgtacgccgacgacacggccggctgggacacccggatcaccctagaggatctgaagaacgaggagatggtcaccaaccacatgaaaggggagcacaagaagctggcggaggcgatcttcaagctcacttaccagaacaaggtggtaagggtccaaagacccactccgcgaggcaccgtaatggacatcatctcccgtcgcgaccagcggggaagcgggcaggtcggcacctacgggctgaacacgttcactaacatggaggctcagctgatcagacagatggagggagagggcattttcaagtccatccagcacctcaccgccaccgaggagatcgccgtccaaaactggctggcgcgagtagggcgggagcgcctgtctcggatggctatctccggtgacgactgtgttgtcaagcccatcgatgaccgtttcgccagcgccctcacggccctgaatgacatggggaaggtgcggaaggacatccagcagtgggagccctcccgcggctggaatgactggacccaggttcccttttgctcacaccacttccacgagctggtcatgaaggacggaagagtgcttgttgtcccctgtcgtaaccaggacgagctgatcggccgcgcgcgaatctcgcagggcgccgggtggtccctgaaggagaccgcctgtctggggaagagttacgcacagatgtggacgctgatgtatttccatcggcgggacctgcggctcgccgcgaacgccatctgctccgccgtgccttcgcactgggttcccactagccgcacgacctggtccattcacgccaagcacgagtggatgacgaccgaggacatgctggccgtgtggaaccgggtgtggatccaggagaacccatggatggaggacaagacgccagtagagtcctgggaggaagtgccctacctggggaagcgcgaggaccagtggtgcggctcccttatagggctgactagtagagccacttgggcgaagaacatccagacagccatcaaccaggtaagaagcctgatagggaacgaggagtacacggactacatgccatccatgaaaaggttccggagggaggaggaggaagccggcgtgctctggtaa

SEQ ID NO: 25022 - RNA, 9876 nt, synthetic construct
  misc_feature 1..9876: note = derived and/or modified CDS sequence (opt11) from DENV-2__FJ390391__SS-prME
  source 1..9876: mol_type = other RNA
accgcgggggtgatcgtcatgttaatccccacggccatggcgttccacctcaccacgcgcaacggggaaccgcacatgatagtgggccggcaggagaagggtaagtccctgctgttcaagaccgaggacggcgtgaacatgtgcaccctgatggccatcgacctaggagagctttgcgaggataccatcacctataagtgcccgcttctgcgccagaacgagcccgaggacatcgactgctggtgcaacagcaccagcacttgggtcacctatgggacctgcaccaccacgggagaacaccggagggagaagcggtccgtggccctggtgcctcacgtcggaatgggcctcgagacccgcaccgagacctggatgagctctgagggggcctggaagcacgtgcagcgcatcgagacctggatcctgcgccacccgggtttcaccatcatggccgcaatcctggcctataccatcgggaccacgcactttcagcgggccctcatcttcatcctgctaaccgccgtggcgccctcaatgaccatgcgctgcatcggcatcagcaaccgggacttcgtcgagggagtgagcgggggctcctgggtggacatcgtcctggagcacggcagctgcgtgacgacgatggctaagaacaagcccaccctggatttcgagctgatcaaaaccgaggctaagcagcccgccaccctccgtaagtactgcatagaggccaagctgacaaacaccaccaccgaatctcggtgcccgacgcagggcgagcctagcttaaacgaggagcaggacaagcgcttcatctgcaagcactccatggtggaccggggatgggggaatggctgcgggctgttcggcaagggaggcatcgtgacctgcgcgatgttcacgtgcaagaagaacatggaaggtaaggtggtacagcccgagaatttagagtacaccatcgtcatcacgccccacagcggggaggagcacgccgtgggcaatgacaccgggaagcacggcaaggagatcaagatcacccctcagtccagcatcaccgaggccgagctgacagggtacggcacggtgaccatggagtgctcgccccggacgggacttgacttcaacgagatggtcctgctgcagatggaggacaaggcttggctcgtgcaccgccagtggttcctggacctgcccctcccgtggcttccgggggccgacacccagggcagcaactggatccagaaggagactctggtgaccttcaaaaatccacacgcgaaaaagcaggacgtcgtggtcctcgggtcccaggagggagccatgcacaccgccctgaccggggccacggagatacagatgagctcgggcaacctcctgttcaccggccacctgaaatgccgtctgcggatggataagctccaattaaaggggatgtcctacagcatgtgcactggcaagttcaagatcgttaaggagatcgccgagacccagcacgggacgatcgtgatccgcgtgcagtatgagggcgacggctccccctgcaaaatccccttcgagattaccgacctggagaagcggcacgtgctcggtcgcttaattaccgtcaacccgatcgtcacggaaaaggacagccccgtaaacattgaggcggagcccccgttcggggactcctacattatcatcggggtggagccgggccagctgaaactcaattggttcaaaaagggtagctcgatcggccaaatgttcgaaacgaccatgcgcggagccaagaggatggccatcctgggggacaccgcctgggactttggaagtctcgggggtgtcttcacctccattggtaaggccctccaccaggtgtttggcgcaatctacggcgccgccttctccggggtttcctggacgatgaagatcttgatcggcgtaattatcacctggatcgggatgaacagccgctccaccagcctgtccgtcagcctggtgctcgtcggagttgttaccttatacctaggggccgtggtgcaggcggattccggatgcgtggtaagctggaagaacaaggagttaaagtgcggcagcgggatcttcattacggataacgtgcacacctggaccgagcagtacaagttccaacccgagtcgcctagcaagttggcctccgccatccagaaggctcacgaggagggcatctgtgggattcggagcgtaacccgcctggagaatttaatgtggaaacaaatcacgcccgagctgaaccacatactgtccgagaacgaggtcaagctgaccatcatgacaggcgacatcaaggggatcatgcaggccggcaagcggagcctgcgcccacagcccaccgaactgaagtactcttggaagacgtggggcaaggcgaaaatgctcagcaccgagtcccacaaccagaccttcctgatcgacgggccggaaaccgccgagtgcccgaacacgaacagggcctggaacagcctggaggtggaggactacgggttcggggtgttcactaccaacatctggctcaagctgcgggagaagcaggacgtcttttgcgactccaagctcatgagcgccgccatcaaggacaaccgggccgtgcacgccgacatgggctactggatagagtccgccctcaacgacacctggaagatggagaaggcgagcttcatcgaggtgaagtcctgccactggcccaagagccacaccctttggagtaacggcgtcctggagagcgagatgattatacccaagaatttcgccgggcccgtatcccagcacaactaccgcccgggctatcacacgcagaccgcggggccctggcacttaggcaagctggagatggacttcgacttctgcgaggggaccaccgtggtagtgacggaggactgcggcaaccggggcccctccctgcgcaccaccaccgcctccggtaaactcatcacggaatggtgctgccggtcctgcaccctgcccccgctgcggtaccggggcgaagatgggtgttggtacggcatggagatccgccccctcaaagagaaggaggagaatctggtgaacagcctggtaaccgcagggcacggacagatcgacaacttctccctcggggtgcttgggatggccctgttcctcgaggaaatgctgcggacccgcataggcactaagcacgcgatcctgcttgtggccgtcagcttcgtgactctgatcaccggtaacatgtccttccgggacctgggccgagtgatggtaatggtgggtgccaccatgaccgacgacatcggcatgggcgtgacgtacctcgccctcctggccgcgttcaaggtccgccccacctttgccgccgggctcctgctgagaaagctcaccagcaaggagctgatgatggccacgatcggcatcgcactgctctcccagagcactattcccgagactatctttgaactgaccgacgcgctggccctcgggatgatggtgctgaaaatcgtgcgcaacatggagaagtaccagttagctgtcactatcatggccatctcctgcgtgccgaacgccgtgatcctccagaatgcctggaaggtcagctgcaccatcctagccgccgtgagtgtcagccccctgctcttgacctcctcccagcaaaaggccgactggatccccctggccctcaccattaaagggctgaaccccacggccatcttcctgaccaccctttccaggacgagcaagaagcgctcctggccgctgaacgaggccatcatggccgtgggcatggtatcgatcttggcctccagcctcctgaaaaacgacatccccatgactgggcccctggtcgcaggcgggctcctgaccgtgtgctacgtgctgaccggccggagcgcagacctcgagctggagcgcgccgccgacgtcaagtgggaggaccaggccgagatatccggcagctcccccatattaagcattaccatctccgaggacggcagcatgtccatcaagaacgaggaggaggaacagacgctcaccatcctgattcggactggtctgctcgtgatcagcggggtattcccggtctccattcccatcaccgcggcggcttggtacctgtgggaggtgaagaagcagcgcgcgggtgtgctgtgggatgtgcccagcccgccgccagtggagaaggccgagctcgaagacggggcgtaccggatcaagcagcgcggcatcctggggtactcacagatcggcgccggcgtgtacaaggaggggacattccacacgatgtggcacgtcacgcggggcgctgtgctgatgcaccgcgggaagcgcatcgagcccagctgggccgacgtgaaaaaggacctcatttcctacggcgggggctggaagctagagggcgagtggaaagagggggaggaagtccaggtgctggccctcgagcccggcaagaacccccgcgcggtgcagaccaagcccgggatcttcaagaccaacacaggtacgatcggggccgtcagcctggacttctctccgggcacttcaggctcccccatcgttgaccggaagggcaaggtcgtcggcttatacggtaacggcgtggtgacgcgcagcggtgcgtacgtctccgccatcgcccagacggagaagtcaatcgaggacaacccggagatcgaggacgacatcttccggaagaagcgcctcaccatcatggacctgcaccccggggccggcaagaccaagcgctacctgcccgccatagtgcgcgaggccatcaaacgggggctccgcactttgatactggccccgacgcgcgtggtcgcggccgagatggaggaggcactgcggggccttcccatccgctatcagacccccgccataaagaccgagcacacagggcgcgagatcgtggatctgatgtgccacgccacgttcacgatgcgccttctcagccccgtgcgggtgccgaactacaacctgatcatcatggacgaagcgcacttcaccgaccccgcatccatcgccgcgcgcggatacatcagcacccgggtggagatgggggaggccgctggtatcttcatgacggccacgccccccggcagccgcgacccgttcccgcagagcaacgcccccatcatggacgaagagcgggagatccccgagcgcagctggaacagcgggcacgagtgggtgaccgacttcaagggcaagaccgtctggttcgtgccgtccatcaaggccgggaacgacatcgcggcctgcctacggaagaacggcaagaaggtgatccagctgtcacgcaaaaccttcgactccgagtacgtcaagaccagggccaatgactgggacttcgtcgtgaccaccgacatcagtgagatgggggcgaacttcaaggccgagcgcgtcatcgacccccggcgctgcatgaaacccgtgattctgacggatggggaggagcgcgtgatcctggcgggccccatgccggtcacccactcaagcgccgcgcagcgccgggggcgtatcggccgcaatcccaaaaacgagaacgaccagtacatctatatgggggaacccctcgagaacgacgaggactgcgcacactggaaggaggctaagatgctattagacaacatcaacacccccgagggcatcatcccgtctatgttcgagcccgaacgggagaaagtggacgcgatcgacggcgaataccgcctccgcggggaagcccgcaagaccttcgtggatctgatgcggcgcggcgacctcccggtctggctcgcctacaaggtcgccgcagaggggatcaactacgcggaccggaagtggtgcttcgacggcatcaagaacaatcagatcttggaggagaacatggaggtggaaatatggacgaaggagggggagagaaagaaactgaagccccggtggctcgacgcgcgcatttacagcgaccccctggccctgaaggagttcaaggagttcgcagcgggccggaaatccctcaccctgaacctgataaccgaaatgggccgcctcccgacatttatgacgcaaaaggcacggaacgccctggacaacttagcagtcctccacaccgccgaggccgggggccgcgcctacaaccacgccctgagcgagctgcccgagaccctcgagaccttgctgctgctgacgctgctcgccaccgtgaccgggggcatctttctgttcctgatgtccggtaaggggataggcaagatgaccctagggatgtgttgcatcatcaccgccagcatcctgctgtggtatgcgcagattcagccgcactggatcgccgccagtatcattctcgagttcttcctgatcgtcctgctaatcccagagcccgagaagcagcggacgccccaggataaccagttaacctacgtggtaatcgccattctgactgtcgtggccgcgaccatggccaacgaaatgggcttcctcgagaagacgaagaaggacctggggctgggcagcatcaccacccaggagagcgagtcgaacatcctggacatcgacctgcgcccggcttccgcctggaccctgtacgccgtcgcgacgacgttcgtcacccccatgctccggcactcgatcgagaatagctccgtgaacgtgagcctgaccgccatcgccaaccaagccacggtcctgatgggcctcgggaaggggtggcctctgtccaagatggacataggggtgccactgctcgcgatcggctgctacagccaggtgaaccctatcactctgaccgccgccctgctcctgctcgtcgctcactacgccatcatcgggcccggcctccaggcgaaggccacacgcgaggcccagaagcgggccgccgcgggcatcatgaagaatcccacggtggacgggatcaccgtgatcgacctggagcctatcccgtacgaccctaagttcgagaagcaactgggtcaggtcatgctgctgatcctctgcgtgacccaggtgctcatgatgcgcaccacgtgggccctgtgtgaggccctcaccctcgccaccgggcccatctccaccctgtgggagggcaacccagggcggttctggaacactaccatcgctgtcagcatggccaacatctttcgcggctcctacctggccggcgccgggctcctgttctccatcatgaagaacactacctccacgcggcggggcaccgggaacatcggcgagaccctgggcgagaagtggaaatcccgcctcaacgccctggggaagtccgagtttcagatttacaaaaagtccggcatccaggaggtggaccggaccctggcgaaggaggggataaagcgcggcgagacggaccaccacgccgtgtcccggggatcagccaagctccgctggttcgttgagcggaacatggtgaccccggagggcaaggtggtcgaccttggctgcgggcgcggcgggtggtcctactactgtggcgggctaaaaaacgtgcgagaggtgaagggcctcaccaagggggggccaggccacgaggagcccattcccatgagcacctacgggtggaacctggtccgcctgcagagcggtgtggacgttttttttacgccgcccgagaagtgcgacaccctcctgtgtgacatcggggagtccagccccaaccccaccatagaggccggtcggaccctgagggtgctcaacctggtggagaactggctgaacaacaacacccagttctgcataaaggttctcaacccgtatatgccctccgtcatcgagaaaatggaggccctgcagcggcagtacggaggggcgctggttcggaaccccctcagcagaaactccacgcacgagatgtactgggtaagcaacgccaccggcaacatcgtgtccagcgtcaacatgatctcccgcatgcttatcaaccggttcacgatgaagcacaagaaagccacatacgagccagacgtggaccttgggagcggcacgcggaacatcgggatcgagaatgagatccccaatttagacatcatcggcaagcgtatcgagaagatcaagcaggagcacgagatctcatggcactatgatcaggaccatccctacaagacgtgggcctaccacggcagctacgagaccaagcagactgggtccgccagctccatggtcaatggtgtagtgcgcctcctgacgaaaccctgggatgtcgtgcccatggtgacgcaaatggcgatgaccgataccacgcctttcgggcagcagcgcgtcttcaaggagaaggtggacacccgaacccaagagcccaaggagggcaccaagaaactgatgaagatcacagccgaatggctctggaaggagctgggcaagaagaaaaccccccgcatgtgcacccgggaggagtttacgaaaaaggtccgcagcaacgccgccctgggggcgatcttcaccgacgagaacaagtggaagtccgctagagaggccgtcgaggacggccgcttctgggagctcgtggaccgggagaggaacctccacctagaaggtaagtgcgagacctgcgtgtacaacatgatgggtaaacgggagaagaaactcggcgagttcggaaaagctaagggcagccgcgccatctggtatatgtggctgggggcgcggttcctggagttcgaggccttagggttcctgaacgaggaccactggttctcccgcgggaactcactgagcggtgtagagggtgagggcttgcaccggctgggctacatcctgcgcgacgtggggaagaaggagggcggggccatgtacgccgacgacaccgccggctgggacacccggatcacgctcgaggacctgaagaatgaggaaatggtcaccaaccacatgaagggagagcacaagaagctggcggaggccatcttcaagctcacctaccagaacaaggtggtgcgtgtccagcggccaacgccccgcggtacggtgatggacatcatttccaggcgcgaccagcgtggcagcgggcaggttggcacctacgggttgaacaccttcaccaacatggaggcccaactgatccgccagatggagggcgagggcatcttcaagtccatccagcacctcacggccaccgaggagatcgccgtccagaactggctggcgcgcgtggggcgggaacgcctgagccggatggccatttccggcgacgactgcgtggtaaagcctatcgacgaccgcttcgcttccgccctcaccgccctgaacgacatggggaaggtgcggaaggacatccagcaatgggagccatcccgcggttggaacgactggacccaggtgccgttttgcagccaccacttccacgagctggtcatgaaggacgggcgggtgctcgtcgtgccctgccgcaaccaggacgagctgattggcagggcgcgcatctcccagggcgccgggtggagcctgaaggaaacggcctgcctcggcaagtcctacgcccagatgtggacactgatgtacttccaccggcgcgacctgcggctcgccgcgaacgccatctgcagcgccgtgccctcccactgggtgcccaccagccgcaccacctggtccatccacgccaagcacgagtggatgacgaccgaggacatgcttgctgtctggaaccgggtgtggatccaggagaacccgtggatggaggacaaaacccccgtggagagctgggaggaggtcccctacctggggaagcgcgaggaccaatggtgcggctctctcatcggtctgaccagccgggccacatgggccaagaacattcaaaccgccatcaatcaagtgcgcagcctgatcggcaacgaggagtacaccgactacatgcccagcatgaagcggttccgacgcgaggaggaggaggccggagtgctctggtga

SEQ ID NO: 25023 - RNA, 9876 nt, synthetic construct
  misc_feature 1..9876: note = derived and/or modified CDS sequence (opt11) from DENV-2__FJ882593__SS-prME
  source 1..9876: mol_type = other RNA
acggccggagtcatcgtcatgctgatccccacggccatggcattccatctcactacccgcaacggagaaccacacatgatcgtcggtcggcaggagaaggggaagagtctgctatttaagaccgaggacggtgtaaacatgtgcactctgatggccatcgatttgggggaactgtgcgaggataccatcacatacaagtgccctctcctgcgccagaacgagcccgaggacatcgactgttggtgcaacagcacctcgacttgggtcacctacgggacctgcacaaccacgggcgagcaccggagagagaagcgctccgtggccttggtaccccacgtcgggatgggcctcgagaccagaacagaaacatggatgagcagcgagggggcctggaagcacgtgcagcggatcgagacctggattcttcgccacccaggcttcaccatcatggccgcgatcctggcctacaccatagggacaacccacttccagcgcgctttaatcttcatcctgctaaccgccgtggcgccgtctatgacgatgcggtgcattggaatcagtaaccgggatttcgttgaaggagtgagcggggggtcctgggtggacatagtcctcgaacacgggagctgcgtgaccacgatggccaagaacaagcccaccctggacttcgagctgatcaaaaccgaggccaagcagcccgccaccctccgcaagtactgcatcgaggcgaagctgacgaacaccacaaccgagtcccgctgcccgacgcagggcgagccgagcctgaacgaagagcaagataagcgcttcatctgtaaacactccatggtagaccgggggtggggtaacggctgcggcctgttcgggaagggcgggatcgtgacatgcgcgatgttcacatgcaagaagaacatggaaggcaaggtggtgcagccggagaatctggagtacaccatcgtcatcacgccccacagcggggaggaacacgccgtgggtaacgacaccggtaagcacggaaaggagatcaagatcaccccgcagtccagcatcacagaggccgagctgacaggctacggcacggtgaccatggaatgcagcccccggaccggcctcgacttcaatgagatggtcctgctgcagatggaggacaaggcctggctcgtgcatcgtcagtggttcctggatctgccactcccttggctaccgggtgccgacacacaggagtccaactggatccaaaaggagacgctggtaaccttcaaaaaccctcacgcgaagaaacaggacgttgtggttctagggtcccaggagggggccatgcacaccgccctgaccggcgccacggaaatccaaatgagctcggggaacctcctcttcaccggccacctgaagtgccgcttgagaatggacaagttgcagctgaaaggcatgtcctacagcatgtgcactgggaagttcaagatcgttaaggagatcgccgagacccagcacggcacaatcgtgatacgcgtccagtacgagggggacggcagtccctgcaagatcccattcgagatcaccgacctggagaagcggcacgtgctcggaagactgatcactgtgaacccaatcgtcaccgaaaaggactcccccgtgaacatcgaggcggagcccccattcggggactcctacatcatcatcggcgtggagccggggcagctgaagctcaactggtttaagaagggcagttccatcgggcagatgttcgagacgaccatgagaggcgccaagaggatggccatcctgggagatacggcctgggacttcgggagcctgggcggggtcttcacctcgatcggcaaggcactccaccaggtattcggtgcgatctacggcgccgccttcagcggcgtgagctggacgatgaagatcctaatcggtgtcatcatcacgtggatcggaatgaacagccgctccacctcactgtcagtgagcctggtcctcgtcggggtggtcaccttatacttaggcgccgtggtgcaagcggactccggttgcgtggtctcgtggaagaacaaagagctcaaatgcggttccggcatcttcataacggataacgtgcacacctggaccgagcagtacaaatttcaacccgagagcccctcgaagttggcgtctgccatacagaaggcccacgaggaggggatctgcggcatccgtagcgttaccagactggagaacctcatgtggaagcagatcacacccgagctgaaccatatcttgtcagagaacgaagtaaagctcacgatcatgactggggacatcaagggcataatgcaggctgggaagcggtcgctgcgcccgcagcccaccgagctgaaatactcctggaagacgtggggcaaggcgaaaatgctcagcaccgagtcccacaaccaaactttcctgatcgacgggccggagaccgcggagtgcccgaacaccaaccgcgcttggaactcgctggaagtggaagactacgggttcggcgtgttcaccaccaacatctggctcaagctgcgcgagaaacaggacgtcttctgcgactccaagctgatgagcgccgccataaaggataaccgggccgtgcacgccgacatgggatactggatcgagtccgctctcaacgacacctggaagatggagaaggcctcatttatcgaagttaagtcgtgccattggccgaagagccacaccctgtggtccaacggcgtcctggagtctgagatgataatcccaaagaacttcgccggcccggtgtcccagcacaactaccgcccgggctaccacacccagaccgcgggaccttggcatctcggtaagctggagatggacttcgacttctgcgagggcaccaccgtcgtcgtgaccgaggattgcgggaaccggggcccaagcctgcgcaccacgactgctagcggcaaactcatcacggagtggtgctgccgatcttgcaccctgccaccgctgcgctaccgcggagaggatggctgctggtacggcatggagatacggcccctcaaggaaaaggaggagaatctggtgaactcactagtcaccgccggccatgggcagatcgataacttctcactcggcgtgcttggcatggccctgttcttggaggagatgctgcggacccgaatcgggacgaagcacgctattctgctcgtggccgtctcgtttgtgactctgatcaccggcaacatgagcttccgggacctgggccgcgtgatggtgatggtgggcgccaccatgacggacgacatagggatgggcgtgacctacctcgccctgctggccgcgttcaaggtccggcccaccttcgcagctggcttgctgctcaggaagctcaccagcaaggagttgatgatggccacaatcgggatcgcactgctctcccagagcacaatccccgagaccatcctggagctgaccgatgcgcttgccttaggcatgatggtgctgaagatcgtgagaaatatggagaaataccagctcgctgtcacgatcatggccatatcatgtgtgccgaacgcagtgatcctacagaacgcttggaaggtcagctgtactatcctcgccgccgtgtccgtcagccccttactcctgacgtcaagccagcaaaaggctgactggatccctctcgctctgacaatcaaagggctgaaccccacggccatattccttaccaccctgagtcggacctccaagaagcgttcctggcccttaaacgaagctataatggccgtgggcatggtgtccatactcgcctcctcattactgaagaatgatatccccatgactggaccgctcgtagccggcggtctgcttacggtctgctacgtgctcactggacggtcagccgacttagagctggagcgcgctgccgacgtcaagtgggaagatcaggcagagatctccgggtcgagtcccattctcagcatcacgatcagtgaggacgggagcatgtccattaagaacgaggaggaggagcagacgctgaccatcctgatccgaaccggcctcttagtgatctccggcgtgttcccggtctccatccctatcaccgctgctgcctggtacctgtgggaggtgaaaaagcagcgcgccggagtgctctgggatgtccccagcccgccgcccgtggagaaggctgagctggaagacggcgcttaccggatcaagcagcgcggaatcctgggctactcccagataggggccggcgtgtataaggagggcactttccacacgatgtggcacgtcacccgaggcgcggtccttatgcatcggggtaagcggatcgagcccagctgggcggacgtgaagaaggacctgatctcctacggaggcggatggaagcttgagggagagtggaaggagggcgaagaggttcaggtgctcgccctcgagcccgggaaaaacccccgcgcggttcagaccaagcccggcatcttcaaaaccaacacggggaccatcggcgccgtcagcctggacttcagccccgggaccagcggctcccctatcgtggaccggaaggggaaggttgtcgggttgtacggcaatggggtggtgacccgcagcggcgcctacgtctccgccatagcgcagaccgagaaatccattgaggacaaccccgaaatcgaggacgacatctttcggaagaagcgcctcaccatcatggacctgcatccaggcgcggggaagacaaagcggtacctccccgctatcgtacgtgaggccatcaagcggggcctgcgcacactcatccttgcaccgacgcgcgtggtcgcggccgaaatggaggaggccctccggggtctgcccattcgctaccagacccccgccatcaagacagagcacacaggcagggagatcgtggacctgatgtgccatgcaacgtttacaatgcgcttgctgagccccgtccgggtccccaattacaacctgatcatcatggacgaggcgcacttcacggaccccgcatccatcgccgcccgcggctacatcagtacccgggtggaaatgggcgaggccgcgggcattttcatgacggccacgccgcccgggtcccgtgacccgttcccccaatccaacgcccccataatggacgaggagcgggagatccccgagcgaagttggaactcgggccacgaatgggtaaccgactttaaggggaagaccgtctggttcgtgccgtccatcaaggccggcaacgacatcgctgcctgcctccggaagaacgggaaaaaggtgatccagttgtcacgcaagacctttgactccgagtatgtcaagacccgggccaacgactgggacttcgtggtaaccacagacatcagcgaaatgggagccaacttcaaggcggagcgcgtgatcgaccctcgccgctgcatgaagcccgttatcttaacggatggagaggagcgggtgattctcgcggggcccatgccagttactcactcctcggccgcccagcgccggggccgcatcgggcgcaaccccaagaacgaaaacgaccagtacatctacatgggcgaaccgctggagaacgacgaggactgcgcccattggaaggaggcaaagatgctactcgataatatcaatacgccggagggaatcataccatcgatgttcgagcccgaacgggagaaggtggatgcgatcgatggcgaataccgcctgcggggcgaggcccgcaaaaccttcgtggacctgatgcggcgtggggacttacctgtctggttagcctacaaggtggccgccgagggaattaactacgcagaccggaagtggtgctttgacggaatcaagaataatcagatcctcgaggaaaacatggaagtggagatctggacgaaggagggcgagcgcaagaagctgaagccgcggtggttagacgccagaatatacagcgaccccctggccctgaaggaatttaaggagttcgccgcgggtcggaagagcctgaccctgaacctcatcacagagatgggccgattgcccacctttatgacgcaaaaggcccggaacgccctggacaacctcgccgtcctacacactgccgaggcgggcgggcgcgcgtacaaccacgccctgagcgaactacccgagacgttggagacccttctcctgctgactctcctggccacggtgaccggcggcatttttctcttcctcatgtccggaaagggcatcggtaagatgaccctgggtatgtgttgcatcatcactgccagcatcttactctggtatgcgcagatacagccacattggatcgccgcctccatcatcctggagttcttcctgatagtcctcctgatccccgagcccgagaaacagaggacgccccaagataaccagttaacctacgtcgtcattgccatcttaaccgtcgtggccgctaccatggccaacgagatggggttcctggagaagaccaagaaggatctcggtctcgggtctataacgacccaggagtcagaatccaacatccttgacatcgacctgcgccctgcaagcgcttggaccctctacgccgtggcgacgacgttcgtgacccccatgctacggcactccatcgaaaacagctccgtgaacgtgagcctgaccgccattgccaaccaagccacggttctcatggggctgggcaaggggtggcccctgtctaagatggacatcggcgtgcccctccttgccatcggttgctacagccaagtgaacccgatcacccttaccgcggccctcctgttgctcgtggcccactacgccatcatcggtcccggcttgcaagcgaaggctacccgcgaggcccagaagagagcggcagcgggtatcatgaagaacccgacggtggatggcattactgtgatcgatctggagcccattccatacgaccccaagttcgagaagcagctcggacaggtcatgctgctcatcctctgtgtaactcaagtgctgatgatgcgcacaacttgggctctgtgcgaggcgctcaccctggccaccgggccaatatccaccctgtgggaaggaaaccccggccggttctggaacacgactatcgcagtcagcatggctaacatcttccgcgggtcatacctcgccggcgcaggtctgctgttctctatcatgaagaacaccacctccacgcgtagggggaccggcaacatcggggagactttaggcgagaaatggaagtcccgtctgaacgctctgggcaagtccgagtttcagatttataagaagtccgggattcaggaggtggaccggactctggctaaggagggcattaagcgcggggaaacggaccaccacgccgtttcccgtggcagcgccaaactgcggtggttcgtcgaacggaacatggtgaccccggaagggaaggtagtggacctggggtgcggccgcgggggatggtcctactactgcgggggactcaagaacgtgcgggaggtgaaggggctgactaaaggcggtcccgggcatgaggagcccatcccaatgtcgacctacggctggaacctagtcagactccagtctggggtcgatgtgttcttcacgccgcccgagaagtgcgacaccttactgtgcgacatcggcgagtccagccccaaccccacaatcgaggccgggcggaccttgcgcgtcttaaatctggtggaaaactggctcaacaacaatacccagttctgcatcaaggtgctgaacccgtacatgccctccgtcatcgagaagatggaggccctgcaacggcagtatgggggcgcgcttgtgcgcaatcccttgagccgtaactccacgcatgaaatgtattgggttagcaacgccaccgggaacatcgtctccagcgtgaacatgatttcccgaatgctaatcaatcggtttaccatgaaacacaagaaggccacctacgagccggacgtggacctgggaagcgggacccgcaacatcggcatagagtctgagatccccaacctagacataataggtaagcggattgaaaagattaagcaggagcacgagatatcttggcactacgatcaggaccacccatacaagacctgggcctatcacggctcctacgagaccaagcagaccggatcagcctcgtctatggtcaacggagtggttcgacttctgactaagccctgggacgtcgtgcccatggtgacccagatggcgatgactgacaccacgcccttcggacagcagcgcgtttttaaggaaaaggtggacacccggacccaggagccaaaggaggggacgaaaaaactcatgaagattaccgcagagtggctgtggaaggagctggggaagaagaagactccccggatgtgcacccgggaggagttcaccaagaaggtgcgctccaacgcggccctcggcgccatattcacggatgagaacaagtggaagtccgcgcgggaggccgtagaggacgggcgcttctgggagctggtagatcgggaacgcaacctgcacttagaaggtaagtgcgagacctgtgtgtacaatatgatgggcaagcgagagaaaaagctcggggagtttgggaaggccaagggatcccgcgccatttggtacatgtggctgggcgcgcggttcctcgagtttgaggccttggggttcctgaacgaggaccactggttctcgcgcggtaacagcctctccggggtcgagggcgaggggctgcaccggctaggctacatcctgcgcgatgttggcaagaaggagggcggggccatgtacgccgacgacacggcgggctgggacacgcgaattacgctagaagacctgaagaacgaggagatggtcaccaatcacatgaagggggagcacaagaaattggcggaggccatattcaagttaacctaccagaataaggttgtgcgcgtccagcggccgacgccacgcgggacggtgatggacatcatcagccggcgggatcagcggggatccgggcaggttgggacctacggcctgaacaccttcaccaacatggaggcccaactcatccgccagatggaaggggagggcatcttcaagagcatccagcacctgacggccaccgaggagatcgctgtccaaaactggctggcgcgcgtgggccgggaacgtctttcccggatggcgatcagcggagatgactgcgtcgtcaagcccatcgacgaccgcttcgcaagtgctctgactgccttaaacgacatgggaaaagtgcggaaggatatccaacagtgggagccatcacgcgggtggaacgattggacacaggtgccgttttgttcccaccatttccacgaattggtcatgaaagacggccgggtgctagtggtcccctgccgcaatcaggatgagctgatcgggagagcgcgcataagccagggcgcgggctggtccctcaaggagacggcatgcctgggcaaaagctacgcgcagatgtggactttaatgtacttccaccgtcgcgatctccggctggcggcgaacgccatctgcagcgccgtgcccagccactgggtcccaacctccaggacaacctggagcatccacgcaaagcacgagtggatgacgaccgaggacatgctggcagtctggaaccgggtgtggatacaagagaacccgtggatggaggacaagacccccgtcgagtcatgggaggaggtcccctacctcggcaagcgcgaagatcagtggtgtggcagcctcatcggcctgacttcgcgggccacttgggccaaaaacatccagacggcaatcaaccaggtgcgctcactcattgggaacgaggaatacacagactacatgccctctatgaagcggtttcgacgcgaagaggaggaggcgggtgtgttatggtga

SEQ ID NO: 25024 - RNA, 9876 nt, synthetic construct
  misc_feature 1..9876: note = derived and/or modified CDS sequence (opt11) from DENV-2__FJ182014__SS-prME
  source 1..9876: mol_type = other RNA
acggcgggcgtgatagtcatgctgatccccaccgccatggcgtttcaccttaccacccgcaacggcgagccgcacatgatcgtgggccggcaggagaagggcaagtccctgctattcaagaccgaggacggagtgaacatgtgcaccttaatggccatcgaccttggggagctgtgcgaggacactatcacctacaagtgtcccttcctccgccagaatgagcccgaggacatcgactgttggtgcaactctaccagcacctgggtcacgtacgggacttgcactacgacgggcgagcaccggcgcgagaagcggtccgtggcccttgtgccccacgtggggatgggcctggagacgaggaccgagacctggatgagcagcgagggggcatggaagcacgtgcagcggatcgagacatggatactccgccacccaggcttcaccatcatggccgccatcctggcgtacaccatcggaactacgcacttccagcgggccctgatatttatcctcctgaccgccgtggcgcccagtatgactatgcgctgcatcggcatcagcaaccgggatttcgtcgagggcgtgtcggggggcagttgggtggacatcgtcctggagcacgggagctgcgtgaccacgatggctaagaacaagcccaccctcgacttcgagctgataaagaccgaggcgaagcagccggccactttgcgcaagtactgcatcgaggccaagcttacgaacaccaccacggagagccggtgcccgacgcaaggtgagcccagcctgaatgaagagcaggacaagcgcttcatttgcaagcattcgatggtggaccggggctggggcaatggctgcgggctgttcggtaagggcgggatcgtgacctgcgcgatgtttacgtgcaagaagaacatggagggcaaggtggtgcagcccgagaacctcgagtacaccatcgtcatcacgccgcacagcggggaggagcacgccgtgggcaacgacaccgggaaacacggcaaggaaatcaagatcaccccgcagtccagcatcaccgaggccgagctgactggctacggcacggtgaccatggagtgcagcccccggaccggtctggactttaacgagatggtcttgctgcagatggaggacaaggcctggctagtgcaccggcagtggttcctcgacctgcccctcccctggctcccgggggccgacacccagggcagcaattggatccagaaggaaacgctggtgacctttaaaaatccccacgcgaagaagcaggacgtcgtggtcctggggagccaggagggcgccatgcacaccgccctaacaggggccacggaaatccagatgagcagcggcaacttattattcaccggccacctcaagtgccgcttgcggatggacaagttacaactcaagggaatgtcctacagcatgtgcaccggcaagttcaaaatcgtgaaggaaatagccgagacccagcatgggacgatcgtgatccgcgtccagtacgagggcgacggctctccctgcaagatccccttcgagattaccgacctggagaagcggcacgtgctggggcgcctcattaccgtaaaccccatcgtcaccgagaaggacagcccagtgaacatcgaggctgagccgcccttcggcgattcctacatcataataggggtggagcctgggcaactgaaactgaactggttcaagaaggggagctccatcgggcagatgttcgaaacgacaatgcgcggagccaagcggatggccatcctcggggacaccgcgtgggactttggcagcctcgggggcgtcttcacctccatcgggaaggcccttcaccaggtgttcggcgcgatctacggcgctgccttcagcggggtatcctggacgatgaagattctcatcggcgtgattatcacctggatcgggatgaacagccgctccacatctctgtccgtgagtctggtgctggtcggcgtggtgaccctctacctgggggccgttgtgcaggcggactccggctgcgtggtcagctggaagaacaaagagctgaagtgcggctctgggatattcatcaccgacaacgtgcacacttggaccgagcagtacaagttccaacccgagagccccagcaagctcgcctccgccatccagaaagcccacgaggagggcatctgcgggatacgcagcgtgacccgcctggagaacctgatgtggaagcagattacgccggaactcaaccacatcctgtccgagaacgaggtcaagctgaccattatgacaggcgacatcaaagggatcatgcaggccggtaagcggagcctccgcccacagcccaccgagctgaaatactcctggaagacgtggggcaaggcgaaaatgctaagcaccgaatcccacaaccagaccttcctcatcgacgggcccgagaccgcagagtgcccgaacacaaaccgggcctggaactcgctggaggtggaggactacggctttggagtgttcactacaaacatatggctgaagttgcgcgagaagcaggacgtcttctgcgacagtaagttgatgagcgccgccatcaaggacaatcgggccgtgcacgccgacatgggctactggatcgagtccgccctaaacgacacctggaagatggagaaggcgagcttcatagaggtgaagtcctgccactggcccaagagccacaccctttggagcaacggcgtcctggagagtgagatgatcatccccaagaacttcgccgggcccgtttcccagcacaactaccgcccgggctatcacacgcagaccgcgggtccctggcacctgggcaagctcgagatggacttcgacttctgcgaggggaccactgtggtcgtgacggaggactgcggcaaccggggccccagtctgcgcaccaccactgcgagcggcaagctgatcacggaatggtgctgccggtcctgcaccctgccacccctgcgctaccggggcgaggatggatgctggtacggcatggagatccgccccctgaaggagaaggaggagaacctggtgaacagcctggtcaccgccgggcacggccagatcgacaatttcagcctgggcgtgctcgggatggctctgtttctggaagagatgctccggacccgcatcggcacgaagcacgcgatcctgctggtggccgtctctttcgtgaccctaatcactgggaatatgtctttccgggacttaggccgcgtgatggtaatggtcggggccaccatgacagacgacatcggcatgggcgtgacatacttagccctcctggctgcgtttaaggtccgccccaccttcgccgccgggctgctcttacggaagctgacgagcaaggagctcatgatggccacgatcggcatcgccctgctgtcccaaagcaccatccccgagaccatcctagagctgaccgacgctctcgccctcgggatgatggtgctgaagatcgtgcgcaacatggaaaagtaccagctagccgtcacgatcatggcaatctcctgcgtgcccaacgccgtgattctccagaatgcttggaaggtcagctgcactatcctggccgccgtgtcagtcagtcccctgctcctgacctccagccagcagaaggccgactggatccccttagcgttaaccatcaagggcctgaacccgacggccatcttcctgaccaccctctcgcggacaagcaagaagcgctcctggccgctcaacgaggccatcatggccgtgggcatggtgagcatcctggcctccagcctacttaaaaacgacatccccatgacaggccccctggtagcgggcgggttgctgacagtgtgctacgttctgactggccggagcgccgatctcgagctggagcgggccgccgacgtcaagtgggaggaccaggccgagatctccgggtcatctcccatcctgagcatcatcatctccgaggacggcagcatgtccatcaagaacgaggaggaggaacagaccctcacaatcctgatacggaccggcctgctcgtgatatcaggcgtgttcccggtctccatccccatcaccgcggccgcctggtacctgtgggaggtgaagaaacagcgcgccggcgtgctctgggacgtcccctccccgccgcccgtggagaaagccgagctagaggacggggcgtatcggattaagcagcgcggcatcctgggttactcccagatcggcgccggcgtgtacaaggaggggaccttccacaccatgtggcacgtcactcggggcgccgtgctaatgcaccgcggtaagaggattgaaccaagctgggccgacgttaagaaggacttgatctcctatggcgggggctggaagctggagggagagtggaaggagggggaagaggtccaggttttagccctcgagcccggtaagaaccctagagccgttcagaccaagcccgggatcttcaaaaccaataccggcactattggggccgtcagcctggacttctcccccggtacgagtggctcccccatcgtagatcgtaaagggaaggtggtcggcctgtacgggaacggcgtggtgacccgcagcggggcctacgtctcagccatcgcgcagaccgagaagtcaatcgaggataaccccgagatcgaggacgacatcttccggaagaagagactcacgattatggacctgcaccccggggccggcaagaccaagcgctacctacccgctatcgttcgtgaggccattaagcgggggctccgcaccctgatcctggccccgacccgcgtagtcgcagccgaaatggaggaagcgctaaggggcctccccatccgctaccaaacgccggccatcaagaccgagcacaccgggcgggagatcgtggacctgatgtgccacgccaccttcacgatgcgcttactcagccccgtgcgggtcccgaactacaatctgatcatcatggacgaggctcacttcaccgaccccgcctccattgccgcacgcgggtacatctctacccgggtcgagatgggcgaggccgcggggatcttcatgaccgccacgccgcccggctcccgcgacccgttcccccagagcaatgcccccatcatggacgaggaacgggagatccccgagcgctcctggaactccgggcacgagtgggtgacggacttcaagggtaagaccgtctggttcgtgccgtccatcaaggccgggaacgacattgcggcctgcctgcggaagaacgggaagaaagtgattcagctcagcaggaagacctttgactcagagtacgtcaagaccagggccaacgattgggacttcgtagtgaccacggacattagcgagatgggagccaacttcaaggccgaacgcgtcatcgatccccggcgctgcatgaagcccgtgatcctgactgatggagaggagcgggtgatactggcgggccccatgccggtcacccactccagcgcggcccagaggcgggggcgcatcggccggaacccgaagaacgaaaacgaccagtatatctacatgggtgagcccctcgagaacgacgaggactgcgcccactggaaggaggccaagatgctgctggacaatatcaacacccccgagggcatcattccgtccatgttcgagcccgagcgggagaaggtggacgcgatcgacggcgagtaccgcctccgcggggaggcgcgcaaaaccttcgtggacctgatgcgacgcggcgacctgcccgtctggctcgcctacaaggtggccgctgagggcatcaactacgcggaccggaagtggtgcttcgacggcatcaagaacaaccagatcctggaagaaaacatggaggtggagatttggacgaaagagggggagcgcaagaagctgaagccgcggtggttggacgccagaatctacagcgatcccctggccctgaaggagttcaaggaatttgccgcgggccggaagtccctcacgctcaacctaatcaccgagatgggccgcctgcccaccttcatgacccagaaggcccggaacgccctggacaacctagcggtccttcacaccgccgaggctgggggccgcgcctacaaccacgccttaagcgagctgcccgagaccctcgagacactgctgctgctgaccctgctcgccacggtgacgggagggatcttcctgttcctgatgtccggcaaggggatcggtaagatgaccctcgggatgtgctgcatcatcacggccagcatcctgctgtggtacgcgcagatccagccgcactggatcgccgcttccatcatcttagagttctttctgatcgtccttctcatcccggaaccagagaagcagcggacgccccaggacaaccagctgacgtacgtggtgatcgccatcttgaccgtcgtggccgcgaccatggccaacgagatgggtttcttagagaagaccaagaaggacctggggctgggcagcatcacgacacaagaaagcgagtccaacatcctcgatatcgacctgcgcccggccagcgcctggaccttatatgccgtggcgaccacgtttgtcacgcccatgctccgccactccatagagaacagctccgtgaacgtaagcctgaccgccatcgccaaccaggccaccgtcctgatgggcctcgggaagggctggcctctgtccaaaatggacatcggggttcccctcctcgcgatcggctgctactcacaggtgaatccaattaccttaaccgccgccctgctcctgctggtggcccactacgccatcatcgggccgggcctccaagcgaaagccaccagggaggcccagaagcgggccgccgcgggcatcatgaagaatcccaccgtggacgggatcaccgtgatcgacttagagcccatcccatacgaccccaaatttgagaagcaacttggccaggtcatgctcctaatcctgtgtgtgacccaggtgctcatgatgcgcaccacctgggccctgtgcgaggccctgacgctcgctactgggcccattagtaccctgtgggagggaaaccccggacggttctggaacaccacaatcgccgtcagcatggcgaacatcttccgcggcagttacctggccggcgccgggctcctgttcagcattatgaagaacaccacatcaactcgccggggcaccgggaacatcggcgagaccctgggcgagaagtggaagtccaggctaaacgccctggggaagtccgagttccagatctacaagaagtccggaatccaggaggtggaccggaccctggcgaaggaggggataaagcgcggtgagaccgaccaccacgccgtgtcccgggggagcgccaagctccgttggttcgtcgagagaaacatggtgacaccggagggcaaggtggtcgacctgggctgcgggcgtggcgggtggtcctattactgcggagggctgaagaacgttcgggaggtgaagggcctcaccaagggcgggcccggacacgaggagcccattcccatgagcacatacgggtggaacctcgtacgcctgcagtcaggcgttgacgtcttcttcaccccgccagagaaatgcgacacgctcctgtgtgacattggggagtccagccccaaccccaccatcgaggccggacgaaccctgcgcgtcctcaacctggtggagaactggctgaacaacaacacccaattctgcatcaaggtgcttaacccgtacatgccctctgtcatcgaaaaaatggaggccctgcagcggcagtacggcggtgcgctggttagaaaccccctcagccggaactccacccacgagatgtactgggtaagcaacgccacgggcaacatagtctcaagcgtgaacatgatctcccgcatgctgatcaaccggttcaccatgaagcacaagaaggctacctacgagccggacgtggacctggggtcaggcacccgcaacatcgggatcgagtccgagatccctaacctagacatcatcggcaagcggatcgagaagatcaagcaagagcacgagattagctggcactacgaccaggatcacccctacaaaacctgggcctaccacggctcctacgagaccaagcagaccgggagcgcctcctccatggtcaacggcgtggtacgcctcctgaccaagccctgggacgttgtgccgatggtgacgcagatggcaatgaccgacaccaccccctttgggcagcagcgcgtcttcaaggagaaggtggacacgcgtacacaggagcccaaggagggtaccaagaagctgatgaagatcaccgctgagtggctttggaaggagctgggcaagaagaagactccccgtatgtgcacccgggaagagtttacaaagaaggtgcgctccaatgccgccctgggtgctatcttcaccgatgagaacaagtggaagtccgcgcgggaggccgtcgaagacggccgcttttgggagctcgtggaccgtgaacgcaacctgcacttggaggggaagtgcgagacgtgcgtgtataacatgatgggcaagcgggagaagaagttgggggagttcggaaaggccaagggctcccgcgcaatctggtacatgtggctgggggcgcgcttcctggagttcgaggccctcggcttcctgaacgaggatcactggttcagccgcgggaacagcctgtccggcgtcgagggggaggggctccacaggctgggctacatcctgcgtgacgtggggaagaaggagggcggggccatgtacgcggacgacaccgccggctgggatacccggatcaccctcgaagatctgaagaacgaagaaatggtcacgaaccatatgaagggcgagcacaagaagctggcggaggccatcttcaagctcacctaccagaacaaggtggtgcgcgtccagcgcccaacgccacgcggcacggttatggacataataagccggcgcgaccagcggggttccgggcaggtcggcacttacggtctgaataccttcaccaacatggaggcccagttaatccgccagatggagggcgagggaattttcaagagcatccagcacctcaccgccacggaggagatcgccgtccagaactggctggcccgcgtggggcgggagcgcttatcccggatggccataagcggcgacgactgtgtcgtcaagcccattgacgaccgcttcgcctccgctctcaccgccctgaacgacatggggaaggtgcgtaaagacattcagcagtgggagcccagtcgcggctggaacgactggacccaggtgccgttctgctcccaccacttccacgagctggtcatgaaggacgggcgagttctcgtggtcccctgccgaaaccaggacgaactgatcggccgggcgcgcatcagccagggcgccgggtggtctctgaaggagaccgcctgcctaggcaagagctacgcccagatgtggaccctgatgtacttccaccggcgcgacctgcggcttgccgcgaacgccatctgctccgccgtacccagccactgggtgccgaccagtcgcactacctggagcatccacgctaagcacgagtggatgaccacggaggacatgctggcggtctggaaccgggtgtggattcaggagaacccgtggatggaggacaagacgcccgtggagagttgggaggaggtcccgtacctgggaaagcgcgaggaccagtggtgcggctcactcatcggattgacaagccgggccacctgggccaagaacatccagacggccatcaaccaggtcagatccctgatcggcaacgaagagtacaccgattatatgcccagcatgaagcgttttcgccgcgaggaggaggaggccggcgtgctctggtaa

SEQ ID NO: 25025 - RNA, 9876 nt, synthetic construct
  misc_feature 1..9876: note = derived and/or modified CDS sequence (opt11) from DENV-2__FJ547090__SS-prME
  source 1..9876: mol_type = other RNA
accgccggcgtgatcgtaatgctcatccccaccgcaatggcattccaccttaccacaagaaacggggagccacacatgatcgtgggacgccaggagaaggggaagtccctgttattcaagaccgaggacggcgtgaatatgtgcactctcatggccattgatctgggggagctatgcgaggacacgatcacctacaagtgccccctcctgcgtcagaacgagcccgaggacattgactgctggtgcaacagcaccagcacgtgggtcacctacgggacatgcactaccacgggcgaacaccggcgcgaaaagcgctccgtggccctggtgccccacgtcggaatgggtctcgaaacccgcactgagacttggatgagcagcgaaggtgcatggaagcacgtgcagcggatcgagacctggatcctgagacaccccggcttcaccatcatggctgctatactggcctacacgatcgggaccacgcattttcagcgggcccttatcttcatcctattgaccgccgttgccccaagcatgaccatgcgctgtattggcatctcaaaccgggatttcgtggagggggtgagcggaggcagctgggtggacatcgtcctcgaacacgggtcgtgcgtgaccactatggcgaagaacaaacccacccttgactttgagctgatcaagaccgaggccaagcagcccgccaccctccgaaagtactgcatagaagccaagctaaccaataccaccaccgagagccgttgcccaacgcagggcgagcccagcctgaacgaggaacaagacaagcgcttcatatgcaagcactccatggtggatcggggctggggaaacggctgcggtttatttggcaagggtggcatcgtcacgtgcgcgatgttcacctgcaagaagaatatggagggcaaggtggtacagcccgaaaacctcgaatacaccatcgtcattacgccccatagcggggaggagcacgccgtgggcaacgacaccgggaagcacggcaaggagatcaagatcaccccgcagtccagtatcacagaagccgaactgaccgggtatggtacggtgacgatggagtgtagcccccggaccggcctcgacttcaacgagatggtcctgctacagatggaggacaaggcctggttggtgcaccggcagtggttcctcgacctgcccctcccatggctgccgggtgctgacacccaaggcagcaactggatccaaaaagagacgctggtgaccttcaagaacccacacgcgaagaagcaggacgtcgtggtactcgggtcccaggagggcgccatgcataccgccttgaccggggccacggagatacagatgagcagcggcaacctcttgttcacaggccatctaaagtgccggctccgtatggacaagctccagctcaaggggatgtcctacagcatgtgcaccggcaagttcaagatcgtaaaggagatcgccgagacccagcatgggacgatcgtgatccgcgtccagtacgagggggatggcagtccctgcaagatcccctttgagatcaccgacctggagaagcggcacgtgctcgggcgcctgatcaccgtgaatccgatcgtcaccgaaaaggatagcccggtgaatatcgaggctgagcccccttttggggactcctacatcatcatcggcgtggagccgggccagcttaagttaaattggtttaaaaaggggagctctatcggtcaaatgttcgagacgactatgcgcggtgccaagcggatggcaatcctgggggataccgcctgggatttcggaagcctcgggggggtgtttaccagtatcgggaaggcactccaccaggtgttcggcgccatttacggcgcagcattctctggggtatcctggacgatgaagatcctgattggcgtcataataacctggatcgggatgaacagccggtccaccagcctgtccgtgtcactggtgctcgtcggcgtggtgactctgtacttgggcgctgtcgtgcaagcggactccggctgtgtagtgagctggaagaataaggaactcaagtgtggctccgggatcttcatcacggacaacgtgcatacatggaccgaacagtataagtttcaacccgaatctccaagcaagctggcgtcagcaattcagaaggctcacgaggagggcatttgcgggatacggtcggtgaccaggttagaaaatctaatgtggaagcagatcacgcccgagctgaaccacatcctttccgagaatgaggtcaagctaacaatcatgaccggcgacatcaaggggatcatgcaggccggcaagcggtcgcttcgcccgcaacccaccgagctaaagtactcatggaagacatggggcaaagctaagatgttgagcaccgagtcccacaaccaaacattcctgatcgatgggcccgagaccgccgagtgccccaacaccaaccgggcgtggaacagcctggaggtggaggactacgggttcggggtgttcaccacaaacatctggctcaagctgcgcgaaaagcaggacgtcttctgcgacagtaagctgatgagcgccaccattaaggacaaccgtgccgtgcacgcggacatggggtactggatagagtccgccctcaacgatacctggaagatggagaaagccagcttcatcgaggtcaaatcctgtcactggcccaagagccacacgctgtggtccaacggcgtactggagagcgaaatgatcatccccaaaaactttgctgggcccgtgtcacagcacaactaccgcttaggctatcacacacagaccgccgggccgtggcacttaggcaagctggagatggacttcgacttctgcgaggggaccacggtggtcgtgactgaagactgcggcaatcgggggcccagcctccgcacaaccacggcgagcgggaagctgatcaccgaatggtgttgtcggtcctgcaccttgccaccactgcgctaccggggtgaagacggctgctggtacgggatggagatccgccccctgaaggagaaagaggagaacctagtgaacagcctagtcaccgcagggcatggccaaattgacaatttttccttaggcgtgctggggatggcccttttcctggaggagatgttgcggacacgcatcggcaccaagcacgctatcctcctggtagcggtcagctttgtgaccctgatcaccggaaacatgtccttcagggacctcggccgagtgatggtcatggtgggagctacaatgaccgatgatattgggatgggcgtgacctatttggcactgcttgccgccttcaaggttaggcccacgttcgcggcagggctgctgttacggaaactgacgagcaaggagctgatgatggctacgatcggcatcgcgctcctgtcccagagcacgatacccgagaccatcctggaactgacggacgccctagcgctggggatgatggtgctcaagatcgttcgcaacatggagaagtaccagctggctgtcaccatcatggcgatctcatgcgtgcccaatgcggttatcctgcagaacgcctggaaagtcagctgcaccatcctcgcggccgttagcgtcagcccgttactgctcacctccagccaacagaaagccgattggatccccctggccctgacaatcaaaggcctcaaccccaccgcgatattccttaccaccctctcccggacgagcaagaagcgctcctggccactcaacgaggccatcatggccgtgggcatggtgagcatcttagcatccagcctgttgaagaatgacatccccatgaccggtcccctggtcgccggcgggttgctcacagtgtgctatgtcctgaccggacggagcgctgacttagagctcgagagggccgctgatgtcaagtgggaggaccaggccgagatctccgggtcgagtcccatcctgtcgatcacgatctccgaggacggatctatgtcaatcaaaaacgaagaggaggagcaaaccctgaccatcctcatacggaccggcctgctggtgatcagcggcgtgttccccgtcagcatccccataacggccgcagcttggtacctctgggaggtgaagaagcagcgcgccggggtgctgtgggacgtcccttctccgccgcccgtggagaaggccgagctagaggacggggcataccggataaagcaacgcggcatactcgggtactctcaaatcggagcgggcgtgtataaggaggggacattccataccatgtggcacgtcacccggggcgccgtgctgatgcatcgcggtaagcggatcgagcccagctgggccgacgtgaagaaggacctgataagctacggcgggggctggaagctcgagggcgagtggaaagagggtgaggaggtccaggtgctggccctcgagcctggtaaaaatccacgcgccgtgcagactaagcccgggatcttcaagacgaataccggcaccatcggggcggtctccctcgatttctcccccgggaccagcggttcgccgatcgtggaccggaaggggaaagtagtcggcctgtacgggaacggcgtggtgacgcgtagcggggcctacgtctccgccatcgcgcagaccgagaagtctatcgaagacaacccggagatcgaggacgatatttttcggaagaagcgcttaaccatcatggatctccaccctggggcggggaagaccaagcggtatctgcccgctatcgtgcgcgaagccataaagcggggcctacgcacgctgatcctcgcccccacccgcgtggtcgccgctgagatggaagaggccctgcgtggcctcccgatccgctaccagacccccgccataaagaccgagcacacggggcgggagatcgtggacctcatgtgccatgccaccttcaccatgcgcctgcttagccctgtgcgggtcccaaactacaacctcattatcatggacgaagcccacttcaccgatccggcttctatcgcggccagaggctacataagcacgagagtggagatgggggaggccgccgggatattcatgaccgcgacgccccccgggtcccgcgaccccttcccgcaaagcaacgcccccattatggacgaggagagagagatccccgagcgcagctggaacagcgggcacgagtgggtgactgacttcaagggcaagacagtctggttcgtgccgagtatcaaggccgggaacgacatcgccgcgtgcctccggaagaatggcaagaaggtgatccagttaagtcgcaagacctttgactccgagtacgtcaagacccgggccaatgactgggactttgtggtgaccactgacatcagcgaaatgggcgccaacttcaaagccgagagggtaatagacccacggcgctgcatgaaacccgtgatactcaccgatggggaggagcgcgtgatcctggctggacccatgcccgttacccacagctccgcggcccaacgacgggggcgcatcggccgcaacccaaagaacgagaatgaccagtacatctatatgggcgagcccctggaaaacgacgaggattgcgcacactggaaggaggccaagatgctcctggataacattaatacccccgagggtataatcccttcgatgttcgagccggagcgcgaaaaggtggacgccatcgacggcgagtaccgcctgcgcggggaggcacgcaagacgttcgttgacctcatgaggcgtggcgacctacccgtctggctggcctacaaggttgccgccgaggggatcaactacgcggaccgtaagtggtgcttcgacggcattaagaacaaccagatactcgaggagaacatggaggtggagatctggactaaagagggggagcgcaaaaaactgaaaccccggtggctggacgctcgcatctacagcgacccgctggcccttaaagagttcaaggagttcgctgccggccgtaagtcactgaccctcaacttaatcactgagatgggaagactgccgactttcatgactcagaaggcgaggaacgccctcgacaatctagcggtcctgcacaccgctgaggccggcggtcgcgcgtacaaccacgctctctctgagcttccagagaccctagaaacgttgctgctgctcacgctgctggcgaccgtgacagggggcatattcctcttcctgatgtccggcaagggtattggcaagatgacgctggggatgtgttgcatcataactgccagcatcctgctgtggtatgcccaaatccaaccccattggattgctgccagtattatattggagttctttctcatcgtcctgctgattcctgagcccgagaagcagcggacgccccaggacaaccagcttacatacgtggtgatcgccatcctgaccgttgtagccgccacgatggcgaacgagatgggcttcctggagaaaaccaagaaggatctcgggctgggctctataacaacccaggagtcagagtccaacatcctggacatcgacctccgccctgccagcgcgtggacgctatacgctgtggccaccacattcgtcacccccatgttacggcactccatcgagaacagctccgtgaatgtgagcctcacggcgatcgccaaccaggccaccgtcctgatgggcctgggaaaagggtggcccctctccaaaatggacatcggggtgcccctgctggccatcggctgttacagccaggtgaacccgatcactctcacggctgcccttctgctgttagtcgctcactacgcaatcataggcccgggtctgcaggccaaggcaacgcgggaggcccaaaaacgggccgccgcaggcatcatgaagaacccaaccgtggacgggatcactgtgatcgatctcgaacctattccctacgacccgaagtttgagaagcagctgggccaggtcatgctgctcatcctgtgcgtgacccaagtgctgatgatgcgcacgacctgggcgctctgcgaggcgctgaccctagccaccgggcccatctccacactctgggagggcaacccagggcgtttctggaataccacgatagccgtcagcatggccaacatcttcagaggctcctacctggcgggagccgggttgctcttcagtatcatgaagaacacaacgtccactaggcggggcaccgggaacatcggcgaaaccctgggcgagaagtggaaaagccgcctgaatgccctcggcaagtctgagttccagatttacaagaagtccggcatccaggaggtggaccggacgctggccaaggaggggataaagcgcggcgagaccgatcaccacgctgtgtcccggggtagcgccaagctgcgctggttcgtcgagcggaacatggttactcccgaaggtaaggtggttgacctcggatgcgggcgcggagggtggtcatactactgtggcgggcttaagaacgtgcgggaggtcaagggcctgactaaaggcgggcctggccacgaggagccgattcccatgagcacgtacgggtggaacctcgtccgcttgcagagcggcgtggacgtgtttttcacgcctccggaaaagtgcgacaccctgctgtgtgacatcggggagagttcgcccaaccccacaatcgaggctggccggactctgcgcgtcctgaacctcgtggagaattggttgaacaacaacacgcagttctgcattaaggtactgaatccgtacatgccatccgtgatagagaagatggaggcactccagcggcagtatggtggagccctggtgcgcaaccccctctctcggaactccacccacgaaatgtactgggtaagcaacgcgaccggcaacatcgtctcctctgtgaacatgatctcccgcatgttgataaaccggttcacgatgaagcacaaaaaggccacgtacgagcctgacgtggatctcgggtcgggcacccgcaacatcgggatcgagtccgagatccccaacctggatatcatcggcaagcggatcgagaagatcaaacaggagcatgagatcagctggcactatgaccaggaccacccctacaagacatgggcctatcacggctcctacgagaccaagcagacgggttcggcctccagcatggttaacggggtggtgcgcctactcaccaagccctgggacgtcgtgcccatggtgacgcagatggccatgaccgacacgacaccgtttgggcagcagcgcgttttcaaggagaaagtagatactcggacacaagagcccaaggagggcacgaagaagctgatgaagataacggcggagtggctgtggaaggagctcggcaagaagaaaacgccccgcatgtgcacccgggaagagttcacgaagaaggtgcgctcgaatgccgccctgggggccatcttcaccgacgagaacaagtggaagtccgcccgggaggccgtcgaggacggccgcttctgggagctggtggaccgggagcgtaatttacatctcgaaggcaagtgcgagacgtgcgtctacaacatgatggggaagcgggaaaagaaactgggagagttcggcaaggctaagggctccagggccatctggtacatgtggctcggggcccggttccttgagtttgaggcgctgggctttctcaacgaagaccattggttcagccgcgggaacagcttatccggtgttgagggggaaggactgcaccgactcggctatatcctgcgcgacgttgggaagaaggagggcggagccatgtacgccgacgacaccgctggttgggatacacggatcaccctggaggacctcaaaaacgaagagatggtaaccaaccacatgaagggggagcacaagaagctggcggaggcaatattcaaacttacctaccagaacaaggtggtgcgggtccaacggcccacgccacgcggcaccgtgatggacatcatcagccggcgcgaccagcgaggctccgggcaggtcggcacatacggactgaacaccttcaccaatatggaggcgcaactgatccgccaaatggagggcgagggcatctttaagagcatacagcacctgaccgcaaccgaggagatcgcagtccagaactggctcgcccgcgtggggcgggaacgcttgtcccggatggcgataagcggcgacgactgtgtcgtcaagcccatcgacgaccgctttgcctccgccctgaccgctttgaatgacatggggaaggtgcggaaggacatccagcagtgggagcccagccgcggctggaacgactggacacaggtgccgttctgttcccaccacttccacgagctggtcatgaaggacgggcgggtacttgtggtcccatgccggaaccaggacgagttaattggccgggctaggattagccagggggcggggtggagcttgaaggagacggcctgcctggggaaaagctacgcacagatgtggactctcatgtacttccaccggcgcgacctgcggctggccgctaacgcgatctgttctgccgtacccagccactgggtccccacctcccgcaccacgtggagcatccacgccaagcacgaatggatgaccacagaggacatgctcgccgtctggaaccgggtgtggatccaagagaacccttggatggaggacaagaccccggtcgagtcgtgggaggaagtcccgtacctggggaagcgcgaggaccagtggtgtgggagcctgatcgggctcacgagccgtgcgacctgggccaagaatatccagactgccatcaatcaggttcgctccctgatcggcaacgaggaatacacagactacatgccaagcatgaagcggttcaggagggaagaggaggaggccggtgtcctttggtga

SEQ ID NO: 25026 - RNA, 9876 nt, synthetic construct
  misc_feature 1..9876: note = derived and/or modified CDS sequence (opt11) from DENV-2__EU482630__SS-prME
  source 1..9876: mol_type = other RNA
accgctggggtgatcgtgatgctcatcccaaccgctatggcgttccacctcactacccgcaacggggagccacacatgatagtgggacggcaggagaaagggaagtccctactgttcaagaccgaggacggagtgaacatgtgcaccctcatggccatcgacctaggggagctgtgcgaggacaccatcacctacaagtgtcccttcctacggcagaacgagcccgaggacatcgactgttggtgcaacagtaccagcacctgggtcacctacgggacctgcaccactacgggagagcaccggcgcgagaagcggagcgtggccctggtgccacacgtcgggatgggactagagaccagaactgagacgtggatgtcgagcgagggggcctggaagcatgtgcagcggatcgagacatggatcttacgccacccgggtttcaccatcatggcagcaatcctggcctacaccatcggaaccacgcatttccagcgggccctgatctttattctcctgaccgcggttgcccccagcatgacaatgcgctgcatcggaatctcaaacagagacttcgtcgagggcgtgagcgggggcagctgggtggacatcgtccttgagcacggtagctgtgtgacgacgatggctaaaaataagccgaccttggacttcgaacttatcaagaccgaggcgaagcagcccgccaccctgcgcaaatactgtatagaggctaagctcacgaacacgactacagagagtaggtgcccgacccagggcgagccgagtctgaacgaggagcaggacaagcgcttcatctgcaagcactccatggtggatcggggctgggggaacggctgcgggctcttcggcaagggtggcatcgtgacctgcgcgatgttcacctgcaaaaagaacatggagggaaaggtagtgcagccagagaacttggagtatacgatcgtcataacgccccacagcggggaagaacacgccgtgggcaacgacaccgggaagcatggcaaggaaatcaagataaccccgcagtccagcatcaccgaggccgagctcactgggtacggcacggtgactatggagtgcagcccccgtacaggcttagacttcaacgaaatggtcttactgcagatggaggataaggcttggctggtgcatcgccagtggttcctcgacctgcctctgccctggctaccgggggcagatacccagggatcaaactggatacagaaggagacgctggtgaccttcaagaacccccacgcgaagaagcaagacgtcgtggtcttagggtcccaggagggcgcgatgcacactgcattaacgggggccacggaaatccagatgtcaagcggcaacctactattcaccggccatctcaaatgccgcttacgtatggacaaactgcagctcaagggtatgtcatatagcatgtgcacaggcaagttcaagatagtgaaggagatcgccgagacccagcacggaacaatcgttatccgggtccagtacgagggtgacggtagcccctgtaagatcccctttgagattaccgacctggagaagagacatgtgctgggacgcctcatcacggtcaaccccatcgtcaccgagaaggacagccccgttaacatcgaggcggaaccgcccttcggggactcctacatcatcattggcgtagagccgggtcagttaaagctaaactggtttaagaaagggagcagtatcgggcaaatgtttgagacgaccatgcgcggcgccaaacgtatggccatcttaggggacaccgcctgggacttcggcagcctaggtggagtatttacgtcgatcggaaaggccctgcatcaggtgttcggagccatctacggcgctgccttcagcggtgtgtcgtggacgatgaaaatactcattggcgttatcatcacatggatcgggatgaactcgcgctccaccagcctgtccgtgagtctggttctcgtcggcgtagtgaccctctacctaggggccgtcgtccaggccgactctggctgcgtggtctcgtggaagaacaaggagctgaagtgcggctccgggatattcatcaccgataacgtccacacttggaccgagcaatacaagttccagcccgaaagccccagtaagctcgcctctgccatccaaaaggcacacgaggaggggatctgcggtatccgtagcgtcacccgcctggagaacctgatgtggaaacaaatcactccggagctcaatcatatcctgtccgaaaacgaggttaagcttaccatcatgaccggcgatatcaaggggatcatgcaggccggcaagcgaagtctcaggccgcagcccacagaattgaagtactcctggaagacgtggggcaaggcgaagatgctgagcacagagtcccataatcaaaccttcctcatcgacgggccagaaaccgcggagtgtcctaacaccaaccgggcctggaattcattggaggtggaggactatgggtttggggttttcaccaccaacatctggctgaaactacgcgagaaacaagacgtattctgcgactcaaagttaatgagcgccgccatcaaagacaaccgagcggtacacgcggacatgggctactggatcgaatccgccctgaacgacacctggaagatggagaaggccagtttcatagaggtgaagtcctgtcactggcccaaaagccacacgctctggtccaacggcgtcctggaaagcgagatgattatccccaagaacttcgcggggcccgtgtcccaacacaactaccgcccgggctaccacacgcagacggccgggccctggcacctgggtaaactcgaaatggacttcgacttctgcgaaggtactaccgtggtggtcacagaggactgcgggaaccggggcccaagtctgcgcaccaccacagcaagtggaaagctgatcacggagtggtgttgtcggtcctgcaccctgccgcccctgcgctacaggggcgaggacgggtgctggtacggtatggagataagacccctaaaggagaaagaggagaacctcgtaaactcgctggttaccgccgggcacggacagatcgacaacttctccctgggcgtgcttgggatggccttattcctggaggagatgttgcggacacgcatcggcacgaaacacgcgatccttctagtggccgtaagctttgttacgttaatcaccggaaacatgtcgttccgggatctgggccgcgtgatggttatggtgggggccaccatgacggacgacatcggcatgggcgtcacgtacctggccctcctagccgcgtttaaggtccgacccaccttcgctgccgggctcctactgaggaagttgacgagcaaggagctcatgatggccacgatcggaatcgccctgctgtcccagtctacgatccccgagaccatcctcgaactgaccgacgcgctggccctcggtatgatggtactcaagatcgtgcggaacatggagaagtaccagctggccgtcacgatcatggcgatctcctgcgtgcctaacgcagtgattctccagaacgcttggaaggtcagctgcaccatacttgccgccgtctccgtcagccccctgctcctcacatccagccagcagaaagcagactggatacccctggcgctgaccatcaagggcctgaaccccacggccatcttcctcaccaccctctcgcggacgagtaagaagcgctcctggcccctgaacgaggcgataatggccgtgggcatggtgagcatcctggcctcctcactccttaagaacgacatccccatgacgggtcccctcgtcgcgggtgggctgctgactgtttgctatgtgctgaccggtcggtcggccgacctagagctagagcgggcggctgatgtcaagtgggaggatcaggccgagatcagtgggtcatccccaatcttgtctatcacgatctccgaggacggcagcatgtccatcaagaacgaggaggaggagcagacgctcaccatcctaattcggaccggcctactggtgatttcaggggttttcccagtctccatccccatcaccgcggccgcctggtacctgtgggaggtgaagaaacagcgcgctggcgttctttgggacgtcccctcccctccgcccgtcgagaaggccgaactcgaggatggggcgtatcgcataaaacagagaggcattttgggatattcccaaattggcgccggggtgtataaggaagggaccttccatacgatgtggcatgtcacccggggcgccgtgctgatgcaccgtggcaaacggatagaacccagctgggcggacgtgaagaaggatctcatctcgtatggcgggggctggaaattggagggcgaatggaaagagggtgaggaggtccaggtgctggccctggagcccgggaagaacccccgcgcggtccaaacaaagcctgggatcttcaagaccaacacgggcacaattggggcggtcagcttggacttctcccccgggactagcggctccccaatcgtggaccggaaggggaaggtggtaggcctgtatgggaatggcgtggtgacccgcagcggcgcgtatgtctccgccattgcgcaaacggaaaagtccattgaggacaaccccgagatcgaagatgacatattccggaagaaacgcctcaccatcatggacctgcacccgggggccggcaaaactaagcggtacctccccgcgattgtgcgagaggcgatcaagcgggggctccgcacactgatactggccccgacgcgggttgtcgccgccgagatggaggaagccctgcggggccttcccatacgctatcagacccctgccatcaagactgaacacaccgggcgggagatcgtggacctgatgtgtcacgctacgttcacgatgcgcctactcagtcccgtaagagtcccgaactacaacctgatcataatggacgaagcgcatttcaccgacccagcctccatcgcggcacgcggctacattagcacccgggtagagatgggcgaggcggcggggatcttcatgactgccacgccgcccggctcccgtgacccgttcccccagagcaacgcccccatcatggacgaagaacgggaaatccccgagcggtcctggaacagcgggcacgagtgggtgaccgacttcaaggggaagaccgtttggttcgttccgagcatcaaggccgggaacgacatcgcggcctgcctgcgaaaaaacggcaaaaaggtgatccagctctcccggaaaacttttgactccgagtacgtcaagacgcgggctaacgactgggacttcgtggtcaccaccgacatctcggaaatgggcgccaatttcaaggccgagcgggtcatagacccccggaggtgcatgaagccagtgatcctgactgacggggaagagcgggtgattcttgcaggccccatgcctgtcacccactccagcgccgcccaacggagaggacgcatcggccgcaacccgaagaacgagaacgaccagtacatttacatgggggagccgctcgagaacgacgaggattgcgcgcactggaaagaggcaaagatgctgctggataacatcaacaccccggagggtattataccgtccatgttcgagcctgagcgggagaaagtggacgccatcgatggcgagtatcgactccgcggggaagcgcgcaagacattcgtggaccttatgaggcgtggcgacctacccgtgtggctcgcgtataaggtggctgcggaagggatcaattatgccgacagaaagtggtgcttcgacggcatcaagaacaaccagatcctggaagagaacatggaggtagagatctggacaaaggagggggagcgcaagaagctgaagccacggtggctggacgcccgcatctacagcgaccctctggccctgaaagagttcaaggagtttgccgcgggccgaaagtccctcaccttgaatctgatcaccgagatgggccgcctccccaccttcatgacacagaaggcacggaacgccctggacaacctggccgtcctccacaccgccgaggccggcggcagggcctacaaccacgcacttagtgagctgccggaaaccctcgaaaccctgctgttgctgacgctgctcgccacggtaaccggaggcatcttcctgttcttgatgtctggcaaggggatcggaaagatgaccctcgggatgtgctgcatcatcacagccagcatcctcctgtggtatgcgcagatccaaccgcattggatagccgcctcaataatcctcgagtttttcctgatcgtcctcctcatccccgagcccgagaaacagcggaccccccaggacaaccagctgacttacgtggtgattgccatactcaccgtagtggccgcgaccatggcaaacgaaatgggcttcctcgagaagacgaagaaggacctggggctgggcagtataaccacccaagagagcgagtcgaacatcctcgacatcgatctgcgtcctgcctcggcgtggaccttgtatgccgtagcaacgactttcgttacgccaatgctccggcattccatcgagaatagttcagtgaacgtaagcctgacagccattgctaaccaggccacagtactgatgggcctcgggaagggctggccgttatccaaaatggatatcggagttcccctgctggcgatcgggtgctacagccaggtaaacccgataaccctgaccgcagccctcctcttactggtcgcgcactacgccatcatagggccgggcctccaggcgaaagccacacgcgaggcccagaaacgggccgccgcgggtatcatgaagaatcccacggtggatggaatcacagtcatcgatctggaacccatcccgtacgatcccaagttcgagaagcagctgggtcaagtcatgttactgattctgtgcgtgacccaggtgttaatgatgcgtaccacgtgggccctgtgcgaagccctaacactcgccaccgggccaatttccaccctgtgggagggcaaccccgggaggttctggaacacgaccatagcagtcagcatggctaatatcttcagaggctcctacttggcaggcgccggtctactgtttagcattatgaagaacaccacctccacgcgccgtggcaccggtaacatcggcgagacacttggcgagaagtggaagtcacgcctcaacgccttggggaagtccgagttccagatatacaagaagtccggcattcaggaagtggatcggacgctagcgaaggagggtatcaagcgcggcgagaccgaccaccacgccgtttcccggggatcggccaaattacgttggttcgtcgagagaaacatggttaccccggagggaaaggtggtcgacctggggtgcgggcgcggcgggtggtcctactactgtggcgggctgaagaacgttcgcgaagtgaaaggcctgaccaagggcggccccggccatgaagagcccattcccatgagcacgtacgggtggaacctggtccgccttcagagcggcgtggacgtgttcttcacgccgcctgagaaatgcgacaccctcctgtgcgacataggtgaatcctcgcccaaccccaccatcgaggcaggcaggacgctgcgcgtcctcaatctggtggagaactggcttaacaacaacacccagttttgcatcaaagttctcaatccgtacatgccctccgttatcgagaaaatggaggccctacagcggcaatacggcggcgcactagtgcgcaaccccctctcccgaaattctacccacgagatgtactgggtgagcaacgctaccgggaacatcgtctccagcgtgaacatgatcagccgcatgctgattaaccgttttacgatgaagcataagaaggccacctacgagcccgacgtggacctggggagcggtacccgcaacattggtatcgagtccgagatccccaacctggatatcatcggcaaacggattgagaagatcaaacaggaacacgagatcagttggcactacgaccaggaccacccctacaagacctgggcctaccatggctcctacgagaccaagcagacaggttccgccagcagcatggtcaacggggtggtgcgtctcttaacgaagccgtgggacgtcgtgccgatggtaacccaaatggcgatgactgatacgacgcccttcgggcagcagcgcgtcttcaaggaaaaggtggacacgcgcacacaagagcccaaagagggcaccaagaaactcatgaagatcacggctgagtggctctggaaggagttaggtaagaagaagacgccccgcatgtgcacacgggaggaatttacgaagaaggttaggtcaaatgcagccctgggggccatttttacggacgagaacaagtggaaaagtgcgagagaggctgtcgaggacggcaggttctgggagctcgtagaccgggagcgaaacctccacctggaggggaagtgcgaaacatgcgtgtacaacatgatgggcaagcgggaaaagaaactcggtgaattcggcaaggccaaggggtcccgcgccatctggtatatgtggctaggggctcggttccttgagttcgaggccctcggcttcctgaacgaggaccattggtttagccgcgggaattccttgtccggtgtcgagggggaggggctccatcgtctgggatatatcctgcgcgacgttgggaagaaggagggcggggccatgtacgccgacgacacagccggctgggacacccggattacgctcgaagacctgaagaacgaggagatggtgaccaaccacatgaagggggagcacaagaaactggcggaagcaatttttaagctcacctaccagaacaaggttgtaagagtccagagaccgacgccccgcgggaccgtgatggacatcatcagccgccgggaccagcggggctccgggcaggtaggcacgtacgggctgaataccttcaccaacatggaggcgcaactgatacgccagatggagggcgagggtatctttaagagtatacagcacctcacggccacggaagagatcgccgtccagaactggctggcacgcgtcgggcgggagcgcctgtcccggatggcgatctccggcgacgactgcgtggttaagcctatcgacgaccgattcgcctccgccctcaccgcactaaatgacatggggaaggtgagaaaggacatccagcagtgggaacccagccgcggctggaacgactggacccaggtgccgttctgctcccaccacttccatgagctggttatgaaagacggacgggtgctcgtggtcccctgccgcaaccaggatgagttaatcggccgggcgcgtatctcccagggggccggatggagtctgaaggaaactgcctgtctaggcaagtcttacgcccagatgtggaccctaatgtacttccaccggagggacctacgcctcgccgcgaacgcgatctgctcagctgtgcccagccactgggtgccaacctcccgaactacctggagcattcacgcaaagcacgagtggatgacaaccgaagatatgcttgcggtctggaaccgtgtgtggatccaagagaacccgtggatggaggacaagaccccagtggaatcctgggaggaggtcccttatctgggcaaacgggaggaccagtggtgcggctcgctcataggtctgaccagccgggccacctgggccaagaacatccagaccgcaattaaccaggtgcgatctctgatcgggaacgaggaatataccgattacatgccaagcatgaagcggtttcgccgtgaagaagaggaggccggcgtcttgtggtga

SEQ ID NO: 25027 - RNA, 9876 nt, synthetic construct
  misc_feature 1..9876: note = derived and/or modified CDS sequence (opt11) from DENV-2__FJ882594__SS-prME
  source 1..9876: mol_type = other RNA
accgcgggggtgattgtcatgctgatccccacagcgatggcgttccacctcacgacccgcaacggggagccgcacatgatcgttgggagacaggagaaggggaagtccctgctgttcaagaccgaagacggcgtaaacatgtgcacgttaatggccatcgatctgggggaactgtgcgaggacaccattacctacaagtgccctttactgcgccagaacgaacccgaggacatcgactgctggtgcaacagcactagcacctgggtcacctacgggacctgcaccaccacgggcgagcacagacgcgagaagcggtccgtagctctcgtgccccacgtcgggatgggcctagagacccgcaccgagacctggatgagctctgagggggcctggaagcacgttcagcggattgagacgtggatcttgcgccatccgggctttaccatcatggccgcgattctggcatacaccatcggaaccacgcactttcaaagggctctcatcttcatcttactaaccgccgtggcgccgagcatgacaatgcgctgtattggaatctcaaaccgagacttcgtcgagggcgtgagcgggggctcttgggtggacatagtactcgagcacggctcgtgcgtgactacgatggctaagaacaaacccactctggatttcgagctgattaagaccgaggccaagcagcccgcaaccctgcgcaaatactgcatcgaggccaagctgacgaacaccaccaccgagtcccggtgcccgacgcagggcgagccgagcctgaacgaagaacaggacaagcgctttatctgcaagcactcgatggtggaccgaggctgggggaatggctgcggcttattcggcaaggggggaatagtgacctgcgctatgttcacgtgcaagaagaatatggaaggcaaggtagttcagcccgagaacctggaatacacaatagtcatcacgccccattcgggggaggagcacgcggtgggcaatgacaccggcaagcacggcaaggaaatcaagatcaccccccagtctagcatcaccgaggccgagctgaccggctacggtacagtgaccatggagtgcagcccacgcaccggccttgacttcaacgagatggtcctgctgcagatggaggacaaagcctggctcgtgcaccggcagtggttcctggacttacccctcccctggctgcctggggccgacacccagggcagcaattggatacagaaggagacgctggtgaccttcaaaaacccgcatgcgaagaagcaggacgtcgtggtgcttgggtcccaagagggcgccatgcacaccgccttaaccggtgcgacggagatccagatgagcagtggtaacttgctattcacaggccacttgaagtgtaggctgcgaatggacaagctccaactgaagggcatgtcatacagcatgtgcacgggcaagttcaaaatcgtgaaggagatcgccgaaacccagcacggaacgattgtaatccgggtgcagtacgagggcgacggctccccctgtaagatccccttcgagattaccgatctggagaagcggcacgtgctcgggcgcctgatcaccgtgaacccgatcgtcacggagaaggatagccccgtgaacattgaggcggagccgccgttcggcgactcctacatcataatcggtgtggagcctggtcagttaaagttgaactggttcaagaaggggagctccattgggcagatgttcgagactaccatgagaggcgccaagcggatggctatcctgggggacaccgcgtgggacttcgggagccttgggggcgtctttacctccatcgggaaggctctccaccaggtattcggcgcgatctacggcgccgccttcagcggtgtctcctggacgatgaagatcttaatcggagtcatcatcacgtggatcgggatgaacagccgctccaccagcttatccgttagcctagtgctggtgggcgtggtgaccttgtatcttggtgccatggtccaggcggactccggctgcgtggtgagctggaaaaacaaggagctcaagtgcggcagtgggatcttcatcacggacaatgtccacacttggaccgagcagtacaagtttcagcccgagtcgccctccaagttagcctccgcgatccaaaaagctcatgaggagggcatctgcgggatccggtctgtgacccgcctggaaaatcttatgtggaaacaaatcacgcccgaactgaaccacatcctgtccgagaacgaggtgaagctcaccatcatgaccggagacattcgagggatcatgcaagccgggaagcgcagcctgcggccgcagccaaccgagctgaagtactcatggaagacgtggggcaaggcaaagatgctcagcaccgagtcccacaaccagacgttcctgatcgacgggcccgaaaccgctgagtgcccgaacacgaacagggcttggaactcgttagaagtcgaggactacggattcggggtgttcaccacgaacatctggcttaaattacgggagaagcaggatgtgttttgcgattccaagctgatgagtgccgccatcaaagacaacagagctgtccacgccgacatgggctattggatcgagtcagccctcaatgacacatggaagatggagaaagcctcattcatcgaagtaaagagctgccactggcccaaaagccacaccctgtggtccaacggcgtgttagagagcgagatgataatccccaagaacttcgccgggcccgtctcccagcacaattatcggccgggctaccacactcagaccgcagggccctggcacctcgggaagttggagatggactttgacctgtgcgagggtaccaccgtcgtggtcacggaggactgcggcaatcgcggcccaagcctccggaccaccacggccagcggaaagttaattacggagtggtgctgccgctcctgcaccctcccacctctccggtaccgtggcgaagacggatgctggtatggcatggagatccggccacttaaagagaaagaggagaatctggtgaacagcttagtcaccgccgggcacggccaaatcgacaacttctccttgggagtcctggggatggccctattcctggaggaaatgctgcgtacgcggatcggcacgaagcacgcgatcctcctggtggccgtcagcttcgtcaccctgatcaccgggaacatgtccttccgggacctcggccgcgtgatggtgatggtcggcgcaaccatgacggacgacatcggcatgggcgtcacgtacctggccctgctcgccgcgtttaaggtgcggccaacctttgctgccgggctgctcctccgcaagttaaccagcaaggagctgatgatggccacgatcggtatcgctctcctttctcagagcaccataccagagaacatactggagctcaccgacgcgctggcactggggatgatggtcctcaagatcgtgcggaatatggagaagtaccaactggccgtaacaatcatggccatctcatgcgtcccgaacgccgtgatcttacagaatgcgtggaaggtaagctgcacgatcctcgccgccgtctccgtatcgcctctgctgctcaccagcagccagcagaaggccgactggatccccctggcgctgaccatcaagggcctcaaccccaccgctatcttcctgacgactctgtccagaacctcaaagaagaggtcctggccgctcaacgaagctatcatggccgtcggaatggtgtcgatcttagccagtagcctgctgaagaacgatatccccatgaccgggccgctcgtcgcgggcgggctgctcaccgtctgctacgtgctgaccggccgctccgccgacctagaactcgagcgggcagccgacgtgaaatgggaggaccaggccgagatcagtgggagctctcccatcctgagcatcaccatctccgaggatggcagcatgagcataaagaacgaggaggaggagcagaccctgacgatcttgatccgcaccggcctactcgttatcagcggcgtgttcccggtctccatccccatcaccgcagccgcctggtacctctgggaggtcaagaagcaacgggccggcgtcctgtgggacgtgccctcaccaccgccagtcgagaaggccgagttagaagacggcgcgtaccgcattaagcagcgcggtatcctcgggtactcccagatcggcgccggcgtgtacaaggaggggacgttccacaccatgtggcacgtgacccgcggtgccgtcctgatgcaccgggggaagcgtatcgagcctagctgggccgatgtgaagaaggacctgatctcctacggagggggctggaaactcgagggcgagtggaaggaaggggaggaggtgcaggtcctggccctggagcccggcaagaacccccgcgcggtgcagaccaagcccgggatcttcaaaaccaacaccggaacgattggagccgtgtccctcgacttctctcccggcaccagcggctcccccatagtcgaccgcaagggaaaggtggtgggcctgtacggcaatggcgtagtgacccggagcggcgcctacgtgtccgccatcgcgcagaccgagaagtccatcgaggacaaccctgagatcgaggatgatattttccggaagaagcggcttaccataatggacctccaccccggggccggcaagaccaagcgctacttgcccgccatcgtccgggaggccatcaagcgcgggctgcgcacactgatcctcgccccgacccgggtggtggctgctgaaatggaggaggccctgcgtggcctgcccatccggtaccagacgacagccattaagaccgagcacactggacgcgagatagtcgatctcatgtgccacgcaacgttcaccatgcggctgttgagccccgtgcgcgtaccaaactataacttaatcataatggacgaggcccatttcacagaccctgccagtatcgcggctcggggctatatcagcacccgcgtcgagatgggcgaggcggcggggattttcatgacggcaacgccgcctggctcccgggaccccttcccccaaagtaacgccccgatcatggacgaagagagagaaataccagagcggtcgtggaactccgggcatgagtgggtgacagatttcaaaggcaagaccgtgtggtttgttccaagtatcaaagcggggaacgacatcgcggcctgcctgaggaagaatggaaagaaggtgatccagctgagccgtaagacgttcgactccgaatacgttaagacccgagccaacgactgggacttcgttgtgaccaccgatatcagcgaaatgggcgccaacttcaaagccgagagagtgatcgacccgcgccggtgtatgaagcccgtcatactaacggacggggaggagagagtcatcctggcgggccccatgcccgtgacccactccagcgccgcccagcggcgagggcgcatcggccggaacccaaagaatgagaatgaccagtatatctacatgggggaacccctggaaaacgacgaagactgcgcccattggaaggaggccaagatgctcctggataacatcaacacccccgaaggcatcatccccagtatgttcgaaccggagcgcgagaaggttgacgcgatcgacggcgaataccggctgcggggggaggccaggaagaccttcgtggacttaatgcggcggggcgacctgcccgtgtggttggcctacaaggtcgccgctgagggtatcaactacgcggatcgcaagtggtgcttcgacggcatcaagaacaaccagatcctcgaggagaacatggaggtcgagatatggacgaaggagggggaacggaagaagctgaagccccgctggctagacgctaggatctatagtgacccgctagctctgaaggagttcaaggaatttgccgcgggccgcaagtccctgactctcaatctgatcaccgagatgggccgcctgcccacgttcatgacgcagaaagcccgcaatgccctggacaacctggcggtgcttcacactgccgaggccgggggccgggcctacaaccacgcactcagcgaactgcccgagactctagaaaccctcctgctgttgacgctgttagccacagtaactggaggcatctttctcttcctgatgtccggcaaagggatcggcaagatgacgctggggatgtgctgtattattactgccagcatactcctgtggtatgcgcaaatccagccacactggatcgccgcctccatcatcctggagttcttcctcatagtgctgctgatcccggagcccgagaaacagcgtacgccccaggacaatcagctcacatacgtcgtcatagccattctgaccgtcgtcgccgctacgatggccaacgaaatgggcttcctggagaagacgaagaaggacctcggactgggtagcatcaccacccaagagagcgagagcaacatcctggacatcgacctccggccagccagcgcctggaccttatacgccgtggctacgaccttcgtgacgccgatgcttcgccactccattgagaacagctcagtcaacgtgagcctcaccgccatcgccaaccaggccacggttctgatgggcctgggtaagggctggcccctctcaaagatggatatcggggttcccctgctggcgatcggctgctacagccaggtgaaccccatcactctcaccgccgccctgcttctgctggtggcccattacgctataatcgggccggggctgcaggccaaggccacccgggaggcccagaaaagagccgccgctgggatcatgaaaaaccccacggtggacgggatcacggttatcgatctcgaacccatcccctacgacccgaaattcgaaaagcagctgggacaggtgatgcttctcatcctgtgcgtcacccaggtactgatgatgaggaccacatgggcgttatgcgaggccctgacactggcaaccgggccaatctcaaccctctgggagggcaatcccgggcgtttctggaatacgaccatagcggtgagcatggcgaacatcttccgcggctcttacctggcgggagccgggttgctttttagcatcatgaagaacaccaccaatacgcggcgcggaacggggaacatcggcgagaccctgggcgagaagtggaagtcgcgcctgaacgccctcggcaaaagcgagttccagatctacaagaagtccggcatccaggaggttgaccgtacgttagcgaaagagggcataaagaggggcgagacggaccaccacgccgtgtcgaggggttccgccaagttacggtggttcgttgagcgtaacatggtcacccccgagggaaaggtggtggacctgggctgtgggcggggcgggtggagctactattgcggcgggctgaagaacgtccgcgaggttaagggcctgaccaagggggggccgggccacgaggagcccatccctatgtccacatacgggtggaacctcgtacggttgcagagcggcgtcgacgtgttctttacgccccccgagaaatgcgataccctgctctgcgacatcggggagtcatcccccaacccgaccatcgaggcaggtcgcaccctgagggtgctgaatctcgtcgagaactggctgaacaacaacacccaattctgcatcaaggtgttgaacccctacatgcctagcgtcatcgagaagatggaagccttgcagcgcaagtatggcggggctttggtacggaatcctctgtcccgcaacagtacgcacgaaatgtactgggtgtccaatgcaaccggcaatatcgtgagctcggtcaacatgataagccgaatgcttattaaccgcttcactatgaaacacaagaaggccacctatgagcccgacgtcgacttggggtccggtacgagaaatatcgggatcgagagcgagatccctaaccttgacatcatcggcaagcgcatcgagaaaatcaagcaggagcacgaggcgtcctggcactacgaccaagaccacccatacaagacctgggcctaccacggtagctacgagactaagcagaccgggtctgcgagttccatggttaacggcgtcgtgcgccttctcacgaagccttgggacgtggtcccgatggtgacgcagatggcaatgaccgacaccacgcccttcgggcaacaacgggtgttcaaggagaaggtcgacactcgcacccaggagcctaaggagggcaccaagaagctgatgaagatcaccgccgaatggctatggaaggagctcggcaagaagaaaacgcccagaatgtgcacgcgcgaagagtttaccaagaaggtgcgcagcaatgccgccctgggggctatcttcacggacgagaacaagtggaaatctgctcgcgaggccgtggaggacggccgtttctgggagcttgtcgaccgcgagcgaaacttgcatctggagggtaaatgcgaaacttgcgtgtacaacatgatgggcaaaagagaaaaaaagctgggggaattcggccgggccaagggctctcgggcgatttggtacatgtggctcggcgccagatttctggagttcgaggccttgggtttcctcaacgaagaccattggttctcgcgcggcaacagtttgagcggcgtcgagggggaggggctgcaccgactgggctacatactgcgcgacgtaggtaagaaagagggcggggccatgtacgcagacgacacagcgggctgggacacccgaatcaccctggaagacttgaagaacgaggagatggtgaccaaccacatgaagggggagcacaagaagcttgccgaggcaatcttcaagctgacgtatcagaacaaggtcgtgcgcgtgcagagacccactccgagaggcactgtcatggacatcatcagcaggcgcgaccaacgcggcagcggccaggttggcacctacgggctaaataccttcacgaacatggaggcgcagctgatccgacaaatggagggtgaggggatcttcaagtccattcagcacctgacggccaccgaggagatcgccgtgcagaactggctcgcccgcgtcgggcgggaaagactgagccggatggccatttccggcgacgattgcgtggtcaagcccatcgacgaccgcttcgctagcgccctgaccgcgctcaacgatatggggaaggtcaggaaggacatccagcaatgggaaccctcacgcggctggaacgactggacgcaggtgccattctgcagccaccacttccacgaactggtgatgaaggatggccgggttttggtggtgccgtgccgcaatcaagacgaactgatcggccgggcccgcatcagccagggcgccgggtggagcctgaaggagacggcctgcctgggcaagtcctatgcgcagatgtggaccttaatgtacttccaccgacgcgacctgcggcttgcggccaatgccatctgttcagccgtcccctctcactgggtgcccacttctcgcaccacatggtccatccacgcgaagcacgaatggatgacgaccgaggacatgttagccgtgtggaaccgggtatggatacaggagaacccctggatggaagacaaaacgccggtggagagctgggaggaggtgccctacctggggaagagagaggaccaatggtgcggctctcttatcggcctgacctcaagagccacgtgggctaaaaacattcagacggccatcaaccaagtgaggagcctaataggcaacgaggagtataccgattacatgccatccatgaagcgcttccggcgcgaggaggaagaagcgggcgttctgtggtga

SEQ ID NO: 25028 - RNA, 9876 nt, synthetic construct
  misc_feature 1..9876: note = derived and/or modified CDS sequence (opt11) from DENV-2__FJ205885__SS-prME
  source 1..9876: mol_type = other RNA
accgccggcgtcattgttatgctgatccccaccgccatggccttccacctcaccacccgcaacggggagccccacatgatcgtgggccggcaggagaaggggaagtccctgctgttcaaaacagaggacggcgtgaacatgtgcaccctcatggccatcgacctgggcgagctctgcgaagataccataacgtacaagtgcccgctcctgcgccaaaacgagcccgaggacatcgactgctggtgcaatagcaccagcacttgggtgacctacgggacgtgcaccaccacgggcgaacacagaagggagaaacggagtgtggccctggtaccccacgtcggtatgggcttggagacccgcaccgagacctggatgagcagcgagggtgcctggaaacatgtgcagcggatcgagacgtggatcctgagacacccgggctttaccataatggcagcgatcctggcctacaccatcgggaccacgcacttccagcgggctctaatcttcatcttactgaccgccgtggcgccaagcatgaccatgcgatgcatcggcatcagcaaccgggacttcgtcgagggcgtgagcggaggcagctgggtggacatcgtcctcgaacacgggtcgtgcgtgaccacgatggctaagaacaagcctaccctggacttcgagctgatcaaaaccgaggcaaagcagcccgccacactacgaaagtattgtatcgaagccaagctcacgaacaccaccactgagagtcggtgccctacgcagggcgagcccagcctgaacgaggagcaggacaagcgcttcatttgcaagcactccatggtggaccgaggatggggcaacggctgtgggctatttggcaagggcggcatcgtgacctgcgcaatgttcacgtgcaagaagaacatggaggggaaagtagtgcagcccgaaaacctggagtacacaatcgttatcacgccccactcgggggaggagcacgccgtgggcaatgataccgggaagcatggcaaggaaatcaagatcacccctcagtcctccatcaccgaagcagagcttaccggttacggtacggtgaccatggagtgcagcccccggaccggcctcgacttcaacgaaatggttttgctgcagatggaggacaaagcctggctcgtgcatcggcagtggttcctggacttaccgcttccctggctgccgggtgccgacacccaaggcagcaactggattcagaaggagacgctcgtgaccttcaaaaacccccacgcgaagaaacaggacgtcgtcgtcctcgggtcccaggagggtgccatgcacacagccctgaccggggcgacggaaatccagatgagcagcggcaacttgctattcaccggccatctcaagtgccgcttacgaatggacaaactccaactgaaagggatgtcttatagcatgtgcacgggcaagttcaagatcgtaaaggagatcgccgaaacccagcatgggacgatcgtgatccgcgtgcaatacgagggtgacggcagcccctgcaagatcccctttgagattaccgacctggaaaagcggcacgtgctcgggagactgatcaccgtgaacccgattgtcaccgagaaggacagccccgtgaacatcgaggcggagccgcccttcggcgactcctatatcatcatcggggtagagccgggccagctgaagctcaactggttcaaaaaggggagcagtatcggccagatgttcgagacgaccatgcgcggcgccaaacggatggccattctgggcgacaccgcatgggactttggcagcctcgggggtgttctcacctccatcgggaaggccctgcaccaggttttcggcgcgatatacggcgcagccttcagcggggtgtcctggacaatgaagatcctaatcggagtcataattacctggatcgggatgaacagccgctccaccagccttagtgtgagtctcgtgctggtcggagtcgtgaccttatacctcggggccgtagtgcaggcggactccggctgcgtagtatcctggaagaataaagagctgaagtgtggcagtgggatctttattacggataacgtgcatacgtggaccgagcagtacaagttccagcccgagagccccagtaagctggcctctgccatccagaaggcccacgaggagggcatctgcggaatccggagcgtgaccaggctggagaacctcatgtggaagcagattacgccggaacttaaccacatcctctccgaaaacgaggtcaagctgaccatcatgaccggcgacatcaaggggatcatgcaggccggcaagcgcagcctgcgcccgcagccgacagagctcaagtactcctggaagacgtggggcaaagcgaagatgctgagtaccgaatcccacaaccagaccttcctgatcgacgggcccgagaccgcagaatgcccgaacacgaaccgcgcgtggaacagcctcgaggtggaggactacggctttggggtgttcacgacaaacatctggctgaaactgcgcgagaaacaggacgtcttctgtgactctaagctcatgagtgccgccatcaaagacaaccgggcggtgcacgccgacatgggctactggattgagtccgccctgaacgacacctggaagatggagaaggcgtccttcatcgaggttaagtcctgtcactggcccaagagtcacaccctgtggtccaatggcgtcctcgagagcgagatgattatccctaaaaatttcgccgggcccgtgtcccaacacaattatcgcccgggctatcacacccagaccgcggggccctggcacttaggcaaattagagatggattttgacttctgcgagggcaccaccgtggtggtaacggaggactgcggaaaccggggtcccagccttcgcaccaccacggccagcggaaagctgatcaccgaatggtgctgccgctcctgcaccctgccaccactccgctaccggggcgaggacgggtgctggtacggcatggaaatccgccccttaaaggagaaggaggagaacctggtgaacagcctcgtaaccgctgggcacggccagatcgataacttctcccttggcgttctggggatggccctcttcctggaggagatgctgcggacccgcatcggcacgaagcatgcgatcctcctggtggccgtctcgttcgtgaccctgatcaccgggaacatgtcgttccgggatctcggcagagtgatggtcatggtgggggccaccatgaccgacgacatcggcatgggcgtaacctacctggccttactcgccgcgttcaaagtccgccctaccttcgccgccgggctactgctccggaaactgacctctaaggagttgatgatggccacgatcggcatcgcactcttgtcccagagcacgatccccgagaccatcctggagctgacggacgcgctggccctggggatgatggtactcaagatcgtgcgcaacatggagaagtaccagctagccgtcacaatcatggccatctcctgcgtgccaaacgctgtgatcctgcagaacgcgtggaaagtcagctgcaccatcctcgcggccgtatcagtctcacccctgctgctcacctcaagccaacagaaagccgactggatccccctcgcgctgacgatcaagggtctcaaccccaccgcaatcttcctgaccaccctgtctcggaccagcaagaagcgctcctggccactcaacgaggccatcatggccgtgggcatggttagcatcctggcctcgagcctgctcaagaacgacatcccaatgacggggcccctggtcgcgggcgggctgctcaccgtatgttacgtattaaccggccggagcgccgacctggagctcgaacgcgcagccgacgtaaagtgggaggaccaggctgagatctccgggagctcccccatcctgagcatcacgatctccgaggacggcagcatgtcgatcaagaatgaggaggaagagcagacgctgaccatcctcatccggactggcctgctggtgatcagcggggtgtttccggtaagcattcccattaccgcggccgcctggtacttgtgggaagtgaaaaagcagcgcgccggggtgctatgggatgtccccagcccgccgcccgttgagaaggccgagctggaggacggggcgtatcggatcaagcagcgcggcatcctcgggtactcccaaatcggagcaggcgtgtacaaggaagggaccttccacacgatgtggcatgtcacccggggcgccgttctgatgcaccgtggcaagcggattgagcccagctgggccgacgtgaaaaaggacctgatctcctacggcggcggttggaagctcgaaggcgagtggaaggagggggaggaggtgcaggtgctagcgctggagcccggcaagaacccccgagcggtccagactaagcccggcattttcaagaccaacactggcacaatcggcgccgttagcctcgacttctcccccggcacgagcggctctcccatcgtggatcggaaggggaaggtggtcggcctgtatgggaatggcgtcgtaacccgctcaggcgcctacgtctccgccattgcgcagacggagaagtccatcgaggacaatccagagatagaggacgacattttccgcaagaaacgcctgacgatcatggacctccacccgggtgccggcaagaccaagcggtacctgcccgccatagtgcgcgaggcaattaagcgggggctgcgcaccctgatcctcgccccgactcgcgtggtcgcggccgagatggaggaagcactgcggggcctgcccatccgctaccaaacccccgccatcaagaccgagcacaccgggcgggaaattgtggacctaatgtgccacgccacgttcacaatgcgcttactgagccccgtgcgggtcccgaattacaacctcataatcatggacgaagcgcacttcaccgacccggcttcaatcgccgcccgcggctacatcagtactcgcgtcgagatgggcgaagcagctgggatcttcatgacggccacgccacccggatcccgggacccgttcccacagtccaacgctcccatcatggacgaggagcgggaaatccccgagcgctcctggaacagcgggcacgagtgggtgaccgacttcaagggcaagaccgtctggttcgtgccgtccatcaaggcagggaacgacatcgcggcctgcctgcggaagaacggcaaaaaggtgatccagctgagcagaaagacgttcgactccgagtatgtcaaaactcgggccaatgactgggacttcgtggtgacaaccgacataagcgagatgggcgccaacttcaaggccgagcgggtaatagacccccggcgctgtatgaagcccgtgatcctcacggacggggaggagcgggtgatcctggccgggcccatgccggtcacccactccagtgcagcccagaggcgggggcgcataggcaggaaccccaagaatgagaacgaccagtacatctacatgggggagcccctggagaacgacgaggactgcgcccactggaaggaggccaagatgctcctggacaatatcaacacccccgagggcatcatcccgtccatgttcgagcctgagcgggagaaagtggacgcgatcgacggcgaataccgcctgcgcggggaggcgagaaagacctttgtcgacctgatgcggaggggagatctgcccgtctggctggcctacaaggtagccgccgaggggatcaactatacggaccggaagtggtgcttcgacggcatcaaaaacaaccagatcttggaagagaacatggaggtcgagatctggaccaaggaaggggagcggaagaagctgaagccacgttggttggacgcgcgcatctactcagacccgcttgcccttaaggaatttaaggagttcgccgccggccggaagtccctcactctcaacctgatcactgagatgggtcgcctgcccacgttcatgacccagaaggcacggaacgccctcgataacctggccgtgctgcacaccgcggaggcggggggccgcgcgtataaccacgccctgagcgagctgcccgagacccttgagactctccttctgttgaccttgctggccaccgtgaccgggggcatattcctcttcctgatgtccgggaaggggatcggcaaaatgacccttgggatgtgctgcatcatcacggccagcatcctcctgtggtacgcccagatccagccacactggatcgcggcatccatcatcctggagtttttcctcatcgtgctgctgatccccgagcccgagaaacagcggacgccgcaggataaccagctgacctacgtggtcatcgccatcctgaccgtcgtggccgccacgatggcgaacgagatgggcttcctggaaaagactaagaaagacctggggctcggcagtatcacaactcaggagagcgagagtaacatcctggacatcgacctccgcccggcctcggcctggacgctgtacgccgtggccaccaccttcgttaccccaatgctgcggcactccatcgagaacagctccgtgaacgtgagcctcacggctatcgccaatcaggccaccgtcctgatgggcttggggaaggggtggccgctctctaagatggacatcggggtccccctgttagccatcggctgctatagccaggtgaacccgatcaccctaacagcggcgctgctgttgcttgtcgcccactacgcgatcatcgggcccggcctgcaagctaaagcgacgcgcgaggcccagaagcgggccgcggccggcatcatgaagaatccgaccgtggatgggatcaccgttatcgacctcgagcccatcccatacgaccccaagttcgagaagcaactgggccaggtcatgctgcttatactgtgcgtgactcaggtgctgatgatgcggacgacctgggcgctctgtgaggccctgaccctggctaccgggcccatctcaacgctctgggaggggaaccccggacggttctggaataccaccatcgccgttagcatggccaacatcttccgcggatcttacttggcgggcgccggcctcctgttcagcatcatgaagaacaccacatccacccgccggggcaccggtaacatcggcgagaccctgggcgagaaatggaagtcccgcctgaatgcactcggaaagagcgagttccagatctataagaagtccggcatccaggaagtcgatcggacacttgccaaggaggggatcaagcgcggggaaaccgaccaccacgcggtgtcccgggggagcgccaagctgcgatggttcgtcgagcggaacatggtgaccccggagggaaaggtggtcgacctaggctgtgggcgcggaggttggtcctactactgcggcggcctgaagaacgtgcgggaggtaaagggcctgaccaagggcggacccggccacgaggagccaatcccgatgtcaacgtacgggtggaatctcgtgaggttacagagcggcgtggacgtgttctttaccccgcccgagaagtgcgacaccctgctctgcgacattggggagagcagccccaaccccaccatcgaggccggccggaccctgcgggtcctgaatctcgtggaaaattggctaaacaacaacacgcagttctgcatcaaggtgctgaacccctacatgccctccgtcattgagaagatggaggccctccagcggcagtacggcggagcactggtgcgcaaccccctcagcagaaactccacgcacgagatgtactgggtgagcaacgcgaccggcaatatcgtctccagtgtgaacatgatatcccgtatgcttatcaaccggttcaccatgaagcacaaaaaggccacgtatgagccggatgtggacctagggagcggcacgcggaacattgggatcgagtcagagatccccaacctggacatcattggcaagcggatcgagaagatcaagcaggagcacgagatctcgtggcactacgaccaagaccacccctacaagacctgggcctaccacgggtcctacgagaccaagcagacggggagcgctagttcaatggtgaacggcgtggtgcgcctgttaaccaagccctgggacgtcgtgccgatggtgacgcagatggccatgacagacacgacccccttcgggcagcagcgcgtctttaaggagaaggtcgacacccggacccaggagcccaaggaggggacgaagaagctgatgaagatcaccgcggagtggctgtggaaggagctcggcaaaaagaagacgccgcgcatgtgcacacgggaggagttcacgcgcaaggtgcggtccaacgccgcacttggggctatcttcaccgacgagaacaagtggaagtccgctcgcgaggcggtcgaggacggccgattctgggaactcgtggaccgcgagcggaacctgcatctggaggggaagtgcgagacttgtgtgtacaatatgatgggcaagcgcgagaagaagctgggagagtttggcaaagccaagggcagtagagccatctggtacatgtggctcggggcccgcttcctggaattcgaggccctgggcttcctcaacgaggaccactggttcagccgggggaatagcctttccggcgtcgagggagagggactgcacaggctcggctacatactgcgggacgtcgggaagaaggagggcggggcaatgtacgccgacgacaccgccggctgggacacgaggataactctggaggaccttaagaacgaggagatggtcaccaaccacatgaagggggagcacaagaagctagccgaggcgatctttaagttgacctaccagaacaaggtggtgcgggtccaaagacccaccccccgaggcacggtgatggacatcatctcgcgccgggatcagcgcggctccgggcaggtgggcacgtacgggctcaacaccttcacgaatatggaagcccaacttattcgccagatggagggggagggcatattcaagagcatccagcacctgaccgccacagaggagatcgctgtccaaaactggctcgcccgggtggggcgcgagagactgtcccggatggcgatctcaggcgacgactgcgttgtcaaacccatcgatgaccggttcgcctccgcactgactgccttaaacgacatggggaaggtgcggaaggacatccagcagtgggagcctagccggggctggaacgactggacacaggtgcctttctgcagtcaccacttccatgagctggtcatgaaggacgggcgcgtactggttgtgccctgccgtaaccaggatgagctcatcgggcgcgcccggatcagccagggcgcggggtggtccctgaaggagaccgcgtgcctggggaagtcctacgcgcagatgtggacactcatgtactttcaccgccgcgacctacgcctggccgccaacgcgatatgcagtgccgtgccctcacattgggtgcccacatcccgcaccacgtggagcatccacgccaagcacgagtggatgaccaccgaggacatgctcgctgtctggaaccgcgtgtggatccaggagaacccctggatggaggacaaaaccccagtggagtcctgggaggaggtcccctacctgggtaagcgtgaggaccagtggtgcggcagcctgatcgggctcacgagccgcgcgacctgggctaagaacatccagaccgcgatcaaccaagtaaggtccctgatcggcaacgaggaatacaccgactatatgcccagcatgaagcgcttcagacgggaggaagaagaggccggcgttctgtggtga

SEQ ID NO: 25029 - RNA, 9876 nt, synthetic construct
  misc_feature 1..9876: note = derived and/or modified CDS sequence (opt11) from DENV-2__FJ744743__SS-prME
  source 1..9876: mol_type = other RNA
accgcgggcgttatcgtcatgctgatcccaaccgccatggcgtttcacctgaccactcgcaacggtgaacctcacatgatagtgggccggcaggaaaaggggaagtccctgctgtttaagaccgaggacggcgtcaacatgtgcaccctcatggcgatcgacttgggggagctgtgcgaggacaccataacatacaagtgtccactcctcaggcagaacgagcccgaggacattgactgctggtgcaactccacgagcacctgggtcacctacggcacctgcaccaccacgggagagcaccggcgcgagaaacggtccgtggccctggtgccacacgttgggatgggtctcgagactcgcacagagacatggatgagctcagagggtgcctggaaacacgttcagcggatagagacgtggatactgcgccatcccggcttcaccatcatggccgcgattcttgcctacaccatcgggactacgcatttccagcgggcactcatctttatcctgctgaccgctgttgcgcctagtatgacgatgcgttgcatcggaatctccaaccgggatttcgtcgagggggtgagcgggggcagctgggtggacatagtcctcgagcatggatcatgcgtgaccactatggcaaagaacaagcccactctggacttcgagctgataaagaccgaggccaagcagcccgcgacactccgcaagtactgtatagaggctaagctgactaacaccacgaccgagtctcgttgcccgacacaaggagagcccagcctaaacgaggagcaggacaagcgcttcatttgtaagcactccatggtggaccgcggctgggggaatggctgcgggctgttcggcaagggcggcatcgtgacctgcgcaatgttcacgtgcaagaagaacatggagggcaaagtggtgcagccagaaaacctagagtacaccatcgtgattacgccgcactctggagaggagcacgccgtgggcaacgacaccgggaagcatggcaaggagatcaagattactccgcagagcagcattaccgaggccgagctgactgggtacggcacggtgaccatggagtgcagcccgagaaccggcctcgacttcaacgagatggtcctgttgcagatggaggacaaggcatggctcgtgcaccgccagtggttcctggaccttcctctcccttggctgccaggggcagacacccagggcagcaactggattcaaaaagagacgttagtgaccttcaagaacccacacgcgaagaagcaggacgtagtagtgctcggctcccaggagggcgccatgcacaccgcgctgaccggggcaacggagatacagatgtcgagcggcaacctcctgttcaccgggcacctcaagtgtcgcctgaggatggacaagctccagttaaaggggatgtcatacagcatgtgtaccggtaagttcaagattgtgaaagagatagccgagacccagcacgggacgatagtgatccgagtccagtatgagggcgacggttccccctgtaaaatccccttcgagatcaccgatctggagaagcggcacgttctggggcgcttaatcacggtaaaccccatcgtaaccggcaaagatagcccggtgaacatcgaggcagagccgcccttcggggacagctacatcatcatcggcgttgaacccggtcaactgaaactcaactggttcaagaaaggaagctccatcggccagatgtttgagactaccatgcggggagccaagagaatggctatcctgggcgacacagcttgggatttcgggagtctgggaggggtattcaccagtataggcaaggccctccaccaggtgtttggcgcgatctacggggcagcattctctggcgtgtcctggacaatgaagatactgatcggggtcattatcacctggatcggcatgaatagcagaagtaccagcctgtccgtctctctggtgctcgtcggagtggtgaccctctacctgggcgccgtggtgcaggcggactctggctgtgtggtcagctggaagaataaggagttaaagtgcgggtcaggcatcttcatcacggataatgtacacacctggaccgagcagtataagttccagcccgaaagccccagcaagttggccagtgctattcagaaggcacacgaagaaggaatctgcggcatccggagcgtgacccgcctagagaacctcatgtggaagcaaatcacgcccgagctgaaccatatactgtccgagaacgaggtcaagctcacaatcatgactggggatatcaagggcatcatgcaagccggtaaacggtcgctatggccgcagccaacggagctgaagtactcttggaaaacgtggggaaaggcgaaaatgctgtccaccgaatcccacaaccagaccttcttgatagacggtcctgagaccgccgagtgcccgaacaccaacagggcctggaacagcctggaggtcgaggactatgggttcggcgtcttcaccacaaacatctggctcaaactgcgggagaagcaggacgtgttctgcgactcgaagctcatgagcgccgccatcaaggataaccgggcggtgcatgccgatatgggctactggatcgagagcgccctcaacgacacctggaagatggagaaggcctcttttatcgaggtgaaatcctgtcactggccgaagagccacacactgtggtccaacggggtcttagaaagcgagatgataatccccaaaaacttcgccggcccagtttcccagcacaactaccgaccggggtatcacacgcagaccgctgggccctggcacctaggtaagctggagatggacttcgacttctgcgaaggcaccacagttgtagtgacagaggactgcggcaaccgcggacccagcctgcggaccaccaccgccagcggaaagctgattacggaatggtgctgtcgcagctgtaccctgcctccgctgcggtatcgcggggaggatggttgttggtacgggatggagatccggcccctcaaggaaaaggaggagaatctggttaactcactcgtcaccgctggccatggacaaatcgataacttctccttaggggtgctgggcatggctctgttcctagaagagatgctgcgcacccgtatcggtacgaaacacgcgatcctgctcgtggccgtatcgttcgtaaccctgatcaccggaaatatgtccttccgggatctggggcgggtaatggtcatggtgggcgccaccatgactgacgacatcggaatgggggtgacatacctcgccctgttggccgcgtttaaggtccgcccgaccttcgccgccggcttgctcctgcgcaagctcactagcaaggagcttatgatggccacgataggcattgcccttctttcccagagtactatacctgagaccatccttgagcttaccgacgccctcgccctcggcatgatggtgctcaaaatcgtgaggaacatggagaagtaccaactcgccgtcacgataatggccatctcctgcgtgccgaatgctgtgatcctgcagaacgcgtggaaggtatcttgcaccatcctggcggcagtatccgtgagccccctcctgctgacctccagccagcagaaggccgactggatacccctcgcactaacgatcaagggcctgaaccccacggccatcttcttgaccacactgtcacgcaccagcaaaaagcggtcctggccgctgaacgaggctatcatggcggtggggatggtcagcatactcgcctccagcctgctgaaaaacgacattcctatgacgggccccctcgtagccggcggactgctgaccgtttgctatgtgctcacggggcgctccgccgacctggagttagaacgggctgccgacgtgaaatgggaagaccaggcagaaatctccgggtcatcccccatcctcagcatcactatttccgaagacggcagcatgtccatcaagaacgaggaggaggaacaaactctgaccatcttgatccgcacaggactcctggtgatcagcggcgtgttccctgtctccatccctataaccgcggctgcctggtacctgtgggaggtcaagaagcagagggcaggggtgctctgggacgtccccagccccccccctgtggaaaaggccgagctagaggacggtgcgtatcgcatcaagcagcgagggatcttaggctactcgcagatcggcgccggggtgtacaaggagggcacattccacacaatgtggcacgtaacccgcggggccgttctgatgcaccggggcaagcgcatcgagccctcatgggccgatgtgaagaaggatttaatctcgtacggcggaggttggaagctggaaggggaatggaaggagggcgaggaggtccaggtattagcactagagcccgggaagaatccccgggcggttcagaccaaaccggggatcttcaaaaccaatacggggacgataggcgccgtcagcctggatttctcccccggcaccagtgggtcccccatcgtggaccgcaaaggcaaggtggttgggttgtacggcaacggcgtcgtgaccaggtcaggagcctacgtctccgcaatcgctcagacggagaagtccatcgaggacaaccccgaaatcgaagatgatatcttccggaagaagcggctgaccatcatggacctgcaccccggtgccggaaagaccaagcgatacctcccggcaatcgtacgcgaggccatcaagcgaggcctgcgcaccttgatcctggcaccgacgcgggtggtcgcggctgagatggaggaggctcttcgcgggctgcccatccggtatcaaacccctgccatcaagaccgaacacactggtcgcgagatcgtggacttgatgtgtcacgcaacgttcacaatgcgcctcctttcaccggtgcgcgtcccgaactacaacctgatcatcatggacgaggcacacttcaccgaccccgcatccatcgccgcccggggctacatctctacccgggtggagatgggagaggccgcgggcatcttcatgactgccacgccccccggctcccgggatccgttcccccagagcaacgctcccatcatggacgaggagcgcgagatccccgagcggtcctggaacagcggccacgagtgggtcaccgacttcaaggggaagaccgtctggtttgtgccgtccatcaaagccggaaacgacatcgcggcctgtctacgcaaaaacggcaagaaagtaatccaactgagccgaaaaacgtttgattccgagtacgtcaagacccgagccaatgactgggatttcgtcgttaccacagacatcagcgagatgggggcaaacttcaaagccgagagggtcatcgacccgcgccggtgcatgaagcccgttatcctgacagacggcgaggagcgcgtgatcctcgcggggcccatgccggtcacccactcgtccgccgcccagcgtagaggccgcatcggtcgaaaccccaagaacgagaacgaccagtacatttacatgggcgaacccctggagaacgatgaagactgcgctcactggaaggaagcgaagatgctgctcgacaacatcaacacccccgagggcataatcccgtcaatgttcgagcccgagcgcgagaaggtcgatgcgatcgatggggagtataggctgcgcggcgaagccaggaagaccttcgtagacctgatgcgccgcggagacctcccagtttggttagcctacaaggtggccgccgagggtatcaattatgcagaccgcaagtggtgctttgacgggataaagaataaccagatcctggaggagaacatggaggtggagatttggacgaaggagggcgagcggaagaagctcaagccgcgctggctggacgcccggatctatagcgaccccttagcgctcaaagagttcaaggaattcgccgctggccgcaagtccctgacactaaacctcattaccgagatggggcggctgcccaccttcatgacccagaaggcccgcaacgcactggacaacttagccgtcctgcacacggccgaggcgggcgggcgggcctacaaccacgccctaagcgagctccccgagaccttggagacccttctcctgctgaccttgttagcgaccgtcactggtggcatctttctgttcttgatgtccggcaagggcatcgggaaaatgaccctgggaatgtgttgcatcataaccgccagcatcctgctgtggtacgcgcagattcagccacactggatagctgcgtccatcattctggagttcttcctgatcgtcctgctgatccccgagcccgagaagcaacggacgccacaggacaaccagcttacctatgtggtaatcgccatcctaaccgtcgtcgcggcgaccatggccaacgagatgggtttcctggagaagactaagaaagatctgggcctcggctccgttaccacgcaggagtcggaatccaacatccttgacatcgacctgcgaccggcgagcgcctggaccctgtacgccgtcgcaaccactttcgtcacccccatgctgcgtcactccatcgagaacagctctgtgaacgtctctctaaccgccatcgccaaccaagccacggtgctcatgggcctgggcaagggctggccgttatccaaaatggatatcggcgtgcccctcttggcgatcgggtgctacagccaagtcaacccaatcactctcaccgcaaccctcttacggtttgtggcgcagtacgctatcatcggtccaggcctgcaggccaaggcgacgcgcgaggctcaaaagcgcgccgctgccgggatcatgaagaatcccaccgtcgacggcataacggtgatcgacctcgaacctatcccgtatgatcccaagttcgagaagcagctcggtcaggtcatgcttctcatcctgtgcgtcacccaggtcttaatgatgcgtactacctgggcgctctgcgaggcgctgaccttagccaccgggcccatctctacactctgggagggtaacccaggccggttttggaacaccacaatcgccgtgagcatggcaaacatttttcgcggctcctacctcgcgggagccggcctcctcttctccatcatgaagaacaccacgtccacccgccggggcacaggaaacataggagaaacccttggggaaaaatggaagtcccgcctgaacgccctaggcaagtcggagttccagatctacaaaaagtccgggatacaagaggtggatcggacgctggccaaggaaggcatcaagcgcggggagaccgatcaccacgcggtctcccggggctcagccaagctgcgctggtttgtggagcggaacatggtgaccccggaagggaaagtcgtggacctcggctgcggccgcggggggtggagttattactgcggggggctgaagaacgttcgggaggtgaagggcctgaccaagggtgggcccgggcacgaggagcccatcccaatgagcacgtacggctggaaccttgttcgcctgcagagcggggtggacgtgttcttcacacccccagaaaagtgcgacaccctcctttgtgacatcggcgaatcgagccccaaccctaccattgaggcaggtcggacattacgcgtgttaaacctcgtggagaactggctgaacaacaacacacagttctgcatcaaagtcctgaatccatacatgccctcagtcatcgagaagatggaggctttacagcggcagtacgggggagccctggtgcgcaatcccctttcacggaactccacgcacgagatgtactgggttagcaacgcgaccggcaacatcgtgtcaagcgtcaatatgatctctagaatgctcataaaccgtttcacgatgaagcataagaaggccacgtacgagccagacgttgatctgggctcgggaacccgcaacatcggcatcgagtctgagatccccaacttagacattatcggcaagaggattgagaagataaagcaggagcacgagatcagctggcactacgaccaagaccacccctacaagacatgggcctaccacgggtcctatgaaactaagcagacgggcagcgccagcagcatggtgaacggcgtggtacgcttactcacaaagccctgggacgtcgtaccgatggtgactcagatggccatgaccgacactaccccttttggacagcagcgagtctttaaggaaaaagtggacacgcgtacccaggaacccaaggagggaactaagaagctcatgaagatcaccgcagagtggctgtggaaggaacttgggaagaaaaagacgccccgcatgtgtacccgggaagagttcactaagaaggtccgcagtaacgccgccctgggcgccatattcaccgatgagaataaatggaaaagtgcccgggaggcggtagaggacgggcgcttttgggagctggttgaccgtgagcgcaacctccacctggagggcaaatgcgaaacatgcgtttacaacatgatgggcaagcgtgagaagaaattgggcgagttcggcaaggccaagggatctagggccatttggtacatgtggttaggcgcccggttcctagagtttgaagcgctgggatttctcaacgaggatcactggttctcgcgcggcaactccctgagcggtgtcgaaggcgagggcctgcatcggctcggctatatcctgcgagacgttggcaagaaggagggcggtgccatgtacgcggacgacacagccgggtgggacacgcgcataaccctggaggacctcaagaacgaggaaatggtgacaaaccacatgaaaggcgagcataagaaactggccgaggctatctttaaactgacctaccagaacaaagtagtgcgagtccagaggccgactccccgcggtactgtaatggacatcataagccggcgcgaccagcggggttctggacaggtcgggacctacggcctaaacacctttacgaatatggaggcccagctgatccgccagatggagggcgaggggatctttaagagcatccaacacttgaccgccattgaggagatcgccgtgcaaaactggcttgccagagtgggccgggagcgactgtcccggatggcgatctctggggacgactgcgtcgtaaagcccatcgacgaccggttcgcctcagccctgaccgccctcaatgacatgggcaaggtgcggaaagatatacagcagtgggagcccagccgcgggtggaacgattggacccaagtccccttctgctcccaccacttccacgagctggttatgaaggatggccgggtcctggtcgtgccctgtagaaaccaggacgaactcattggccgggcgcgcatcagccagggcgcaggctggtccttaaaggaaaccgcctgcctgggcaagtcatacgctcagatgtggactctcatgtacttccacaggagagacctgcgactggctgccaatgctatatgtagtgccgtaccctcgcactgggtcccaacctcccgcaccacctggagtatccacgcaaagcacgagtggatgaccaccgaagacatgctcgccgtgtggaaccgggtgtggatccaggagaatccgtggatggaggacaagaccccagtcgagagttgggaggaagttccgtaccttggcaaacgcgaggaccagtggtgcgggtcactgatcggactaaccagccgagctacgtgggcaaaaaacatccagacggccatcaaccaggtgaggtccctgatcggcaacgaggagtataccgactatatgcccagcatgaagcgattccgccgggaggaggaggaagcaggtgtcttatggtaa

SEQ ID NO: 25030 - RNA, 9876 nt, synthetic construct
  misc_feature 1..9876: note = derived and/or modified CDS sequence (opt11) from DENV-2__JN819424__SS-prME
  source 1..9876: mol_type = other RNA
accgccggcgtgattgtaatgttgatccctaccgcgatggcgtttcacctcaccacgcgcaacggggagccccacatgatcgtgggccggcaagagaaggggaaatccctgctgttcaagaccgaggacggcgtgaacatgtgtaccttgatggccatcgacttaggggagctgtgcgaggacaccatcacctataagtgcccgctcctgcgccagaacgaacccgaggacatcgactgctggtgcaacagtaccagcacatgggtcacctacgggacctgtaccaccacgggcgagcaccggagagagaagaggagcgtagccctggtgccccacgtagggatgggcctggagacccgcaccgagacctggatgtcgagcgagggagcctggaagcacgtgcagcggatagaaacgtggatactgcgacatcccggcttcaccataatggctgcgatcctagcctataccatcgggaccacgcacttccagagagcactcatattcattctgctgaccgccgtggcgcccagcatgaccatgcgatgcatcggcatttccaaccgggacttcgtcgagggcgtgagcgggggctcctgggtggacatcgtactcgagcatgggagctgtgtgaccacgatggctaagaacaagcccaccttagacttcgaactgataaaaaccgaggccaagcagccagccaccctccgcaagtattgcatcgaagccaaactgacgaacaccactaccgagtctcgctgcccaacacagggtgagcccagcctaaatgaggagcaagacaagcgctttatctgcaagcactcgatggtggacaggggatgggggaacggctgcgggctgttcgggaaggggggaatagtaacctgcgcgatgtttacgtgcaagaagaacatggagggtaaggtcgtgcagccggagaatctggagtacacgatcgtcatcacgccccactcgggagaggagcatgctgttggcaacgacaccgggaagcacggtaaagagatcaagatcacgccgcagagttccattacggaggccgagctgaccggctatggcacggtgactatggagtgcagcccccggacgggtctcgacttcaacgaaatggtactgcttcagatggaggacaaagcctggttagtgcaccggcagtggtttttagacctgcccctcccgtggctgcccggggccgacacccagggcagcaactggatccaaaaggagaccctggtcaccttcaagaacccccatgcgaagaaacaggatgtcgtggtcctcgggtcccaagagggcgctatgcacaccgccctgacaggggcgacggagatccagatgtcatcgggcaacctgttatttaccggtcacctgaagtgccgcctgcggatggacaagctccagctgaaggggatgtcgtacagcatgtgcacaggtaagttcaagatcgtgaaagaaatcgccgagactcagcacgggacgatcgtaattcgcgtccaatacgagggcgacggctccccctgcaagatcccgttcgagatcaccgacctggagaagaggcatgtgctcgggcgcctgatcacggtgaacccgatagttaccgagaaggacagccccgtgaatatagaggcggagccacccttcggcgactcctacatcatcatcggggtggagccgggccagctgaagctcaactggttcaagaagggctcatccatcggccagatgttcgagacgaccatgcgcggcgccaagcggatggcaatccttggggatacagcatgggatttcggcagcttgggcggggtcttcacctctatcggcaaggccttacaccaagtgttcggggcgatctacggcgcggcgttctccggggtgtcctggacgatgaagatcctgatcggtgtcatcatcacctggattgggatgaactcccgctccacgagcctgtcagtgagcttggtcctcgtcggcgtggtcaccttatacctgggggccgtcgtgcaagcggactccggctgcgtggtcagctggaagaacaaagagctcaaatgcggctcagggattttcataacagacaatgtgcatacctggaccgagcagtacaagttccagccagagagtccctcgaagctggccagcgccattcaaaaggcccacgaagagggcatctgtgggatccggagcgtaacccgcctagagaacctcatgtggaagcagatcacgccagagcttaaccatattctgtccgagaacgaggtaaagctcaccatcatgacgggcgacataaagggaatcatgcaagcgggcaagcgcagcctgcgcccgcagcccactgagttgaaatatagttggaagacgtggggcaaggccaaaatgctgtcgacagaaagtcacaaccaaacctttctgatcgacgggccagagacagccgagtgcccgaatacgaacagagcctggaacagcctggaggtcgaggactacggcttcggagtctttaccaccaacatctggctcaaactcagagagaagcaggatgtcttttgtgattccaaactgatgtcagcctcctcgatcgacaaccgggcagtgcatgctgatatgggctactggatggaaagtgcccccagcgactcctgcaagatggagaaggccagcttcatcgaggataagtcctgttactggccgaatagccagcatctttggagtaacggcgtcttggagtcagaaatgatctttcccaagaacttcgcaggcccggtcagccagcatatctaccgccccgggtaccacacccagaccgccgggccgtgcaatctaggcaagctcgagatggacttcgacttctgcgagggcaccaccgtggtggtaaccgaggactgcggcaaccggggcccctcactcaggaccacgaccgcgagcgggaagctgatcactgagtggtgctgccggtcctgcaccctcccgcctctacgctatcggggcgaagacggctgctggtacggcatggagatccggcccctgaaagaaaaagaggagaacttggtgaatagcctggtgacggccggccacggccagatcgacaacttctccctgggggtactcgggatggcactgttcctggaagagatgctcagaactcgcatcgggaccaagcatgccatcctgctggtcgcagtgtccttcgtcaccctaattaccgggaacatgtcatttcgggacctgggccgtgtgatggtgatggtcggggccacaatgactgatgacatcggcatgggcgtgacctacctggccttgctggccgccttcaaggtgcggcccactttcgcagctgggctgctcctgcggaagttgaccagcaaggagctcatgatggctaccatcgggatagctctgctgtcccagagcaccattcccgagacgatcctcgagctgaccgacgccctggcgctcgggatgatggtcttaaaaatcgtgcgcaacatggaaaagtaccagctggccgtgacgatcatggcgatctcctgcgtcccaaacgccgtgatcctccagaacgcgtggaaggtaagctgcaccatactggctgccgtctccgtttcgccactgctactcacttcctctcagcaaaaggcagactggatccccctggcgctcactatcaagggcctaaacccgaccgcgatcttccttaccactctcagccggaccagcaagaagcgcagctggcccctaaatgaggccattatggccgtcggcatggtctcaattcttgcaagctccctcctcaagaacgacatccccatgaccgggcccctggtggccggcgggcttttgaccgtctgctatgtattaacggggcgaagcgctgacttggaactggaacgcgccgccgatgtgaagtgggaggaccaggccgagatctccgggagctccccgatcctgagcatcaccatctctgaggatggcagcatgtccattaagaacgaggaggaggagcagacgctcacgatactgattcggacgggcctgcttgtcatcagcggcgtgttccctgtgtccatccctataaccgccgccgcctggtatctttgggaggtcaagaagcagagagccggcgtgctttgggacgtccccagcccgcctcccgtcgagaaggccgaactcgaggacggcgcctaccggatcaagcagagaggaatcctgggttattcccaaatcggagcgggtgtgtataaggaagggacattccacaccatgtggcacgtgacccgaggcgcggtcctgatgcacagggggaagagaatcgagccgtcatgggcggatgtgaagaaggacctcatcagttacggcggtggctggaaactggagggcgagtggaaggagggggaggaagtgcaggtcctggccctcgagccaggtaagaacccccgtgccgtgcagacgaagcccggtatctttaagacaaacaccgggaccatcggcgcggtcagcttagacttctcaccgggcacctccggcagccctatcgtggaccggaaggggaaggtagttgggctgtacgggaacggcgtggtgacacgctccggcgcctacgtttccgccatcgcccaaaccgagaagtccatcgaggacaatcccgagatcgaagacgatatcttccggaagaagaggctcaccatcatggatcttcatcccggtgctggaaagactaaacggtacttgccagccatcgtgcgcgaagccatcaaaagagggttacgaacactgatcctggctcccacacgtgtggtggccgctgagatggaggaggcattaaggggcttacccatccggtatcagacccccgccataaaaacggagcacaccggccgggagatcgtcgacctcatgtgccacgctaccttcacgatgcgcctgttgtctccggtgcgggttcccaactacaacctgatcatcatggatgaagctcacttcacggacccggcgtccatcgccgcgcgcggctacatcagcacacgggtagagatgggtgaggccgctgggatttttatgaccgcgacgccacccggtagcagagaccccttcccccagagtaacgcgcccatcatggacgaggaacgggagatcccagagcgctcctggaacagcgggcatgagtgggtcaccgacttcaagggcaagaccgtgtggttcgtcccctccatcaaggccgggaacgatattgccgcgtgcctgcggaagaatggcaagaaggtgatccaactcagccgcaagaccttcgactccgagtacgtgaagacccgggccaacgactgggacttcgtcgtgaccaccgatatcagcgagatgggcgccaacttcaaagccgagcgcgttattgacccgcggcgctgcatgaagcccgtcatcctgaccgacggggaggagcgagtgatcctagccggcccgatgcccgtgacccattcgtctgcagcacagagacggggacgcatcggcagaaatcctaagaatgagaacgatcagtacatttacatgggagagcccctcgaaaatgacgaggactgtgcccactggaaggaggccaagatgctgctggacaacatcaacacgcccgagggcatcatcccttctatgttcgagcccgaaagagaaaaggtcgaggccatagacggcgagtaccgcctccgcggcgaggcgcgaaagaccttcgtggatcttatgcgtaggggcgacctgccggtgcggctcgcctacaaagtcgctgctgaggggatcaactacgccgaccgcaagtggtgcttcgacggcatcaagaactctcagatcctggaagagaacatggaggtggaaatctggaccaaggagggggagcggaagaagttgaagccccgctggctcgacgcccggatatatagcgatcccctggccctaaaggagttcaaggagtttgccgccggccgcaagagcctcactctgaacctgattacggaaatgggccggctccccaccttcatgacccagaaggcgcgcaacgccctggacaatttggccgttctccacaccgccgaggccgggggtagagcgtacaaccacgccctaagcgagctgccggaaacgctcgagacccttctgcttctgaccctgctcgcgaccgtcacagggggcatattcctgttcttgatgtccggcaagggtattgggaagatgaccctcgggatgtgctgcataatcaccgccagtatccttctgtggtatgcccaaatccagccccactggatcgcggcttccatcatactcgagttctttctaattgtgctgttgataccggagcccgagaagcagcgaaccccgcaagacaaccagctgacatacgtagtaatcgccatcctgactgtggtcgccgccaccatggcgaatgaaatgggcttcctcgagaagaccaagaaggacctgggtctgggcagcatcactacgcaagagtccgaaagcaacatcttagacatcgacctgcgtcccgcctcagcctggaccttgtacgccgtggctaccaccttcgtgacgcccatgctcagacatagcattgagaactccagcgtcaacgtaagtctgaccgcgattgccaaccaggccacagtgctgatgggcctcgggaagggctggccactgtccaagatggacataggtgtcccgctgctcgctatcggctgctattcccaggtgaaccccataaccctgacggcagccctgcttctcctggtagcccactacgccatcattgggcccggcctccaggctaaggcgactcgcgaggctcagaagcgcgccgccgccggcatcatgaagaatcccactgtcgacggaattaccgtcatcgatctggaacctattccctatgaccctaagtttgagaagcagctgggccaggtgatgctccttatcttgtgcgtcacacaggtcctcatgatgaggaccacctgggcgttgtgcgaggcgcttactctcgccaccggtcccattagcaccctatgggagggcaacccggggcggttttggaataccaccatcgcagtgtccatggccaacatctttcgcggcagctatctggcgggcgccggtttgttattctccattatgaagaacacgacgagcacacggagaggcaccgggaatatcggcgagacgctgggtgagaagtggaagtcccgtctcaacgccttaggcaagagtgagtttcaaatatacaaaaagagcggtatccaggaagtggaccgcacgctggctaaggaaggtatcaagcggggcgagaccgaccatcacgcggtgtcccgcgggagtgcgaagttgcgttggttcgtggagcgtaacatggtcacgcccgagggcaaggtggtagatttaggttgcgggcgtgggggctggtcgtattactgtggtgggctgaagaacgtccgagaggttaagggcctcactaagggcgggcccggacacgaggagcccatccctatgagcacctacgggtggaacctggtacggctccagtccggcgtcgacgtgttcttcaccccgccagagaaatgcgacacgctcctttgcgacataggggagagctccccgaacccgacgatcgaggccggtcgcacactgcgggtgctcaacttagtggagaattggctgaacaacaacacccagttctgtatcaaggttcttaatccctacatgccctccgtgatcgagaagatggaagcactgcagcgccaatacggcggtgccctggtccggaatcccctgtccagaaattcaacccacgagatgtactgggtgtccaatgccactgggaacattgttagcagcgtcaacatgatctcccgaatgctgatcaatcgcttcactatgaagcataagaaagcgacctacgagcccgacgtggacctggggtccggcactaggaacatagggatcgagagtgaaattccaaacctggacatcattggcaagagaatagagaagatcaagcaagagcacgaaatttcctggcactatgaccaggaccacccttacaagacctgggcgtaccacggcagctatgaaacgaagcagaccgggagcgcctcgtcgatggtgaacggggtcgttcgactcctgaccaagccgtgggacgtggttcccatggtgactcagatggccatgacagacacaacccccttcgggcagcagcgagttttcaaggagaaggtcgacacccgcacgcaggagcccaaggagggcaccaagaagttgatgaagattaccgcagagtggctctggaaggagctcggcaagaagaagaccccgcggatgtgcacgcgcgaggagtttaccaagaaggtgcgttccaacgcagccttgggggccatcttcaccgacgagaacaagtggaagtccgcccgcgaagcggtggaggacggccggttttgggagctagtggaccgcgaaaggaacctgcacctcgaggggaagtgcgagacgtgcgtttacaacatgatgggcaagcgcgagaagaaactcggggagttcggcaaggccaagggttcccgagccatctggtacatgtggctcggtgccaggtttctggagttcgaggcactcggcttcctgaacgaggatcactggtttagccgggggaactccctgagcggagtggagggggagggcctccatcgtctaggctacatcttacgcgacgtcgggaagaaggagggcggggccatgtatgccgacgacacggccgggtgggacacccgcatcaccctggaagacctgaaaaacgaggagatggtcaccaaccacatgaagggggagcacaaaaagctggccgaggcgatctttaaactcacgtaccagaacaaggtggtgcgggtgcaacgccccacccctcggggcactgtcatggacatcatcagtcgccgcgatcagcgcggcagcggccaggtgggtacatacgggctgaacacgttcaccaacatggaggcccagctaattcgccagatggagggggaggggatcttcaagtcgatacaacacctcaccgccaccgaagagatcgcggttcagaactggctggctcgagtcggccgtgaacggctgtcgcgcatggcgatcagtggtgacgactgtgtggtgaagcccattgacgaccggttcgccagcgccctcaccgcccttaatgacatggggaaagtcagaaaggacatccaacagtgggagccgtcccggggctggaacgactggacccaggtgcccttctgcagccaccactttcacgagctggtgatgaaggacgggcgggtgctagtggtgccctgccggaaccaggatgagctgattggtcgcgcccggatctcccaaggcgcggggtggagtctgaaagagaccgcctgtcttggcaaatcctacgcgcaaatgtggacattgatgtacttccaccggcgggacctgcgcctggccgccaacgcgatctgctctgcagtgccgtcccactgggtgccgacgtcccggacaacctggagcatacatgcgaagcacgagtggatgactaccgaggacatgttggccgtgtggaaccgcgtctggatccaagagaacccctggatggaggacaagacgcccgttgagtcatgggaggaggtgccctatttgggaaagagagaagaccagtggtgtggtagcctcatcggccttacctcacgagcgacctgggcaaagaacattcaaaccgccattaaccaggtacggagcctaattggtaatgaggagtacacggactacatgccaagcatgaaacgcttcagacgggaggaggaagaagcgggcgtgctctggtga

SEQ ID NO: 25031 - RNA, 9876 nt, synthetic construct
  misc_feature 1..9876: note = derived and/or modified CDS sequence (opt11) from DENV-2__FJ744741__SS-prME
  source 1..9876: mol_type = other RNA
accgctggtgtgattgtcatgctgattcccaccgccatggcgttccacctcaccacccgcaacggggagcctcacatgatcgtcggcaggcaagagaaaggtaagtccctcctattcaaaacagaggacggggtgaacatgtgcacgctcatggccatcgacctaggggagctgtgcgaggacaccatcacatacaagtgcccgctcctgcgacagaacgagcccgaggacatcgactgttggtgcaacagcaccagcacctgggtcacctatgggacctgcaccaccacgggcgagcacagacgcgagaagcggtcagtggccctggtgccccacgtggggatgggcctcgagactcgcaccgaaacgtggatgagctctgagggggcctggaagcatgttcagagaatagagacctggatcctgcgccacccgggcttcacgatcatggccgccattctggcctacaccattgggaccacccacttccagcgggccctcatattcatactgctgacggccgtggctcccagcatgaccatgcgttgcatcggcatatccaaccgggatttcgtggaaggtgtgagcgggggctcatgggtcgacatcgtcctcgagcacgggtcctgcgtgacaacgatggccaagaataagcccaccctggatttcgagctgatcaagaccgaggccaagcagcccgccacgctccgaaaatattgcattgaggccaagctgacgaacaccaccaccgaatcccggtgccccacacagggcgagcccagcctgaacgaggagcaggacaagcgcttcatctgcaagcactccatggtggatagaggctgggggaacggctgcgggttattcggcaaggggggcatcgtgacttgcgcgatgttcacgtgcaagaagaacatggagggcaaggtagtgcagccagagaacctggagtacaccatcgtaataacgccgcatagcggggaagagcacgcagtgggcaacgacaccgggaagcacggcaaggaaatcaagatcaccccgcagagtagcatcaccgaggcagagctgaccgggtacggaacagtgaccatggagtgcagcccccggaccggcctcgacttcaacgagatggtcctgctccaaatggaggacaaggcctggctagtgcacaggcagtggtttcttgacctgcccctcccctggctgcccggggccgacacacagggcagcaactggatccagaaggagactttggtaactttcaaaaatccccacgctaagaaacaggacgtcgtggtcctcggatcccaggagggcgcaatgcataccgccctgaccggggcaacagaaatccagatgagcagcggcaacctcctgttcaccggccacctgaagtgccgcctgcggatggacaaattgcagctgaagggaatgtcctacagtatgtgcaccggtaagttcaagatcgtgaaggaaattgccgagacccagcacggaacgatcgtgatccgagtccagtacgagggcgacggttccccctgcaagatccccttcgagatcaccgacctggagaagaggcacgtgctcgggcgccttattacagttaacccgattgtaaccgagaaggacagccccgtgaacatcgaggcggagccgcccttcggcgactcctacatcatcatcggggtggaaccgggccagctgaagctcaactggttcaagaaggggtctagcatcgggcagatgtttgagacgaccatgcgcggcgccaagcggatggccatcttaggggataccgcctgggacttcgggagcctgggtggcgtcttcacttccatcggcaaggccctacaccaggtgttcggagcgatctacggcgccgccttcagtggtgtgtcgtggacgatgaagatcctgatcggcgtgatcatcacctggatcgggatgaacagccgcagtaccagcctgtccgtgagcctcgtgctggtaggcgtggtgaccctgtacctgggggccatggtccaggcggactccggctgcgtggtgtcatggaagaacaaggagctcaagtgcggctccgggatcttcatcacggataacgtccacacctggaccgagcagtataagttccagccagagagcccaagcaagctggcctcagctatccagaaggcccacgaggagggcatatgcggcatccggagcgtgacccgcctggagaacctcatgtggaagcagatcacgccggagctgaatcacattttgtctgagaacgaggtgaagctcaccatcatgaccggtgacatccggggcatcatgcaggccggcaagcgcagcctgcggcctcagcccaccgagctgaagtatagttggaagacgtggggtaaggcgaaaatgctcagcaccgagagccacaaccagacctttctgattgacgggcccgagaccgccgagtgcccgaacacgaaccgcgcctggaactctctggaggtcgaggactacggtttcggggtttttaccaccaacatctggctcaagctgcgagagaaacaggacgtgttctgcgactctaagctgatgagcgctgccattaaagataatcgcgcggtccacgccgatatgggctactggatcgagtccgccctcaacgacacctggaagatggaaaaggccagcttcatcgaggtgaaatcctgccactggcccaagagccacaccctgtggtcgaacggcgtgctcgagagcgagatgatcatccctaagaacttcgccgggcccgtctcccagcacaattaccggccgggctaccacacgcagaccgcgggcccctggcacctcggaaagctagaaatggacttcgacctatgcgagggtaccaccgtggtggttacggaggactgcggcaaccgcggcccgagcctcagaactaccaccgccagcgggaagctgataacggaatggtgctgccgctcctgcacactgccgccgctcagataccgcggtgaggacgggtgctggtatggcatggagatccggcccctcaaagagaaggaagagaacctggtgaacagcctcgtgacagccgggcatggccagattgataacttctccttgggcgtcctggggatggcactcttcctggaggagatgctgcgcacccggataggcacgaagcacgctatcctgctggtggccgtgagcttcgtcaccctgatcactggtaacatgtcattcagagatctcggccgtgtgatggtgatggtcggcgccaccatgactgacgacattggcatgggcgtcacttacctggccctgctcgccgcgttcaaggtgcggcccaccttcgccgccgggctcctgttgaggaagctgaccagcaaagaactgatgatggccacgatcgggatcgcccttctatcccagagcaccatcccagagaccatcctggagctcaccgacgccctggccctggggatgatggtcctgaagattgtgcggaacatggagaagtatcagttagccgtgacaatcatggccatctcctgcgtgccgaacgccgtcatactacagaacgcgtggagagtgagctgtacaatcctcgccgccgtctccgttagccccctgctcctcacctcgagccagcagaaggcagactggatccccttggcgctgacgatcaagggactcaaccccacggccatcttcctgaccaccctgtcccggacctcgaagaagcgcagctggccgctcaacgaggctatcatggccgtcggcatggtgagcatcctggccagctcactgcttaagaacgacatacccatgacagggcccctggtggcgggaggcctgctcaccgtctgctacgttttaacaggccggagcgccgatctggaactcgaacgcgccgccgatgtaaaatgggaagaccaggccgagatttccgggagctcccctatactgagcatcacgatctccgaggacggaagcatgtccatcaagaacgaggaggaggagcagacgctgactatactcatcagaaccggccttctcgtcattagcggggtgttccccgtctccatccccataacagcggccgcctggtacctctgggaggttaagaagcagcgtgccggcgtcctgtgggacgtgcccagcccacctcccgtcgaaaaggctgagctggaagacggggcttaccggatcaagcagcgcggcatcctcgggtactcccagattggggccggcgtttacaaggaggggaccttccacactatgtggcacgtgacccggggcgccgtgctgatgcatcgcggaaaacgtatcgagcccagctgggccgacgtaaagaaagacctgatctcctatggcgggggttggaagctcgaaggtgagtggaaggagggggaggaggtgcaggtactggccctggaacccggcaagaacccccgcgcggtgcagaccaaacccgggatattcaagaccaacacgggcacaatcggggctgtgagcctcgacttctcccccggcaccagtggctcccccatcgttgaccggaaggggaaagtggttggcctttacgggaacggtgtcgtgacccggagcggggcctatgtctccgccatcgcgcagacggagaagtccatcgaggacaaccctgagatcgaggacgacatctttcggaagaagcgcctcacaatcatggacctccacccaggcgccggcaagaccaagcggtacctgcccgccatcgtacgtgaggcgatcaagcgcgggctgagaacgctaatcttagcgccgacgcgcgtggtagcggccgagatggaggaggcactgagaggcctgcccatccggtaccagaccaccgccatcaagaccgaacacactgggcgggagatcgtcgacttgatgtgccatgccaccttcaccatgcgcctgctgagcccagtgcgggtgcccaactacaacctcatcatcatggacgaggcacacttcaccgacccagcctccatcgccgcgcgcggctatatcagcacgcgagtcgagatgggcgaggccgcagggattttcatgaccgccaccccgcccggcagtcgcgatcccttcccgcagagcaacgcccccatcatggacgaggaacgggagatccccgagcggtcctggaactctgggcacgagtgggtcaccgacttcaagggcaagacggtgtggttcgtcccctccatcaaggccggtaatgacatcgcggcgtgcctacggaagaacggcaagaaggtgattcagctaagcagaaaaacctttgactccgagtacgtgaagaccagggccaacgactgggatttcgtcgtcaccactgacatctctgagatgggtgccaactttaaggccgagcgcgtgatcgacccgcggcgctgcatgaagcctgtcatcctcaccgacggggaagagcgggtaatacttgcgggccccatgcccgtgacgcacagcagcgccgcgcagcgccgcgggcgtatcggccgcaacccgaagaacgagaacgaccagtacatatacatgggggagcccctggagaacgacgaggactgcgcccattggaaggaggccaagatgctcctggacaacattaacacgcccgagggcatcatcccttccatgttcgagccggagagagagaaggtcgatgcgatcgacggcgagtaccgcttgcgcggggaggcccggaagacgttcgtggaccttatgcgtcgcggtgacttacccgtgtggctggcctacaaggtcgccgccgaagggatcaactacgcggatcggaagtggtgcttcgacggcatcaagaacaaccaaatcttggaggaaaacatggaggtggagatttggaccaaggagggggaacgaaagaagctgaagccacggtggttagacgctcggatctacagcgacccgctcgccctgaaggagttcaaggagttcgccgcggggcggaagtcccttaccctcaacctcatcacggagatgggccgcctgcccacgttcatgacccaaaaggcacggaatgccctcgacaacctggccgtgctgcataccgccgaggccgggggccgcgcctacaaccacgctctaagcgagcttcccgaaacattggaaacgcttctgcttctcacactgctggccaccgttaccgggggcattttcctctttctgatgtccggcaaggggatcggaaagatgaccctggggatgtgttgtatcatcacggccagcatcctcttatggtacgcgcagatccagccccattggatcgccgcctccatcatcctggagttctttctcatcgtgctgctcatcccggaacccgaaaagcaaaggactccccaagacaaccagctcacctacgtcgtgatcgccatcctgactgtggtcgccgcgacgatggcaaacgaaatgggcttcctcgaaaagaccaagaaggacctcgggctgggcagcatcacgacgcaggagtcagagtccaacatcctggatatcgatctccgccccgccagcgcctggacgctctatgccgtggcgaccaccttcgtgacaccgatgctccgacactccatcgagaacagctccgtcaacgtgtcgcttactgccatcgccaatcaggccacagttctgatgggcctggggaagggctggcccctctccaagatggacataggggtccccctgctggcaatcggctgttacagccaggtgaaccccatcacactcaccgccgccctacttctcttggtggcccactacgccatcatcgggccggggctgcaggctaaggccacccgcgaggctcagaagcgtgccgccgcgggcatcatgaagaaccctaccgtcgacggtatcaccgtgatcgacctggaaccaatcccgtacgacccgaagttcgagaaacagctgggacaggtaatgttactcatcctgtgcgtgacccaggtgctgatgatgcgcacgacgtgggcactctgtgaggccctgacacttgcaaccgggcccatttccacgctgtgggagggcaacccggggcgtttctggaacactaccatcgccgtgagcatggctaacatcttccggggttcctatctggctggagccggcctcctgttctcgatcatgaagaacaccacgaacacccggcggggcactgggaacatcggcgagacgctgggcgagaagtggaagtcaaggctgaacgccttgggcaagagcgagttccagatctacaagaagtccggcatccaggaggtcgaccggacgctggcgaaggaagggatcaagcgcggcgaaaccgaccaccacgccgtaagcagagggtccgccaagcttcgctggttcgtggaacggaatatggtcacccccgagggcaaggtggttgacctgggctgcgggcgcggcgggtggagctactactgcggagggctgaagaacgtccgcgaggtgaagggcctgaccaagggcgggccgggccacgaagagcctattcccatgtccacatacggttggaacttagtacgcctgcagagtggtgtcgacgtgttctttacgcctcccgaaaagtgcgacaccctgctctgcgacattggggaaagctcccccaatcccaccatcgaggccggccgaaccctgcgggtgctgaacctggtagagaactggttaaacaataacacgcagttctgcatcaaggtgctgaacccctatatgcccagcgtgatagagaagatggaggccttacagcggaagtacggcggggcactggtccgcaaccccctatcccggaactccacacacgaaatgtactgggtgagcaatgccaccggaaatattgtgagctccgtcaacatgatcagccgcatgttaatcaaccgattcaccatgaagcacaagaaagccacgtacgagcccgacgtggacctcggctccggcacccgtaatatcgggattgagagcgagatccccaatctggacatcatcggcaagcgcatcgagaagataaagcaggagcacgaaacctcctggcactacgaccaggaccacccctacaagacgtgggcctaccacggcagctatgagacgaagcagaccgggtccgccagctcaatggttaacggcgtcgtgcggctcttaacgaagccctgggatgtggtccccatggtgacccaaatggcgatgacggacaccacccctttcgggcaacagcgcgtgttcaaggaaaaggtcgacacccggacacaggagcccaaggaaggcaccaagaaactgatgaagatcaccgccgaatggctgtggaaggagctgggcaagaagaagacgccccgcatgtgcacgcgggaggagtttacccgcaaggtgcggagcaacgcagccctaggggccatcttcacagacgagaacaagtggaagtcggcccgcgaggctgtcgaagacggtcggttttgggagctggttgaccgcgagcggaatctacacctggaggggaagtgcgagacctgcgtgtacaacatgatgggcaaacgcgaaaagaagctgggggagttcggcaaggccaagggcagccgcgcgatctggtacatgtggctcggggcgcgcttcctagagttcgaggccttaggtttcctcaacgaggatcactggttctcccgggggaatagccttagcggcgtggagggggaggggctgcatcggctcggctacatccttcgggacgtcgggaagaaggagggtggggccatgtacgccgacgacacggcaggctgggacacccgcatcacgctggaggacctaaagaacgaggagatggttaccaaccacatgaagggggagcacaagaaactggcggaggccattttcaagctgacgtaccagaacaaggttgtgcgggtgcagcgcccgaccccccggggcaccgtcatggatatcattagtcgccgcgaccaaaggggcagcgggcaggtaggcacatacgggcttaacacttttaccaacatggaggcccagctgatccggcaaatggagggcgagggcattttcaagtccatccaacacctgaccgccaccgaggagatcgccgtgcagaattggctggcgcgggttgggcgcgagcggctgtctcgcatggccatctctggtgacgactgcgtggtgaagcccatcgacgaccggtttgccagcgccttaacggcgctgaacgacatgggcaaggtccgaaaggacatccagcaatgggagccctcacggggctggaacgattggactcaggtccccttctgcagccaccacttccacgaactggtgatgaaggacgggcgcgtcctggtggtgccgtgccggaatcaggacgaactcatcggccgcgcgcggattagccagggcgcggggtggagcctgaaggagacagcctgcctgggcaagtcctatgcccagatgtggacactcatgtacttccaccgccgggacctgcggctggccgcgaacgcgatctgcagcgccgtcccctcacactgggtgcccacctctcggacgacctggtccattcacgccaagcatgagtggatgaccaccgaggacatgctcgcggtatggaaccgcgtttggatccaggagaacccctggatggaagacaagacgccggtcgagagctgggaggaggtgccctacctggggaagcgggaggaccagtggtgcgggtcgctgatcgggctcacctcccgcgccacctgggccaagaacattcagacagccatcaaccaggtccgctcgctgatcggcaacgaagagtacacggactacatgccctccatgaagcggttccgccgggaggaggaggaggccggcgttctgtggtag

SEQ ID NO: 25032 - RNA, 9876 nt, synthetic construct
  misc_feature 1..9876: note = derived and/or modified CDS sequence (opt11) from DENV-2__FJ744703__SS-prME
  source 1..9876: mol_type = other RNA
accgcgggtgtgattgtcatgcttatccccaccgccatggcgttccatctcaccacccgcaacggggagccccatatgatcgtgggccgtcaagagaaggggaagtccctgctgttcaagaccgaggacggcgtaaacatgtgcaccctcatggccatcgacctgggcgagctgtgtgaggacaccattacctataagtgccccctcctacggcagaacgaacccgaggacatcgactgctggtgcaacagtacctcaacctgggtcacttacggaacttgcactaccacaggggagcaccggcgcgagaagcggagcgtggccctggttccccatgtgggtatgggcctggagacccgcaccgaaacgtggatgtctagtgaaggtgcctggaagcacgtgcagcggatcgagacgtggatccttagacaccccggttttaccatcatggccgcgatcctggcctacaccatcgggaccacgcacttccagcgggccctcatattcatactattaactgccgtggcccccagcatgaccatgcgctgcatcggtatcagcaaccgggacttcgtcgagggcgtaagcgggggcagctgggtggacattgttctcgagcacggcagctgcgtgaccactatggcaaagaacaagcccaccctggacttcgagctaatcaagactgaggccaaacagcccgccaccctccgcaagtactgcatcgaggccaagctgacgaacaccaccaccgagagcaggtgtccgacgcagggcgaacccagccttaacgaggagcaggacaagcgctttatctgtaagcactctatggtggaccggggctgggggaacggctgtgggctgttcggcaaaggcggaatcgtgacatgcgcgatgttcacgtgcaagaaaaacatggagggcaaggtggtacagcccgaaaacctggagtacacaatcgtcattacgccccacagcggagaggagcatgccgttggtaacgatactgggaagcacggcaaggagatcaagataacgccgcaaagctctataactgaggcggagctgaccgggtacggcacggtgacaatggagtgcagcccccgcaccggactcgattttaacgagatggtgctgctgcaaatggaagacaaagcttggctcgtgcatcggcagtggtttctggacctgcccctcccgtggctgccaggggccgacacacagggcagcaactggatccagaaggagactctggtgactttcaagaacccccacgcaaagaagcaagacgttgttgtcctcggatcccaggagggcgccatgcacaccgccctgaccggggccacggagatacagatgagcagcggcaacctcctgttcaccggccacttaaaatgccgcctgagaactgacaagctccagctgaaggggatgtcctactccatgtgcaccggtaagttcaagatcgtgaaagagattgccgagacgcagcacggcacaattgtgatccgcgtacagtacgagggcgacggttccccatgcaagatccccttcgagatcaccgacctggagaagcgccatgtgctcggacgcctgatcacggtgaacccgattgttacggaaaaggacagcccagtgaacattgaggcagagccgcccttcggtgactcctatatcatcatcggggttgaaccaggacagctgaaactcaattggttcaagaaggggagctccatcggccagatgttcgagaccacaatgcgcggcgcgaagcggatggctatcttgggggacaccgcctgggatttcgggagcctcgggggcgtcttcacgtcaatcgggaaggcactccaccaggttttcggcgcgatctatggagccgcattcagcggggtgtcctggaccatgaagatccttatcggcgtcatcatcacgtggatcggaatgaactcgcgctccaccagcctgtccgttagcctggtgctcgtcggcgtggtgacgctgtacctgggcgccgtcgtgcaggctgactccggctgtgtagttagctggaagaacaaggagctaaaatgcgggtccgggatcttcatcaccgataacgtgcatacttggacggaacaatataagtttcaacccgagagcccatccaagctggcatccgccatccagaaggcccacgaggagggcatatgcgggattcggagcgtgacacgcttagaaaacctcatgtggaagcagataacccccgagctgaaccatataccgtccgagaatgaggtcaagttgaccatcatgaccggcgacatcaaggggatcatgcaggccggcaagcggagcctaagaccccagccgacagagctaaagtactcctggaaaacctggggtaaggcgaagatgctgtctactgagtcccacaaccagaccttcctcatcgacgggccagagactgccgagtgccccaataccaatagggcctggaactcgctggaagtagaggactatggctttggggtgttcaccaccaacatctggctgaagctccgcgagaaacaggacgtgttctgtgactccaagctgatgagcgccgcaatcaaggacaaccgtgcggtgcacgcggacatgggctactggatcgagtccgctctgaacgatacctggaagatggagaaagccagcttcatcgaagtgaagtcctgccactggcccaagtcgcatacgctctggagcaacggcgtcctcgagagcgagatgatcatccccaagaactttgccgggccggtatcgcagcacaactaccgcccagggtaccacacccagaccgcggggccctggcacctaggtaagctcgagatggacttcgacttctgcgagggcaccacagttgtcgtgaccgaggactgcggcaaccggggccccagtctgcgcaccaccaccgctagcgggaagttaataaccgagtggtgctgcagatcctgcaccctcccgcccctgcgctatcgcggcgaggatgggtgctggtatgggatggagatccgcccactgaaggagaaggaggaaaatctcgtcaactcccttgtcaccgccgggcacggccagattgacaacttctccctgggcgtgctcgggatggcgttgttcctggaggagatgctccggacgcgcatagggacgaagcacgcgatcctgctggtggccgtcagcttcgtgaccctcatcaccgggaacatgtccttccgggaccttggccgggtgatggtcatggtgggggccacgatgacggacgacatcggcatgggtgtgacgtacttggccttactagcggcgttcaaagttcgcccaacctttgcggccgggctgctcctgcggaagttaacgagcaaggagctaatgatggccaccataggtattgccctgctgtcccagagcaccatccccgagaccatcctcgagctcacggatgcactcgccctcgggatgatggtgctcaagatcgtgcgcaacatggagaagtaccaattagccgtcaccatcatggctatctcctgcgtacccaacgccgtgatcctccagaacgcgtggaaggtgagctgcactatcctggccgcagtgtccgtcagccccctgctccttacctccagtcagcagaaggcggactggattcccctggcgcttacgataaagggcctgaacccgaccgcaattttcttgacaacactctccaggacgagtaagaagcgctcctggcccctgaacgaggccatcatggccgtgggcatggtgagcattcttgcctcctcactcctgaagaatgacatcccaatgacgggccccctggtagcgggtgggctccttaccgtgtgctacgtgctgaccggccggagcgccgacctggagctggagcgggccgccgacgtcaagtgggaggaccaggccgagatctccgggagctccccgatcctgagcatcacgatctccgaggacggcagcatgtccatcaaaaacgaggaggaggaacagaccctcaccatccttattcggacaggtctgcttgtcatctctggtgtgttcccagtctcgatccccatcacggcggccgcctggtacctgtgggaagtgaagaagcaaagagccggcgtactgtgggacgtgcccagcccgccgcccgtggagaaggccgagctcgaggacggggcgtataggatcaagcaacgcggaatcctggggtactcccagattggcgcgggagtttacaaggaggggacgttccacaccatgtggcatgtcaccagaggggccgtgcttatgcaccggggtaagcggattgagcctagctgggcagatgtcaagaaggacctgatctcctacggcggtggctggaagctagagggcgaatggaaagaaggagaggaggttcaggtgctggccctcgagcccggaaaaaatccccgcgcggtgcagaccaagcccggaatcttcaagacgaataccgggaccatcggggccgtcagcctggacttctccccaggcacctctggcagtccgatcgtggatcggaagggtaaggttgtcggcctgtacgggaacggcgttgtcacgcgatcaggcgcctatgtgtccgctatcgcgcagacggagaagtccatagaggataaccccgaaatcgaagatgacatcttccggaagaaacgacttacgatcatggacctgcaccccggggccggcaagaccaagagataccttccggccattgtgcgcgaggccatcaagcgggggctacggacactgatcctagcccccaccagggtggtcgcggccgagatggaggaggccctgaggggccttcccatccgctatcagactcccgccatcaaaaccgagcacacgggtcgggagattgtggacttgatgtgccacgccacctttaccatgcgcctgttgagcccggtgcgggtccctaactataaccttattatcatggatgaggcgcatttcacggaccccgcctctatcgccgcccgcggctacataagcacgcgcgtagaaatgggcgaggccgccgggatcttcatgaccgccacaccgcccggttcccgcgacccattcccacaatcgaatgcccccatcatggacgaagagagagagatccccgagcgctcctggaactcagggcacgagtgggtgactgacttcaagggcaagacagtctggtttgtcccttctataaaagccggcaacgacattgccgcctgtctacggaagaacggcaagaaggtgatccagctcagccgcaagaccttcgactccgagtacgtcaagacgcgggccaacgactgggacttcgtggtgaccacggacatctctgaaatgggcgccaactttaaggccgagcgcgtaattgatccccggcgctgcatgaaacccgtcatcctgaccgacggcgaggaacgggtgatccttgcgggtccgatgcccgtcacgcactcctccgccgcccagcggcgggggcgtattgggcgaaaccccaagaacgagaacgaccaatacatctacatgggggagcctctagaaaacgacgaagactgcgctcattggaaagaggccaaaatgctgctcgataacatcaacaccccggagggtatcataccctccatgttcgagcccgagcgggaaaaagtggatgcaatcgatggggagtaccgcctccgcggggaagcacgcaaaacattcgtggacctgatgcggcgtggcgacctgcccgtctggctcgcctataaggtggccgctgaagggatcaactacgccgaccggaagtggtgcttcgacggcatcaagaacaatcaaattctggaagagaacatggaggttgagatatggaccaaggagggggagcgcaagaagctcaagccccggtggctcgacgcccgaatctacagcgacccgctggcattgaaggagttcaaggagtttgccgcgggccggaagtccctcacattgaacctgattaccgagatgggccgcctccccacgttcatgacccagaaggcacgcaacgccctggacaaccttgccgtcctccacacagccgaggccggtggccgcgcctacaaccacgcactgagcgaattaccggagacgttagagacgcttctactcctgaccctgctcgctaccgtgaccgggggtatcttcctgtttctgatgtccggcaaggggatcggcaaaatgaccctcgggatgtgctgcatcattacggcctccatcctgctgtggtacgcccagattcagccccactggatcgctgccagtatcatcctcgagttcttcctgatagtcctgctcatccccgagcccgagaagcagcggaccccccaggacaaccaactgacctacgtggtgatcgccatcctgacggtcgtggcggcgacaatggccaacgaaatgggctttctcgaaaaaaccaagaaagacctaggcctgggcagcataaccacccaggagagcgagtcaaacatcctcgacattgacctgcgtccggccagcgcctggacgctgtacgccgtggcgacaacctttgtcacccccatgctccgccactccatcgagaacagctctgtgaacgtgagcctgacggcaatagcaaatcaggcaaccgtcctgatgggcctcgggaagggctggcctctttccaagatggacatcggggtgccgctgctcgcgatcggctgttacagtcaggtcaaccccatcaccttaaccgccgccctgctcctgttggtcgcccattacgctatcatcgggcccggcttacaggccaaagcaacgcgggaggcccagaagcgtgccgccgcgggtatcatgaagaaccccaccgtggacggcatcaccgtgatcgatctggagcctatcccctacgacccgaagttcgagaagcagttgggacaagtcatgctcctgatcctgtgcgttacccaggtcttaatgatgcgcacgacttgggcactgtgcgaggccctgaccttagccaccgggcccatctccacgctgtgggagggcaatccgggccggttctggaacacaaccatcgccgtcagcatggcgaacatattccgcggctcctacctggcgggagcagggctcctttttagcatcatgaagaataccacgtctaccaggcggggcacagggaacatcggagaaaccttaggcgaaaagtggaagtcgcgcctcaacgccctggggaagagtgagtttcaaatctataagaagtccggcatccaggaggtagaccggaccctggcgaaggaggggatcaagcgcggcgaaacggaccaccacgccgtgtcccgggggtctgccaagctacgctggttcgtagagcggaacatggtgacacccgagggcaaggtagtcgacttgggctgtgggcgcggcgggtggagctactactgcggagggctgaagaacgtgcgggaggtgaaggggcttacaaagggagggccaggacacgaggaaccaattccaatgagtacgtacggatggaacctggtcaggctgcagagcggagtggacgtgttctttacgccccccgagaagtgcgacactctcctgtgcgatatcggggagtccagccccaatcctaccatcgaggccggccggacgttacgcgtcctcaatctcgtggagaactggctgaacaacaacacgcagttctgcatcaaagtcctcaacccttacatgccctcggtcattgagaagatggaggccctgcagcgacagtacggcggggcccttgtgcggaaccccctcagccggaactcgacacacgagatgtactgggtgagtaacgcgacgggcaacatcgtctccagcgtgaacatgatctcccgcatgttgatcaacaggttcaccatgaagcacaagaaagcaacgtacgagccagacgtggatttagggagcggaacccgtaacataggcatagagtccgaaatccccaacttggacatcatcggcaagcggatagaaaagatcaagcaagaacacgagatctcctggcactacgaccaggaccacccctacaagacctgggcctatcacggttcctacgaaaccaagcaaacgggaagcgcttccagcatggtcaatggggtcgtaaggctcttgaccaagccgtgggacgtcgtgccgatggtcacccagatggcgatgaccgatacgaccccctttgggcagcagcgcgtcttcaaagagaaggtggatacccggacccaggagcccaaggagggcacgaagaaactgatgaaaatcaccgccgagtggctttggaaagagctgggtaagaagaaaacgcctcgcatgtgcacccgggaagagttcacgaagaaggtgcgttccaacgctgccttgggagccatcttcacagacgagaacaaatggaagtcggcgcgcgaggctgtcgaggatggccgcttctgggagctcgtggaccgagagcgaaacctgcaccttgaggggaagtgcgagacctgcgtgtacaacatgatgggcaagcgggagaaaaagctcggggagttcgggcgcgccaaaggctcccgggccatctggtacatgtggctcggagcgcgcttcctggagttcgaggccctaggttttctgaacgaagatcactggttcagccgggggaactcgttgtcaggcgtcgagggggagggcctccaccgcctcggctacatcttgcgcgatgtagggaagaaggagggcggcgcaatgtatgccgacgacacggccggatgggatactcgcatcacgctcgaggatctgaagaacgaggagatggtgaccaaccacatgaagggagagcacaagaagctggccgaggccatttttaagctcacctaccagaataaggtggtacgggtccagcgccccactcccagagggaccgttatggatatcataagccgccgggaccagcggggcagtgggcaggtcggcacttacgggctcaatacgttcacgaacatggaggcccagctgatacgccagatggaaggtgaaggcattttcaaatctatccaacacctaaccgccaccgaagagatcgctgtacagaactggctggcgcgggtggggcgcgagcggctgtcccggatggccatcagcggcgacgactgtgtggtcaagcccattgacgaccggttcgcctccgccctcaccgccctgaacgatatggggaaagtgcgcaaagacatccagcagtgggagcccagccgcggctggaacgattggacccaggtgccattctgctcccatcactttcacgagctggtaatgaaggatgggcgggtgctcgtggtgccttgtaggaaccaagacgagctgatcggccgcgcgcggattagccagggcgcgggctggtcccttaaagaaaccgcctgcctcggaaagagctacgcccaaatgtggacgctgatgtacttccatagacgggatctgcgcctcgccgcgaacgccatctgctccgccgtgcccagccattgggtgccgaccagccggaccacgtggagcatccacgccaaacacgagtggatgactaccgaagacatgctggcagtttggaaccgcgtgtggatccaagagaacccctggatggaggacaaaacccctgtggagtcctgggaggaggtcccatatctggggaagcgggaggatcagtggtgcggtagcctaatcgggctgacgagccgcgcaacctgggccaagaatatccagaccgccatcaaccaggtccggtccctaatcggcaacgaggagtacaccgactacatgccgagcatgaagcgcttccgacgcgaggaagaagaggcaggcgtgctgtggtag

SEQ ID NO: 25033 - RNA, 9876 nt, synthetic construct
  misc_feature 1..9876: note = derived and/or modified CDS sequence (opt11) from DENV-2__FJ850067__SS-prME
  source 1..9876: mol_type = other RNA
accgcgggggtgatagtcatgctgatccccaccgccatggcgttccacctcactacccggaacggagaaccccacatgatcgtgggtcgccaggaaaaggggaaatcccttctgttcaagaccgaagacggagtcaatatgtgcaccctcatggccatcgatctaggggagctctgcgaggatactatcacctacaagtgcccgctcctgcgtcagaacgaacccgaggacatcgactgttggtgcaactcaaccagcacctgggtcacgtatgggacctgtaccaccacaggcgagcacagacgcgagaagcggtccgtggccctggttcctcacgtcggaatgggcctagagacccgcaccgaaacctggatgtcctctgagggggcgtggaagcacgtccagcgcatagaaacctggattctgcgccacccaggcttcaccatcatggctgctatcctggcttacacaatcgggaccacccatttccagcgggcgttgatcttcatattgctgacggcggtggcgcccagcatgacgatgcgctgcattggcatctctaaccgggactttgtagagggcgtgagtggcggatcctgggtggatatcgtcttagagcacgggagctgcgtgactactatggctaagaacaagcctaccctagatttcgagctgatcaaaaccgaggccaaacaaccggcgacgctccgcaagtattgcatcgaggctaagctgacgaacaccaccacagagtctcgttgccctacacagggtgaaccaagcctaaacgaggagcaagacaagcgcttcatctgcaagcactccatggtggatcggggctgggggaacgggtgtggtctgttcgggaaagggggaatcgttacatgcgcgatgtttacctgcaagaagaacatggagggcaaggtggtgcagcccgagaacttggagtacaccatcgtcatcacaccccactccggggaggaacatgccgtgggcaacgacaccgggaaacatggcaaggaaatcaagattaccccgcagtctagcatcacggaagcggagctgacgggatacggcacggtgaccatggagtgcagcccccgcacgggcttagacttcaacgagatggtcctactgcaaatggaggacaaagcctggctggtacatcggcagtggttcttggacttgcccttaccctggctgccgggcgcggacacccagggctcaaattggatccaaaaggagacgctggtgaccttcaaaaacccacacgcgaagaaacaagatgtagttgttctcggatcccaggagggcgccatgcacaccgccctgactggggccacggagatccagatgagctctggcaatctactgttcacgggccatcttaagtgccgcctgagaatggataagctccaactgaaaggaatgtcctacagcatgtgcacaggcaagttcaagatcgttaaggagatcgcggagacccagcacgggactatcgtgatcagagtccagtacgaaggcgacggctcgccttgcaagatacccttcgagatcaccgacttggagaagcggcacgtgctcgggcgcttaataaccgtgaaccccatcgtcacagagaaggatagccctgtgaatatcgaggcggaaccgcccttcggcgactcctacataataatcggagttgagccagggcagctgaagctcaattggtttaagaaggggtcttccattggccaaatgttcgaaactaccatgcgcggtgctaagcggatggctattctgggggacaccgcctgggacttcggtagcttagggggtgtcttcacgtccatagggaaagcgctccaccaagtgttcggcgcaatatatggggccgccttcagtggggtctcctggacgatgaagatcttaatcggtgtcataataacctggatcggaatgaacagccgctccacaagtctgtccgtgtctctggtgctcgttggcgtggtgaccctgtacttaggtgccatggtccaggccgactccggctgcgtggtttcttggaagaataaagaactcaaatgcgggtccggaatctttatcacggataacgtacacacctggactgagcagtacaagtttcagcccgagtctccctcaaagctagcctccgccatccaaaaggcccacgaggaagggatatgcgggatccggtcagtgacgagattggagaacctcatgtggaagcaaattacccccgagctgaatcatatactttccgaaaacgaagtgaagctcacgatcatgacgggagacattagggggatcatgcaagccggcaaacggagcttacgcccccagccgaccgaactgaagtattcctggaagacgtggggcaaagcgaaaatgctatcaaccgagtcccacaaccagacctttttaattgacggccccgaaaccgcagagtgtccgaacaccaaccgagcatggaactctctggaagtcgaggactatggcttcggagtcttcaccaccaacatctggctcaagctccgtgagaagcaggacgtcttctgcgactccaaactgatgagcgccgccataaaggataaccgcgcggtccatgctgacatggggtactggatcgaatccgcgcttaatgacacctggaagatggaaaaggcctctttcattgaggtgaagtcctgtcactggcccaagagccatacactatggtccaacggggttctggagagcgagatgattattccgaaaaacttcgcagggccggtatcacagcacaattaccgcccgggctaccatacgcaaaccgcggggccctggcacctcggcaaactggagatggacttcgacctgtgcgaggggacaaccgtggtagtcacggaggactgcggtaaccgcggtccctccttacggaccaccaccgccagcgggaagctgataacagagtggtgctgccgctcatgcaccttacccccgctccggtatcgcggggaggacgggtgctggtacgggatggagatccgtcccctcaaggagaaggaagaaaacctagtgaacagcctcgtaaccgcgggccacgggcagatcgacaacttctccttgggcgtcctcggcatggccttattcctggaagagatgctgcgcactcgaataggtaccaagcacgctatcctcctcgtggccgtgagcttcgtcacactgataaccggcaatatgtccttcagggacctcgggcgggtaatggtcatggtcggggcaaccatgacggacgacattgggatgggcgtgacctacctcgccctgctggctgccttcaaggtacggcccactttcgcagccggtctgcttttgcgtaagctgaccagcaaagagttaatgatggcgacgatcggcatagctctcttatcccagagcaccatccctgagaccatattggagttaacagacgcactagcactaggcatgatggtgctcaagatcgtgcgcaacatggaaaagtaccagcttgccgttactatcatggccatttcctgtgttccgaatgccgttatcctgcagaacgcttggaaggtgtcctgtaccatcttagcggccgtctccgtatcgccacttctcttgacatctagccagcaaaaagccgactggatcccactagccctgactatcaagggtctcaaccccacggctatctttcttacaaccctctcccgcaccagcaagaagcgttcctggcctctgaatgaggcaatcatggccgtcggcatggtgtcaatcctggccagtagtctgctcaaaaacgacatccccatgacggggcctctagtggcaggcgggctactcaccgtctgctacgtgctcaccgggcgcagcgcagatcttgaactagagcgggctgccgacgtaaagtgggaagaccaagcagagatctccgggagctcccccatcttaagcatcaccatctccgaagatggcagcatgtccatcaaaaacgaagaggaggaacaaacgctgactatcctcatcaggaccggcctgcttgttatcagcggggtgttcccggtgtccattcccatcaccgcggcggcatggtacctctgggaggtcaaaaagcagcgggccggcgtgttgtgggacgttcccagccctccgcccgtcgagaaggctgaactggaagacggggcgtacaggatcaagcagcggggcatactcgggtactctcagattggcgctggcgtatataaagaagggaccttccacactatgtggcacgtgacgcgcggcgccgtcctaatgcaccgagggaagcgcatagagcccagctgggctgacgtaaagaaggatcttatctcctacggaggtggttggaagctcgagggcgagtggaaggagggggaggaggtgcaggtccttgccctcgagccaggaaagaatcctcgggcggtgcagacgaagcccgggatattcaagacaaacacggggaccataggggcagtgagcctcgacttctcgcccggtaccagcggctcgcccatcgtcgaccgcaagggaaaagtggtaggcctgtacggtaacggcgtcgtgacccggagcggcgcctatgtttccgcgatagcacagacggaaaagtccatcgaggacaaccctgagatcgaggatgacatcttccgcaagaagcggctgaccatcatggaccttcatcccggggccggcaaaaccaagcgctacctgcccgccatagtccgtgaagccatcaagcgcgggctgcgcaccttgatcctcgcccccacgcgggtggttgcggccgaaatggaggaagccctgagaggtctgcccatccggtaccagaccaccgctatcaaaaccgagcatacgggaagggagatcgtcgacctcatgtgccacgcgaccttcaccatgcggctgctgagccccgttcgcgtacccaactataacctcatcatcatggatgaagcgcacttcaccgacccggcttccatagccgcccgtggatatattagcactcgcgttgagatgggcgaggccgctggaatctttatgaccgccacgcctcccggctcccgggatcccttcccgcagagcaacgcaccaatcatggacgaggagcgcgagataccagagcggagctggaacagcgggcacgaatgggtgaccgatttcaagggcaagaccgtgtggttcgtcccctccattaaggccgggaacgacatagcggcctgcctgaggaagaacggcaagaaagtgatccagctgagccggaagacattcgactcagagtacgtaaaaactcgcgccaacgactgggacttcgtagttacaacggatatctcagaaatgggggccaattttaaagccgagcgtgtgatcgatccgcgccggtgcatgaagccagtcatcctcactgacggggaggagcgcgttatcctggcgggccccatgcccgtgacccactctagcgccgctcagcgacgagggcgcatcggacggaacccgaagaacgagaatgaccagtacatctacatgggagagcccctcgagaacgacgaggactgcgcacactggaaagaagccaaaatgctcttggacaacataaatactccagaaggcatcatccctagcatgttcgagccggagcgggagaaggtcgacgcgatcgacggggagtaccggctgagaggggaggcccggaagacgttcgtggacttaatgcgccggggagatcttcccgtgtggctggcctacaaggtggccgcggagggtatcaactacgcggaccgcaagtggtgttttgacggcattaagaataatcagatcctcgaggaaaacatggaggttgagatttggacgaaagagggggaacggaaaaagctaaagcctcgttggttagacgcgcggatctacagcgacccgctcgccctgaaggagttcaaggagttcgcggcggggaggaagtccctgaccctaaacctcatcactgagatgggccggctgcccaccttcatgacccaaaaggcccgcaacgcgctcgataacctggcggtgctacacacggcagaggccggtggtcgggcctacaaccacgccctctctgaactgcccgaaaccctggagacactcctgctgctgactctgctggccaccgtcaccgggggtatcttccttttcctgatgtccggcaaaggtattggtaagatgacactggggatgtgctgtatcatcacggctagcatcctcctgtggtacgcgcaaattcagccccattggatcgccgcctccataatcttggagttcttcctcattgtgctgctgatccccgagccggagaagcagcggacgccccaggacaaccaactgacgtacgtcgtcatcgcgatccttaccgtagtcgccgctactatggccaacgagatgggattcctagagaagaccaaaaaggacctcggtttgggatcaatcacaacccaggagtccgagtccaacatactggacatcgacctccgacctgcaagcgcctggacgctgtacgccgtggctacgacgctagtgacgccgatgctcagacactccatcgagaacagctccgtgaatgtgagcctgacggctatcgctaaccaggcaacagtgcttatggggctcgggaaggggtggccccttagtaaaatggacatcggtgtccccctgttagcgatcggctgctactcacaggttaaccccataaccttaaccgccgccctactcctgctggtggcccactacgccattatcgggccaggcttacaggccaaggccacccgggaggcccagaagcgcgcagccgcgggcatcatgaaaaaccccaccgtcgacgggatcaccgtcatcgacctggagccgatcccctacgatccgaaattcgagaaacagctgggccaggtgatgttactgattctttgcgtcacgcaggtattgatgatgcggacgacttgggccctttgtgaagcattaaccctcgcaaccggaccgatctctacgctgtgggagggcaaccccggtcgcttctggaacactaccatcgccgtgagtatggctaacatcttcaggggctcctaccttgccggcgccgggcttttatttagcatcatgaaaaacaccacgaacaccagacgcggcaccgggaccatcggagagacgctgggggagaagtggaagtcccggcttaatgcattaggtaaaagcgagttccagatatacaaaaagtccgggatccaggaggtcgaccggactctggcgaaggaggggatcaagagaggcgagaccgatcaccatgccgtcagccgtggatccgctaagctcagatggtttgtggagcgcaacatggtcacccccgaaggcaaggtagtcgacctgggctgcgggcgtggtgggtggagctactactgtggcgggctcaaaaacgttagggaggtgaagggtctcacaaagggcggcccgggccatgaggaacccattcccatgtccacctatgggtggaacctggtgcgactgcagtccggcgtggatgtcttcttcacaccacccgagaagtgcgagaccctcttgtgcgacataggcgagagctcccccaatccaaccatagaggccggtcgcaccttgcgggttctcaacctcgtagaaaattggctgaacaacaacacccagttctgcattaaggtattgaacccctatatgccctcggttatcgagaaaatggaagccctgcagcgcaaatacggaggggcgctggtacggaatcccctgtcccgcaacagcacacatgagatgtactgggtaagcaacgcaactggcaacatagtctcttccgtcaacatgataagccgcatgctcatcaacaggttcactatgaagcataagaaggctacttacgagcccgacgtggacctgggatccggcacgcggaacatagggatcgaaagcgagatcccgaacctggacatcatcggcaagcggatagagaaaataaagcaggaacatgagacttcgtggcactacgaccaggaccacccttacaaaacctgggcttaccatggcagctatgaaaccaaacagaccggatccgcgagttctatggtgaatggcgtggtgcgcttattaaccaaaccatgggacgtggtccccatggtgactcagatggcgatgaccgacaccacaccgttcgggcaacagcgggtgttcaaagagaaggtcgacactcgcacgcaggagcccaaggagggcacgaagaaactaatgaagatcaccgcagagtggctgtggaaggagctgggcaagaagaagacgccccggatgtgcacacgcgaggagttcactcggaaagtgcgctctaacgccgcccttggggccatcttcaccgacgagaacaagtggaagagtgcgcgggaggccgtagaggacggcaggttctgggaactcgtcgaccgagagcgcaatctgcacctggaggggaagtgcgagacgtgcgtgtacaacatgatgggcaagcgtgagaaaaagctcggggagttcggcaaggccaagggcagccgcgctatctggtacatgtggctgggagcgcggttcttggagttcgaggccctcggattcctgaacgaggaccactggttttcccgtgggaacagcttgagcggcgtagagggggagggactccaccggttgggctatatcctgcgtgacgtcgggaagaaggagggcggtgccatgtacgccgacgataccgcgggctgggacacccggatcacccttgaggacctgaagaacgaggagatggttacgaaccacatgaaaggggaacacaagaaactggcggaggcaattttcaagctgacttaccagaacaaggtcgtgcgcgtgcagcggcccacaccccgcgggaccgtgatggacatcatctcccgaagagatcagcgcggcagcgggcaagtcggcacgtacgggctgaacaccttcacaaacatggaggcccaattgattagacagatggagggcgagggaattttcaagtcaatacaacacctgaccgccacggaggagattgccgtgcagaactggctggcccgagttgggcgggagcgcctcagccgaatggccatatcgggtgacgactgcgtcgtaaagccgatcgacgaccgcttcgccagcgccttgaccgccctcaacgacatgggaaagatccggaaagatatccagcagtgggagccctcccggggctggaacgactggacccaggtccccttctgcagtcaccactttcacgagctggttatgaaagacggccgggtgctggttgtgccctgccgcaatcaggacgaactgatcggccgggcgaggatctctcagggcgccgggtggagtttaaaggagaccgcctgcttaggtaagtcctacgcccagatgtggaccctgatgtacttccaccggagagatctccgattggccgccaacgcgatctgctcggctgtgccatcccattgggttcctacgagcagaactacctggtccatacacgccaagcacgagtggatgaccacggaggacatgttagcggtatggaaccgggtgtggatccaagaaaatccctggatggaggacaagaccccggtcgagagctgggaggaggtgccctacctgggtaagcgcgaggatcagtggtgtggcagcctcatcggattaacttctcgggccacctgggccaagaacatccaaacggccattaaccaggtgcgcagcttgatcggcaatgaggagtacaccgactacatgccctccatgaagagattccggcgcgaggaggaggaagccggcgtcttgtggtga

SEQ ID NO: 25034 - RNA, 9876 nt, synthetic construct
  misc_feature 1..9876: note = derived and/or modified CDS sequence (opt11) from DENV-2__FJ850060__SS-prME
  source 1..9876: mol_type = other RNA
acagccggcgtcatcgtcatgctgatccccaccgccatggcgttccacttgaccacacgcaacggggagccccacatgatcgtcgggcggcaggagaaggggaagtcgctgctgttcaagaccgaggacggtgtgaacatgtgcaccctaatggccatagacctgggggagctttgcgaagacaccatcacctacaagtgccccctcctgcgccagaacgagcccgaggacatagactgctggtgtaacagcaccagcacctgggtcacctacggaacctgcaccaccacgggcgagcaccggcgcgagaagcggtccgtggcactggtaccccacgtcggaatgggcctcgagacccgcaccgagacctggatgagctccgaaggcgcctggaagcacgtgcagcggatcgagacctggatcctgcgccacccgggttttacaatcatggccgcgatattagcttacaccatcgggaccacgcacttccagcgcgccctcatcttcatcctgctaaccgccgtggcgcccagcatgacaatgcgctgcatcggcatctccaaccgggacttcgttgagggcgtaagcgggggctcctgggtggacatagttctcgagcacgggagctgcgtgaccacgatggccaagaacaagcccaccttggacttcgagctgatcaagaccgaggccaagcagccggccaccctccgcaagtattgcatagaggccaagttaacgaacaccaccaccgagtcccggtgccccacgcagggcgagcccagtctgaacgaggagcaggacaagcgcttcatctgcaagcactccatggtggaccgaggctgggggaacggctgcgggttattcggcaagggcggcatcgtgacctgcgcgatgttcacgtgtaagaagaatatggagggcaaggtggttcagcccgagaacctggagtacaccatcgtcatcactccccacagcggggaggaacacgccgtgggcaacgataccgggaagcacggcaaggagatcaagatcacgccgcagtccagcatcaccgaggccgagctgaccggttacggcacggtgaccatggagtgcagccccaggaccggcctcgatttcaacgagatggtcctgctgcagatggaggacaaggcctggctcgtgcacaggcaatggttcctggacctgcccctcccctggctgccgggggccgacacccagggcagcaactggatccagaaggagacgctggtgaccttcaagaacccccacgcgaagaagcaggacgtcgtggtcctcggctcccaggagggcgccatgcacaccgccctgactggggctacggagatccagatgtccagcggcaacctcctgttcaccggccacctgaaatgccgcctgcggatggacaagctccagctgaaggggatgagctacagcatgtgcaccggcaaattcaagatcgtgaaggagatcgccgagacccagcatgggacgatcgtgatccgcgtccagtacgaaggcgacggctccccctgcaagatacccttcgagatcaccgacctggagaagcggcatgtgctcgggcgcctgatcaccgtgaacccgatcgtcaccgagaaggacagccccgtgaacatcgaggcggagccgcccttcggcgactcctacatcatcatcggggtggagccgggccagctgaagctcaactggttcaagaaggggagctccataggccagatgttcgaaacgaccatgcgcggcgccaagaggatggccatcttaggggacaccgcctgggacttcggcagcctcgggggcgtcttcacctccatcgggaaggccctccaccaggtgtttggggcgatctacggcgccgccttcagcggcgtgtcctggacgatgaagatcctgatcggcgtcatcatcacctggatcgggatgaacagccgctccaccagcctgtcagtgagcctggtgctcgtcggcgtggtcaccctgtacctaggggccatggtccaggcggactccggctgcgtggtgagctggaagaacaaggagctcaagtgcggctccgggatcttcatcacggacaatgtccacacctggaccgagcagtacaagttccagcccgagagccccagcaagctggcctccgccatccagaaggcccacgaggagggcatctgcgggatccggagcgtgacccgcctggagaacttaatgtggaagcagattacgcccgagctgaaccacatcctgtccgagaacgaggtgaagctcaccatcatgaccggcgacatcaagggcatcatgcaggcgggtaagcggagcctgcgcccgcagcccaccgagctaaagtactcctggaagacgtggggcaaggcgaagatgctcagcaccgaatcccataaccagaccttcctaatcgacgggcccgagaccgccgagtgccctaacacaaaccgggcctggaacagcctggaggtcgaggactatggcttcggggtgttcaccaccaacatctggctgaagctgcgcgagaagcaggacgtgttctgcgactccaagctaatgagcgccgccatcaaggacaaccgggcggtccacgccgacatgggctactggatcgagtccgccctcaacgatacctggaagatggagaaggcctcattcatcgaggtgaagtcctgccactggcccaagagccacaccctgtggtccaacggcgtacttgagagcgagatgatcatccccaagaactttgccgggcccgtctcccaacacaactaccgcccgggctaccacacgcagaccgcggggccctggcacttgggcaaactggagatggacttcgacctctgcgaggggaccaccgtggtggtcacggaggactgcggcaaccggggccccagcctccgaaccactaccgccagcgggaagctgattacggagtggtgctgccgttcctgcaccctgcccccgctccgctaccggggcgaagacgggtgctggtacggcatggagatccgccccctgaaggagaaggaggaaaacttggtgaacagcctagtgacggcagggcacggccagatcgataacttctccctgggcgtactagggatggcgctcttcctggaggagatgctccggacccgcatcggtacgaagcacgcgatcttgctagttgccgtaagcttcgtcaccctgattaccgggaacatgtcgttccgggatctcggccgcgtgatggtgatggtcggggccaccatgacggacgacatcggcatgggtgtgacctacttagccctgttagccgcgttcaagatacgccccaccttcgccgcagggctgctgctccggaagctgaccagcaaggagctgatgatggccacgataggcatcgccctcctgtcccagagcaccatccccgagaccatcctggagctcactgacgcccttgcactggggatgatggtgctcaagatcgtccgcaacatggagaagtaccagctggctgtcacgatcatggccatctcctgtgtgccgaacgccgtcatcttgcagaacgcttggaaggtcagctgcgctatcttagcggccgtgtccgtcagcccgctgctgctcacctccagccagcagaaagcagactggatccccctggccctgacaatcaagggcctcaaccccaccgccatcttcctgaccaccctgtcccggaccagcaagaagcgctcctggccgcttaacgaggcagtcatggccgtcgggatggtgagcatcctggcgtcgagcctgttaaagaacgacatccccatgaccgggcccctggttgccggcggactgctcacggtctgctacgtgctgaccggccggagcgccgacctggaactggagcgcgccgccgacgtgaagtgggaggaccaggcggagatctccgggtcaagcccgatcctgagcatcaccatctccgaggacggcagcatgtccatcaagaacgaggaggaggagcagaccctgacgatcctcatccggaccggcctgctggtcatcagcggtgtgttcccggtgtccatccccatcaccgccgccgcatggtacctctgggaggtcaagaagcagcgcgccggcgtgctctgggacgtgccctctccgccgcccgtcgagaaggcggaactggaggacggggcctaccggataaagcagcgcggcatcctcggttactcccagatcggcgccggagtgtacaaggaggggaccttccacaccatgtggcacgtgacgcggggcgccgtccttatgcaccgcgggaagcggatcgagcccagctgggccgacgtgaagaaggacctgatctcctacggcggaggctggaagctcgagggcgagtggaaggagggggaggaggtgcaggtcctggcgttagagcccggcaaaaacccccgcgccgtgcaaaccaaacccgggatcttcaagaccaatactggcacgatcggggccgtgagcctcgacttctcccccggcaccagcgggtctcccatcgtcgaccggaaagggaaggtggtgggcttatacggcaacggcgtcgtgacccgcagcggcgcctacgtatccgcgatcgcgcagaccgagaagtccatcgaggataaccccgagatcgaggacgacatcttccggaagaagcgcctgacaatcatggacctccaccccggtgccggcaagaccaagcggtacctgcccgccatcgtccgcgaggccatcaagcgggggctgcgcaccctgatactcgcgccaacccgcgtggtggccgccgagatggaggaggccctgcggggcctgcccatccgctaccagacgcccgcgatcaagaccgagcacaccgggcgggagatcgtagacctcatgtgccacgcgacctttacaatgcgcctgctgagccccgtgagagtgccaaactacaacctaatcatcatggacgaggcccacttcaccgaccccgcctccatcgccgcccgcggctacatcagcacccgggtcgagatgggtgaggcggccgggatcttcatgaccgccacgcctcccggctcccgggacccgttcccccagagcaacgcccccatcatggacgaggagcgggagatcccagagcgctcctggaactccgggcacgagtgggtgaccgactttaagggcaagaccgtgtggtttgtcccgtccattaaggcggggaacgacatcgccgcctgcctgcggaagaacggcaagaaggtcatccagctgtcacgcaagaccttcgactccgagtacgtgaagacgcgggccaacgactgggacttcgtcgtgaccaccgacatcagcgagatgggcgctaacttcaaggcggaaagggtgatcgacccccggcgttgcatgaagcccgtcatcctcaccgacggggaggagcgggtcatcctggccggccccatgccggtaacgcactcgagcgccgcccagcgccgggggcgcatcggccgcaacccgaagaacgaaaacgaccagtacatctacatgggggagcccttagagaacgacgaggactgcgcccactggaaggaagcgaaaatgctcctggacaacatcaacacacccgagggcatcatcccgtccatgttcgagcccgagcgggagaaggtcgacgccatcgacggcgagtaccgcctgcgcggggaggcccgtaagaccttcgtagacctcatgcggaggggcgacctgcccgtgtggctggcctacaaggtggccgcggaggggatcaactacgccgatcggaagtggtgcttcgacggcatccgcaacaaccagatcctcgaggaaaacatggaggtggagatctggaccaaggagggagaacggaagaagctgaaaccgcgctggcttgacgcccgaatctacagcgaccccttagccctgaaggagttcaaggagttcgcggccggccgcaaatccctaacgctcaacctgatcaccgagatgggcaagctgccaaccttcatgacccagaaggcccggaacgcactcgacaacctggccgtactgcacacggcggaggccgggggccgcgcctacaaccacgccctgtcagagctgccggagaccctggagactctcctgttgctcaccctgctggccacggtaactggggggatcttcctcttcctgatgtccggcaaggggatcggcaagatgaccctggggatgtgctgtatcatcacagcaagcatcctcctgtggtacgcccagatccagccgcattggatcgccgcctccattatcctggagttcttcctcatcgtactgctgatccctgagcccgagaagcagcggacgcctcaggacaaccagctcacgtacgtcgtgatcgccatcctgaccgtggtcgccgcaaccatggccaacgagatgggcttcttagagaagaccaagaaggacctcgggctgggcagcatcacgacccaggagagcgagtccaacatcctggacattgacctccgcccggccagcgcctggaccctgtacgcggtggcgaccacattcgtgacccccatgctgagacactccatcgagaactcaagcgtcaacgtgagcctcaccgccatcgccaaccaagcgaccgtcctgatgggcctggggaagggctggcccctcagcaaaatggacatcggggtccccctgctggccataggctgttatagccaggttaacccgatcacgctcaccgccgccctgctgctcctggtggcccactacgcgatcatcggccccggcctgcaggccaaagccacccgcgaggcccagaagcgggccgcagccggtatcatgaagaaccccaccgttgacgggatcactgtgatcgacctcgagcccatcccgtacgaccccaagttcgagaagcagctcggccaggtgatgctgctcatcctgtgcgtcacccaggtgctgatgatgcgcaccacctgggcgctatgcgaggccctgacgctggccaccgggcccatctccaccttatgggagggcaaccccgggcggttctggaacaccacgatcgcggtgagtatggccaacatcttccgcggctcctacttagccggcgccgggctgctgttctctatcatgaagaacaccaccaacacccgccggggcacggggaacatcggcgagaccctgggtgagaagtggaagtcccgcctaaacgcgctcggcaaaagcgagttccagatctataagaagtccggcatacaggaggtcgacaggaccctggccaaggaggggatcaagcgcggcgagaccgaccaccacgccgtgagccgggggtccgccaagctgcgctggtttgtggagcggaacatggtcacgccggagggcaaggtggtggacctcggctgcgggcgcggcgggtggtcctactactgcggcgggctcaagaacgtccgggaggtgaagggcttaaccaagggcgggcccggccacgaggagcccatacccatgtccacctacgggtggaacctcgtgcgcctacagagcggcgtcgacgtgttcttcaccccgcccgagaagtgcgacacgctgctctgcgacatcggggagtcgtcccccaatcccacaatcgaggccggccgcaccctgcgcgtactgaacctcgtcgagaattggctgaacaacaacacccagttctgcatcaaggtgttgaacccgtacatgcccagcgtgatcgagaagatggaggcgctccagcggaagtacggcggggccctggtccgcaaccccctgtcccggaacagcacccacgagatgtattgggtatccaacgccacgggcaacatagtgagctccgtcaacatgatcagccgcatgctgatcaatcggttcaccatgaaacacaagaaggccacctacgagcccgacgtggacctcgggtccggcacccgcaacatcggtatagagagcgagatccccaacctggacatcatcggcaagcggattgagaagattaagcaggagcacgagacctcctggcactacgaccaggaccacccctacaagacctgggcctaccatggcagctacgagaccaagcagaccgggtccgcgagctccatggttaacggcgtcgtgcgcctgctcacgaagccttgggacgtggtccctatggtgacccagatggccatgaccgacaccacgcccttcgggcagcagcgcgtgttcaaggagaaggtcgacactcggacccaagagcccaaggaaggcactaagaagctgatgaagatcacggccgagtggctgtggaaggagctcggcaagaagaagacgcccagaatgtgtacccgggaggagttcacccgcaaagtgcggagcaacgccgccctgggggcgatcttcacggacgagaacaagtggaagtccgccagggaggccgtggaggacggccggttctgggaactggttgacagagagcggaacctccacctggaggggaagtgcgagacctgcgtgtacaacatgatgggcaagcgcgagaagaagctgggtgagttcggcaaggccaagggcagccgggcgatctggtatatgtggctcggggcccgcttcctggagttcgaggccctgggctttctcaacgaggaccactggttctcccgggggaacagcctgagcggcgtggagggggagggcctgcaccgcctcggctacatcttgcgggacgtcgggaagaaagagggcggagccatgtacgccgacgacaccgcgggctgggacactcgcatcaccctagaggacctcaagaacgaggagatggtgaccaaccacatgaagggggagcacaagaagctggccgaagctatctttaagctgacctaccagaacaaggtcgtgcgggtgcaacgcccgacgccccggggcacggtcatggacatcatctcccgccgggaccaacgcggcagcgggcaggtcggcacctacgggctcaacaccttcacaaacatggaggcccagctgatccgccagatggagggcgagggcatctttaaatccatccagcacctgacggcaactgaggagatcgccgtgcagaactggctcgcccgggtcgggagagagcggctgagccgcatggccatttccggcgacgactgtgtggtgaagcctatcgacgaccggttcgccagcgccctgaccgcgctcaacgatatggggaaggtccgcaaggacatccagcagtgggagccctcccggggctggaacgactggacccaggtgccgttctgcagccaccacttccacgagctagtcatgaaggacgggcgcgttctggtggtgccatgccggaaccaggacgagctcatcggccgcgcccggatctcccagggcgccgggtggagcctgaaggagacggcctgcctgggcaagtcctacgcccagatgtggaccctcatgtacttccaccgccgggacctgcgcttggcggccaacgccatctgcagcgccgtgccgccccactgggtgccgaccagccggaccacctggagcatccacgcgaaacacgagtggatgaccaccgaggacatgcttgccgtgtggaaccgcgtctggatccaggggaacccctggatggaggacaagacccccgtggagtcctgggaggaggtgccctacctgggcaagcgggaggaccagtggtgcgggagcctgatcggcctcacctcccgcgccacgtgggccaagaacatccagaccgccatcaaccaggtccggagcctgatcggcaacgaggagtacaccgactacatgccgagcatgaagcgtttcagacgggaggaagaggaggcgggggtgctatggtga

SEQ ID NO: 25035 - RNA, 9876 nt, synthetic construct
  misc_feature 1..9876: note = derived and/or modified CDS sequence (opt11) from DENV-2__FJ850061__SS-prME
  source 1..9876: mol_type = other RNA
accgcaggcgtgatcattatgctgatccccaccgccatggcgttccacctcaccacccgtaatggggaaccccacatgatagtcggcagacaggaaaaggggaagtccctcctgttcaagaccgaagatggtgtgaacatgtgcaccctcatggccatcgacctgggggagctttgtgaggacaccatcacctacaaatgccccctcttacgccagaacgagccagaggacatcgactgctggtgcaacagtaccagcacgtgggtgacgtacgggacctgtaccaccacgggcgagcaccggcgcgagaagaggtcagtcgccctggttccacacgtagggatgggactagagactcgcaccgaaacctggatgtcttcagagggggcttggaagcatgtccaacggatcgaaacatggatcctgagacatccgggcttcacgattatggccgcgatacttgcctacaccatcgggaccacgcatttccagagagcgctcatcttcatcctgctcactgccgtagcgccctctatgaccatgcgctgcatcggcatctccaatcgggacttcgtcgagggcgtcagcgggggcagttgggttgacatcgtcctggagcatgggagctgcgtaaccacgatggccaaaaacaaacctacgctcgacttcgaactgatcaagacggaggccaagcagccagccaccctgcgtaagtactgcatcgaggcgaaactaacgaacaccacaaccgagtcgcggtgtccgacgcagggcgagccgagcctgaacgaggagcaggacaagaggttcatctgcaaacactcaatggtcgaccggggctgggggaacggctgcgggctgttcgggaaaggtggcatcgtgacctgcgcgatgttcacgtgcaagaagaacatggaaggcaaagtcgtgcagccagagaatctggaatatacaatcgtgatcacgccgcatagcggggaggagcacgcagtcgggaatgacacggggaaacacggcaaggaaatcaagatcaccccgcagtcctcgataactgaggccgaactgactgggtacggcactgtgacgatggagtgcagccccagaaccggcttagacttcaacgagatggtgctgctgcagatggaggacaaggcctggcttgtccaccggcagtggttccttgacctgcccctcccctggctgcccggggccgacactcagggcagcaactggatccagaaagagacactggtcactttcaagaaccctcatgcgaagaagcaagacgttgtcgtgctcgggagccaggagggcgctatgcacaccgccctgaccggggcaaccgaaatccaaatgagtagcggcaacctcctgttcaccgggcacctgaagtgccgcctgcgcatggacaagctacagttaaaggggatgtcctacagcatgtgtaccggcaagttcaagatcgtcaaggagattgcggagacccaacacggcaccattgtaatccgcgtgcagtacgagggcgatggttccccatgtaagatccccttcgaaatcactgacctggagaagcggcacgtcttagggcggctcatcacagtgaacccgatcgtgaccgagaaagacagtcccgtcaacatcgaggcagagccgcccttcggcgactcctacattatcattggggtcgagccgggccagctaaagttgaactggttcaagaaagggagctccatcggccagatgttcgctacgactatgaggggtgccaagcgtatggccatcctgggggacaccgcctgggatttcggtagcttagggggtgtctttacctccatagggaaggcgctccaccaagtattcggggccatctatggcgcggccttcagcggggtgagttggacgatgaagatactgatcggcgtgattattacttggatcgggatgaactcacgctccaccagcctgtccgtcagcttggttctcgtgggcgtagtgactctgtacctgggggcaatggtgcaggccgacagcgggtgcgtcgtgagctggaagaacaaggagttgaagtgcggctccgggatcttcatcacggacaacgtgcacacatggaccgagcagtacaagttccaacctgagtcaccctcgaagctggcctccgccattcagaaggcccacgaggagggcatctgcggcatccggtcagtgacccgcctggaaaatctcatgtggaagcagatcacgcccgaactgaatcacatcttaagtgaaaacgaggtgaaactgacaatcatgacgggggatatcaaggggataatgcaagctggcaaacggtcattgcgcccgcagcccaccgagctgaagtattcctggaagacgtggggcaaggctaaaatgctcagcaccgagtcccacaatcagacctttctgatcgacgggcccgagacggccgaatgcccgaacacaaaccgggcctggaacagtctggaggtggaagactacggctttggagtcttcaccaccaatatctggctcaagctgcgcgagaagcaagacgtgttctgcgactctaaactgatgagcgctgcgatcaaggacaaccgtgccgtgcacgctgacatgggctattggatcgagtcagctctcaacgacacgtggaagatggaaaaagctagcttcatcgaggtcaaatcatgccattggccaaaaagccataccctgtggtccaacggcgtcctggagagcgagatgataatccccaagaacttcgcggggccagtgtcccagcacaactaccgcccgggataccacacgcagaccgccggaccgtggcacctcggtaaactcgagatggactttgacctgtgcgaggggacaaccgttgtggtgacagaggactgcggcaatcgaggtcccagcctgcgtacgaccaccgcctccggaaagctaatcacggagtggtgctgtcggtcctgcacgttacccccgttacgctaccggggagaggacggctgttggtacggcatggagatccgtcccctgaaggaaaaagaggagaacctggtcaatagtcttgtgaccgctgggcacggacagatcgacaacttcagcctgggtgtgctgggaatggcattgtttctcgaggagatgctgcgaaccagaatcggcacgaagcatgccatcctcctggtcgccgtgtccttcgtcacccttattacggggaatatgtctttccgggacctcggccgcgttatggtaatggtgggcgcgaccatgaccgacgatattggaatgggcgtcacgtacctggccctgctggcggccttcaaagtgaggccaaccttcgcggcagggctcctgttacggaagctgacctcgaaagagctgatgatggctacgatcggcatcgccctcctgtcccagagcacaataccggagaccatcctagagctcactgacgcgctggcgcttggtatgatggtcctaaaaatcgttcgcaacatggagaagtatcagctggcggttacgatcatggccatatcctgcgtaccaaatgccgtaatactacagaacgcctggaaggtcagctgcaccattctcgccgctgtgtccgtcagtcccctgctgctcacctccagccagcaaaaagcggactggatcccgttggctctcactattaagggactcaaccctacggccatatttctgactacactgtccagaaccagcaagaaacgctcctggcctctaaacgaagccatcatggcagtgggcatggtttctatcctcgcttccagcctactcaagaacgatattcccatgacgggtccgttggtggcgggcgggctgctgaccgtgtgctacgttctgaccggccggtctgccgacctggagttggagcgcgccgccgatgtgaagtgggaagaccaagcggagatatctggaagcagcccaatcctgagcatcaccatctctgaggacggcagcatgtccataaagaacgaagaggaggagcagacgctgacaatccttatccggactggtctcctggtgatctccggcgtattcccggtgagtatccccatcacagccgccgcctggtacctctgggaggtgaagaagcagcgagcgggcgtcttatgggacgttccctcaccaccgccagtggagaaggcggagctggaagacggggcctaccggatcaagcaacgaggcatacttgggtactcacagattggcgccggtgtctacaaggaagggacctttcacacgatgtggcacgtgacccggggcgccgtactgatgcaccgcgggaagcggatagagcctagctgggccgacgtgaagaaggaccttatcagctatggcgggggctggaaactcgaaggcgaatggaaagagggtgaggaagtccaggtactagcgctggagcctggcaagaatccccgcgcagtgcagaccaagcccgggatcttcaagaccaacacgggaactataggggcggtgagcctcgacttcagccccgggaccagcggcagccccatcgtcgaccggaaggggaaggtcgtgggcctgtacgggaacggcgtggtgacccgaagtggcgcctacgtatccgcgattgcccaaacggaaaaatccatcgaagacaaccccgaaatcgaggacgacatcttccggaagaaacgcctgacgataatggatctccatccgggggccggaaaaaccaagcggtacctgcccgccatcgtacgcgaggccatcaagcgggggctaaggacccttatccttgcgccaacccgcgtggtggccgccgagatggaagaggccctgcggggtctgcccatacgctaccagacgcccgccataaagaccgaacacaccggacgggagattgtggatctcatgtgtcacgcgacgttcaccatgcgcctgttgagccccgtcagggtacctaattacaacctcatcatcatggacgaggcacacttcacagaccctgcctccattgctgcacgcgggtacataagcacccgggtggaaatgggcgaggcagccgggatcttcatgactgcaacgccgcccggctcccgtgacccgttcccgcagagcaatgcgcccatcatggacgaggagcgggaaataccagaaagatcctggaacagcgggcacgagtgggtcaccgacttcaagggtaagacagtgtggttcgtgccatccataaaagctgggaacgacatcgctgcttgcctgcggaagaatggtaagaaagtcatccagctatcccgcaagacgttcgactccgagtacgtgaagaccagagccaacgattgggacttcgtggtcacaaccgacatttccgagatgggagcaaacttcaaggctgagcgagtgatagacccccggcgctgcatgaagcccgttatcctcacggacggggaggagcgcgtgatcctggccggaccgatgccggtgacccactccagcgccgcccagcgccgggggcgcatcggccgcaaccccaaaaatgagaacgaccagtacatttacatgggagagcccttggaaaacgacgaggactgcgcccactggaaggaggcgaagatgctcctcgacaacatcaacacccccgagggcattataccgagcatgtttgagcccgagcgcgagaaggttgacgctattgacggcgagtacaggctgcgcggggaagcccgcaaaacttttgtagacctcatgcggaggggcgacttacccgtgtggctggcgtacaaggttgcggcggaggggatcaactacgctgaccgtaagtggtgcttcgatggtattaagaacaaccagatcctcgaggaaaacatggaagtcgaaatctggacgaaagagggggagcgcaagaaactgaaaccacggtggctggatgcccgcatttacagcgaccccctagctctgaaagagttcaaggagttcgcggccggtcggaaatctctcaccctaaacttgattacggaaatgggcaggctgccaacattcatgacgcagaaggccaggaacgcgctggataacctggcggtgttacacaccgccgaggcaggcgggcgcgcctacaatcacgccctctcggagctgcccgagactctggagaccctcctgctgcttacgctgctcgcgaccgtgaccggagggatttttctcttcctgatgagtgggaaggggatcggcaagatgacactgggaatgtgttgcatcatcaccgcgagtatcttactgtggtacgcccagatccagccacactggatcgccgcctcgatcatcctggagttctttctcatcgtcctcctgatccccgaacccgagaaacagcggacgccccaggacaatcagctcacctacgtggtcatcgccattctaaccgtggtcgcagccaccatggccaacgagatgggctttttagagaagacgaagaaggacttagggctgggcagcatcacgacccaggagtctgagtcgaacattttagacatcgacctccgaccggcatcggcctggaccctgtatgctgtcgctacgacttttgtgacacccatgctgcggcactccatcgaaaatagttcagtgaacgtcagtctgaccgcgatcgccaaccaggcaacggtgctgatgggcctcgggaaggggtggcccctgtcgaaaatggatatcggggttcccctgctggccatcggctgttacagccaggtcaagccgatcacgtttacagccgccctcctgttactcgtagctcactatgcgatcatcggaccaggcctgcaggccaaggcgccccgcgaggcccagaagcgagcggcggcgggcataatgaagaatcccaccgtggacggtatcaccgtcattgacctggagccgatcccctatgaccccaagttcgagaaacagcttggccaggttatgctgctgattctatgcgtcacccaggttctgatgatgcggacaacatgggccctgtgtgaggccttgacgttggctaccggacctatctccaccctgtgggaaggcaacccgggaaggttctggaacaccacgatagcggtttcgatggccaacatctttcgcggctcctacctcgccggcgccgggctcttattctctattatgaaaaacaccaccaacacacggcggggcacggggaacatcggtgagaccttaggagaaaagtggaagtcccgcctgaacgctctgggcaagagcgagttccagatttacaagaagtcaggtatccaagaagtggaccggaccctcgctaaggaggggatcaaacgcggcgagaccgaccaccacgccgtcagccgagggtccgcgaagctgcgatggttcgtggagcggaacatggtgacgccagagggtaaggtcgttgatctggggtgcggtcgcggcgggtggagctactattgtggtggcctcaagaacgtgcgggaggtcaaaggcctgaccaagggcgggcccggccatgaggaacccatcccgatgtccacctacggttggaacctggttcgcctccagagcggcgtggacgtgttcttcacgccacccgagaagtgtgatacgttgctgtgtgacataggagagtccagccccaacccgaccatcgaggccggcaggaccctccgtgtcttgaacttagtggaaaactggctcaataataacacccaattctgcatcaaggttctgaacccctatatgccctcagtgatcgagaaaatggaagcgctgcagagaaagtacggcggagcgctagttcgcaatcccctgtcccggaacagcacccacgagatgtactgggtctccaacgccaccggcaacattgtgtcctcggtcaacatgatctcccgcatgctgattaacagattcacaatgaagcacaagaaggcaacgtacgagcccgacgtcgacttgggatctggaaccagaaacatcgggatcgagagcgaggtaccaaacttggacatcatagggaagcggatagagaaaatcaaacaggagcacgagacgtcctggcactacgaccaagatcacccttataagacttgggcctaccatggcagctatgagaccaaacagaccggtagcgctagctccatggtgaacggcgtggtacgccttctgactaagccgtgggacgtggtgcccatggtgacccaaatggccatgaccgacaccacgcccttcgggcagcagcgcgtgtttaaggaaaaggtcgacacccggacacaggagcccaaggagggaaccaagaagttgatgaagatcacagccgagtggttatggaaagagctaggcaagaagaaaaccccacggatgtgcactcgggaagagttcacccggaaggtgagatccaacgcagccctcggggcgattttcacggacgagaataagtggaagtccgcccgggaggccgtggaagacggtcggttctgggagctggtagaccgcgagcggaatctgcacctcgagggtaagtgcgagacctgcgtgtataacatgatgggaaagcgcgagaaaaagttgggtgagttcggcaaagccaagggtagccgtgcgatctggtacatgtggctgggtgccaggtttctcgagttcgaggcactgggcttcctgaatgaggaccactggttcagccgggggaactcgctctctggcgttgagggcgagggtctgcaccgcctgggttacatcctccgggacgtcgggaagaaggaaggcggcgccatgtacgccgacgacaccgcgggctgggatacacgcataactctcgaagacttaaagaacgaggagatggtgaccaaccatatgaagggggagcataagaaacttgcagaggctatcttcaagctaacctaccagaacaaggtcgtgcgggtccagagacccacaccccggggtactgtcatggatattatttcacgccgggatcagcgcggcagcggacaggtgggtacctacggactgaacaccttcacaaacatggaggcccagctaatcagacagatggaaggggagggtatattcaagagcatccagcaccttacggccaccgaggagatcgctgtgcagaactggctggctcgggtcgggcgcgaacgcctaagtcgtatggccatctctggagacgactgcgttgtgaagccaatagacgacagattcgccagcgctctgaccgcgctgaacgacatgggaaaggtacgcaaggacatccaacagtgggagccgtcgcggggctggaacgactggacccaggtgccgttctgttcacatcacttccacgagctcgtgatgaaggacgggcgcgtcctggtggtcccctgccggaaccaggacgagctcatcggccgcgcccggatcagccagggggcagggtggtcgctcaaggagacggcctgcctgggcaagtcctacgcccagatgtggaccctaatgtatttccaccggcgggacctccgcctggcggccaacgccatctgcagcgctgtgccgccacattgggttcccacatcccggaccacttggagcatccacgcgaagcacgaatggatgacgaccgaggacatgctggccgtgtggaacagagtctggattcaggagaacccttggatggaggacaagaccccagttgagtcctgggaggaggtgccctatctcgggaaacgggaggatcaatggtgcggcagcttaatcgggctgacctcccgggccacttgggccaaaaatatccagaccgccataaaccaggtgagaagcctcatcggcaacgaggagtacactgattatatgcccagcatgaagcggttccgccgggaggaggaagaggcgggcgtgctgtggtaa

SEQ ID NO: 25036 - RNA, 9876 nt, synthetic construct
  misc_feature 1..9876: note = derived and/or modified CDS sequence (opt11) from DENV-2__FJ744709__SS-prME
  source 1..9876: mol_type = other RNA
acagccggcgtgatcgtaatgctgattcccaccgctatggcgttccacctgaccacccgcaacggggagccccacatgatagtgggccggcaggaaaaggggaagtccttgctgttcaagaccgaggatggcgtaaacatgtgtaccctcatggcgatcgacctgggggagctgtgcgaggacacaatcacatacaagtgtcccctcctccgccagaacgagcccgaagacatcgactgctggtgcaacagcacctccacctgggtgacctacgggacctgcaccaccaccggcgagcaccggcgcgagaagcggtccgtggccctggtgccccacgtagggatgggcctcgagacccgaaccgagacctggatgagcagcgagggggcctggaaacacgtgcagcggattgagacgtggatcctacgccaccctggcttcaccatcatggcggcagtgcttgcctacaccattgggaccacccacttccagaaggccctcatcttcatcctgctgactgccgtcgcgcccagcatgaccatgcggtgcatcggcatcagcaaccgcgacttcgtggagggcgtgagcgggggcagctgggtcgacatcgtgctcgagcacggctcttgcgtgaccaccatggccaagaacaagcccaccctggacttcgagctgatcaagaccgaggccaagcagcccgccaccctccggaagtactgcatcgaggccaagctgacgaacacgaccaccgagtcccgctgcccgacacagggcgagcccagcctgaatgaggaacaggacaagcggttcatctgcaagcactccatggtcgaccgcggctggggtaacggctgcgggctgttcgggaagggcgggatcgtgacctgcgcgatgtttacgtgcaagaagaacatggagggcaaagttgtccagcccgagaatctggagtacaccatcgtgataactccccacagcggggaggagcacgccgtggggaacgacacaggaaagcacggcaaagaaatcaagatcaccccacagtccagcatcaccgaggccgagctgaccgggtacggcacggtcaccatggagtgcagcccccgcaccggccttgacttcaacgagatggtgttactgcagatggaggacaaggcctggctcgtgcaccgccagtggtttctggacctgcctctcccctggctgccgggggcagacacacagggcagcaactggatacagaaggagacgctggtcaccttcaagaacccccacgcgaagaaacaggacgtggttgtcctcgggtcccaggaaggcgccatgcacaccgccctgaccggggccacggaaatccagatgagtagcggcaacctcctgttcaccggccacctgaagtgccggctgcgtatggacaaactccagctgaagggaatgtcctacagcatgtgcaccggcaagttcaagatcgtgaaggagatcgcagagacccagcacgggacgatcgtcatccgggtacaatacgagggagacggctcgccctgcaagatcccctttgagatcaccgacctggagaaacgccacgtgctcggacggttaatcaccgtcaacccgatcgtgacagagaaagacagccccgtgaacatcgaggcggagccgccgttcggcgactcctacatcatcatcggggtcgaaccaggccagctgaagctcaattggttcaagaagggtagctccatcggacagatgtttgagaccaccatgcgcggcgctaagcgcatggccatcctgggggacaccgcctgggactttggttcgctcggcggggtgtttacctccatcgggaaggccctccaccaggtgttcggggcgatttacggcgcagccttcagcggggtgtcctggacgatgaagatcctgatcggagtgataatcacatggatcgggatgaacagcaggtccaccagcctgtcggtgagcctggtcctcgttggcgtggtaaccctgtacctgggggccgtggtacaggcggactccggctgcgtcgtctcgtggaagaacaaggagctgaagtgcggctcagggatcttcatcacggacaatgtgcacacctggaccgagcagtacaagttccagcccgagagcccctcgaagttggccagcgccatccagaaagcccacgaggagggcatatgcgggatccgcagcgtcacccgtctggagaacttgatgtggaagcagatcacgcccgagctgaaccatatactgagtgagaacgaggtgaagctcaccatcatgacaggcgacatcaaggggatcatgcaggccggcaagcgcagcctgcggccacaacccactgagctgaagtacagttggaagacgtggggcaaggcgaagatgctcagcaccgagtcccataaccagaccttcctgatcgacgggcccgagaccgccgagtgcccaaacacgaacagggcctggaactcgctggaagtggaagactacggcttcggtgtcttcaccaccaacatttggctcaagctgagagagaagcaggacgtgttctgcgactctaaactgatgagcgcagcgatcaaggacaacagagcggtgcacgccgacatgggctactggatcgagtccgccctcaacgatacctggaaaatggaaaaggccagcttcattgaggtaaaatcctgccattggcctaagtctcacaccctgtggtccaacggcgtgctggaaagcgaaatgatcatccccaagaactttgctggacccgtgtcccagcacaattacaggccgggctaccacacgcagacggcgggcccctggcacctcggcaagttagagatggacttcgacttctgcgaggggaccaccgtcgtggtgaccgaggactgtggcaaccgcggccccagcctgcggactaccactgcctcggggaagcttattacggagtggtgctgccgctcctgcaccctgcccccgttgcgctaccgcggcgaggacgggtgctggtacggaatggagatccggcctctcaaggagaaggaggaaaacctggtcaacagcctggtgaccgccgggcacggacagatagacaatttcagtctcggcgtgctgggtatggccctgttcctcgaggagatgctgcgcacccggattggtacgaagcacgccattctgctcgtcgccgtgagcttcgtgaccctgatcaccgggaacatgtccttccgcgacctgggccgggtcatggtgatggtgggggccaccatgacggacgatatcggcatgggcgtcacatacctcgccctgctggccgccttcaaggttcgcccgactttcgccgccggactcctgctgagaaagctcaccagcaaggaactgatgatggccacaatcggcatagccctcctctcccagagcactatccccgaaacaatcctggagctgaccgacgcgctcgccctggggatgatggtgctgaagatcgtccggaacatggagaagtaccagctcgcggtgacgatcatggccatcagttgcgtgccgaatgccgtcatcctgcagaacgcgtggaaagtgagctgcacgattttagccgcagtctccgtcagccccctcctgctgacctccagccaacagaaggccgactggatccccctcgctttaaccatcaaaggcctaaaccccaccgccatcttcctcaccaccctgtcccgcacttccaagaagcggtcctggccactgaacgaggccatcatggctgtgggcatggtcagcatcctcgcctcgagcttactgaagaacgacatccccatgacggggcccctcgtggctggcggactgctgacagtgtgctacgtcctcaccggccgcagcgccgacctggagctggagcgtgctgccgacgtgaagtgggaagaccaggccgaaatctcagggagctcccccatcctctcgatcaccatctccgaggatgggagcatgtccatcaagaacgaggaggaggagcagacgctgaccatcctgatccgtaccggcctcttagttatcagcgggatttttccggtgtcaatccccatcaccgctgccgcctggtacctatgggaggtgaagaagcagcgggccggcgtgttgtgggacgtccccagcccgccacccgtggagaaggccgagctggaggacggggcataccgcatcaagcagcggggcatcctggggtactcccagatcggcgcgggcgtgtacaaggaggggaccttccacacgatgtggcacgtcaccaggggcgccgtactcatgcaccgggggaagcgtatcgagcccagctgggccgacgtgaagaaggacctgatctcctacgggggcggctggaagctcgagggcgagtggaaggagggggaggaggtccaagtgctagccctagagcccggcaagaatccccgggcggtgcaaacaaaacccgggatattcaagactaacacgggcaccatcggggctgttagcctggacttctcccccggcacgagcggctcccccatagtcgacaggaaggggaaggtggtcggcctctacgggaacggcgtggtgacacggagcggcgcttacgtctccgccatcgcgcagacggaaaagtccatcgaggataatcccgagatcgaggacgacatctttcgcaagaagcggctgaccatcatggaccttcaccccggggccggaaagaccaagcgctacctccccgccatcgtccgggaggccatcaaacgagggttgcggacactgatcctggccccgacgcgtgtcgtcgcagccgagatggaagaggccctccgcggtctgcccatacggtaccagaccccagccatcaagacagagcataccggccgcgagatcgtggacctcatgtgccacgcgacgttcaccatgagactcctgagccccgtgcgcgtcccgaactacaacctgatcattatggacgaggcgcacttcacggaccccgcctccatcgccgcccggggctacatcagcacacgcgttgaaatgggtgaggccgcggggatctttatgacagccacgccgccaggctcccgggacccgttcccccagagcaacgccccgatcatggacgaagagcgcgagatccccgagcggagttggaactccggtcacgagtgggtgaccgacttcaagggcaagaccgtctggttcgtcccgagtatcaaggccgggaacgatatagcggcctgcctgcgcaaaaatggcaagaaggtgatccagctgagccggaaaacgttcgactccgagtacgtcaagacccgcgccaacgactgggacttcgtggtgaccaccgacatcagcgagatgggcgcaaacttcaaggccgagcgggttatcgacccccgccggtgcatgaagccagtgatcctcacggacggggaagagcgcgtgatcttggctggccccatgccggtcacacactcctcagccgcccagcgacgcgggcggatcggccgtaaccccaaaaacgagaacgaccagtacatctacatgggggagcccctggaaaacgacgaagactgtgcccattggaaggaggccaagatgctgctcgacaatatcaacactcccgagggtataatcccgtccatgttcgaacccgagcgcgagaaggtggacgcgatcgatggcgagtaccggctgcgcggggaggcccggaagaccttcgtggacctgatgcgccgaggtgacctccccgtctggctggcctacaaagtggccgccgagggtatcaactacacggaccgcaagtggtgctttgacggcatcaagaacaaccagatcttggaggagaacatggaggtggagatctggaccaaggagggggagcggaagaagctcaagccgcgctggctggacgcgcgcatctacagcgatcccctggccctcaaggaatttaaagagttcgcggccggccgcaagtccctgaccctgaacctcatcaccgagatgggccggctgcccaccttcatgacccagaaggcgagaaacgccctggacaacctagccgtcctgcacactgctgaggccgggggccgggcgtacaatcacgccctcagcgagctccccgagactctggagacgctgctcctgctgaccctcctggccaccgtaaccgggggcatcttcctgttcctcatgtccggcaaggggatcggcaagatgaccctggggatgtgctgcatcatcacggcgagcatcttgctgtggtacgcccagatccagccgcactggatcgctgcgtccatcatccttgagttctttctgatcgtcctcctgatccccgagcccgaaaaacagcgcactccccaggacaaccagctgacctacgttgttatcgccatcctcaccgtcgtagccgccacgatggcgaacgagatgggcttcttggagaagaccaaaaaagacctggggctaggcagcatcacgacccaggagagcgagtccaacatcctggatattgacctgcggccggccagcgcgtggaccctctatgccgtggccaccaccttcgtcacccccatgttgcgccactccatcgagaactcatccgtgaacgtgagcctgacagcaatagccaatcaggccaccgtcctcatgggcttagggaagggctggccgctatccaagatggacatcggggtgcccctcctggccatcggctgctacagccaggtgaacccgatcaccctgaccgcggccctcctgctgctcgttgctcactatgccatcatcgggcccggcctgcaggccaaggcgacgcgggaggcccagaaacgcgccgccgccggcatcatgaagaaccccaccgtggacgggataaccgtgatcgacctggagcccatcccgtacgaccccaagttcgaaaagcagttgggccaggtcatgctgctgatcctctgcgtgacccaggtactcatgatgcggactacgtgggcgctgtgcgaggctcttaccctagccaccgggcccatttccacgctgtgggaaggcaaccccgggcgcttttggaacaccactatcgccgtcagcatggccaacatcttccggggctcctacctagcgggcgccgggctgctgttctctatcatgaagaacaccacgtcgacccgccgcgggaccgggaacatcggcgagaccctcggcgagaagtggaagtcgcggctgaacgccctggggaagtcagagttccagatctacaagaagtccggcatccaggaggtggaccgcacgctcgccaaggaggggatcaagcggggcgagaccgaccaccacgcagtttcccgcggtagcgcgaagctgcggtggttcgtcgagcgtaacatggtgacccctgaaggtaaggtggtcgacctggggtgcgggcgaggcggatggtcctactactgcggtggtctcaagaatgtgcgcgaggtgaaaggcctgaccaaaggcggtcccggccatgaggagcccatccccatgagcacgtacgggtggaacctggtccggctccagtctggtgtggacgtgttcttcaccccgcccgagaagtgtgacaccctgctgtgcgacatcggggagagtagccccaaccccaccatcgaagcaggccgaaccctccgggtcctgaacctggtagagaactggctcaacaacaacacgcagttttgtatcaaggtgctgaacccgtacatgccctccgtcatcgagaagatggaggccctgcagcgccagtatggcggggccctcgtgcggaaccccctgtcccgcaactccacccacgaaatgtactgggtctcaaacgcgaccggcaacatcgtctccagcgtgaacatgatctcgcggatgctgatcaatcgcttcacaatgaagcacaagaaggccacgtacgagccggacgttgacctgggcagcggcaccaggaacatcggtatcgagtccgagatccccaatttagacatcatcggcaagcgcatcgagaagattaagcaagagcacgagatcagctggcactacgaccaggaccacccctacaagacctgggcctaccacggctcatacgagacaaagcagacggggtccgcctccagcatggtcaacggcgtagtacggctgctgaccaagccctgggacgtagtgccgatggtgacgcagatggccatgaccgacaccacccccttcggacagcaacgcgtcttcaaagagaaggtggacacccgcacacaggagcccaaggagggcacgaagaagctcatgaagatcaccgcggagtggctgtggaaggagctgggccggaagaaaacgccccgtatgtgcacccgggaggagttcacgcgcaaagtgcggtcgaacgccgcactcggggccattttcaccgacgagaacaagtggaaatccgcccgcgaggccgtcgaggacggccgtttctgggagctggtggaccgcgagagaaacctccatctcgaagggaagtgcgagacctgcgtgtacaacatgatgggcaagcgcgagaagaagctgggggaattcggcaaggccaaggggtcccgggccatttggtacatgtggctgggggcccgcttcctcgagttcgaagcgctgggcttcctgaatgaagaccactggttcagccgggagaacagcctctccggggtcgagggcgagggcctgcatcgcctgggctacatcctccgggacgtgggcaagaaggagggcggtgccatgtacgcggacgacaccgccgggtgggacacgcgcattaccctggaggacctgaagaacgaggagatggtcacgaaccacatgaagggcgagcacaagaagctcgccgaggcgatcttcaagctgacctaccagaacaaggtggttcgggttcagcgcccgacgccccgagggaccgtgatggacatcattagccgccgggaccagcgcggctccggacaggtggggacttacggcctgaacactttcacgaacatggaggcccagctcatcagacagatggagggggagggcatcttcaagagtatccagcacctgaccgccactgaggagatcgccgtacagaactggttggcccgggtggggcgcgagaggctctcccggatggcgattagcggggacgactgcgtggtgaagcctatcgacgatcggtttgcctccgccctgacagccctgaacgatatgggcaaagtgcgaaaggacattcagcagtgggagcccagccgggggtggaacgactggacccaggtgcctttctgttcgcaccacttccacgagttggtcatgaaggacggccgcgtgctggtggtcccgtgccggaaccaagacgagctgatcgggcgcgcccggatcagccagggcgcgggttggagcctcaaggagaccgcctgcctgggcaagagctacgcccaaatgtggaccctgatgtacttccatcgccgggatctccgcctggccgccaatgcgatctgttccgcagtgcccagccactgggtgcccaccagccggaccacgtggagcatccacgccaagcacgagtggatgacaaccgaggacatgctggccgtctggaaccgcgtgtggatacaggagaacccgtggatggaggacaagaccccagtggagtcctgggaggaggtcccctacctcggcaaacgggaggaccagtggtgcgggagccttatcggcctgacgagccgcgcgacctgggccaagaacatccagacagccatcaaccaggtgcggtccctcatcgggaacgaggagtacaccgactacatgcccagcatgaaacgcttccgccgtgaggaggaggaggctggcgtgctgtggtga

SEQ ID NO: 25037 - RNA, 9876 nt, synthetic construct
  misc_feature 1..9876: note = derived and/or modified CDS sequence (opt11) from DENV-2__FJ744708__SS-prME
  source 1..9876: mol_type = other RNA
accgcgggcgtgatcgtaatgctgattcccaccgccatggcgttccacctcaccacccgcaatggcgaaccccacatgattgtggggcggcaggagaaagggaagtctctgctgttcaaaacggaggatggggtgaatatgtgcaccctcatggccatcgacttgggggagctgtgcgaggacaccatcacctacaaatgccccctcttaaggcaaaacgagcccgaggatatcgactgctggtgcaactccaccagcacctgggtaacctacgggacttgcaccaccacgggcgagcaccggcgcgagaagcgaagtgtggccttggtgccgcacgttgggatgggtttagagaccaggactgagacctggatgagcagtgaaggggcctggaagcacgttcagcggatcgaaacgtggatattacgccacccaggctttaccatcatggccgcgattcttgcctacaccatcgggactacgcacttccaacgagcacttatctttatcttgctgaccgccgttgcgcccagcatgaccatgcgctgcatcggaatctccaaccgtgactttgtcgagggcgtaagcgggggctcatgggtggacatagtcctcgagcacggcagctgcgtgaccacaatggccaaaaataaacccacactggacttcgagctgatcaagaccgaagccaagcaacccgccaccctccgcaagtattgtattgaggccaaactgacgaacaccaccaccgagtcccggtgtccgacgcagggcgagccaagcctgaacgaggagcaagataagcgcttcatctgtaagcactccatggtcgaccggggctgggggaacgggtgcgggctgtttgggaagggcggaatcgtgacctgcgcgatgttcacgtgtaagaagaacatggagggcaaggtggtgcaacccgagaacctggagtacacgatagtcattaccccacacagcggggaggaacatgccgtgggtaacgacaccgggaaacatggcaaggagatcaagattaccccgcagtccagcattacagaagccgagctgacggggtatggcaccgtcaccatggagtgctcgccccgaaccggcctggacttcaacgagatggtcctgctgcagatggaggacaaggcctggctcgtccaccggcagtggttcctggacctaccgctcccctggctgccgggtgccgacacccagggttctaactggatccagaaggagactctggtgacgttcaagaacccccacgcgaagaagcaggacgtcgtggtcctcgggtctcaggagggcgccatgcacaccgccctgactggggccacggagatccagatgagcagcgggaacctcctgtttaccggtcatctgaagtgccgcttacgaatggacaaactccagttaaaggggatgtcctatagtatgtgcaccggtaaattcaaaatagtgaaggagatcgccgagacccaacacggaacgatagtaattcgcgtacagtacgagggcgacggcagcccctgcaaaatccctttcgagattactgacctggagaagcggcacgtgctcgggcgcctgatcaccgtgaatcctattgtcaccgaaaaggattctcccgtgaacattgaggcggagccacccttcggcgactcctatatcatcattggtgtagagccgggccagctgaagctcaactggttcaagaaaggtagctccatcggtcagatgtttgagacgaccatgcgcggcgccaagcggatggccattctaggcgacaccgcctgggacttcggttcgctagggggcgtattcacttccatcggcaaggccctacaccaggtgttcggcgcgatctacggagccgccttctctggggtctcctggacgatgaagatcttaatcggtgtcatcataacctggatcgggatgaatagccgctccacctctctttccgtgtctctggtcctcgtcggtgtggttaccctgtacctgggtgccgtcgtgcaggcggactccggctgcgttgtcagctggaaaaataaggagctcaaatgcggctccgggatctttatcacggataacgtgcacacctggaccgagcaatacaagttccagcccgagagtccctcaaagttggcctccgccatccagaaggcacacgaggagggcatctgcgggattcggagcgtgacccgccttgaaaatctcatgtggaagcagatcacacccgagctgaaccacatcttatcggagaacgaggtcaaactcaccataatgaccggtgacataaaggggataatgcaggccggcaagcggagcctccgcccacagcccaccgaattgaagtacagctggaagacctgggggaaagcgaaaatgctcagcaccgagtcccacaatcagactttcttaatcgatgggcccgagactgccgagtgcccgaatacgaatcgggcctggaatagcctggaggtagaagactatggattcggggtcttcactacaaacatctggctcaaactacgcgaaaagcaagacgtgttctgcgacagcaagttaatgagcgccgccatcaaggacaaccgggcggtgcacgccgacatgggctactggatcgagtccgccctaaacgacacctggaagatggagaaggccagcttcatcgaggtgaagtcctgccactggccgaaaagccacaccctgtggagtaacggcgtactggagagcgagatgatcatccccaagaacttcgctggtcccgtctcccagcacaactaccgcccaggctaccacacgcagactgcggggccgtggcacctcggcaaacttgagatggatttcgacttctgcgaagggaccaccgtggtcgtgacggaggattgcggcaatcggggccccagcctgcgcaccaccaccgcgagcgggaagctcatcacggagtggtgctgccggtcctgcaccctgcccccgctgcgatatcggggcgaagacgggtgttggtacggcatggagattcgccccctcaaggagaaggaggagaacctggtgaactcgctggttaccgcaggacacggccagatcgacaacttctccctcggcgtgctggggatggcccttttccttgaagagatgctgcgaactcgcatcggcacaaagcacgcgatcctgctggttgcggtcagcttcgtgaccttaatcaccgggaatatgtccttccgggacctgggccgggtgatggtaatggttggggccaccatgactgacgacatcggcatgggcgtgacctacctagcgctgctggccgcgttcaaggtacgccccacctttgcagcggggctcctgctccggaagctgaccagcaaagagcttatgatggccacgatcggcatagccctattgtcccagagcaccatcccagagactatcctggaattaaccgatgctctcgccctggggatgatggtgctgaagattgtgcgcaacatggagaagtaccagctcgccgtcaccatcatggccatatcctgcgtgccgaacgctgtgatactgcagaatgcgtggaaggtcagctgtaccatcctggccgccgtgtccgtcagccccctccttttaacctccagccagcaaaaggccgattggatccccctcgcgctgactatcaagggcttaaaccccactgccattttcctgaccacattatccaggacctcaaagaagcgttcctggccgcttaacgaggccatcatggccgtgggcatggtgagcattctcgcgtcgtcacttctgaagaacgatatccccatgaccggccccctagtcgccggtgggctgctgacggtgtgctatgtgctcacagggcggagcgccgacctggagctggagcgcgcggcggacgtcaagtgggaggaccaggccgagatctccgggtcatcccccatcctcagtatcaccatatccgaggatggttcaatgagtataaagaacgaagaagaggagcaaacactgaccatacttatccggaccggcctcctcgtgatctccggggtgttcccggtctcaatccctattaccgcggccgcctggtacctgtgggaggtgaagaaacagcgcgccggcgtcctctgggacgttccgagcccgccgcccgtggagaaagccgagctcgaggacggggcgtaccggataaagcagcgcgggatactggggtactcccaaatcggcgctggcgtgtataaggagggcacgttccatacgatgtggcacgtcacccggggcgcggtgttgatgcaccgcggaaagcggatcgagccaagctgggcagatgtgaagaaggacctgatctcctacggcggagggtggaagctagaaggcgagtggaaggagggggaggaggtccaagtgctggccctggagcccggcaaaaacccccgcgcagttcaaactaagcccgggatctttaaaaccaacacggggacaatcggggccgtgagccttgacttctcccccggcacgagtggcagcccaatcgttgatcggaaggggaaggtggtcggcctctacggtaatggcgtggtgacccggagcggcgcgtatgtgtccgccatcgctcagaccgagaaatccatcgaggacaaccccgaaattgaagacgacatctttcgtaagaaacgcctgaccataatggatctccaccctggggccggcaagaccaaacggtatctccccgcgattgttcgggaggcgattaaacgagggctccgcaccctgatcctcgccccgacgcgagttgtcgcggccgagatggaggaggccctccggggcctgcccatccgctaccagacccccgcgatcaaaacggagcacaccgggcgggagattgtggacctgatgtgccatgccacgttcaccatgcgcctcctgtctcccgttcgggtcccaaactacaacctgatcatcatggacgaggcgcacttcaccgatcccgcctccattgccgcgcgcggctacatcagcacccgggtggagatgggggaggctgccgggatcttcatgacggccaccccgccaggctcccgcgacccgttcccccagagcaatgcccccatcatggacgaggagcgggagatccccgagcgctcctggaatagcgggcacgaatgggtgaccgacttcaaggggaagaccgtgtggttcgtgccctccatcaaggcaggtaatgatatcgccgcatgcctccggaagaacggaaagaaggtgatccagctcagccgcaagacgttcgattccgagtatgttaaaacccgggccaacgattgggactttgtggtgaccaccgacataagcgaaatgggcgccaatttcaaggcagaacgggtcatcgatccccggcgatgcatgaagcccgttatcctgacagacggggaggagcgggttatcctcgcggggcccatgccggttacccactccagcgccgcccagaggcgggggaggatcggccggaatcccaagaacgagaacgatcagtatatctatatgggagagcccctggagaacgacgaagactgcgcgcactggaaggaggccaaaatgctgctcgacaacataaatacccccgagggcataatcccctccatgttcgagcccgaacgggagaaggtggacgcgatcgacggcgagtaccgcctgcgcggggaggcacgcaagaccttcgttgacctgatgcggcgcggcgacctcccagtctggctggcctacaaggtggccgcggaggggatcaactacgcggaccggaagtggtgctttgacggcatcaagaacaaccagattctagaggaaaacatggaggtggagatctggactaaggagggggagcgcaagaagctgaagccccgttggctggacgcccgtatctacagcgacccgctcgccctcaaggaatttaaggagtttgccgccggcaggaagtcgttaaccctgaacctcatcaccgagatgggccggctgcctaccttcatgacgcagaaggcccgcaacgcattggataacctcgcagttctacacaccgcagaggccggcggccgcgcgtataaccatgctctgagcgagctccccgagaccctggagaccctcctgctgctgactctgctggccacagtgaccgggggcatcttcctgttccttatgtccggcaaggggatcggcaagatgacgctggggatgtgctgtatcatcaccgccagcatcttgctatggtatgctgagatccagccccactggatagccgccagcatcatcctggagttcttcctgatagtcctcctgatcccggagcccgagaagcagcggacgccgcaagacaaccagcttacctacgtggtaatcgccatcctcaccgtcgtagccgcgacaatggccaatgagatgggctttctggaaaagaccaagaaggacctggggctcggcagcatcactacccaggagagcgaaagtaacatcttggatatcgacctgcgcccggcttccgcctggaccctctacgccgtggcgacaaccttcgttacccccatgctgcgtcacagtatcgagaatagctccgttaacgtgagcctgaccgccattgccaatcaggcaacggtactcatgggtcttgggaaggggtggcccctgtccaaaatggacatcggggtgcccctcctagcgatcggctgctactctcaggtgaacccgataaccctgacggccgcgctcttactcctcgtcgcccactacgccatcattgggcccggcctgcaggcgaaggccacccgagaggcgcagaagcgggcagccgcgggcatcatgaaaaatcccaccgtagacggcatcaccgtcattgacctggagcccatcccgtacgaccctaagtttgagaagcagttggggcaggtaatgctgttgatcctctgcgtcacccaagtgctgatgatgcgcactacctgggccctgtgtgaagccctcaccctggccaccgggcccatttccaccctttgggagggcaacccggggcggttctggaacacgactatcgcggtgagcatggtgaacatcttctccggcagctacctcgcaggcgccgggctgcacgtgccgctccgtaagaatacactgcgtacccggcgcggcacggggaacaccggcgagaccctgggtgagaagtggaagtcccggttgaatgctctcgggaaaagcgagttccagatctacaagaagtccggcatccaggaggtcgacagaaccctggctaaggaggggatcaaacggggcgaaacagaccaccacgctgtaagccgcgggtcggctaagctgcggtggttcgtcgagcgcaacatggtcacgccggagggcaaggtggtggacctcggatgcggtcgaggcgggtggagctactactgcggcgggctgaagaatgtcagggaggtgaagggcctgaccaagggcgggcccggccacgaggagcccatcccgatgtccacctacggatggaatctcgtccggctgcagtccggcgtagacgttttctttacgccgcctgagaagtgcgacaccctgctctgtgacatcggggagagctcgcccaatccgactatcgaggccgggaggacactgcgggtgttaaacctcgtcgagaactggcttaacaataacacccagttctgtatcaaggtgctgaacccctatatgcccagtgtgattgagaaaatggaggccctccaacgacagtacggaggggccctggtccggaacccgctgtcccgcaacagcacacacgagatgtattgggtgtccaacgctaccggaaacatagtgagctccgtcaatatgatcagccggatgctcatcaatcgcttcaccatgaagcataagaaggcgacctacgagcccgacgtagacctcgggtctggcacacgaaacatcgggatcgaaagcgagatccccaacctggacattattggcaaacgcatcgagaagattaagcaggagcacgaaatttcctggcactacgaccaagatcacccctataagacctgggcctaccacggctcttacgagaccaagcagaccgggtccgctagctccatggtgaacggcgtcgtgcgcctgctcacgaagccctgggacgtggtcccgatggtgacccagatggccatgacagacaccacacccttcggtcaacagcgggtgtttaaggagaaggtcgacacccgcactcaggagcccaaagagggcaccaagaagttaatgaagatcacggcggagtggttatggaaggagctggggaagaagaaaacaccgaggatgtgcaccagagaagaatttactaagaaagtgcgtagcaacgccgccctgggagctatcttcacggacgagaacaaatggaagtccgcccgcgaggctgtggaggacggacggttttgggagcttgtcgaccgggagcgaaacctccacctcgaggggaagtgtgagacctgtgtgtacaacatgatgggtaagagagaaaagaagctgggggagttcggcaaggcgaagggtagccgcgccatctggtacatgtggttgggggccaggttcttggagttcgaggcactaggtttcctgaacgaggaccactggttctccagggggaactccttaagcggcgtggagggggagggcctgcaccgcctcggctatatccttcgggacgtggggaagaaggagggcggggccatgtacgccgacgacactgccggctgggacacaagaattacattagaggacctcaaaaacgaggagatggtgactaaccacatgaagggcgaacacaagaagctggctgaggcgatcttcaaactgacttaccagaacaaggtcgtgcgggtgcagcggccaacgccccgcggaacggtcatggacatcatctcccgcagggatcagcgcggcagcgggcaggtcggtacctacggattgaacacattcaccaatatggaggcccaactgatccgccaaatggagggtgaggggatcttcaagtccatccaacacctgacggccactgaagagatcgccgtgcagaactggctcgcacgggtcggtcgcgagcgtctgagccgcatggcgatctccggcgatgactgcgtcgtgaagcccatcgacgaccgattcgcttccgccctgaccgcattgaatgacatgggcaaggttcgtaaagacatccaacagtgggagccgtccagaggctggaacgactggacccaggtacccttctgctctcaccacttccacgaactggtgatgaaggacgggcgcgtcctggttgtgccttgtcgaaaccaggacgagctcatcggccgcgcccgaatttcacaaggagcggggtggagcctaaaggagactgcatgcctgggcaaatcctacgcccagatgtggaccctcatgtatttccatcgccgggacctgagactggcggccaacgccatctgcagcgccgtcccctcccactgggtaccgaccagccgcaccacatggtccatccatgccaagcacgagtggatgacgacggaggatatgctcgccgtgtggaaccgcgtttggatccaggaaaacccctggatggaagacaagacacccgtggagagctgggaggaagtgccctacctggggaagcgggaagaccagtggtgtggctctttgatcggcctcaccagcagagcgacgtgggcgaagaacatacagaccgccatcaaccaggtccggtcactgatcggcaatgaggagtacaccgactacatgccgtccatgaagcgcttcagacgagaggaggaggaggctggcgttctgtggtga

SEQ ID NO: 25038 - RNA, 9876 nt, synthetic construct
  misc_feature 1..9876: note = derived and/or modified CDS sequence (opt11) from DENV-2__FJ810418__SS-prME
  source 1..9876: mol_type = other RNA
acagcgggcgtgatcgttatgctaatccccaccgccatggcgtttcacctcaccacccgcaacggtgagccccacatgattgtgggccggcaagaaaaagggaagtccctactcttcaaaactgaggacggagtgaacatgtgcaccctcatggccatcgacctgggggaactgtgcgaggacacgattacctataagtgccccctcctgaggcagaacgagcccgaggacatcgactgttggtgcaacagcaccagcacatgggtcacctacggtacctgcaccaccacgggcgagcaccggcgtgaaaaacggtccgtggcactcgtgccgcacgtcggaatgggcctggagacccgcacagagacgtggatgtcgtctgagggggcctggaagcatgtgcagcgaattgagacctggatcctgcgccacccgggctttacaattatggccgcgatactggcatacaccattgggaccacacactttcagcgggccctcatcttcatcctgctaacagccgttgcgccaagcatgacaatgagatgcatcggcataagcaaccgggacttcgtcgagggcgtgtctgggggcagctgggttgatatcgtcctcgagcatggtagttgcgttacgacgatggccaagaataagcccacgctcgatttcgagctgatcaaaaccgaggccaagcaacccgccaccctcagaaagtactgcatcgaagccaaactgacgaacaccaccaccgagagccggtgccccactcagggcgaacccagcttaaacgaggagcaggacaagcggtttatctgcaagcactcaatggtagaccgaggctggggtaacggctgtgggttgttcgggaagggcggtatagttacctgcgctatgttcacgtgcaagaagaacatggagggcaaggtggtgcaacccgagaacctggagtataccatcgtcatcactccccatagtggggaagagcacgccgtgggcaacgacaccgggaaacatggcaaggaaatcaaaatcacgccgcagtccagcatcaccgaggcggagctgaccgggtacggcactgtgaccatggagtgcagcccccggaccggcctcgacttcaacgagatggttctgctgcaaatggaggacaaggcctggctcgtgcaccggcagtggttcctggacctgcccctcccctggttacctggggccgacacccagggatccaactggatccagaaggagacgctggtgaccttcaagaacccccacgcgaagaagcaggatgttgtcgtcctcgggtcccaggaaggagccatgcacaccgcgttaaccggggcgacggaaatccagatgagctctggcaacctgctgttcaccggccacctcaagtgccgcctgcggatggacaagctccagctgaaggggatgtcctactcaatgtgcacagggaagttcaaaatcgtgaaggaaatagccgagacccagcacggcacgatcgtcatccgagtacagtacgagggcgatggcagcccctgcaagatccccttcgagatcaccgacctagagaagcggcatgtgctcgggcgtctgatcaccgtgaacccgatcgtcaccgaaaaggactcacccgtgaacatcgaggcggaaccgcccttcggcgactcctacatcattattggcgttgagcccggccagctgaaactcaactggttcaagaaggggagctccataggccagatgttcaagacgaccatgcgcggagcaaagcggatggccatcctgggggacacagcctgggacttcggaagcctagggggcgtcttcaccagtatcgggaaggccctccaccaggtcttcggtgctatctatggcgccgcattcagcggggtgagttggacgatgaaaattttgatcggagtcgtgatcacctggatcgggatgaatagccgatccactagcctatccgtaagtctggtgctcgtgggcgtggtcacgctgtaccttggggccgtggtccaggcggactccgggtgcgtcgtgagctggaagaataaagagctcaagtgcggatccgggatcttcataacggacaacgtgcacacctggaccgaacagtacaagttccagcccgagagccccagcaagctggccagtgctatacagaaagcccacgaagaaggcatttgcgggatcagatccgtgacgcgcctggagaatctcatgtggaagcagatcacgccggagttgaaccacatcctgagcgagaatgaggttaagctcaccatcatgacgggcgatattaaggggattatgcaggccggcaagcggagcctgcgcccccagcccaccgagctgaagtactcctggaaaacatggggtaaagctaagatgctctccaccgagtcccacaaccagacattcctgatcgacgggcccgagaccgccgagtgccctaacacgaatagagcgtggaacagcctggaggtggaggactacggcttcggggtctttaccaccaacatatggctcaagttgcgcgagaaacaggacgtgttctgtgactccaagctgatgtccgcagccatcaaagataaccgggcggtgcacgccgacatgggctactggatcgagtccgcgttaaatgacacctggaagatggagaaagcttcgttcatcgaggtaaaatcctgccactggcccaagagccacaccctgtggtccaacggcgtgctggagagcgagatggtcatccccaaaaacttcgcggggccggtctcccagcacaactaccggccgggctaccacacgcagaccgcgggcccctggcacttaggcaagctggagatggacttcgacttctgcgaaggaacgaccgtggtggtcacagaggactgcggcaaccggggccccagcctgcgcaccaccaccgctagcggtaagctaatcacggagtggtgttgtcggtcatgcaccctgcccccgctgcgttaccggggcgaagacgggtgctggtacggaatggagatccgccccctcaaggagaaggaggagaacctggtgaatagccttgtgaccgccggacacggccagattgacaacttctcccttggcgtcctggggatggccttattcctcgaggagatgctgcggacccgcatcggcacgaagcacgcgatcttactcgtggcagtaagtttcgttaccttgatcacgggtaacatgtccttcagagacctgggccgtgtgatggtgatggtaggcgccaccatgacggacgacatcggcatgggggtgacctacctcgccctgcttgccgcgttcaaggtgcgtcccacctttgccgccgggctcctgctacggaagctaaccagcaaggagctgatgatggccacaatcggaatcgccctgctttcccagagcactatccccgagacaatcctggaactgacggacgcgctcgccctggggatgatggtcctgaagattgtgcgcaatatggagaaataccagctcgccgtgactatcatggccatatcctgcgttccgaacgctgtgattctccagaacgcgtggaaggtcagctgcaccatcctagccgcggtgtccgtgtctccacttttacttacgtccagtcagcagaaagccgactggatccccctggcgcttaccataaaggggctgaaccccacggccatcttcctcaccaccctgtcccggaccagcaaaaagcgctcgtggccactgaatgaggccataatggccgtcggtatggtgagcatccttgcatcctctctgctgaagaacgacatcccaatgacagggccgctcgttgcgggcgggcttctgaccgtctgctatgtgctaaccggcagaagcgccgacctggaactcgaacgtgccgccgacgtgaaatgggaggaccaagctgagatctccggctcttcccctatcctctcgattaccatctccgaggacggcagcatgtccatcaagaacgaggaggaggagcagacgctgaccatactgatccggacgggcttactggtcatcagcggggtcttcccggtctccatccccatcaccgctgccgcctggtacctgtgggaggtcaaaaagcagcgcgccggtgtgctttgggacgttcccagcccgccgcccgtcgagaaggccgagctggaggatggcgcttatcggatcaagcagcgcggaatcctcgggtattcccagattggcgccggcgtgtacaaggagggcacattccacactatgtggcacgtaacaaggggtgcggtcctcatgcaccgcgggaaacggatcgaaccctcttgggctgacgtgaagaaggacctgatctcgtatggcgggggttggaagctagagggggagtggaaggagggggaggaggttcaggtccttgccctggagcccgggaagaatcccagggctgtgcagacgaaacccgggatcttcaagaccaacacaggtaccattggggccgtgagcttggatttctcacccggtaccagcggcagtcccatagtggatcggaaggggaaggtagtgggactgtacgggaacggtgtcgtcacccgtagcggcgcctatgtgtccgccatcgcgcaaacggaaaaatccatcgaagataaccccgagatcgaggacgatatctttcggaagaaacgcctcactatcatggacttacaccccggggccggcaagaccaagcggtacctccccgcaatcgtccgcgaggccattaagcgggggctaaggaccctgatccttgccccgacgagagtcgtcgcggccgagatggaggaggccctccggggtctgcctatccgctaccagacccccgccatcaaaacagaacacacagggcgggagatcgtcgatttgatgtgccacgccacgttcaccatgcgcttgctgtcgcctgtgcgagttcccaactacaaccttatcatcatggacgaagcacacttcaccgaccccgccagtatcgccgcccgaggctatatcagcaccagggtcgagatgggcgaggccgcggggatctttatgaccgccacgccgccaggctccagggacccgtttccccagtctaacgcccccattatggacgaggagcgggagatccccgaacgctcctggaacagcggccacgagtgggtgaccgacttcaaaggcaagaccgtgtggttcgtcccatccatcaaggccgggaacgacatcgctgcttgcctccggaaaaacgggaagaaggtgatacaactgtctcgcaaaacgttcgacagtgagtacgtgaaaaccagggcaaacgactgggacttcgtggtgaccaccgacatcagcgagatgggagcgaatttcaaggccgaacgcgtgattgacccccggcgctgcatgaagcctgtgatcctgacggatggtgaggagcgggtgatcctcgcgggccccatgccggtgacccacagtagcgctgcacagcggcgggggcgaatcgggcgcaacccaaagaacgagaacgaccaatacatctacatgggggagcccctggagaacgatgaggactgcgcccactggaaggaggccaagatgctgctcgacaacataaacacccccgagggcatcatcccctccatgttcgaacccgaacgggagaaggtcgacgcgatcgatggcgagtaccgcctgcgcggagaggcacgcaagaccttcgttgacctgatgcggcggggcgatctacccgtgtggctagcctacaaggtcgcggccgaggggatcaactacgcggaccggaagtggtgctttgatggcattaaaaataaccagatcttagaggagaacatggaggtggaaatttggacgaaggagggagaacgcaagaaactcaagccgcggtggttagacgcccgcatctacagtgaccccctggccctgaaagagttcaaggagttcgccgcaggccggaagagtttaactttgaacctcatcaccgagatgggcaggctacccaccttcatgacgcagaaagcccggaacgcgctggacaacttggccgtcctgcatacagccgaagccggggggcgcgcgtacaatcatgccctgagcgagctccccgagaccctagagactctgctcctgcttacgctcctagcgaccgtgaccgggggcatcttcctgttcctcatgagtggtaaaggaataggcaagatgacactgggcatgtgctgcatcatcaccgcctctatcctgctctggtacgcgcaaatacaaccgcattggattgccgcttccatcattctggaattcttcctaatcgtgttactcatccccgagcccgagaaacagcgtacgccccaggacaaccagctgacctacgtcgtgatcgccatcctcaccgtggtcgcagcaaccatggccaacgagatgggcttcttggagaagacgaaaaaggacttagggctcggcagcatcaccacccaggagagcgagtccaatatcctggacatcgacctgcgaccggctagcgcctggaccctgtacgccgtggcgacgaccttcgtgacccctatgctgcggcactccatcgagaacagctccgtcaacgtgagccttacggccatcgccaatcaggccacggtactcatgggcctggggaagggatggcccctgtccaagatggacatcggagtgcccctcctggctatcgggtgctacagccaggtgaaccctatcaccctgaccgccgccctcctgctgctcgtggcccactacgccataatcgggcccggcctgcaggcgaaagccactcgcgaagcccagaagagggccgccgcgggtatcatgaagaaccccacggtcgatgggatcaccgttatcgacctggagcccattccgtacgatccgaagtttgagaaacagctcggccaggtgatgcttctgatactctgtgtcacccaggtactgatgatgcgcaccacgtgggccctttgcgaggcgctcaccctggccaccgggcccatctccactctgtgggagggcaaccccgggcggttctggaacacgaccattgccgtgtccatggcgaacatcttccgcggttcctacctcgccggcgccggtctgctgttctccatcatgaagaacaccacctccacgcgccggggcacggggaacataggcgagaccttaggcgagaaatggaagtcccgcttgaacgccctggggaagtccgaattccagatctacaaaaagtccggtatccaagaggttgaccggaccctcgcgaaggaaggcataaagcgcggcgagaccgaccaccatgctgtgagccgggggagcgcaaaactgcgctggttcgtggaacgcaatatggtcacccctgagggcaaggtagtggacctaggctgcgggcgcggcggttggtcctactattgcggaggcctgaagaacgtccgggaagtgaagggtctgacgaagggcgggccgggccacgaggagcccatacctatgtcgacatacgggtggaacctagtgagactccagagcggcgtcgacgtattcttcacgccgcccgagaagtgcgacaccctgctgtgcgacatcggcgagtcgagccccaatcccacaatcgaggccggccggaccttgcgcgtgttaaacctggtagagaattggctcaacaacaacacccagttctgcataaaggtattaaacccatacatgccctcggtgatcgagaagatggaggcgttgcagcgtcagtatggcggggctctcgtccgcaacccgctaagccgcaattcgacgcacgagatgtactgggtgagcaacgccaccgggaacatcgtgtccagcgtaaacatgatctcccgaatgctgatcaaccggttcaccatgaagcacaagaaggccacctacgagccggacgtggatctggggtcaggcacacgcaacatcggaatagagtccgaaatccccaacctcgacatcataggcaagcgtatagagaagatcaaacaggagcatgagatatcatggcactacgaccaagaccacccctacaaaacatgggcataccacggctcctacgagacaaagcagaccgggtctgcctcctctatggtgaacggagtagtgcgactgctgaccaaaccctgggatgtggtccccatggtgactcagatggcgatgaccgacaccacgccattcgggcagcagcgtgtgttcaaggaaaaggtcgatacgaggactcaagagcccaaggaaggcaccaaaaagttaatgaaaataacggccgagtggctgtggaaagaattgggcaagaagaagaccccacgcatgtgcacccgggtagagttcaccaagaaagttagatccaacgccgccctcggggctatcttcacggacgagaataaatggaagtccgcgcgggaggccgttgaggatgggcggttttgggagttggtcgaccgagagcggaacctgcacctagagggaaaatgcgagacctgcgtctacaacatgatgggcaagcgggaaaagaagttaggtgagttcggcaaggctaagggttcccgcgccatatggtacatgtggcttggagcgcgcttcctcgagttcgaggcgctgggcttcctgaacgaggaccactggttctcgcgcgggaacagcttgtccggagttgagggtgagggcctgcatcggctgggctacatcctccgcgacgtggggaaaaaggagggtggggccatgtacgccgacgacaccgcgggctgggacacccggatcactctggaagatctgaaaaacgaggagatggtgaccaatcacatgaagggggagcacaagaagcttgccgaggcaatcttcaaactcacctaccaaaacaaggtggtccgcgtccagcggccgactcctcgaggcacagtgatggatatcatcagcaggcgcgaccagcgcggcagtggacaggtaggaacctacggactgaatactttcacaaacatggaggcccagctcatacgccaaatggaaggcgagggcatcttcaagagcatccagcacctgacagcaaccgaagagatcgccgtccagaactggttggcgcgcgtggggcgggagcgcctctcccggatggccatcagcggcgacgactgtgtggtaaagcccatcgacgaccgctttgcctccgctctcactgccctgaatgacatggggaaggtccggaaggacatccagcagtgggagcccagccgcgggtggaacgactggacccaggtgccgttctgttcccaccacttccacgaactggtcatgaaggatggacgggtgctcgtggtcccctgccgcaaccaagacgagctgatcggccgggcgcgcatctcacagggcgccgggtggtctcttaaggaaacggcatgcctgggcaagagctacgcccagatgtggaccctcatgtacttccatcggcgcgacctgagactggccgcgaacgccatctgctccgccgtgcccagccattgggtgcccacctcccgtaccacctggagcatccatgccaaacacgagtggatgaccactgaagacatgctggcggtctggaatcgggtatggatccaggagaacccgtggatggaggacaagacccccgttgaatcttgggaggaggtaccataccttgggaaacgcgaggaccagtggtgcggttcactgatcgggctgaccagccgggccacatgggcaaaaaacattcagaccgccatcaaccaggtgcgctcactcattggtaacgaagagtacaccgattacatgcccagcatgaagcggtttcgccgtgaggaggaagaagccggcgtgctgtggtga

SEQ ID NO: 25039 - RNA, 9876 nt, synthetic construct
  misc_feature 1..9876: note = derived and/or modified CDS sequence (opt11) from DENV-2__FJ639835__SS-prME
  source 1..9876: mol_type = other RNA
accgccggcgtaatcgtcatgctcattcccaccgccatggcgttccacctcaccacccgcaacggggagccgcacatgatcgtgggccggcaggagaagggtaagtccttgctgttcaagacggaggacggcgtgaatatgtgcacgctcatggccatcgatctgggggagctgtgtgaggacactatcacctataaatgccccctcctgcgccagaatgagcccgaggacatcgactgctggtgcaacagcacgagcacatgggtcacttacgggacctgtaccacgacaggggagcaccggagagagaaacggtccgtggctttggtcccacacgtcgggatggggctcgagacccgcaccgagacatggatgtctagcgagggggcctggaagcacgtgcagcggatcgagacctggatactgcgccacccgggctttaccatcatggccgcaatcctggcgtacactatcgggaccacgcacttccaacgggcactcatcttcatactgctgactgccgtggccccctccatgaccatgcgctgcatcggcatctcgaacagagacttcgtcgagggagtgagcggagggtcctgggtagacatcgtcctcgaacatgggtcttgcgtgaccacaatggcaaagaacaagcccacactggactttgagctgatcaaaaccgaagcaaaacagcccgcaacactccgcaaatactgcatcgaggccaagctcacgaacacgactaccgaatcccggtgcccgacgcagggcgagcccagcctgaacgaggaacaggacaagcgattcatctgcaaacactccatggtggaccggggctgggggaacgggtgcgggctgttcggaaagggcgggatcgtaacctgtgcgatgttcacatgtaagaagaacatggagggcaaggtagtgcaacccgaaaatctggagtacaccatcgtaatcacgccccacagcggggaggagcacgctgtggggaacgacacgggtaagcacggcaaggagatcaagatcaccccgcagtccagcatcaccgaagccgaattgaccgggtacggcacggtgaccatggagtgcagcccacggaccggtctcgactttaacgagatggtcttgctgcaaatggaggacaaggcctggctagtgcatcgtcagtggtttctcgacctgcccctcccctggctgccgggggctgacacgcaaggcagcaactggatacagaaagagacgttggtgaccttcaagaacccccacgcaaagaagcaggacgtcgtggtcctcgggtcccaagagggagccatgcacaccgccctgaccggggccacggagatacagatgagcagcggcaacctcttgttcaccggccacctgaagtgccgcctgcggatggacaagctccagttaaagggaatgagttactcaatgtgtaccggcaaattcaagatcgtgaaggagatagcggaaacgcaacatgggaccatcgtcatccgcgtccagtacgagggcgatgggtccccgtgtaagatccctttcgaaatcaccgacctggagaagcgtcacgtgctcgggcgcctgatcactgtgaatccgatcgtcaccgagaaggattcccccgtgaatatcgaggcggaaccgcccttcggggacagctacatcatcatcggtgtagagccgggacagctgaaattaaactggttcaagaagggtagttcgatcggccagatgttcgagacgaccatgcgtggcgccaagcggatggccatcctgggtgacactgcatgggacttcgggagcctcggcggggtctttacctccataggaaaggccctccaccaagtgtttggggcgatctatggcgccgcgtttagcggcgtgtcctggacgatgaagatccttattggagtcatcatcacctggatcgggatgaactcgcgctccaccagtctgtccgtgtctctggtgctcgtcggcgtggtgaccctgtacttaggggccgtcgtgcaggccgactcggggtgcgttgtcagctggaagaacaaggaactcaagtgcggttccgggatcttcatcactgacaacgtgcacacctggaccgagcagtataagtttcagccagaaagtccgagcaagttggcctccgccatccaaaaagcccacgaggagggtatatgcgggatccggagcgtgacccgcctggagaacctcatgtggaagcagatcacccccgaactgaaccacatcctatccgagaacgaggtcaagctaaccattatgaccggcgacatcaaggggattatgcaagccggcaagagaagcctaagaccgcagcccaccgagctgaaatactcctggaagacgtggggcaaggcgaagatgctctcgaccgagtcccacaaccagacattcctgatcgacggcccggaaacggccgagtgtcccaacacgaatagagcgtggaattcattagaagtggaggactacggcttcggtgtgtttaccaccaacatctggctcaagctgcgcgagaagcaggacgtcttctgcgactccaagctgatgagcgccgcaatcaaggataatcgggcggtgcacgccgatatgggatactggatcgagtccgctttaaatgacacctggaagatggagaaggcctcgttcatcgaggtaaagtcctgccattggcccaagtctcacaccctgtggtccaacggagtcctggaatccgagatggtcatccccaaaaacttcgccggtcctgtctcgcaacacaactaccgcccgggctaccacactcagaccgcggggccctggcatctcgggaagcttgagatggacttcgacttctgcgagggcaccacagtcgtggtaacggaggactgcggcaacaggggccccagtctgcgcactaccactgccagcgggaaactcatcacggagtggtgctgccgtagctgcaccctgcccccgctacgctaccgtggagaggacgggtgttggtacggcatggagatccgccccctcaaggagaaggaggaaaacttggtcaatagcctggtgactgccggccacggccagatcgataacttctccctcggcgtgctggggatggccctgttccttgaggagatgctgcggacccgtatcggcacgaagcacgcgatcctgctcgtcgccgtaagcttcgtgactctgatcacggggaacatgtccttccgggatctgggcagggtgatggtgatggtgggggctaccatgacggatgacatcggaatgggagtcacctacctcgccctactggcagcgttcaaggtgcgccctaccttcgccgccggtctgctgctgcgaaagctcacgtctaaggagctgatgatggcgactattggtatcgccctcctctcccaatctaccatccccgagaccatcttagagctgaccgacgcgctcgctctggggatgatggtgctgaagatcgtacgcaacatggagaaataccagctcgccgtaacgatcatggccatctcctgcgtgccgaacgctgtcatcctgcagaacgcctggaaggtttcatgcacaatcttagccgccgtctccgtgagccccctactgctgacctccagccagcagaaagccgactggatccccttagcgcttaccataaagggcctgaatcccacagccatcttcctcaccaccctgtcccggacctccaaaaagcgctcctggccgctgaacgaggccatcatggccgtgggcatggtcagcatcctggcctcctccctgttaaagaacgatatccccatgactggtcccctcgtagctggcggactgcttaccgtatgctacgtcttaactggtcgtagcgcggacctggagctggagcgcgccgccgacgtaaagtgggaggatcaagccgagatttcagggagctcccctatacttagcatcaccatctccgaagacggcagcatgtccataaaaaacgaggaggaggagcaaaccctgaccatccttatccgtaccggcctcctggtgatcagcggggttttcccggtttccattcccattaccgcggccgcctggtacctgtgggaagtgaaaaagcagagggccggcgttctctgggatgttcccagcccgccacccgtggagaaggctgagctcgaggacggtgcgtaccggatcaagcagcgtggaatcctggggtactcccagataggcgccggcgtgtacaaggaagggacgtttcacactatgtggcacgtgacccggggcgccgtgctcatgcatagggggaagcggatcgagcccagctgggcggacgtcaagaaggacctaatctcttacggcggcggctggaagttagaaggcgagtggaaagaaggggaggaggtccaggtgcttgccctggagcctggcaagaaccctcgcgcggtgcagacgaagcccggaatcttcaaaacgaacacgggcaccattggcgcagtcagcctggacttctcccccggcaccagcggctctcctattgtggatcggaaggggaaagtcgtgggcctctatggtaacggcgtggtcacccgcagcggcgcctacgtgagcgcaatagcgcagacggagaagtccatcgaggacaaccccgaaatcgaggatgacatttttcggaagaagcgcctgactattatggatctgcaccccggtgcaggcaagactaagagatacctccccgccatcgtccgcgaggccatcaagcgggggttacgcaccctgatcctagctccaacgagggtcgtcgctgccgagatggaggaggccctcagaggcctgccgatcaggtaccagacccccgccatcaagaccgagcacacggggcgggagatcgtggaccttatgtgtcacgccacgttcaccatgcgactcctgtcgcccgtccgggtaccgaactacaacctgattatcatggatgaggcacacttcacagacccggcatccatcgccgcccgcggctacatcagcacccgggtagagatgggcgaagccgcggggatcttcatgacggccacgcctcctggctcccgcgacccattcccccaaagcaacgcgcccatcatggacgaggagcgtgaaatccccgagcgctcctggaacagcggccacgagtgggtcaccgacttcaagggcaagaccgtgtggttcgtgccgtcgatcaaggccgggaacgacatcgctgcatgcttacgtaagaacgggaagaaggtcatccagctgagccgcaagacgttcgactccgagtacgtgaagacccgggcgaacgattgggacttcgtagtgaccaccgacatcagcgagatgggcgccaacttcaaagccgagcgggtgatcgacccccggcgctgtatgaagccggttatcctaaccgacggggaggaacgcgtaatactcgcgggccccatgccggtgacccattccagcgctgcccagcgcagagggcgcatcggaagaaaccccaagaatgaaaatgatcagtacatttacatgggggagcccctggagaacgacgaagattgcgcccactggaaggaggcgaaaatgctactcgacaatataaacacgcccgaagggatcattccgtccatgtttgaaccagaacgggagaaggtggacgcgatcgacggtgagtaccgcctgcgtggcgaggcccgaaagacatttgtcgacctgatgcggcgcggcgacctccccgtctggctggcatacaaggtagcagctgaaggaatcaactacgctgaccggaagtggtgttttgatgggatcaagaataaccagatcctggaagagaacatggaagtcgagatctggacgaaggagggggaacgcaagaagctcaagccgcggtggctggacgcccgcatctacagcgaccccttagcgctcaaggagttcaaggagtttgccgcaggacggaagtcccttaccctgaacctcattaccgagatgggacgcctgccaaccttcatgacgcagaaagctcgcaacgccctcgacaatctcgccgtcttgcacaccgccgaggcgggagggcgggcgtacaatcacgcccttagcgagctcccagagaccctcgagacactgctcctgttaacactcctggccaccgtaaccggcgggatcttcttatttctcatgtccggcaaaagcattgggaagatgactctggggatgtgctgcataatcactgcctccatactgctctggcacgcgcagatccagccgcactggatagccgcctcaattattctggagttctttttgatcgtgctccttattccggagcccgaaaagcaacggacgccccaggacaaccagctgacctacgtggtcatcgccattttaacggtggtggccgcgaccatggccaatgagatggggtttctggagaaaacgaagaaggacttggggctcgggagcatcaccacccaggagtccgagagcaacatcctggacattgacctgagaccggcctccgcctggaccttgtacgctgtcgcgacgaccttcgtgaccccgatgctgaggcacagcatcgagaactcctctgtcaacgtctccctgactgccattgccaaccaggccacggtactcatgggcctgggaaaggggtggcccttaagcaagatggacatcggcgtgcccctcctggcgatcgggtgctactcccaagtcaatcctataaccctgactgccgccctcctactgctagtggcccattacgccatcatcggcccgggactgcaagcgaaggccactcgcgaggcgcagaaacgtgccgccgccggcatcatgaagaaccccacggtcgacggcataaccgtcatcgacctcgaaccaatcccgtacgatcccaagtttgagaaacagctcggccaggtgatgctgttaattctctgcgtgacccaggttttaatgatgcgcaccacgtgggcgttatgcgaggcgctgactctcgcgaccggccccatctccaccctgtgggaggggaaccccggccgattctggaatacgactatcgccgtgtccatggcgaacatcttccgtgggagctacctcgccggtgcggggctgctgttttccatcatgaagaacaccacaagcactcgcaggggtaccggcaatatcggggagacgctcggcgagaagtggaagtctaggcttaacgccctggggaaatctgagtttcagatatataagaaatccgggatccaggaggtggaccgcactctcgcgaaggagggcatcaaacgcggggagacggaccaccacgccgtcagccggggctccgccaagctgcgctggttcgtggagcggaacatggtgaccccggaggggaaggtagtggacctgggctgcggccgcgggggctggagctactactgcgggggcctcaagaacgtgcgggaagtcaaggggctgaccaaaggtggcccagggcacgaagagcccatccccatgagtacctatggctggaacttagtgcggctgcagtccggggtggacgtcttcttcacgccgccggaaaaatgcgacaccctgctgtgtgacatcggcgaaagctcccccaatcccaccatcgaggccgggaggaccttacgggtgctgaacctggtggaaaactggctcaacaacaacacccagttctgcatcaaggtcctgaacccgtacatgccgagcgtgatcgagaagatggaagcgctgcagagacagtacggcggcgcgctcgtgcgcaaccccctgtcccggaacagcacgcacgaaatgtactgggtctccaacgccactgggaatatagtgagctccgtgaacatgatcagccgcatgttgataaaccggtttaccatgaagcacaaaaaggcaacctatgagccggacgtcgatctcggctccgggacgcgtaacatcggcatagagaatgagattccgaatcttgacatcatcggtaagcgaatcgagaagatcaaacaggagcacgagatcagctggcattacgaccaagatcacccctacaagacctgggcgtaccacggctcgtatgaaaccaaacagaccggaagcgcctcaagcatggtgaacggtgtggtccgcctgctgacgaagccctgggacgtagtcccgatggtgacccagatggcgatgaccgacacgacgcccttcggccagcaacgcgtcttcaaagagaaagttgacacgcggacccaagagcccaaggagggtaccaagaagctcatgaagatcacggccgagtggctctggaaggagctggggaagaaaaagactccccgcatgtgcacccgcgaggagttcacccggaaggtccggagtaacgccgcccttggcgccatcttcacggacgagaacaagtggaagtccgcgcgcgaggctgtggaggacggacggttctgggagctcgtggaccgcgaacggaacctgcacttagagggcaagtgcgagacctgcgtctacaatatgatgggtaagcgcgagaagaagctgggcgaatttgggaaggctaagggctcccgggccatctggtacatgtggctgggtgcgcgtttcctcgagttcgaagccttggggttcctgaacgaggaccactggttctctcggggcaacagcctctccggcgtggagggcgaggggctgcaccgcctgggctatatcctacgggacgtcggcaagaaggagggcggcgccatgtatgcagatgacacggccggctgggacacccgtatcacgctggaagacttaaagaacgaagagatggtgaccaaccacatgaagggcgagcataagaagctcgcggaggccatctttaagctaacgtaccaaaacaaggttgtccgggtgcagcgcccgacgccccgggggactgtgatggacatcattagccgccgggaccagcgcggatccgggcaggtcgggacttacggactgaacacattcactaacatggaagcccaactcatccgccagatggagggggagggcatcttcaagtcgatccaacacctcactgccaccgaggagatagccgtgcagaactggttggcgcgggtgggtcgcgagcgtctctcgaggatggccatcagcggggacgattgtgtcgtgaagcccatcgacgaccggttcgcctcagccctgaccgccctgaatgacatggggaaggtgcgcaaggacatacaacagtgggagcccagccgggggtggaacgactggacccaggtcccgttctgttcccaccatttccacgagctcgtgatgaaagacggccgcgtgctggtcgtgccctgccggaaccaagacgagttgatcgggagagcaaggatcagtcaaggcgctggatggtccctcaaggaaacggcctgcctgggcaagagctatgcccagatgtggaccctgatgtacttccaccgccgggacctccgcctggcagcgaatgccatctgcagcgctgtgccgtcccactgggtacccacctcaaggaccacctggagcatccacgccaagcacgagtggatgactaccgaggacatgctggcggtgtggaaccgcgtgtggatccaggaaaatccttggatggaagacaagaccccagtagagtcctgggaggaggtgccctacctcggtaagcgggaggaccagtggtgcgggtcgctcatcggcctgacctcacgggccacgtgggcaaagaacatccagaccgccatcaaccaggttcggtcgctcattgggaacgaggagtacaccgactacatgcctagcatgaagaggttccgccgggaggaagaggaggcaggcgttctgtggtaa

SEQ ID NO: 25040 - RNA, 9876 nt, synthetic construct
  misc_feature 1..9876: note = derived and/or modified CDS sequence (opt11) from DENV-2__FJ850050__SS-prME
  source 1..9876: mol_type = other RNA
accgccggcgtgatagtaatgttgatccccaccgcaatggcgttccacttaacgacccgaaatggggagccgcacatgatcgtggggcggcaggagaaagggaagtccctgctgtttaagaccgaggacggcgtgaatatgtgcaccctcatggccatcgacttaggggagctgtgcgaggacacgatcacctacaagtgccccctcctgcgccagaacgagcccgaggacatcgactgctggtgtaattctaccagcacctgggtcacgtacggaacctgcaccaccactggcgagcaccggcgcgagaagcggtccgtggcactcgtgccccacgtcgggatgggtctcgaaacgcggaccgagacctggatgtcgtccgagggcgcatggaagcacgtgcaaaggatagagacgtggatcctgcgccaccccgggttcaccatcatggccgcaattctggcatacaccatcggcaccacgcactttcagcgggcacttatcttcatccttttgaccgctgtagcgcccagcatgaccatgcgctgcattggcatatccaaccgggacttcgtcgagggcgtgagcgggggctcctgggtggatatcgtcctcgagcacgggtcgtgcgtgaccacgatggccaagaacaagcccaccctagactttgagttgatcaagacagaggccaagcagcccgccaccctacgcaaatactgcatcgaagccaagctcaccaacaccacaacagagtcccggtgccctacgcagggcgaacccagcctgaatgaggagcaggacaaacgcttcatctgcaagcattctatggtagaccggggctgggggaacggctgcggactcttcggcaagggtggcatcgtcacatgcgcgatgttcacctgtaagaaaaacatggagggcaaggtggtgcagcccgagaacctcgagtataccatagtcatcacgccacacagcggggaggagcacgccgtgggcaacgacaccgggaagcatggcaaggagatcaaaatcacaccgcagagctctatcaccgaggccgaactgaccgggtacggcacagtgaccatggaatgctcaccacgcaccggcctcgactttaatgagatggtcctgctgcagatggaggacaaggcctggctcgtgcataggcagtggttcctggacctgcccctcccctggctccctggggccgacacccaaggcagcaactggatccagaaggagactttagtgaccttcaagaacccccacgcgaagaaacaggacgtcgtggtactcgggtcccaggagggcgccatgcacaccgccctcactggcgggacggagatccagatgagctcggggaatctgcttttcaccgggcacctcaagtgccgcctgcggatggacaagctccagctgaaggggatgtcttacagcatgtgcactggtaagtttaagattgtgaaagagattgccgagacccagcacgggaccatcgtgatccgcgttcagtacgagggcgacggctccccctgcaagatcccgttcgagataaccgatctggagaagcggcacgtgctcgggcgactgattaccgtgaaccctattgtcaccgagaaggactctcctgtgaacatcgaagcagagccacccttcggggactcctacatcatcattggcgtggaaccaggccagctgaagctgaactggtttaagaaaggcagcagcattggccagatgttcgagacgactatgagaggggcaaagcggatggcgatactaggcgacaccgcctgggacttcgggtcactaggcggggtgttcacatccatcggcaaggccctccaccaagtgtttggagctatctacggggccgccttttcaggcgtgtcgtggacgatgaagatcctgatcggggttatcatcacctggatcggcatgaacagccgctccaccagtctctcggtgagcctggtgctcgtcggggtggtgacgctttaccttggcgcagtggttcaagccgactccggctgcgtggtcagctggaagaacaaggagctaaagtgcgggtccggcattttcatcacagacaacgtgcacacctggacggaacagtacaagttccagcccgagtctcctagcaagctggcgtccgccatccaaaaggcccacgaggaggggatttgcgggatccggagcgtgacccgcctagaaaacctcatgtggaaacagatcacgccagagctgaaccacatcctatccgagaacgaggtcaagctcaccatcatgaccggcgacatcaagggcataatgcaggcgggcaagcggagcctgcgcccgcagcccaccgagctgaaatactcctggaagacgtgggggaaggcgaagatgctcagcaccgagagtcacaaccagaccttcctgattgatggaccggagacagcggagtgcccgaacacgaaccgggcctggaacagcctggaggtggaggactacggtttcggcgtctttaccaccaacatctggctgaagctacgcgagaagcaggacgtgttctgcgactccaagttaatgagcgccgccataaagtacaaccgggcagtgcacgcggacatgggctattggatcgagtccgccccctgcgactcatgggagatgcagaaagcctcattcatcgaggtgatctcatgtcactggcccaagtccctcaccctttggagcaatggggtcctggagtccgaaatgatcatccccaagaacttcgccggaccggtgagccaacacaactatcgccccggataccacacccagacggccgggccctggcaccttgggaagctggaaatggacttcgatttttgcgagggaaccaccgtggtcgtgaccgaggactgcggcaaccgtgggcccagcctgcgcacgaccaccgcgagcggaaagctgatcaccgaatggtgctgccggagctgcacgctgccgcccctgcgataccggggagaggacgggtgctggtacgggatggagatccgccccctcaaagagaaggaggaaaacttagtcaacagccttgtcaccgcgggccacggccagatcgacaatttcagcctcggggtgctgggaatggcattattcctcgaggaaatgctgcggacccgcatcgggacaaagcacgctatcctactcgtggccgtgagtttcgtaacgctgataacgggcaacatgagcttccgcgacctggggcgcgttatggtcatggttggagctaccatgaccgacgacatcggcatgggtgtgacgtacctcgccctgctggccgcattcaaggtccgccctaccttcgccgccgggctcctgctgcggaagttgacgtccaaggagctgatgatggcaaccatcgggatagccctgctcagccagtccacgatcccggagaccatcctggagctgaccgacgccctggccctcggcatgatggtactgaagatcgtgcggaacatggagaagtaccagctcgccgtcaccatcatggccatcagctgcgtgcccaacgccgtgatactgcagaatgcctggaaagtttcttgcacaatacttgcggcggtgagcgtctcgcccctccttctgacctctagtcagcagaaggccgactggatccccctcgcgctgaccatcaagggtctgaatccgactgcgatcttcctcacgaccctgtcacggacgagtaaaaagcggagctggcccctgaacgaggctatcatggccgtggggatggtgtccatactcgcaagcagcctgctgaagaatgacattccgatgaccggacccctcgtcgccgggggacttctaacggtgtgctacgtcctcaccggtagatctgcggacctggaattagagcgcgcggcggatgttaagtgggaggatcaagccgagatcagtggcagtagccctattctatccataaccatcagcgaggacggttccatgagcatcaagaacgaggaggaggaacagacactgacgatcctgatccgtaccgggctcctggtgatcagtggcgtgtttcccgtcagcatccccatcaccgcagcggcctggtatctgtgggaggtgaagaaacagcgcgcgggggtgctctgggacgtcccctccccgccacccgtggagaaggcggagctagaggacggggcctatcgcattaaacagcgcgggatcctgggatactcccaaataggcgcgggggtgtacaaggagggcaccttccacacaatgtggcacgtcacgcgtggagccgtgctcatgcaccgaggcaagcgcatcgagccctcctgggccgacgtgaaaaaggacctgatttcatacgggggcggctggaagctggagggggagtggaaggagggcgaggaggtccaggtgctagcactggagcccggtaaaaacccccgcgccgtccagaccaagcccggtatctttaaaacaaacaccgggacaataggtgcggtctccctggacttctcaccgggcacaagcggtagccccatcgtggatcggaaaggtaaggtagtcggactctacggcaacggcgtcgtgacccgctccggcgcctacgtcagcgccattgcacagaccgagaaaagcatcgaggacaaccccgagatcgaggacgacatcttccgtaagaagcgcctgacgatcatggacctgcaccccggcgcgggcaagaccaaacggtacttaccggccattgttcgggaggccattaaacggggcctacgaaccctcatcctggctcccacacgcgttgtcgccgcggaaatggaggaggcactacgggggctgcccatcagatatcagacgcccgccattaaaaccgagcacacaggccgggagatcgtggatctgatgtgccacgccaccttcacgatgcgcctcctgtctccggtaagagtcccgaattataacctgatcatcatggacgaggcccacttcaccgaccccgcgagcatcgccgcccgcggctacatctccactcgggtggagatgggggaggccgccggcatcttcatgaccgcaacaccccctgggagccgtgacccattcccccagtcgaatgcccccatcatggacgaggaacgggagataccggagcgcagctggaactcagggcacgagtgggtaaccgacttcaaggggaagaccgtctggttcgtccccagcatcaaggccggcaacgatatagccgcgtgcctaaggaagaacggtaagaaggttatccagctgtcccgcaagaccttcgatagcgagtacgtcaagacgcgggccaacgactgggacttcgtcgtgaccaccgacatctctgagatgggggccaacttcaaagccgagcgcgtcatcgacccccggcgctgcatgaaaccggtgatcctgaccgacggagaggaacgggtgatccttgcggggccgatgcctgtcacgcactcctccgccgcccaacgccggggccgtatcgggcgcaaccccaagaacgaaaatgatcaatacatttatatgggcgagccgctggagaacgacgaggattgcgctcactggaaggaggccaagatgctgctcgacaacattaataccccggagggcatcatcccaagcatgttcgagcccgagcgtgagaaagtggacgccatcgatggggagtatcgcctgcgcggggaggcaaggaagaccttcgtggatttaatgcgtcgcggggacctcccggtttggttagcctacaaagtggctgccgagggcatcaactacgccgaccggaagtggtgcttcgatggaatcaagaataaccagatcctggaggagaacatgcaggagcagatctggaccaaggagggggagcgcaagaagctcaagccccggtggctggacgcgcgaatctattcagaccctctggcactcaaggagttcaaggagttcgctgctggccggaagtcattgacgctgaacctgataactgagatggggaggctacccaccttcatgacccagaaggcgcggaacgccctggacaacctcgccgtactgcacacggccgaggccggcgggcgggcctacaaccacgccttgtctgagctcccggagaccctagagaccttgctactgttaacactcctggccacggtcactggcggcatcttcctattcttgatgagcgggaagggcatcgggaaaatgactctgggcatgtgctgcataatcaccgcctccattctgctttggtacgcccaaattcagccacactggatcgcggcgagcatcatcctggagttcttccttatcgtcctcctgatccccgagcccgagaagcaacgcaccccgcaagataaccagttaacgtacgtcgtgatcgcaatcttgaccgtggtcgcagccacaatggcgaatgagatggggttcctggagaagaccaaaaaggacctgggtctcggcagcatcactacacaagagtccgagagcaatatcttagacatcgacctgcgaccagcctccgcctggaccctctacgccgtggccaccacgttcgtcacccccatgctgcgacatagcatcgaaaattccagcgtgaacgtgtccctgacagcgatcgccaaccaagccaccgtgctcatggggctgggcaaggggtggcctctaagcaagatggacattggcgtgcctctactggccatcgggtgctactcccaagtgaatcccattacgctgacagcggccctcctcctcctcgtggcccactatgccataatcggtcccggcctgcaagccaaggcgacacgcgaggcccagaagagagccgccgccggaatcatgaagaaccccaccgtcgatggcatcacggtgatcgacctggagccgatcccctacgatccgaagttcgagaagcagctcggacaggttatgctactgatcctctgcgtcactcaagtcctgatgatgcgcaccacctgggcgctatgcgaggcactcacgctggccaccggccccatctccaccttatgggaagggaaccctggtcggttctggaacactacgattgccgtgtccatggccaacatcttccgcggctcatatctcgcgggcgccggcctgctgttctccataatgaaaaacaccaccagcacccgccgagggacgggtaacatcggcgagaccctcggggagaagtggaaatcacggctgaacgccctgggcaagagcgagtttcagatctataagaaatccgggatccaggaggtagaccggaccctcgccaaggaaggcatcaagcgcggagagactgaccaccacgccgtgtctcgaggctccgctaagctgagatggttcgtggagcggaacatggtcacacccgagggcaaggtagtcgatctggggtgcggccgcggagggtggagttactactgcgggggcctcaagaacgtccgggaggtaaagggcctgaccaaagggggccccgggcacgaggaacccatcccgatgagtacctacggttggaacctggtccgcctccagagcggtgtcgatgtcttcttcacaccccctgagaaatgcgacacgctgctctgcgacatcggggagagctcccccaacccgacgatagaggccggtcgtaccctacgcgtgctgaatctggtcgaaaactggcttaacaacaacacccagttctgcatcaaggtactgaacccttacatgcctagcgtcatcgagaagatggaagccttacagcggcaatacggaggggccctcgtcaggaatccgctgtcacggaacagcacccacgagatgtactgggtgtccaatgccacgggcaacatcgtcagctccgtcaatatgattagccggatgctgattaaccggttcactatgaagcataagaaggccacatacgagcccgacgtggacttaggctccgggaccaggaacatcggcatcgagagcgagatacccaatctcgatatcataggcaaacggatcgagaagatcaagcaggagcacgagattagttggcactacgatcaggaccacccctacaagacgtgggcctaccacgggagttacgaaacgaagcagaccggctccgcatcgagtatggtgaacggagtcgtacgtctgctgaccaagccgtgggacgtggtccccatggtgacgcagatggctatgaccgataccaccccctttgggcagcagcgcgtgttcaaggagaaggttgacacgcgcacccaggaacccaaggaaggaaccaagaagctcatgaagatcaccgcggagtggctgtggaaggagctggggaagaagaagacgccgcgcatgtgtaccagagaggagttcaccaagaaggttcgcagcaacgccgccctcggcgccatcttcacggatgagaataagtggaaaagcgcccgggaggcggtggaggacgggcgcttctgggaactggtagaccgggagcgcaacctgcatctcgaaggcaagtgcgagacgtgtgtttataacatgatggggaagcgggagaagaagctgggcgagttcggcaaggccaaagggtcacgagcaatttggtacatgtggctgggtgcccggttcctcgagttcgaggcgttagggttcctgaacgaggatcactggttcagccgcggcaactccctcagcggggtggagggtgaaggtttgcaccggttgggttacatcctccgagacgtcggcaagaaggaagggggcgccatgtatgccgacgacacagcgggatgggacacccggatcaccctggaggacttgaagaacgaggaaatggttacgaaccatatgaagggcgaacacaagaagctcgccgaagcgattttcaagctgacctaccagaacaaggtcgtgagggtgcaacggcccacaccccgcggcaccgtcatggacatcatctcccgtcgcgaccagcggggaagcggccaggtggggacatacggcctgaataccttcaccaacatggaggcccaactcatccgccagatggagggcgagggaatattcaagtccatccagcatctgaccgccacggaggaaattgcagttcagaattggttagcccgtgttggccgggagcgactgagccgaatggcgatttccggcgatgattgtgtcgttaagcctattgacgaccgcttcgccagcgccctgacggcgctgaatgacatgggcaaggtccggaaggacatccagcagtgggagccgtcccgcgggtggaacgattggacccaagtacccttctgcagccaccacttccacgagctcgtgatgaaggacggccgggtcctggtggtgccctgccgaaatcaagacgagctgatcggccgggctagaatctcccagggggcgggctggagtctcaaggagaccgcctgcctgggtaagtcgtatgcccagatgtggacgctgatgtacttccaccggcgcgatcttcggttggccgcgaacgccatctgcagcgcagtcccctcccactgggtgccgaccagccgcacaacctggtccattcacgccaagcacgagtggatgaccacggaggacatgttggccgtctggaaccgggtctggatccaagagaacccatggatggaggacaagacacccgtggagtcttgggaggaggtgccctacctcggcaagcgcgaggaccagtggtgcgggtccctgattggactgacgtcccgggccacctgggctaaaaatatccaaacggctatcaatcaggtccgcagcctcatcggcaacgaggaatataccgattatatgccgtccatgaagcgattcagacgcgaggaggaggaggcaggggttctgtggtga

SEQ ID NO: 25041 - RNA, 9876 nt, synthetic construct
  misc_feature 1..9876: note = derived and/or modified CDS sequence (opt11) from DENV-2__FJ639837__SS-prME
  source 1..9876: mol_type = other RNA
acggcaggcgtgattgtcatgcttattcccacagcaatggcctttcacctcactacccgcaatggggagccccacatgatcgtgggccggcaggagaaggggaagagtcttctgtttaagaccgaggacggcgtgaacatgtgcaccttaatggccatcgacctgggggagctgtgcgaggacaccatcacctataagtgtcccctactgcgccaaaatgagcccgaagacatcgattgctggtgcaactctaccagcacctgggtcacctacgggacctgcaccacaacgggcgagcaccgtagggagaagcgttccgtggccctggtgccccacgtcgggatgggtctcgagacccgtacggaaacctggatgagctctgagggggcctggaagcatgtgcagcggattgagacctggatattgcgccacccgggcttcaccatcatggcggcgatcctggcgtataccatcggcaccacgcacttccaaagagccctcatcttcatcctgctgaccgccgtggcacccagcatgaccatgcggtgtataggcatatcgaaccgcgactttgtcgagggcgtgagcggaggctcctgggtggacatcgttctcgaacacggtagctgcgtgaccacgatggccaagaacaaacctaccctggactttgaattaatcaagaccgaagcgaagcagcccgccaccctccgcaagtactgcatcgaggcgaagttgacgaataccacaacagaatcccggtgccccactcagggcgaacccagcctgaacgaggaacaagataagaggttcatatgtaagcactccatggtggaccggggctggggtaacggctgcgggctgtttggcaagggaggaatcgttacctgtgcgatgttcacgtgcaagaaaaacatggagggcaaagtggtgcagccggaaaacttagaatacaccatcgtcatcacgccccactcgggtgaggagcacgcagttggaaacgacaccgggaagcacggcaaggagatcaagatcacgccacagtcgtcaatcacggaggccgagctgaccgggtacggcactgtgaccatggagtgtagccctcgtaccggcctcgacttcaacgagatggttttgctacagatggaggacaaggcctggctcgtgcatcggcaatggttcctcgacctacccctgccctggctaccgggggccgatacccagggcagcaactggatccagaaggagacgctcgtgaccttcaagaatccgcacgcgaagaagcaggacgtcgtggtgttggggtcccaggagggagccatgcacactgccctaaccggggccacggagattcagatgagcagcggcaacctcctgttcacgggccacttaaagtgccgtctccggatggacaagctgcagctaaagggtatgtcctacagcatgtgcaccggaaagttcaagattgtgaaggagatcgccgagacccagcatgggacaatcgtgatccgggtacagtacgagggtgacggctccccctgcaagatacccttcgaaatcaccgaccttgaaaaacggcacgtgctcgggcgcctgataaccgttaacccgatcgtgacagagaaggactctccagtaaacatcgaggcggagccgccgttcggcgactcctacatcataatcggggtggagcccggccagctgaagctcaactggttcaagaaggggagttccatcggccaaatgttcgagacgaccatgcgcggagccaagcggatggcgatcctgggggacaccgcctgggactttggcagcctcggcggagtctttaccagtatcgggaaggccctccaccaagtttttggcgcgatctacggcgccgcattcagcggggtgagctggactatgaagatcctgatcggtgttataatcacctggatagggatgaatagccgctccacctcgctatccgtgagcttggtgctcgtcggcgtggtgactctgtacctgggggccgtcgtgcaggcggattccggttgcgtggtcagctggaagaacaaggaactcaagtgtggatccggtatcttcattacggacaacgtgcacacctggaccgagcagtacaagttccagccagagtctccctcaaagctggcgtccgcaatacaaaaggcacacgaggagggaatctgcggtatccggagcgtaacccgcctggagaacttgatgtggaagcagatcacgcccgaactgaatcacatcctatccgagaacgaggtcaaactcactatcatgaccggcgatatcaaggggatcatgcaggccggcaagcggagcctgcgcccgcaacctaccgagctgaagtactcctggaagacgtggggcaaggcgaagatgcttagcaccgagtcccacaaccaaaccttcctgatcgacgggccggagaccgccgagtgcccgaacaccaaccgggcgtggaacagcctggaggtggaggactacggcttcggggtatttaccaccaacatctggcttaaactgagagagaaacaggacgtcttctgcgacagcaagctcatgagcgccgccatcaaggacaaccgggccgtgcacgccgatatgggctattggatcgaatctgccttaaacgacacctggaagatggagaaggcgtcgttcatagaggtgaagtcctgccactggccaaagagccacaccctgtggtccaacggcgtcctggagtcagagatggtgatccccaagaacttcgcaggacccgtatcccaacacaattaccgcccgggctaccacacgcagaccgcggggccctggcacctcggcaagctggagatggatttcgacttttgcgagggcaccaccgtagtggtgacggaggactgtggcaaccggggcccctcattgaggacaaccaccgcaagcgggaaattgatcacggagtggtgttgccggtcatgcacactgcccccgctgcgctaccggggcgaggatgggtgctggtacggaatggagatccgccccttaaaggaaaaagaagagaacctggtcaacagcctggtgaccgcagggcacgggcaaatcgacaacttctccctaggcgtgctggggatggccttattcctcgaggaaatgctgcggacccgaatcggcacgaaacatgcgatccttctcgtcgccgtcagctttgtgaccctgattaccgggaacatgtccttccgggacctgggccgcgtcatggtcatggttggggccaccatgacggacgacattggaatgggcgtcacctacttggccctgttagctgcttttaaagtccgcccgacattcgccgccggtctcctgctacgcaagctcaccagcaaggagctaatgatggccacgatcggaatcgccctgctatcccaatcgaccatccccgagaccatcctggagctgaccgatgcactcgccctggggatgatggtgctgaagattgtccgcaacatggagaaataccagttagccgtgacgatcatggccatctcctgcgtgccgaacgccgtcatcctgcaaaacgcgtggaaggtgagttgtaccattctggcagccgtctccgtgagcccgttactgcttacctctagtcagcagaaggccgactggatccccctcgcgctgacaataaagggcttaaaccccaccgccatcttcctcaccaccctgtcccggaccagcaaaaagcggtcctggcctctgaacgaggccatcatggccgtcgggatggtcagcatattagcctcctctttgctgaaaaacgacatcccgatgacaggacctctcgtggccggtggtctgctgacggtgtgttacgttctcaccggcaggagcgccgacctggagctggagcgcgccgccgatgtgaaatgggaggaccaggccgagatctccgggagctcccccatccttagcatcaccatatccgaggacggtagcatgtccatcaagaacgaggaagaggagcagactctgaccatattaatccggaccggcctgctggtgatcagcggggtgttcccggtgtccattcctatcaccgcggccgcttggtacctgtgggaggtgaagaagcagcgcgccggcgtcctctgggatgtgcccagcccgcccccagtcgagaaagccgagctcgaggacggggcgtatcggatcaagcagcgaggcatactggggtactcccagatcggcgccggcgtctacaaggagggtacattccacaccatgtggcacgtgacacgtggcgctgtccttatgcacaggggtaagcggatcgagcccagctgggccgacgtcaaaaaggacctgatctcctatggcgggggttggaagctagagggagagtggaaagagggtgaggaggtccaggtccttgccctggaacccggcaagaatccgagagccgtccagaccaagcccgggatctttaaaacaaacacgggcaccatcggcgcggtatccctggacttctcccccggaaccagcggcagccccatcgttgaccggaaggggaaagtggtggggctctacgggaacggagtggtcactcgcagcggagcctatgtgagtgcaatcgcgcaaacggagaagtcaattgaggacaaccccgagatcgaggacgatatttttcggaagaagcgcctgacaatcatggacctgcaccccggggccggcaagaccaagcgctacctacccgccatcgtacgcgaggccatcaagcgggggctgcgcaccctgatcctggctccgacgcgcgtcgtagccgccgagatggaagaggccctacggggccttcccattcgctaccagacccccgccatcaagaccgagcacaccgggcgggagatcgtggacctgatgtgccacgccacgttcaccatgagactcctgagcccggtccgagtgccgaactacaacctgattatcatggatgaagcccacttcaccgatcccgcctccatcgcagcccgcggctacatctctactcgggtggagatgggcgaggcggcggggatttttatgacggccacgccgcctggctcccgcgatcccttcccgcagagcaacgctcccattatggacgaggagcgggagatcccagagcgctcctggaacagcgggcatgaatgggtcaccgatttcaagggcaagactgtgtggttcgtgccgtcgataaaggccgggaacgacatcgcggcctgcctccggaagaacgggaagaaggtcatccagctgagccgcaaaacgttcgactcagagtacgttaagactcgcgccaacgactgggactttgtggtcactaccgacatcagcgagatgggcgccaacttcaaggcggagcgcgtgatcgacccccggcgttgtatgaagccagtgatcctgacggacggggaggaacgggtgatcctcgccggccccatgccagtaacccattcctcagcggcacaacgacgagggcgcatcggcagaaaccccaaaaacgagaacgaccagtacatctacatgggggagcctctggaaaacgatgaggactgcgcccactggaaggaggcaaagatgctgctcgacaacatcaacacccccgaaggcattatcccgagtatgttcgagcccgagcgggaaaaggtggacgctatcgacggcgagtatcgcctgcgtggggaggcccgcaagaccttcgtcgacctaatgcggcgcggcgacctcccagtctggcttgcctacaaggtcgctgcagaagggatcaactacgccgaccggaagtggtgcttcgacggcatcaagaacaaccagattctagaggaaaacatggaagtcgagatctggacgaaggagggcgagcgcaaaaagctcaagccgcgctggctggacgcccgtatttatagcgaccctttggccctcaaggagtttaaggagttcgccgcgggccgcaaatccctgaccctgaacctcatcactgagatgggacgcctgcccaccttcatgacgcaaaaggcccggaacgctttagataacctcgccgtgctgcacaccgccgaagctggtggccgcgcctataaccacgccctgtcagagctcccggagaccttagaaaccctgctcctgctgactctgctggccaccgtcaccgggggcatcttcctattcttaatgtccggcaagagcatcgggaagatgacactgggaatgtgctgcatcatcacggcttcaatcctgctctggcacgcgcagatccagccgcactggattgccgcaagcatcatcctggagttctttctcatagtgctcctgatcccagagcccgagaagcagcggacgccccaagacaaccaactgacctacgtggtcatagccatcctcaccgtggtagcggcgacgatggccaacgagatggggttcttggagaagacgaagaaggacctggggttgggtagcatcaccacgcaggagagtgagagcaacattctagacatagacctgcgcccggcctcagcctggaccctgtacgcagtcgcgacgaccttcgtgacacccatgttgcggcatagtatcgagaactccagcgtgaacgtctccctgaccgccatcgccaaccaggcgacggttctgatgggcttgggcaagggctggcccctgtcaaagatggacataggagtgcccctcctggcgatcgggtgctactcccaggtcaacccgatcaccctaacagccgccctcctcctgctcgtggcacattacgccatcatagggcccgggctccaggcgaaggccacccgcgaggcccagaagcgggcggccgcgggaatcatgaagaacccaacggtggatggtattaccgttatcgacctggcacccatcccatatgaccccaagttcgaaaagcaactcggccaggtgatgcttctgatcttgtgcgtgacccaggtgctgatgatgcgcaccacgtgggccctgtgcgaggccctgaccctggccactgggcctatcagcaccttatgggaggggaaccctggccggttctggaacacgaccatagcggtgtcgatggcaaacatcttccgcgggagctaccttgcgggagccggcttactgttctccatcatgaagaacaccacgagcacgcgccggggtactggaaatatcggggagacccttggcgagaaatggaaaagccgcctgaacgcgctggggaaaagcgagtttcagatctacaagaagtccggtatccaggaggtagaccggaccttagcaaaggaagggatcaagagaggggagacggaccaccacgccgtcagcagaggctctgccaaactgcgatggttcgtggagcggaacatggtgactccggaggggaaggtcgtggacctgggctgcggccgcgggggctggagctactactgcggcggcctcaagaacgtgcgagaggtcaaggggctgaccaaagggggaccagggcacgaggagcccatcccaatgagcacctatgggtggaatctggtgagactgcagtcgggggtggacgtctttttcacgccacctgagaagtgcgataccctgctgtgcgacatcggggaaagctcccctaaccccacgatcgaggcggggcggacgctcagagtgctgaacctggtggagaactggttaaacaacaatacccagttctgcatcaaggttctgaacccgtacatgcccagcgtgatcgaaaagatggaagcgctgcaacggcagtacggcggcgcactcgtgcgcaaccccctctcccggaactctacacacgagatgtactgggtctcaaacgccaccgggaacatcgtcagttccgtgaatatgatcagccgaatgctgatcaaccgtttcaccatgaagcataagaaggccacctacgagccggacgtggacctgggctccgggacgcggaacatcggcatcgagaacgagattcccaacctcgacatcatcgggaagcggattgaaaagatcaaacaggagcacgagatctcctggcactacgaccaggaccacccatacaagacttgggcttaccatggcagctacgaaacaaagcagactgggtctgcttccagcatggtgaacggggtggtacgcctgctgacgaagccatgggacgttgtcccgatggtcacccaaatggccatgaccgacaccacccccttcggccagcagcgcgtgttcaaggaaaaggtggacacccggacccaggagcccaaggaggggaccaagaagctcatgaagataaccgccgagtggctgtggaaggaactcggaaagaagaaaacgccccgcatgtgcacccgggaagaatttacccgcaaggtcagatccaacgccgccctcggcgccatattcacggacgaaaacaagtggaagtccgcccgcgaggccgtcgaggatgggcggttctgggaactggtggatcgcgagcggaacttacatctcgagggtaagtgcgagacctgtgtctataacatgatggggaagcgcgagaagaagctaggcgagttcgggaaggccaagggctcccgggcgatttggtacatgtggttgggtgcccgcttcctcgagtttgaagccctggggttcctcaatgaagaccactggttcagcaggggaaacagcctctccggggttgagggcgaggggctgcaccgtctgggctacatcctccgggatgttgccaagaaggaaggcggcgccatgtacgccgacgacaccgctggctgggacacacggatcaccttagaggacctaaagaacgaggaaatggtgaccaaccacatgaagggggaacacaagaagctcgccgaggcgatcttcaagctgacctaccagaacaaggtagtgcgagtgcaacgcccgacaccccggggtacggtgatggacatcatcagccgccgcgaccaacgtgggtccggccaggtcggcacctacgggttaaacaccttcaccaacatggaggcccagctgattagacagatggagggcgagggcatcttcaagagcatccagcaccttactgcgacagaggagatagccgtccaaaactggctggcccgggtaggccgcgaacggttgtcacgcatggcgatctctggcgacgactgtgtcgtgaagcctatcgacgaccggttcgcctcagcgttaaccgccctgaatgacatggggaaagtacgcaaggacatccagcagtgggagcccagtcggggctggaacgactggacccaggtcccgttctgctcccatcacttccacgagctcgtgatgaaggacggtcgcgtgttagtagtgccctgccgaaaccaggacgaactgataggcagggcccggatcagtcagggggccggctggtcgctcaaggagacggcgtgcctgggcaagtcctacgcacagatgtggaccttgatgtacttccacaggcgtgacctacgactggccgccaatgccatctgctccgcagtgcccagtcactgggtccccacctcccggactacctggagcatccacgccaagcacgaatggatgacgaccgaggacatgctggccgtatggaatcgagtgtggatccaggagaacccgtggatggaagacaaaacccccgtcgagtcctgggaggaggtgccctacctcggaaaacgggaggaccagtggtgtgggagcctgatcgggctgacctcacgcgccacgtgggctaagaacatccagaccgcgataaaccaggtgcggtccctcattgggaacgaggagtacacagactacatgcccagcatgaagcgcttccggagggaagaggaggaggccggtgtcctgtggtga

SEQ ID NO: 25042 - RNA, 9876 nt, synthetic construct
  misc_feature 1..9876: note = derived and/or modified CDS sequence (opt11) from DENV-2__FJ744706__SS-prME
  source 1..9876: mol_type = other RNA
accgcgggcgtcatcgtcatgctgatccccaccgccatggcgttccacctcaccacccgcaatggggagccccacatgatcgtggggcgacaggaaaaggggaagtccttgctgttcaaaaccgaggatggcgtgaacatgtgcacgctcatggcgatagacctgggggagttatgcgaggacaccatcacctacaaatgccctctgctgcgccagaacgagcctgaagacatcgattgctggtgcaatagcaccagcacctgggtcacgtacgggacatgcaccaccactggcgaacatcggcgcgaaaagcggtccgtagcgctggtgccccacgtcgggatgggcctcgagacccgcactgagacctggatgagcagcgagggagcctggaagcacgtgcagcggatcgagacctggatcttacgtcacccgggcttcaccatcatggccgcgatactcgcctatacgatcggtaccacgcacttccagcgggccctcatcttcatcctactgaccgccgtggcgccatcaatgaccatgcgctgcatcggcatcagcaaccgggactttgtcgagggcgtaagcgggggcagttgggtggacatcgtactagagcacgggagctgcgtgaccacgatggccaagaataagccaaccctggactttgagttaatcaagaccgaggccaagcaacccgcgaccctccgcaaatactgcattgaggctaaactgacgaataccactacggagtcccggtgcccgacgcagggtgagccctctctgaatgaggagcaggacaaacgcttcatctgcaagcattccatggttgatagaggctgggggaatggctgtggcctgttcggcaagggcggtatcgtgacctgcgcgatgttcacgtgcaaaaagaacatggaaggcaaggtggtccagcccgagaacttggaatacacgatcgtcatcacgccccacagcggagaggagcacgccgttggcaacgacaccggcaagcacggcaaggagatcaagatcaccccacagtccagcatcaccgaggccgagctgaccgggtacggcacggtaaccatggagtgtagccccaggaccggcttggatttcaacgaaatggtcttactgcagatggaggataaggcctggctcgtacaccggcagtggttcctggatctgcctctcccctggctgccgggggccgacacccagggcagcaactggatccagaaggagacgctggtgaccttcaagaacccccacgcgaagaagcaagacgtcgtggtactcgggtcccaagaaggcgccatgcacaccgccctgaccggggctacggagattcagatgagcagcggcaacctcctgttcactgggcacctgaagtgccgtctgcggatggacaagctacaactgaaggggatgtcatacagcatgtgcaccggcaagttcaagatcgtgaaggagatcgccgagacgcagcatgggacgatcgtgatccgcgtccagtacgagggagacgggtctccctgcaagatcccctttgagatcaccgacctggagaagcggcacgtcctcgggcgcctaataactgtgaaccctatcgtcaccgagaaggacagccccgtgaacattgaagctgagccgcccttcggcgactcctacataatcatcggggtggagccgggccagctgaagcttaactggttcaagaaggggagctccatcggccagatgttcgagacgaccatgcgcggcgcaaagcggatggccatccttggggacaccgcctgggacttcggcagcctcgggggcgtcttcacctccatcgggaaggcacttcaccaggtgttcggcgcgatttacggcgccgccttcagtggggtgtcctggacgatgaagatcctgattggggtcatcatcacctggatcgggatgaactctcgctcgacgagcctgtccgtgagcctggtgctcgtcggcgtcgtgaccttatacctgggggccgtagtgcaggcggacagtgggtgtgtggtcagctggaagaacaaagagctcaagtgtgggtccggtatcttcatcacagataacgttcacacctggaccgagcagtacaaatttcagcctgagagccctagcaagcttgcatccgccatccagaaggcgcacgaggaaggcatctgtggaatccggtctgtcactcgcctagagaatctcatgtggaagcagattacccccgaactgaaccacattctgtccgagaacgaggtcaagctcacgattatgaccggtgacatcaagggcatcatgcaggcaggcaagcggtcactgcgcccgcagcccaccgagctgaaatactcctggaagacgtggggtaaggcgaagatgctgagcaccgggagtcacaaccagacctttctgattgacggccccgagaccgctgagtgccccaatacaaaccgggcctggaacagcctggaagtagaggactatggtttcggcgttttcaccaccaacatatggctgaagctgcgggagaagcaggacgttttttgcgactccaaactgatgagcgccgctatcaaggataaccgggcggtccacgccgacatgggctactggatcgagtccgcccttaacgatacctggaagatggagaaggcaagttttatcgaggtgaaatcctgccactggcccaagtcccacaccctgtggtccaatggagtcctggagagcgagatgatcatccccaagaactttgccggccccgtctcccagcacaactaccgcccggggtaccacacacagaccgcaggcccctggcacctcgggaagcttgagatggacttcgacttctgtgagggcaccaccgtggtcgtcacggaggactgcggcaacaggggtcccagcctgaggaccaccaccgccagcggcaaactcatcacggaatggtgttgccgttcctgcaccctgcccccgctacgctaccgcggggaggacggctgctggtatgggatggagatccgcccactcaaagagaaggaggagaacctggttaacagcctggtcaccgccggccacgggcagatcgacaacttttcactcggggtattgggcatggccctgttcctcgaggagatgctgcggacccgcatcgggacgaaacacgcgatcttactcgtggccgtcagctttgtgaccctcatcactggcaacatgtcgttccgggatctggggcgtgtcatggtcatggtgggcgccacaatgacggacgatattggcatgggtgtgacctacctcgccctattggccgcgttcaaggtccgccccacgttcgcggccgggctattactgcggaagctcacctccaaggagctgatgatggccacgatcgggatagccctactgagtcaaagtaccatccccgagaccatcctggagctgaccgacgcgctcgcactgggaatgatggtgctgaaaatcgtgcgcaacatggagaagtaccagctggccgtcacgatcatggccatctcctgcgtgcccaacgccgtaatcctgcagaatgcctggaaggtgagctgcaccatcctggccgccgtgtccgtcagccccctgctgttaacctccagccagcagaaggctgattggatccccctagcgctgaccatcaagggcctgaaccccacggccatcttcctaaccaccctgtcccggaccagcaaaaagcgctcttggccgttgaatgaggctatcatggccgttggaatggtgagcatcctcgcatccagcctgctgaaaaacgacatcccgatgacgggccccctcgtggccgggggcctgctgactgtgtgctatgtactcaccgggcggagcgctgacctggagttggagcgcgccgccgacgtcaaatgggaggatcaggccgagatctccggcagctcccccatcctctctataaccatctccgaagacggctccatgtcgatcaaaaacgaggaggaagagcagacgctcaccatcctcatacggaccggactcctggtgatcagcggcgtattccccgtctctatacccatcaccgcggccgcctggtacctctgggaggtgaagaagcagcgcgccggggtattatgggacgtccccagtccgccgcccgtggagaaagccgagctggaggacggcgcatacaggatcaagcagcgcgggatcctgggctactcccagatcggtgccggagtgtacaaggagggcaccttccacacgatgtggcacgtcacgcgcggtgcggtgctcatgcaccggggcaagaggatcgagcccagctgggcagacgtgaagaaggacctcatctcctacggcggcggctggaagcttgagggggagtggaaggagggcgaggaggtccaggtgctggctctagagcccgggaagaacccacgcgccgtgcaaacgaaacccggcattttcaagaccaatacggggaccataggcgccgtcagcctggacttctcccccggtacctctgggtcccccatagtggaccggaagggcaaggtggtagggttatacgggaacggcgtggtcacccgcagcggggcctacgtctccgccatcgcccagacggagaagtccattgaagacaaccccgagatcgaggacgacatcttccgtaagaagcgcctaacgatcatggacttgcaccccggcgccgggaaaaccaagcggtatctccccgccatcgtgcgcgaggctatcaagcggggcctgcgcaccctgatcctggccccgacgcgcgtggtcgctgctgagatggaagaggccctccggggactaccaatccgctaccagacccccgccatcaagaccgaacacaccggccgggagatcgtggacctgatgtgccatgccacgttcaccatgaggctcctgagccccgtccgggtcccgaactacaacctgataatcatggacgaggcgcacttcaccgatcccgcgtccattgcagcgcgcggctacatcagcacccgggtagagatgggtgaagccgctgggatctttatgacggccacgccgcccgggtcccgcgacccgtttccccagagcaacgcccccattatggatgaggagcgggagatccccgaacgcagctggaacagtggccacgagtgggtgaccgactttaaggggaagaccgtctggtttgtgccgagcatcaaagccggcaacgacatcgcggcatgccttcggaagaacggcaagaaggtgatccagctgagccgtaagacgttcgacagtgagtacgtcaaaacccgggctaacgactgggacttcgtcgtgaccaccgacatcagcgagatgggggccaacttcaaggccgaaagagtcatcgatcctcggcgctgcatgaaaccagtgatcctgacggacggcgaggagcgggtgatcctcgcagggcccatgccggtcacccactccagcgccgctcagcgcagaggccgcatcggacgcaaccccaagaacgaaaatgaccagtatatatacatgggcgagcccctggagaatgacgaggactgcgcccactggaaggaggccaagatgctgctcgacaacatcaacactcccgagggcatcatcccgtccatgttcgagcccgaacgggagaaggtggacgcgattgacggggagtatcgcttacggggggaggcccgcaagacctttgtggacctgatgcggcgcggggacttgcccgtctggctggcatacaaggtggccgccgaaggcatcaattacgcggaccggaagtggtgcttcgacgggatcaaaaacaaccaaatcctcgaggagaacatggaggttgagatatggacgaaagagggagaacgaaagaagctcaagccgcggtggctggacgcccgcatctattcggaccccctcgccctcaaggagttcaaggagttcgccgccggccggaagtccctaaccctgaacctcatcaccgagatgggcagactgcccaccttcatgacgcagaaggcccggaacgcacttgacaacctggccgtcttgcataccgccgaggcgggagggcgcgcatacaatcacgcgctgagcgagctccctgagactttggagaccctgctcctcctgacgctcctggccaccgtgaccgggggcatcttcctgtttctcatgagcgggaaaggcatcgggaagatgaccctgggcatgtgctgcatcatcaccgctagcatcctactctggtacgcgcagatccagccccactggatcgccgcctccatcatcctggagttcttcctgatcgtcttgctaatccccgagcccgagaaacagcggacgccccaggataaccagctgacctacgtggtgatcgccatcctcacagttgtggccgcgaccatggccaacgagatggggttcctggagaagacgaagaaggaccttggcttaggcagcatcaccacccaggagagcgagtccaacatcctggacattgaccttcgcccggccagtgcctggacactctacgccgtagcgacaaccttcgtgacccccatgctgcggcactctatcgagaactcgtccgttaacgtgagcctaaccgccatcgccaaccaggccacggtcctcatggggctgggtaaagggtggcccctgtccaaaatggatatcggcgtgcccctcctcgctatcgggtgctacagccaggtgaacccgatcacactgaccgccgccctccttctgttggtagcccattacgccatcatcggccccggcctccaagcgaaggccacccgcgaggctcagaagcgggccgccgcggggatcatgaagaaccccacggtcgacggcataaccgtgatcgacctggagcccataccgtacgaccccaagttcgagaaacagttagggcaggtcatgctgctgatcttgtgcgttacccaggtgctgatgatgcgtaccacgtgggccctgtgcgaggcacttacactggccaccggccccatctccaccctgtgggaagggaaccccggccggttctggaacacgaccatcgccgtctctatggcgaacatcttccgcggcagttacctcgccggggccggtctgttgtttagcatcatgaaaaacaccacctccacgcgccgggggacaggcaacatcggcgagaccctcggggagaagtggaagtcccgcctgaatgccttaggaaagtccgagttccagatctataagaagtccgggatccaggaggtggaccggaccttggcgaaggagggaatcaagcggggggaaacagaccaccacgccgtgtcccgggggagcgccaagctgcgctggttcgtcgagcggaatatggtgaccccggaggggaaggtggtcgacctggggtgcggccgcgggggatggtcttactactgcggcggcctcaagaacgtgcgggaggtgaagggcctgacaaagggcggccccgggcacgaggagcccatccccatgagcacctacggctggaacctggtcagacttcagagcggggtggacgttttttttacgccgcccgaaaagtgcgacaccctgctgtgcgacatcggcgaaagcagccccaacccgaccattgaggcaggcaggaccctccgcgtgcttaatctggtggagaactggttgaacaacaacacccaattctgtatcaaggttcttaacccgtacatgccctccgtcattgagaagatggaggccctgcagcggcagtacgggggcgcgctcgtgcggaaccctctgagccggaactccacgcacgagatgtactgggtgagcaacgcaaccgggaacatcgtctccagcgtgaacatgatcagcaggatgctgatcaacaggttcaccatgaagcataaaaaagccacctacgagcctgacgttgacctgggcagcggcacgcgaaacataggcatcgagtccgagatccccaacttagatatcatcggcaagcggatcgagaagataaaacaggagcacgaaatcagctggcattacgaccaggaccacccctacaagacctgggcttaccacgggagctacgagaccaagcagactggcagcgcttccagcatggttaacggggtggtgcggctgctgactaagccatgggacgtcgtgccgatggtgacccagatggcgatgaccgataccacgcccttcggccagcagcgcgtcttcaaggaaaaggtggacaccaggacccaggagcccaaggaaggaacgaagaagctcatgaaaatcacggccgaatggctgtggaaggagctggggaagaaaaagacgccccgcatgtgcacccgggaggagttcaccaagaaggtgcgcggcaacgctgccttaggagcgatttttacggatgagaacaagtggaaatccgcgcgggaggccgttgaagacggccgcttctgggaactggtggaccgagagaggaacctgcacctcgaggggaagtgcgagacgtgcgtttacaacatgatgggcaagcgggagaagaaactgggcgagttcgggaaggccaagggcagccgcgcgatctggtatatgtggctgggggcgcggttcctagagttcgaggccctgggcttcttgaacgaggaccactggttctcccgcggcaacagcctcagcggcgtcgagggcgaaggcctccatcggctgggctacatcctccgcgacgtggggaaaaaggagggcggggccatgtatgccgatgacacggcgggctgggacacccgcatcacgctggaggacctgaaaaacgaggaaatggtgaccaatcatatgaagggcgagcacaaaaagctcgcggaagccatcttcaagttgacgtaccagaacaaggtcgtgcgcgtccagcggccgacgcctcgcgggacggtgatggacatcatatcccggcgcgaccagcggggctctggccaggtggggacctacggactgaacacgttcaccaacatggaggctcaactcattcgccagatggagggggagggaatattcaagtccatccagcaccttacggccaccgaggagatcgccgtccagaactggctggctcgcgtggggcgggaacggttaagccggatggccatttccggcgacgactgcgtggtcaagcccatcgacgaccgcttcgccagcgccctgaccgcccttaacgacatgggaaaggtacggaaggatatccaacagtgggaaccctcgcgaggctggaacgattggacacaggtgccgttctgcagccatcacttccacgagctcgtcatgaaggacggcagagtgctggtagttccctgccgaaaccaagacgagctaatcgggcgggcgcggatctcccagggcgcggggtggagcctcaaagagaccgcctgccttggcaagtcctacgcccagatgtggacgctaatgtacttccaccggcgtgaccttcggctggccgcgaacgcgatctgcagcgccgtcccctcccactgggtgccaacctcccgcaccacctggtccattcacgccaagcacgagtggatgacgaccgaggatatgctggcggtctggaaccgggtgtggatccaggagaacccgtggatggaggacaagacgcccgttgagagctgggaggaggtcccctatctcgggaaacgcgaggaccagtggtgcggctccttgatcggcctaacctcacgggccacgtgggccaagaacatccagaccgccattaaccaggtgcgcagcctcatcgggaacgaggagtacaccgactacatgccctccatgaagcggtttcgccgcgaagaggaggaggccggcgtgctctggtaa

SEQ ID NO: 25043 - RNA, 9876 nt, synthetic construct
  misc_feature 1..9876: note = derived and/or modified CDS sequence (opt11) from DENV-2__FJ744707__SS-prME
  source 1..9876: mol_type = other RNA
acagcgggcgtgatcgtcatgctgatccctacggccatggcattccacctcaccacgcgcaacggggagccccacatgatagtgggccggcaggagaagggaaagtctctcctgttcaagaccgaggacggcgtgaacatgtgcaccctcatggccatcgacctgggggagctctgcgaggacacgatcacctacaagtgccctctcctgcggcagaacgaacccgaggatatcgactgctggtgcaacagcacctcaacctgggtaacctatggtacttgtaccacaacgggagagcaccgtcgcgagaagcggagcgtggccctggtgccccacgtcgggatgggactcgagacccgcactgagacctggatgagcagtgagggagcctggaaacacgtacagcggatcgagacatggatcctgcgccaccctggattcactatcatggccgcgatcctggcctacaccatcgggaccacgcacttccagcgggcactcatctttatcctgctgactgcagtcgcgccgagcatgacaatgcgctgcattggcatcagcaatcgggatttcgtggagggtgttagcggcggctcgtgggtggacatcgttctcgagcacggtagctgcgtgaccacgatggcaaaaaacaaacctactctggacttcgagctgatcaagaccgaggccaaacaacccgccaccctacgcaagtactgtatcgaggccaagctgacaaacacaaccaccgagagccggtgtccgacgcagggcgaacccagcctgaacgaggagcaagacaagcggttcatctgcaagcactccatggttgaccgtgggtgggggaacggatgtgggctgttcggcaagggcggcatcgtgacatgcgcgatgttcacgtgcaagaagaacatggagggcaaggttgttcaacccgagaacctcgagtacacaatagtcatcacgccccatagcggggaggagcacgcagtgggcaacgacaccggtaaacacggcaaggagatcaagatcaccccgcagtcaagcatcaccgaggccgagcttacggggtacggaacggttaccatggagtgcagcccacggacaggactcgatttcaacgagatggtcctgctgcaaatggaggacaaggcctggctcgtccaccggcagtggttccttgacttgcccctcccctggttgccgggcgccgatacccagggcagcaattggatccagaaggagaccctggtgaccttcaagaacccccatgcgaagaagcaggacgtcgtggttctcggctcccaggagggcgcaatgcacaccgcgctgacgggcgccacggagatccagatgagcagcgggaacttattattcacggggcacctgaagtgccgtttacggatggataagctacagctaaagggcatgtcctatagtatgtgcacaggtaagttcaagatcgtcaaagagatcgccgagacccaacacggcacgatcgtgattcgcgtgcaatacgagggcgacggctccccctgtaagatcccctttgagatcaccgacctggagaagcgccacgtgctcgggcgcttaattaccgttaacccgattgtcaccgaaaaggacagccccgtgaacattgaggccgaaccgcccttcggggattcctacattataatcggcgtggagccgggacaactgaagctcaactggttcaagaagggctcctccatcggccaaatgttcgagacgaccatgcgcggcgccaagcggatggccatcctaggggacaccgcctgggacttcggaagtctcgggggtgtgttcacgtcaatcggcaaggccctccaccaggtgttcggcgcgatctatggcgcagctttcagcggagtgagttggacaatgaagattctgatcggcgtcatcataacctggattggcatgaacagtcgctccaccagcctttccgtgagcctggtgttagtaggcgttgtaaccttgtacttaggagccgtcgttcaagcggattcgggttgcgtggtgtcatggaaaaacaaagagctcaaatgtggcagcggcatcttcatcacggataatgtgcacacctggaccgaacaatataagttccagccggagtcccccagcaagctggcgtccgccatccagaaggcccacgaagagggcatctgcgggataaggagcgtgacccgactggaaaacctcatgtggaagcaaatcacacccgagctgaaccatatcctgtccgagaacgaggtaaagctcaccatcatgaccggagacattaagggcattatgcaggccggtaagcggagccttcgcccgcagcccaccgagctgaagtactcctggaagacgtggggcaaagccaagatgctctccaccgagtctcacaatcagacattcctgatcgacgggcccgaaaccgccgagtgcccgaacaccaaccgggcctggaacagcctggaggtggaggactacggctttggggtgttcaccaccaatatctggctcaagctccgcgagaagcaggacgtcttctgcgacagcaaattgatgtcagccgccattaaagacaaccgagcagtacacgcggacatggggtactggatcgagtccgccttaaacgacacctggaaaatggagaaggctagcttcatagaggtgaaatcctgccactggccaaagagccacaccctgtggtccaatggcgtgctggagagcgaaatgatcatccccaaaaactttgcggggcccgtgtcccaacacaactataggccgggctaccacacacagactgcgggcccatggcatctcggtaagctggaaatggacttcgacttctgcgaagggaccaccgtagttgtaaccgaggactgcggaaaccggggccccagcctgcgaaccaccaccgcctcagggaagctcattacggagtggtgctgtcggagttgcacattacccccgctgcgctacaggggtgaagatgggtgctggtacggcatggagatacgccccctcaaggagaaggaggagaacctggtgaactcactcgttaccgccgggcacggtcaaatcgacaacttctccctcggcgtactgggcatggccttgttcttagaggagatgttacggacccggatcggtacgaagcatgcgatcctgctcgtggctgtcagcttcgtgaccctgatcaccgggaacatgtcgttccgggacttaggtcgcgtgatggtcatggtgggggccaccatgacggacgatatcgggatgggtgtgacctacctcgctctgctggcagcgtttaaggtacgccccaccttcgccgccgggctcctgctgcggaagctgacctcgaaagagctgatgatggccacaatcggcatcgcactgctctcacagagcactatacctgagaccattctggagctgacagatgcgctcgccctggggatgatggtgctgaagatcgtgcgaaacatggaaaagtaccaactggccgtcaccattatggccatttcctgcgtgccgaacgctgtgatcctgcagaacgcatggaaagtcagctgcaccatacttgccgccgtgtctgtctctccgctcctgctgacctcgagccagcagaaggcggactggattcctcttgcgctgaccatcaaaggtctgaaccccacggcgatcttcttaaccaccctgagccggacctcgaaaaagcgctcctggccgctaaacgaggcgatcatggccgtgggtatggtgagcatccttgcttccagcttactgaagaacgacatccccatgacgggcccactggtcgccggcgggttgctgaccgtctgttacgtactaaccggacggagcgccgaccttgagctggagcgcgcggccgacgtcaagtgggaggaccaggcagagatatcaggatcttcccccatcctcagcatcaccatttcagaagacgggagcatgtctatcaagaacgaggaggaggagcagactctgaccattctgatacggaccgggttgcttgtgataagcggcgtgtttccggtatccatcccaataacggcggccgcgtggtacctgtgggaggttaagaaacagcgcgcaggggtgctctgggatgtgcccagcccgccgccagtggagaaagccgagctggaggacggtgcgtaccggatcaaacagcgtggcatcctagggtacagccagatcggagccggggtttacaaagaaggtacctttcataccatgtggcatgttaccagaggcgccgtgctcatgcatcgcgggaagcggatcgagccctcgtgggccgacgtgaagaaggacctgatttcctatggggggggttggaagctggagggtgagtggaaggagggtgaggaggtacaggtgctcgccctggagcccggtaagaacccccgtgcggtgcagactaaaccgggaatatttaagacaaacacaggcacaattggtgccgtcagtctagatttttcgcccgggacctcaggctctcccattgttgatcggaaggggaaggtggtgggcctctacgggaacggagtggtgaccaggagcggcgcatacgtctccgccatcgcgcagacggagaaatcaatcgaagataaccccgaaattgaggacgacatcttccggaagaagcgcctgacgatcatggacctgcatcctggagccggcaagaccaagcggtacctcccggcaatagtgcgcgaggccataaagcggggactgcgcaccctgatcctggctcccacccgggtggtggcggcggaaatggaggaggcgttgcggggcctgcctatccgctaccagacccccgccatcaagaccgagcacaccgggcgagagatcgtggatctgatgtgccacgccacgttcacaatgcgcctcctgagccctgttcgggtaccgaactacaatctaatcatcatggacgaagcccacttcaccgaccctgcatccatcgccgctaggggctatatctcgacgcgcgtggaaatgggcgaggccgcggggatctttatgaccgccacgccgcccggtagcagggacccattcccgcaatccaacgcgcccatcatggacgaagagagggagatacccgagcgctcctggaactcaggccatgagtgggtgaccgacttcaagggcaagaccgtctggttcgtgccgtctatcaaggctgggaacgacatcgcggcctgcctgcggaagaacggtaagaaagtgatccagctcagccgcaagactttcgactccgagtacgtcaagaccagggccaacgactgggacttcgtggtgaccaccgatataagcgagatgggcgccaactttaaggccgagcgcgtcatcgacccccggcgatgcatgaagcccgtgatcctgacagacggtgaagaacgcgtgatcctcgcaggtcctatgccggtaacccactccagcgccgcccagcgccgtgggcgcataggccgcaaccccaagaacgagaacgaccagtacatctacatgggggagcctctggagaacgacgaggactgcgcccactggaaggaggcgaagatgctgctcgacaacattaacacccccgagggcatcatcccgtcgatgttcgaacccgagcgggagaaggtggacgcgattgacggcgagtaccgcctacgaggtgaagcccgcaagaccttcgtggacctgatgcggcgcggcgatctccccgtttggctggcctacaaagtggccgcggagggtatcaactacgcggacaggaagtggtgtttcgacggcataaagaacaaccaaatcctagaggagaacatggaggtggagatctggacgaaggagggggagcgcaagaaactcaaaccgagatggttagacgcccgtatatacagtgaccccctggcactcaaggaatttaaggagttcgcagccgggcggaagtccctgaccctgaatctcatcaccgagatgggtcggctccccaccttcatgacgcagaaggcacggaatgccctggacaaccttgccgtcttgcacacagcagaggccggcggccgcgcctacaaccacgccctgagcgagttgcccgagactctcgaaacactgctcctgttaactctcctggccaccgtgacagggggcatctttttattcctcatgagcggcaagggcatcggcaagatgacccttgggatgtgctgtatcatcaccgccagcattctgctctggtatgcgcagatacagccgcattggattgccgcctcaatcatcctggagttcttcctgatcgtgctcctgatccccgagccagagaagcaacggaccccacaggacaaccaacttacctacgtggtgatagcgatcctaaccgtcgtggccgcgaccatggcaaacgagatgggcttcctggagaagacgaaaaaggacctcgggctcggcagcatcacaacacaggaaagcgagtccaacatcctcgatatcgacctgcgccctgcttcggcttggaccttgtatgccgtggcgacgacgttcgtcacccccatgctgcggcactccatcgagaacagctccgtgaacgtgtcgctgactgccattgccaaccaggccacggtccttatgggcctggggaagggctggccgctgtcaaagatggacatcggggtgcccctcctagcgatcggctgctactctcaggtaaacccgatcaccctgaccgccgccctgctgctgctcgtcgctcattacgccatcatagggccgggcctgcaggcaaaggctactcgcgaggctcaaaagcgggccgcagcgggcataatgaaaaaccccacggtggatgggatcaccgtgatcgacctggaacccatcccgtacgacccaaagttcgagaagcagctcggccaggtcatgctgctgatcctctgcgtgacccaggtgctgatgatgcgcaccacctgggccctatgcgaggccctcacactggccacagggcccatcagtacgctgtgggagggaaatcctgggcgtttctggaacacgacaatcgccgtaagcatggcgaacattttcagaggttcctacctggccggcgccgggctgctgttctcgatcatgaagaatacaacctccacgaggcggggtaccgggaacatcggcgagaccctcggcgaaaagtggaagagccgcttaaacgccctgggtaaaagcgaatttcagatctacaagaaatccggcatccaggaggtagaccgtacgctagcgaaggaaggtatcaaacgtggtgagacggatcaccatgccgtgtcccgggggagcgcaaagctgcgctggttcgtcgagcggaacatggtgaccccggagggcaaggtcgtcgacctgggctgcgggcgcggcgggtggagttactactgcggcggactcaagaatgtgagggaggtcaagggcctgacgaagggcgggcccggccacgaggagcccatcccaatgagcacgtacgggtggaatctggtccgcctccagtcgggcgtggacgtattctttactccgcccgagaagtgcgacactctgctttgcgacataggtgagtcctcacccaaccccaccatcgaagccggccggaccctccgcgtgctgaacttagttgagaattggcttaacaataacacgcagttctgtatcaaggtactcaatccgtatatgccgtccgtaatcgagaagatggaggccttacagcggcaatacggcggagcgcttgtccgcaaccccttgagccggaactccacccacgagatgtactgggtgagcaacgcgaccggcaacatagtctccagcgtcaacatgatttcccgcatgctgatcaaccggttcacgatgaagcacaagaaggctacctacgaaccggacgtggacttaggtagcgggacgcgcaatatcggaatcgagtccgagatcccgaacctcgacattatcggcaaacggatagaaaagatcaagcaggagcacgagattagctggcactacgaccaggaccacccctataagacctgggcctatcacggatcctacgagaccaagcagaccgggagcgcatccagcatggtcaatggcgtggtgaggctgttgacaaaaccctgggacgtcgtaccgatggtgacgcagatggcgatgacggacaccacgccgttcgggcagcagcgtgtcttcaaagagaaagtagacacacggacgcaggagcccaaggaaggtactaagaaactaatgaaaataacggccgagtggctctggaaagagctgggcaagaagaagacgcctcgcatgtgcacccgtgaggaattcaccaagaaggtgcgctcaaacgccgccctcggtgccatctttacggatgagaacaagtggaagtcggcgcgggaggcggtcgaggacgggcgcttctgggagctggtagaccgggaacgaaacctgcacttggaggggaagtgcgagacctgcgtatacaatatgatgggcaagcgggagaagaagctgggtgagttcggcaaggccaagggctcgagggctatctggtacatgtggctcggggcccgtttcctcgaattcgaggcactgggcttcctgaacgaggatcattggttcagcaggggaaacagcctctccggagtcgagggggagggcctgcatcggctggggtacattctgcgggacgtaggtaagaaggaaggcggggccatgtacgccgacgacaccgccggctgggacaccagaatcacgctggaggacctcaaaaacgaagaaatggtcaccaaccacatgaagggggagcacaagaagctcgcggaggccatcttcaaactgacctatcagaacaaggtagtgcgcgttcagcggccgaccccacgcggaacggtaatggacatcatcagcagacgcgatcaaagaggctcaggccaggtcggcacctacgggcttaatacctttaccaatatggaggcccagctcatcaggcagatggagggcgagggcatcttcaagagcatccagcacctgacggcgaccgaggaaatcgcggtgcaaaactggcttgcccgcgtagggagggagcgtctatccagaatggccatttccggcgacgactgcgtagtgaagccgatcgacgaccgcttcgcctctgccctgaccgccctaaacgacatgggcaaagttcgaaaagacatccagcaatgggagcccagccgcggctggaatgactggacccaagtgccgttctgctctcaccactttcacgagctcgtcatgaaggatgggagagtgctagtggcgccgtgccgcaatcaggacgagctaatcggccgggccagaatcagtcagggtgccgggtggtccctcaaggagacggcctgcctgggcaagagctatgcccagatgtggaccctaatgtacttccaccggcgggacctccggctggctgcgaacgccatctgctcagccgtgcccagccactgggtacccacgtcccgcacaacatggagcatccacgctaagcatgagtggatgacgaccgaggatatgcttgccgtgtggaaccgggtctggatccaggagaatccgtggatggaagataaaacacccgttgaatcgtgggaggaagtaccgtaccttggaaaacgcgaggaccagtggtgcgggagcctgatcggcctgacctcgcgggccacgtgggcaaagaacattcagacggcgattaaccaggtacgatccttgatcgggaacgaggagtacaccgattacatgccgtctatgaaacggttcaggcgagaggaggaagaggcgggcgtgctgtggtaa

SEQ ID NO: 25044 - RNA, 9876 nt, synthetic construct
  misc_feature 1..9876: note = derived and/or modified CDS sequence (opt11) from DENV-2__FJ744704__SS-prME
  source 1..9876: mol_type = other RNA
actgcaggcgtgatcgtcatgctcattcccaccgccatggcgttccatctcaccacccgcaacggggagccccacatgatcgtcggcaggcaggagaaagggaagtcgctgctgttcaagaccgaggacggcgtgaatatgtgtacactcatggccatcgatctgggggagttgtgtgaggataccatcacctacaaatgccccctcctgcggcagaacgagcccgaggacattgactgctggtgcaacagtaccagcacctgggtgacatacgggacctgcaccaccaccggcgagcatcgtcgtgagaagcgaagcgttgccttggtgccacatgtggggatgggcctggagacccgtactgagacctggatgagctcagaaggtgcctggaagcatgtgcagcggatcgagacgtggatactgcgccacccgggcttcaccatcatggcggcgattttagcttacacaatcgggaccacgcacttccagcgggctcttatctttatactgctgaccgccgtagccccaagcatgaccatgcgatgcatcgggatctccaaccgggacttcgtcgagggcgtgagcgggggctcctgggtggacatcgtcctcgagcacggaagctgcgtgaccacgatggccaagaacaagcccactctggacttcgagctgatcaagaccgaggccaagcagcccgccaccctccgcaagtactgtattgaggctaagctcacgaacaccaccactgagtcccggtgccctacgcagggcgagcccagcctgaacgaggaacaggacaagcgcttcatctgcaagcattccatggtcgacagaggctgggggaacggctgcggcctgttcggcaagggcggtatcgtgacttgcgcaatgttcacgtgcaagaagaacatggagggcaaggtagtgcagcccgagaatctggagtacaccattgtcatcacgccccacagcggggaggagcatgccgtgggcaatgacaccgggaagcacgggaaagagatcaagattaccccgcagagtagcatcaccgaggcagagctaactggttacggtacggtgaccatggagtgcagcccccgcaccggcctcgacttcaacgaaatggtcttactgcagatggaggacaaagcgtggctcgtgcaccggcagtggttcctcgacctgcccttgccctggcttcccggcgccgacacccagggttcaaactggatccagaaggagactctggtgacgttcaagaacccccatgcgaagaagcaagatgtcgtggtcctcggctcccaggagggcgccatgcacaccgccctgacaggggcaacggagatccagatgtccagcggcaatctactgttcaccggccatctgaagtgtcgcttacggatggataagctccaactgaagggcatgtcctactctatgtgtaccggcaagttcaagatcgttaaagaaatagccgagacccagcacggaaccatcgtgatccgcgtccaatacgagggagacgggagtccatgtaagatccccttcgagatcacggacctggaaaagcggcacgtactcgggcgcctgatcaccgtgaacccgatcgtgaccgaaaaggacagccccgtcaacatagaagcggagccgcccttcggcgactcctacatcatcatcggggtggagccgggccagctgaagctgaactggttcaagaaggggagctccatcggccagatgttcgaaactaccatgcgcggggccaaacgcatggccatcctgggagataccgcctgggatttcgggagcctcggaggggtcttcacgtcaatcgggaaggccctacatcaggtcttcggggcgatctacggtgccgccttcagcggggtgtcctggacgatgaagatcctgatcggcgtgatcatcacatggataggcatgaacagccgctccacctccctgtccgtgagcctggtgctcgtaggcgtggtgaccctgtacctaggggccatggtccaggccgactccggctgcgttgtgagctggaaaaacaaggagctgaagtgcggatcgggcatctttatcacggacaacgtgcacacctggacggagcagtacaagttccagcccgaaagcccctccaagctggcctccgccattcaaaaggcccacgaggagggcatttgcgggatccggtcagtgactcgcctggagaacctcatgtggaagcagattacgcccgaactgaaccacattctgtccgagaacgaggtgaaactcacaatcatgaccggtgacatccggggcatcatgcaggccggcaagcgcagcctgcgtccgcagcccaccgagctgaagtattcctggaagacgtggggtaaggcgaaaatgctgtcgacggagtctcacaaccagaccttcctgatagacggaccggaaaccgccgagtgccccaacaccaaccgcgcctggaatagcctggaggtagaggactacggcttcggtgtgttcacgactaacatctggcttaagctgcgggagaagcaggacgtcttctgcgactccaaactcatgtccgcggccataaaggacaatcgcgcggtccatgccgacatgggctactggattgagtccgccctcaacgacacctggaagatggaaaaggccagcttcattgaggtgaagtcgtgccactggcccaagagccacaccctctggtccaacggcgtgctggagagcgaaatgatcatccccaagaacttcgctgggcccgtctctcaacacaattaccggcccgggtaccacacgcagacagcgggaccttggcatctcggcaaactggagatggacttcgacctatgtgaggggaccaccgtggtggtcacggaggactgcgggaaccgcggaccctctctccggactaccacggcttctggaaagctaattaccgagtggtgctgccgcagttgcaccctcccaccgctccggtaccgcggcgaagacgggtgctggtacggtatggagatccggcctctgaaggagaaagaggagaacctggtgaacagcttagttaccgctgggcacggccagatcgacaacttctcacttggcgttctgggcatggcactcttcctggaggaaatgctgaggacccggatcgggacaaagcacgctatcctgctggtggctgtatcattcgtgaccctcatcacagggaacatgtcatttcgagacctcggccgcgtgatggtaatggtcggggcgaccatgacggatgacatcggcatgggcgtgacctatttggcgctgttagccgccttcaaggtccggccgaccttcgccgctgggctactgctccgcaagctgacctcgaaagagcttatgatggccacgatcgggatcgcgctactgtcccaaagtaccatacccgaaaccatcctggagctcaccgatgcattggccctggggatgatggtcctcaaaatcgtgcggaacatggagaagtaccagttagcggtaacgatcatggcgatctcctgcgtaccgaacgccgtgatcttgcagaacgcgtggaaggtgagctgtaccatcctcgccgccgtctccgtgagccccctgctgttaacctcaagccagcagaaggccgactggatccccctggcgttgaccatcaagggcctcaaccccaccgcaatattccttaccaccctgagtcgcactagcaagaagcgctcctggccgctcaacgaggccatcatggctgtgggcatggtgtccatcctggcatccagcctcttaaagaacgacatcccaatgacggggcccctggtggcaggagggctcctcaccgtctgctacgtgctgacaggccgatccgcggacttggaacttgagcgggccgccgacgtgaagtgggaggaccaggcagagatcagtgggagttcccccattctgagcattaccatctccgaggacggctcgatgtccatcaagaacgaggaagaggaacaaactctgaccatccttatacgcaccggcctcctggtcatatcaggggtgttcccggtgtccatcccaatcacagcggccgcctggtatctctgggaagtcaagaagcaacgggccggcgtgctgtgggacgtgcccagccctcctcccgtggagaaggccgagctggaggacggggcataccgcatcaagcagaggggcatcctcggttactcccaaataggcgccggcgtatacaaagaggggacgttccacacgatgtggcacgtgactcgcggcgccgtgctgatgcaccgggggaagcgcatcgaacccagctgggccgacgtgaagaaggacttgatctcttacggtgggggctggaaacttgagggcgagtggaaggagggggaggaggtgcaggtcctggccctggagcccgggaagaatccaagagcggtccaaaccaagcccgggatgtttaagaccaacacaggcacgattggggccgtgagcttggacttctctccaggcaccagtggctctcccatcgtcgaccgcaagggtaaggtggtggggttgtacgggaatggcgttgtcacgcggtcaggcgcatacgtgtcggccatagcgcagactgagaagtcaatcgaagacaaccccgagattgaggatgacatcttccggaaaaagcgtctgaccataatggacctccatcctggggctggaaagaccaagcgctatctgcccgccatagtgcgggaggccatcaagcggggtctgcgcactctgatcctcgcaccgacgcgggtcgtagcagccgaaatggaggaggcgctgcgcgggcttcccatacggtaccagacccccgccatcaagacagagcacaccgggcgcgagatcgtcgacctaatgtgccacgccaccttcaccatgagactgctgagccccgttcgcgtgcctaactacaacctcattatcatggacgaggcgcactttactgaccccgcctccatcgccgcccggggctacatcagcacccgcgtagagatgggcgaggccgcggggatcttcatgacggcgacaccgccgggctcccgggacccattcccccagagcaacgcacccatcatggacgaggagcgcgagatccctgagaggtcctggaactcggggcatgagtgggtgaccgactttaagggcaagaccgtgtggttcgtcccttccatcaaggccggcaatgacatcgccgcctgtctgcggaaaaacggcaagaaggtgattcagctctcccggaagactttcgactccgaatacgtgaagacacgcgccaacgactgggatttcgtcgtgactaccgacatcagcgagatgggcgctaatttcaaggccgagcgggtgatcgatcccagacggtgcatgaagcctgttatcctcacggatggggaggagcgggtgatcctggcgggccccatgccggtgacccattcgagcgccgcccagcgacgcgggcgcataggccggaatcccaagaatgagaacgaccagtacatttacatgggggaacccctggagaacgatgaggactgcgcgcactggaaggaggctaagatgctcctggacaatatcaacacccccgagggcatcatcccgtccatgttcgaacccgagcgtgagaaggtagacgcgatagacggcgagtaccggctgcgaggggaagctcgaaagactttcgtggaccttatgcgccggggtgacctgcccgtgtggctcgcctacaaggtcgcagcagaggggatcaactacgcggaccgcaaatggtgctttgacggcatcaagaacaaccagatcctcgaagagaacatggaagtagagatttggaccaaggagggcgaacggaaaaagctgaagccgagatggctggatgcccggatctactccgaccctctcgcgctgaaggagttcaaggagttcgccgcgggtcgcaaatccctgacgctcaacttgatcaccgaaatgggtcggctgccaaccttcatgacgcagaaggcccgcaacgccctcgacaacctggccgtgctgcacaccgcggaggccggcggccgggcctacaaccacgccctatcagaactgcccgagaccctggagaccctactgctgctaactctgctggcgaccgtcaccggcggaatcttcctcttcctgatgagtggcaaggggatagggaagatgaccctggggatgtgctgcatcatcaccgccagcatcctcctgtggtacgcgcagatccaaccgcactggatcgccgccagcatcatcctggagttcttcctcatcgtgctcctgatccccgaacccgagaagcagcgaacgccccaggacaaccagctcacctacgttgtcatcgcaatcctgaccgtggtcgccgcgaccatggccaacgagatgggattcctggagaagacaaagaaagacctcggtctgggcagcattaccactcaggaaagcgagagcaacatcctggacatcgatctccggcctgccagcgcctggactctgtacgccgttgccacgaccttcgtgacccccatgctgcgtcatagcatcgaaaattcttcggtcaacgtaagccttaccgcgatcgcaaaccaagcaacggtgcttatgggcctggggaagggatggccactctcgaagatggacattggggtccccctgctggcgatcggctgctatagccaggtaaacccgataaccctcaccgccgcgctgctgctcctggtcgctcactacgccatcattgggcccggcctgcaagcgaaggccacccgggaggcccagaagcgcgccgcagctggcatcatgaagaaccccacggtggacgggatcaccgtcatcgatcttgagcccatcccgtacgaccccaagttcgagaagcagcttggccaggtgatgctgctcatactgtgcgtcacccaagtgctcatgatgcggaccacgtgggccctctgcgaggctcttactctggccaccgggcccatctccaccctctgggagggcaatcccgggcgcttctggaacacgaccatcgccgtaagcatggcgaacatcttccgcggatcctatctggcgggcgccgggttgctgttctcaattatgaagaacaccaccaacacgcggcgtggcacggggaacatcggcgaaaccctgggcgagaagtggaaaagtcggctgaatgccctcggcaagagcgagtttcaaatctataagaagtccggcatccaggaagtcgaccgcaccctggcgaaggaggggatcaaacggggcgagacggaccaccacgccgtgagcagagggagtgccaagttgcggtggttcgtggagcgcaacatggtcaccccagagggcaaggtggtggacctcggctgcgggcggggcgggtggagctactactgcggcgggcttaagaacgtccgcgaagttaaaggcctgacgaagggcggacccggtcatgaggagcccatccccatgtccacctacgggtggaacctagtgcgcctgcagtctggcgtcgatgtattcttcacaccgcccgagaagtgtgacaccttactatgcgacattggggagagttcccctaacccaactatcgaggccggccgcaccctgcgggtgctaaatctcgtcgagaactggctgaacaacaacacgcagttctgcatcaaggtgctgaacccgtacatgcccagcgtgatcgagaagatggaagccctccaacgcaagtacggtggagcgctcgtccggaaccccctgtcccgcaactcgacgcatgagatgtattgggtgtccaacgcgaccggcaacatcgtgagctccgtcaacatgatctcccggatgctgataaacaggttcaccatgaagcacaagaaagccacctacgagcctgatgttgacctcggctccggcacgcggaacatcgggatcgagagcgagataccgaatctggacatcatcggcaaacgcatcgagaagataaagcaggagcacgagacatcctggcactacgaccaagatcacccgtacaagacctgggcctatcacgggagctacgagaccaaacagacggggtccgcaagttccatggttaatggtgtagtgcgcctgctcaccaaaccctgggacgtggtcccgatggtgacccagatggcgatgaccgacacgacccccttcgggcagcagcgggtgttcaaggagaaggtggacacccgaacccaggagcccaaagagggcaccaagaagttaatgaaaatcacagccgagtggctgtggaaggaacttgggaagaagaagacgcctcggatctgtacccgcgaggagttcactcggaaggttcgctctaacgccgcgctgggcgccatcttcactgacgagaacaagtggaagtccgcgcgggaggcggtggaagacgggagattttgggagctggttgaccgggagcgcaacctccacctggaggggaagtgcgagacctgcgtgtacaacatgatgggcaagcgggagaagaagctgggagagtttggcaaggccaagggcagtagagcaatctggtacatgtggttgggagctcggttcttagagttcgaagccctgggcttcctcaacgaggaccactggttctcgcgggagaacagcctgagcggggtggagggagaggggctgcaccggctcggctatattctgagagacgtaggcaagaaggagggcggagccatgtatgccgacgataccgccgggtgggatacgaggatcaccctggaggacctgaagaacgaggagatggtgaccaaccacatgaaaggcgagcacaagaagttagcggaggccatcttcaaactgacctatcagaacaaggtcgtgcgcgtgcagcggccgacaccccgcgggacggtcatggacatcataagccggcgggaccagcgcggcagcggccaggtggggacctacggcctcaacacattcacaaacatggaggcccagctgatccgtcaaatggagggagagggcatcttcaagtccatccagcacctgacagccaccgaggaaatcgccgtgcaaaattggctcgcccgcgtaggccgggaacgcctgtcgcgtatggcaatctccggggacgactgcgtggtgaagcccatcgacgaccgcttcgccagcgcccttacagccctcaacgacatgggcaaggtccggaaggacatccaacagtgggaacccagccgcgggtggaacgactggactcaggtcccgttctgctcccaccacttccacgaactggtgatgaaggatggccgggtcctggtggtcccctgcagaaatcaggatgagctcatagggcgggcgcgcatctcccagggcgccggatggagcctgaaggagaccgcctgcctgggaaagagctacgcccagatgtggacactaatgtactttcatcggcgggacttgcggctcgctgccaatgccatctgtagcgccgtgccgccccactgggtgccgacctcacgtacaacgtggagcatccatgccaagcacgagtggatgaccacagaggacatgctcgctgtatggaaccgggtttggattcaagagaacccgtggatggaggataagacgcccgtagagtcctgggaggaagtgccctatctgggaaagagggaggaccagtggtgcggcagccttatcggtctcacgtcccgggcgacctgggccaagaacatccagaccgcaatcaaccaggtccgcagcctgattgggaatgaagaatacaccgactacatgcctagcatgaaacgcttccggcgcgaggaggaggaggccggggtgctgtggtga

SEQ ID NO: 25045 - RNA, 9876 nt, synthetic construct
  misc_feature 1..9876: note = derived and/or modified CDS sequence (opt11) from DENV-2__FJ744745__SS-prME
  source 1..9876: mol_type = other RNA
accgcgggggtcatcgtcatgctgatccccaccgccatggccttccatctcaccacgcgcaacggtgagccccatatgattgtgggccggcaggagaaggggaagagtctgctgttcaaaaccgaggacggcgtcaatatgtgtacccttatggctatcgatctgggggaattatgcgaggacaccatcacctacaagtgccccctcctgagacaaaatgagcccgaggatatcgactgttggtgcaatagtacctcaacttgggttacctacggtacctgtaccaccactggcgagcaccgaagagagaagcggtccgtggccctggtgccccacgttgggatgggactcgagacccgcaccgagacctggatgagcagcgagggggcatggaaacacgtccagcggatcgaaacctggatactgcgccatccgggctttaccatcatggccgccatcctcgcatacaccatagggactacccactttcagagagccctcatcttcatcctgctgacggccgtagcgcccagtatgaccatgcggtgtattggcatctccaacagggactttgtcgagggcgtgagcggcgggtcctgggtcgacatcgtcctcgagcatggcagctgcgtaaccacgatggccaagaacaaacccaccctggacttcgagctgatcaaaaccgaagccaagcagccggccaccctccgcaagtactgcatcgaggccaagctgacaaacactaccacagagtctcggtgccccactcagggagaacccagcctaaacgaggagcaggataagcgcttcatttgcaagcactccatggtggaccggggctggggaaacggatgtggcctgtttggcaagggagggatagtcacctgcgctatgttcacgtgcaagaagaacatggaaggcaaggttgtgcagccggagaacctggaatacaccatcgtcatcacgccccacagtggtgaagagcatgccgtgggcaacgacaccggtaagcacggtaaggagatcaagatcaccccgcagagttctattacagaagcagaattgacggggtacggcactgtaaccatggagtgcagcccccggaccggcctcgacttcaacgagatggttctgctgcagatggaggataaagcctggctcgtgcaccggcagtggttcctggacttacccttgccctggctgcctggggcagacacccagggcagcaactggatccagaaagagacacttgttacgttcaagaacccgcacgccaaaaagcaggacgtggtggtcctcgggagccaggaaggcgctatgcacaccgccctgaccggcgctactgagattcagatgtccagcggaaaccttctgttcaccgggcatctgaagtgccgcttgaaaatggacaagctccagctcaaggggatgtcttatagcatgtgcaccggcaagtttaagattgtgaaggaaatcgcggagacccagcacgggacgatcgtgatccgggttcagtacgagggtgacggcagcccttgcaagatccccttcgagatcacggacctggaaaagcgacacgtcttggggcggctaatcaccgtgaacccaatcgtgaccgagaaagacagtcccgtgaacatcgaggcggagcctcccttcggcgactcctacattatcattggggtagagccgggacagctgaagttgaactggttcaagaagggtagctccatcggccagatgtttgaaacgaccatgagaggcgcgaagagaatggcaatcttgggggacaccgcctgggacttcggcagcctcggcggtgtcttcacatccatcgggaaggccctgcaccaagtcttcggggcgatctacggcgctgccttcagtggggtgtcctggacaatgaagatcctgatcggggttataattacctggatcgggatgaacagcaggagcacatctctgtctgtgagcctggtgctcgtaggcgtggtgaccctgtacctgggagcaatggtccaggcagactccggctgcgtggttagttggaaaaataaggagctcaagtgcggctctggaatctttatcacggacaacgtccacacctggaccgagcaatacaagttccagcccgagagcccctccaagctggcttccgccatccagaaggcccacgaggagggcatctgcgggatacggagcgtgactcggttggagaacctcatgtggaaacagatcacgccggagttgaaccacatcctctccgagaacgaggtcaagttaaccatcatgaccggcgacatccgagggatcatgcaggccggcaagcgttccttacgcccgcagcctaccgaattgaagtattcctggaagacgtggggcaaagcgaagatgctcagtacggaatcccacaaccaaaccttcctgatcgatgggcccgagaccgccgaatgcccgaacacgaaccgcgcctggaactccttggaggtcgaggactacggcttcggtgtcttcacaaccaacatttggctcaagctccgcgagaagcaggacgtgttttgcgattctaaactgatgagtgccgccatcaaggataaccgggccgtccacgccgacatgggttactggatcgagtccgcactcaatgacacgtggaagatggagaaggcatctttcatcgaggtgaagtcctgccactggcccaagtcacacacactgtggtccaacggggtgctggagagcgagatgatcatccccaagaatttcgctggaccggtcagccaacacaactatcgcccgggctaccacacgcagaccgcggggccttggcaccttggcaagctggagatggacttcgatctttgcgagggtaccaccgtggtcgtcacagaggattgcggcaaccggggcccctctctcagaacgactaccgccagcgggaagctcatcactgagtggtgttgccggtcctgcaccctcccccctctccgctatcggggcgaagacgggtgctggtacgggatggaaatcagaccattaaaagaaaaagaagagaacctggtgaacagcctcgtaaccgcaggccacggccagatcgacaacttctccttaggcgtcctcgggatggccctctttctggaggagatgctgcggacccgtatcgggacgaagcacgcgatcctcctcgtggccgtgagcttcgtaacgctgatcacggggaacatgtccttccgggatctcggccgagtcatggtgatggtcggtgcgaccatgacggacgacatcggcatgggcgttacctatctggcgctactcgccgcatttaaggtgcgacccaccttcgcagccgggctgctactgcggaagctgacgagcaaggagctcatgatggccacgatcggcatagccctcctgtcccagagcacaatccctgagactatcctggagctaaccgacgcgctagccctgggcatgatggtcctcaaaatcgtgcgcaatatggaaaaatatcaactggccgtgacgataatggccatctcctgcgtccctaacgccgtgatcctgcagaatgcgtggaaggtatcatgcactatcctagccgccgtcagcgtcagccccctgctgctaacttccagtcagcagaaggcagattggatccctctggcgctaaccatcaagggactcaatccaaccgccatattcctgaccaccctgtcccggaccagcaaaaaacgctcctggcctttgaatgaggccattatggctgtcggcatggtgagcatcctggcatcctcactgctcaagaacgacatacccatgacagggcccttagtggcgggcgggcttctcaccgtctgctacgttctaaccgggcggtccgcggacctggagctcgagcgcgcagccgacgtgaagtgggaagaccaagccgaaatatcagggtcgtcgcccatcctgtcaatcactatctccgaagacggctccatgtccatcaagaacgaggaggaggagcagacgctgaccatcctcatcaggaccggactgcttgttatcagcggggtgtttcccgtgtccataccgattaccgctgccgcctggtacctatgggaggttaagaaacaaagggccggcgtcctttgggatgtgccgagccccccgcccgtcgaaaaggccgagctggaggacggggcttaccggataaagcaacgcggaatcctcggttattcccagatcggcgctggcgtttataaggaagggacattccacacgatgtggcacgtgacccgaggagctgtactgatgcaccgcgggaagcggatcgagccaagctgggccgacgtgaagaaagatctgatctcatacggcgggggttggaagttggagggcgagtggaaggagggggaggaagtgcaggtactggccctggagcccggcaagaacccccgagcggtgcagaccaagcccgggatctttaaaaccaacacaggcaccatcggggccgtgagcctcgacttcagtccaggcaccagcggctctcccattgtcgacagaaaggggaaagtggtcggcctctatgggaatggagtggtgacccgcagcggagcctacgtttccgccatcgcgcagacggaaaagtctatcgaagacaaccccgagatagaggacgacatattccggaaaaaacgcctgaccatcatggacctccacccaggagccggcaagaccaaacggtaccttcccgcaattgtccgcgaggccatcaagcgtggactgcgcactcttatactagctccgacacgtgtggtggcggcagagatggaggaggccttgaggggcctgccaattagatatcaaacccccgccatcaaaaccgagcataccgggagggagatcgtcgacctcatgtgccacgctaccttcaccatgcgcctgttgagtcctgtccgggtgccgaactacaacttaatcatcatggacgaagctcacttcactgaccccgcctccatcgccgcccgcggctacatatctaccagagtggagatgggcgaggccgcggggattttcatgacagccacgccgcccggcagccgggaccctttccctcagagcaacgcccctatcatggatgaggagcgtgagattccagagcgctcatggaacagtgggcacgaatgggtgactgacttcaaaggtaagaccgtctggtttgtcccatccataaaggccggcaacgacatcgcggcctgcctgcggaagaacggcaagaaggtcatccagctgagccgcaagacgttcgactccgagtatgtaaagacccgggccaacgactgggatttcgttgtgaccaccgacatcagcgagatgggtgccaacttcaaggccgaaagggtgatcgacccccggcgctgtatgaaacccgtcatcctcacggacggggaggagagagtaattctggcgggccccatgcctgtaacacacagtagcgccgcccagcgtcgggggcgcatagggcgcaaccccaagaacgaaaatgaccagtacatctacatgggggagccactggagaatgacgaggactgcgctcactggaaggaggccaagatgttgctggacaacatcaataccccggaagggatcatcccgtcaatgttcgagccagagcgggagaaggtcgacgcaatagacggggagtaccgattgaggggggaggccagaaagactttcgtagacttgatgcggcggggcgacctgcccgtgtggttggcctataaggttgcggccgaggggatcaactacgcagatcggaagtggtgcttcgatggcattaaaaacaatcagatcctcgaggagaacatggaggtggagatctggacgaaagagggggaacgaaagaaactgaagccgcgatggctggacgctcgaatctactcagatcccctcgccctgaaggagttcaaagaattcgctgccgggagaaagagtctgaccctgaacctgatcaccgagatgggccgcctgcccactttcatgacgcagaaggcgcggaatgccctagataacctggcggttttgcacacggcggaggctggggggagggcatacaaccacgctctaagcgagctgcccgagaccctggagaccctcttgctgctaacgctgctagctaccgtcacaggaggaatcttcttgttcctgatgtcaggcaaaggcattggcaagatgaccctagggatgtgctgcatcatcacggccagcaccctcctgtggtatgcacaaatacaaccgcactggatcgccgcctccatcatcctggagttcttcctcatcgtgctgttgatccccgagcccgagaagcagcggacgccccaggacaaccaactcacgtacgtcgtgatcgcgatactgactgtggtagccgccacgatggcaaatgagatgggcttcctcgagaagaccaagaaggacctcggtctggggtcaattaccactcaagaaagcgagtccaatatcctggacatcgacctacgcccggcctcagcctggacgttatacgccgtcgcgacgaccttcgtgacccctatgctgcggcactccatcgaaaactcatctgttaacgtatctctcacggccatagccaatcaggctaccgttttgatgggcttaggcaagggttggcccttatccaagatggacattggagtcccccttttagcgatcggctgctatagccaggttaacccgataaccctcacagccgcgctactgttgctggttgctcactacgcgatcatagggcccggcctgcaagcaaaggccacgagggaagcccagaagcgggccgctgcgggcatcatgaagaacccgaccgtcgacgggatcaccgttatcgatctcgagccaattccgtatgaccccaagttcgagaaacaactcggccaggtgatgctgctcattctgtgcgtcacccaggtactgatgatgcgcacgacctgggcgctctgcgaggctctgaccctggccaccgggcccatctccactttatgggagggcaacccagggcggttctggaacaccaccatagcggtgtcaatggcgaacatcttccgcggctcctacctggccggcgccgggctcctgttcagcatcatgaaaaacacgactaacaccagacggggaacaggaaacatcggcgaaacacttggggagaagtggaagtcccgcctgaacgccctcggaaagagcgaattccagatctacaaaaagtccggcatccaagaagtcgacagaactctggccaaggaagggataaagaggggcgagaccgaccaccacgccgtcagccgtgggtccgccaagctgcgctggttcgtggagcggaacatggtgaccccagagggaaaggtggtcgacttaggctgcgggcgtggcgggtggtcatactactgcggcgggctgaagaacgtccgcgaggtgaagggcctgaccaagggcgggcccggtcatgaggaacccatcccaatgtccacgtatgggtggaacctcgttcggcttcagtcgggcgtggacgtctttttcaccccccccgaaaaatgcgacaccctgctgtgcgacatcggagagagctcccccaatcccaccattgaggccggccggacactgcgcgttctgaacttggtggagaactggctgaacaacaatacgcagttctgcatcaaggttctaaacccgtacatgccctcggtgattgagaagatggaggccctccagcggaagtacggtggtgcgctggtacgcaacccgctgtcccgtaattccactcacgagatgtattgggtgtccaacgcgtcgggcaacatcgtatccagcgtgaatatgatctccaggatgttgatcaaccggttcacgatgaagcacaaaaaggccacctacgagccggacgtggacctcggcagcggcacgagaaacatcgggatcgagtcggagatccccaacctggacataattggcaagcgcatcgagaagatcaagcaggaacacgagaccagctggcactacgaccaagaccacccctacaagacctgggcctatcacggcagttacgaaacaaagcagaccggaagcgcttccagtatggtaaacggtgtcgtgcggctgttaaccaaaccttgggatgtggtcccgatggtgacccaaatggcgatgaccgatacgaccccctttgggcagcagcgcgtgttcaaggagaaggtcgacacccggactcaggagcccaaggagggcacgaagaagttgatgaaaattaccgccgagtggctgtggaaagagctagggaaaaagaagacgccccgtatgtgcaccagagaggaattcacgcgcaaggtgcgttccaacgccgccctgggggccatattcaccgacgaaaacaagtggaagtccgctcgcgaagccgtcgaggactcccggttctgggaattagtcgaccgcgagcgcaacctacacctggagggcaagtgcgaaacttgcgtgtacaacatgatgggtaagagggagaagaagctcggcgagttcgggaaggcgaagggaagtcgggccatctggtacatgtggctcggcgcacgattcctagaattcgaggccctgggatttctcaacgaggaccactggttctcgcgagggaactctctcagcggagttgagggcgaagggctgcaccgcctcggttacatcctgcgcgacgtcggtaaaaaggagggcggcgccatgtacgccgacgacacggcggggtgggatacccgcatcaccctggaggacctcaagaacgaagagatggtaaccaaccacatgaagggcgagcacaagaagctggccgaagccatcttcaagctgacgtaccagaacaaggtcgttcgggttcagcgcccgacgccgcggggtaccgtaatggacatcatttcccgcagggatcagcgcggttcgggacaggtggggacctacggactcaacacattcacgaacatggaagcacagctgatccgccagatggagggggaaggcatcttcaagtccatccaacacctgaccgccaccgaggagatcgcggtacagaattggttggcgcgggtcggcagggagcggcttagccgcatggccatctccggcgatgactgtgttgtgaagccaatcgacgaccggttcgccagcgccctgaccgctctgaacgacatgggtaaagtccggaaggacatccaacagtgggagcccagccggggctggaacgactggacccaggtcccgttctgcagccaccacttccatgagctggtgatgaaggatggacgcgtcctagtggtaccctgccgaaatcaggacgagctaatcgggcgcgctcggatttcccaaggggccggctggagcctgaaggaaacggcctgcctcgggaagagttatgcccaaatgtggacccttatgtattttcaccgcagagacctgcgcctggccgcgaacgccatctgcagcgccgtgccgccgcactgggtgccaacctcccgtaccacgtggagtatccacgctaagcacgaatggatgactacggaagacatgctcgcggtgtggaatcgcgtctggatccaagagaacccctggatggaggacaaaactccggtggagtcctgggaggaggtaccttacctgggcaagcgggaagaccagtggtgcggcagcctgatcggcctcacgagcagggcgacctgggccaagaacatccagaccgccatcaaccaggtcagatcgcttatcgggaatgaggagtacaccgactacatgcctagtatgaagcgcttcagaagagaagaagaggaggccggcgtgctatggtag

SEQ ID NO: 25046 - RNA, 9876 nt, synthetic construct
  misc_feature 1..9876: note = derived and/or modified CDS sequence (opt11) from DENV-2__FJ744705__SS-prME
  source 1..9876: mol_type = other RNA
accgccggagtaatcgtaatgctgatccccaccgccatggccttccatttaaccacacggaatggcgaaccacacatgatcgtgggtcgccaggagaaggggaagtccctgctgtttaagacggaagatggcgtgaacatgtgcaccctcatggccatcgacctgggcgagctgtgtgaggacaccatcacctataagtgccccctcctcaggcagaacgagcccgaggacatcgattgttggtgcaactctactagcacctgggttacgtacggtacctgcacaaccacgggggagcaccggcgcgaaaagcggtcggtagccctggtaccccacgtcggcatgggcctcgaaacccggacggagacctggatgagctcggagggcgcatggaagcacgtgcagcggatcgagacgtggatcctgcgccaccccggttttacaatcatggccgctatcctggcctataccatcggaaccactcacttccaacgggccctcattttcatcctacttacggccgtagcgcccagcatgaccatgcggtgcatcggcatctccaaccgcgacttcgtcgagggcgttagcgggggttcctgggtggacatcgtcttagaacatgggtcatgcgtgaccacgatggccaagaacaagcccaccctggatttcgagctcatcaagaccgaggcaaagcaaccggccaccctccgcaaatactgcatcgaagccaaattaacaaataccacaactgagtcccggtgcccaacacaaggagagccatcactgaacgaggaacaggacaagcggtttatctgtaagcacagcatggtggatcggggctggggaaacggctgcggtttatttggaaagggcgggatcgtgacctgtgctatgttcacatgcaagaagaacatggaaggcaaggtggtgcagcccgaaaacctggagtacaccatcgtcattactccccactcgggagaagaacacgcagtgggcaacgacaccgggaaacacgggaaggagatcaagatcaccccgcagtcctcaatcactgaagcagagctgaccggatacggcacggtgacaatggagtgctctccccgaacaggactggacttcaacgagatggtactgttgcagatggaggacaaggcatggttggtgcaccggcagtggttcctggacctgccccttccatggctacctggggccgatacccaaggcagcaattggatacagaaagagaccctagtgaccttcaaaaacccccatgcgaagaagcaggacgtcgtcgttctcgggtcccaggagggagccatgcacacagcgctgactggcgccacggaaattcagatgagcagcggcaatctcctgttcacaggtcacctaaaatgcaggctgcggatggataaactccagctaaaggggatgagctacagtatgtgtaccggaaagttcaagatcgtgaaggagatcgcagagacacagcacgggactatagtcatccgcgtccagtacgagggggacgatagcccctgcaagatccccttcgagatcacggacttagaaaagcggcacgtgctcggccgactgatcactgtgaacccgatcgtgaccgaaaaggatagcccggtgaacatagaagcagaaccacctttcggggacagctacatcataatcggcgtcgagccggggcagctgaagctaaactggtttaagaaaggcagctccatcggtcaaatgtttgaaacgaccatgcggggcgccaagcggatggccatccttggcgataccgcctgggactttggaagccttggcggcgtctttacttccatcggcaaggccctgcaccaggtgttcggggcgatctacggcgcagccttcagcggcgtatcctggacgatgaagatcctgatcggggtgataatcacctggattggcatgaacagcaggtccaccagcctgagtgtcagcctggtccttgtaggggtggtgacattatacctgggagccatggttcaggcggactctggctgcatcgtatcttggaaaaataaagagctcaagtgcggctccggcattttcatcactgacaatgtccacacgtggaccgaacagtataagttccagcccgagtcacccagcaaactggcctccgccatccagaaagctcacgaggaaggtatctgcggcatacggagcgtcacccgcctagagaacctcatgtggaagcagatcacacccgagctaaaccacatactgtcggagaacgaggtgaaacttaccatcatgaccggggatattcgtgggatcatgcaggccggaaagcgctccttacgaccgcagcccaccgagttgaaatattcctggaagacgtggggcaaggcgaagatgctcagcaccgagtcccacaatcaaacctttcttattgacggcccagagaccgtcgagtgccctaacacgaaccgggcctggaactctcttgaagtcgaggactatggattcggagtgtttaccaccaacatatggctcaagctccgggagaagcaggatgtgttctgcgactccaaactgatgagcgctgccatcaaggacaacagggccgtacacgcggacatggggtactggatcgaaagcgctctgaacgacacctggaagatggagaaggccagcttcatcgaggtgaagtcatgccactggccgaaaagccacaccctatggtctaatggagtgctggagtccgagatgatcatcccaaagaactttgccggccccgtgagccaacacaattaccggcccgggtatcacacacagacagcgggcccgtggcaccttgggaaactggagatggacttcgacctctgtgaaggcacgaccgtagtggtcacggaggactgtggaaaccggggccctagcctccggaccaccaccgcaagcggcaagttgatcacagagtggtgctgtcgctcatgcacgctgcccccgctccgttaccgtggcgaggacgggtgttggtatgggatggagatccggcccctgaaggagaaagaggagaacttagtgaacagcctggtgacggccggccatgggcagatcgacaacttctccttaggcgtcctgggaatggccctcttcctggaggagatgttacgaacccggattgggacgaagcacgccatcttactcgtcgcggtcagcttcgtcaccttgatcaccggcaacatgtccttccgcgatctcggtcgcgtgatggtaatggtaggcgccactatgaccgatgacataggtatgggcgtaacttacctggcactgctggccgcctttaaggtgcgccccaccttcgccgcgggcctgctgctccgcaagctgaccagtaaagagttaatgatggcgaccatcgggatcgcgcttctgtcccagagcacgatccccgaaacaattctggagctcaccgacgcgctggcgctcggcatgatggtcctgaaaatcgttcggaatatggagaagtaccagctggccgtaacgatcatggccatctcctgtgtgccgaacgctgtcatcctgcagaacgcctggaaggtgtcgtgcactatccttgcggccgtatcggtaagccccttgttactcacctccagccagcaaaaggccgattggatacccctggctttaaccatcaaagggcttaaccccacggcgattttcttgactaccctctccaggaccagcaagaagcgatcctggccgcttaacgaggcaattatggccgtggggatggtgagcatcctagcatctagcctgcttaagaatgacatacccatgacgggccccctggtagccgggggtctcctcaccgtctgctacgtcttgaccgggcgcagtgcggacctggagctcgaacgtgccgctgacgtcaaatgggaggatcaggcagagatcagcggatcgagcccgatcctgagtatcacgattagtgaagacggatcaatgtccatcaagaatgaggaagaggagcagacgctgacaatacttatccgcacaggcttgctggtcatcagcggcgtcttcccggtgtctatccccataaccgccgccgcttggtacctctgggaggtaaagaagcagcgggccggagtgctgtgggatgtgccctcaccgccgcccgtggagaaggcggagctggaggatggcgcctaccgcatcaaacagcgggggattttaggctactcccagatcggcgctggcgtatacaaggagggaaccttccacactatgtggcacgtaacccgtggcgccgtattaatgcacaggggcaagcgcattgagcccagctgggccgatgtgaagaaggacctgatctcctatgggggcgggtggaagctagagggagagtggaaggagggcgaagaggtgcaggtcttggccctggagcctggaaagaacccgcgtgccgtgcagaccaaaccaggcatcttcaagaccaacacggggaccataggtgctgtgagcttagacttctctcccggcaccagcggttcccccatagtcgaccgtaaaggcaaggtggtggggctgtacggcaacggggttgttactcggagtggcgcctacgtgagcgccatcgctcagacggagaaaagcattgaggacaacccggaaattgaggacgatatcttcagaaagaaaagactgaccatcatggacttacaccctggtgcggggaagaccaagcgatacttacctgcaatcgtaagggaggccatcaaacgcggcctgagaactcttatcttagcccccactcgcgtggtggccgcggagatggaggaggcgctgagaggactgcccataaggtaccagaccccggcaattaagaccgagcacactggtcgcgaaatcgttgacctcatgtgccacgccacgttcaccatgagattgctgtcgcctgttcgggtgcccaactacaacctcatcatcatggacgaggcccactttaccgatcccgcctctatcgccgcgcgcgggtatatcagcaccagggttgaaatgggcgaagcagctggcatatttatgactgcaacgccgcccgggtcgcgagacccgttcccacaatcaaacgcccccatcatggacgaggagcgggagattcctgagcggtcctggaacagcgggcacgagtgggtcaccgactttaagggcaagaccgtgtggttcgtcccgtccataaaggccggcaacgacatagcagcgtgcctgcgcaagaatggcaagaaggtgatccagctgagccggaaaacgttcgactcggagtacgtgaagacccgagcaaacgactgggactttgtcgtgaccaccgacattagcgagatgggcgccaacttcaaggcggaacgagtgatcgacccacgccggtgtatgaaacctgtcatcctgaccgatggcgaggagcgtgtgatcttagccgggcctatgcccgtgacccactcctcggcagcccagaggaggggccgtatcggccgaaatcccaagaacgaaaatgatcagtacatctacatgggggagcccctggaaaatgacgaggactgcgcccactggaaagaggcgaaaatgctcctggacaacattaacacccccgaggggattataccgtcaatgttcgagcccgaacgcgagaaggtcgacgccatcgacggcgagtatcggctgcgcggggaggcgcggaagacctttgtcgatttaatgcgcagaggggacctgcccgtgtggctggcctacaaggtcgccgccgaaggcatcaattacgccgaccgcaaatggtgttttgacggaattaagaacaaccagatcctcgaggaaaatatggaggtggagatctggaccaaggagggcgagaggaagaagctaaagccaagatggctggacgcgcggatctacagcgaccccctcgccctaaaagagttcaaagagttcgccgccgggaggaagtccctgaccctcaacctgataaccgagatggggcggctgcccaccttcatgacgcaaaaggcgcgcaacgcactcgacaacttggccgtgctccacaccgcggaggccggtgggcgggcgtacaaccacgccctcagcgagctgcccgagacactggagacgctgctgctactcaccctgctggctactgtaaccggcgggatcttcctctttctgatgtccggcaagggtatcggtaagatgaccctaggcatgtgttgcatcataaccgcaagcatccttctgtggtacgctcaaatccagccacattggatcgcggccagcatcatcctagagttcttcctcattgtgcttctaatccccgagcccgagaagcagcgcactccccaagacaaccagcttacctatgtcgttattgccatcctgacggtggtcgccgccaccatggctaacgagatgggcttcctggagaagacgaagaaagacctggggttggggagtatcaccacccaggagtcagagtccaacatcctggacatcgacctcaggccggcgtcggcgtggacattatatgccgtggctacgaccttcgtgacccccatgttacgccattcaattgaaaactcaagtgtgaacgttagccttacggcaatcgcgaaccaggccacggtgctgatgggcttaggcaaagggtggcccctaagcaaaatggacatcggcgtccctctgctcgcgatcggctgctacagtcaggtgaacccgataacgctcacggctgccctgctgctactcgttgcccactacgccatcatcggacctggcctgcaggctaaggctacgcgagaggcacagaagcgtgccgccgcaggcatcatgaagaatcccacggttgatggcattactgtgatagacctcgagcccatcccatacgatccgaaattcgagaaacaactggggcaggtcatgctgttgatcttatgcgtcacacaggtgctcatgatgcggaccacgtgggccctgtgcgaagctctgaccctggcaaccggccccatctccaccctatgggagggcaatcccggcaggttctggaacacgaccatcgccgtcagcatggccaatatcttccgcgggtcctacctcgcgggcgccggcctactcttctcgatcatgaaaaacaccacgaacacgcggagggggaccggcaacatcggtgaaaccttgggcgagaagtggaaatcccggctgaacgccctcggcaagagcgagttccaaatctacaaaaagagtgggatccaggaggtagatcgcaccttggccaaagaggggataaagagaggggagacggaccatcacgcggtgagccgggggtccgccaagttgcggtggttcgtagagcgcaacatggtcacccccgagggcaaggtagtcgatctaggctgcggccgcggcgggtggagctactactgcggcgggctcaagaatgtaagggaggtcaaaggtctgaccaagggcgggcccggccacgaggagcccattcccatgtccacctacggatggaacctcgtgagactgcaatcaggggtcgatgtgttcttcactccgccagagaagtgcgacaccctgctctgcgacatcggcgagagttcaccaaatcccactatcgaggccgggcgcaccctgcgggtgctgaacctcgtcgagaactggctgaacaacaacacccagttctgcatcaaagtgctgaatccgtacatgccgtccgtgatcgagaagatggaggcccttcagcgcaaatacggcggagccctcgtccgaaatcctttaagccgcaacagcacgcacgaaatgtactgggtgtccaacgcgaccgggaacattgtgagctccgttaatatgataagccggatgctgataaatcgcttcaccatgaagcacaagaaggccacttacgagcccgacgtggatctcggctccggtacgcggaacatcggcatcgagtcggagatccccaacttggatatcatcgggaaacgcatcgagaagataaagcaggagcatgagaccagctggcactacgaccaggaccatccctacaagacctgggcttatcatggcagctatgagacgaaacagacgggctccgccagctcgatggttaacggtgtagtccgcctgctcaccaaaccctgggacgtagtcccgatggtgacccagatggccatgaccgacactaccccatttgggcaacagcgggtgttcaaggagaaggtagacacccgtacgcaggaaccgaaggaggggacgaagaaacttatgaaaataactgccgagtggctctggaaggagctcggtaaaaagaagacacctcggatgtgcaccagagaagagttcactcggaaggtacgctcgaacgccgccctgggcgccattttcaccgacgagaataagtggaagtccgcacgggaggccgtggaggacgggcgcttctgggagctggtggaccgggagagaaacctccatctggagggcaagtgcgaaacatgcgtgtacaacatgatgggtaagagggagaagaagctgggcgagttcgggaaggcaaaggggagccgtgccatctggtatatgtggctcggcgcacggttcctggagttcgaggcgctgggattcctcaacgaggaccactggttctcccgcggcaactcactgtcaggggtggagggcgagggtcttcaccgactcgggtacattcttcgggacgtcggcaagaaagagggcggcgccatgtatgccgatgacactgccggatgggacacacggatcactctggaagacttaaagaacgaggaaatggtgaccaatcatatgaagggcgagcacaagaaactggcagaagcgatctttaagctgacgtaccagaacaaagtagttcgagtgcagcggccaacgcctcgtgggaccgttatggacataatctccagacgtgaccaacgcggcagcggtcaggtcgggacctacggactcaataccttcacgaacatggaggcccagctgatccggcaaatggagggggaaggaatcttcaagtctatacagcacttaaccgctaccgaggaaatcgctgtgcagaactggctagcccgtgtcggacgtgagcgcctctcccgtatggcgatctcaggtgacgactgcgtagtgaagccgatagacgaccgtttcgccagcgcccttaccgcactcaacgacatgggcaaggttcggaaagacattcagcagtgggagccttcccgcgggtggaacgactggacccaggtcccgttctgcagccaccacttccacgagctcgtaatgaaagacggcagggtcctggtggttccctgtcgcaaccaagacgagctcatcggccgagcccgcatctcacagggcgcgggttggagcctaaaggagaccgcctgtctggggaagagttacgcacaaatgtggaccctcatgtatttccaccggcgcgacttacggctggcggcgaacgccatctgcagcgccgtcccgccccattgggtgccgaccagtcgcaccacgtggagcattcacgcgaagcacgagtggatgacgacagaggacatgttagccgtgtggaaccgagtctggatccaggagaacccctggatggaggacaagactcccgtggagagctgggaagaggtaccctatctgggcaaacgggaagaccaatggtgcgggagcctgatcggcctcacgtcgcgagcgacctgggccaagaatattcaaacagcaatcaaccaagtccgttccctgatagggaacgaggagtacactgactacatgccgagcatgaagcgcttccgtcgcgaggaagaggaggcaggcgtcctgtggtga

SEQ ID NO: 25047 - RNA, 9876 nt, synthetic construct
  misc_feature 1..9876: note = derived and/or modified CDS sequence (opt11) from DENV-2__FJ744744__SS-prME
  source 1..9876: mol_type = other RNA
accgcaggggtgattgtcatgttaattcccaccgccatggcgttccatttgaccacccgaaacggggaaccccacatgatcgtgggccggcaggaaaaagggaaatcccttctgttcaagaccgaagacggcgtgaacatgtgtacgctcatggccatagacctcggggaactgtgcgaagacaccatcacttacaaatgtcccctcctgcgccaaaacgagcccgaagatatcgactgctggtgcaattcaaccagcacctgggttacatacggaacctgcaccacaactggcgagcaccggcgagagaaacggtctgtggccctggtgccccacgtggggatgggtctcgagacccgcacagaaacctggatgagcagtgaaggggcctggaaacatgtacagcgcatcgagacctggatcctgaggcatccgggcttcaccatcatggccgcgatcctggcctacactatcgggacgacgcacttccagcgggcgctcatttttattctgctcaccgccgtggcgcccagcatgaccatgcgatgcatcggcatcagtaaccgggatttcgtcgagggtgtgagcggcggcagctgggtggacatagtcctcgagcatgggagctgcgtgaccacaatggccaaaaacaagcccaccctggatttcgagctcatcaagaccgaagcgaagcagcccgcaaccctccgcaagtactgtatcgaagcaaagctgactaacaccaccacagagtcccggtgccccactcaaggcgagcccagcttaaacgaagaacaggacaagcgcttcatctgtaagcactcaatggtcgaccgtggctgggggaacggctgcggactgtttggcaagggcgggatcgtgacttgcgcgatgttcacgtgtaagaagaacatggagggcaaggtggtgcagcccgagaacctggagtacaccatcgttatcactccccacagcggggaagaacacgcagtgggcaacgacaccgggaagcacggaaaggagatcaagattaccccacagtccagcattacggaggccgagcttactgggtacggcacggtcactatggagtgcagcccccggaccggcctcgacttcaacgagatggtcctgctgcagatggaggacaaggcctggctcgtgcaccggcagtggttcctggacctcccccttccctggctgccgggtgccgatacccagggtagcaactggatacaaaaggagacgctggtgaccttcaagaatccccacgcgaagaagcaggacgtcgtcgtcctcggatcccaggaaggcgccatgcacaccgccctgacgggggccacagagattcagatgtccagcggcaacctactcttcaccggtcacttgaagtgccgcctgaagatggacaaactccaactgaaggggatgagctacagcatgtgcaccggcaagttcaagattgtaaaggagatcgccgagacccaacacgggacgatcgtaattcgggtccaatacgagggcgatggctccccctgtaagatccccttcgaaatcaccgacctcgagaagcgccacgtactcgggcgactgataaccgtcaatccgatcgtcactgaaaaagacagccccgtgaacattgaggcggaaccgcccttcggagatagctatatcattatcggggtggagcccggccagctgaagctcaactggttcaagaaggggagttccatcggccagatgttcgaaacgaccatgcgcggcgctaagcgcatggccatcctgggggatacagcttgggacttcggtagcctcggcggagtatttacctccatcgggaaggccctccaccaggtgttcggggcgatctacggggccgctttcagcggggtgtcctggacaatgaaaatactgatcggcgtcatcatcacttggattgggatgaactctcggtcgaccagcctatccgttagcctggtgctcgttggcgtagtaaccctgtacctgggcgccatggtccaggcggactccggctgcgttgtgagctggaaaaacaaggagttgaagtgcggctcggggatcttcattacggacaacgtccacacatggaccgagcagtataagttccagcccgaatctcccagcaagctggcctccgcgattcaaaaggcccacgaagaaggcatttgcgggattaggagcgtgacccggctggagaacctcatgtggaagcagatcacgccggagcttaaccatattctttccgagaacgaggtaaagctcaccataatgaccggcgacatacgcgggatcatgcaggccggaaagcggagcctgcgcccgcagcccaccgagctgaagtactcttggaagacgtgggggaaagccaaaatgctcagcacagagtcccacaaccaaaccttccttatcgatgggcccgagactgccgagtgtccgaatacgaaccgggcttggaacagcttagaggtcgaggactacggcttcggagtgttcaccaccaacatctggcttaaactgcgggagaaacaagacgtattctgcgactccaagctgatgagcgccgccatcaaggacaaccgtgcggtccacgccgacatgggatactggatcgagtccgccctcaacgacacgtggaagatggagaaggccagcttcattgaggtgaagtcctgtcactggcccaagagccacaccctgtggtccaacggcgtgctggaaagcgaaatgatcatccccaagaactttgccgggcccgtcagccagcacaactaccgtccggggtatcacacgcagacagcggggccctggcatttgggcaagctggagatggatttcgacttgtgcgaggggaccaccgtggtggtcacggaggactgcggcaaccgcggcccgtcactccgcacaaccactgcctcggggaagttgattacggagtggtgctgccgtagctgcacactacctcccttacggtatagaggggaagacgggtgctggtacggcatggaaatccgacccctaaaggagaaggaggagaatcttgtgaacagcctcgtgactgccgggcacggccagatcgacaacttctccctgggcgtcctagggatggcactcttcctggaggagatgctacggacccgcataggcacgaagcatgcaatcctcctggtggccgtgagcttcgtcaccctgatcacaggtaacatgtcctttagggacctcggccgcgtgatggtgatggttggggccaccatgacggacgacatcggcatgggcgttacgtacctggccctgctcgctgcgttcaaggtgcgccccaccttcgccgtcgggttattgctccggaagctaacaagcaaggaactgatgatggccacgatcggcatcgccctcttatcccagagcaccatccccgagaccatcctggagctcaccgacgccctggctttagggatgatggtgctaaagatagttcggaatatggagaaataccagctggccgtcacgattatggctatctcctgcgtgcccaacgccgtcatcttacagaacgcatggaaggtctcctgcaccatcctggctgtcgtcagtgtgagccccctgctcctcacctcctcccagcagaaggccgattggatccccctggcactgaccatcaaaggactcaatcccacggctatcttccttacgacactgagcagaaccagcaagaagcgctcgtggccgctcaacgaggcaatcatggccgtggggatggtcagcattctagcttccagcctcctcaagaacgacatcccgatgaccggacccctggtagccggtgggttattaacggtgtgttacgtccttaccgggcggagcgcggacctggagctcgaacgagccgccgacgtgaaatgggaggaccaggccgaaatctccgggagctcccctatcctgagcatcaccatatccgaagacggcagcatgagcatcaagaacgaagaggaggagcaaacgcttaccattctcatacgtaccggtttgctggtaatcagcggggtctttccggtgtccatccctattaccgccgcggcttggtacttatgggaggtgaagaagcaacgcgccggcgtcctgtgggacgtgcctagcccgccgcccgttgaaaaggcggagctggaggatggggcctaccggatcaagcagcgagggattctcgggtactcccagatcggagccggcgtttacaaggaggggactttccacacgatgtggcacgttacccggggcgcggtgctaatgcaccgcgggaagagaatcgagcccagctgggcagacgtcaagaaagatctgatctcctacggcgggggatggaagctcgagggcgagtggaaagaaggggaggaggtccaagtgctggccttggagcccggcaagaacccccgcgcagtacaaaccaagcccggaatcttcaagactaacacgggaaccatcggcgccgtgagcctcgacttctcccctggaacctcgggctcccccatagtggatcggaaggggaaggtcgtgggcctgtacgggaacggcgtcgtcacccgctctggcgcgtacgtgtccgcgatcgcccagacggagaagtccatcgaggacaaccccgagatcgaggacgacatcttccggaagaagaggctgaccataatggacctccaccccggggccggcaaaacgaaacggtacctgccagcgatcgttcgcgaggcaatcaagcgggggctgcgcacgctgatactcgccccgacgagggtggttgccgccgagatggaggaggcgctgcggggcctgcctatccgctaccagactcccgccatcaagaccgaacataccgggcgggagatcgtagacctgatgtgtcacgccacgttcacaatgcgcctcttgtctcccgtacgggtgccgaactacaacctcatcataatggatgaggcacacttcaccgaccccgcgtccattgcggcccgtggctatatcagcacccgggtggagatgggcgaggcagcggggatcttcatgacggccacgccacccggctcccgcgatccgttcccgcagagcaacgcgccaatcatggacgaggagcgggagatccctgagcgctcctggaacagcggccacgagtgggtcacggatttcaagggcaagaccgtgtggttcgtgccctccatcaaggccgggaacgacatcgccgcttgcctacgaaagaacggcaagaaggtcattcaactctctcgcaagacatttgactccgaatacgtgaagactcgggcgaatgactgggactttgtagtcaccaccgacatcagcgagatgggcgccaacttcaaggctgaacgagtgatcgacccgcggcgctgtatgaagcccgtaatcctcacggatggggaggaacgggtcatcctggccggccccatgccggtgacccactcctcagcggcgcaacgccgggggcgcatcggacggaaccccaagaacgagaacgatcagtacatctacatgggtgagcctctcgagaacgacgagaactgcgctcactggaaggaagcgaagatgctcctggacaacatcaatacccccgagggcatcatcccgtccatgtttgagcccgagcgggagaaggtggacgctatcgacggagagtacagactgcgcggggaggcccggaagacctttgtcgatctcatgcggcgtggagacctgcccgtctggctggcatacaaggtggctgctgaggggataaactacgccgacaggaagtggtgctttgacggcatcaagaacaaccagatcctcgaggagaatatggaggtagaaatctggactaaggagggggagcgcaagaagctgaagcctcggtggcttgacgcccgcatctacagcgatcccctcgcgctgaaggagttcaaggagttcgccgctggccggaagtcgctgacactaaacctgatcaccgagatgggccgcctgccaaccttcatgacgcagaaggcgcggaacgcgctcgacaacctggccgtgctgcacacagcagaggccgggggccgcgcctataaccacgcgctcagtgagctgcccgagaccttagaaacccttctgttgctgactctgctggccacagtaactgggggcatctttctcttcttgatgtccgggaaggggatcggcaagatgacgctgggcatgtgctgcatcataaccgctagcattctcctctggtacgcccagatccagccgcattggatcgccgccagcatcatcctggagttctttctcatcgtgctcctgatccccgagcccgaaaagcaacggacgccccaggacaaccagctcacctatgtagtcatcgcgattttgaccgtagtggccgccaccatggccaacgagatgggcttcctggagaagacgaagaaggacctcgggttagggagcatcaccacccaggagagcgaatccaacatcttagacatagatctccgcccggcgagcgcctggaccctgtacgccgtcgccacgacgttcgtgacccccatgctgcggcacagcatcgagaactcatccgtgaatgtcagcctcactgccatcgcgaaccaggcgacggtacttatgggccttgggaaggggtggcccctcagcaagatggacatcggagtgcccctgctggctatcggctgttacagccaggttaacccgatcacactcaccgccgctctgctgttgctggtggctcactacgctattatcggtcccggcctgcaggccaaggccacccgcgaggcgcagaagcgggccgcagccggcatcatgaagaatcccacggtagacgggattaccgtcatcgacctcgagcccatcccctacgaccctaagttcgaaaagcagcttggccaggtgatgctgctcatcctctgcgtgacgcaggtcttaatgatgcgcaccacgtgggcactctgtgaggcgctgaccctggcgaccggcccaatctccaccctgtgggaagggaatcccggtcggttctggaatacgaccatcgctgtgagcatggccaacatattccggggttcctacctggccggcgcgggcctcctgttcagcataatgaagaacaccaccaatacccgacgaggcaccgggaacatcggcgagaccttaggtgaaaagtggaagtcacgcctgaacgccctcgggaagtcagagttccagatatacaagaagtctggcatacaggaggtggatcggactctggccaaggagggaatcaaacgcggcgagacggaccaccacgctgtcagccggggaagtgcgaaactgcgctggttcgtggagcggaacatggtgaccccagagggaaaggtcgtggacctcggctgcgggcgtggcggctggtcgtattactgcggcgggctgaagaacgtgcgggaggtgaaaggcctgactaaaggcgggcccgggcatgaggagcccatccccatgtccacatatgggtggaatctcgttcgccttcagtcgggcgttgatgtcttcttcacgcctccagagaagtgtgacaccctgctctgcgacatcggggagtcatctcccaatcccaccatcgaggcgggccgcaccctgcgcgtgctgaacttggtggagaactggctgaacaacaacacccaattctgcatcaaggtgctgaacccgtacatgcccagcgtgattgagaaaatggaggccctccagcgtaagtatggcggtgcactggttcgcaaccccctgtcccggaacagcacccacgagatgtactgggtgtccaacgccagcggcaacatcgtgtccagcgttaacatgatctcccgcatgctgataaatcggttcaccatgaagcacaagaaggccacctatgagccggacgtagacctcgggagcggaacccgtaacatcggaatcgagtccgagatacccaacctagacattataggcaagagaatcgagaagatcaagcaggagcacgagaccagctggcactacgaccaggatcacccttacaaaacctgggcgtaccacggctcctacgagaccaagcagaccgggagcgcctcgtctatggtgaacggcgtagtccgcctgctcacgaaaccctgggacgtggtgccaatggtcacgcagatggctatgacggacaccactcctttcgggcagcagcgcgtgttcaaggagaaggtggacacccgaactcaggagcccaaggagggtaccaagaagctgatgaaaataacggcagagtggctgtggaaagagttggggaagaagaaaacgccccgcatgtgcacacgagaggagttcaccaggaaggtgcggtccaacgcagcactgggcgccatcttcacagacgagaacaagtggaaatccgcccgcgaagccgtggaggactcccggttttgggagctggtggaccgcgagcggaacctccacctggagggcaagtgtgaaacctgtgtctataatatgatgggtaaacgcgagaaaaagctgggcgagttcgggaaggcaaaaggcagccgcgctatctggtacatgtggctcggcgccagatttctggagttcgaggcgctggggttcctcaacgaggaccattggttcagccgtggcaactcccttagcggggtggagggtgaggggttacaccgcctgggctatatcctgcgggacgtgggcaagaaggaaggaggcgcgatgtacgccgatgataccgccgggtgggacactcgcatcaccctggaggatctcaaaaacgaggagatggtgaccaaccacatgaagggcgagcacaagaaactggctgaggccatcttcaagctgacctaccagaacaaggtggtcagagtccagcgccctacgccccggggcacggtcatggacatcatctcccgccgggaccagcgcgggagcggccaggtagggacctatgggctcaacaccttcactaatatggaggcgcagctgatccgccagatggaaggggagggaattttcaagagcatccagcaccttacggccaccgaagaaatcgccgtccagaactggctcgcccgggttggacgcgaacggctgagccgtatggccatctccggggacgactgcgtcgtgaagcccattgacgaccggttcgcgagcgccctgacagcactcaacgacatgggcaaggttcgcaaggatattcagcagtgggagccatcccggggatggaacgattggacccaagtgcccttctgctcgcaccacttccacgagctggtgatgaaggacggccgagtgctggtcgtgccctgccggaatcaggacgagctcataggtcgcgcccgtatatcccagggcgccggctggagcctgaaagagacggcgtgccttgggaagtcctatgcccagatgtggactctcatgtactttcaccgccgggatctgcgcctggctgccaacgccatctgttcagcggtcccgccgcattgggttccgacatcccggaccacttggtcgatccacgcgaagcacgagtggatgacgaccgaggacatgctagctgtgtggaatcgcgtctggatccaggaaaacccttggatggaggacaaaacccccgtcgagtcatgggaggaggtcccctacttgggcaagagggaggaccaatggtgcgggtcgctgatcggcctcacaagccgcgccacgtgggcgaaaaacatccagaccgccatcaaccaggtgcggtccctgatcgggaacgaggagtacactgactacatgccgtccatgaagcgctttcgccgagaagaggaagaggcgggagtcctgtggtga

SEQ ID NO: 25048 - RNA, 9876 nt, synthetic construct
  misc_feature 1..9876: note = derived and/or modified CDS sequence (opt11) from DENV-2__GQ868646__SS-prME
  source 1..9876: mol_type = other RNA
actgcgggagtgatcgtaatgctgatccccacagccatggctttccacttgaccactcgcaatggcgagccgcacatgattgtgggtcggcaggagaaggggaagtccctcctgttcaagaccgaggacggagtgaacatgtgtaccttgatggccatcgacctgggggagctgtgcgaagacaccatcacctacaagtgcccgctcctgcgccagaacgagcccgaggatattgactgctggtgcaatagtactagcacctgggtcacctatgggacctgcaccaccacgggcgagcaccggcgcgagaagcggtctgtagccctggttccccacgtcgggatgggcctcgaaacccgcacagagacctggatgagctcagagggtgcctggaaacacgtgcagcggatcgagacctggatcctgcgccaccctggcttcaccatcatggctgcaatcctggcctacactattgggaccacccacttccagcgggccctcatcttcatcctgctgaccgccgtggcccccagcatgacaatgcgctgcatcggcatctccaaccgagacttcgtcgagggcgtgagcggaggctcctgggtggacatcgtcctcgaacacgggagctgcgtgaccacgatggccaagaacaagcccaccctagatttcgagctgatcaagaccgaggccaagcagcccgccacgctcagaaagtactgcatcgaagctaaactgacgaacactaccaccgagtcccggtgtccgacacagggcgagcccagcctgaacgaggaacaggacaagcgcttcatctgtaagcactccatggtggaccgggggtgggggaatggctgtgggctgttcggaaaaggcgggatcgtgacctgcgcgaagttcacgtgcaagaagaacatggaggggaaggtggtgcagcccgaaaacctggaatacaccatcgtcatcacgccccacagcggggaggagcacgccgtgggtaacgacaccgggaagcacggcaaagagatcaagatcacaccgcagtccagcatcaccgaggccgagctgaccgggtacggcacggtgaccatggagtgcagcccccgcacgggcctcgactttaatgaaatggtactgctgcaaatggaagacaaggcctggttagtgcaccggcagtggttcttagacctgcccctcccctggctgccaggagccgacacacagggcagcaactggatccaaaaggaaacgcttgtgaccttcaagaacccccatgcgaagaagcaagacgtcgtggtcctcggatcgcaggagggcgccatgcacaccgccctgacaggggccacggagatccagatgagctccggcaacctcctgttcacaggccacttaaagtgccgactgcggatggacaagctccagctgaaagggatgtcttacagcatgtgcacgggcaaattcaagatagtgaaggagatagccgagactcagcacggcacgatcgtgatccgcgtacagtacgagggcgacggctccccctgtaaaatccccttcgagattaccgacctggagaagcggcacgtgttaggccgcctgatcacggtcaacccgatcgtcaccgagaaggacagccccgtgaacatcgaggcggagccgcccttcggcgactcctacatcatcatcggcgtggagccgggtcagctgaagctcaattggttcaagaagggtagctccataggccagatgttcgagacaacaatgcgcggcgccaagcggatggccatcctgggagacactgcttgggacttcggaagcctcgggggcgtcttcaccagcatcgggaaggccctccaccaggtattcggtgcaatctacggtgcggccttcagcggggtgtcctggactatgaagatactgatcggcgttatcatcacctggataggtatgaactcccgctccaccagcctgtccgtgagcctggtgttagtcggcgtggtgaccctgtatctgggcgccatggttcaggcggacagtggctgcgtggtgtcgtggaagaacaaggaactcaagtgcggctcaggtatattcatcacggacaacgtccacacctggaccgagcagtacaagttccagcccgaatctccctctaagttagcctccgccatccagaaagcccacgaggagggaatctgtgggatacggagcgttacacgcctggagaacctcatgtggaagcagatcacgcccgaactgaaccacatcctgtccgagaacgaggtgaagctgaccatcatgaccggcgacattagaggaataatgcaggccggcaagaggagcctgcggccgcagcccaccgagctgaagtactcgtggaaaacgtggggaaaggcgaagatgctcagcaccgagtcgcacaaccagaccttcctgatcgacggccccgaaaccgcagagtgcccgaacacgaaccgcgcctggaacagtctggaggtagaggactacggcttcggggtgttcaccaccaacatatggctcaagctgcgagacaagcaggacgtgttctgcgattcaaagctgatgagcgctgccatcaaggacaaccgcgcggtccacgccgacatgggctattggattgagagtgccctcaacgacacctggaagatggagaaagccagcttcattgaagtaaagtcgtgccactggcccaagagccacaccctgtggagcaacggcgtgctggagagcgagatgattatccccaagaacttcgccgggcccgtctcccagcacaactaccggccgggttaccacacgcaaaccgcgggtccgtggcacctcggcaaattggagatggacttcgacctctgtgaggggacgaccgtggtggtcacggaggactgcggcaaccgcggtcccagcctcagaaccaccaccgccagcggcaagctaattacggagtggtgctgtcgctcctgcaccctgcccccgctccggtaccgcggcgaggacgggtgctggtacggaatggagatccggcccttaaaggagaaggaggaaaacttggtgaatagcctcgtgaccgccggccacggccagatcgacaacttctccctaggcgtcttagggatggcactcctgctggaggagatgctccgcacccgtataggcactaagcacgcgatcctgctggtggccgtaagcttcgtcaccctcatcaccgggaatatgtccttcagggacctggggcgtgtgatggttatggtcggtgccaccatgacggacgacataggcatgggagtgacttacctggccctcttagccgcgttcaaggtacggcccaccttcgccgccggactgcttctgcgcaagctgacgagcaaggagctaatgatggccacgatcggaatcgcgctactgtcccagagtaccatccccgaaaccatcctcgagctgaccgatgcgttggccctggggatgatggtcctgaagattgtgcggaacatggagaagtaccagttggccgtgacagtaatggccatctcttgcgtgccgaacgctgtgatcctccagaacgcatggaaggtcagctgcaccatcctggccgccgtatccgtcagtccactgctgttgacctccagccaacagaaggccgactggatccccctggcgctcaccatcaagggcctgaaccccacggccatcttcctgaccacactctcccgaaccagcaagaagcgatcatggccgctgaacgaggccatcatggccgtgggcatggtgagcatcctggcaagtagcctccttaagaatgacatccccatgacgggccccctggttgcgggggggctcttaactgtgtgctacgtgctgaccggacgcagcgccgacctagagctggagcgagcagccgatgtcaagtgggaggaccaggccgaaatctccgggagttcccctatactgagcatcaccatctccgaggatggcagcatgtcgattaaaaacgaggaggaggagcagacgctcacgatcctgatccgcaccggtctgctcgtgataagcggagtgttcccggtctcgatacccatcaccgcggccgcctggtatctgtgggaggtgaagaagcagcgggctggcgtgctctgggacgtccctagcccgccgcccgtagagaaggccgagttggaggacggggcataccgaatcaagcagcggggcattctgggctactcccagatcggcgccggcgtgtataaagaggggacgtttcatacgatgtggcacgtcacgaggggcgccgtgttaatgcatagagggaagcgcatcgagcccagttgggccgacgtgaagaaggacctcataagctacggcggaggctggaagctggagggcgagtggaaggagggagaggaggtccaggtactcgccctcgagcccggtaagaacccacgggcggtgcaaaccaagcccgggatcttcaagaccaacacaggcaccatcggggccgtcagcttagacttttcccctggaaccagcggctcccccatagtagacagaaaggggaaggtggttggcctgtacgggaacggagtggtgacgcggagcggcgcctacgtcagtgccatagcgcagacggagaagtccatcgaggacaaccccgagatcgaggacgacatattccggaagaagcggctcaccataatggatctgcacccgggggccggcaagaccaagcgctacctgccggccattgtgcgggaggccatcaagcgcgggctgcgtaccctcattctggccccgacgcgggtggtcgcggccgagatggaagaggccctgcgcggcctacccatccggtaccaaaccaccgccattaagacggagcacacagggcgtgagatcgtggaccttatgtgccacgccaccttcaccatgaggctgctctcgcccgtgcgcgtccccaactacaacttgatcattatggacgaggcgcacttcaccgacccggcttccatcgccgcccggggttacatcagcacgcgcgtggagatgggcgaggcagcggggatcttcatgactgccacgccgcctggctcccgcgatcccttcccacagagcaacgccccaatcatggacgaggagagggagatccccgagaggtcgtggaacagcggtcacgagtgggtgaccgatttcaagggaaagactgtctggttcgttcccagcatcaaggccgggaatgatatcgcggcctgtctgcgcaagaacggtaagaaggtaatccaactcagccgaaagacctttgactccgaatacgtcaagacccgcgcgaacgactgggacttcgtggtgacaacggacattagcgagatgggcgccaacttcaaggccgagagggtcatcgacccgcgccggtgcatgaagcccgtcatcctgaccgacggggaggagcgcgtgatcctggcgggccccatgcccgtaacccattccagcgccgcccagcggcgcgggcgcatcggtcggaacccgaagaacgagaacgaccagtacatctacatgggggagccgctcgagaacgacgaggactgtgcccactggaaggaggccaaaatgctgctggacaacatcaacacccccgagggtatcatccccagtatgttcgaaccggagcgcgagaaggtcgacgcgatcgacggcgaataccggctcagaggggaagcccggaaaacgttcgtggacctgatgcgccgcggcgacctgcccgtctggctcgcctacaaggtggccgccgaagggatcaactacgcggaccgcaagtggtgcttcgacggtatcaagaacaaccagatcttagaggagaacatggaggtggagatttggaccaaggagggagagcggaagaagttaaaacctcgctggctcgacgcccggatctacagcgacccgctggccctgaaggagttcaaggagttcgccgcgggacgcaaatccctcaccctgaacctgatcaccgagatgggccggctcccgacctttatgacccagaaggcccgcaacgccctggacaacttggccgtcctccacaccgccgaggcggggggcagagcctacaaccacgccctgagcgagctgccagagaccttggagacgctactgctattgaccctgctcgccaccgtgaccgggggcattttccttttcctgatgtccggcaaggggatcggcaagatgactctggggatgtgttgcatcatcaccgcctccatcctgctgtggtacgcccaaattcagccccactggatcgccgcttccatcattctagagttcttcctgatcgtcctcttaatccccgagcctgaaaagcagcgcacgcctcaggataaccaactgacctacgtggtgatcgcgatcttaaccgtcgtggccgccacgatggccaacgagatgggcttccttgagaagaccaagaaagacctggggctgggcagcatcaccacccaggagagtgaatccaatatcctcgatatcgacctccggcccgccagcgcctggacgttatacgcagtcgcgaccacattcgtcaccccgatgctgcgccactcaatcgagaacagctccgtgaacgtttcgctgacggctattgccaaccaggccaccgtcctgatgggcctcgggaagggatggcccctgtccaagatggacatcggggtacccctgttggcgatcggctgctatagccaggtgaaccccatcaccctgaccgccgccctgttactgctggttgcccactatgccatcatcggtccaggccttcaggccaaagccacgcgggaggcccagaagcgcgccgccgcgggcatcatgaaaaaccctaccgtggacgggatcaccgtgatcgaccttgagccaatcccctacgacccgaaattcgagaagcagctgggccaggtcatgttactgatcctgtgcgtgacccaggtgctcatgatgcggacgacatgggcgctttgcgaggccttaaccctggcaaccgggccaatttccacgctgtgggagggcaatcccgggaggttctggaacaccaccatcgccgtcagcatggcgaacatctttcgtggctcctacctggccggggccgggctcctgtttagcatcatgaagaataccacgaacaccagacgcggtaccgggaatatcggcgagaccctaggcgagaagtggaagtcccggcttaatgcactgggcaaatctgagttccagatctacaaaaagtccggcatccaggaggtggaccgcacgcttgcgaaggaggggatcaagcggggcgagacagatcaccacgccgtgagccgcgggtccgccaagctccgatggttcgtcgagaggaacatggtgacccccgagggtaaggtggtcgacctgggctgcggccggggcgggtggagctactactgcggcgggctgaagaacgtcagggaggtaaagggcctcacgaagggcggcccgggccacgaggagcccatccccatgtccacatacgggtggaatttggtcagactgcagagcggcgtggacgtgttctttacgccccccgagaaatgtgacaccctcctgtgcgatataggggaaagctcccccaacccgacgatcgaggccggtcgcaccctgcgggtcctcaacctggtagagaattggttaaataacaacacgcaattctgtattaaggtgctcaacccctacatgccaagcgtcatcgagaagatggaggccctgcagcgcaagtatggcggggcgttggtgcggaaccccctgtcccgcaacagtacccacgagatgtactgggtgtctaacgccaccggcaatatcgtcagttccgtgaacatgatctcccggatgctcatcaaccgcttcaccatgaagcacaaaaaggccacgtacgagcccgacgtggacttaggatccgggactcggaacatcgggatcgaatccgagataccgaacctggacatcatcggcaagcgaatcgagaagatcaagcaggagcacgagacctcctggcactatgaccaggaccacccctacaagacgtgggcctaccacggcagctatgagacgaagcagaccgggtccgccagctctatggtcaacggcgtggtgcgcctcctgactaagccctgggacgtcgtgcccatggtgacccagatggctatgacggacacaaccccgttcgggcaacagagagtcttcaaggagaaagtggacacgcgcacgcaggaacccaaggaaggtactaagaagctgatgaagatcaccgctgagtggctctggaaggagctgggcaaggagaagacgccccggatgtgcacgcgcgaggagttcacccggaaggtgcgctccaacgccgccctgggggccatattcaccgacgagaacaagtggaaatccgcgcgagaggccgtcgaggacggccgtttctgggagttagtggaccgggagcgcaacttacatctggaggggaagtgtgagacgtgcgtgtataatatgatgggcaagcgggaaaagaagcttggggagttcggcaaggccaaggggtcccgcgccatctggtacatgtggctgggcgccaggttccttgagttcgaggccctcggcttcctgaatgaggaccattggttctcccgcggtaatagcctaagcggcgtcgagggggaaggtctccaccgactggggtacatcctacgcgacgttggaaagaaggagggcggggcgatgtacgccgacgacacggccgggtgggacaccaggatcaccctcgaggacctgaagaacgaggagatggtcaccaaccatatgaagggggagcacaagaaactggcggaagccatctttaagttgacgtaccagaacaaggtggtgcgcgttcagcggcccaccccgcgcggaaccgtgatggacatcatctcacggcgcgaccagcgcggcagcgggcaggtcggtacctacggcctgaacacgttcaccaacatggaggctcagctgatccggcaaatggagggcgagggcatcttcaagtccatccagcacctcaccgccaccgaggagatagcggtgcagaattggctggcgcgcgtagggcgggagcgcctgagccggatggccatatccggagacgactgcgtggtcaagcctatcgacgaccgctttgctagcgcactgacggccctgaacgacatggggaaggtgcggaaagacatccagcagtgggagccctcccgcggctggaatgactggactcaagtgcccttctgtagccaccactttcatgagctggtcatgaaggatggccgggtgctcgtggtcccttgccgcaatcaggacgagctgatcgggagggcacgcatctcccagggcgccggatggagtctgaaagagaccgcctgtctcggcaagagttacgcccagatgtggactctaatgtatttccaccggcgcgacctgcggctcgcggccaacgccatatgcagcgccgtgccctcccattgggtgcccacaagccgcacaacctggtccatccacgccaagcacgagtggatgaccacagaggacatgctggcggtatggaaccgcgtttggatccaggagaacccctggatggaggacaagaccccggtagagagctgggaggaggtcccctacctgggcaagcgcgaggatcagtggtgcggctccctcataggcctcaccagccgggccacgtgggctaaaaacatccagaccgccatcaatcaggtgcgaagcctgatcggcaatgaggagtacacggactacatgccctcaatgaagaggttcaggcgcgaagaggaggaagccggcgtgctttggtga

SEQ ID NO: 25049 - RNA, 9876 nt, synthetic construct
  misc_feature 1..9876: note = derived and/or modified CDS sequence (opt11) from DENV-2__FJ906961__SS-prME
  source 1..9876: mol_type = other RNA
actgcaggcgtgatcgtaatgctgatcccgactgccatggcgttccatctcaccactcgcaacggggagccccacatgatcgtgggccggcaggagaaggggaaatccctgctgttcaagaccgaagacggcgttaatatgtgcactctcatggctatcgacctgggggaattgtgtgaagacaccatcacctacaaatgccccctcctgcgccagaacgagccagaggacatcgactgctggtgcaactctacgagcacctgggtcacctatgggacctgtacaaccacgggcgagcaccggagagagaagcggtcagtggcgctagtgccccatgtcgggatgggtctcgagacccgcaccgagacctggatgtctagcgagggagcctggaagcatgtgcagaggatcgagacctggatcctgcggcaccccggctttaccattatggcggcaatcctggcatacaccattgggaccacccacttccagcgggcgctaatcttcatcttgctgaccgccgtagcgccttctatgaccatgcgctgcattggtatctccaacagggacttcgtggagggcgtgagcgggggctcctgggtggacatagtactcgagcacggatcatgcgtgaccacgatggccaaaaataaacccaccttggacttcgagctgatcaagacagaggccaagcagcccgctaccctccgaaagtactgcatagaggccaaactaacgaataccacaaccgagtctcggtgccccactcaaggcgagcccagcctaaacgaggagcaggacaagcgctttatctgcaaacactccatggtggaccggggctggggcaacgggtgcggcctgttcgggaagggcggcatcgttacctgcgcgatgttcacgtgcaagaagaacatggagggcaaggtggtgcagcccgaaaacctggaatataccatcgtaatcacgccccacagcggtgaggagcacgccgtgggcaacgacaccgggaagcacggcaaagaaatcaagatcacccctcagtcctcgattaccgaggccgagctgaccgggtacggcacggtaaccatggagtgctcaccccgcaccggactcgacttcaacgagatggtcctgctccagatggaggacaaggcctggctcgtgcaccggcaatggttcctggacttacccctcccctggctgcctggtgccgatacccagggcagcaactggatccagaaggagacgctggtgacattcaagaacccccacgcgaagaagcaggacgttgtagttctggggtcccaggagggtgccatgcataccgccctgaccggggctacagagattcagatgagcagcggcaacctcctgttcactggccacctgaagtgccggctgcggatggacaagctccagctgaaagggatgtcgtatagcatgtgcaccggtaagttcaaaattgttaaggagatcgccgaaactcagcacgggacgatcgtgatccgcgtccagtacgagggggacggctccccgtgcaagatacccttcgagatcaccgacctggagaagcggcatgtactcgggcgcctgatcaccgtgaacccgatcgtcaccgagaaggattctccggttaatatcgaagcagaaccgcccttcggcgatagctacattatcattggggtggagccgggccagctaaaactgaactggttcaagaaggggtcctccatcggccaaatgttcgagacgaccatgaggggagccaagagaatggccatcttaggtgacaccgcctgggacttcggctccctcgggggcgtattcactagtatcgggaaggcattgcaccaggtatttggtgcgatctacggcgccgccttctcaggggtgagttggacgatgaaaatcttaattggcgtaataatcacctggatcggaatgaacagccgctctacgagcctgtccgtgagcctggtgctcgtaggcgtggtgaccctgtaccttggggccatggtccaagcggactccggctgcgtagtgagctggaagaacaaggagctcaaatgtggctcagggatctttatcacggataacgtccacacctggacagagcagtacaagttccagcccgagtcccccagtaagctagcctcagccatccagaaggcccacgaggagggaatctgcgggatacggagcgtaacccggctggagaacttgatgtggaaacaaatcacgcctgagctgaatcacatcctgtccgagaacgaggtgaagcttaccatcatgacgggggacattcggggtatcatgcaggccggcaagcgaagcctgcggccgcagcccacagagctaaagtactcctggaagacgtggggcaaggcgaagatgctaagcaccgagccccacaaccagacctttctgatcgacgggccggagaccgccgagtgccccaatacaaatcgcgcctggaactccctggaggtagaggattatgggttcggggtattcacgaccaatatctggctgaagctgagggagaagcaggaggtgttctgcgacagcaagctgatgtccgcggcaataaaggacaaccgcgcagtccatgccgatatgggctactggatcgagtctgccctcaacgacacctggaaaatggagaaagcctccttcatagaggtcaagagctgccactggcccaagtcccacaccctgtggagcaacggcgtgctggaaagtgaaatgataatccccaagaactttgctgggccagttagccagcacaattaccggcccggctatcacacgcagaccgccgggccctggcatctcggcaagctggagatggacttcgacctttgcgaagggaccaccgtggtggtcactgaagactgcggcaatagaggcccctccctgcggaccaccaccgccagtgggaagctgatcacggagtggtgctgccgcagctgtaccctgccacccctccgatataggggagaagacggctgctggtacggcatggagataagacccctaaaagagaaggaagagaacctggtgaattccctcgtgaccgccgggcacggccagatcgacaacttcagtctaggagtcttgggcatggccctcttcctggaggagatgctccgcacccggataggcacaaagcacgcgatcttattggtggcagtatcctttgtcactctgatcaccggaaacatgtccttccgtgacctcggccgggtcatggtgatggttggggcgaccatgacggacgatatcggcatgggcgtcacgtacttggcccttctcgccgccttcaaggtccggcccacgttcgctgccgggctgctgctccgcaagctgacctccaaggagctgatgatggccacgatcgggatcgccctcctgagccaatccaccattccggagaccatcctggagttaaccgatgcgctcgcccttgggatgatggttctgaagatcgtgcggaacatggagaaataccaactggccgttacgatcatggctatcagctgcgtacccaacgcagtgatcctccagaacgcgtggaaagtatcgtgcaccatactcgccgctgtctccgtgagccccctgctactcaccagctcgcaacagaaggcagactggatccccctggcgttaacgatcaagggcctcaacccgacggccatcttcttaaccaccctgagccgcacctccaagaagcggagttggcccctcaacgaggcgataatggccgtcggcatggtgtccatcctggcctcgtctctgctcaagaacgacatccccatgacggggcccctggtggcgggcgggttgctcaccgtctgctacgtgttgaccggacgtagcgctgacctcgagctcgagcgggcagccgacgtgaagtgggaagatcaggccgagatctctggctccagcccgatcctgtccatcaccatctccgaggacggctccatgtcgatcaaaaacgaggaggaggagcagactctgacaatactcatccgcacaggcctgctggttatctccggagtcttcccagttagcatacccatcaccgcggcagcctggtacttgtgggaggtcaaaaagcagcgtgccggcgtgctgtgggacgttccctcgccgccgcccgtcgagaaggcggagcttgaggacggggcataccgcataaagcaacggggtatcctcggatactcccagattggagcaggcgtttacaaggaagggaccttccacactatgtggcatgtgacccgtggcgccgtcctgatgcaccgagggaagcgaatcgagccttcgtgggccgacgtgaagaaggacctgatcagctacggcggtggctggaaactcgagggcgagtggaaggagggggaggaggtgcaggtcctagccctggagcccggcaagaaccctcgcgcggtgcagactaagcccgggatcttcaagaccaacactggcaccatcggggccgtgtccttagacttcagcccgggcacttccggaagccccatcgtcgaccgcaaggggaaagtggttgggctgtacggtaacggcgtcgtgacccggtccggcgcctacgtgagcgccatcgcgcaaaccgagaaatccatcgaggacaaccccgagatcgaggacgacatattccgcaagaagcgtctgaccatcatggacctacaccccggggccggcaagaccaaacgctatctgcctgctatcgttcgggaagcgatcaaacgcgggttacgcaccctgatcctcgctccgacacgggtcgtggcggctgagatggaagaggccctgcgcggtctgccgattcggtaccagaccaccgccatcaagacagagcacaccgggcgagagatagtcgacctcatgtgtcacgctaccttcacaatgcgtcttctgagccccgtgcgcgtcccgaactacaacctcatcatcatggacgaggcgcacttcaccgaccccgcctcgatcgccgcgcggggttacatctctacgcgcgtcgagatgggagaggccgcggggatctttatgaccgcaacgccgcccggcagccgggacccgttcccccagtccaacgcccccatcatggacgaggagcgagagatccccgagcgcagctggaactccgggcatgaatgggtgaccgacttcaagggcaagacagtatggttcgtgccttcgatcaaagccgggaacgacattgcggcctgcctgcgcaagaacggaaagaaagtgatccagctgtcgagaaagaccttcgacagcgagtatgtgaagacgagagccaacgactgggacttcgtcgttaccacggacatcagtgagatgggcgcgaacttcaaggccgagcgagtgatcgacccccggcggtgcatgaagcccgtcatcctcaccgacggggaggagcgcgtgatcctggcaggccccatgccagtcacccattcatccgccgctcagcggcgcggtcgcatcggccggaaccccaagaacgagaacgaccagtacatctacatgggggagcccctggaaaacgacgaggactgcgcccactggaaggaggcaaagatgctcttggacaacatcaacaccccagagggcataatcccgagcatgtttgagcccgagcgtgagaaggtcgatgcgatcgacggcgagtaccggctgcgcggggaggcccggaaaacattcgtggacctcatgcgccggggtgacctccccgtttggctggcctacaaggtcgccgccgagggaattaactacgcggaccgcaagtggtgcttcgacggcatcaagaacaaccagatcctggaagagaacatggaggtggagatctggaccaaggagggagaacggaagaaactgaagccccgctggctggacgccagaatctactccgacccccttgccctgaaggagttcaaggagttcgcggcaggccgcaagagcctgaccctcaacctgatcaccgagatgggccggcttccaacgttcatgacccaaaaggcccgcaacgccctcgataacttagccgtgttgcataccgccgaagccgggggaagggcctataaccacgccttgtcagagctgccagagaccctggaaacgttactgctgctcaccctgctggctaccgtcaccggtggcatcttcctcttcctgatgagtggcaaggggatcggcaagatgacccttgggatgtgctgcatcattacggcctctatcctcctgtggtacgcgcagatccaacctcactggatagccgcctccataatcctggaattcttcctgatcgtgctgctgatccccgagcccgagaagcagcgcacgccccaggataaccagctcacctacgtcgtgatcgccatcctgacagtcgtcgccgctactatggccaatgagatgggtttcctggagaagaccaagaaagacctcgggctgggctccatcacgacccaagagagcgagtcaaacatacttgacatcgacctccggccagccagcgcctggacgctgtacgccgtggcgaccacctttgtgacacccatgttacggcacagcatcgagaattcctcggtcaatgtctccctcacggccattgccaaccaggctaccgtgcttatgggcctcggtaaaggctggccgctaagcaagatggacatcggggtccccctgctggcgataggctgttattcacaggtgaacccgatcacactcaccgccgccctcttacttctggtggcccactacgccatcataggccccggcctgcaggccaaggccacgcgggaggcccagaaacgtgcggccgccggtatcatgaagaaccccaccgtcgacgggattaccgtgatagaccttgagcccatcccgtacgaccccaagttcgagaagcagctgggccaggtgatgttactcatcctgtgtgtgacccaggtgctgatgatgcgcacaacctgggccctctgcgaggccttgaccctggccacggggcccatcagtacgctctgggaaggtaatccaggacgcttttggaacaccaccatcgccgtgtccatggcgaacatcttccgcggtagctacctggccggcgccgggctactgttttccataatgaagaacacgacgaacacccggcgcggcaccgggaacataggcgagaccctgggcgagaagtggaagtccagactgaacgccctcgggaagtccgagttccagatatacaagaagtcgggaatccaagaggtcgaccgtacgctggcgaaggaggggatcaagcggggcgaaaccgaccatcacgccgtgtcccgcggcagcgccaagctgcggtggtttgtagagcgcaacatggtaaccccggaggggaaggtggtggacctcgggtgcgggcggggcgggtggtcctactactgcggaggactgaaaaacgtccgcgaagtgaaaggccttaccaaaggcggcccgggccacgaagagcccatcccgatgagcacctacgggtggaacctcgttagactgcagtcaggagtagacgtgttctttaccccgcccgagaagtgcgataccctgctctgcgacattggagagagcagcccgaatcccactatagaagccggccgtacccttcgggttctgaacctcgtcgagaattggctgaacaataacacacagttctgcatcaaggtgctcaacccgtatatgccatccgtgatcgagaagatggaggcccttcagcgcaaatatggcggggcgctggtccggaaccctctgtcgcgcaactctacacatgagatgtattgggtgtcgaacgcgaccggcaacatagtgtcctcggtaaacatgatctcccggatgctgatcaaccgcttcaccatgaagcacaagaaggccacgtacgaaccggacgtggacctcgggagcgggacccggaacatcggtatcgaatccgagatccccaacctggacatcatcggcaagcgcatcgagaaaatcaagcaggaacatgagaccagctggcattacgaccaggaccacccctacaagacttgggcctatcatggatcatacgagacgaagcaaaccgggagcgcttccagcatggtgaatggcgtcgtgcgcctgttaaccaaaccctgggacgtggtccccatggtgacccagatggcgatgacggacaccaccccctttgggcagcagagagtctttaaggaaaaggttgacacgcgcacgcaggagcccaaagagggcaccaagaaactgatgaaaatcacagccgagtggctgtggaaggaactcgggaaaaagaagaccccccggatgtgcacgcgcgaggagttcacccgcaaggtacgttccaacgccgccctgggggccatcttcaccgacgagaataaatggaagtcggcccgggaggcagtggaggacggtcgtttctgggagttagtcgaccgcgagcgaaacctacacctggaggggaagtgcgagacctgcgtgtacaacatgatgggcaagcgggagaagaagttgggggagttcgggaaggccaagggcagccgagccatctggtacatgtggttgggagcgcggttcctggagtttgaggcactcggattcctcaacgaggaccactggttcagtcgcggaaactccctcagcggcgttgaaggagagggcctgcaccggctcgggtacattctgcgggacgtcgggaagaaggagggcggggccatgtacgcagacgatacggccggctgggacacacgaatcaccctggaggacctcaagaatgaggagatggtgaccaatcatatgaagggggagcacaagaagctggcggaagccatcttcaagctgacataccagaacaaagtcgtgcgcgtgcagcgacccacgccccggggcaccgtcatggacatcatcagccggcgggaccaacgcggctccgggcaggtcggcacctacgggctcaacacgtttaccaacatggaggcacagctgatacggcagatggagggcgaaggtatcttcaagagcatacaacaccttaccgccacagaggagatcgctgtgcagaactggctcgcgcgggtcgggcgggaaagactgtcccgaatggccatttcaggcgacgactgcgtggttaagccaatcgacgatcgtttcgccagcgccctgacggctctcaacgacatggggaaggttagaaaggatatccagcagtgggagcccagccgcgggtggaatgactggacccaggtgccgttctgctcccaccactttcatgagttagtgatgaaggacgggcgggttctggttgtcccatgccgcaatcaggacgaactcatcggccgtgcccgcatatcccaaggggccggctggtccctgaaggagaccgcctgcctgggcaaaagctacgcccaaatgtggaccctcatgtacttccatcgacgcgaccttcggctggcggcgaacgcgatctgttccgcggtccccagtcactgggtgcctacttcccgcaccacctggagcatccacgccaagcacgagtggatgaccacagaggacatgttagcggtgtggaaccgggtctggatccaagagaatccatggatggaggacaagacgccagtggagtcctgggaggaggtgccatacctggggaagcgtgaggaccaatggtgcggctcactgattgggctcacctcgcgggccacctgggccaagaacatccagaccgccatcaaccaagtccgctcgttgattggcaatgaagagtatacggattacatgccgagtatgaagcgcttccgacgcgaggaggaagaagccggcgtgttatggtga

SEQ ID NO: 25050 - RNA, 9876 nt, synthetic construct
  misc_feature 1..9876: note = derived and/or modified CDS sequence (opt11) from DENV-2__FJ906962__SS-prME
  source 1..9876: mol_type = other RNA
accgcgggcgtgatagtaatgctaatccccaccgccatggccttccatctcaccacccgaaacggtgagccgcacatgatcgtgggccggcaggagaaggggaagtctctcctcttcaagaccgaggacggcgtgaatatgtgtaccctcatggccatagacctgggggagctgtgtgaggacaccatcacctacaagtgtccccttctgcgccagaacgagcccgaagacatcgactgctggtgcaacagcaccagcacctgggtaacctacgggacctgcaccaccacgggcgagcaccgacgggagaagcggtccgtggcactggtgcctcacgtcgggatgggactagagacccgcaccgagacctggatgagctcagagggggcctggaagcacgtgcagcggatcgagacgtggatcctgcgccacccgggcttcaccatcatggccgcgatcctggcctacaccattgggaccacgcacttccagcgggcccttatcttcatactgctgaccgccgtcgcgcccagcatgaccatgcgctgcatcggcatctccaaccgggactttgtcgagggagttagcggcggctcctgggtggacatcgtcctcgagcacgggagctgcgtgaccacgatggccaagaataagcccaccctggacttcgagctgattaaaactgaggccaagcagcccgcgaccttgaggaagtactgcatcgaggccaagctgacaaacacgaccaccgaatcccggtgcccgacgcagggcgaacccagcctaaacgaggagcaggacaagcgctttatctgcaagcattccatggttgaccggggatgggggaacggctgcgggctgttcggcaagggcgggatcgtcacctgtgcgatgttcacgtgcaagaagaacatggagggcaaggtggtgcagcctgagaacctggagtataccatcgtcatcacgccgcacagcggggaggagcacgcggtgggcaacgacaccgggaagcacggcaaagagatcaagatcaccccgcagtcctctatcacggaggccgaactgaccgggtacggcactgtgaccatggagtgctccccccgcaccggcctcgacttcaatgaaatggtcttgctacagatggaggataaggcttggctcgtacacaggcagtggttcctggacctacccctcccctggcttccgggggccgacacccagggaagcaactggatccagaaggagacgcttgtgaccttcaaaaacccccacgcgaagaagcaggacgtcgtggtcctcggatcccaggagggcgctatgcacaccgccctgacgggggctacggagatccagatgagcagcggaaacctcctgtttaccggccacctgaagtgccgcctgcggatggacaaactacagctgaaggggatgtcctacagcatgtgcactggcaagttcaagatcgtaaaagagatcgccgagacccagcacgggacgatcgtgatccgcgtccagtatgagggcgatggctccccttgtaagatccccttcgagatcactgacctggaaaagcggcacgtgctcgggcgcctgatcaccgtgaacccgatcgtcaccgagaaggatagccccgtcaacatcgaagcggagccgcccttcggcgactcctacatcatcatcggggtggagccgggccagctgaagctcaattggtttaaaaagggcagctccatcggccagatgttcgagacgaccatgcgcggcgccaagcggatggccatcctgggtgacaccgcctgggacttcggcagcctcgggggcgttttcacctccatcgggaaggccctccaccaggtgttcggggcgatatacggagcagccttcagcggggtgtcctggacgatgaaaatcctgatcggagtcatcatcacctggatcgggatgaacagccgttccaccagcctgtccgtgagcttagtgctcgtcggagtggtgaccctgtacctgggggcgatggttcaggcggactccggctgcgttgtgagctggaagaacaaggagctcaagtgcggctccggcatcttcatcacggacaatgtccacacctggaccgagcaatacaagttccagcccgagagccctagcaagctggcctccgccatccagaaggcccacgaagagggcatctgcgggattcggagcgtgacccgtctagagaacctcatgtggaagcaaatcacgcccgagctgaaccacatcctgtccgagaatgaaattaagctcaccataatgaccggcgacatccgggggatcatgcaggccggcaagcgcagcctgcggccgcagcccactgaactgaagtactcctggaagacgtggggcaaggcgaagatgctcagcacggagtcccacaaccagacattcctgatcgacgggcccgaaaccgccgagtgcccgaacaccaatcgcgcctggaacagcctggaggtggaggactacggcttcggggtcttcaccaccaacatctggctcaagctgcgggagaagcaggacgtgttctgcgactccaagctgatgagcgccgctataaaggacaaccgcgcggtgcacgccgacatgggctactggatcgagtccgccctcaacgacacctggaagatggagaaggcgagcttcatcgaggtcaaatcctgtcactggcccaagagccataccctgtggtccaacggcgtgctggagagcgaaatgatcatccccaagaacttcgccgggcccgtgtcccaacacaactaccggccgggctaccacacacaaaccgcagggccctggcacttgggcaagctggagatggatttcgatctgtgcgaggggaccaccgtcgtggtgacggaggactgcggcaaccgcggccccagcctccggaccaccacagccagcgggaagctgatcacggagtggtgctgccgctcctgcaccctgcctcctctccggtaccgcggcgaggatgggtgctggtacggcatggagattcggcccctgaaggagaaggaggagaaccttgtcaacagcctcgtgaccgccgggcatggccagatcgataacttcagcctgggcgtactggggatggccctcttcctggaggagatgctgcgtacccggatcggcacgaagcacgcgatcctcctagtcgccgtgagcttcgtaaccctgatcaccgggaacatgtccttccgcgacctcggccgagttatggtaatggtgggtgccaccatgacggacgacatcggcatgggtgtcacgtacttggcactgctcgctgcgttcaaggtgcggcctaccttcgccgcggggctgttactccgcaagctgaccagtaaggagctgatgatggcgactattgggatcgctctcctttctcagagcaccatccccgagaacatactggagctcaccgatgcgttagccctgggtatgatggttctgaagattgtccggaacatggagaagtaccagttggccgtgaccatcatggcgatctcctgcgtaccgaacgccgtcatcctgcaaaacgcgtggaaggtgagctgcacgatcctcgctgccgtgtccgtctctcccctgctgctcacatcctcacagcagaaagccgactggatccccttagcgctcacgatcaagggcctcaatcctaccgcaatcttcctgacgaccctgtcacgcacctcgaagaaacggtcctggccccttaacgaggccatcatggccgtgggcatggttagcatcctggcctccagcctgctcaagaacgacatccccatgaccgggccccttgtggcgggcgggctgctcacggtgtgctacgtcctgacaggccgcagcgccgatctcgagctcgagcgggccgccgacgtgaagtgggaggaccaggccgagatctccgggagctcccccatcctgagcataacaatttccgaggacggcagcatgtccatcaagaacgaggaggaagagcagaccctgacgatcctcatccgcaccggcctgctcgtgattagcggggtgttcccggtgtccatcccaatcaccgcggcagcctggtacctctgggaggtgaagaagcaaagagccggcgtcttatgggacgtaccgagcccgccgcccgtggagaaggcagagctggaggacggggcataccgcattaaacagcggggcatcctcgggtactcccagatcggggccggcgtctacaaggaggggacgttccacaccatgtggcacgtgacgcgcggcgcagttctgatgcatcgagggaagcgcatcgagcccagctgggccgacgtcaagaaggacctgatctcatacggagggggctggaagctcgagggcgagtggaaggagggagaggaggtacaggtgctggccttggaaccaggcaagaacccgcgggcggtccagacaaagcccgggattttcaagaccaacaccggcactatcggcgccgtgtcactcgacttcagccccggcacaagcggctccccaatcgtggacagaaaggggaaggtcgtcggcctgtacgggaacggcgtggtcacccggagcggcgcatacgtgtccgccatcgcgcagaccgagaaatccatcgaagacaaccccgagatagaggacgacatcttccgcaagaagcggctgacgatcatggacctccatcccggggcaggcaagaccaagcgctatctgcccgcaatagtgcgggaggctattaagcgcgggcttcgcacgctgatcctcgccccgacccgggtcgtggcggcggagatggaggaagccctgcgcggcctgcccatccgttaccagacgacagccatcaagaccgagcacaccgggcgcgaaatcgtggacctcatgtgccacgccacattcacaatgcgcctgctgagccccgtccgcgttcccaactacaacctcatcatcatggacgaggcgcacttcaccgacccggccagcatcgctgcccggggctatatcagcacccgcgttgagatgggcgaggccgcggggatctttatgacagccacgccgcccggctcccgggaccccttcccgcaaagcaacgcccccataatggacgaggagcgcgagatccccgaacgatcctggaacagcgggcacgagtgggtcaccgacttcaagggcaagaccgtctggttcgttccctccattaaggctgggaacgatatcgcggcctgcctgcgcaagaacgggaaaaaggtcatccagctgagccggaagacgttcgactccgaatacgtgaagacccgtgccaacgactgggacttcgtggtcaccaccgatatcagcgagatgggagccaactttaaggccgaacgagtgatcgaccctaggcggtgcatgaagccagtaatcctcacggacggggaggaacgggtcatcctggcggggcccatgcccgtgacccactccagcgccgcccagcgacgtgggcgcatcggccggaacccgaagaacgagaacgaccagtacatatacatgggggagccccttgagaacgacgaggactgcgcccactggaaggaggccaagatgctcctggacaatatcaacacccccgagggcatcatcccctccatgttcgagccggagcgcgagaaagtagacgcgatcgacggcgagtaccggctgcgcggggaggcccgtaagaccttcgtcgatctcatgcgccgtggcgacctgcccgtgtggttagcctacaaggtggccgccgaggggatcaactacgcggaccgcaagtggtgcttcgacggtattaagaacaaccaaatcctcgaggagaatatggaggtcgagatctggacgaaggagggggagcgaaagaagctgaagcctcgctggctggacgcccggatctattccgacccgctcgccctgaaggagttcaaggagttcgccgcggggcgtaagtccctgaccttgaacctgatcaccgagatgggccggctgcccacgttcatgacgcagaaggcgcgcaacgcactcgataacctggccgtgctgcacacggcggaggccgggggccgggcctataaccacgcccttagcgagctgcccgagaccctggagaccctcctgctgctcaccctgctggccaccgtgaccggtggcatcttcctcttcctgatgtccggcaaggggatcgggaagatgacgctggggatgtgctgcatcatcaccgccagcatccttctgtggtacgcgcagatccagccacactggatcgccgcctccatcattctggagtttttcctcatcgtcctgctgatcccggagcccgagaagcagcgcactcctcaggacaaccagctcacatacgtcgtcatcgccatcctgaccgtggtggccgcgaccatggccaacgagatgggcttcttggagaagacgaagaaggacctcggtctgggcagcatcaccacccaggagagcgagtccaacattctggacatcgatctccgtcccgccagcgcctggaccctgtatgccgtcgcgacgacttttgtgacgccgatgctgcgccactcgatagagaatagctccgtgaacgtcagcctcaccgccatagcgaatcaggccacggtcctgatgggccttgggaaaggctggcccctctccaagatggacattggggtgcccctgctggcgataggctgctacagccaggtcaacccaatcaccctcaccgccgccctgctcctcctggtggcccactacgccatcataggaccgggtctacaggcgaaggccacccgggaggcccagaagcgcgcggccgcaggcatcatgaagaaccccacggtagatgggattaccgtcattgacctcgagcccatcccctacgacccgaagttcgagaagcagctgggccaggtgatgctgctgatcttatgcgtgacccaggttctgatgatgcggaccacgtgggccctctgcgaagccctgaccctggccaccgggcccatctcgactctctgggagggcaaccccgggcgcttctggaacactactatcgccgtgagcatggcgaacatcttccgaggctcctacctggccggcgctgggctcctgttcagtatcatgaagaacaccaccaacacgcggcgcggaaccgggaacattggcgagaccctgggagagaagtggaagtcccggcttaacgccctcggcaagagcgagttccaaatctacaagaagtccggcatccaggaagtggaccgcacactggcgaaggaggggatcaagcggggcgagacggatcaccacgccgtcagccgcgggtccgccaagctgcggtggttcgtagagcgcaatatggttacccccgagggcaaggtcgtggacctcggctgcgggcggggcgggtggagctactactgtggcgggctgaagaacgtgcgcgaagtcaaaggcctgaccaagggcggcccaggccacgaggagcccatccccatgtccacctacggttggaacctggtgcggctgcagagcggcgtggacgtcttcttcacgcccccggagaagtgcgacaccctgctctgcgacatcggcgagagctctcccaaccccacaatcgaagccgggcgcaccctgcgggtgctgaacctcgtggaaaactggctgaataacaacacccagttctgcatcaaggtcctgaacccctacatgccgtctgtgatcgagaagatggaggccctccagcgcaagtatggcggggcgctggtgcgcaaccccttatcgcgcaacagcacgcacgagatgtactgggtctccaacgccaccggcaacatcgtgagctccgtgaatatgatctcgcggatgctgatcaaccgcttcaccatgaagcacaagaaggccacctacgagcccgacgtcgatctcgggtccggcacgcggaacatcggaatcgagagcgagatcccgaacctcgacattatcggcaaacgcattgagaaaataaagcaggagcacgagacttcctggcattacgaccaggaccacccatataagacctgggcgtaccacggcagctacgagaccaagcagacggggtccgccagctccatggtgaacggcgtggtacgtctgctcaccaagccctgggacgttgtacccatggtcacccagatggcgatgaccgacacgaccccgttcgggcagcagcgggtgttcaaggagaaggtggacacccgcacacaggaacccaaggagggcacgaagaagctgatgaagatcaccgccgagtggctgtggaaggagctcggcaagaaaaagacgccccggatgtgcactagagaggagttcacgcggaaggtccgcagcaacgccgccctgggggctatcttcaccgacgagaacaagtggaagtccgcgcgggaggccgtggaggacggccgcttctgggagctggtggacagggagcgcaacctccacctggaggggaagtgcgagacctgcgtctacaacatgatgggcaagagagagaagaagctaggggagttcggcaaagccaaaggcagcagagcgatctggtacatgtggctcggggcgcgctttctggagttcgaggccctgggctttctcaacgaggaccactggttctctcgcgggaacagtctgagcggcgtggagggggagggcctgcaccggctgggctacatcctgcgcgacgtggggaagaaggagggcggcgccatgtacgccgacgacaccgccggctgggacacgcgtatcaccctggaggacctcaagaacgaagagatggtcaccaaccacatgaagggggagcacaagaagttggcggaggccatcttcaagctgacctatcagaacaaggtggtacgcgtccagaggcccacgcctcgcggtacagtcatggacatcatctcccggcgcgaccagcgcggctcaggtcaggtcggcacctacgggctcaacacattcacgaacatcgaggcccagttgatccggcagatggagggcgagggcatcttcaaatccatccagcacctaaccgcaaccgaggagatcgccgtccagaactggctcgcgcgcgtcgggcgggagcgcctctctcgtatggctatttcgggagacgactgcgtcgtgaagccaatagacgaccgctttgctagcgccctgaccgccttaaacgatatggggaaggtgcggaaggacatccagcagtgggagccctcccgcggctggaacgactggactcaggtccccttctgcagccaccacttccacgagctggtgatgaaggacgggcgggtgttagttgtgccgtgccgcaaccaggacgagctcataggccgggcgcgcatttcccagggcgccgggtggtctctgaaggagaccgcctgcttaggcaagagttacgctcaaatgtggactctcatgtactttcaccggcgcgacctgcggctggccgcgaacgccatctgctctgccgtgccctcccactgggtccccaccagtcgcaccacttggtccattcacgccaagcacgagtggatgacgaccgaggatatgctcgccgtgtggaaccgggtatggatccaggagaacccgtggatggaggataagaccccggtcgagagctgggaggaggtcccctacctggggaagagagaggaccagtggtgcggaagtctgatcgggctcacgagccgggcgacctgggccaagaacatccagaccgccatcaaccaggtgagaagtctgatcggcaacgaggaatacaccgactacatgccctccatgaagcgcttccggcgcgaggaggaggaggctggcgtcctgtggtga

SEQ ID NO: 25051 - RNA, 9876 nt, synthetic construct
  misc_feature 1..9876: note = derived and/or modified CDS sequence (opt11) from DENV-2__FJ850053__SS-prME
  source 1..9876: mol_type = other RNA
actgcgggcgtcatcgtcatgctgatccccaccgccatggcgttccacctcaccacacgcaacggggaaccccatatgatcgtcggccggcaagaaaaggggaagtccctgctgttcaagaccgaagatggtgttaacatgtgcaccctcatggccatcgacctgggggagctgtgtgaagacaccattacctacaagtgcccgttactacgccagaacgagcctgaggatatcgactgctggtgcaacagcacctctacctgggtcacgtacggtacctgtaccaccacgggcgagcaccggcgcgagaagcggtcggtcgcccttgtgccccacgtcgggatgggcctcgaaacccgcaccgagacatggatgagctcggagggggcctggaagcacgtgcagcggatcgagacctggatcctacgccaccccggcttcacaataatggccgcgatcctggcctacaccatcggtacaacgcactttcagcgggctctcatttttatcttgctgacagccgtggccccgagcatgacgatgaggtgtataggtataagcaatcgggacttcgtcgagggcgtgtcggggggctcctgggtggacatcgtcctagagcatgggtcttgcgtgacgacgatggccaagaacaagcctaccctggatttcgagctgattaagaccgaggcgaagcagcccgccaccctccggaagtactgcatcgaggccaagctgacgaataccaccaccgaatcccggtgccccacacagggcgagccctcgttgaacgaggagcaggacaagcgtttcatctgcaagcattccatggtggatcggggttgggggaacggctgcgggctgttcggtaagggcggcatagtgacctgtgcaatgttcacgtgcaagaagaacatggagggcaaggtcgtacagcccgagaacttagagtacaccatcgtcatcacaccccacagcggggaggagcacgctgtggggaacgacaccgggaagcacggcaaggagatcaagatcaccccgcagtctagcatcaccgaggctgaactgaccgggtacggcacggtgaccatggagtgcagcccccgcaccggcttggactttaacgagatggtcctgctgcaaatggaggacaaggcatggcttgtgcacaggcaatggttcctggacctgcccctcccgtggctgccgggtgctgacacccaaggctccaactggatccagaaggaaacgctggtgaccttcaaaaacccacacgcaaagaagcaggacgtcgtggtcctcgggtcccaggagggtgccatgcacaccgccctgaccggggccacggagatccagatgagcagtgggaacctcttattcaccggccacctgaagtgccgcttacggatggacaagctccagctgaagggtatgtcctactcgatgtgtaccggtaagttcaagatagtgaaggagatcgcagagacccagcacggtactatcgtgatccgcgtccagtacgaaggcgacggctccccctgcaagattccattcgagatcaccgacctggagaagcggcacgtgctcgggcgcctgataaccgtgaatccgatcgtcacagagaaggacagccccgtgaatatcgaagcggagcctccctttggagactcctacatcatcatcggggtcgagccgggacagctgaagctcaactggttcaaaaaggggagctccatcggtcagatgttcgagactaccatgcgcggcgcaaagcggatggcgatcctgggggacacagcctgggacttcggcagcctcgggggcgtcttcacctccataggtaaggccctccaccaggtgttcggcgctatctacggcgcagccttcagtggggttagctggacgatgaagatattaatcggtgtcatcatcacgtggatcgggatgaacagccgcagcaccagtctgtcagtgtctctggtgctcgtcggcgtggtaaccctataccttggggccatggtccaggcggactccggctgcgtggtgtcgtggaagaacaaggagctcaagtgcggctccgggatcttcatcacggataacgtacacacctggaccgagcagtataagttccagcccgagagccccagcaagcttgcttccgccattcagaaggcgcacgaagagggcatctgcgggatccggagcgtgacgcgtctagagaacctcatgtggaaacagatcacccccgaactgaaccacatactgtccgagaacgaggtcaaactcaccattatgaccggcgacatacgagggataatgcaggcaggcaagcgcagccttcggcctcaaccaaccgaactgaagtacagttggaagacatggggcaaggctaagatgctctccaccgagcctcacaatcagacattcctgatcgacggtccggagaccgccgagtgccccaatacgaatcgcgcctggaattctctggaggttgaggactacggcttcggtgtgttcaccactaatatatggctcaaattacgagagaagcaagatgtgttctgcgacagcaagctgatgtccgcagccatcaaggataaccgcgcggtccacgctgacatgggttactggattgagagcgccctaaacgacacctggaagatggagaaggcctccttcatcgaggtaaagagctgccactggcccaaatcgcacaccctgtggtcgaacggcgttctggagtccgagatgatcatccccaagaacttcgccgggcctgtcagccaacacaattatcgacccggataccatacgcagaccgcgggaccctggcacctcgggaaactggaaatggacttcgacctgtgcgaggggaccacggtggtcgtcaccgaggactgcggcaacagaggtccctccctccggaccaccaccgccagcggaaagctgatcacggagtggtgctgtcgctcctgcaccctgccgccactcaggtatcgtggagaggacggatgctggtacggcatggagattaggcccctgaaggaaaaggaagagaacctggtgaacagtcttgtgaccgccgggcacggccagattgacaatttcagcctgggcgtcctcgggatggccctctttctggaggagatgctgcgcacgcggatcggcaccaagcacgctatcctcctggtggctgtgtccttcgtcaccctgatcaccggtaacatgtcctttcgcgacctcgggcgcgtgatggtcatggttggggccaccatgacggacgacatcggtatgggcgtgacctacctggccttactcgctgcattcaaggttcggcccacgttcgccgccggtctgctactacgcaagctgacctccaaggagctgatgatggccacgatcggaatcgccctcttgtctcagagtaccatccccgaaaccatcctggagctcaccgacgcactagcgctgggcatgatggtactcaagatcgtgcggaacatggagaaataccaactggccgtgacgatcatggccatcagttgcgtccccaacgccgtgatcctgcagaacgcgtggaaggtatcttgcaccatcttagccgccgtcagcgtgagccccctgctactcaccagctcccagcagaaagccgattggatccctttagcgctgaccataaagggcctcaacccgaccgccatcttcctgaccaccctgtcgaggacctccaagaaacgtagctggcccttgaatgaagccatcatggccgtcgggatggtatccatcctggcctcttccttactgaagaacgacatccccatgacggggcccctggttgcgggcggcttgctcaccgtctgttacgtgttaacgggacgcagcgccgacctggaactcgagcgggccgccgacgtgaagtgggaggaccaggccgagatctcagggtcaagtccgatcctgtccatcaccatcagcgaggacggctccatgagcatcaaaaatgaagaagaggagcagacgcttaccatcctcatccgcaccggcttactggtcataagcggagtgttccccgtgagcatccccatcaccgcggctgcgtggtacctctgggaagtgaagaagcagcgggccggcgtgctatgggacgtgccctccccgccgccagtcgaaaaggccgaactggaggatggggcgtaccgcatcaagcagcggggcatcctcgggtactcgcagatcggggccggcgtctacaaggagggaaccttccacacgatgtggcatgtgaccagaggcgccgtcctgatgcaccgggggaaacgcatcgagccatcctgggccgacgtgaagaaagacctgatcagctacggggggggctggaagctcgagggcgagtggaaggagggggaagaggtgcaggtgctagccctggagcccggcaagaacccccgagcggtgcagaccaagcccggaattttcaaaaccaacacgggcacgatcggagccgtgagcttagacttttcgccgggaacctctggcagcccgattgtggaccgcaaggggaaggtggttgggttgtacgggaacggtgtcgtgactcgatccggagcatacgtgtctgccatcgcgcagacggagaaatccatcgaagacaaccctgagatcgaggacgacattttccgcaaaaagagactaaccatcatggaccttcaccccggggccggtaagaccaagagatatctgccggccattgtacgggaggccataaagcgtgggctgcgcacactgatactcgcccccacacgtgtggtggctgccgagatggaggaggcgctgcgcggtctccccatccggtaccagaccaccgccatcaagaccgagcacactggccgcgagatcgtggacctcatgtgccacgccactttcaccatgcggctgctaagccccgtgcgcgtgccgaactacaacctcatcatcatggacgaagcgcactttaccgaccccgcatcaatcgccgcccgaggatacatatccacccgagtcgagatgggcgaggccgcgggcattttcatgaccgcaacaccgcccggcagccgggacccgttcccccaatccaacgccccgatcatggacgaagaacgcgagattccagagaggtcatggaacagtggacacgagtgggtgaccgacttcaagggcaagacggtgtggttcgtgccgagtatcaaggccgggaatgacatcgcggcctgcctgcgcaagaacggcaagaaggtgatccagctctcacggaagaccttcgacagcgagtacgtaaagactcgcgccaacgactgggacttcgtcgtgactacggacatctcagagatgggtgccaacttcaaagcagagcgggtgattgacccccgtcggtgcatgaaacccgtaatccttaccgatggcgaggagcgcgtgatcctagcgggaccaatgccggtgacccacagctccgccgcccagcggcgcgggagaatcggtcggaaccccaagaacgagaacgaccagtacatctacatgggggagccactggagaacgacgaggactgcgcgcattggaaagaggcgaagatgctgctggataatatcaatacgcccgagggcataatccccagcatgttcgagcccgagcgcgaaaaggtcgatgcgatcgacggcgagtaccggttgcgcggggaggcccggaagacgttcgtcgatctcatgcgccgtggcgatctccccgtgtggttagcctacaaagtcgcagcggaggggattaactacgcggatagaaagtggtgtttcgacggcatcaagaacaaccagatcctcgaggagaacatggaggtggaaatctggacaaaggaaggggagcggaagaagctgaagcctcgctggctggatgctcggatctactccgacccgctcgccttaaaagagttcaaggagtttgcagcgggccgaaagagcctgaccctcaatctcatcaccgagatgggcagactgcctacgtttatgacacaaaaggccaggaacgccctcgataacctggccgtgcttcacaccgccgaggccggcggccgggcctacaaccacgccttatcagaactgcccgaaacccttgagacgctcctgctgctcaccctgctggctaccgttaccggaggcatcttcctcttcctgatgagcggcaaggggatcggcaagatgaccctggggatgtgctgcataatcacagcctctatcctactatggtacgcgcagatccagccgcactggatcgccgccagcatcatcctggaattcttcctcatagtgctgttgattcccgaacctgagaagcagcgtacgcctcaggacaaccagctcacctacgtggtcatcgcgatcctgaccgtggtcgccgcgacgatggccaacgagatgggctttctggagaaaaccaagaaggatctcgggctgggctccatcaccacgcaggagtctgagagcaacatcctggacatcgacctacgacccgcatccgcctggacgctatacgccgtcgcgaccactttcgtgacccccatgttacgccatagcattgagaactccagcgtcaacgtgtcacttacggctatagctaaccaggctaccgtcctgatgggtctggggaagggctggcccctcagcaagatggacatcggcgtcccgcttctagcaatcggctgctactcccaggtgaatccgatcaccttgacggctgccctgctgctactggtggcccactacgccatcatcgggcccggcctgcaagctaaggccacgcgggaagcccagaagagggctgccgcgggcatcatgaagaacccaacggtggacgggataaccgtgattgaccttgaacccatcccttacgaccccaagttcgagaaacagctgggccaggtgatgctattgatcctgtgcgtcacccaggtgctcatgatgcggacgacctgggccctctgcgaagccttgaccctggcgaccggtccgatcagcacgctctgggaggggaaccccgggcgcttctggaacaccaccatcgccgtgtccatggcgaacatcttccgcggaagctacttggccggcgctgggctcctgttttcgataatgaagaacaccacgaacacccggcgcgggacggggaacataggggagaccctgggggagaaatggaagtcccggctgaatgccctggggaagtccgaattccagatatacaagaagtccggtatccaggaggtcgacagaacgctggccaaagagggtatcaagcggggcgaaaccgaccatcacgcggtgtcccgcggttctgccaagctgcggtggttcgtggagcgcaacatggttaccccggaaggtaaggtggtggacctcggctgcgggcggggcgggtggagttactactgcggcgggctgaagaacgtccgcgaggtgaagggcctgacaaagggcggtccaggccacgaggagcccatccctatgagcacctatgggtggaacctcgtgcggctacagtccggcgttgacgttttcttcactccgcccgaaaagtgcgacactttgctctgcgatatcggagagagcagccccaaccccaccatcgaggccggccgaaccctgcgggtgcttaacctcgtcgagaactggctcaacaacaacacacagttctgcatcaaagtactgaacccgtacatgccatccgtgatcgagaagatggaagctctccagagaaaatacggcggggccctggtaaggaaccccctgtcacgcaactccactcacgagatgtactgggtgagcaatgccaccggcaacatcgtgagttctgtcaacatgatctcccggatgcttataaaccgcttcaccatgaagcacaagaaggccacgtacgagccggacgtggatctcgggagcggcacccgaaatattgggatcgaatctgagattcccaatctggacataatagggaagcgcatcgagaagataaagcaagagcacgagacatcctggcactatgaccaggaccacccctataagacctgggcctaccacggctcgtacgaaactaaacagaccgggtcggcctccagcatggttaacggcgtcgttcgcctgctcactaaaccgtgggacgtggtcccaatggtgacgcagatggcgatgactgacaccacacccttcgggcaacagcgggtattcaaagaaaaggtcgacacccgcacgcaggagcctaaggagggcactaagaaattaatgaagatcaccgctgagtggctgtggaaggagctcgggaaaaaaaagactccccggatgtgtacgcgcgaggagttcacccggaaagtgcgctccaacgccgctctgggggctatcttcaccgacgaaaacaagtggaagtccgcgcgagaggccgtagaggacggccgcttctgggagcttgtcgaccgagaacgcaacctccacctggaggggaagtgcgagacatgcgtatacaacatgatgggaaaacgggagaagaaactaggggagttcggcaaggccaagggctcccgcgcaatctggtacatgtggctcggggcgcggttcctggagttcgaagccctgggcttcctcaacgaggaccattggtttagccgcgggaactccctgtccggggtggagggggaggggctgcatcgcctcggctacatcctgcgcgacgtcgggaagaaggaaggcggggcgatgtacgctgacgatacggcgggctgggacacgcggattaccctggaagacctcaagaacgaggagatggtgaccaaccacatgaagggggagcacaagaagctggcggaggccatctttaagctgacgtaccagaacaaagtcgtgcgcgtgcagcgtccgacgccgcgcggaaccgtcatggatattatcagccgacgcgaccaacgcggctccgggcaggtcggcacctatgggctcaacacgttcactaatatggaggcccagttaatccgacaaatggagggcgaaggcatcttcaagagcatacagcacctgactgccactgaggaaatcgccgtgcagaactggctcgcccgcgtcgggcgggagcgcctgtcccggatggccatctccggcgacgactgcgtagtgaagcccatcgacgatcgctttgcctccgcactgaccgccttgaatgacatggggaaagttcgtaaggacatccaacagtgggagccctcgcgcggctggaacgactggacccaggtgccgttctgctcccaccacttccacgaactggtcatgaaagatggacgcgtcctggtcgtgccctgccggaatcaggacgagctcatcgggcgggcccgcatctctcagggcgccggatggtctcttaaggagaccgcctgcctgggcaaaagctacgcccagatgtggaccttaatgtattttcatcgacgcgatctgcggctagctgcgaacgccatctgttccgcggttccctctcactgggtcccaacttcccgcacgacgtggagtatccacgctaaacatgaatggatgaccaccgaggacatgcttgcggtgtggaacagggtatggatacaggagaacccgtggatggaggacaagacgcccgtggagagctgggaagaggtcccctacctggggaaacgcgaggaccagtggtgtggttcactaattgggctcacctcccgggccacatgggccaagaacatccagaccgccatcaatcaggtgcgctcactcatcggtaacgaagaatatacggactacatgccctcaatgaagcgcttccggcgcgaggaggaggaggccggcgttctgtggtga

SEQ ID NO: 25052 - RNA, 9876 nt, synthetic construct
  misc_feature 1..9876: note = derived and/or modified CDS sequence (opt11) from DENV-2__JN819420__SS-prME
  source 1..9876: mol_type = other RNA
accgccggcgttatcgtgatgctgattcccaccgcgatggcgttccatctcaccactaggaacggggagccccatatgatcgtgggccggcaggagaaggggaagagtctgctgttcaagaccgaggacggagttaacatgtgcaccttgatggccatagatctgggggagctgtgcgaggacactattacctacaaatgcccccttctacgccaaaacgaacccgaggacatcgactgctggtgcaacagcacctcgacctgggtcacctacggcacttgcacaaccacgggcgagcatagacgcgaaaagcggtccgtagcgctggtgccccacgtagggatgggccttgagacccgcaccgaaacttggatgagcagtgaaggggcctggaaacatgttcagagaatcgagacctggatcctgcgtcacccggggttcaccatcatggccgcgatcctggcctacaccatcgggaccacgcacttccaacgggcactaatattcatcctgctgaccgccgtggcgccctcgatgaccatgaggtgcatcggcatttccaaccgggatttcgtcgagggcgtgagcgggggttcctgggtggacatcgtactcgagcacgggagctgcgtgaccacgatggccaagaataagcccaccctggacttcgaactgatcaagacggaggcaaagcagcctgcgactctccgaaagtactgcatcgaggccaagctaacgaacaccaccacagagtcgcggtgtccgacccagggcgagccctctctgaacgaggagcaggacaagcgcttcatttgcaagcactccatggtggacagaggctggggaaacggctgcgggttgttcggcaagggcgggatagtgacctgtgccatgttcacttgcaagaagaacatggagggcaaggtggtgcaacccgagaacctggagtacacaatagttattacaccccactcgggggaggaacacgccgtgggcaacgacacagggaagcacggcaaggagatcaagataaccccgcagagtagcatcacagaggcagagttgaccgggtacggcacagtgaccatggaatgctcacccaggaccggcctcgatttcaacgagatggtcctgttacagatggaggacaaggcctggctcgtgcaccggcagtggttcctggacttaccccttccctggttaccaggagccgacacccagggatcgaactggatccaaaaggaaacgctggttaccttcaagaaccctcacgcgaagaagcaggatgtcgtggtcctcgggtcccaggaaggtgcaatgcatacagccctaaccggagcaacggagatccagatgagctctggcaacctcctcttcaccggccacctgaagtgccgcctgagaatggacaagctccagttaaagggcatgtcgtacagtatgtgcaccggcaaattcaagatcgtgaaggaaattgccgagacccagcacggaacgatcgtcatacgcgtccagtacgaaggggacggctccccctgcaagatacccttcgaaatcaccgacctagaaaagcggcacgtgctggggcgccttatcacagtgaaccccatcgtcaccgagaaggactctcctgtgaacatcgaggcggagccgcccttcggcgactcctacatcatcatcggggtcgaaccgggccaactgaaactcaactggttcaagaaaggaagctccatcggccagatgttcgaaacgacgatgcgcggcgccaagcggatggccatcctgggcgacaccgcctgggacttcggcagcctcgggggcgtcttcacttcaatcgggaaggccctccaccaggtgttcggcgcgatctacggcgccgccttcagcggggtgtcctggacgatgaaaatcctaatcggcgtcatcattacctggatcggcatgaattctcgctccacaagcttatccgtaagcctggtgctcgtaggcgtggtgaccctgtacctaggggccgtcgttcaggcggactccgggtgcgtggtgagttggaagaacaaggagctcaagtgcggctccgggatttttatcacggacaacgtgcacacctggaccgagcaatacaaattccagcctgagagcccttcgaagctggcatccgctatccagaaggcccacgaggagggcatctgcgggatccggtctgtgacccgcctggaaaacctaatgtggaagcaaattacaccggagctaaaccacatcctgtccgagaacgaggtcaagctgaccatcatgaccggggacatcaaggggatcatgcaagccggcaaacggagcctgcgcccgcagcctaccgagctgaagtattcctggaagacgtggggcaaggccaagatgctgtctactgagtcccacaaccaaaccttcctgatcgacgggcccgagaccgccgagtgcccgaacacaaaccgcgcttggaacagcctggaagtggaggattacggttttggggtgtttaccacgaacatatggctcaagctgcgcgagaagcaggacgtcttctgtgactccaaactgatgagcgccgcaatcaaggacaatcgggccgtacacgcggacatgggctactggatcgaaagtgcccttaacgacacctggaagatggagcgggccagcttcatcgaggtcaaatcctgccactggcccaagagccacaccctgtggtccaacggcgttctggagagcgagatgatcatccccaagaacttcgccggtccagtgtcccagcataattataggccgggctaccacacgcaaaccgcgggaccctggcacctcggcaaactggagatggacttcgatttctgcgaggggactaccgtggtcgtgacagaggactgtggcaaccgcggcccatctcttcgtacaacaaccgccagcgggaaactgatcacagagtggtgctgccgatcctgtaccctgcccccgcttcggtaccggggcgaagacggttgttggtacggcatggagatccgtcccctcaaggagaaagaagagaacctggtgaacagcctggtcaccgccgggcacggccagatcgacaacttctccttaggcgtgctggggatggccctgttccttgaggagatgctgcgtacccgcatcggtacgaagcacgcaatattgctcgtggccgtcagcttcgtgaccctgatcaccgggaacatgtccttcagagacctgggacgcgtgatggtcatggtgggcgcaaccatgaccgacgatatcggcatgggcgtgacctacctcgctctgcttgccgccttcaaggtccggcccacattcgccgccgggctcctgctacgtaaactcaccagcaaggagctgatgatggccacgatcggtatcgcactgctctcccaaagcaccatccccgagaccatcctggagctgacggacgctctcgccttagggatgatggtgctgaagatcgttcggaacatggagaagtaccaactagccgttacgatcatggccatctcctgcgtgcctaacgccgttatcctgcagaacgcttggaaggtctcatgtacgatcctggccgccgtgtcggtcagccccctcctgctgacctcctctcaacagaaggccgactggattccgctcgccctgaccatcaagggcctgaaccccacggcaatctttctgaccactctgtcccgcaccagcaagaagcggtcctggccgctgaacgaggccatcatggccgtgggaatggtttctatactagcctccagcctgctcaagaacgacatccccatgacggggcccctcgttgcgggcgggctgctgaccgtgtgctacgtgttgacggggcgcagcgccgacctagagttggagcgggctgctgacgttaagtgggaagatcaggccgagatctccgggtcctcacccatcctcagcatcacgatctccgaagacggcagcatgtccatcaagaacgaggaggaagagcagactctgactatactgattaggaccggccttctcgtgattagcggggtgttcccggtcagtatccccatcaccgcggccgcctggtacctgtgggaggtcaagaagcagcgggccggggtgctatgggacgtccccagcccgccgcccgtggagaaggcagagctagaggacggggcgtaccgtattaagcagagaggcatcttaggttactcccaaatcggcgccggtgtgtataaggagggcaccttccacactatgtggcacgtcacccgaggagcggtgttaatgcatcgggggaagcgcatcgagccgagctgggcggatgttaagaaggacctgatttcctacgggggaggctggaaactggagggcgaatggaaggaaggggaggaggtccaggtccttgccctagaacccggaaaaaacccccgggcagttcagaccaagcccgggatcttcaaaaccaacacgggcacaatcggggccgtctccctggacttctcccccggcacaagcggctcccccattgtcgaccgcaaagggaaagtcgtcggcctctatgggaacggcgtggtcacccggagtggcgcatacgtgtccgcgatcgcgcaaaccgagaagtccatcgaggataaccccgaaatcgaggacgacatcttccgcaaaaagcggctgaccatcatggacctgcaccccggggctggcaagaccaagcgctatctcccagccatcgtgcgggaagccatcaaacgcgggctgaggaccctgattctggccccgacgcgggtggtagcggccgagatggaagaggccctacggggcttgcccattcggtaccagacccccgccattaagaccgaacacaccgggcgcgagatcgtggacctgatgtgccacgccacgttcaccatgcgactcctgagccccgtgcgcgtcccgaactacaaccttataatcatggatgaggcgcacttcaccgaccccgccagtatcgccgcccggggctacatcagcacccgcgtggagatgggcgaggccgcggggatcttcatgacggctacgccgcccggctctcgggacccgttcccccagtcaaacgcccccataatggacgaggaacgagagatccccgagcggtcgtggaacagcggtcacgagtgggttaccgattttaagggaaagaccgtctggttcgtaccgtcgatcaaggcggggaacgacatcgcggcctgcctccgcaaaaacggcaaaaaggtgatccagctgtcacggaagacttttgactcggagtacgtcaaaactcgggcgaatgattgggacttcgtggtaaccaccgacatcagcgagatgggggcaaacttcaaggccgagcgggtgatcgatccccgccggtgcatgaagcccgtgattctgacagactcggaggagagggtgatcttagcggggcctatgccggtcacccattctagcgcggcccagagacgcggacgcattggacggaaccccaaaaacgagaacgatcagtacatttacatgggcgagccgctggagaacgacgaggactgcgcccactggaaggaggccaagatgctgctcgataacatcaacacgccagaggggatcatcccgagtatgttcgaaccagagcgcgagaaggtagacgccatcgacggggagtaccgactacgcggcgaagcgcggaagacgttcgtcgacctcatgcgccgcggggacctccctgtctggctggcctataaggtggcagcggagggcataaactacgctgaccgcaaatggtgcttcgacgggatcaagaacaaccaaatcctggaggaaaacatggaggtggagatctggacgaaggaaggcgagcggaaaaagctcaagccgaggtggcttgacgcacggatctattccgaccctctggccctcaaggagttcaaggagtttgccgcgggccgcaagagtttgaccctgaacctcatcaccgagatgggacggctgcccacattcatgacgcagaaggccagaaacgccttagacaacttggccgttctgcacaccgccgaggccggcgggcgggcctacaaccacgcgttgtccgaactccccgagaccctcgaaaccttactactgctgaccctcctggccaccgtgaccggcgggatcttcctcttcctcatgtcgggcaagggcatcggaaagatgacccttggcatgtgttgcatcataacggcttcgatcctgctctggtacgcgcagattcagccgcactggatcgccgccagtatcatcctggagttcttcctgatcgtactcctgatcccggagcccgaaaaacagcgcaccccccaagataaccagctgacgtacgtggtgattgccattctcaccgttgtagcggccaccatggccaacgagatggggtttttagaaaagacgaaaaaggatttaggcctcgggagtatcaccacccaagaatccgagagcaacatcctggacatcgacctgcggcctgcgtccgcatggacactgtacgccgtggcgacgacctttgttacacccatgctccgccacagcatcgaaaactccagcgtcaatgtgtccctcaccgctatcgccaatcaagccacagtgctcatgggcctgggcaaagggtggcccctgtcaaagatggacatcggcgtgccgctcctcgcgatgggctgctactctcagttcaaaccgattaccctgactgccgcgctattgctgctcgtagctcattatgctatcatcggtccggggctgcaggccaaggccacccgggaagcccagaagcgcgccgccgctggcattatgaagaaccccacggtcgatggcattaccgtcatcgacctggagcccatcccgtacgaccctaagttcgagaagcagctcggtcaggtcatgcttttgatcctgtgcgtaacccaggtgctgatgatgcggaccacgtgggcgctgtgcgaggctctcacactggccaccggtccaatcagtaccctttgggagggaaacccgggccgcttctggaacactaccatcgccgtttccatggcgaatatattccgcgggtcatacctcgccggcgccggcctgctgttttccattatgaagaataccacctctacgaggcgcggcacaggcaacataggggagacgctcggcgagaagtggaagtcccggctgaacgccttgggcaagagcgagttccagatctataagaaatcagggatccaggaggtcgaccgcacactcgcgaaggagggcatcaagcgcggtgagactgaccaccacgccgtgagccgcggctccgcgaaactgcggtggttcgttgaacggaatatggttaccccggaggggaaggtggtggacctgggctgcggccgtgggggctggagctactactgcggtggactcaagaacgttcgcgaggttaaagggctgacgaagggcggccccgggcacgaggagcccatccccatgtccacctacggctggaatctggtgcggcttcagtccggggtggacgtcttcttcactcctcccgagaaatgcgacaccctactgtgtgatatcggcgagagctcccctaatccgacaatagaggccgggcgaactctccgggtgctgaacctcgtcgagaattggttgaacaacaatacccagttctgcatcaaggtgctcaacccttacatgcccagcgtaatcgagaagatggaggccctacagagacagtacggtggcgcgctcgtccgcaaccccctgtcccgcaacagcacgcacgagatgtattgggtgagcaacgccaccgggaacattgtgagctcagtgaatatgatctcccggatgctgatcaatcgcttcaccatgaagcacaagaaagccacctacgagccggacgtggacctgggctccgggacgcggaatatcggcatagagagcgaaatcccgaacttagacataatcggcaaaagaatcgagaaaattaagcaggagcacgagatcagttggcactacgaccaggaccacccctacaagacctgggcctaccatggatcgtatgagaccaaacaaaccggctccgcttcctccatggtaaatggggtcgtgcgcctgctgacgaagccctgggacgtggtgccgatggttacccagatggcgatgaccgacacgacgcccttcggccagcagagagtctttaaggaaaaggtcgacacccgcacacaagaacccaaggaagggacgaagaagctcatgaagatcacggccgagtggctatggaaggaactgggtaagaagaaaacgccccgcatgtgcacccgcgaggaattcaccaagaaggtgcggtctaacgcagccctcggagccatctttacggatgaaaacaagtggaaatccgctcgcgaggccgtggaggacgggcgtttctgggagctggtcgaccgcgagcggaacctgcatctcgagggcaagtgcgagacctgcgtgtacaacatgatggggaagcgagagaagaagctgggcgagttcggtaaggccaagggaagccgggccatctggtacatgtggttaggggccaggttcctcgagttcgaggctctgggattcctgaatgaggaccactggttcagccggggcaactccctctctggtgtggaaggcgaggggctgcatcgcctgggctacatcctccgggacgttggtaagaaagaaggcggcgcaatgtacgccgatgacaccgccgggtgggacaccaggatcacgctggaggacctgaagaacgaggaaatggtgaccaaccacatgaaaggagagcacaagaagctcgcggaggccatcttcaaactgacctaccagaacaaggtcgtgcgagtgcagcgccccacccctcgcgggaccgtcatggacatcatcagcaggcgggaccagcgcggttctggccaggtggggacctacggcctgaacaccttcaccaatatggaggcccagcttatacggcagatggaaggggagggcattttcaagtccatccagcacctgacagccaccgaggagatagcagtgcaaaactggctggcgcgggtaggccgggagcggctcagccgaatggccatctccggggatgactgcgtggtaaagccgattgacgaccggttcgccagcgccctgacggccttaaacgacatgggcaaggtcaggaaggacatccagcaatgggagccatcccgggggtggaacgactggacccaggttccattctgcagccaccactttcatgaactggtaatgaaggacggccgggtccttgtggtgccctgtcggaaccaggacgagctgatagggcgcgcgcggatcagtcaaggcgccggctggagcttgaaggagacggcctgtctggggaagtcctacgcccaaatgtggacactgatgtactttcaccgccgggacctccgcctggctgcgaacgcaatctgcagcgctgtcccctcccactgggtgcccactagccggaccacctggtccatacacgccaaacatgagtggatgacgacggaggacatgctagcggtgtggaacagagtctggatccaggagaacccgtggatggaggacaagacccccgtggagtcctgggaggaggttccctatctcggcaagcgggaggaccagtggtgtggttcactgatcggtctgacctcccgcgccacgtgggccaagaacatccaaaccgcaatcaatcaggtcagatccctcatcggaaacgaggaatataccgattacatgccatctatgaagcgctttcgccgcgaggaggaggaggccggcgtcctgtggtaa

SEQ ID NO: 25053 - RNA, 9876 nt, synthetic construct
  misc_feature 1..9876: note = derived and/or modified CDS sequence (opt11) from DENV-2__FJ850118__SS-prME
  source 1..9876: mol_type = other RNA
accgccggcgttatcgtcatgctgatccccaccgctatggcgttccacctcaccacccgcaatggggagccccacatgattgtggggcgtcaggagaaggggaagtccctactattcaaaaccgaggacggggtgaacatgtgcaccctcatggccatcgacttgggggaactctgcgaggacaccatcacctacaagtgtccccttctgcgccagaacgagcccgaggacatcgattgctggtgcaacagcaccagcacctgggtcacgtatgggacctgtacaaccacgggcgagcaccggcgcgagaagcggtccgttgccctggtgccccacgtcgggatgggcctcgagacccgcaccgagacctggatgagttccgagggggcctggaagcacgtgcagcggatcgaaacgtggatcctgcgccacccgggcttcaccataatggccgctatcctggcctacaccatcggcaccacgcatttccagagggcgctcatcttcatcttactgaccgccgtggcgcccagcatgaccatgcgctgcatcggtatctccaacagagattttgtcgagggcgtgagcgggggctcctgggtggacatcgtcctggagcatgggagctgcgtgaccacgatggccaagaacaagcctaccctggacttcgagcttatcaagaccgaggccaagcagcccgccaccctccgaaagtactgcatcgaggccaagctgacgaacaccaccaccgagagtcgttgccctacacaaggcgagcccagcctgaacgaggagcaggacaagcgcttcatctgcaagcactccatggtcgaccggggctggggaaatggctgcgggctgtttggcaagggcggcatcgtgacctgcgcgatgttcacctgcaagaagaacatggagggcaaggtggtgcaacccgagaacctggagtataccatagtcatcacgccccacagcggagaggagcacgccgtgggcaacgacacagggaagcacggcaaggagatcaagatcaccccgcagtccagcatcaccgaagcggagctgaccgggtacggcacggtcaccatggagtgttcaccccgcactggcctcgactttaacgagatggttctgctgcagatggaagacaaggcatggctcgtgcaccggcagtggttcctggacttaccactcccctggctgccgggggccgacacccagggcagcaactggatccagaaggagacactggtgaccttcaagaacccccacgcgaagaagcaggacgttgtggtcctcgggtcacaggagggcgcgatgcacaccgccctgaccggggccacggagatccaaatgtcgagcggcaacttgctgttcaccggccatctgaagtgccgcttgcggatggacaagctccagctgaaggggatgtcctacagcatgtgcaccggcaagttcaagatcgtgaaggagatcgccgagacccagcacgggacgatcgttatccgtgtgcagtacgagggagacggctccccctgcaagatacccttcgagatcaccgacttggagaaaaggcacgttcttgggcggctgatcaccgtgaacccgatcgtcaccgagaaggacagtcccgtgaacatcgaggcggagccaccgttcggcgactcctacattatcataggggtggagccgggccagctgaagctcaactggtttaagaaggggagtagcatcggccagatgtttgaaacgaccatgcgcggcgccaagcggatggccatcctgggggacaccgcctgggacttcggaagcctcgggggggtcttcaccagcattgggaaggccctccaccaggtcttcggtgcgatctacggcgccgccttttcgggggtgtcctggacgatgaagatcttaatcggcgtcatcatcacctggatcgggatgaatagccgctccacctcattatctgtgagcctggtgctcgtcggtgtggtgacactgtacctgggggcgatggtgcaggcggactccggatgcgtggtgagctggaagaacaaggagttgaagtgcggctccgggatcttcatcacggacaacgtccacacctggaccgaacagtacaagtttcagcccgagagcccctctaagctagcctccgccatccagaaggcccacgaggagggcatctgcgggatccggagcgtaacccgccttgagaacctcatgtggaagcagatcacgcccgagctgaaccacatcctgtccgaaaacgaggtgaaactgaccatcatgaccggcgacatccgggggatcatgcaggccggcaaacgcagcctgcggcctcagcccaccgagctaaagtactcctggaagacgtggggcaaggcgaagatgctcagcaccgaatcccacaaccagaccttcctaatagacggacctgagacagcagagtgccctaacacgaacagggcctggaacagccttgaggtcgaggactacggcttcggggtgttcaccaccaacatttggctcaagctgcgggagaagcaggacgtgttctgtgactccaagttgatgagcgccgctatcaaggacaaccgcgcggtccacgccgacatgggctactggatcgagtccgccctcaatgacacctggaagatggagaaggccagcttcatcgaggtgaagtcctgtcactggcccaagagccacaccctgtggagcaacggcgtgctggagtcggagatgatcatccccaagaacttcgccgggcccgtctcccagcacaactaccggccgggttatcacactcagaccgcggggccgtggcacctcgggaagctggagatggactttgacctgtgtgagggaaccaccgtagtggtcacggaggactgcggcaatcgcggccccagcctccggaccaccacagccagcgggaagctgatcacggaatggtgctgccgcagctgcactctgcccccgctccgttaccgtggcgaggacggttgctggtacggcatggagatcaggcccctgaaggagaaggaggaaaacctggtgaacagcctagtgaccgccgggtacggccagatcgacaacttctccctgggggtcttggggatggcccttttcctggaggagatgctgaggacccggatcggaacgaagcacgcgatcctcctggtggccgtgagcttcgtcacgctgatcactgggaacatgtccttccgcgatctcgggcgcgtgatggtgatggtcggggccaccatgacggacgacatcgggatgggggtgacctacctggccctgctcgccgcgttcaaagtacggcccaccttcgcggccggactgctgctcagaaagctgacgagcaaagagctgatgatggccacgatcggcatcgccctcctgtcacaaagcaccatccccgagaccatactagagctcaccgacgcgcttgccctggggatgatggtcctgaaaatagtgcggaacatggagaagtaccagctggccgtgacgatcatggccatctcctgtgtcccgaacgccgttattttgcaaaacgcctggaaggtatcttgcaccatcctcgcggccgtctccgtgtctcccctgctgcttacctcctctcaacaaaaggctgactggatcccccttgccctgaccatcaagggcctcaaccccacggctattttcctgacgaccctatcccgcaccagtaaaaagcggtcctggccgctcaacgaggccatcatggccgtcggcatggtgagcattctggcctccagcctgctcaagaacgatatccccatgacaggacccctggtggcgggcgggctgctcaccgtctgctacgtgctgaccggccgcagcgccgatctagagcttgagcgcgccgccgacgtgaagtgggaggaccaggccgagatttcagggagctctcccatcctgagcatcaccatcagcgaggacggcagcatgtccatcaagaacgaggaggaggagcagacgttgaccatcctcatccgtaccggcttgctggtcatctcgggggtgttcccggtgtctatccccatcaccgcggctgcctggtatctctgggaggtcaagaaacagcgagccggcgtgctgtgggacgtaccctctccgccgcccgtcgagaaggccgaactggaggatggggcgtaccgcatcaagcaacggggcatcctcgggtactcccagattggagccggcgtgtacaaggaggggaccttccacacgatgtggcacgtaacccggggcgcagtcttgatgcaccggggtaagaggatcgagcccagctgggctgacgtgaagaaggacttgatctcatacggaggaggttggaaactcgaaggcgagtggaaggagggggaggaagtgcaggtattggccctggaacccggcaagaacccccgggcggttcagaccaagcccgggatcttcaagactaacacgggcaccattggggccgtatcgctcgacttctccccgggcactagcggctcccccatcgtcgaccgcaaggggaaggtggtgggcttatacgggaatggcgtcgtgacccggagcggcgcctacgtctccgccatagcgcagacggagaagtcgatcgaggacaaccccgagatcgaggacgacatctttcgcaagaagcggctgaccatcatggacctccaccccggggccggcaagaccaagcgctacttgcccgccatagtccgggaggccattaagcgcgggctgcgcacgctgatcctcgccccgacgcgggtggtggcggccgagatggaggaggctctgcgcggcctgcccatacgctaccagacccccgccatcaagaccgagcataccggtcgcgaaatcgtcgacctaatgtgccatgccacattcaccatgcggctgctgagccccgtgcgcgtgccgaactacaacctcatcatcatggacgaggcccacttcaccgaccccgcctccatcgccgcccggggctacatcagcacccgcgtcgagatgggcgaggccgcggggatcttcatgacggccacgccgcccggctccagggacccgttcccccagagcaacgcccccatcatggatgaggagcgcgagatccccgagcggtcctggaacagcgggcacgagtgggtgaccgacttcaagggcaagaccgtgtggttcgtcccgtccatcaaggccgggaatgacatcgcggcctgcctgcgcaagaacggcaaaaaggtgatccagctgagccggaagacgttcgactccgagtacgtgaagacccgcgctaacgactgggacttcgtcgtgaccaccgacatcagcgagatgggagccaacttcaaagccgagcgggttatcgatccccgcaggtgcatgaagcccgtcatcctcacagacggggaggagcgcgtgatactggcgggccccatgccggtgacgcacagtagcgccgcgcagcggcgagggcgcatcggccggaaccccaagaacgagaacgaccaatacatctacatgggggagcccttggagaatgacgaggactgcgcccactggaaggaggccaagatgctcctggataacataaacaccccagaaggcatcattccgtccatgttcgagcccgagcgcgagaaagtcgacgcgatcgacggcgagtaccggctgcgcggggaggcccggaagaccttcgtggatctgatgcgccggggcgacctccccgtgtggttggcctacaaggtcgctgccgaggggatcaactacgcagaccgcaaatggtgcttcgacggcatcaagaacaaccaaatcctcgaggagaacatggaggtggagatatggacaaaggagggggagcggaagaagctgaagccgcgctggcttgacgcacggatatacagcgaccccctcgcactgaaggaattcaaggagttcgcagcgggccgcaaatccctgaccttaaatctgatcaccgagatgggccggctgcccaccttcatgacacagaaggcccgcaacgccctcgacaacctggcggtactgcacaccgccgaagccgggggccgggcctacaaccacgccctctctgagctgccagagaccctggagaccctcctgctgctcacgctgctggccactgtcaccggggggatcttcctcttcctgatgtctggcaagggtatcggcaagatgaccctagggatgtgctgcatcatcacagccagcatcctcttgtggtacgcgcagatccaaccccactggatcgccgcttccatcatcctggagttcttcctcatcgtgctgctgatacccgagcccgagaagcaacgcacaccccaggacaaccagctcacttacgtcgtgattgcgatcctgaccgtcgtcgccgcgaccatggctaatgaaatgggcttcctggagaagacgaagaaggacctcgggctgggcagcatcaccacgcaggagagcgagagtaacatcctggacatcgacctccggccggccagcgcgtggaccctgtacgcagtggcgacaaccttcgtgacccccatgctgcgccactccatcgagaatagctccgtcaacgtgagcctcacggcgatcgccaaccaggctacggtgctgatgggcctggggaaaggctggcccctatccaagatggacatcggggtccctttactggcgatcggatgctatagccaggtgaacccgatcaccctcaccgcggccttactgctcctggtcgcccactacgccatcatcgggcccggcttgcaagccaaggccactcgggaggcccagaaacgcgccgctgctggcatcatgaagaacccaacggtagacgggatcaccgtgatcgacctagagcccatcccgtacgaccccaagttcgagaagcagctgggccaagtgatgctgctcatcctgtgtgtcacccaagtgctgatgatgcggactacgtgggccctctgcgaggctttaaccctggccaccgggcccatctccactctctgggagggcaacccggggcgcttctggaacacaaccatcgccgtgagcatggcgaacatcttccgcggtagttacctggccggcgccgggctcctgttctccatcatgaagaataccaccaacacgaggcgcggcaccgggaacatcggcgagaccctgggcgagaagtggaagtcccggctgaacgccctcggcaagagcgaattccagatctacaagaagtccggcatccaggaggtcgaccgcaccttggcgaaggaggggatcaagcgtggcgaaacggaccaccacgccgtgagccgcgggtccgccaagttgcggtggttcgtggagcgcaacatggttaccccggagggcaaggtggtggatctcggctgcgggcggggcgggtggagctactactgcggggggctgaagaacgtccgggaggtgaagggcctgacaaagggggggcccgggcacgaggagccaatccccatgtccacctatgggtggaacctcgtgcggctccagagcggcgtcgacgtgtttttcacgccacccgagaagtgcgacacgctgttgtgtgacatcggggagtcgtcccccaaccccaccatcgaggcgggccgcaccctgagggtgttaaacttggtcgagaactggctgaacaacaacacccagttttgcatcaaggtgctgaatccgtacatgcccagcgtgatcgagaaaatggaggctttgcagcgcaagtatggcggtgcgctggtccggaaccccctgtcccgcaacagcacgcacgagatgtactgggtgtccaacgcaaccggcaacatcgtaagctccgtcaacatgatcagccggatgttaatcaaccgcttcaccatgaagcacaagaaggcaacctacgagccggacgtggacctcgggtccggcaccaggaacatcgggatcgagagcgaaatccccaatctggacattatcggcaagaggatcgagaagatcaagcaggagcacgagacctcctggcactacgatcaggaccacccctacaagacctgggcctaccacggctcctacgagaccaagcagacgggctccgcctcctccatggtgaacggcgtcgtgcgcctgctcaccaagccctgggacgtggttcctatggtgacccagatggcgatgaccgacacgactcccttcgggcagcagcgggttttcaaggaaaaagtcgacacccgcacccaagagcccaaggagggtacgaagaagcttatgaagatcaccgccgagtggctgtggaaggagctcggcaagaagaagacgccccggatgtgcacccgtgaggagttcacacggaaagtgcgatctaacgccgccctgggggctatcttcaccgatgagaacaagtggaagtccgcgcgggaggccgtggaagacggccgcttctgggagctcgtcgaccgggaacgcaacctccacctggagggaaagtgcgagacatgtgtgtacaacatgatgggcaagcgggagaagaagctgggggagttcggcaaggccaaggggagccgcgcgatatggtatatgtggcttggggctcggttccttgagttcgaggcgctgggcttcctcaatgaggaccactggttctcccgcgggaacagcctgagcggcgtggagggggagggactgcatcggcttggctatatcctgcgcgacgtcgggaagaaggagggcggagcaatgtacgccgacgacaccgccggctgggacacgcggattaccctagaagacctcaagaacgaggagatggtgaccaaccacatgaagggggaacacaaaaaactggcggaggccatcttcaagctgacatatcagaataaggtcgtgcgtgtgcagagaccgacgccccgcgggaccgtaatggacatcatctcccggcgcgaccagcgggggagcgggcaggtaggcacctacggtctcaacaccttcacgaacatggaagcccagctgatcaggcagatggaaggcgaggggatcttcaagtccatccagcacctgaccgcaaccgaggagattgccgtgcagaactggctcgcgagagttgggcgggagcgcctaagccggatggccatctccggtgacgactgcgtggtgaagcccatcgacgaccgcttcgcctcagccctgaccgccctcaatgacatggggaaggtccggaaggacatccagcagtgggagccatcccgcggctggaacgattggacccaggtcccgttctgcagccaccacttccacgaactggtgatgaaggacgggcgggtcctggtggtgccctgccgcaaccaggacgagctcatcggccgggcgcgcatctcccagggcgcggggtggtcccttaaggagacggcctgcctgggcaaatcctacgcccagatgtggacactcatgtacttccaccggcgggatctgcggctggcagcgaacgccatctgcagtgccgtgccgccccactgggtgccaacctcacgcactacctggagcattcacgccaaacacgagtggatgaccactgaggacatgctcgcggtatggaaccgggtctggatccaggagaacccctggatggaggacaagacccccgttgagagttgggaagaggtgccctacctgggtaagcgcgaggaccagtggtgcggcagcctgatcggtctcacgtcccgtgccacctgggccaagaacatccagaccgccataaaccaggtccgcagcctgatcggcaatgaagagtacaccgactacatgccgagcatgaagcgctttcggcgcgaggaggaagaagccggcgtactgtggtga

SEQ ID NO: 25054 - RNA, 9876 nt, synthetic construct
  misc_feature 1..9876: note = derived and/or modified CDS sequence (opt11) from DENV-2__JN819416__SS-prME
  source 1..9876: mol_type = other RNA
accgctggtgtaatcgtgatgctgatccccacggccatggcattccatctcaccacacgcaatggcgaaccacacatgatcgtgggccggcaggaaaagggtaagtccctgcttttcaaaaccgaggacggcgtgaacatgtgcactctcatggccatagacctgggggagctgtgcgaggacaccatcacttataagtgcccgctccttcgacagaacgaacccgaggatatcgattgttggtgcaactctacaagcacctgggtcacgtacggaacctgcaccactactggagagcacaggcgcgagaagcgcagcgtagctctggtcccgcacgtggggatgggcttagaaactcgcactgagacgtggatgagctccgagggagcctggaagcatgtacagcggatcgagacgtggatcctacgccatccgggcttcaccatcatggctgctatactggcatataccatcgggacgacgcacttccaacgggcgctcatattcatcctgctgaccgccgtggcccccagcatgaccatgagatgcattggtatctccaaccgggacttcgtagagggggtcagcggtggctcttgggtcgacatcgtcctcgagcacgggtcttgtgtgacaacgatggcgaagaacaagcccaccctggacttcgaactgatcaagaccgaggccaagcagcccgccaccctccgcaagtactgcatcgaggctaagctgacgaacaccaccaccgagagccggtgcccgacgcagggcgaaccctcactcaacgaggagcaagacaagcggttcatctgtaaacactccatggtggaccggggctgggggaacggctgtgggctgttcggtaagggcggtatcgtgacctgcgcaatgttcacgtgcaagaagaacatggaggggaaggtggttcagcctgagaacctggagtacacaatagtgataacgccccactctggggaggaacatgctgttggcaacgacacgggaaagcatggcaaagagatcaagatcaccccgcaatcctccatcaccgaggccgagctgaccgggtacggcacggtgaccatggaatgcagcccccggaccggactcgattttaacgaaatggttctgctgcagatggaggacaaggcctggctcgtgcatcgccagtggttcctggatctgcccctcccgtggctgccgggggcagacacccaggggtcaaattggatccagaaggagactttagtgacctttaaaaatccccacgcgaagaagcaggacgtagtggtcctcggttcccaggaaggcgcgatgcacacggccctgacgggcgccacggagatccagatgagctcaggcaaccttctgtttaccgggcacctgaagtgtcgcctgcggatggacaagctccagcttaaaggaatgtcctactccatgtgcacagggaagttcaagatagtgaaggagattgcggaaacccagcatgggacaatcgtcatccgggtacagtacgaaggcgacggatcgccctgtaagatccccttcgagatcaccgatctggagaagcggcacgtgctcgggcgcctgattacggtaaacccgatcgtcaccgaaaaggacagcccagtgaatatcgaggcggagccgcccttcggcgattcctatataattataggagtggagccgggtcagctgaagttgaactggttcaagaaggggagctccatcggccagatgttcgagaccaccatgcggggcgctaagcggatggccatcctgggggacaccgcgtgggactttgggagcctcggaggggtcttcacctcaatcggaaaggccctccaccaagtgttcggggccatatacggcgccgccttcagcggggtttcctggactatgaagatcttgatcggcgtcatcattacctggatcgggatgaactcgcgcagtaccagcttatccgtgagcttagtgttggtgggcgttgtgaccttgtacctgggggctatggtccaggcggactcgggatgcgtggtcagctggaaaaataaggagctcaagtgcggctccgggatattcatcacggacaacgtgcacacctggaccgaacagtacaagttccagcccgagagcccatctaagttagcatccgccattcagaaggcccacgaggagggcatctgcgggattcggagcgtaacgcgcctggaaaatctcatgtggaagcagatcaccccagagttaaatcacatcttaagtgagaatgaggtgaaactaaccatcatgaccggcgatataaaggggataatgcaggccggcaagcggagcctgcggcctcagcctaccgagctgaagtacagctggaagacgtggggaaaggcgaaaatgctctccaccgaaagccacaaccagaccttccttatcgacgggcccgagaccgccgagtgcccgaacacgaacagagcctggaacagcctggaagtcgaggactatggcttcggcgttttcaccaccaacatctggctcaagctgcgcgagaagcaggatgtgttttgcgactccaaactgatgtccgccgcaatcaaggacaaccgggctgtccacgcggacatgggctattggatcgagtccgccttaaacgatacctggaaaatggaaaaagctagcttcatagaggtcaagtcatgccattggccaaagtctcacaccctgtggagtaacggcgtgctggagagcgagatgatcatacctaagaacttcgcgggtcccgtctcgcaacacaactaccgtccgggctaccacactcagaccgcgggcccctggcacctcgggaagctggaaatggacttcgacctatgtgaggggaccaccgtggttgtcacggaggactgcgggaaccggggcccaagtctccgcacaactacagcctctgggaaactgatcacggagtggtgctgccggtcctgtacactgccacccctcagataccgcggggaagatggttgctggtacggcatggagatccggcccttgaaggagaaggaggagaacctggtaaacagcctagtgaccgccggccatggccagatcgacaacttctccttaggcgtcctagggatggccctcttcctggaggagatgctgcggactcgcatcggtacgaagcacgctatcctcctggtggccgtcagcttcgtcaccctgataaccggcaacatgtctttccgggacctaggtcgcgtgatggtgatggtcggggcaacaatgacggacgacatcggtatgggcgtgacctatttggccctgttagctgcgttcaaggtgcgtcccaccttcgccgccgggctgcttctacggaagctgaccagcaaggagttgatgatggcgaccatcggcattgccctcctgtcccaatcaaccatcccggagaccattctggagctcactgacgcgctggcactcggcatgatggtcctcaagattgtgcgcaacatggaaaagtatcagctggccgtgactatcatggccatctcctgcgtcccgaatgccgtgatcctacaaaacgcgtggaaggtgtcatgcaccatcctcgccgccgtctccgtgtcacccctgttactcacctcctcgcagcagaaagccgattggatacccctcgcccttactatcaagggactgaatcccacggctatcttcctgaccactctgtcccggactagcaagaaacgctcctggccgctcaatgaggccatcatggccgtcggtatggtgagcattctggcttcgtctttactcaagaacgacatcccgatgacggggcctctggtggcgggagggctgctcaccgtctgctacgtgctcaccggccggtctgctgacctggagctcgaacgagcggccgacgtgaagtgggaggaccaggcagagatctccgggtcttcccccatcctgagcatcaccatttccgaggacggcagcatgtccatcaagaacgaggaagaggagcagacgctgaccatactcatccggaccggactgttggtaatctcaggggtgttcccagtgtccatccccatcaccgcggccgcctggtacctttgggaggtcaaaaagcagcgcgccggggtgctgtgggacgtgcccagcccgccgcccgtggaaaaggccgaactggaagacggggcgtatcgtatcaagcaacgcggtatcctcgggtactcccaaatcggcgcgggcgtgtacaaagaagggacattccacactatgtggcacgtaacccggggcgccgtcctgatgcaccgcgggaagcggatcgaacccagctgggccgacgtgaagaaggacctgatcagctacgggggcggctggaaactcgaaggtgaatggaaggaaggggaggaggtgcaagtgttggcgctcgagcccggaaagaaccctcgagccgtccaaaccaagcccgggatcttcaagactaacacgggcaccattggggcggtgagcctcgacttcagccccggcaccagcggctctccgattgtcgaccggaagggaaaagtggtaggcctgtacggtaacggcgtagttaccagaagcggtgcctatgtttcggcgatcgcgcaaacggagaaatccattgaggacaatcccgagatcgaagacgacatctttcggaagaagcgcctcaccataatggacctccaccccggggcaggcaagaccaagcggtacctaccagcaatagtccgggaagccatcaaacgggggctgcgcacgttaatcttggcccccacgcgcgtggtggccgctgaaatggaggaggccctgcgaggcctgcccatccgatatcagacacccgccatcaagaccgagcacaccgggcgggagattgttgacctcatgtgccatgccactttcactatgaggctgttgagccccgtgcgggtgccaaactacaatttgatcatcatggacgaagcgcatttcacggacccagcctccattgcagcccgcggctacattagtacccgggtcgagatgggcgaggccgcggggatcttcatgacggccacaccgcccggctcgagagatccattcccgcaatccaacgcccccataatggacgaggagcgggagattcccgagagatcctggaactcggggcatgagtgggtgaccgattttaagggcaagaccgtgtggttcgttccgtctataaaggccggaaacgacatcgcggcttgcctgcgcaagaatggcaagaaggtcatccagctgagcaggaagacgttcgactctgagtacgtgaagaccagagccaacgactgggacttcgtcgtgaccaccgacatcagcgagatgggcgcaaacttcaaggccgaacgcgtaatagacccgcggcgctgcatgaaaccggtcatccttacggacggggaggagcgcgtgattctggcgggccctatgccggtgactcatagttcggccgctcagcgccgtggacgcataggtcgcaaccctaagaatgagaacgaccagtatatttacatgggggaacccctagaaaatgacgaggactgcgcccactggaaggaggccaagatgctcctggataatataaacacccccgagggcatcatcccttctatgtttgaaccggagcgggagaaggtcgacgcgatcgacggcgagtatcgcctccgcggagaggcccggaaaaccttcgtggacttgatgcggagaggcgacctgcccgtgtggctggcctataaggtcgccgccgagggaatcaactacgccgatcggaagtggtgctttgacggcatcaagaacaaccaaattctcgaggagaacatggaggtggagatctggacgaaggagggggagcgcaagaagctgaagccgcggtggctggacgcccgcatctacagcgaccccctagccctgaaagagttcaaggagttcgccgcgggcaggaagtcccttacgctcaacctgatcaccgagatggggcggctgcccaccttcatgacgcagaaagcaaggaacgccctcgacaacttagcagtactgcacaccgccgaagccggcgggcgcgcctacaaccacgccttatcagagctgccggagaccctggagaccctacttctgctcacgctcctggcgacagtaacaggcggaatcttcctctttctcatgtcggggaaaggaatcggaaagatgaccctggggatgtgctgcatcatcaccgcgagcatcctcctgtggtacgcgcaaatccagccgcattggatcgcagcttccatcatcctggagtttttcctcatcgttctcctgatccctgagccggaaaaacagcggacgccacaagacaaccagctaacctacgtagtgatcgccatccttaccgtggtggccgctaccatggccaatgaaatgggctttctagagaagacgaagaaagacctcgggctgggcagcattaccacacaggaaagcgagtccaacatccttgacatcgatctccgccctgccagcgcttggaccctgtacgccgtggccacgaccttcgtgactccaatgttgcggcactccatcgagaactcctctgttaacgtgagcctgaccgcgatcgccaaccaggccacagttctcatgggtctcggtaagggctggccactctccaagatggacatcggggtccccttactggctatcggctgctacagccaggtgaacccaattaccttaaccgccgcactgctgctcctcgtcgcccactacgccatcatcggtcccggtctgcaggcgaaggccacccgtgaggcccaaaagcgggcggcggctggcattatgaagaatcccacggtcgacgggatcaccgtgatcgatctcgagcccattccatacgaccctaaattcgaaaagcagcttggccaggtaatgctgttaattctgtgcgtcacccaggtgctgatgatgcgcaccacatgggccctctgcgaagccctgacactggcaactggtcccatctctaccctctgggagggcaaccccgggaggttctggaacacgacgattgccgtgagtatggcgaatatcttcaggggctcctacctggccggcgcggggctcctgttcagcatcatgaagaataccaccaatacgcgccggggtactgggaacatcggcgaaaccctaggcgagaaatggaagtcccgtctgaacgccctcggtaagtccgaatttcagatctacaagaagtctggcatccaggaggtcgaccggacactggcgaaagaggggatcaagcgcggcgagacggaccaccacgctgtgagccggggatcggccaagctgcggtggttcgtggaacggaacatggtcacaccggagggcaaggtcgtagacctcggatgcgggcgcggcggttggtcctactactgtggcggactgaagaacgtccgggaggtcaaggggctgacgaagggcgggcccggccacgaggagcccatcccgatgtccacctacgggtggaacctcgttaggctgcagagcggcgtcgatgtgtttttcaccccgcccgagaagtgcgacaccctattgtgtgacattggggagagctcccccaatcccaccatcgaggccggccggacgctgcgcgtgctcaatctggtggagaactggttgaacaacaatacacaattctgcataaaggtgctgaacccgtacatgcccagcgtgatcgagaagatggaagccctccagcggaagtacgggggtgctctagtccgcaaccccttatccaggaacagcacccacgaaatgtactgggtgtccaatgccaccggcaacatagtcagctcagtcaacatgattagccgcatgctgatcaaccggtttacaatgaagcacaagaaggccacatacgagccggacgtcgatctcggctctggcacgcgcaacatcggaatcgaaagcgagatacctaacctggacatcataggcaagcggattgagaaaatcaagcaggagcacgagacctcctggcactacgaccaggatcacccgtataagacgtgggcctatcacgggagttacgagactaagcagacggggtccgcgagctcaatggtcaacggggttgtgcgcctgctaacgaagccctgggacgttgtcccgatggtgactcagatggcgatgaccgacacgacccccttcgggcagcagcgtgtgttcaaggagaaggtcgacacccgaacccaggagccaaaggaagggacgaagaagttgatgaagatcaccgcggaatggctctggaaggaactcggcaagaaaaagacgccgcgcatgtgtacccgggaggagttcacccggaaggtgaggagcaacgctgccctgggggccatcttcaccgacgaaaacaagtggaagtcagcacgcgaggcggtcgaggacagccggttctgggagttagtcgacagagagcgcaacttacacttagagggcaagtgcgaaacctgcgtgtacaacatgatggggaagcgcgagaaaaagctgggcgagttcggcaaagccaagggctctcgggcgatctggtacatgtggctcggcgcgcgcttcctggagtttgaggccctaggtttcctcaatgaggaccactggttctctcgggggaacagcctcagtggggtggagggcgaggggctgcaccgtctcggctacatcctgcgtgacgtcggaaagaaggagggtggcgcgatgtacgccgatgacaccgccgggtgggacacgaggatcacgctggaagatctcaagaacgaggaaatggtgacaaaccacatgaaaggcgagcacaagaagctggcggaagccatcttcaagctgacataccagaacaaggtcgtgcgggtgcaacgcccgacgccgagaggcaccgtcatggacatcatttcacgacgtgaccagcggggctcgggacaggtaggtacctatggtctcaacaccttcacgaacatggaggcccagttgattcgacaaatggagggagagggaattttcaagagcatccaacatctgaccgcaaccgaggaaatcgccgtgcagaactggctcgctcgcgtaggccgcgagcggctgtcccgaatggcgatcagcggagacgattgcgtggtgaagcccatcgatgaccggttcgcctctgccctgaccgccctcaacgacatgggtaaggtccgaaaagacatccagcagtgggagccctcgagagggtggaacgactggacccaggtcccgttctgctcccaccacttccacgaactcgtaatgaaggacggcagggtcttggtggtgccatgccggaaccaggacgagctcatcgggcgcgcgaggataagtcaaggagccggttggtcactgaaggaaaccgcatgcctgggcaagtcgtatgcccagatgtggacattgatgtatttccaccgccgagacctgcgcctggccgccaatgccatctgctccgccgtgccgccccactgggtaccgacctcccgcaccacgtggtccatccacgctaaacacgagtggatgacgaccgaagacatgctcgcggtgtggaatcgagtctggatacaggagaacccatggatggaggacaagacgcccgtggagagctgggaggaagtgccctatctgggcaagcgtgaggaccagtggtgcggatcccttatcggcctcacgagccgcgccacatgggccaagaacatccagaccgccatcaatcaggtccgctcgctgatcggcaacgaggagtacaccgactatatgccgtctatgaagcgcttcagacgggaggaggaggaggctggcgtgctgtggtga

SEQ ID NO: 25055 - RNA, 9876 nt, synthetic construct
  misc_feature 1..9876: note = derived and/or modified CDS sequence (opt11) from DENV-2__FJ850119__SS-prME
  source 1..9876: mol_type = other RNA
accgcgggcgtgattgtcatgctcatccccaccgcaatggcgttccacctcaccacccgcaacggagagccccacatgatagtcggccggcaagagaaaggcaaatccctgctgttcaagaccgaggacggtatcaatatgtgcacactcatggcgatagacctcggggagctgtgcgaggacaccatcacctacaagtgccccctactacgccagaatgagcccgaggacattgactgctggtgcaatagcacgagcacctgggtcacctacgggacctgtaccaccacgggtgagcaccggagggagaagcggtccgtcgccctggtgccccacgtggggatgggtctcgagacccgcaccgagacatggatgagctccgagggggcctggaagcacgtccagcgcatcgagacgtggatcctgagacaccccggcttcaccatcatggccgcgatcctggcctacaccatcggaaccacgcattttcagcgggccttgatatttatcctgttaaccgccgtggctcccagcatgaccatgcgctgcatcgggatctcgaaccgggacttcgttgaaggcgtcagcgggggcagttgggtggacatcgtgctcgaacacgggagctgcgtaaccacgatggccaagaacaaacccacccttgacttcgagctgatcaagaccgaggccaagcagccggccaccctgcgcaagtattgcatcgaggctaagctgacgaacaccaccaccgagtcccggtgcccaacgcaaggcgagccctctctgaacgaggagcaggacaagcgtttcatctgcaaacactccatggtggaccgcggctgggggaacggttgtgggctgttcggcaagggcgggatcgtgacctgcgcaatgttcacttgcaagaagaacatggagggcaaagtagtacagcccgagaatctagagtacactatcgtgataacgccgcactcaggggaggagcatgccgtcggcaacgacaccgggaagcacggcaaagagatcaagatcaccccgcagtcgagcatcaccgaggctgagcttaccgggtatgggacggtgaccatggaatgttccccccggaccggtctcgactttaacgagatggtgctgctgcagatggaggacaaggcatggctcgtccaccggcagtggtttctggacctgcccttgccatggctccctggggctgatacccaggggtcgaactggatccagaaggagacgctggtgaccttcaagaacccccacgcgaagaagcaggacgtagtcgtgctcgggtcccaggagggcgccatgcacaccgccctgaccggggcaacggagatccagatgagctcaggcaaccttctgttcaccggccacctaaagtgccgactgcggatggacaagttacagctgaaggggatgtcctactcaatgtgcaccgggaagttcaagattgtcaaggagatcgccgagacccagcacgggacgatcgtgatccgcgtgcagtacgaaggcgacggctccccctgcaagatccccttcgagatcaccgacctggagaagcggcacgtcctcgggaggcttatcaccgtgaatcctatcgtgaccgaaaaggacagcccggtcaatattgaagcggagccgcccttcggtgactcctacatcatcatcggggtggagccgggccagctgaagctgaattggttcaagaaggggagctccatcggtcagatgtttgagacgaccatgcgcggcgccaagcggatggccatcttaggggacaccgcctgggacttcggcagcctcggtggcgtgttcacttccatcgggaaggcactccaccaggtcttcggagcaatctatggcgccgccttctcaggcgtgagctggacgatgaagattctgatcggcgtgatcatcacctggatcgggatgaacagccgctccaccagcctctccgtaagcctggtgttggtaggagtcgtgaccctgtacctgggggccatggtgcaggcggactccggctgcgtggtgagttggaagaacaaagaactcaagtgcggttccgggatctttatcacggacaacgtgcacacctggaccgaacagtacaagttccaacccgaaagccccagcaagctcgcctccgccattcagaaggcccacgaggagggcatttgcggaatccggagcgtcacccgcctcgaaaacctcatgtggaagcagataacgccagagctgaaccacatactatccgaaaacgaggtgaagctcaccatcatgaccggcgacatcaaaggtatcatgcaggcaggcaaacgcagcctgcgcccgcaacccaccgaacttaaatactcctggaagacgtggggcaaggcgaagatgttgtctaccgagtcccacaaccaaaccttcctgatcgacgggcccgagaccgctgagtgcccgaacactaaccgggcctggaactcactggaggtggaggactatggcttcggggtcttcacaaccaacatctggttaaagctgcgcgagaaacaggacgtcttctgtgactccaaactgatgagcgccgccattaaggataacagagcggtacatgccgatatgggctactggatcgagagcgccctcaacgacacatggaagatggagaaggccagctttatagaggttaagtcctgccactggcccaaaagccacaccctgtggtccaacggcgtgctggagagcgagatgatcatccccaaaaacttcgccgggcccgtgtcccagcacaactaccgcccaggctaccacacgcagaccgcagggccctggcacctcggcaagctggagatggattttgacctgtgcgaggggactaccgtcgtggtcacggaggactgcggcaacaggggccccagcctccgcaccaccaccgcctccgggaagctgatcacggagtggtgctgtcggagctgcaccctgcccccgctccgctatcggggcgaggatgggtgctggtacggcatggagattcgccccctgaaggagaaggaggagaacctggtcaacagccttgtgaccgccgggcacgggcagatcgacaacttctcattgggcgtgctggggatggccctgttcctggaggagatgttgcggactcgcataggcaccaagcacgcgatactcctggtcgccgtgtctttcgtgaccctgatcaccgggaatatgtccttccgggacctcggccgagtcatggtaatggtgggggccaccatgacggacgatattggcatgggcgtcacctacctggccctcctagccgcattcaaggtgcgcccgactttcgccgccggcctgctgctccgaaaactgactagcaaggagctgatgatggccacgatcggcatcgccctcctgtcccagagcaccatcccggagaccatcctggagctcaccgacgcgctggcgttagggatgatggtgctcaagatcgtccgcaacatggaaaagtaccaactggccgtgacgatcatggccatatcctgcgtgccgaacgccgtcatccttcaaaacgcgtggaaagtttcgtgcaccatccttgcagccgtgtccgtcagccctctactgctcacctcgagccagcagaaggccgactggatccctctggcgctgaccatcaagggtctcaaccccacagccatcttcctgactaccctctcccggacaagcaaaaagcgctcctggccgctaaacgaagccattatggccgtaggcatggtcagcatcctggcctccagcctgctcaagaacgacattcccatgacgggccctctggtggcgggcgggctgctcaccgtgtgctacgtactgaccggccggagcgctgacctggagctcgagcgagccgccgacgtcaagtgggaagaccaggccgagattagtgggtcgtcccccatcctgagcataaccatctccgaggacggctcaatgtccatcaagaacgaggaagaggagcaaacgctgaccatcctcatcagaaccggcctgctggtcataagcggggtcttcccggtctcaatccccatcaccgcagccgcctggtacttgtgggaggtgaagaagcagcgcgccggggtcctgtgggacgtacctagcccgccgccagtggagaaggccgagctggaggacggggcgtatcggatcaaacagcgcggcatcctagggtattcccagattggcgctggcgtgtacaaagaagggacgttccacacgatgtggcacgtgacccggggcgcagtgctgatgcaccgcgggaagcggatcgagcccagctgggctgacgtcaagaaggacctgatcagctacggcgggggatggaagctcgaaggcgagtggaaggagggggaggaggttcaggtgctggccctggaaccaggaaagaatccccgagcggtccagaccaagccagggatctttaagaccaacacgggcaccatcggcgccgtgtcactggacttctcccccggtacgagcggctcccccatcgttgaccggaaagggaaggttgtgggtctgtacgggaacggagtggtcacccgttcaggtgcatatgtatctgccatcgcgcaaacggagaagtccatcgaagataaccctgagatagaggacgacatcttccggaaaaagcgcctgaccatcatggacctccaccccggggccggaaagactaagcggtacctgccagcaatcgtgcgcgaggctatcaaacgggggttacgcaccctgatcttagccccgacgcgcgtcgtggctgccgagatggaggaggcactgagaggcctgccaattcgttaccagaccccggctattaagaccgagcacacgggacgtgagatcgtggacctcatgtgtcacgccacatttacgatgcgcctgctgagccccgtccgggtgccgaactacaacctcatcatcatggacgaggcgcacttcacagaccccgcctccatcgccgcccgaggctacatcagcacccgggtggagatgggcgaggccgcggggatcttcatgacggccacaccgcccggctcccgcgacccgttcccccaaagcaacgcaccgattatggacgaggagagagaaatccccgagcgctcctggaacagcgggcacgagtgggtaaccgacttcaaaggcaagaccgtttggtttgtgccgtccattaaagccgggaacgacatcgcagcctgcctgcggaagaacggcaaaaaggtcattcagctaagccgtaagacgttcgattcagaatacgtcaagacccgggccaacgactgggacttcgtggttacgacagatatatcagaaatgggtgcaaacttcaaggccgagcgcgtgatcgacccccggcgctgcatgaagcccgtgatcctcaccgacggggaagaacgggtaatcctggcgggccccatgccggtgacacactccagcgctgcccagcggcgcggccgcatcgggcgcaacccgaagaacgagaatgaccagtacatctacatgggggagcccctggaaaacgatgaggactgcgcccactggaaagaggcaaagatgttactggacaacatcaacacccccgaaggcatcatcccgtctatgttcgagcctgagcgtgagaaggtggacgcaattgacggcgagtaccgccttcgcggggaggcccgcaagactttcgtcgacctcatgcggcgtggcgacctgccagtttggctggcatacaaggtggccgccgaagggatcaactacgcggaccggaagtggtgcttcgatggcatcaagaacaaccagatcctcgaggagaacatggaggtagagatctggacgaaggaaggggaacgcaagaagctgaagccgcgctggctggacgcgcggatctatagcgaccctctcgccctgaaggagttcaaggaattcgccgctggccggaagtccctgactctcaacttaatcactgaaatgggccgcctacccaccttcatgacgcagaaagcccggaatgccctcgacaacctggccgtacttcacacggccgaggccgggggcagggcctacaaccacgcccttagcgagctgcctgagaccctggagaccctcctgctgctcacgctgctggccaccgtgaccggtggcattttcctctttctgatgagtggcaaagggatcggcaagatgaccttagggatgtgctgcatcatcactgccagcatcctactgtggtacgcgcagatccagccgcattggatcgccgcctcaataatcctggaattcttcctcatcgtactgcttatccccgagccagagaagcaacggacacctcaggacaaccaactgacctacgtggtcatagccatcctgaccgtcgtcgccgcaaccatggccaacgagatgggcttcctggagaagacgaaaaaggacctcgggctcggctccataaccacccaggagtcggagtccaacatcctggatatagacctccgcccggcctcggcctggaccctgtacgccgtcgcgacaacctttgtgacgcccatgctgcggcactcgatcgagaacagtagtgttaacgtgagcctcaccgccatcgccaaccaggccacggtgttgatggggctggggaagggctggccgttgtccaagatggacatcggcgtgcccctgctggcgattggctgctacagccaggttaacccgatcacccttaccgcagccctgctactactggtggcacactacgccatcattggccccggattacaggcgaaggccacccgagaggcccagaaacgggccgccgcgggaatcatgaagaaccccacggtggacggaattaccgtcattgacctcgagcccatcccctacgacccaaagttcgaaaagcagttaggtcaggtcatgctgctcatcctatgcgtgacccaggtcctgatgatgcgcaccacctgggccttgtgcgaggccttgaccctggccaccggccccatctccaccctctgggagggcaatcccgggcggttctggaacacgaccatcgccgttagcatggcgaacatcttcagaggcagctacctggcaggggccgggctcttattcagcatcatgaagaacaccaccaatacgcgccgcggcacgggtaacatcggtgagaccctgggggagaagtggaagagccgcctgaacgccctcggtaagagcgagttccagatttacaagaagtccggcatccaggaggtggaccggactctggcgaaggaggggatcaagcgcggtgaaacggaccatcacgccgtcagccgggggtccgccaaactgcgctggttcgtagagcggaacatggtcaccccggaaggcaaggtcgtggacctcggctgcgggcgcggggggtggtcctactattgcggcgggctgaagaatgtgcgagaggtcaaggggctgacaaaagggggtccaggccacgaggagccaatacccatgtctacctatgggtggaacctcgtgcgcctgcaaagcggcgtcgacgtgttcttcacgccccccgagaagtgcgacaccctgctctgcgacatcggggagagctccccaaatccgacaatcgaggccggccggaccctgcgcgtgttaaacctcgtggagaactggcttaataacaacacccagttctgcatcaaggtcttgaacccgtacatgccaagcgtgatagaaaagatggaggccttacagcgaaagtatggcggggcgctggtacgcaaccccctgtccaggaacagcacgcacgagatgtattgggtcagcaatgccaccggcaacatcgtgagctccgtgaacatgatcagtcgcatgttaatcaaccggttcaccatgaagcacaagaaggccacctacgagccggacgtagacctcgggtccggcacgagaaacatcggcatagaatcggagatccccaacctggacataatcggcaaacggatcgagaagataaagcaggagcacgagacctcctggcactacgatcaggaccacccctacaagacctgggcctaccacggcagctacgagaccaagcagacggggtccgccagctctatggtgaacggagttgtccgcctgttgactaagccctgggacgtggtgccgatggtcactcagatggcgatgaccgacactacgccattcgggcagcagcgggtattcaaggagaaggtcgatacccggacccaagagcccaaggagggcacgaagaagctgatgaagataaccgccgagtggctatggaaggagctcggtaagaagaagactccccgcatgtgcactcgggaggagttcacgcgcaaggtccggagcaacgccgccctgggggccatcttcaccgacgagaacaagtggaagtccgcgcgcgaggccgtggaggacggccggttctgggagctggtggatagggagcggaacctacacctggaggggaagtgcgaaacctgtgtttataacatgatgggaaagcgcgagaagaagctgggggagtttggcaaggccaagggctcgcgggccatctggtatatgtggcttggggcgcgcttcctagagtttgaggccctgggctttctcaacgaggaccactggttctcccgtggtaacagcctgagcggcgtggaaggggagggcctgcaccgcctcggctacatcctgcgggatgtcgggaagaaggagggcggggccatgtacgctgacgacactgcgggatgggacacgcggatcaccttggaggacctcaagaacgaggagatggtgaccaaccacatgaagggggagcataagaagctggcggaggccatcttcaagctgacctaccagaacaaggtcgtccgggtgcagcgcccgacgcctcgaggcaccgtgatggatatcatctccaggcgagaccaacgcggcagcgggcaggtcggtacctatgggcttaacacctttacgaacatggaggcccagctgatcaggcagatggagggcgagggaatcttcaaatccatccagcacctgaccgccagcgaagagaccgccgtgcagaactggctagcgcgggtgggtcgagagcggctgtcccgaatggccatcagcggggacgactgcgtcgtgaagcccatcgacgaccggttcgccagcgccctgaccgccctcaacgacatgggaaaggtacgcaaagatatccagcagtgggagcccagccggggctggaacgactggacacaggtcccgttctgctcccaccacttccacgagctggtgatgaaggacgggcgcgtgctggtcgtgccctgccgcaatcaggacgaacttatcggtcgcgccaggatctcgcagggcgccgggtggagtctgaaggagaccgcatgcctgggtaagagctacgcccagatgtggaccctcatgtattttcaccgccgggatctgcgcctggccgcgaacgccatctgctccgctgtcccacctcactgggtccccaccagccgtaccacctggtccatccacgccaagcacgagtggatgaccacagaggacatgctagcagtgtggaaccgcgtgtggatccaggagaatccctggatggaggacaagacccccgtcgagagctgggaggaagtgccctatttaggaaagcgggaggaccagtggtgcggctccctgataggtcttacgagccgagccacctgggccaagaacatccagaccgctatcaaccaagtgcgtagccttatcggcaacgaggagtacaccgactacatgccgtccatgaagcgcttccggcgagaggaggaggaggccggagtcctgtggtga

SEQ ID NO: 25056 - RNA, 9876 nt, synthetic construct
  misc_feature 1..9876: note = derived and/or modified CDS sequence (opt11) from DENV-2__FJ850064__SS-prME
  source 1..9876: mol_type = other RNA
accgcgggggtgatcgttatgctgatccccacagccatggccttccacctcaccacccgcaacggggaaccgcacatgatcgtgggccggcaggaaaaggggaagtccctgcttttcaagaccgaggacggcgtgaacatgtgcactctcatggccatcgacttgggagaactgtgcgaggacaccatcacctacaagtgccccctcctgcgccagaatgagcccgaggacatcgactgctggtgcaacagcactagcacctgggttacgtatgggacctgcaccacgacgggcgaacaccggcgcgagaagcgttctgtggcgctggttccccacgttgggatggggctcgagacccgcaccgaaacctggatgagcagtgaaggagcctggaagcacgttcagcgcatcgagacgtggattctgcgccacccgggcttcaccatcatggccgcgatcctggcctataccattggcacgacgcactttcaacgggctcttatcttcatcctgctgaccgccgtggcgcccagcatgacaatgcgatgtatcggcatctccaaccgggacttcgtcgagggagtgagcggaggatcctgggtggacatcgtacttgagcacgggagctgcgtgaccacgatggccaagaacaagcccaccttggatttcgaactgattaagaccgaggccaagcagccggccaccctccgcaagtattgcatcgaggccaagctaaccaacaccactaccgagtcgcggtgccccacgcagggcgagccctccctgaacgaggagcaggataaaagattcatctgcaagcactccatggtagaccggggctgggggaacggctgcgggctgttcggcaaaggagggatcgttacctgcgccatgttcacgtgtaaaaagaatatggagggcaaggtggtgcagccggagaatctggagtacaccatcgtcatcacccctcactccggggaggagcacgccgtaggcaacgacaccgggaaacacgggaaggagatcaagatcacaccgcaatccagcatcaccgaagccgagctgaccgggtacggcacagtgactatggaatgtagtccccggaccggactggatttcaacgagatggtcctgctgcagatggaggacaaagcctggctcgttcaccgccagtggttcctggacttgcccctcccctggctgccgggcgcagacacccagggcagcaactggatccagaaggagacgctggtgacctttaagaacccccacgccaagaagcaggatgtcgtggtactagggtcccaggagggcgccatgcataccgccctcaccggggccacagagatccagatgagctcaggcaatctcttattcaccggccacctgaaatgccgcctgcggatggataagctccagctgaaaggcatgagttatagcatgtgtaccggcaagtttaaaatcgtgaaggagatcgccgagactcaacatgggacgatagtaatccgcgttcagtatgagggagatggttccccgtgcaagattcctttcgagatcacagacctggagaagcgacacgtgctcggaaggctgatcacggtgaaccccatcgtaaccgagaaggacagccctgtaaacatcgaggcggagccgcccttcggcgacagttacataatcatcggtgtggagccgggccaactgaagctcaactggttcaagaaggggagctccatcggccagatgttcgccacgacaatgagaggggccaagcggatggccatcctgggggacaccgcctgggatttcgggtcactcggaggggtcttcacatccattgggaaagctctccaccaggtattcggtgccatctacggtgccgcctttagcggggtgtcctggacgatgaagatccttatcggtgtcataataacctggatcgggatgaacagccgctccaccagcctctccgtgagcctggtgctggtaggcgtagtgaccttgtacttgggggcgatggtccaagccgactccgggtgcgtggtgagctggaagaacaaggagctaaagtgcggctccgggatattcatcacggataacgtccacacctggacggagcaatacaagttccagcccgagagccccagcaagctagcctccgccatccagaaggcccacgaggagggcatctgcggtatccgcagcgtaactcgcctggagaatctcatgtggaagcagatcacacccgagttaaaccacatactgtctgagaacgaggtgaagctcactattatgaccggcgacatcaaggggatcatgcaggcaggcaagcgtagccttcgcccgcagcccaccgagctcaaatattcctggaagacatggggaaaggccaagatgcttagcacagagtcccacaaccagaccttcctgatagacgggcccgagacagccgaatgtccgaacacgaaccgggcttggaacagcctggaggtcgaggactacggcttcggggtgttcaccaccaacatctggctcaagctgcgcgaaaagcaggatgtgttctgcgactccaagctgatgagcgcagcgattaaggacaaccgggctgtccacgcggatatgggctactggatagagtccgccctcaacgacacctggaagatggaaaaggccagcttcatcgaggtaaagtcctgccactggcccaagagccacaccctgtggtcaaacggcgtgctggagagtgagatgatcatccccaagaacttcgccggacccgtctcgcagcacaactacaggccgggctatcacacgcagaccgccgggccctggcacctcggcaagctggagatggatttcgacttgtgcgagggcaccaccgtagttgtaactgaggattgcggcaaccggggacccagcctcaggacgaccacggcgagcgggaaacttattacagagtggtgctgtcggtcctgcaccctcccaccgctccgctaccggggcgaagacgggtgctggtacggtatggagatccgcccgcttaaggagaaagaggagaacttagtgaacagcctcgtaacagcaggacacggccagatcgacaacttctcactgggcgtgttagggatggcgctgttcctggaggagatgctccggacacgcatcggcacgaagcatgccattctcctagtggccgtgagcttcgttacactgatcaccgggaacatgagtttccgcgacctcggccgcgtgatggtgatggtcggagcgaccatgacggatgacataggcatgggtgtgacctacctggccctcctcgccgcgttcaaggtgcgccccacattcgccgcaggtctgctgttgcggaagctgacctctaaggagctgatgatggccacgattggtattgcgctcctgtcgcaaagcaccatccctgagaccatcctggaactcaccgacgccctggccctggggatgatggtcctaaagatcgtacggaacatggagaagtaccagctggcggttacgatcatggccatatcgtgcgtcccgaacgcggtgattctgcagaacgcctggaaggttagctgtaccattctcgccgcagtcagtgtgagccccctactgttgacctccagccagcagaaggcggactggatccccctggctcttaccatcaaaggcctcaaccccacggccatattcctgaccaccctgtcccggaccagcaagaagcgctcgtggccgcttaacgaagcgatcatggccgtcggcatggtgagcatcctggctagtagcctgctcaagaacgacattcctatgacggggcccctggtggctggcgggctgctcaccgtttgttacgtgctgaccggccggagcgccgaccttgagctggaacgcgccgctgacgtcaagtgggaggaccaggcggagatctccggctcatccccgatcctgagcatcaccatctccgaggacggcagtatgtccatcaaaaacgaggaggaggagcaaacgttaacaatcctcatccggacgggcctgctggtcatcagcggggtgttcccggtgtccatccctatcaccgccgccgcctggtacctctgggaggtcaagaagcagcgcgccggcgtgttgtgggatgtaccatctccaccgcccgtagaaaaagcggagctggaggacggagcctatcgcattaaacagcgcggcatcctcgggtactcccagatcggcgccggagtttataaggagggcaccttccacacgatgtggcacgtcacccggggcgccgtactgatgcacagggggaagcgcatcgagcccagctgggccgacgtgaagaaggacctgatctcctacggcgggggctggaagctcgagggcgagtggaaggagggggaggaggtgcaggtcttagcgctggaacccgggaagaaccccagggcagtgcagaccaagcccgggatcttcaagacaaatacgggcaccatcggggccgtttctctcgacttttctcccggcaccagcggatcgcccatcgtcgaccggaagggaaaggtggtggggctgtacgggaatggggtcgtgaccagaagcggcgcctacgtgtccgccatagcgcagaccgagaagtccatcgaggacaaccccgagatcgaagacgacatattcagaaagaagcggctgaccattatggatctccacccaggggccggcaagaccaagagatacctgcccgccatcgtccgcgaggccatcaagcgggggctgcgtaccctgatactcgcgccgacccgagttgttgcggcagagatggaggaggccctgcggggcctgccaatccgctaccagaccccagccataaagacagagcataccgggcgggagattgtcgatctcatgtgccacgccacgttcaccatgaggctactgtcccccgttcgggtgccgaactataacctcattataatggacgaagcccacttcaccgaccccgcctccatcgcagctcgcggctacatcagcacccgcgtcgaaatgggagaggcggctggtattttcatgacggcgacgccacccggctccagggaccctttcccccagagcaacgccccgatcatggacgaggaacgggagatccccgagcgtagctggaacagcgggcacgagtgggtgacagatttcaagggaaagaccgtgtggttcgtcccatccatcaaggcagggaacgacatagccgcctgcctgaggaagaacggcaagaaagtaattcagctgtcgcgtaagacgttcgattccgagtacgtaaaaacacgcgccaacgactgggacttcgtcgtaaccaccgacatcagcgagatgggcgctaacttcaaggcggagcgagtgatcgaccctcggcgctgcatgaagccagtcatcctcacggacggggaggagcgtgttatccttgccggtcctatgccggtaacccactcctcagctgcccagcgccggggtcgaatcggccgcaaccccaagaatgagaacgaccagtatatctacatgggggaacccctggagaacgacgaggattgcgcccactggaaggaggcgaagatgctcctagacaatatcaacacccccgagggcatcataccgtctatgttcgaacccgaacgggaaaaggtagacgccatagacggcgagtaccgcctacgcggagaagccaggaagacgtttgtagacctcatgcggcgcggcgacctgcccgtgtggctggcatacaaggtcgccgcggaaggcatcaactatgccgaccggaaatggtgcttcgatgggataaagaacaaccaaatcctcgaagagaacatggaggtcgagatttggactaaggagggggagcgcaagaagttgaagccgcgttggcttgacgcgcgcatctattcagaccccctcgccctcaaggagttcaaggagttcgcagcaggccggaagtccctgaccctcaatctgataaccgaaatgggcagactgcctacattcatgacgcagaaagcccggaatgccctcgacaatctggccgtgctgcacacggcggaagccgggggccgcgcttacaaccacgccctctcagagctgcccgagaccttggagaccctcctattgctcacgctgctggccaccgtcaccggtggcatcttcctcttcctgatgtccggcaaggggatcggcaagatgacgctggggatgtgctgcatcatcaccgcgagtatcttgttgtggtacgcgcagatccagccgcactggatcgccgcctctattatcctggagttctttcttattgtgctgttaatccccgagccagaaaagcagcggacaccgcaggacaaccagctcacgtatgtagtgatcgccattctgactgtggtcgcggcgacaatggccaacgagatgggctttctggagaaaactaagaaggatctcggtcttggctccatcaccacgcaggagtcggagagcaacattttggacatagacctccgccccgcatcggcctggacgctgtacgccgtggccactactttcgtgactcccatgctacggcattccatcgagaacagctctgtcaacgtgagcctcacggccatcgccaaccaggcgacggtgctgatgggactgggcaaaggttggcctctctctaaaatggacataggcgtccccctgctggctatcggctgctacagccaggtgaaccctataaccctcaccgccgcgctgctgctactggtggcccactatgcgatcatcgggcccggcttacaagccaaggctacccgggaagcccagaaaagagccgcggccggcatcatgaaaaaccctacggtagatggaatcaccgtgatcgacctcgagcccatcccgtacgaccccaagtttgagaaacagctgggccaggtgatgctgttgatcctgtgcgtcacccaagtgctgatgatgcgcaccacatgggctctctgcgaagccttgactctggccaccggacccatctcaaccctatgggagggcaaccccgggcggttctggaatacgactatcgcagtgagcatggccaatatctttcgaggctcctacctggccggcgccgggctactcttcagcatcatgaagaacaccaccaacactaggcgggggaccgggaacatcggtgaaaccctgggcgagaagtggaagtcccgcctgaacgcgctcggcaagagcgagttccagatctacaaaaagtccggcatccaggaggtcgaccggaccctggccaaggaggggatcaagcgcggcgagacggaccaccacgccgtgagccgggggtccgccaagctgcgctggttcgtagagcggaatatggttaccccggagggcaaggtcgtcgatctcggctgcggccgcggcgggtggagctactactgcggcgggcttaagaatgtccgcgaggtgaagggccttactaagggcgggccgggtcacgaggagcccatcccaatgtccacatacgggtggaatctcgtgagactgcagagcggcgtcgacgtattcttcacgccgcccgagaaatgtgacaccctgctttgtgacatcggggagagcagccccaatcccaccatcgaggccggccggacgctgcgcgtactgaacctcgtcgagaattggctcaataacaacacccagttctgcatcaaggtgctgaacccgtatatgcccagcgtgatcgagaagatggaagcgctccagcggaagtacggcggggccctggtccgcaatcccctgtcacggaacagcacccacgagatgtattgggtttccaacgccactggtaatatcgtgagctccgtcaacatgatcagccgcatgttaatcaacaggttcacgatgaaacacaagaaggccacctacgaacctgacgtggacctcggttccggcacgcgcaatatcgggatcgagagcgaggtgcccaatctggacatcatcggcaagcggatagaaaagatcaagcaggagcatgagacctcctggcactacgaccaggaccacccgtataagacgtgggcttatcacggcagctacgagacgaagcagacggggagtgccagcagcatggtcaacggcgtggttcgcctgttgactaagccttgggatgtcgtgccgatggtgacgcaaatggccatgacggacaccacccctttcgggcagcagcgggttttcaaggaaaaagtggacacccgtacccaggagcccaaggagggcacgaaaaagctgatgaaaatcaccgccgagtggctctggaaagaattaggcaagaagaagacgccccgaatgtgcacccgggaggagttcaccagaaaggtgagatcgaacgccgccctgggggcgattttcaccgacgaaaacaagtggaaaagcgcccgcgaggcagtcgaggatggcagattctgggaattggtggaccgcgagaggaacctccatttggaagggaagtgcgagacctgcgtgtacaatatgatgggaaaacgcgagaagaaacttggggagtttggtaaggccaagggcagcagagctatatggtacatgtggctaggggcccgcttcctggagttcgaggcgctgggctttctcaacgaagaccactggttctcacgggggaatagcctgagcggcgtcgagggggaggggctgcatcgcctgggctacatcctgcgggacgtggggaagaaggagggcggggctatgtacgcagacgacaccgcgggctgggatacgcgcatcaccctggaagacctcaagaacgaggaaatggtaaccaaccacatgaagggggagcacaagaagctggccgaagccatcttcaaactcacctaccaaaacaaggtagtgcgggtccagcgcccgacgcccaggggcaccgtgatggacattataagtcgccgggaccaacgcggcagcgggcaggtcggcacctacgggctcaacacctttacgaacatggaggcacagttgatccgccagatggagggcgagggcatatttaaaagcatccagcacctgaccgccacggaggagattgcagtccagaactggcttgcccgggtggggcgtgagcggttaagcagaatggctatctccggcgacgactgcgtggtcaagccaattgacgaccgcttcgccagcgcgctgaccgcactaaacgacatgggcaaggtccgcaaggacatccagcagtgggagccgtcccggggctggaacgactggacccaggtgccgttctgcagccaccacttccatgagttggtcatgaaggacgggcgcgtattggtggtcccatgccggaaccaggacgaattgattgggcgcgcccgtatctcccagggagccgggtggtcgctaaaggagacggcttgcctaggcaagtcctacgcccaaatgtggactctcatgtactttcatcgtcgggatctcaggctggcggccaacgccatctgtagcgccgtgccgccccactgggtgccaaccagtcgaaccacatggagcatccacgcgaagcacgagtggatgaccaccgaggacatgctcgcggtttggaatcgcgtgtggatccaagagaatccctggatggaagataagacccccgtggagtcctgggaggaggtaccctacctggggaagcgggaggaccagtggtgcggtagcctgatcgggctcacgagccgcgccacctgggccaagaacattcagaccgccatcaaccaggtgcgatcgctgatcggcaatgaggagtataccgactacatgccgagcatgaagcgcttccgccgggaagaagaggaggctggcgtgttgtggtaa

SEQ ID NO: 25057 - RNA, 9876 nt, synthetic construct
  misc_feature 1..9876: note = derived and/or modified CDS sequence (opt11) from DENV-2__FJ850065__SS-prME
  source 1..9876: mol_type = other RNA
acagcgggggtcattgtcatgcttatacccacagcaatggcattccacctcacgacaaggaatggggaaccgcacatgatcgtagggcgccaagaaaaagggaaaagtcttctattcaaaaccgaagatggggtcaacatgtgcacgctaatggcaattgacctaggagagctttgcgaggatacgatcacatacaagtgtccactgttacgccaaaacgagcccgaggatatagactgctggtgtaacagcacgagcacctgggtcacttacggaacatgcaccacgacaggcgaacaccgacgtgaaaaacgatcagtcgcactcgtaccccacgtgggaatggggctggaaacccgcacagagacatggatgtccagcgagggggcatggaaacatgtccaacgaatagaaacgtggatcttacgacacccaggattcacaataatggcagccattctcgcgtatacaataggcacgacccactttcaacgcgcactgatattcatactactgacggcagttgcaccctcgatgacaatgcgctgtatcggtatctcaaaccgggactttgtcgaaggagttagcggcggaagttgggtagacatagtcctggagcacggctcctgcgtgacgacgatggctaaaaacaaacctacattagattttgagctcatcaagaccgaagcgaagcaaccggccactctacgtaaatactgcaccgaagcaaagctaaccaataccacgacggagagccggtgtcccacacaaggcgagccaagcctaaacgaagaacaagataagaggttcatatgtaaacacagcatggtagatcgaggttggggtaacggctgcggactcttcggcaaagggggaatcgtaacgtgcgcaatgttcacatgtaagaaaaacatggaaggcaaagtcgtccagcccgaaaacctcgagtacacgatcgttataacaccacattccggcgaagaacacgcagtagggaatgataccggaaagcacgggaaggaaataaaaatcactccccagagttccatcaccgaagcggagctgacaggctacggaaccgtgaccatggaatgcagccctagaactgggctagatttcaacgaaatggtcctcctgcaaatggaagacaaggcctggctcgtccaccgacaatggtttctagacctacccctaccctggctgccgggagcggatacccaagggtctaactggatccaaaaagaaacgttagtcacattcaaaaacccccacgcgaagaaacaagacgtagtggtcctggggagccaagaaggagcgatgcacacggccctcactggggccactgaaatccagatgagcagcggcaacctcctatttacaggacacctcaaatgcaggctgcgcatggacaaactacagctaaaaggaatgagttacagcatgtgcaccggtaaattcaaaatagtcaaagaaatcgccgaaacgcagcacggcaccatagttatacgtgttcaatacgaaggggacggatcgccgtgcaagattcctttcgaaattaccgatctagaaaagcgccatgtcctgggacgcctgataacggtaaaccccatagtaactgagaaggactcgcccgtgaacatagaggctgagccaccatttggagattcttacattatcataggcgtggaacctggccagcttaaacttaactggttcaagaaaggctcctccatcggccagatgttcgaaacgacaatgcgaggggcgaaacgaatggcaattcttggagacaccgcgtgggacttcggaagcctcggtggagtgtttacttccattggcaaagcgttacaccaagtattcggggcaatctacggcgcggcattcagtggtgtttcctggacgatgaaaatactaataggggtcataattacatggatcgggatgaactcacgttctacgtcccttagcgtttctctggtccttgtaggagtggtaaccttgtacctgggggcaatggtccaggcagactcgggttgtgtagtatcctggaaaaacaaggagctaaaatgcggaagcggcatctttataacggacaacgtacatacctggacagagcagtataagttccaacctgaatcacccagcaaactcgcctcagcgatacaaaaggcccacgaggaaggcatatgcgggatccggagcgtgactagacttgaaaacctaatgtggaaacaaatcacccccgaactcaaccatatattatccgaaaacgaggtaaaattgactataatgaccggggacataaaaggaataatgcaggctggaaagagatcgttacgaccacagcccacagagcttaaatatagctggaaaacgtggggtaaagctaaaatgctcagtaccgaaagccataaccaaacattcctaatagatggcccagaaaccgccgagtgtccgaacacaaaccgggcatggaacagtctggaggtggaagactatggatttggagtcttcactacaaacatctggctaaaactacgggaaaagcaggacgtattttgcgattcaaaactaatgtcggcagctattaaagacaaccgggcagtccatgccgatatgggatactggatcgagtccgcgctcaacgacacgtggaagatggaaaaagccagcttcatcgaggtaaaatcgtgccactggcccaagagccacactctatggagcaacggagtcctggagagcgaaatgatcatccccaaaaatttcgcgggcccagtgagccaacacaactaccgacccggataccatacacagacggccggtccatggcacctaggcaagctagaaatggatttcgacctgtgcgaaggaacaacagtagtcgtaacggaggactgcgggaaccgcggcccatcgctgcgaaccactactgcgtcgggaaagctcatcacggagtggtgctgcaggagctgcacactcccgcccttgcggtaccgtggagaagacgggtgctggtatggcatggagatcaggcccctcaaagagaaagaagaaaacctcgtcaacagcctcgtgacagctgggcatgggcagatcgacaacttcagtctcggagtactgggaatggcactcttcttggaagaaatgctaagaacccggattggaaccaagcacgcgatactattagtagctgtatcatttgtcactctaataaccggaaatatgagcttccgagacctcggacgagtgatggtgatggtaggcgccaccatgactgacgatatagggatgggagtgacgtacctagcacttttagcagccttcaaagtcagaccgactttcgcggcagggctactactcagaaagctcacaagcaaagaacttatgatggcaaccattggaatcgcactcctttcacagagtacaataccagaaacaatattagaattgacagacgcactcgcgttgggaatgatggtcttaaagatagtaagaaacatggagaagtaccaacttgcagtcaccattatggcgatctcatgtgtccccaacgcggtaatactacaaaacgcttggaaagtgagctgcacgatacttgcggccgtatccgtgtccccactactcttgacttcgtcacagcaaaaggcggactggatccccctagcattgaccatcaaaggcctgaaccccacggcaatctttttaacaacgctgtccaggacaagcaagaaacgcagctggccgttgaatgaagctattatggcggtaggaatggtctcaatactggcgtcgagcctattaaagaatgacataccgatgacgggcccgctcgttgcagggggactacttacggtgtgttacgtcctaacaggacggagtgcggatttggaactggaacgcgccgcggacgtaaagtgggaagaccaagcagaaatctccggtagttcacccatcctatcgataaccataagcgaggatggctcaatgtcgataaagaacgaggaagaggaacaaaccctgacgatactcatcagaaccggcctgctcgtgatctctggcgtattcccggttagtatccccataactgcagcagcctggtacctgtgggaggtgaaaaagcaacgcgcaggcgtcctttgggacgtgccttccccgccgccagtggaaaaagccgaactagaagacggggcgtatcgaattaagcagcgagggatactggggtattcacagataggggctggcgtgtacaaggaagggactttccacacaatgtggcatgtcacaagaggggctgtcctcatgcatcgaggcaagcgaatcgagccgagttgggccgacgttaaaaaggacctaatctcatatggaggtggatggaaactggaaggcgagtggaaagagggtgaagaagttcaagtgttggcgctcgagcccgggaagaacccccgagccgtacagacaaaacccggtatttttaagacgaacacggggacaattggcgcagtctccctggacttctcgcctggtacatctggaagcccaatagttgatagaaagggcaaagtagttgggctatacggaaacggcgtcgtaacaaggagtggagcatacgtgtccgcaattgcacagacggaaaaatccatcgaagacaacccagaaatcgaggaggacatcttccgaaagaagagactcacaatcatggacctccacccgggcgccggcaagacgaaacgatacctacccgcgatagtccgcgaagccataaaaagaggcttacggacgctcattctggcgccgacgcgtgtagttgctgcagaaatggaggaagcactacgcggcctacccatacgctaccaaacaccagctattaagacagagcacacggggcgagaaatcgtggacctgatgtgccacgccaccttcacgatgcgcctactatccccggtacgggtacctaactacaatttgataatcatggacgaagcacactttacagatcctgcctcaattgcggcccgcggatacatcagtaccagggtagagatgggcgaggccgccggcatattcatgactgctacgccgcctggaagccgcgacccgttcccgcagagcaatgcacccattatggacgaagaacgcgagatcccagagcgttcatggaacagtggccacgaatgggttaccgacttcaaaggaaaaacagtctggttcgtacccagcatcaaggcgggcaacgacatcgcagcgtgcctgcgcaaaaacgggaagaaagtaatacaactctcaagaaaaacattcgacagcgagtacgtgaagacccgggcgaacgattgggactttgtcgtgactaccgacatatccgagatgggagccaatttcaaagcggaacgtgtaatagacccgcgacgatgcatgaaacccgtgattctaaccgatggcgaagaaagagtcatcctagccggacccatgcctgtgacacacagctcagcagcgcagcgccgagggagaattggacggaacccgaaaaacgagaacgaccagtacatctacatgggggaaccacttgaaaacgacgaagattgtgcacactggaaagaggcaaaaatgctgctagacaatattaacacgccagaaggaattattccatcgatgtttgaaccggaaagagagaaggtagacgcgattgacggggagtacaggctcaggggagaagcacgaaaaactttcgtagatctcatgcgaagaggcgacctacccgtttggttggcctataaggtggcagccgaggggatcaactacgccgaccgaaaatggtgcttcgacggaatcaaaaacaaccagatactagaggaaaacatggaagtggaaatatggacaaaggagggagagagaaagaaactcaaacctcggtggctggacgcccggatctactccgacccactagccttaaaggagtttaaagagttcgcagccggacgcaaatcgcttaccctcaatttgataacagaaatgggaagactaccgaccttcatgactcaaaaggcgcgcaacgcactggacaacctggctgtactgcacaccgctgaggcaggagggagagcgtacaatcatgcactaagcgaacttccagagacactcgaaacgctgctcctcctcacattgctagcaaccgtgaccgggggtatcttcctgttcctaatgagtgggaaaggtatcgggaaaatgacgctaggaatgtgctgcataattacggcttcaatattactgtggtacgcgcagattcaaccccattggatagcagcatcgatcatactggagttcttcctgatcgtgctactcatacccgaaccagagaagcaacggacgcctcaggacaatcagcttacctacgtggtaatcgcgatactaacggttgtcgctgcaacaatggctaacgaaatggggttcctagagaaaactaagaaagacttaggcctaggatcaatcacaactcaggaatccgagtcaaatatactagacatagatctcaggccggcaagcgcatggaccctctacgcagtggcgacgaccttcgtaacaccgatgcttcgacactccatagagaatagctccgtcaacgttagcctaaccgcaatagccaaccaggcgacggtgctaatgggactggggaagggatggcctctaagtaaaatggacattggcgtccctcttttagccatagggtgctatagccaggtgaacccgatcactctaacagcggcattactcttattggtggcccactacgccataatcggacccgggctgcaagcaaaagccacccgggaagctcagaagagagcagccgcaggcatcatgaaaaacccaaccgtagatggtatcacggtaatcgacctggagcctataccgtatgaccctaaattcgaaaagcagctcggacaggtgatgctactcatactgtgcgttacccaagtgctaatgatgagaacaacttgggctctatgcgaagcgctcaccctggcaaccggaccgatttcaacactgtgggagggaaaccccggaaggttttggaacacgacaatagccgtaagtatggcgaacatattccgcggaagctacctagccggcgcaggactactctttagcataatgaaaaacacaacaaacactaggagggggacaggcaatatcggagaaaccctaggcgagaagtggaagtcacggctcaacgctcttggaaagtccgaatttcagatatacaagaagtcagggatacaggaagtcgaccgtacattggcgaaagaggggataaagcggggcgagacagatcaccatgcggtatcccgcggctctgcgaagctacgatggttcgtcgaacgaaatatggtgaccccagagggcaaagtggtcgacctggggtgcggccgaggagggtggagctattattgcggaggccttaaaaatgtccgcgaagtaaaaggtctcacgaaagggggaccaggccatgaagaaccgatcccgatgtcaacctacgggtggaatctcgtaagactccagtcgggcgtcgacgtcttcttcacaccaccagaaaaatgcgacacccttctctgcgacatcggcgagtcaagcccaaatccaacgattgaggcaggaagaactcttagggtgttaaatctcgtagagaactggttgaacaacaatacgcaattctgcataaaagtactaaacccgtacatgcccagcgtgatcgagaaaatggaagccctgcagcgaaaacatggaggggccttggtacgcaacccgctgagtcggaacagcacgcacgaaatgtactgggttagcaacgccacgggaaacatcgtaagttccgtcaacatgatcagcaggatgctgataaaccgattcactatgaaacacaaaaaggcaacatacgaaccagacgtggatctgggaagcggcaccagaaatatcggcatcgagagcgagataccaaacctggatataatagggaagaggatagaaaagataaaacaagaacatgaaacatcttggcactacgatcaagatcacccttacaaaacttgggcataccacgggtcatacgagacgaaacagacagggagcgcctcgagtatggtcaacggggttgtgagactgctaacgaaaccgtgggacgtcgtcccaatggttactcagatggcgatgacagacacgacgcctttcggccaacaaagagtctttaaagagaaagtcgatacaagaacccaagaaccgaaagaaggtaccaagaaactcatgaaaataaccgccgagtggctatggaaagaactaggcaagaagaaaacaccacggatgtgtaccagagaagagttcaccagaaaagttagaagcaacgcggctctaggggcgatattcacagacgaaaacaaatggaaatccgcaagagaagcggtagaggatggaaggttctgggagctcgtagacagagagcgcaacttgcacctcgagggcaaatgcgagacatgcgtatacaatatgatgggcaaaagagagaagaagctcggtgagtttggcaaggcaaaaggcagtcgtgcgatctggtacatgtggctaggggcgcgtttcttagagttcgaggcactgggctttttgaacgaagatcactggttctcgagggggaatagcctatccggagtagaaggcgagggactccatcgcctaggctacatactacgtgatgtgggtaaaaaggaagggggtgccatgtacgccgacgatacagcgggctgggacactaggataacactagaagatctcaagaacgaagagatggtaactaaccacatgaaaggcgaacacaagaagctggcggaggcaatcttcaaactcacgtaccaaaacaaggtagtgcgcgtacaaagacctacaccgaggggcacggtaatggacataatatcacgacgcgaccaacggggcagcgggcaggtcggaacctacggactaaataccttcacaaatatggaagcgcagctaatcaggcaaatggaaggagaggggatcttcaaatcgatccaacacctaacggccactgaagagatagccgttcaaaactggttagccagagtgggacgcgaacggctaagtcgcatggcgatctcaggtgatgactgcgtggtaaagcccatagacgaccggttcgcttcggcactgacagccctaaacgacatgggaaaggtgagaaaagatatacagcaatgggaaccgtcccgaggctggaacgactggacccaagtgccattctgcagtcatcatttccatgagctagtcatgaaggatggacgagtgcttgtcgtcccgtgtcgaaaccaggatgaattgatcggccgagcacggatatcacaaggagccggatggtccctaaaggagacagcctgcctgggcaagtcgtacgcacaaatgtggaccctgatgtactttcatcgtcgggatttacgattagcggcgaacgcgatctgcagtgcagttccgccgcactgggtacccacctcgcgaacaacttggagtatccacgccaaacacgaatggatgacaacggaggacatgctcgcagtctggaacagagtctggatccaagaaaacccatggatggaggacaagacaccggtcgagagctgggaggaggttccatacctaggaaaacgggaagatcaatggtgcggaagcctcatcgggctcacttcgagagcaacctgggccaaaaacatccagacagcgatcaaccaagtaagatctctaataggcaatgaagagtacacagactacatgccttccatgaaacgattccggcgtgaggaagaagaggctggggtattatggtag

SEQ ID NO: 25058 - RNA, 9876 nt, synthetic construct
  misc_feature 1..9876: note = derived and/or modified CDS sequence (opt11) from DENV-2__FJ873808__SS-prME
  source 1..9876: mol_type = other RNA
accgccggcgtcatagtaatgctgatccccacggccatggcgttccacctcaccactcgaaacggggagccccacatgatcgtgggccggcaggaaaaggggaagtccctgctgtttaagaccgaggatggcgtgaacatgtgcaccctcatggccattgacctgggggaactgtgcgaggacaccatcacttataagtgtcccctcctgcgccagaacgagcccgaggacatcgattgctggtgcaatagcaccagtacctgggttacctacgggacctgtaccaccactggcgagcaccggcgggagaagcgttccgtggccctggtgccccatgtcgggatgggcctcgagacccgcaccgagacctggatgagctccgagggggcctggaagcacgtacagcggattgagacatggattctccgccaccccggcttcaccatcatggctgcgatcctagcctacaccatcggaaccacgcacttccagcgggccctcatcttcatcctgcttaccgccgttgcgcccagtatgaccatgcgttgcatcggcatctccaacagggacttcgtcgagggcgtatcggggggctcctgggtggacattgtcctcgagcacggtagctgtgtgacgacaatggccaagaacaagccaactttagacttcgagctgatcaaaaccgaggccaagcagcccgccacactccgaaagtactgcatcgaggccaaactgactaacaccaccaccgagtcccggtgcccgacacagggcgagccgagccttaacgaagagcaagataaacgcttcatctgcaagcactccatggtggaccggggctgggggaacggctgcgggttattcggaaagggagggatcgtgacatgcgcgatgttcacctgcaagaagaacatggagggaaaggtcgtgcagcccgagaacctggagtacaccattgtcatcacgccccacagcggggaggagcatgccgtgggcaacgataccggtaagcacgggaaggagatcaagatcacaccccagtccagcatcacagaagcagagctaaccggctatggcacggtgaccatggaatgtagcccccgcaccggcctagacttcaacgagatggtcttgctgcagatggaggacaaggcctggctcgtgcaccggcagtggttcctggatctccccctcccctggcttccgggggccgacacccagggcagcaactggatccagaaggagacgctggtgacattcaagaacccccacgcgaaaaagcaggatgttgtggtcctcgggtctcaggagggcgctatgcacactgccctaaccggcgcgactgaaattcagatgagcagcggtaacctcctgttcaccggccacctgaagtgccgcctgcggatggacaagctccagctgaaggggatgtcgtacagcatgtgcaccggcaagttcaagatcgtcaaagagatcgccgagactcagcacggtacgattgtgattcgcgtccaatacgagggcgacggctccccctgcaagatccccttcgagatcaccgacttggagaaacgccacgtgctcgggcgcctgatcaccgtgaacccgatcgtcaccgaaaaagactcgcccgtcaacatcgaagcggaaccgccttttggtgactcctacattataatcggtgtggagccgggtcaattaaagctcaactggttcaagaaggggtctagtatcggccagatgttcgagactaccatgcgcggtgctaagaggatggccatcctgggggacactgcctgggatttcggctctctcgggggcgtcttcacctccatcgggaaagctctccaccaggtgttcggagctatctacggcgcggcctttagcggggtgtcctggactatgaagatcctgatcggcgtcatcatcacctggatcggaatgaacagcagatccaccagcctgtccgtgtcactggtccttgtcggcgtggtgaccctgtacctgggggctatggtccaggccgactccggctgcgtcgtgtcttggaagaacaaggagctcaagtgcggctcagggattttcatcacggacaatgtccacacctggacagagcagtacaagtttcagcccgagagccccagcaagctggcatccgccattcagaaggcgcacgaggaagggatctgcgggatccggagcgtgacccgcctggaaaacctcatgtggaagcagatcacgcccgagctgaaccacatcttgtcagagaacgaggtgaagctcaccatcatgaccggagacatcaaggggatcatgcaggccggcaagcgtagcctgcgtccacaacccaccgagctaaagtacagttggaagacgtggggcaaagcaaagatgctcagcaccgaatcccataaccagaccttcctgatcgacgggcctgaaaccgcggagtgtccgaatacgaaccgggcgtggaacagcttggaggtcgaggattacgggttcggggtgttcaccaccaacatctggcttaaactgcgcgagaagcaagacgtgttttgcgattccaaactgatgagcgccgccatcaaagacaatcgggccgtccacgcagacatgggctactggattgagtccgccctcaatgacacctggaagatggagaaggccagctttatcgaggtaaagtcctgtcattggcccaagagtcacaccctgtggtccaatggcgtgctagagagcgagatgatcattcccaagaacttcgccgggcccgtttcccaacataattaccgcccgggctaccacacccagaccgcggggccctggcacctcggaaagctggagatggactttgacctgtgcgaggggacgacggtggttgtcacggaggactgcggcaacaggggccccagcctgcgtacaactaccgcaagcggtaagttaataacggaatggtgctgcaggtcctgcaccctgcctccgctccggtaccgtggggaggacgggtgctggtacgggatggagattcgcccgctgaaggagaaggaggagaatctggtgaacagcctcgtgaccgccgggcatggacaaatcgacaacttctcccttggcgtcctgggaatggccctcttcctggaggagatgcttcggacacgcatcggcacgaagcatgcgatactcctggtggctgtgagctttgtcacccttatcacaggaaatatgtccttccgggacctcggccgtgtgatggtgatggtcggggccactatgacggacgacatcgggatgggcgtaacttacctggccctgctcgccgcgttcaagatccgcccgaccttcgccgccgggctgcttctccggaagctgaccagcaaagagctgatgatggcaacgattggcatcgccttattgagccaaagcaccatccccgagaccatcttagagctcaccgatgcgctagcgctcggcatgatggtgctgaagatcgtacgcaacatggagaaataccaactggccgttacgatcatggccatatcctgcgtgccgaacgccgtcatcctgcagaacgcgtggaaggtttcatgcgcaatcctcgccgccgtgtccgtctcacccctgctgctcacctccagcaagcagaaggcggactggatcccgttagccctgaccatcaagggcctaaaccccacggcaatattcctgacaacattatcccggaccagcaagaagaggagttggccgttaaacgaggccgtcatggccgtcggtatggtgtctatcctggccagtagcctgctcaagaacgatatacccatgaccgggcccctggtggcaggtggtctgctcaccgtctgctatgtgctgaccggccggagtgccgatctggagctcgagcgcgccgccgacgtaaaatgggaggaccaggcggagatctccggaagctcccccatcctgagcataaccatttccgaggacggtagcatgtccatcaagaacgaggaagaggaacagaccctgacgatcttgatccggaccggcctcctggtcatcagcggggtgttccccgtgtccatccccatcactgccgccgcctggtacctctgggaggtaaagaagcagcgcgccggcgtgctgtgggacgtgcccagcccgccgcccgttgaaaaggcggagctggaggacggggcgtaccgtatcaaacagcgcggcatccttgggtactcacagatcggcgccggagtctacaaggaagggaccttccataccatgtggcacgtaactcgcggcgctgtcctgatgcaccgcgggaagcggatcgaaccctcgtgggccgacgtgaaaaaggatttgatctcctacggcgggggctggaagctcgagggcgagtggaaggagggggaagaggtgcaggtcctggcgctggaacccggcaagaacccaagagccgtgcagacgaagcccgggatcttcaagactaatacaggcacgataggtgccgtgagcctcgacttctcccccgggaccagcggtagccccatcgttgaccggaagggaaaggtggttggcctgtacgggaacggcgtcgtcacccgtagcggtgcttatgtctcagcgatcgcccagaccgagaagtctatcgaggacaaccccgaaatagaggacgacatctttcggaagaagcgcctaaccatcatggacctacaccccggggccggcaagaccaagcggtacctgcccgccatcgtgcgcgaggccatcaagaggggcctccgcactttaatcttagcgcccaccagggtggtggcggccgagatggaagaggccctgcggggtctgcccatccgataccaaactccagctatcaagaccgaacacacgggtcgcgagatagtcgacctaatgtgccacgctacttttacaatgcgcctactgtcccccgtgcgggtgccgaattacaacctcattataatggatgaagcccatttcaccgaccccgcctccatagccgcccgcgggtatattagtacccgggtcgagatgggcgaggcggcagggatcttcatgacagccacgccacccggctcccgcgatccgttccctcagagcaacgccccgatcatggatgaagagcgggaaatccccgagcgatcctggaactccgggcacgagtgggtgaccgacttcaagggcaagaccgtgtggtttgtcccgtcgatcaaggcggggaacgatattgccgcgtgcttgcggaagaacggtaagaaggtgatccagctgtcacgcaagaccttcgactccgagtacgtaaagacgcgggccaacgattgggacttcgttgtgaccaccgacataagcgagatgggcgcgaacttcaaggccgagcgcgtgatagacccccggcgctgcatgaagcccgtcatcctcaccgacggggaagagcgggtgatcctggccgggcccatgccagtgacccattcgagcgcagcccagcgtcgggggcgcataggccgcaaccccaagaacgagaacgaccagtacatctacatgggggagcccctggaaaacgatgaagactgcgcccattggaaggaggcgaagatgctcctggacaacatcaacactcccgagggtataatcccgtccatgtttgagcccgagagagagaaggtggacgccatcgacggcgagtaccgattacgcggggaggcccgcaagacgttcgtcgatctcatgcggcggggtgacctgccagtatggctggcctacaaggtagccgctgaggggatcaactacgccgaccggaaatggtgcttcgacggaattcgcaacaaccagatactcgaggagaacatggaggttgagatctggactaaggagggggagcggaaaaagctgaagccgcgctggctggacgcccggatctactcagaccccctcgccttaaaagagttcaaggagttcgcggccggccgcaagtccctaactttaaatctgataaccgagatgggcaagttaccgaccttcatgacccagaaggcgcgaaacgcccttgacaacctggccgtactgcacacggcggaagccggggggcgcgcttacaaccacgccctcagcgagctgcccgagaccctggaaaccctacttctgctcactctcctggcgaccgtaaccgggggcatattcctcttcttgatgtccggcaaggggatcggcaagatgaccttggggatgtgctgcatcatcaccgcgtccatcttactgtggtatgcccagatacagccgcactggatcgccgcatctatcatcctggagtttttcctgatcgtgctgctgattcctgaaccagagaagcaacgaacgccgcaggacaatcagttgacgtacgtcgtgatcgccatcctaaccgttgtcgcggccaccatggccaacgagatgggttttctggagaagaccaagaaagacctcgggctgggcagtatcacgacccaagagagcgagtccaatatactggatatcgacctccgcccggcctccgcctggaccctgtacgcagtagcaaccacgttcgttaccccaatgctgagacactccatcgagaacagctccgtcaacgtgagcctcaccgcaatcgccaatcaggcgaccgtgctgatgggtctggggaagggctggcccctatccaagatggacatcggggtcccgctgctggcgatcggttgctatagtcaagtgaacccaattacgttgaccgctgcgttgctgctcttggtagctcactacgccattatcgggcctggcctgcaagccaaggccacccgcgaggcccaaaagcgggccgcagccggcatcatgaagaaccccaccgtcgacgggattacggtgatcgacctcgagcccattccgtacgaccccaagtttgagaagcaattaggccaggtgatgctgctcattctgtgcgtcacccaggtgctgatgatgcgcaccacctgggccctctgcgaggccctaacgctggctaccgggcccatttccaccctctgggagggtaacccggggcggttctggaataccacgatcgcggtgagcatggccaacatcttccgcggctcgtacctggcgggagccgggttactgttcagtatcatgaagaacaccaccaacacgaggcggggcacggggaacattggagagaccctgggcgagaagtggaagtcccgcctgaacgctctaggcaagagcgagttccaaatttacaaaaagtccggcatccaagaggtcgatcgcactctggccaaggaaggaatcaagcgcggagagacggaccaccacgccgtgagccggggttctgccaaactgcgctggttcgtggaacggaacatggtaactccagagggtaaggtggttgaccttggttgcgggcgtggtgggtggagttactattgcgggggtctgaagaatgtccgggaggtgaaggggttgaccaagggtggacccggccacgaggagcccatcccgatgtccacgtatgggtggaacctcgtccggctgcagagcggagtcgatgtgttcttcacgccgcccgagaagtgtgatacgctgctctgtgacatcggggagtcgtcccccaatccgactatcgaagccggacgcaccctaagagtgctcaacctcgtcgaaaactggctgaacaacaacacacagttctgcatcaaagtgctgaacccgtacatgcccagcgtgatcgaaaagatggaggcgctccaaagaaaatacggcggggccctggttcgcaaccccctgagtcggaacagtacacacgagatgtactgggtgtcgaacgccacgggaaacatcgttagctccgtcaacatgataagccgcatgctgatcaaccggttcaccatgaagcataagaaggccacctacgagccggatgtggacctcgggtcgggcacgcgcaacattgggatcgagagcgaaatccctaacctggacatcataggcaagcggatcgaaaagataaaacaggagcacgagacgtcctggcactacgaccaagaccacccctataagacttgggcctaccatggctcttacgagacaaagcagaccgggagtgctagctcaatggtgaacggcgttgtgcgcctgctcacgaaaccttgggacgtggtcccgatggtgactcaaatggccatgaccgacacgacccccttcggacagcagcgcgtgttcaaggagaaagtcgacacccggacccaggagcccaaggagggcactaagaagctgatgaagatcacagcggagtggctttggaaggagctaggcaagaagaagacacctagaatgtgcacccgggaagagttcacccgcaaggtccgttcgaacgccgccctgggggctatcttcacggatgagaacaaatggaaatccgcccgcgaggccgtagaggacggccggttctgggagctggtcgaccgcgagcggaacctccacctggaggggaagtgcgagacctgcgtgtacaacatgatggggaaacgcgagaagaagctgggggagttcggtaaagccaagggcagtcgggcgatttggtatatgtggctcggggcccgcttcctggaattcgaggccctgggcttcctcaacgaggaccactggtttagtcgcgggaactcccttagcggcgtggaaggggagggcctacaccgcctcggctacatcctccgtgacgtagggaaaaaggagggaggtgcaatgtacgccgacgacaccgctggctgggacacccgcatcacgctggaggacttaaagaacgaggagatggttacgaaccatatgaagggggagcacaagaagctggccgaggccatcttcaaattaacttaccagaacaaagtcgtgcgggtgcaacgcccgacgccccggggcacggtcatggacatcatctcccgccgggaccagcgcggcagcggtcaggtcggtacctatgggctcaataccttcaccaacatggaggcccagctgatacgccagatggagggggagggcatcttcaaatcaatccagcacctgacggccaccgaagaaatcgcagtgcaaaactggctcgcccgggtcgggcgcgagcgtctgagccgcatggccatctccggcgacgactgcgtggtgaagcccatcgacgaccgattcgcctccgccctaaccgcgctcaacgacatgggaaaggtccgtaaggacatccaacaatgggaaccctcccggggctggaatgactggacacaggtgccgttctgctcccaccacttccacgagctggtgatgaaggacggtcgcgtcctcgtggtaccatgtcggaatcaggatgaactcattggaagggcgcggatctctcagggcgccgggtggagcctgaaggagacggcctgcctgggcaaaagttacgcacagatgtggaccctcatgtacttccacagacgggacctgcgcctggcggcgaacgccatctgcagcgcggtgccgccgcactgggtaccaacatcccgcactacctggtcgatccacgcgaagcacgagtggatgacgaccgaggatatgctcgccgtgtggaaccgcgtctggatccaggggaatccctggatggaggataagacgcccgtggagtcctgggaggaagtgccctacctaggcaaacgagaggaccagtggtgcgggtcgcttataggtctgacctcccgcgccacatgggccaaaaacatccagaccgctatcaaccaagtccggagcctgattggtaacgaagaatacaccgactacatgccgtctatgaagcgcttccgtcgcgaagaggaggaggcgggggttctatggtga

SEQ ID NO: 25059 - RNA, 9876 nt, synthetic construct
  misc_feature 1..9876: note = derived and/or modified CDS sequence (opt11) from DENV-2__FJ850120__SS-prME
  source 1..9876: mol_type = other RNA
accgccggagttatcgtgatgttgattccaacggccatggcgttccatcttacaacccgcaacggtgagccccacatgatcgtgggacggcaggagaaggggaagtcactgctattcaagaccgaggatggagtgaacatgtgcacgctcatggctatcgacctgggggaactgtgcgaagacaccatcacctataagtgccccctactgagacagaacgaacccgaggacatcgactgctggtgtaacagcactagcacttgggtcacgtacgggacttgcaccaccacgggcgagcacaggcgcgagaagaggtccgtagccctggtgccgcacgtgggcatgggcctcgaaaccaggactgagacttggatgagctccgagggggcctggaagcacgttcagcggattgagacatggatcctgcgccacccgggcttcaccatcatggccgcaatcctggcctacacaatcgggaccacgcacttccagcgggcgctcatcttcatccttctgaccgccgtggcgcccagcatgactatgcgctgcatcggcatcagcaaccgggacttcgtcgagggagtgagcgggggctcctgggtggacatcgtactcgaacatggaagctgcgtaaccacgatggccaagaacaagccaactctggacttcgagctcatcaagaccgaggccaagcagccggcgaccctgcgcaagtactgcatcgaggctaagctgacgaacaccaccaccgagtcccggtgcccaacacagggcgagccaagcctgaacgaggaacaggacaagcgtttcatatgcaaacactccatggtggaccgcggctgggggaacggttgcgggttgttcggcaagggcgggattgtgacatgcgcgatgttcacgtgcaaaaagaacatggagggcaaggtggtgcagccagagaacttggaatatacaatcgtcatcacgccccacagcggagaggagcatgctgtgggcaacgacacaggtaagcacggcaaggagatcaagatcaccccgcagtctagtgttaccgaggccgagctaaccgggtacgggacggtgacgatggagtgtagccctaggaccggcctcgacttcaatgagatggtacttcttcagatggaggacaaggcctggttagtacaccggcagtggttcctcgatctgcccctcccctggctgcctggggccgacacccagggcagcaactggattcagaaagaaacgctggtcactttcaagaatccccatgcgaagaaacaagacgtggtcgtgctcgggtcacaggagggcgccatgcacaccgctctgactggtgcgacggaaattcagatgagcagtgggaatctactgttcaccggccacctgaagtgccggttaagaatggacaagttgcagctgaaggggatgtcctatagcatgtgcaccggcaagttcaagattgttaaggagatcgccgagacccagcacggcacgatcgttatccgcgtgcagtacgagggcgatggctccccctgcaagattcccttcgagatcaccgacctggagaagcggcacgtgttgggccgccttataactgtcaaccccatcgtgacggaaaaggacagccccgttaacatcgaggcggaaccgcccttcggtgactcctacatcataatcggggtcgagccgggccaactaaagctaaattggttcaagaaggggtcgtcaattggccagatgttcgaaacgaccatgcgcggcgccaagcggatggccatccttggggacaccgcctgggacttcggcagcctcggcggggtttttacctccatcgggaaggcactccaccaggttttcggcgcgatctatggcgctgcgttctccggggtgtcctggactatgaagatcctcattggagttatcattacgtggatcgggatgaatagccggtccaccagcttgtcagtaagcctggtactcgtgggcgtcgtgaccctgtacttaggcgcaatggtgcaggccgactccggctgcgtggtgagctggaaaaacaaggagctcaaatgcggatcagggatcttcatcacggacaatgtacacacctggaccgagcagtacaagtttcagcccgagagcccctcaaaactggcctccgctatacagaaggcccatgaggaaggcatctgcgggatccggagtgttactcgcttagaaaacctcatgtggaagcagatcacccccgagctgaaccacatcctgtccgagaacgaggtcaagctaaccataatgaccggcgacatccggggtatcatgcaggccggcaagcgaagcctgaggccccagcccaccgagctgaagtattcctggaaaacgtggggcaaggcgaagatgctcagcaccgaatcccacaaccagaccttcttgatcgatggcccagagactgcggaatgcccgaacaccaatcgcgcctggaacagcctggaggtagaggattacgggttcggggtgttcaccacgaacatctggctcaagctgcgtgagaagcaagacgtcttctgcgactccaaactgatgagtgccgccatcaaggacaaccgcgccgtgcacgcagacatgggctactggatcgaatccgccctcaacgacacttggaaaatggaaaaggccagcttcattgaagtgaagagttgccactggccgaaaagccacaccctttggtccaatggcgtcctggagagcgagatgattatcccaaagaacttcgcagggcccgtgtcccagcacaattaccgtccgggctaccacacgcagaccgccgggccctggcatctcggcaaactcgagatggatttcgatctgtgcgaagggaccacggtggtcgttactgaggattgcggcaatcgaggcccaagtctacgtacaaccaccgcgagcggaaagctgatcacggaatggtgctgtagatcctgcaccctgccgccgctcagataccgtggcgaggatgggtgttggtacggcatggagatccggcccctcaaggagaaggaggagaacctcgtaaattccctcgtcaccgccgggcacggccagatcgataacttttcattgggcgtacttggaatggcactcttccttgaggaaatgctgcggacccggattggcacgaagcacgcgatcttgctcgtcgccgtgagcttcgtgaccctaattaccgggaacatgtcctttcgagacctcggccgagtgatggtcatggttggggccaccatgacggacgacataggcatgggggtgacctacctggccctcctcgccgcgttcaaggtccggcccactttcgccgccgggttactgctcaggaaacttaccagcaaggagctgatgatggcaactatcggcatcgccctcctatcccagagcacgatcccggagaccatcctggagctcaccgacgcgctcgccctagggatgatggtgctcaaaatagtccggaacatggaaaagtaccagctggcggtcacgatcatggctatctcctgtgtgccaaacgccgtgatcctgcagaacgcttggaaggtatcgtgcacaatcctcgccgctgtgtccgttagccccctgctgctcaccagctcccagcaaaaggcagactggatccccctggctctgaccatcaagggcctcaatcccacagcgattttcctaaccaccctaagtcgcaccagcaagaagagaagctggccactcaacgaggccatcatggccgtgggaatggtgagcattctggcaagctcgctgctcaagaacgacatccccatgaccgggcctttagtcgctggcggtctgctcaccgtgtgctacgtgctgaccggccgcagcgccgatctggagttagagcgggctgcggacgtcaagtgggaggaccaggccgagatctcggggagctcccccatcctttctatcaccatttccgaggacggcagtatgagcatcaagaacgaggaggaggagcagactctgaccattctaatcaggacgggcctgctagtgatctccggggttttcccggtatcaatccccatcaccgcggccgcctggtacctctgggaggtgaagaaacagcgggctggcgtgttgtgggatgtcccgtcacctccgcccgtggagaaggccaagctggaggacggggcgtaccggatcaagcagcggggcattctcgggtacagccagatcggcgccggcgtgtacaaagaagggacattccacaccatgtggcacgtcacgcgcggggcagtgctgatgcatcgggggaagcgcatcgagccctcatgggcggacgtcaagaaggacctgatctcctacggcggtggctggaagctcgagggcgaatggaaggagggcgaggaggtccaggtgctagccctggagcccggcaagaacccccgcgctgtgcagactaagccagggatcttcaagaccaacaccgggaccatcggagccgttagcctcgacttctcccctggcaccagcggcagtcccatcgttgatcgcaaagggaaggtcgtaggcctgtacgggaacggtgtggtgactcggtcaggcgcctacgtctccgccatcgcgcagacggagaagaacatagaggacaaccccgagatcgaagacgacatcttccgcaagaagagactgaccatcatggacctacaccccggggccggtaagaccaagcgctacctgcccgccatcgtgcgggaggccattaaacgcggcctgcgcaccctgatcctcgctccaactcgcgtggtcgcagccgagatggaggaggccctgcgcggcctgcccattcggtaccagacaccggcgatcaagaccgagcacaccgggcgcgagatagtggacctcatgtgccacgccacgttcaccatgcggctgctgtctcccgtgcgcgtgccgaactacaacctcataatcatggacgaagcccacttcaccgatcccgctagcatcgccgcaaggggttacatctccacgcgcgttgaaatgggcgaggccgcgggcatatttatgactgccacaccgcctggttcccgggatccgttcccccagtccaatgcgcccattatggatgaggagcgcgagatccccgagcggagctggaacagtgggcacgagtgggtgaccgactttaagggcaagaccgtctggtttgtacccagcataaaggcgggtaacgacattgcagcttgcctgcgcaagaacggcaagaaggtgatccaactgtcccggaagacattcgatagcgaatacgtcaaaactcgcgcaaatgactgggactttgttgtgacaacagatatatcggagatgggggctaacttcaaggccgaaagggttatcgacccccgccggtgcatgaagcccgtgatcttgacggacggtgaggagcgcgtaatcctggcgggccccatgccggtcacccacagctccgccgcccagagaagggggcgcataggcaggaaccccaagaatgagaacgaccagtatatctacatgggggagccactcgagaatgacgaggactgcgcccattggaaagaggcaaagatgctcctggacaatatcaacacccccgaaggcataatccctagtatgttcgagccagagcgcgagaaggtggatgcgatcgatggcgagtaccgactgcgtggagaggcccgcaaaaccttcgtagacctcatgcgcaggggcgatttgccggtctggctggcatataaggtagccgccgaggggatcaactatgctgaccgcaagtggtgcttcgacgggatcaaaaacaaccagatccttgaggaaaacatggaggttgaaatctggaccaaagaaggggaacgtaagaagctgaagccgcgctggctggacgcccggatctactcagaccccctcgccctgaaagagtttaaagagttcgctgcgggccgcaagagcctgaccctcaacctgataaccgagatgggcagactgccaaccttcatgacgcagaaggcccgcaacgcgttggacaacctggctgtcctgcacaccgccgaggctgggggtcgggcatacaatcacgccctctccgagctgcccgaaaccctggagactttgctgctgctcactctgctggcgaccgtgaccggtggcattttccttttcctgatgagcggcaaagggataggcaagatgaccttggggatgtgctgcataatcaccgcctcaatcctcctgtggtacgcgcagatccaaccgcactggatcgccgctagcatcatcctagaatttttcctcatagtcttactgatccctgagcccgagaagcagcgcacgccccaggataaccagctcacctacgtagtgatcgcaatactgaccgtcgtggccgcaaccatggccaacgagatgggcttcttggagaaaaccaagaaagacctcgggcttggctccatcaccactcaggagagtgagagcaacatcctagacatcgacctccgaccggcctccgcctggactctgtacgccgtggccacgaccttcgtcacccccatgctgcgccactccatagaaaattcgagcgtcaacgtgtccctcaccgccatcgccaaccaggctacggtcctcatgggactggggaaaggctggcctttgagcaagatggacatcggggtgccactgctggccatcggctgctattcccaagtgaaccccattaccttaacggcagccctgctgctcttagtcgcccactacgccattatcgggcccgggctgcaggccaaagctacccgggaagcccaaaagcgcgccgccgccgggataatgaagaacccaacggtggacgggataaccgttatcgatctcgagccaattccgtacgaccccaagttcgagaagcaactgggccaggtcatgctgttaatcctgtgcgtgacccaggtcctcatgatgcggaccacatgggccttatgcgaagccctgaccttagccaccggccccatcagcaccctctgggagggcaacccaggccgcttctggaatacgacaatcgcagtctctatggcgaacatattccgcggcagctacctggcgggcgccgggctcttgttctcaatcatgaagaacaccaccaatacgcggcgcggcacgggtagcatcggcgagaccttgggcgaaaagtggaaatccaggctgaacgcacttggcaagagcgagtttcagatctacaagaagtccgggattcaggaagtagacaggacccttgcgaaggaggggatcaaacggggcgagacagaccaccacgccgtgagccgcgggtccgccaagttgcggtggttcgtagagcgcaacatggtgacaccggagggcaaggtggtcgacctggggtgcggacggggcgggtggagctactactgtggcgggctgaagaacgtgcgggaggtgaagggactaactaaaggtgggcccggccacgaagaacccatcccaatgtccacatatgggtggaacctcgtacggctgcaatcgggcgtagacgtgtttttcacaccgcccgaaaagtgcgacaccctcctatgcgacattggggagtcatcacctaaccccaccatcgaagcaggccgcacccttcgggtcctgaacttagtagaaaactggctgaacaacaacacccagttctgcatcaaggttctgaatccgtacatgcctagcgtcatcgagaagatggaggctctccagcgtaaatacggcggggcgctggtgcggaaccctctcagcagaaattcaacgcatgagatgtattgggtctccaacgccaccggcaacattgtcagctccgtgaacatgatcagccgtatgctgatcaaccggttcacgatgaagcacaagaaggctacatacgagccggacgtagacctggggtcaggcacgagaaacatcggcatcgagaacgagattcccaacctggatattatcggtaagcgcatcgagaaaatcaaacaggagcacgagaccagctggcactacgatcaggaccacccctacaagacctgggcctaccacggctcctacgagaccaagcagactgggagcgcttccagcatggtcaacggcgtggttcgcctgctcactaagccttgggacgtcgtgccgatggtgacgcagatggcgatgactgacacgacccccttcgggcagcaaagggtcttcaaggagaaggtggatactcgcacccaggagcccaaagagggcaccaagaagctgatgaagatcaccgccgagtggctgtggaaggagctcgggaagaagaagacgccacggatgtgcacgcgagaggagtttacgcggaaagtgcgctccaatgccgccctaggggccatcttcacagacgagaacaagtggaagtccgcgcgggaggccgtcgaggactcccgcttctgggagctggtggaccgggaacgtaatctccacctggagggtaagtgcgaaacctgcgtgtacaacatgatggggaagcgggagaagaaactgggggagttcgggaaagcaaagggctctcgcgcgatctggtatatgtggcttggcgcgcggttcttagagtttgaggccctggggttcctcaacgaggaccattggttctcccggggaaacagcctaagcggcgtcgagggcgagggtttgcaccgtctcggctacatcctgcgcgacgtgggcaaaaaggaaggcggtgccatgtatgccgacgacaccgctgggtgggacacgcggatcaccctggaggacctcaagaatgaggaaatggtcactaaccatatgaagggggagcataagaagttggcggaggccatattcaagctaacttaccagaacaaggtggtgcgcgttcagcggccgacaccccgcggtacggtgatggatattatcagccgacgcgaccagcgcggcagcggtcaggtggggacctacggcctcaacaccttcacgaacatggaggcccagctgatcagacagatggaaggggaaggtatattcaagagcatccagcacctgaccgctaccgaggaaatcgccgtccagaactggttggcgcgagttggccgggagcggctgtctcggatggccatctccggggacgattgcgtggtcaagccaatcgacgacaggttcgcgtcagccctgaccgccctaaacgacatgggcaaggtgcggaaagacattcagcagtgggagccgtcccgcgggtggaacgactggacccaagtccccttctgtagccaccacttccacgagctggtaatgaaggacggccgggtgcttgtggtcccatgtagaaatcaggatgaactcatcgggcgggcccgtatctcgcagggagccggctggtcgctgaaggaaaccgcctgcctgggtaaatcctacgctcagatgtggaccctgatgtacttccacaggcgcgacctgaggcttgcggcgaacgcaatttgcagcgctgtgccctcgcactgggtcccaaccagccgtaccacgtggtccatccacgccaagcacgagtggatgaccacggaggacatgctggcggtctggaaccgggtgtggatccaagaaaacccatggatggaggacaagacccctgtggagtcgtgggaggaggtcccctatctgggcaaacgcgaggatcagtggtgcgggtccctgatcggtcttactagccgggctacatgggccaaaaatatccaaaccgccatcaaccaagtacgcagcctgatcgggaacgaggaatacactgactacatgccctccatgaagagattccggcgcgaggaggaggaggccggcgtcctctggtaa

SEQ ID NO: 25060 - RNA, 9876 nt, synthetic construct
  misc_feature 1..9876: note = derived and/or modified CDS sequence (opt11) from DENV-2__FJ850121__SS-prME
  source 1..9876: mol_type = other RNA
acggctggcgtcatcgtcatgctaatccctaccgccatggccttccacctcaccacccgcaacggggagccacacatgatagtcggccggcaggagaaggggaagtccctgctctttaaaaccgaggacggcgtgaacatgtgcaccctcatggccatcgatcttggcgagctgtgcgaggacaccattacctataagtgccccctcctgcgccaaaacgagcccgaggacatcgactgctggtgtaatagcacgtctacttgggtcacctacggtacgtgcaccaccacgggcgagcaccggcgagagaaacgatcagtggccctggttccccacgtcgggatgggccttgagacccgcaccgagacctggatgtcatccgagggggcctggaagcacgtgcagcgcatcgagacttggatcctgagacacccgggcttcaccatcatggccgcgatcctggcctataccatcgggacaacccacttccagcgggccctcatctttatcctgctgaccgccgtggcgcccagcatgaccatgagatgcatcggtatctccaatcgggacttcgtcgagggcgtcagcggggggtcctgggtagacatcgtactcgagcacgggagctgcgtgacaacgatggccaaaaacaagcccaccctagatttcgagctgatcaagaccgaggccaagcagcccgctaccctccgcaagtattgcatcgaagccaagctgacgaataccacgaccgagagccggtgcccaacgcagggcgagccctcgctgaacgaggagcaggacaagcgattcatctgtaaacactccatggtcgaccggggctggggcaacggatgcgggctgttcggcaaaggcgggatcgtgacatgtgcgatgttcacctgcaagaaaaacatggaaggcaagattgtgcagcccgaaaacctggagtacactatcgtaattacaccccacagcggggaggagcatgccgtaggcaacgataccgggaagcacggcaaggaaattaagatcacaccgcagtccagcatcaccgaggccgagctgaccgggtacggaaccgttacaatggagtgtagccctcggaccgggctcgacttcaacgagatggtccttctgcagatggaagacaaggcctggcttgtgcaccggcaatggttcctggacctgcccctcccctggctgcccggggccgatacccagggcagcaattggatccagaaggagacgttagtgacatttaagaacccccacgctaagaagcaggacgtggtcgtgttagggtcccaggagggcgccatgcacacggccttaacgggcgccacggagatacaaatgagcagcggcaacctcctgttcaccggacacctgaagtgccgcctgcggatggacaagctgcagctgaaggggatgtcctacagcatgtgcaccggcaagttcaagatcgtcaaagagatcgccgagacccagcacgggacaatcgttatccgggtgcagtacgaaggcgacggctccccctgcaagatacccttcgagatcacagacctggagaagcggcacgtactagggagactcatcaccgtgaacccgatcgtgacggagaaggacagcccggtcaacatcgaggcagagccgcccttcggcgactcctacatcatcatcggggtggaaccgggccaactgaagctcaactggttcaagaaggggagctccattggccaaatgttcgagacgactatgcgcggcgccaaacggatggcaatcctgggcgataccgcctgggatttcgggagcctcgggggcgtgttcacctccatcggtaaagccctccaccaggtcttcggcgcgatctacggcgccgctttcagcggggtatcatggacgatgaagatcctgatcggtgtcatcattacatggatcggcatgaacagccgatccacgagcctgtccgtcagcctggtgctcgtgggggtcgtgacactgtacctcggggccatggtgcaagcggactccggctgcgtcgtgtcgtggaagaacaaagagttgaagtgcggctccggaatcttcataacggataacgtccacacctggaccgagcagtacaagttccaaccggagtcgccatcgaagctcgcgtccgccatccagaaggcccacgaggagggcatctgcgggatccgaagcgtcaccagacttgagaacctcatgtggaagcagatcacgcccgaattaaatcacatcctgtccgaaaacgaggtgaagttgacaataatgactggcgacatcaaggggataatgcaggctgggaagcgcagcttacgcccgcagcccactgagctgaagtactcgtggaaaacgtggggcaaggcgaagatgctcagcaccgagtcccacaaccaaacctttctaatcgatggacccgagaccgccgagtgcccgaacacgaaccgggcctggaatagcctggaggtggaggactacggcttcggggtattcaccaccaacatttggctcaaattgcgcgagaagcaggacgtgttctgcgactccaagctgatgagcgccgccatcaaggacaaccgcgcggttcacgccgacatgggctactggatcgagtccgccctcaacgacacatggaaaatggaaaaggctagctttatcgaggtcaagtcctgccactggcccaagtcccacaccctttggtctaacggcgtgttagagagcgagatgataatcccaaagaatttcgccgggccggtgagccagcacaactaccgaccgggctaccacacgcagaccgcggggccctggcacctcggaaagttagaaatggacttcgatctatgcgaggggaccacagtcgtggtgacggaggattgcggcaaccgggggccctcactccgcaccaccaccgcaagcggtaaactgatcacggagtggtgctgtcgttcctgcaccttgcccccgctcaggtatcgtggcgaggacgggtgctggtacggaatggagatccgacccctgaaggagaaagaggagaacctggtcaacagcctcgtcaccgcaggtcatggccagatcgacaacttctcccttggtgtgctgggtatggccctattcctggaggaaatgctgcggaccagaatcgggacgaagcacgtcaccctcttagtggcggtgagcttcgttaccctgatcactgggaatatgtccttccgggatctcggccgggttatggtgatggtcggggccacgatgacggacgacattggaatgggtgtgacctacttagcactgttggccgccttcaaagtgcgccccaccttcgcggcaggcctgcttctccggaagctgacgtctaaggagcttatgatggccaccattggcatcgccctcttaagtcagagcaccatccccgagaccattctggagttaactgatgcgctcgcgctgggaatgatggtcctcaagatcgtacggaatatggagaagtaccaactggcggtgaccataatggcgatctcctgcgtcccgaacgcggtgatccttcagaacgcctggaaagtgagttgcactatactcgccgctgtttccgtttccccgctgttacttacctccagccaacaaaaggccgactggatccccctggctctgacgataaagggcctaaaccccaccgcgatctttttgaccaccttgtcccggacgtcaaagaagcgctcctggcctctcaacgaggccatcatggctgtcgggatggtgagcatactggccagcagcctgctcaagaacgacattcccatgaccgggcccctggtggccggcgggctgctcaccgtgtgctacgtgttgacaggccggtccgcggacctagagttagaacgggccgccgacgtgaagtgggaggaccaggccgagatctccgggagctcccccatcctgagcataacgatctccgaagatggttcaatgtctattaagaacgaggaagaggagcaaaccttgaccatactgattcggactggcctactggttatctcgggggtatttccggttagtatacctattacagcagcggcatggtacctctgggaggttaagaagcagcgcgccggcgtgctgtgggacgtgccctcaccaccgccggtcgagaaagccgagctggaggatggggcctaccggatcaagcaacgcggaattctcgggtactcccagattggggcgggcgtgtataaggaagggacgttccacaccatgtggcacgtgacccggggagcagtcctgatgcaccggggcaagcggatcgagcccagctgggctgacgtaaagaaggacctgatttcctacggcgggggctggaagctcgagggcgagtggaaggagggggaggaggttcaggtgctggccctggaacccgggaaaaacccacgcgccgtgcagactaaacccggcatcttcaagacgaataccggcaccatcggagcggtgagcctagatttctcccccggcacttctggctccccgatcgtagaccggaaggggaaagtagttggtctgtacgggaacggagtcgtgacgcgcagcggcgcctacgtgtccgccattgcccagacagagaagtccatcgaggacaaccccgagatcgaggatgatattttccgaaaaaagcgcctgaccataatggatctccaccccggcgcgggcaagaccaaacggtacctgcccgccatcgtccgcgaggccatcaagcgggggctgcgcacgttaatccttgccccgactcgagtggtggctgcggagatggaggaggccttgcggggcctgcccatccgataccagacccccgccatcaaaaccgaacacaccggccgggagatcgtggacctcatgtgtcacgcgaccttcaccatgcgcctgctgtccccggtgcgggtgccgaactacaatcttatcatcatggatgaggctcacttcaccgaccccgcgtccatcgccgcacgcggctacatctctacgcgggtcgagatgggcgaggccgccgggatcttcatgaccgcgacgccgccgggctcccgtgacccgtttccccagagcaacgcacctatcatggacgaggaacgggagatccccgaacgctcctggaatagcggacacgagtgggtaacagacttcaaaggaaagacggtgtggttcgtaccgtcaatcaaggccggaaatgacatcgccgcgtgcctgcggaagaacgggaaaaaggtgatccagctgtcacgcaaaaccttcgatagcgagtacgtgaagactcgggccaacgactgggacttcgtcgtcaccacggacatcagcgagatgggtgccaacttcaaggcggagcgcgtcatcgacccgcggcgctgcatgaagcccgtcatactcaccgatggggaggagcgggtgatactggccggccctatgccagtgacccactcctctgccgcccagagacgggggcgcatcggccgcaaccccaagaacgagaacgatcagtacatctacatgggggagcccctggagaacgatgaggactgtgctcactggaaggaggccaagatgctactggacaacatcaacaccccagagggcatcatcccgtccatgttcgagcccgaacgggagaaggtcgacgctatcgatggcgagtaccgcttgcgcggtgaggcgcgcaaaacgttcgttgacctcatgcggcgaggtgacctacccgtgtggctggcctacaaggttgccgccgaggggatcaactatgccgaccggaagtggtgtttcgacgggatcaagaataaccagatcctcgaagagaacatggaggtggagatctggaccaaggagggggagcgcaagaagctgaagccgcggtggctcgacgcgcgcatttacagcgatcccctcgccctgaaagaattcaaggagttcgccgccggccggaagtccctgacccttaatctcatcacggagatgggccgcctgcctacattcatgacccagaaggcgcggaacgctctcgacaaccttgccgttctgcataccgccgaggcgggggggcgcgcttacaaccatgccctcagcgagctacccgagacgttggagactctccttcttctaaccctgctggccaccgtcaccgggggcatctttcttttcctgatgtccggcaaggggatcggcaagatgacgctagggatgtgctgcataatcacggccagcatactcctttggtacgcccagattcagccgcactggatcgcggcctcgatcattctggagtttttcctcatcgtgctgctaatccccgaaccggaaaaacagcggaccccccaggacaatcaattaacctacgtcgtgatcgccatcctgactgtggtcgctgcaacgatggctaacgagatgggcttcctggagaagactaagaaggacctcggcctgggaagcatcaccactcaggagagcgaaagcaacatcctggatatcgacctccgcccggccagcgcctggaccctgtacgctgtcgccaccaccttcgtaacccctatgctgcggcactctattgagaacagctccgtgaacgtgagcctcacggccattgccaaccaggctaccgttctgatgggcctgggcaaaggctggcccctctccaagatggacatcggggtcccccttctggccatcggatgctacagccaggtcaacccgatcaccctcaccgcggccctgctgttgctggtggcccattacgccatcattggcccgggcctgcaggctaaggccacacgcgaggcccagaagagggccgccgccggcataatgaagaaccccactgtcgacgggatcacggtgatcgacctcgagcctatcccgtacgacccaaagttcgagaaacagctgggccaggtgatgctgctcatcctgtgcgtaacccaggtgctgatgatgcgcacgacatgggcgctctgcgaggccctgaccctagccacaggccccatctccacgctctgggagggtaatcccgggcggttctggaataccacgatcgctgtgagcatggccaacatattccgcggctcgtacctggccggcgccgggttgctgttcagcatcatgaaaaacaccacgaacacccgcagaggcaccggtaacatcggcgagacccttggcgagaaatggaaaagtcgcctgaacgccctcggaaagagtgagttccagatctacaagaagtccggaatacaagaggtcgatcggacgctggcaaaggagggtatcaagcgcggcgagaccgaccaccacgccgtctctagggggagtgccaagctgcgctggttcgtggagcggaacatggtcacccccgagggcaaagtggtggacttgggatgcgggcgcggcgggtggtcgtactactgcggtgggttgaagaacgtgcgagaggtgaagggtcttactaaaggcggacctggccatgaggagcctatccctatgagcacttacgggtggaacttagtgcgactacaaagcggcgtcgacgtattctttacaccgcccgaaaagtgcgataccctgctctgcgacatcggggagagtagccccaacccaaccatcgaggctggccggaccttacgggtactaaaccttgtagaaaactggctcaacaacaatacgcagttctgcatcaaggtgctgaacccttacatgccttctgtgatcgaaaagatggaggcactacagaggaaatacggcggagccctggtccgcaaccccctgtcccggaacagtacccacgagatgtactgggtgtccaacgcgacgggcaacatcgtgagctccgtcaacatgatctcgcgcatgctgatcaaccggttcaccatgaagcataaaaaggccacgtacgagccggacgtcgacttaggctccggcacccgcaacattgggatagagagcgagatccccaatctggacatcattggtaagcggatcgagaaaatcaagcaggagcacgaaacgtcctggcactacgaccaagaccacccctacaagacctgggcctatcacggaagctacgagacgaagcagactgggtccgccagctccatggtgaacggagtcgtgaggcttcttactaagccctgggacgtggtcccgatggtgacccagatggccatgacggacaccacacccttcggtcagcagagagtctttaaagagaaggtcgacacccggacccaggagccaaaggaggggacaaaaaagctgatgaagatcacagcggagtggctgtggaaggagttgggcaagaagaaaacgccccgcatgtgcacccgtgaggagttcacccgcaaggtacggagcaacgcagccctgggcgctatcttcaccgacgagaacaagtggaagagcgcgagggaggcggtggaggacggccggttctgggagctcgtggaccgcgagcgtaacctccacctggaagggaaatgcgagacctgcgtgtacaacatgatgggcaagcgcgagaagaaactgggagaattcggcaaggccaagggcagccgggccatctggtacatgtggctgggggcccgcttcctggagttcgaggctctgggtttcttgaacgaggatcactggttctcccgcgggaactccctatctggcgtggagggtgagggactgcaccgcctcggctacatcctgcgggacgttgggaagaaggagggcggggccatgtacgccgatgacacggctggctgggacaccagaataacgctggaggacctcaaaaacgaggagatggtcacaaaccatatgaagggagagcataagaaactggccgaggctatcttcaaactgacttatcagaacaaggtcgttagagtgcagagaccgacgcccagaggaactgtcatggacattatctcccgcagggaccagcgcgggagcgggcaggtcggcacctacgggctcaacaccttcacgaacatggaggcccagctgattcgccagatggagggtgagggtatattcaagtccatccagcacttaaccgccaccgaggaaatcgcagtccaaaactggctagcccgggtcggacgcgaacggctcagccgcatggcgatttctggcgacgattgcgtggtgaagcccatcgacgatcgtttcgctagcgccctgacggccctcaacgacatgggaaaagtgcgcaaggacatccagcagtgggagccctcccgaggctggaacgactggacccaggtgccattctgcagccaccacttccatgaattagtgatgaaggacgggcgcgtcctggtggtgccctgtcgaaaccaggacgagctgataggtcgagcaagaatctcgcagggagcgggatggagcctgaaggagaccgcttgtctgggcaagtcctatgcccagatgtggaccctcatgtacttccacaggcgggaccttcgcttggccgccaatgcgatctgcagcgccgtgccgccccattgggtgccgacctcccggacgacctggtctatccatgccaaacacgagtggatgacaacggaagatatgctggccgtgtggaaccgcgtttggatacaggaaaatccttggatggaggacaagacgcccgtagagtcctgggaggaggtcccctatctggggaagcgggaggaccagtggtgcggcagccttatcgggctcacctcacgcgcgacgtgggcgaagaacatccagaccgccatcaaccaggtccggtcgttgatcggcaacgaagagtacacggactacatgccgtctatgaagcgctttcgccgagaggaggaggaagccggcgtgctgtggtga

SEQ ID NO: 25061 - RNA, 9876 nt, synthetic construct
  misc_feature 1..9876: note = derived and/or modified CDS sequence (opt11) from DENV-2__GQ199897__SS-prME
  source 1..9876: mol_type = other RNA
acagcaggcgtgatagtcatgttgattcctaccgccatggctttccacctcacaacccgcaacggggaaccccacatgatagtgggccggcaagagaagggaaaatcgctgctgttcaagaccgaggatggcgtcaacatgtgcacactcatggccatagatctgggggagctgtgcgaagacaccatcacctacaagtgccccctcctgcggcagaacgagccggaggacatagattgttggtgcaacagcaccagcacctgggtcacgtacgggacctgcaccaccacaggcgagcaccggcgcgagaaacggtccgtagccctggtgccacacgtcggtatgggccttgagacccgcaccgagacctggatgagctccgagggggcctggaagcatgtgcagagaatcgagacgtggatcctgcgccacccgggcttcacgatcatggcggcgatcctagcctacaccatcggcacgacgcacttccagcgagcccttatctttattctgttaacagcagtggcgcccagcatgaccatgagatgcatcggcatctccaaccgggacttcgttgagggggtaagcgggggctcctgggtggacatcgtcctagagcacgggagctgcgtcaccacgatggccaagaataaacccacgcttgatttcgagcttattaaaacggaggccaagcagcccgccaccctccgtaagtactgcatcgaggccaagctgactaacaccaccaccgaatcccggtgcccaacccagggagagccgagcttgaacgaggagcaagataagcgcttcatttgtaagcactccatggttgaccgaggctgggggaacggctgtggcctgttcggcaagggcgggattgttacctgtgcgatgttcacttgcaagaagaatatggagggcaaggtggtgcagcccgagaacctcgagtacacgatcgtcatcacgccgcattctggagaggaacacgccgtgggcaacgacaccgggaagcacggcaaggagattaagattaccccgcagtccagcatcaccgaggctgaactgaccgggtacggcacggtgaccatggagtgtagccctcggactggcctcgacttcaacgagatggtcctgctgcagatggaggacaaggcatggttagtgcatcgacagtggttcctggatctgcccttaccctggctgcccggggccgacacccagggaagcaactggatccaaaaggaaacgttggtgacctttaagaacccccatgcgaagaaacaagacgtcgtggttctcgggagccaggagggcgccatgcacaccgccctgaccggggcgacggagatccagatgagcagcggcaaccttctgttcacgggacacctgaaatgtaggctgcgtatggacaagctgcagctgaaggggatgtcgtacagcatgtgcaccggcaagttcaagatcgtgaaggaaatcgccgagacccagcatgggacgatcgtgatccgcgtgcagtacgagggagacggatccccctgtaaaattcccttcgagatcaccgacctggaaaagagacacgtgcttgggagactgatcaccgtgaatccgattgtcactgagaaggactcacccgtgaacatcgaggcggagccgcccttcggtgactcctacatcatcatcggggtggagcccggccaactgaagctcaattggtttaagaagggtagttccatcggccagatgttcgagacgaccatgcgcggcgctaagcggatggccatcctgggagacaccgcttgggacttcggcagcctcggcggcgtctttacctcgatcgggaaggctctccaccaggtgttcggagccatctacggcgcagcgttcagcggcgtgtcctggactatgaagatcctgataggcgtcatcatcacctggatcgggatgaatagtcgctccaccagcctgtcagtatcactagtgctcgttggcgttgtgaccctgtacctgggggccatggtccaggcggactccggctgcgtggtgagctggaagaacaaggagctaaagtgcggctccggcatcttcatcacggacaacgtccacacgtggaccgagcagtacaagttccagcccgagagcccgagcaagctggcttccgccatacagaaggcccatgaggagggcatctgcgggatccggtcggtaacaaggcttgaaaacctcatgtggaagcagatcacgccagagctaaaccacatcttgtcggagaatgaggtgaagctcaccataatgaccggcgacatcaaggggatcatgcaagccgggaaacggagcctgcgcccgcagcccaccgagctgaaatactcgtggaagacgtggggtaaggctaagatgctcagcaccgagtcccataaccaaactttcctaatcgacgggccagaaacagccgagtgcccaaacacgaatcgggcctggaatagcctggaggtcgaggattacggcttcggggtgttcaccacgaacatttggctaaagctgcgcgagaagcaggacgtcttctgtgacagtaaattaatgagcgccgcaatcaaggacaatcgggcggtccacgccgacatgggctactggatagagtccgccctaaacgatacctggaagatggagaaggcgagcttcatcgaggtgaagtcctgccattggcccaagtctcacaccctgtggtcaaacggcgtgctggagagcgagatgatcatccctaagaacttcgctgggcccgtctctcaacacaactatcgcccgggctaccacacgcagacagcggggccatggcatttaggtaaactagagatggacttcgacctgtgcgaaggcaccaccgtcgtggtcacggaggattgcggcaaccggggtccctcgctccgcacaaccaccgccagcgggaaattaatcacggaatggtgttgtcggagctgcaccctccccccgctaaggtaccggggcgaggacggctgctggtacggtatggagatccgtcccctaaaggagaaggaggagaacctggtgaattcacttgtgacggcgggacacggccagatcgacaatttcagcctgggcgtgctggggatggccctcttcctggaagagatgctacggacccgcatcggcacgaagcacgcgattttgttagtggcggtcagcttcgtgaccctgatcaccgggaacatgtcgttccgggacctaggccgcgtgatggtgatggttggcgccaccatgaccgacgacataggcatgggcgtgacctacttggccctgctcgccgccttcaaggtacgtcccaccttcgcggctgggctcctgctaagaaagctgaccagcaaagagctaatgatggccacgatcgggatcgccctcctgtcccagtccaccatccccgagaccatcctcgagttaaccgacgcgctggccctgggaatgatggtactcaagatcgtgcgcaacatggagaagtaccagctcgccgtgaccatcatggccatctcctgtgtcccgaacgccgtgatactgcagaacgcgtggaaggtgagctgcaccatcctcgccgccgtatccgtgagcccattgttactaacctccagccagcagaaggccgattggatccccctggcgctaaccatcaaaggcctcaaccccacagctatcttcctaaccaccctgtcccggaccagcaagaagcgctcctggcccctcaacgaggccatcatggccgttggcatggtttcgatcctggcctccagcctgttgaaaaacgacatccccatgacgggcccactggtagccggcggactgctcaccgtctgctacgtgctgaccggccgcagcgccgacctggagctcgagcgcgccgcggacgtgaaatgggaagatcaggccgagatttccgggagctccccgatactgtccatcacaatcagtgaggacggcagcatgtccatcaagaacgaggaggaggaacagacattgacaatcctcattcggacgggcctgttagtcgtgagcggggtgttccctgtctctatccccataaccgcggccgcctggtacctctgggaggtgaagaagcagcgagcgggcgtcctctgggacgtcccaagcccaccgccggtggagaaggccgagctggaggacggggcgtaccggatcaagcaacgcggcatactcggctacagtcagatcggcgccggcgtgtacaaggagggaactttccacaccatgtggcacgtcacacggggcgccgtgctgatgcaccgcgggaagagaatcgaacccagttgggccgatgtgaagaaggatctgatcagctacgggggtggctggaagctcgagggcgaatggaaggagggagaggaggtccaagtgctggccctggagcccggcaagaacccccgcgccgttcagaccaaacccgggatattcaagaccaacacggggaccatcggggcagtcagcctcgacttctcccccggcaccagtgggtcccccatcgtggaccggaaggggaaggtggtcggtttgtacgggaatggagttgtgactcgcagcggcgcctatgtctctgccatcgcgcagacggagaagtctatcgaggacaaccccgaaattgaggacgacatctttcgcaagaagcgcttaacgatcatggacttgcaccccggggccggcaagaccaaacggtacctgcccgcgatcgtgcgtgaggctatcaagaggggtctgcgcactctgatcctcgccccgacccgcgtggtcgcggccgagatggaggaagccctgcggggcctgcccatccgttaccaaaccccagccatcaagaccgagcacaccggacgggagatcgttgacctcatgtgccacgccacgttcaccatgcgcctgctgagcccagtccgggtgccaaactacaacctcataatcatggacgaggcgcactttaccgacccggcctccatagccgcccgcggctacatctctacacgggtggagatgggtgaggcggcgggtatcttcatgactgccacgccacccggctctagagacccgttcccccagagcaacgcacctatcatggacgaggaacgtgagatccccgagcggtcctggaacagcggccacgagtgggtgaccgacttcaaaggaaagaccgtctggttcgtgccttctatcaaggccggaaacgacatcgcggcctgtctgaggaagaacgggaagaaggtgatacagctaagtcgcaagacgttcgactccgagtatgtcaagacccgggccaacgattgggacttcgtggtgaccacggacatcagcgaaatgggggctaacttcaaggccgaacgcgtcatcgacccccggcgctgcatgaagcccgtgatactcacggacggggaagagcgggtgatcttagcgggtcccatgccggtcacccactccagcgccgcgcagcgccggggacgcatcggccgcaaccctaagaacgagaacgaccagtatatctacatgggggaacccttggagaacgacgaggactgcgcccactggaaagaggcgaagatgctcctggacaacatcaatacacccgaaggcataatcccgtccatgttcgagcccgaacgggagaaggtagatgcgatcgacggcgagtatcgcctgcgaggggaggccaggaagaccttcgtggacctcatgagacgcggtgatctgccagtttggctggcctacaaggtcgctgccgaggggatcaactacgcagaccggaagtggtgcttcgacggtattaaaaacaaccagatcctcgaggagaacatggaggtggagatctggacgaaggagggggaacgcaagaaactaaagccgcgttggctggacgcccgcatctacagcgatcccctcgctttaaaagagttcaaagagttcgcagcgggccggaaatccctgacgctcaatctgatcaccgagatgggccgcctcccaaccttcatgacgcagaaggcccggaatgccctggacaacctggccgtcctgcacaccgctgaggccgggggccgcgcttacaaccacgccttatcggaacttcccgagaccctggagacgctacttctgctcacgctgctggccaccgtgacggggggtatcttcctgttcctgatgtccggtaaagggattgggaagatgactctggggatgtgctgcatcatcacggccagcatcctactgtggtacgcgcagattcagccccattggatcgccgcatcgatcattctggagttcttcttgatcgtcctgctgatccccgagcccgagaaacagcgcacgccccaggacaaccaactcacctacgtggtgatagccatccttactgtcgtggcagcgacaatggcaaacgagatgggctttctagagaagactaagaaagatctcgggctgggctcgatcactacccaggagagcgaatccaacatccttgacatcgacctccgcccggccagcgcctggaccctgtacgccgtggcgactaccttcgtcaccccaatgctgcggcactccatcgagaattcttccgtgaacgtgtcactcaccgccatagctaaccaggctacggtcctgatgggcctgggtaagggctggccactctccaagatggacataggggtgcccctcctggcaatcgggtgttacagccaagtgaacccgatcacgctaaccgctgccctgctactcctggtggcccactacgccattatcggacccggcctgcaggcgaaggcaacgcgagaggcccagaagcgggccgccgcggggattatgaaaaaccctacggtggacgggatcaccgtgatagacctcgaaccaataccgtacgaccccaagttcgagaagcagctggggcaggtcatgttgttaatattgtgcgtgacgcaggtgctcatgatgcgcaccacttgggccctctgcgaggccctgaccttagccaccgggcccatctccaccctctgggaaggcaaccccgggcggttttggaacacgaccattgccgtcagcatggccaacatcttcaggggcagttacctggcaggcgcggggctactatttagcatcatgaagaacaccaccaacacgagacggggcaccgggaacattggcgaaaccctgggcgagaaatggaagtcccgcttaaacgccctcgggaagtctgagttccagatatacaagaagtccggcatacaggaggtggaccggaccttggctaaggaggggatcaaacgcggggagacggaccaccacgccgtaagccgcgggtcagctaaactccgctggttcgtagagcggaacatggtgaccccggagggcaaggtggtcgatctcggatgcggacggggcgggtggagctattactgcggcggcctaaaaaacgtgagggaggtgaagggcctgacgaaaggagggccgggccacgaggagccgatccccatgtccacttacgggtggaacctggtgcgtctacagtctggggtggatgtgttcttcacgccgcccgagaagtgcgacaccctgctctgcgacatcggggaaagctcccccaaccccaccatcgaagccggccggaccctgagagtcctgaatttagttgagaactggttaaacaacaacacccagttctgcatcaaggtactgaatccttatatgcccagcgtcatcgagaagatggaggccctccagcggaagtatggtggggcgctggtgcgcaatccactgtcccggaactctacgcacgagatgtactgggtctcaaacgccaccggcaacatcgtctcgtccgtgaacatgataagcagaatgctgatcaaccggttcacgatgaagcacaagaaggcgacctacgagccggacgtggacctcggaagtggcacgcgcaacattggaatcgaaagcgaaatcccgaacttggacatcattggcaagcggatagagaagatcaagcaggagcacgagacctcctggcactacgaccaggaccacccctacaaaacctgggcctaccatggctcatacgagaccaagcagacggggtccgcttcatccatggtcaacggcgtcgtccgcctgctcaccaagccgtgggatgtcgttccgatggtgacgcagatggcgatgaccgacacgaccccattcgggcagcagcgtgtcttcaaggagaaggtggatacccggacccaggagccgaaggagggcacgaaaaaactgatgaagattacagccgagtggctgtggaaggagctaggcaagaaaaagacgccccgaatgtgcacccgggaggagttcacgcgaaaggttaggagtaacgcagccttaggggccatctttaccgacgagaacaagtggaaatccgcgcgggaggcagtcgaagacggccggttctgggagctagtggatagggagcggaacctccacctagaaggcaagtgcgagacttgcgtttacaacatgatgggcaagcgcgagaagaagttaggcgaattcggcaaggctaagggcagtcgggccatctggtacatgtggctgggggcacgcttcctagagtttgaggccctggggttcctcaatgaagaccattggttctcccggggtaacagcctgtcgggcgtcgagggggagggcctgcaccgcctcggctacatcctgcgcgacgtcggtaaaaaggagggcggggccatgtacgccgacgataccgccggctgggacactcgcatcaccttggaggacctcaagaacgaggagatggtcaccaatcacatgaagggggaacacaaaaagttagcggaggcgatcttcaaactgacctaccagaataaagtggtgcgggtccagcgcccgacgccccgggggaccgtgatggacatcatctcccgccgggaccagagagggagcgggcaggtcggcacctatgggctcaacacctttacgaacatggaggcccagctgatccgccaaatggagggcgaggggatcttcaagtccatccaacacttaaccgccaccgaggagatcgccgtccagaactggctcgcccgtgtggggcgcgagcggctgtcgcgaatggccatctccggggatgactgcgtggtcaaaccgattgatgaccggttcgcgtccgcccttaccgccctcaacgacatgggtaaggtgcgtaaggatatccagcagtgggaacccagcaggggctggaacgactggacacaagtgccgttctgcagccaccactttcacgagctggtcatgaaagacggccgcgtgctggtcgttccttgtaggaaccaggacgagctcattggccgcgcacggatatcccagggcgccggttggagcctgaaggagaccgcttgcctagggaagtcctacgcccagatgtggacgctcatgtacttccacagacgggacctgcgcttagcggcgaatgccatctgcagcgccgttccgcctcactgggtgccgacctctcggacgacgtggagtatccacgccaagcacgagtggatgaccactgaagatatgcttgcggtatggaatcgcgtgtggatccaagaaaatccctggatggaggataagactcctgtggagtcctgggaggaggtgccctaccttggaaaacgggaggatcagtggtgcggctccctgatcggtctcacgtccagagccacctgggccaaaaacatccagaccgcgatcaaccaggtgcggtcactgatcggaaacgaggagtataccgactacatgccaagcatgaagcgctttcgacgggaggaggaagaggccggcgttctgtggtga

SEQ ID NO: 25062 - RNA, 9876 nt, synthetic construct
  misc_feature 1..9876: note = derived and/or modified CDS sequence (opt11) from DENV-2__GQ199895__SS-prME
  source 1..9876: mol_type = other RNA
accgcaggcgtgatcgtcatgctcattcctaccgccatggcgttccacttaaccacccgcaacggggaaccccacatgatagtaggccggcaggagaaggggaagtccttactgttcaagaccgaggatggcgtgaacatgtgcacactcatggccatagacctgggggaactgtgcgaggacaccatcacctataagtgccccctcctgaggcagaacgagcccgaggacatcgactgctggtgcaacagcacaagcacttgggtcacgtatgggacctgcaccaccacgggcgagcaccggagagagaagcggtccgtcgcgctggtgccacacgttgggatgggtctcgagacccgcacggagacatggatgagctcagagggggcctggaagcacgtgcagagaatcgagacgtggatcctgcgccacccgggcttcacaataatggccgcaatcttggcctatacaatcgggaccacgcatttccagcgggcgctcatattcatcctgctgacggccgtggcgcctagtatgacgatgcgctgcataggcatttccaatcgggatttcgtcgagggagtgagcgggggctcatgggtggacatcgtgttggaacacgggagctgtgttaccaccatggccaaaaacaagcccacccttgatttcgagctaataaaaactgaggccaagcagcccgccaccttacgcaagtactgcatcgaggccaagctgactaataccaccacagagtcccgatgccctacgcagggtgaaccaagcctgaacgaggagcaggacaagcgctttatctgtaagcactccatggtggaccggggctgggggaacggctgcggtctgttcggaaagggggggatcgtgacctgcgcgatgttcacgtgcaagaagaacatggaaggaaaagtggtacaaccagagaacctggagtacaccatcgttatcacaccccacagcggggaggagcacgcagtgggaaacgatacagggaagcacggcaaggagatcaagataacgccgcagtccagcatcacagaggccgagctgacagggtacgggacggtgaccatggagtgcagtcctcggaccggcctcgatttcaacgagatggtcctgctgcaaatggaagacaaagcgtggctcgtgcacagacaatggttcctggacctgcccctcccctggctgcctggggccgacactcagggcagcaactggatccagaaggagacactggtgaccttcaagaacccccacgcgaaaaagcaggacgtcgtggtcctcggctcccaagagggcgccatgcacaccgctttgaccggggcgactgagattcagatgagcagcggcaatttactgttcaccgggcacttaaaatgtcgtctgagaatggacaagctacagttgaaggggatgagttacagtatgtgcaccggcaagttcaagatcgtgaaagaaatcgctgaaacccagcacgggacgatcgtgatccgcgttcagtacgagggagatggctcgccctgcaagatcccctttgagatcaccgatctggagaaacggcacgttctcgggaggctgatcacagtgaacccaatcgtaaccgaaaaggactcgcccgttaacatcgaggcggagccccccttcggcgattcttatatcataattggggtcgagccgggccagctaaaactcaactggttcaaaaagggcagctctattgggcaaatgttcgaaacgaccatgagaggcgccaagcggatggccattctgggcgacactgcctgggattttggcagtctcgggggcgtcttcaccagcatcgggaaggcactccaccaggtgttcggtgcgatctacggagcagcctttagcggcgtatcctggacgatgaaaattctgattggcgtcataataacctggatcgggatgaacagccgctcgaccagcctgtccgtgtccctggtacttgtcggggtggtgaccttatacctaggggccatggtccaggcagactccggctgtgttgtgagctggaaaaacaaggagctcaagtgtggatccggaatctttatcaccgacaatgtacacacctggaccgagcagtacaaattccagccagagagccccagcaagctggcctccgccatacagaaggctcacgaagagggtatctgcgggatccggagcgtgacccgactcgagaacctaatgtggaagcagatcacaccggagttgaaccacatcttatccgagaacgaggtcaagcttaccatcatgaccggcgatatcaaggggatcatgcaagccggcaagcggtccctgagaccgcagccgaccgagttaaagtactcctggaagacatggggaaaagccaagatgctctcaaccgagtcccacaatcagaccttcctgatcgacgggcccgaaacagcggagtgccccaacacaaaccgtgcgtggaacagccttgaggttgaggactatggtttcggggtgttcaccaccaatatctggctcaaattacgggaaaagcaggacgtcttctgcgactctaagctgatgagcgccgccatcaaggacaaccgggcagtccacgccgacatgggctactggattgagtcagccctcaacgatacctggaagatggagaaggccagcttcatcgaggtgaagtcgtgccactggcccaaaagccatacgctgtggtccaacggcgtgctggaaagcgagatgattattcccaaaaatttcgccgggcctgtctcccaacataattaccgcccaggataccatactcagaccgcggggccctggcacctcggcaagctggagatggacttcgacctgtgcgaggggaccaccgtcgtggtcacggaggactgcggcaatagaggccccagcctcaggaccaccaccgccagcgggaaactgatcacggagtggtgctgcagatcctgcaccctacctccgctccgctatcggggcgaggacggatgctggtacgggatggagatcagacccctgaaagaaaaggaggagaacctggtgaacagcctcgtgacagcgggacacggccagatagacaacttctcccttggcgttctgggcatggccctcttcctggaggagatgctgcggacacgcataggtacaaaacacgcgatcctcctggtggctgtgagctttgtgactctgataaccggcaatatgtcgttcagagacttggggcgtgtcatggtgatggtcggagccactatgacagatgacatcggcatgggcgtgacctacctggccttgctcgccgcgttcaaggtgcgccccaccttcgccgccgggctgctgctacggaagctaacatcaaaagagctgatgatggcaacgatcggcatcgcactcctgtctcagagcaccattccagagaccatcctggagctcaccgacgcgttagcactggggatgatggtcctaaaaatcgtgcgcaatatggaaaagtaccagctagcggtgacgatcatggccatttcttgtgtgccgaacgcagtaatcctgcaaaatgcgtggaaggtgagctgcaccatactcgccgccgtttccgtgagccccctactgctcaccagtagccagcagaaggcagactggatccccctggcgctgacaattaagggactaaaccccactgccatcttccttaccaccctgtcccggaccagcaagaagcgctcctggccgttaaacgaggcaataatggccgttggcatggtgagcatcttggcgtcctcactgcttaagaacgacatccccatgacggggcccctggtggcaggcggcctgctcaccgtctgctacgtgcttacgggccgtagcgctgacctcgagctcgagcgcgccgccgatgtgaaatgggaggatcaagcagagatttctgggagctcccccatcctgagcattaccatctccgaggacggcagtatgtccatcaagaacgaggaggaagagcaaacgcttacaatcctcatcagaactggccttctggtcatcagcggggtgttcccggtttccatccccatcacggcggccgcttggtacttgtgggaggtcaagaagcagagggccggcgtgctgtgggacgtgcccagcccgccgccagtcgagaaggccgagctggaggacggggcctacagaatcaagcagcgcggcatcctcggttactcccagattggcgccggtgtgtataaggaggggacattccatacgatgtggcatgtgaccagaggcgccgtgctgatgcaccgcgggaagcgtattgagcccagctgggccgacgtgaagaaggacctgatatcctacggagggggctggaagctcgagggcgaatggaaagaaggggaagaggtgcaggtcctagcgctggagcccggcaagaacccccgcgccgtgcagaccaagcccgggatattcaagaccaatacgggcaccattggggccgttagcctagacttctctcccggcactagcggctcccccatcgtcgatcgtaaaggtaaggtcgtgggactgtacgggaacggagtcgtgacccgaagcggcgcatacgtgtccgccatagcgcaaacggagaagtccatcgaagataaccccgagatcgaggaggacattttcaggaaaaagcgcttgaccatcatggacctccatcccggggccggcaagaccaaacgatacctgcccgccatcgtgcgcgaggccataaaacgggggctaaggacactaattttggccccaacgcgcgtcgtggccgccgaaatggaggaggcccttcgtggcctgcccatcaggtaccagacccccgccattaaaaccgagcataccggtcgggagatcgtcgatctcatgtgccacgccaccttcacaatgcgtcttctgagccccgtgcgggttccgaactacaatctcatcatcatggatgaggcacacttcacagatcctgcatccatcgccgcccgcggctacatcagcacacgggtcgagatgggagaagccgctgggatatttatgactgccacgccgcccggctccagggatccgttcccacagagcaatgcccccatcatggacgaggagcgggagatacccgagcgctcgtggaattcagggcacgagtgggtgaccgacttcaagggaaaaaccgtgtggttcgtgccgtccataaaggctggcaacgacatcgccgcctgcctgcgcaagaacgggaagaaggttatccagctaagccgcaagacttttgactccgagtacgtgaagacccgggccaacgattgggacttcgtcgttaccaccgatatctctgagatgggcgcgaacttcaaggccgaacgagtgatagacccacgacgctgtatgaaacctgtcatcttgaccgacggggaggagagggtgatcctggcgggccctatgccagtaacacactcctctgccgcgcagcgtcgggggcgaatcggccgcaacccaaagaacgagaacgaccagtacatctacatgggggaaccccttgagaacgacgaggactgcgcccactggaaggaggccaagatgctcctggataatatcaacacccccgagggcattatcccgtccatgttcgagccggagcgcgagaaagtagacgcgattgacggcgagtaccgtctgcgcggggaagcgcgcaagaccttcgtggacttaatgcgccgcggagacctgcccgtgtggctggcttacaaggtagccgccgagggcataaactacgctgacaggaaatggtgcttcgacggcatcaaaaacaaccagatcctcgaggagaacatggaggtggagatctggacgaaggagggggaacgcaaaaagctgaagccgcggtggcttgatgcacgcatctactctgatcccttggccctgaaggagtttaaggagttcgccgcgggccgcaagtccctaaccctcaacctgatcaccgagatgggccgcctgccgacgttcatgacgcagaaggccagaaacgccctagacaatctggccgtgttgcacactgctgaagctgggggacgcgcttacaaccacgctctcagcgagctgccagagacactggagaccctacttcttctcacgctgctcgcaaccgtcaccggaggcatcttcctcttcctgatgagtggcaaagggatcggcaagatgaccctggggatgtgctgcatcataactgcgtcaatcctcctgtggtacgcgcagatccagccgcactggatagccgcttccatcatcctggagttctttctcatcgtactgctgatccctgaacccgagaagcagcggacaccccaggacaaccagctaacgtacgtagttatcgccatcctgaccgtggtagccgcgaccatggccaacgaaatgggcttcctggagaagacgaagaaggacctcgggctgggcagcattactacacaggagagcgagtcaaacattctggacatagacctccgaccggccagcgcatggaccctgtacgccgtggcgacgacctttgtgacccccatgctccggcattccatcgaaaacagctccgttaacgtgagtctcaccgcaatcgccaaccaggccacagtgttaatgggcctggggaaaggctggcccctgtccaagatggacatcggggttcccctgcttgcgatcggatgttatagccaagtgaacccgatcaccctgactgctgccctgctgctcctggtcgctcactacgccatcatcgggccgggtctgcaggcaaaagccacccgcgaggcccagaagcgcgcagcagcgggcataatgaagaaccccaccgtcgatgggataaccgtgatcgatctcgagcccataccgtacgaccccaagttcgagaagcagttaggccaagtgatgcttttgatactatgtgtgacccaagtcctgatgatgcgcaccacgtgggccctctgtgaggccctgaccctggctacggggccaatctccaccttgtgggagggcaaccctgggcggttctggaacacgaccatcgccgtgtcgatggcgaacatattccgtggctcctatctcgcgggcgccgggctcctgttctcgatcatgaagaataccaccaacacgcgccggggcaccgggaacatcggcgagaccctgggcgagaagtggaagtcccgcttaaatgcgctcggcaagagcgagttccagatctacaagaagagcgggattcaggaggtcgaccggaccttagctaaggaggggatcaagagaggcgagacggaccatcacgccgtgagccggggctccgccaagctgcgctggttcgtggagcggaacatggttaccccagagggcaaggtcgtggacctcggctgcggaagaggcgggtggagctattactgcggtgggctgaaaaacgtccgggaggtgaagggcctaaccaaagggggacccggccacgaggaaccgatccccatgtccacctacggttggaaccttgtgagactccagtccggagtcgacgtgtttttcacgccgccagagaagtgcgacacactgctctgcgacatcggggaaagctctcccaaccccaccatcgaggctgggcggaccctgagagttttaaacctcgtggaaaactggctcaacaacaacacgcagttctgcatcaaggtgctgaacccgtacatgccctcagtgatcgaaaaaatggaagctctccagcggaaatatggcggggcgctagtccgcaaccccctgtcgcggaacagcacacacgagatgtactgggtgtccaacgccaccggcaacatcgtgtcttccgtcaacatgatcagccgaatgcttatcaaccggtttaccatgaagcacaaaaaagccacctacgagccagacgtggaccttgggtccggcacgcgcaacatcgggattgagtcagagatccccaacctagacatcatcgggaagcgtatcgagaaaattaagcaggagcatgagacctcctggcactacgaccaggaccatccctacaagacgtgggcttatcacggcagctacgagaccaagcagaccgggtctgcaagctccatggtgaacggcgttgttcgactgctcactaagccatgggacgtcgtcccgatggtgacccaaatggcaatgactgacacgaccccttttgggcagcagcgcgtattcaaggagaaggtagacacccggacccaggaacccaaggaagggacgaagaagctgatgaagatcaccgccgaatggttgtggaaggagctcggaaagaagaagacgccccgcatgtgtacccgcgaagagtttacccgcaaggtacggtctaacgcagccttgggggccatcttcaccgacgagaataagtggaagtccgcccgcgaggctgtagaggacggccggttctgggagctggtggaccgcgagcgcaacctccatctggagggtaaatgtgagacctgcgtgtacaatatgatgggcaaacgcgagaagaagctaggggagttcggaaaggccaagggcagcagggccatctggtacatgtggttgggggcgagattcctggagttcgaggcgctgggcttcctcaacgaggaccactggttttcacggggcaactctctgtcgggcgtggagggcgagggcctacaccgccttggctatatcctgcgggacgtcgggaagaaggagggcggcgccatgtacgccgacgacaccgccggctgggacacgcgcataacgctggaggacctcaagaacgaggagatggtgacaaaccacatgaagggggagcataaaaagctcgcggaagccatcttcaagctgacttatcagaacaaggtcgtacgggtacagcgtcctacgccacggggcaccgtcatggacatcatctcccgtcgggaccagcgcggcagcgggcaggttggcacctacggactcaacacgtttacgaacatggaagcacaacttatccgtcagatggagggcgagggcatcttcaagtccatacaacacctgacagccaccgaggagattgccgtgcagaactggctggcgagagtcgggcgcgagcggctgtcaaggatggcgatctccggagatgattgcgtggtgaaacccatcgacgatcggttcgccagcgccctaaccgcactcaacgacatggggaaggtccgcaaggacatccagcagtgggagccctcccggggctggaatgactggacccaggtcccgttctgtagccaccacttccacgagctggtcatgaaggacgggcgcgtcctggtggtgccctgccggaaccaggatgagctcatcggacgggctcggatttctcagggcgcggggtggagcctaaaggagacagcctgcttgggcaagtcatatgcacagatgtggaccctcatgtacttccaccgccgggacttgagactggccgcgaatgccatttgcagcgccgtaccgcctcactgggtgccgacatccaggacaacgtggtccatccacgctaagcacgagtggatgactacggaggacatgctcgcggtgtggaaccgcgtatggatccaagagaatccatggatggaagataagactccagtggaatcctgggaggaggtgccctatctggggaagcgggaggaccaatggtgcggcagcctgatcgggctcacgtcgcgggccacctgggccaagaacatccagacggcgatcaatcaggtccggagcctgatcggaaacgaggaatataccgactacatgccgtcgatgaagcgtttccgcagggaggaggaggaagccggcgtgctgtggtga

SEQ ID NO: 25063 - RNA, 9876 nt, synthetic construct
  misc_feature 1..9876: note = derived and/or modified CDS sequence (opt11) from DENV-2__FJ898478__SS-prME
  source 1..9876: mol_type = other RNA
accgctggcgtgatcgttatgctgatccccaccgccatggcgttccatttgaccacccgcaacggggagccccacatgatcgtgggcaggcaggagaagggcaagtccttactgttcaaaaccgaggacggcgtgaacatgtgcaccctcatggccatcgacctgggggagctgtgcgaggataccatcacctacaagtgccccctcctgcgccagaacgaacctgaggacatcgactgctggtgcaacagcaccagcacctgggtcacgtacggcacctgcactaccacgggcgagcaccggcgcgagaaacggtccgtggccttggtgccccacgtcgggatgggcctcgagacccgcaccgagacctggatgagctctgagggggcctggaagcacgtgcagcggatcgagacgtggatcctgcgccacccgggattcaccatcatggcagcgatcctggcctacaccatcgggaccacgcacttccagcgggcactcatcttcatcttgcttaccgccgtggcgcccagcatgaccatgcgctgtattggcatcagcaaccgggactttgtcgagggcgtgagtggtggctcttgggtcgacatcgtcctcgagcacgggagctgcgtgaccaccatggccaaaaacaagcccaccctggacttcgagctgatcaagaccgaggccaagcagcccgccaccctccggaagtattgtatcgaggccaagctgacgaataccaccaccgagagtcggtgcccgacgcaaggcgagccaagcctgaacgaggaacaggacaagcgcttcatctgtaagcactccatggtggaccggggctgggggaatggctgcgggttatttggtaagggcgggatcgtgacctgcgctatgtttacgtgcaagaagaacatggagggcaaggtagttcagcccgagaacttagaatacactattgtcatcacgccccattccggggaggagcacgccgtgggcaacgacaccgggaagcacggcaaggagatcaagatcaccccgcagtcctcaatcaccgaggccgaattgacggggtacggcacggtgaccatggagtgcagcccccggactggcctcgacttcaacgaaatggtcctgctgcagatggaggataaggcctggttagtgcaccgccagtggttcctggatctgccgctcccctggctgcccggggccgacacccagggcagcaactggatccagaaggagacgctggtgacattcaagaacccccacgcgaagaagcaggacgtcgtggtcctcgggtcccaggagggcgccatgcacaccgcccttaccggggcgaccgagatccaaatgagctcgggcaaccttctgttcaccggccacctgaagtgtcgcctgcggatggacaagctccagctgaaggggatgtcctacagtatgtgcaccggcaagttcaagatcgtgaaggagatcgccgagacccagcatgggactatcgtgatccgcgtccagtacgagggcgacgggtccccctgcaagatccccttcgaaatcaccgacctggagaagcggcacgtgctcggtaggctgataactgtcaacccgatcgtcaccgagaaggacagccccgtgaacatcgaggctgagccgcccttcggcgattcctacatcatcatcggcgtggagccgggccagctgaagctcaactggttcaagaaggggtcgtccatcggccagatgttcgaaactaccatgcgcggtgcgaagcggatggccatcctgggggacaccgcctgggactttggcagcctcgggggcgtcttcacctcaatcggaaaggctctccaccaggtgttcggcgcgatctacggcgcagccttcagcggggtgtcctggacaatgaagatcctgataggcgtcatcattacctggatcgggatgaatagccgctccaccagcctgtccgtaagcctggtactcgtcggagtggtgactctctacctgggggccatggtccaggcggactccggctgcgtggtgagctggaaaaacaaggagctcaagtgcggctcagggatcttcatcacggacaacgtccacacctggaccgagcagtacaaattccagccagagagccccagcaagctggcctccgccatccagaaggcccacgaagagggaatctgcggcattcggagcgtgactcggctggaaaacctcatgtggaagcagatcacgcccgagttaaatcatatcctgtccgaaaacgaggtgaagctcaccatcatgaccggtgacatcaaggggatcatgcaggccggaaagcggagcctgcgcccacagcccaccgagctgaagtactcctggaagacatggggcaaagctaagatgctcagcaccgagagccacaaccagactttcttgatcgacggccccgagacggccgagtgcccgaatacgaaccgggcctggaactccctggaggtcgaggactacggcttcggggtgtttaccaccaacatctggctcaagctgcgcgagaagcaggacgtgttctgcgactccaagctgatgagcgcggccatcaaggacaaccgggcagtccacgccgacatggggtactggatcgagtcggccctgaacgacacatggaagatggagaaggccagcttcatcgaggtgaagtcctgtcactggcccaagagccacaccctgtggtccaacggcgtgctagagtcagagatgatcatccccaagaacttcgcgggccccgtttcccagcacaactacaggccgggctaccacacgcagaccgcggggccctggcacctcggcaagctggagatggacttcgacctgtgcgaggggaccaccgtggttgtcacggaggactgcgggaaccggggcccctcactccgcaccaccaccgcctcgggcaagctgatcacagagtggtgctgccggtcctgcaccttacccccactccgctatcggggtgaggacggttgctggtacggcatggagatccgccccttaaaggagaaggaagaaaacctggtgaactctctcgtcactgccgggcacggccagatagacaacttctccctgggcgtcctgggaatggccctcttcctggaggagatgctgcggacccgcataggcacgaagcatgcgatcctcctggtggccgtgagcttcgtcaccttgatcaccgggaacatgtccttccgggacctcggccgcgtgatggtgatggtcggagccactatgacggacgacatcggcatgggcgtgacctacctggccctgctcgccgcgttcaaggttcgccccaccttcgccgccggactacttctccggaagctgaccagcaaggagctgatgatggcaacaatcggcatcgccctcctgtcccagagcaccatacccgaaaccatcttggagctcactgatgcgctggccctggggatgatggtcttaaaaatcgtgcgcaacatggagaagtaccagctggccgtaactatcatggccatctcttgcgtcccgaacgccgtgatcctgcaaaacgcatggaaggtaagctgcaccatcctcgccgccgtctccgttagccctctgctgctcacctccagccagcagaaggccgactggatccccctggctctgaccattaagggtctcaaccccacagccatcttcctcaccaccctgagccggacctcgaagaagcgctcctggccgctgaacgaggcgatcatggccgtcggcatggtgagcatcctggcctccagcctgctcaagaatgacatccccatgacggggcccctggtggcgggcgggctgctcacagtctgctacgtgctaaccggccggagcgccgacctggagctcgagcgcgccgccgacgtgaagtgggaggaccaggccgaaatctccgggagctcccccatcctgtcgataacaatctccgaggacggcagcatgtccatcaagaacgaggaggaggagcagacgctgaccatcctcatacggaccggcctgctggtcatcagcggggtgttccccgtgagtatccccatcaccgcggccgcctggtacctctgggaggtcaagaagcagcgcgccggcgtgctgtgggacgtgcccagcccgccgccagtggagaaagccgaactggaagacggcgcgtatcggattaagcagcgtggcatcctcgggtactcccagatcggcgccggcgtgtacaaggaggggacattccacacgatgtggcacgtgaccagaggcgccgtccttatgcatcgcggcaagcggattgagccgagctgggccgatgtgaagaaggatctgatctcctatggcggtggctggaagctcgagggcgagtggaaggagggggaggaggtgcaggtcctggccttggagcccggcaagaacccccgcgcggtgcagaccaagcccgggatcttcaagacaaacacgggcaccattggggccgtgagcctggatttttcccccggcacgagcggctcccccatcgtcgaccgtaaggggaaggtggtgggcttatacgggaatggagtcgtgacccgcagcggcgcctacgtgtctgccatcgcgcagacggagaagtccatagaggacaaccccgagatcgaggacgacattttccggaagaagcgcttaaccatcatggatctccaccccggggccggtaagaccaagcggtacctgcccgctatcgtccgcgaggccatcaagcgaggtctgcgcaccctaatcctcgccccgacgcgcgtggtggcggcagagatggaggaggccctgcggggcctgcccattcgctaccagactcccgctatcaagaccgagcataccggtcgggagatcgtggacctcatgtgccacgccacgttcaccatgcgcctgctgagccctgtgcgggttccaaattacaaccttatcatcatggacgaggcgcatttcaccgaccccgcctccatcgccgcgcgcggctacatcagcacccgggtcgagatgggcgaagccgccgggatcttcatgacggccacaccacccggttcccgagatccgttcccccagagcaacgcccccatcatggacgaggagcgggagatccccgagcgctcctggaacagcgggcatgagtgggtgaccgactttaagggaaagaccgtatggttcgtcccgtctatcaaggccgggaacgacatagcggcttgcctgcgtaagaacggcaagaaggtgatccagctaagccgcaaaacgttcgactccgagtacgtgaagacccgggccaacgactgggatttcgtcgtcacaacggacatcagcgagatgggcgccaacttcaaggcggaacgcgtgatcgacccccggcgctgcatgaagcccgtcatcctcactgacggggaagagcgggtgatcctggccggacccatgccggtgacccactccagcgccgcccagcgccgggggcgcatcggccgcaaccccaaaaacgagaacgaccagtacatctacatgggggaacccctggagaacgacgaggactgcgcccattggaaggaggctaaaatgctcctggacaatatcaacacccccgagggcatcatcccgtcaatgttcgagcctgagcgggagaaggtagacgcgatcgacggcgagtatcggctgcgcggggaggcccgcaagaccttcgtggacctcatgcggcgcggagacctgccagtgtggctggcatacaaggtcgccgcagaagggataaactacgcggaccggaagtggtgtttcgacggcatcaagaacaaccagatcctcgaggagaacatggaggtggagatctggacgaaggagggggagcgcaagaagctgaagccacggtggctggacgcccgcatctacagcgaccccctcgccctaaaggagttcaaagagttcgccgcgggccggaagtccctgactctcaacctgatcaccgagatgggccgcctccccacatttatgacgcagaaggcccggaacgccctcgacaacctggctgtgctacacacagccgaggccgggggcagagcctacaaccacgccctctccgaactgcccgagaccctggagacactattgctgctcacgctgctggccacagtcaccggcggcatcttcctcttcctgatgtccggcaaagggatcggcaagatgaccctggggatgtgctgcatcatcactgccagcatcctcctttggtacgcgcagatccagccgcactggatcgctgcttccattatactggagttctttctcatagtgctgctaatccccgagcctgagaagcagcggactccacaggacaaccagttaacctacgtagtgatcgcgatcctgactgtggtcgccgcgaccatggccaacgaaatgggcttcctggagaagactaagaaagacctcggcctgggcagtataaccacccaggagagcgagtccaacatcctggacatcgacctccgcccggcgagcgcctggaccctgtacgctgtggcgacgacctttgtcacacccatgttacggcactccatcgagaactcgtctgtcaacgtaagcctcaccgcaatcgcgaaccaggccacggtgctgatgggcctggggaagggctggcccctctccaagatggacatcggggtaccactgctggcaatcggctgctactcacaggtgaacccgatcaccctcacagccgccctgctgctcctggtggcccactacgccatcatcgggcccggcctgcaggcgaaggccacccgcgaggcgcagaagcgggccgccgctgggatcatgaagaaccccacggtcgacgggatcaccgttatcgacctcgagcccatcccgtacgaccccaagtttgaaaagcagctgggccaggtgatgctgctcatcctgtgcgtcacccaggtgctgatgatgcgcaccacctgggccctctgcgaggccctgaccctggccaccggacccatctccaccctctgggagggtaaccccggacggttctggaacaccaccatcgctgtgagcatggcgaacatattccgcggctcctacctggcgggcgcagggctcctgtttagcatcatgaagaacaccacctccacgcgccggggcacggggaacatcggcgagaccctgggcgaaaagtggaagtcccgcttaaacgccttagggaagagcgagttccagatctacaagaaatccggcatccaggaggtcgaccgtactctggcgaaggaggggataaagcgcggcgagacggatcaccacgccgtttcccgagggagcgccaagctgcgctggtttgtggagcggaacatggtcaccccggagggcaaggttgtggacctaggctgcgggcgcggcggttggtcatactactgcggtgggctcaagaacgttcgggaagtgaagggcctgaccaagggcgggcccggccacgaagagcccattcctatgagcacctacgggtggaacctcgtgagactacagagcggcgtcgacgtgttcttcacgccgcccgagaagtgcgatactctgctctgcgacatcggtgagtcaagccctaaccccaccatcgaggccggccggaccctgcgcgtgctaaacctcgtcgagaactggctgaacaacaacactcagttctgcatcaaggtgctgaacccgtacatgccctccgtaatcgagaagatggaggccctccagcggaagtacggcggggcgctggtccgcaaccccctgtcgcggaactccacgcacgagatgtattgggtgagcaacgccacgggcaacatcgtgtccagcgtcaatatgatctcccgcatgctgatcaaccgattcaccatgaagcacaagaaggctacctacgagccggacgtggaccttgggagcggcacgcgcaacatcgggatcgagtccgagatccccaacctggatataattggcaaaagaatagagaagatcaaacaggagcacgaaacaagctggcactatgaccaggaccacccctacaaaacctgggcctaccacggctcctacgagacgaagcagacggggagcgccagttcaatggtgaacggcgtcgtccgcctgctcaccaagccctgggacgtggtcccgatggtgacccagatggcgatgaccgacacgacccccttcgggcagcagcgcgtgttcaaggagaaggtcgacacccggacccaggagcccaaagaaggcacgaagaagctcatgaagatcaccgctgagtggctgtggaaggagctcggcaagaagaagacacccagaatgtgcacccgggaagagttcacgcgcaaggtccggtccaacgctgccctgggggccatcttcactgacgagaacaagtggaagtccgcgcgggaggccgtggaggacggccggttctgggagctggtcgatcgcgagcggaacctccacctggagggaaagtgcgagacctgcgtgtataacatgatgggcaagcgcgagaagaagctgggtgagttcgggaaggccaagggctcccgtgcaatctggtacatgtggctgggggcgcgcttcctggagttcgaggctctgggcttcttgaatgaggaccactggttcagccgggggaactcactgtccggcgtggaaggggagggtctgcacaggctcggctacatcctgcgagacgtcgggaagaaggagggtggggccatgtacgccgacgacaccgcggggtgggacacgcgcatcaccttggaggacctaaagaacgaggagatggtaaccaaccacatgaagggggagcacaagaagctggcggaggccatcttcaagctcacctaccagaacaaggtcgtgcgtgtccagcgcccgacgccccgcggcaccgtcatggacatcatcagccgccgggaccagcgcggctccgggcaggtcggcacatacgggctcaacaccttcacgaacatggaggcccagttaatccgccagatggaaggcgagggcatcttcaagtccatccaacaccttaccgccaccgaggagatcgccgtgcagaattggctcgcgcgggttgggcgggagcggctgtcccgcatggccatcagcggcgacgactgcgtggtgaagcccatcgatgatcggttcgcatccgcactgaccgctcttaacgacatggggaaggtccgcaaagacatacagcagtgggagcccagccggggctggaacgactggacccaggtgcccttctgctcccaccacttccacgagctggtgatgaaggacgggcgcgtcctggtcgtgccttgccggaaccaggacgagctcataggccgcgcgcgaatcagccagggcgcaggatggtccctgaaggaaaccgcttgcctgggcaagtcttacgcacagatgtggaccctcatgtacttccaccgccgcgacctacgcctggccgcgaatgctatctgctccgccgtccccagccactgggtgcccaccagtcgaaccacgtggtccatccacgccaagcacgagtggatgaccaccgaggacatgctcgcggtgtggaaccgtgtctggattcaggagaacccgtggatggaggacaagaccccagtggagtcatgggaggaggtgccctacctggggaagcgggaggaccagtggtgcggaagcctgatcgggctcacgagccgcgccacgtgggccaagaacatccagaccgcaatcaatcaagtccgcagtctgatcggcaacgaggaatacaccgactacatgccctctatgaaacgcttccgccgggaagaggaagaggctggcgttctgtggtga

SEQ ID NO: 25064 - RNA, 9876 nt, synthetic construct
  misc_feature 1..9876: note = derived and/or modified CDS sequence (opt11) from DENV-2__GQ199869__SS-prME
  source 1..9876: mol_type = other RNA
accgcgggagttattgtgatgctgatccccaccgcaatggcgttccacctcaccacccgcaatggtgaaccgcacatgatcgtgggtcggcaggaaaaggggaagagtttgctgttcaagacggaagatggagttaacatgtgcactctcatggctatcgacttgggggaactgtgcgaagataccatcacctacaagtgtcccctactccgccagaatgaaccagaggacatagactgctggtgcaacagcacgagcacctgggtcacctacggtacctgcaccaccacgggcgagcaccggcgcgaaaagcggtccgtggccctggttccgcacgtcgggatgggactcgagacgcgaaccgagacctggatgagcagtgagggcgcctggaagcacgtgcagcgtatcgagacgtggatcttgcgccacccaggcttcaccattatggccgcgatcctggcttacaccatcgggaccacgcactttcagcgtgccctcatcttcattctactgaccgccgtcgcacccagtatgaccatgagatgcatcggtataagcaaccgggactttgtcgagggggtgtccgggggctcgtgggtagacatagtcctcgaacacgggtcctgcgttaccacgatggccaagaacaagccaaccctggatttcgaattaatcaagacggaagccaagcagccagccaccttaaggaagtactgcatcgaggcgaagctgacgaacacgaccaccgaatcacggtgcccaactcagggcgaacccagcctgaacgaggaacaggacaagcgcttcatatgcaagcactccatggtagacaggggctgggggaacggatgcgggctgttcggcaagggcggcatcgtgacgtgcgcgatgtttacctgcaaaaagaacatggagggcaaggtggttcaaccggagaacctcgagtataccatagtcataacgccccacagcggggaggagcacgcggtgggtaacgataccgggaaacacggcaaggagatcaagatcacgccgcagtcaagcatcaccgaggcggagctaaccggttacggaacggtgacaatggagtgttctccgcgaaccggactcgacttcaacgagatggtcctactgcagatggaggacaaggcctggctcgtgcaccggcaatggtttctggacctgcccttaccctggcttccgggggccgacatacagggctctaactggatccagaaggagaccctggtgacattcaagaatccccatgccaagaagcaggacgtagtggtcttaggtagtcaagagggtgcaatgcacaccgccctaaccggggccaccgaaatccagatgagtagtggcaatctcctgttcacgggccatctgaagtgtcggctgcggatggacaaacttcagttaaaggggatgtcctacagcatgtgcaccggtaaattcaagatcgtgaaggagatagcggagactcagcatgggaccatcgtgatccgtgtacagtacgagggcgacggatccccctgcaagatccccttcgagatcacggacctggagaagcggcacgtattagggcggctgataaccgtgaaccccatcgtcaccgaaaaggactctcccgttaacatagaggccgaaccgcccttcggcgactcctacatcatcatcggagtggagccaggccagctgaagctcaactggttcaagaaggggtcgtccatcggccagatgttcgagaccactatgcgcggggcaaaacggatggccatcctgggcgataccgcgtgggacttcggctctctcgggggcgtgttcacctccataggaaaggcactccaccaggtattcggcgcgatctacggcgccgcctttagcggcgtgtcctggaccatgaagatcctgattggtgtcatcatcacatggatcggaatgaacagtcgctcaaccagcctgtccgtctcactggttctcgtcggggtggtgacgttatacctgggggcagtagtgcaggcggactccggatgcgtagtcagttggaagaacaaagagctcaagtgcggctccgggatctttatcaccgacaacgtgcacacgtggactgaacagtataagttccaacccgagagccccagcaaattggcgagcgcaatccagaaagcccatgaggagggcatctgcggaatccggtccgtgacccgcctagagaacctcatgtggaagcaaatcacccccgaactgaaccacatcctgtcggaaaacgaggtcaaactcactatcatgaccggggacataaagggtattatgcaggccgggaagcggtctttgcgtccgcagccaaccgagctgaaatacagttggaagacttggggcaaggctaagatgctctcgacggagtcccataaccagaccttcctaatcgacgggccggagaccgccgagtgccctaacaccaaccgggcctggaactctcttgaggtagaggattatggctttggagttttcaccaccaacatctggctcaagctgagggagaagcaggatgtcttctgcgactccaagctgatgagcgccgccatcaaagacaaccgggccgtgcacgcggacatgggctattggatagagtccgcccttaacgacacatggaaaatggagaaggccagcttcatagaagtaaaatcctgccactggcccaaaagccacactctctggtccaacggcgtccttgagagcgagatgatcatccccaagaactttgccggtcccgtgtcccagcacaactaccgcccaggttaccacacacagacggcggggccatggcatctcggcaaacttgagatggacttcgacttctgcgagggaaccaccgtggtagtgaccgaggattgcggcaaccgcggaccctccctgcgcactactaccgccagcggtaaactgattaccgagtggtgctgccggagttgcacgttgcccccgttacgctaccggggcgaggacgggtgctggtacggcatggaaatccgacccctcaaggaaaaggaagagaacttggtgaacagcctagtcaccgccgggcacggccagatcgacaacttttcgctgggcgtcttggggatggccctgtttctcgaggagatgctgcggactaggatcggaaccaagcatgcgattctgctcgtggccgtcagctttgtgacgttgatcaccggtaacatgtcgttccgggacttaggccgcgtgatggtgatggtgggggctaccatgacggacgacatcggcatgggcgtgacgtacttagctctgctggccgcgttcaaagtccgtccgacgttcgccgcggggctgctcctgcggaagctcacatcaaaggagttaatgatggccaccatcggtatcgcattactctcccagtcgacgatacccgaaacgatcctggagctcaccgacgcgctcgctctggggatgatggtgctgaagattgttcgcaacatggagaaataccagctcgccgtcactatcatggccatatcctgcgttccgaacgccgtcatcttacagaacgcctggaaagtttcctgcacaatcctggccgccgtttccgtctctccgctcctgcttacctcgtcgcagcagaaggccgactggatacccctcgctctaacgatcaagggtctgaaccccaccgccatcttccttactaccttgtcacggaccagcaagaagcgctcttggcctctgaacgaagccatcatggccgtgggaatggtgtccatcctcgcttctagcctgctaaagaacgacatccccatgaccggacctctcgtcgcgggcgggctgcttacggtctgctacgtgttgacgggcaggagcgctgacttggagctggagagagctgccgacgtgaagtgggaagatcaagccgagatctccgggagcagcccaatactatcgatcaccatctccgaggacggcagcatgtctataaagaacgaggaggaggagcagactttaaccatcctcatccggacggggctcctcgtgataagcggagtgttcccggtatccatccccatcactgcggcggcctggtatctgtgggaggtgaagaagcagcgcgccggcgtactctgggacgtccccagcccgccgcccgtagaaaaggccgagttggaggacggggcgtaccggatcaaacagagaggcatcctggggtactcccagatcggtgccggcgtgtacaaggagggaacgttccacaccatgtggcatgtgacgcgaggtgccgtactcatgcaccgcgggaagcggatcgagccatcttgggccgacgtgaagaaggatctgatatcctacggcgggggatggaaacttgagggtgagtggaaagaaggagaggaggttcaggttctcgctctcgaacccggcaagaatccccgcgccgtgcagaccaagccgggcatcttcaagaccaacaccggaacgataggagccgtcagcctggacttttctcccggcacaagcgggtcccctatagtggatcggaaggggaaagtggtgggtctctacggaaatggcgtggtgacacgcagcggcgcctacgttagcgcaatcgcgcagaccgaaaagtccattgaagacaacccggagatcgaggacgacatcttccggaagaaacgcctcacgatcatggacctgcaccccggtgcgggcaagaccaagcggtatctcccggccatagtacgagaggctatcaagcgggggttacgcaccctgattctggcccctacgagggtggttgcggccgaaatggaggaggcgctcagaggtttaccaatccgctaccagaccccggccatcaagacggagcacaccgggagggagatcgtcgatctgatgtgccacgctacatttacgatgcggctcctgtcgcccgtgagagtcccgaattacaacctgatcatcatggacgaggcccacttcactgatcccgcctctattgccgcccgcggttacatcagcacccgtgtagagatgggcgaggcagcagggatattcatgaccgccacgccgcccggatcccgggaccccttcccccaaagcaacgcccccatcatggacgaggagcgggaaatccccgagcggtcttggaactctgggcacgagtgggtgactgacttcaagggaaagaccgtgtggtttgtcccgtccatcaaggcggggaacgatatcgcggcctgcctcaggaaaaacggcaaaaaggtgatacaattgagccgcaagaccttcgactccgagtacgttaagacgcgggcaaacgactgggactttgtggtgaccaccgacatttcagagatgggcgcgaacttcaaggccgagcgcgttatcgacccgcggcgatgtatgaagccggtgatcctgaccgacggggaggagcgtgttattctcgcgggccccatgccggtcacgcactccagtgccgctcagcgcagaggccgcattgggcgcaaccccaagaacgagaacgaccagtatatctacatgggcgaacccctggaaaacgatgaggattgtgcccactggaaagaggccaagatgttgttagacaatatcaataccccggagggcatcatccccagcatgttcgagccggagcgtgagaaggtggacgccatcgacggcgaataccgccttcgaggcgaggctcgcaagacctttgtcgacctaatgcggcgcggggacttacccgtctggctggcctacaaggtagccgccgaggggatcaactacgcggaccgcaaatggtgcttcgacggcataaagaataaccaaatcctagaggaaaacatggaagtggagatatggaccaaggagggggagcgcaagaagctcaagccgcgttggctggacgccaggatttatagcgacccactggccttgaaggagttcaaggaatttgccgcaggtaggaagtccctgaccctgaacctcattaccgagatgggccgcctgcccacattcatgactcagaaggcgcggaacgcgttggacaacctcgccgtactgcacacagcagaggcaggcggccgcgcctacaaccacgccctgagcgagctccccgagacacttgaaacactgttactgctgacactgctggcaacggtgaccgggggcatcttcctgttcctcatgtccggtaagggtattggcaagatgacactggggatgtgctgcatcatcaccgccagcatcctgctctggtacgcgcagatccagccgcattggatcgccgcctccataatcttagagttcttcctgatcgtcctcctgattcccgagcccgagaagcagcggacgccccaggacaaccagctgacgtatgtagtcatagccattttaacagtcgtggctgccaccatggctaatgagatgggctttctggagaagacaaagaaggacctcgggctcggctctatcactacacaggagagcgagtctaacatactggacatcgacttgagaccggccagcgcctggaccctctacgcggtggcaaccactttcgtcacccccatgcttcggcactccatcgagaatagctccgtgaacgtgagcctgaccgctatcgcaaaccaggcaaccgtcctaatgggtcttgggaaaggctggcccctgtccaaaatggacatcggggtgcctctcctggctatcggttgttacagccaggtgaacccaatcaccttaaccgctgccctcctgctgctcgtcgcccactacgccatcatcgggcccggcctgcaggcgaaggcaacccgcgaggcgcagaagcgggcggcggcgggaattatgaagaaccccaccgtggatggaataacggtgatcgatctggagcccataccgtatgaccccaagtttgagaaacagttgggtcaagtcatgttgctgatcctctgcgtgacacaggtgttaatgatgaggaccacatgggctctatgcgaggcgctcacgctggccactggtcctatttccactctgtgggagggaaaccccgggcggttctggaatactacgatagcggtctctatggctaatatcttccgcggctcttaccttgccggcgccgggctcctgttttctatcatgaagaataccacctccactcgccggggcacggggaacataggggagaccctcggcgagaaatggaagtcccgtctgaacgccctcggcaagagtgagttccaaatctataagaagtccggcatccaggaggtggacaggaccttggcaaaagaagggatcaagcggggtgagaccgaccaccacgccgtgtctcgaggatcagcgaaactgcgctggttcgtcgagcggaacatggtgacaccggagggcaaggtcgtcgatctgggttgcggtcgcggcgggtggtcctattactgcggcgggttgaaaaacgtgcgggaagtgaagggcctgaccaaaggcggccccggccacgaggagcccatccccatgagcacctacgggtggaacctggtccgcctccagagcggcgtggatgtgttcttcaccccgcccgagaagtgtgacacgctgctgtgcgacatcggggagagtagccccaaccctaccatcgaggccggccgcaccctgcgcgtactgaacctggtcgagaactggctcaacaacaatacccagttctgcattaaggttttaaacccgtacatgccttccgttatcgagaagatggaagccctgcagcgccagtacggcggggcgttggttcgcaacccccttagccggaacagtacgcacgaaatgtactgggtgagcaacgccacgggcaacatcgtcagcagcgtgaacatgatctcccgcatgctgatcaatcggtttaccatgaagcacaaaaaggccacgtatgagccggacgttgatctggggagcgggacacgcaacatagggatcgagagtgaaatccccaatctcgacatcatcggcaaacgtatcgaaaagatcaagcaggagcacgagatcagctggcactacgatcaggaccatccatacaagacttgggcttaccacggctcctacgagactaagcagaccgggtcagcctccagcatggttaacggagtcgtgcggcttctgacgaagccctgggacgtcgtgcctatggtcacacaaatggcgatgactgacacgacgccctttggtcaacagcgcgtctttaaagaaaaggtggacacgcggactcaggagccgaaggagggcacgaaaaagctcatgaagatcaccgcggagtggctgtggaaggagcttggcaagaagaaaacaccccgcatgtgcaccagggaggagttcacgaaaaaggtgcgatcgaacgccgccctcggggcaatattcactgacgaaaacaagtggaagtcagcgcgggaagcggttgaggacggccgtttttgggaactggtggatcgggagaggaacctgcacctagaggggaaatgcgagacctgcgtatacaatatgatgggcaagcgggagaagaagttaggggagttcggcaaggcgaagggctcccgcgccatctggtacatgtggttgggtgcccggttcctcgagttcgaggctctgggcttcctgaacgaggaccactggttctccagggggaacagcctctctggcgtcgagggggagggcctgcaccggctgggctacatcctgcgcgacgtgggcaagaaggagggtggcgccatgtatgccgacgacaccgccgggtgggacacacggattaccctcgaggacctgaaaaacgaggagatggtcactaaccatatgaaaggcgagcacaagaaacttgcggaggccatcttcaaacttacctaccaaaataaggtggtgcgcgttcaaaggccgacgcccaggggtacggtgatggacataatcagcagacgagaccagcggggctccggacaggtcggcacctatggactgaacactttcacaaacatggaggcgcagctcatccgccagatggagggggaaggtatcttcaaatccatacaacacctgaccgccacggaggagatcgccgtccagaattggctggctagagtggggcgggagcgactctcacgcatggccatcagtggtgacgactgcgtggtcaagcccatcgacgaccgcttcgcatccgctctgacagccctgaatgacatggggaaggtgcgcaaggacatacagcagtgggagcccagtcgcggctggaacgactggacacaggtgccgttttgctcccaccacttccacgagctcgtcatgaaggatggtcgggtgctggtcgtcccgtgcagaaaccaggacgagctgatcggcagagcacgcatcagccagggtgccgggtggtctcttaaggagacggcctgtctgggaaagagctatgcacagatgtggacgctaatgtacttccaccggagagacttacggctggccgcaaatgccatctgctccgccgttccctctcactgggtgcccacctcccgcactacatggtccatccacgccaagcacgagtggatgaccacggaggacatgctggcggtctggaaccgcgtgtggattcaggagaacccgtggatggaagacaagaccccagttgagtcctgggaggaagtcccttacctcgggaagcgagaggaccagtggtgcggcagcttaatcgggcttaccagccgggcgacatgggcgaagaatatccaaacggctatcaaccaagtgcgatccttgatcggcaacgaggagtacacagactacatgcccagcatgaagcggttccgccgtgaggaggaagaagcgggcgtactttggtga

SEQ ID NO: 25065 - RNA, 9876 nt, synthetic construct
  misc_feature 1..9876: note = derived and/or modified CDS sequence (opt11) from DENV-2__JX079688__SS-prME
  source 1..9876: mol_type = other RNA
accgcgggcgtcatcgtcatgctgatccccacggccatggcgttccacctcaccacccgcaacggcgaaccccacatgatagtgggccggcaagagaagggcaagagcctgttgtttaagacggaggacggggtgaacatgtgcaccctcatggccatcgaccttggggagctctgtgaggacaccatcacctataagtgccccctcctgcgccagaacgagcctgaggacatcgactgctggtgcaatagcacctctacgtgggttacctatgggacctgcaccaccacgggggagcaccgtcgggagaagcgttctgtggccctggtgccccacgtggggatgggcctcgagacccgcacggagacctggatgtctagcgagggtgcctggaagcatgtacagcggatagagacctggatcctgcgccacccgggtttcaccattatggccgcgatcctggcctacaccatagggaccacgcactttcagcgggccctcatcttcatccttctgacggccgtggctcccagtatgacaatgcgctgcatcggcatcagcaaccgggacttcgtcgagggcgtgagcgggggctcatgggtggacatcgtcctggagcacgggtcatgcgtgaccacgatggccaagaacaagcccaccctggacttcgagctgataaagaccgaagccaaacagccagccacactccggaagtactgcatcgaggctaagctaactaataccaccaccgaatcccggtgccccacgcagggcgagcccagcttaaacgaggagcaggacaaacgcttcatctgcaagcactccatggtggataggggctggggaaacggctgcgggctgtttggcaaagggggcatagtgacctgcgcgatgttcacatgcaaaaagaacatggagggcaaggtggtgcagccggagaacctggagtacaccatagtcataacgccccacagcggggaggaacacgcggtcggcaacgacaccgggaagcacggcaaggaaatcaagatcacaccccagtcctctattaccgaggccgagttgaccgggtatggcacggtgactatggaatgcagtccacggaccggcctcgacttcaacgagatggttttgctgcagatggaggacaaggcctggttggtgcaccggcaatggtttctggacctgcctctcccctggctgccgggggccgacactcaggggtccaactggatccaaaaggagacactggtgacattcaagaacccccacgcgaagaagcaagacgtcgtggtcctcgggtcacaagagggcgcgatgcacaccgccctgaccggggccaccgagatccagatgagcagcggcaacctcctgttcaccggccacctgaagtgccgcctgcgaatggacaagctccagctaaaggggatgtcctattcgatgtgcaccggcaagttcaagatagtgaaggaaatcgccgagacccagcacgggacgatcgtgatccgcgtacaatacgagggcgacggctcaccctgcaagatccccttcgagatcaccgacctggagaagcggcacgtgctcggacggctgatcacggtgaacccgatcgtcacggagaaggacagccccgtgaacatagaagcggagccacccttcggcgactcctatatcatcatcggggttgagccgggacagttgaagctcaactggttcaagaaagggagcagcataggccagatgtttgagacgaccatgcgcggcgctaagagaatggccatcctgggggacaccgcctgggacttcggcagcctcggtggcgtcttcacctcgatcgggaaggccttgcaccaggtgttcggcgcaatctacggcgccgccttcagcggggtgagctggactatgaagatcctgatcggcgtcatcatcacctggatagggatgaactcacgttccaccagtctgtccgtgtcactggtgctcgtcggtgttgtgaccctgtacctgggagccgttgtacaggcagattccggttgcgtggtcagttggaagaacaaggagttaaagtgcggctcagggattttcatcacggacaacgtgcacacctggactgagcagtacaagttccagcccgagagccccagcaagctggcctccgccatccagaaggcacacgaagagggcatctgcgggatccggagcgtgacccgcttggagaatctcatgtggaagcagatcaccccagagctgaaccacattctttccgaaaacgaggtcaagctcaccatcatgaccggagacatcaaggggatcatgcaggccggcaagcggagcctccgtccgcagcccacggagctgaagtactcgtggaagacgtggggaaaagcgaaaatgctcagcacagagtcacacaatcagaccttcctgatcgacggtccagagaccgccgagtgtccgaatacgaaccgggcctggaacagcctagaggtggaggactacggctttggggtgttcaccacgaacatctggctcaagctgcgcgagaaacaggacgtcttctgcgactccaagctgatgagcgccgccataaaggacaacagagcggtacacgccgatatggggtactggatcgagtccgccctcaacgacacctggaaaatggagaaggccagctttatcgaggtgaaatcctgccattggcccaagagccacaccctttggagcaacggcgtcctggagagtgagatgatcatcccaaagaacttcgccgggcctgtgtcccagcacaattaccgaccgggttaccacacgcagaccgcggggccctggcacctcggtaagctagagatggactttgacttctgtgaagggactaccgtggtagtgacggaggactgcggtaatcggggccccagcctgcgcacgactactgccagcgggaagctcatcacggaatggtgctgccggtcctgcaccctgccccctctgaggtatcggggcgaggacgggtgttggtacgggatggaaatacgaccgctaaaagagaaggaggagaacctggtgaactcgctggtcacagccgggcacggtcagatcgacaacttttccttgggcgtgctggggatggcgcttttcctcgaagagatgctgagaacccgcatcggcaccaagcacgcgatcctgctcgtggcggtcagcttcgtgaccctgattaccgggaacatgtcctttagggatctgggccgcgtgatggtcatggtgggcgctaccatgacggacgacatcgggatgggggtgacctacctcgccctgctggccgccttcaaagtccgcccgaccttcgctgccgggctcttactgcggaagctcaccagcaaggagttgatgatggccacgatcggcatcgccctgctgtcgcagagcaccatccccgagaccatcctagagctgaccgatgcgctcgccctggggatgatggtgctgaaaatcgttcgcaatatggagaagtatcagttggccgtcacgatcatggccatctcctgcgtgccgaacgccgtcatcctgcagaacgcgtggaaggtctcatgcacaatcctcgccgccgtgagcgttagccccctcctgctgacctccagccagcagaaggcagactggatcccgctcgcccttaccatcaagggactgaatcccaccgccatcttcctcaccaccctgtctcgtactagcaagaagaggtcctggccgctgaacgaggcgatcatggccgtgggcatggttagcatcctcgcctcctcgcttctgaagaacgacatcccgatgacggggcctctcgtcgcgggcggcctgctgaccgtgtgctacgtgctgaccggcagaagcgccgacctggagctggagcgcgccgccgacgtcaaatgggaggaccaggccgagatctccgggtcgtcccccatcctcagcatcactatctccgaggacggtagcatgtctatcaaaaacgaggaggaagaacagacgctcacgatcctgatcagaacgggcctactggtgattagcggcgtgttcccggtctcgattcccatcacagcggccgcctggtacttatgggaggtgaagaagcagcgcgccggcgtgctgtgggacgtccccagccctccgcccgtggagaaggctgagctcgaggacggggcgtaccggataaagcaacgcggcatcttggggtactcccagatcggcgccggcgtgtacaaagaagggacctttcacactatgtggcatgtgacccggggcgccgtactcatgcaccgcggcaaacggatcgagcccagctgggccgatgtgaagaaagaccttatctcctacggcggcgggtggaaactggagggcgagtggaaggagggtgaggaggtccaggtcctcgccctggaacccggcaagaacccccgcgcggtgcagaccaagcccgggatcttcaagacgaatacgggcaccatcggggccgtcagcctggacttctcccccggcaccagcggctctcccatcgtggaccggaaggggaaggtggtcggcctctacgggaatggcgtggtaacccgcagcggcgcctacgtaagtgccatcgcgcagacggaaaagagtatcgaggacaaccccgagatcgaggacgacatcttcagaaagaagcgcctgaccatcatggacctccacccaggggccggcaagaccaagcggtacctccccgccatcgttcgagaggccatcaagcgggggctgcgaaccctgattctggcaccgacgcgcgtggtcgcggccgagatggaggaggccctcagaggcctgcccatccggtatcagacccccgccatcaagaccgagcacacgggtcgggagatcgtggacctgatgtgccacgcgacgttcacaatgcgcctcctcagccctgtgcgggtccctaactacaacctgatcatcatggacgaggcccacttcaccgacccagcctccatcgccgctcgcggctatatctcgacgcgggtagagatgggcgaggccgcggggatcttcatgacggcgacgccgccgggctcccgcgacccgtttccccagagcaacgcccccataatggacgaggagcgggagatccccgagcgctcctggaacagcgggcacgagtgggtgacagacttcaaaggcaagaccgtctggttcgtgccgagcatcaaggcagggaatgacatcgcggcctgtctccggaaaaatggtaagaaggtgatccagctgagcagaaagaccttcgactccgagtacgtcaagacgcgggccaatgactgggacttcgtggtgaccaccgacattagcgaaatgggcgccaatttcaaagccgagcgcgtcatcgacccccggcgctgcatgaaaccagtgatactgacggacggggaggagcgggtcatcctcgcggggcccatgcccgttacccacagttcagcagcccagcgccggggtcgcatcggccgcaatcctaagaacgaaaatgaccagtacatctatatgggggagcccctagagaacgacgaagactgcgcccactggaaggaggccaagatgctactcgacaacataaacacccccgagggcatcatcccgtccatgttcgagcccgagcgggagaaggtagacgctatcgacggcgagtatcgcctgcgcggagaggcccgcaagaccttcgtggacctaatgaggcgtggcgacttacccgtatggcttgcctacaaggtggcagccgagggtatcaattacgcggaccggaagtggtgcttcgatggcatcaagaacaaccagatactagaggagaacatggaggttgagatctggaccaaagagggggagcgcaagaaacttaagccgcggtggctggacgcccgcatctactcagacccactggccctcaaggagttcaaagagttcgccgcgggcaggaagtccctaacgctgaacctcattaccgaaatgggacgcctacccactttcatgacgcagaaagccaggaacgccctggacaacctggcagtcctgcataccgccgaagccgggggccgcgcctacaaccacgctctgagcgaactccccgaaaccctggagactctgcttctgttaacgctcctggccaccgtgaccggcgggatcttcctgttcctcatgtccggtaaggggatcgggaaaatgaccctggggatgtgctgcattatcactgccagcatcttactctggcacgcgcagatccagccgcactggatcgccgcctctatcatcttggagttcttcctgatcgtactattgattcctgagcccgagaagcagcggactccccaggacaaccagctgacgtacgtggtcatcgccatactgacagttgtggccgcgaccatggccaacgagatgggcttcctggagaaaacgaagaaggacctgggtctcggcagcatcaccacccaagagagcgagtccaacatcctggacatagacctgcgcccggccagcgcctggaccctctacgccgttgcgacgacgttcgtcacccccatgctgcggcattccatagaaaatagctctgtcaacgtttcgctaaccgccatcgccaaccaggccacggttctcatgggcctgggaaagggctggcccctgtccaagatggacatcggagtgcccctcctggcgatcgggtgttacagccaggtgaacccaattaccctgaccgccgctttgctgttgctcgtcgcgcattacgccattatcggaccaggcctgcaggcgaaggccactcgcgaggcccagaagcgggccgccgcgggcatcatgaagaaccccacggtggacgggatcactgtgattgacctggaacctatcccgtatgacccgaagtttgagaagcagctcggccaggtcatgttgctgatattatgcgtgacccaagtgctgatgatgcgcacaacatgggcactatgcgaggccctcaccctggcaaccgggcccatctccaccctgtgggaaggcaacccagggcggttttggaacacgaccatcgccgtgagcatggcgaacatattccgcggctcctacttagccggcgccgggctgctgttcagcattatgaagaacaccacctcaacgcgccggggcacggggaacatcggcgagaccctcggcgagaagtggaaaagcagactgaacgctttggggaagtccgagttccagatctacaagaagtccggcatccaggaggtcgaccggacccttgcgaaggaggggatcaaacgcggcgaaacggatcaccacgccgtttcccgggggagcgccaagctgagatggttcgttgaacggaatatggtgaccccggaaggcaaagtggtcgacctgggctgcgggcgcggcgggtggtcctactactgcggtggtctcaagaacgtgcgggaggtgaagggcctgaccaaaggcgggcccggccacgaggagccgatccccatgagcacctatgggtggaacctggtgcgcctccagagcggcgtggacgtgttcttcacgccgccggagaagtgcgacaccctgctgtgcgacatcggggagtcaagcccaaaccccaccatcgaggccggccgtaccctccgcgtcctgaacctggtcgagaactggctcaacaataacacacagttctgcatcaaggtgctgaatccgtacatgccctccgtcatcgagaagatggaggcactgcagcggcagtacggaggggctctcgtgcgcaaccccctgagccggaactccacgcacgagatgtactgggtcagcaacgcgaccggcaacatcgtctccagcgtgaacatgatctcccgcatgctgataaaccggttcaccatgaagcacaaaaaggcaacctacgagccagatgttgaccttgggagcggcactcgcaacatcgggatcgaatcggaaatcccgaacctcgacatcataggtaagcggattgaaaagatcaaacaggaacacgaaatcagctggcactacgaccaggatcacccctacaaaacctgggcctaccacggctcctacgagaccaagcagaccgggagcgcgtcgagcatggtcaacggtgtagtgcgcctgctgacgaagccctgggacgtcgtgccgatggtgacccagatggcgatgaccgatactacgcccttcgggcagcagcgcgtctttaaggagaaggtggacacgcggacccaggagcccaaggaaggcaccaaaaagctcatgaagatcacggctgagtggctgtggaaggagctgggcaagaagaagacgcccagaatgtgcacccgggaggagttcaccaaaaaggtgcgctccaacgccgccctgggggccatcttcacggacgagaacaagtggaagtccgcgcgggaggccgtcgaggacggccgcttttgggagttggtggaccgggagcgcaacctgcacctcgaggggaaatgcgagacctgcgtatacaacatgatgggaaagcgggaaaagaagctaggggagttcggcaaggccaaggggtcccgcgcgatctggtacatgtggctaggagcgcggtttctcgagttcgaggccctcggcttccttaatgaggaccactggttcagccgtgggaatagcttgtccggcgtcgagggggaaggcctgcaccggctgggctacattctccgagacgtcgggaagaaggagggcggagccatgtacgccgatgacaccgccggctgggacacccggatcacgctggaagaccttaagaatgaggagatggtcacaaatcacatgaagggggagcataagaagctcgccgaagccatcttcaagctaacctaccagaacaaggtagtgagagtccaaaggccgacgccccgcggaacggtgatggacatcattagccggcgcgaccagcggggctcggggcaggtcggcacctacggactgaatacgttcaccaacatggaagcccaactcatccgccagatggagggtgagggcatcttcaagagcatccagcatctgacagccaccgaggagatcgccgtccagaactggctggcgcgcgtgggacgcgagcggctctcacggatggcaatcagtggtgacgactgcgttgtcaagcctatcgacgaccgcttcgcctctgccctgaccgccctcaacgacatgggcaaggtgcggaaggacatacaacagtgggagcctagtcgcggctggaacgactggacccaagtcccgttctgctcgcaccacttccacgagctcgtgatgaaggacgggcgggtgttggtggtgccctgccgcaaccaggacgaactgatcggacgggcgaggatcagccagggcgccgggtggtccctcaaggagacggcctgtctgggcaagagctatgcccagatgtggaccctgatgtacttccaccggcgcgacctccggctggctgcgaacgccatctgttccgccgtgcccagccactgggtgccgacctcccgcaccacctggagcatccacgccaaacacgaatggatgacgacggaggatatgctggctgtctggaatcgggtgtggatccaagagaacccgtggatggaggacaagaccccggtggagtcctgggaggaagtgccctacctcggcaagcgcgaggaccaatggtgcggcagcctgatcgggctgactagccgggccacgtgggccaagaacattcagactgccatcaaccaagtgcgctcactaattggaattgaggagtacaccgactacatgcccagcatgaagcggttccgcagggaagaggaggaggccggcgtgctgtggtga

SEQ ID NO: 25066 - RNA, 9876 nt, synthetic construct
  misc_feature 1..9876: note = derived and/or modified CDS sequence (opt11) from DENV-2__JF357906__SS-prME
  source 1..9876: mol_type = other RNA
accgccggcgtgatagtcatgttgataccgacggccatggcgttccacctcaccaccaggaacggggaaccccacatgattgtgggccggcaggaaaaagggaagtccctgctgtttaagacggaggacggtgtcaacatgtgcactttaatggcaatcgatttaggcgaactgtgcgaggacaccatcacctacaagtgccccctcttacgtcaaaacgagcccgaggacatagactgctggtgcaacagcacgagcacctgggtcacctatggaacctgcaccactacgggcgaacaccggcgcgagaaacgctccgtggccctggtgccccacgtcgggatgggcctcgagacccgcaccgagacttggatgagctcggagggggcctggaagcatgtgcagcggatcgagacgtggatcctgagacacccgggcttcaccatcatggccgcagtgctggcctatacgatcgggaccacgcactttcagaaggccctcatcttcatcctgctgaccgccgtcgcgcctagcatgaccatgcgctgcatcggcatcagcaaccgcgacttcgtggaaggggttagcggcggaagctgggtcgacatcgtgctcgaacacggtagctgcgtcaccacgatggccaagaacaagcccactctggatttcgagctgataaagaccgaggccaagcagcccgccactctccgaaagtactgcatcgaagccaagctgaccaacaccaccaccgagtcccgttgcccgacacagggggagcccagcctgaacgaggaacaggacaagcggtttatttgcaaacactcaatggtggatcgcggctgggggaacgggtgtggtctgtttggcaagggcgggatcgtgacctgcgcaatgttcacgtgcaagaagaacatggagggcaaggtcgtccagcccgagaacctggagtacaccattgtcatcacaccccactcgggggaggagcacgccgtgggcaacgacacagggaagcacggcaaggagatcaagatcactccgcagagtagcatcaccgaggccgagctgaccgggtacggcacggttacgatggagtgtagccccagaaccggcctcgactttaacgagatggttctgctgcagatggaagacaaggcctggctagtgcatcgccagtggttcctggacctgcccctcccctggttaccgggagccgacacccagggtagcaactggatccagaaagagacgctggtcacattcaagaacccccacgcgaagaagcaagacgtggtggtattagggtcccaggagggcgccatgcacaccgccctgaccggggccacggagatacaaatgagctccggcaacctcctgttcaccggccacttgaagtgccggctgcgcatggacaagctccagctgaaggggatgtcctacagcatgtgcaccgggaagtttaaaatcgtgaaggagatcgccgaaactcagcatgggacgatcgtcattcgggtgcagtacgagggagacggctccccttgtaagatacccttcgagatcacggacttagaaaaacgccacgtgctcggccgactgatcaccgtcaacccgatcgtcactgagaaagacagccccgtgaacatcgaggcagagccgcccttcggtgactcctacatcatcatcggggtagagccgggacagctgaagctcaattggttcaaaaaggggagctccataggccagatgttcgagacgaccatgcgcggcgccaagcgcatggccattttgggcgacacagcctgggacttcggtagcctcggaggggtgttcacctccattgggaaggccctccaccaggtgttcggggcgatctacggcgccgccttcagcggggtctcctggacgatgaagatcctgatcggcgtgatcatcacatggatcgggatgaacagccggtcaacgagcctgtccgtgagcctggtcttagtgggcgtggttaccctgtacctaggggccgtggtgcaggctgatagtggctgcgtcgtgagctggaagaacaaggaactcaagtgcgggtccgggatctttatcacggacaacgtgcacacctggaccgagcagtacaagttccagccggagtcgccctcgaagttggccagtgccatccagaaagcacacgaggagggcatctgcgggatccgtagtgtcacccggctggagaacctcatgtggaagcagatcacacccgagcttaaccacatcctgtccgaaaacgaggtaaagttaaccatcatgacaggcgacataaagggaattatgcaggccggcaaacgtagcctccggccgcagccgactgaactgaagtactcctggaagacgtggggcaaagcgaagatgctcagcaccgaatcccacaaccagaccttcctgatcgacggacccgaaaccgccgagtgtccgaacacaaaccgagcctggaatagcctggaggtggaagactatggctttggggtcttcaccaccaacatctggctaaagttacgggaaaagcaggacgtgttctgcgattctaagctaatgagcgccgccatcaaagacaaccgcgcggttcatgccgacatgggctactggatcgagtccgccctcaacgacacctggaagatggagaaggcttcattcatcgaagtcaaatcctgccactggcccaagtctcacaccctctggtccaacggcgtgctggaatcagagatgatcatccccaagaacttcgctgggcccgtgtcccagcacaattaccgccccggttaccacacgcagaccgcggggccctggcacctcggcaagctggagatggattttgacttctgcgaggggactaccgtcgtggtgacggaggactgcggcaaccgcggccccagcctgcggaccaccactgcctctggcaagctcatcacggagtggtgttgccgctcctgcacgttaccccctctgcggtaccgtggggaggacgggtgctggtatggcatggagatccgccccctgaaagaaaaagaggagaatctggtgaatagcctggtgaccgccgggcacggacagattgacaacttcagcctaggcgttctgggaatggccctgttcttagaggaaatgctgagaacgcggatcggcacaaaacacgcgatcctgttagtcgccgtcagcttcgtaacccttattaccgggaacatgtccttccgcgacctgggacgcgtgatggtaatggtgggggctaccatgaccgacgatataggaatgggcgtaacctacctcgccctgctggccgcgtttaaggtgcgccccaccttcgccgcagggctcctgctgcgcaagctcaccagcaaggagctgatgatggccacgatcggaatcgccctgttgtcccagtctaccatccccgagaccatcttggagctgactgacgccctcgccctggggatgatggtgctcaagatcgtccggaacatggagaagtaccaactcgccgtgacgatcatggccatatcctgcgtgccgaacgccgtcatcctgcagaacgcgtggaaggtaagctgcactatcctggccgccgtctccgtgtccccactcttgctgacctcctcgcagcagaaggccgactggatccccctcgcgctcacaattaagggcctgaacccgactgccatcttcttaaccaccctgtctcgcacctccaagaagcgctcgtggccgctgaacgaggccatcatggccgtgggaatggtgagcatcctcgcctccagccttctgaagaacgatatccccatgactgggcctctggtagcgggcgggttgctgacagtgtgctatgtcctaaccggacgctcggccgacttggaactggagcgggcggccgacgtgaaatgggaggaccaagccgaaatctccgggtcttcccccatcctcagcatcactatctcagaggacggcagcatgagtatcaagaacgaggaggaggagcagacgttaaccatcctgatccgcaccggcctccttgtgatcagcggtatcttcccggtctcgatacccattacggcggccgcctggtacctgtgggaggtgaagaagcagcgggccggcgtgctctgggatgtcccgagcccgccaccagtggagaaagccgagttagaagacggtgcgtaccgcatcaagcagcggggcatcctggggtattcccagattggcgctggcgtttacaaggaggggaccttccacacgatgtggcacgtcacccgcggcgccgtgctcatgcaccggggaaagcgcatcgagccgagctgggctgacgtgaagaaggaccttatctcttatggcgggggctggaagctcgagggcgagtggaaggaaggggaggaagtacaggtgctcgccctggagccgggcaagaacccgcgggcggtgcagaccaagcccggtatcttcaagaccaacactggaaccatcggggccgtcagcctggacttttccccgggtaccagcggctcccccattgtggaccgtaaggggaaggtggtcggcctctacgggaacggcgtggtaacccgtagcggcgcctacgtctccgcaatcgcacagacggaaaagtccatcgaggacaacccagagatcgaggacgacatcttccgcaagaaacggctgaccattatggaccttcacccaggggcgggcaagaccaagcgatacctccccgccatcgtgagggaggccatcaagcgcgggctccggaccttgatcttagccccgacgagagtggtcgcggccgagatggaggaggccctacgcggcctgccaatccgttatcagacccccgccattaagaccgaacacaccgggcgcgagatcgtggacctgatgtgccacgccacgttcactatgcggctcctgtcgcccgtgcgcgtaccgaactacaacctgatcatcatggatgaggcccacttcaccgaccccgcatccatcgccgcgcggggctacatcagcacccgagtggagatgggcgaggccgcgggaatcttcatgacggcaacgccgcccgggtccagagacccgttcccccagagcaacgcccccataatggatgaggagcgtgagatcccggagcggtcctggaacagcgggcacgaatgggtgactgactttaagggcaagactgtctggttcgtgccgtccatcaaggccggaaacgacatcgctgcctgcctccgcaaaaacggcaaaaaggttatccagctgagccggaagacgttcgactccgagtacgtcaaaacccgcgccaacgactgggacttcgtggtgaccaccgatatctctgagatgggcgcgaacttcaaggcggagcgggtcatcgatccccgccggtgcatgaagcccgtcatactgacggacggggaggaaagagtgatactggcgggacccatgcctgtcacccactccagcgccgcccagagaagggggcggataggccgcaaccccaaaaatgaaaacgaccagtacatctacatgggggaacccctggagaacgacgaggactgcgcccactggaaggaggcaaagatgctcctcgacaacataaacacgccagagggcataatcccgtccatgttcgagcccgagcgcgaaaaggttgacgcaatcgacggcgagtaccggcttagaggggaggcacggaaaaccttcgtggatctgatgcgccggggcgacctcccagtctggctagcctacaaggtagccgccgaaggcatcaactacactgaccgtaagtggtgctttgacggcatcaaaaacaaccagatcctggaggaaaacatggaggtggagatctggaccaaggaaggggagcggaagaaacttaaaccacgctggctggatgcgcggatctacagcgatcccctggccctcaaggagttcaaggagttcgccgccggccgcaaaagtctgaccttaaacctgattaccgagatgggacgactgcccacgttcatgacacagaaggcacgcaacgccctggacaaccttgccgtcctgcacaccgccgaggccggaggacgcgcgtacaatcatgccctaagcgagttaccagagaccctagaaacgctgctcctgctaaccttgctggcaaccgtgaccgggggcattttcctgttcctgatgtccggcaaggggattggcaagatgaccctgggcatgtgctgcattattacggccagcatactgctctggtacgcccagatccagccgcactggatcgcggccagcatcatcctggagttcttcctgatcgtcctcctgatccccgagcccgagaagcagcgcacgccacaggacaaccagctgacctacgtggtgatcgcgatccttaccgtcgtggcggccactatggcgaacgaaatgggcttcctggagaagaccaagaaggacctggggctgggctccatcaccacccaggagagcgagtcaaatatcttagacatcgacctgaggccagcgagcgcctggaccttgtacgccgtggcaaccacctttgttacgcccatgctcagacattccattgagaacagctctgtgaacgttagcctcacggcgatcgccaaccaggccaccgtcttgatgggcctggggaagggctggcccctgtccaagatggatatcggggtgcccctcctggccatcggctgctacagccaagtgaaccctatcaccctgaccgcggcccttctgctactcgtcgcccattacgccatcatcggaccaggcttgcaggcaaaagcgacgagagaggcccagaagcgcgccgccgcgggcatcatgaagaaccccaccgtggacgggatcaccgtgatagacttagagcccatcccgtacgacccaaagttcgagaagcagttaggccaggtgatgctcctgatcctctgcgtgacccaggttttgatgatgcggacgacatgggcgctgtgcgaggccctcacactggccactgggcccatctcaacgctgtgggagggcaaccctgggcgcttctggaacacaaccatcgccgttagcatggccaacatcttcaggggctcctacttagcgggcgccgggcttctcttcagcatcatgaagaacaccacgtccaccagacgcggcaccgggaacatcggcgagacactcggcgagaagtggaaatcccggctgaacgcgctggggaagtccgagtttcaaatatacaagaagtccggcatccaggaggtggacaggacgctagccaaggagggaatcaagaggggcgagaccgaccaccacgcggtgtcccgcgggagtgccaagctgcgctggttcgtcgaacgtaacatggtaaccccggagggcaaggttgttgacttaggctgcgggcggggtgggtggtcgtactactgcggcgggctaaagaacgtgcgcgaggtgaagggcctgacaaagggcggccccggtcacgaggagcccatccctatgagcacttacgggtggaacctggtccggctccaaagcggcgttgacgtgttcttcacccctcccgagaagtgcgacacgctgctgtgcgatatcggggagtccagccccaaccctaccatcgaagccggccgcacgctccgggtgctgaacttggtggagaactggctgaacaacaatacgcagttctgcatcaaggtgctgaacccctatatgccctccgtcatcgagaagatggaggctctgcagcgccagtacggtggggccctcgtgcggaaccccctcagccgaaactccacgcacgagatgtactgggtgagcaacgcgaccggcaacatcgtctccagtgtgaacatgatctcccggatgctgatcaaccgcttcactatgaaacacaagaaagcaacatacgagccggatgtagacctggggagcggcacccggaacatagggatcgaatcagaaatccccaacctcgacatcataggtaagcgcatagagaagatcaagcaggagcacgagatcagctggcactacgaccaggaccatccctacaagacctgggcctaccacggctcctacgagacgaaacagacggggagcgcctccagcatggtcaacggcgtggtgcggctgttaaccaagccctgggacgttgttccgatggtgacccagatggccatgacggatacgacccccttcgggcagcagcgcgtttttaaggagaaggtggacacccgcacccaagagcccaaggagggcacgaagaagctcatgaagataaccgcggagtggctgtggaaggagctgggcagaaagaagacgccccgcatgtgcacccgggaggagtttacgcgcaaggtgcggtccaacgccgccctcggggccatctttaccgacgagaacaagtggaagtccgctcgcgaggcggtagaggacggccggttctgggaactggtggatagggagcggaacctgcatttggaggggaagtgcgagacgtgcgtgtacaacatgatgggcaagcgcgagaagaaattgggggagttcggtaaagccaagggatcccgggccatctggtatatgtggctgggggcccgcttcctcgagttcgaggcgctgggcttcctcaatgaggaccactggttcagcagagagaatagcctatccggcgtcgagggcgaggggctccaccgcctgggctacatccttcgggacgtgggcaagaaggagggcggcgccatgtacgccgatgacaccgccgggtgggacacgcgcatcaccctagaggatctgaagaacgaggagatggtcacaaaccacatgaagggggaacacaagaagctcgccgaggcgatttttaaactgacctaccagaacaaggtggtgcgggtccagcgtccgacgccccgggggacagtgatggacattatcagccgccgggaccagcgcggctccggccaagtgggaacatacggcctgaacacattcacgaacatggaagcccagctaatccgccaaatggaaggggagggcatcttcaagagcatccagcatctgacggccaccgaggaaatcgccgtccagaactggctggcgagggtgggccgcgagcggttatcccgcatggcgatctcaggggatgactgcgtggtcaaacccatcgacgaccggttcgcctccgccttaaccgccttgaatgacatgggcaaggtgcgcaaggacattcagcagtgggagcccagcagagggtggaacgactggacccaggttccgttctgctcccaccacttccacgagctcgtcatgaaggacggccgcgtgctggtggtcccctgccggaaccaggacgagctgatcgggagggcccggatttcgcagggcgcgggctggtccctcaaggagaccgcatgcctaggcaagagctatgcccaaatgtggactctcatgtactttcaccgccgggacctccgcttggccgccaacgcaatctgctccgccgtgcccagccactgggtgcccacctcccggaccacgtggtatatccacgccaagcatgagtggatgaccaccgaggacatgctggccgtatggaaccgcgtgtggatccaagagaacccgtggatggaggacaagacccccgtggagagctgggaagaggtcccctacctcggcaagcgggaagaccagtggtgtgggagcctgatcggcctcacgagccgcgcgacctgggccaagaacatccaaaccgccatcaaccaggtgcggtccctgatcggcaacgaggagtacaccgactacatgccctccatgaagcgcttccgccgggaggaggaggaagccggcgtgctgtggtga

SEQ ID NO: 25067 - RNA, 9873 nt, synthetic construct
  misc_feature 1..9873: note = derived and/or modified CDS sequence (opt11) from DENV-2__HQ705624__SS-prME
  source 1..9873: mol_type = other RNA
accgcgggtgtgatcgtaatgctaatacccacagcaatggcgtttcatctcaccaccagaaacggggagccacacatgatcgtgggccggcaggaaaaggggaagtccctcttattcaagaccgaagatggcgtgaatatgtgcaccttgatggctatcgacctgggcgagttatgcgaggacaccattacctacaagtgccccctcctgcgccagaacgagccagaagacatcgattgctggtgcaacagcactagcacctgggtaacatacgggacttgtaccacgacaggggagcacagacgcgaaaagcggtccgtggccctagtcccccacgtcgggatgggcctcgagacacgcactgagacctggatgagcagcgagggggcctggaagcacgtgcagcggatagagacctggatcctacgccacccaggcttcactatcatggccgctatcttagcctacacaatcgggacaacgcacttccaacgggcactaatattcatcctgcttaccgccgtagcgcccagtatgactatgcgctgcatcggcatctcaaaccgggactttgtggagggcgtatctgggggcagttgggtggatattgtcctcgagcacgggtcttgcgtaaccacgatggcaaagaataagcccacgctggacttcgagcttatcaagaccgaggcgaagcagcccgccaccttaaggaagtactgtatcgaggcaaagctgacgaataccacgaccgaatcccggtgcccgacgcagggcgagccctccctaaacgaagagcaggacaagcgcttcatctgcaagcactccatggtggacagggggtgggggaacggctgcgggctcttcggcaagggtggcatcgtgacgtgcgcgaagttcacgtgcaagaagaacatggaaggcaaggtggtgcagcccgagaacctggagtacaccatcgtgatcacgccccacagcggggaagagcacgccgtgggcaacgacaccggtaagcacggcaaggagatcaaaatcaccccacagtccagcatcaccgaagccgagctgacaggctacggcaccgtgaccatggagtgttctccccgcaccggcctggacttcaacgagatggtcttactgcagatggaggacaaagcctggctcgtgcaccggcaatggttcctcgacctgcccctcccctggctgcctggggcagacacccaaggctctaattggatacagaaggagacactggtgaccttcaagaacccccacgcgaagaagcaggacgtcgtggtcctcggcagccaggagggcgcaatgcacactgccctgaccggggcaacggagatccaaatgagcagcggcaacctactgttcacgggccacctgaaatgcaggcttcggatggacaagcttcagctgaaaggtatgtcctatagcatgtgcactggaaagtttaagatcgtgaaggagatcgccgagacccaacatgggaccatcgtgatccgcgtccagtacgagggcgatgggtccccctgcaaggtgccattcgagatcactgacctggagaagcggcacgtgctcgggcgactcatcaccgtgaacccgatcgtgaccgagaaggacagccccgtgaacatcgaggcggagccgccattcggcgactcgtacatcatcatcggcgtcgaaccgggccagctgaagctcaactggttcaagaagggtagctccataggccaaatgttcgagacgacgatgcgcggcgccaagagaatggccatcctgggggacacggcgtgggacttcggcagcttggggggtgtgttcacctccataggtaaggccctgcaccaggtgttcggcgcaatctacggcgccgccttcagcggggtctcctggacgatgaagatcttaattggcgttatcatcacctggattgggatgaacagtcggtccaccagcttgtccgtgagtctggtcctggtgggcgtggtcaccctgtacctcggggcaatggtccaagcggacagtggctgcgtggtcagctggaagaacaaggagctcaagtgtggatccgggatcttcatcacggataacgtgcacacctggacggagcagtacaagtttcagcccgagagccccagcaagctggcctccgccatcaagaaggcccacgaggagggcatctgtgggatacggagcgtgacccgactcgaaaaccttatgtggaaacagattacgcccgagctgaaccacatcctgtccgagaacgaagtcaaactcaccatcatgaccggcgacatccgaggaatcatgcaggccggcaagcgcagcctgcgaccgcagcccacagaacttaagtactcctggaagacctggggcaaggcgaagatgctctccaccgagtcgcacaatcaaaccttcctgatcgacggtccggagaccgccgagtgcccgaacacaaacagggcctggaacagcctggaggtggaagactacggcttcggggtcttcaccaccaacatctggctcaaactacgagacaagcaggatgtcttctgcgactcaaagctgatgagcgccgccataaaagacaaccgcgcggtgcacgcagatatgggctactggattgagtccgctttgaatgacacatggaagatggagaaggccagcttcatcgaggtgaagtcctgccattggcccaagagccacaccctgtggtcgaatggcgtcctagagtcggagatgatcattcccaagaattttgccgggcccgtgtcccaacacaactaccggccgggctaccacacacagaccgcgggaccgtggcatctcggcaaactggagatggactttgacctgtgcgaaggcaccaccgtggtcgtaacggaggactgcggaaacaggggccccagcctccgaacaaccactgcctccggtaagctgatcacggagtggtgctgccggtcctgtaccctgcccccgctccggtaccgcggtgaagacgggtgctggtacgggatggagattcggccgctgaaggagaaagaggaaaacttagtgaacagcctcgtcaccgcggggcacggccagattgacaacttctccctgggcgtgctgggtatggccctcctgctcgaagagatgctccgcacccggatcggcactaagcacgccatcctgctggtggccgtctcattcgttaccctgataaccggaaatatgtcctttcgcgacctgggacgggtgatggtcatggtaggggccaccatgacggatgacatcggcatgggggtaacctacctggccctcctagccgccttcaaggtccggcccaccttcgcggctgggctgctccttcgcaagctgacgagtaaggagttaatgatggccacgatcggcatcgccctgctgtcccagagcaccatcccagagaccatcctcgagctcaccgacgcgctcgcgctcgggatgatggtgctgaagatcgtgcggaacatggagaagtaccagctggcggtcacggtgatggcgatctcctgcgtgcccaacgcagtaattttgcagaacgcctggaaggtgagctgcacaattctggccgccgtctccgtgagccctctgcttctgacctccagccagcagaaggcagactggatccccctggcgctcaccatcaaaggcctaaaccccacggccatcttccttacgaccctcagtagaacgagcaagaagcggtcctggccactgaatgaggccatcatggcagttggtatggttagcatccttgcctccagcctcctgaagaacgacatccccatgacgggccccctggtagccggcgggctcctgaccgtgtgctacgtgctgacgggccgcagcgccgacctcgagctggagcgggccgccgacgtgaagtgggaggatcaggccgaaatcagtgggtcgtcacctatcctgagcattaccatctctgaggacggcagcatgtccattaagaacgaggaagaggaacagacgctcaccatcctgatccgcacgggactgctcgtgatcagcggtgttttcccggtgtccatccccataaccgctgcggcctggtacctgtgggaggttaaaaagcagcgggccggcgtcctgtgggacgtgccttcaccccctccggtagagaaggccgaactcgaagacggggcctaccgaattaaacagcggggcatcctcgggtactcccagatcggcgccggcgtctacaaagagggcaccttccacacgatgtggcacgttacccgcggggccgttctgatgcacagggggaagcgtatagagccgagctgggccgatgtgaaaaaggacttaatctcatacggtggagggtggaagctggagggcgagtggaaagagggggaggaagtccaggtgctggccctcgagcccggcaagaacccccgggctgtccagaccaagcctggaatctttaagaccaacacgggcaccatcggcgccgtgtcgttagacttccccggcacctccggcagtcctatcgtggatcgcaaggggaaagtagtgggtctgtacgggaacggagtggtcacccggtccggggcctacgtgtccgccatcgcccagacggagaagagcatagaggacaaccccgagatcgaagacgatatcttccgcaagaagcgtctcaccatcatggacctgcaccccggagccgggaagaccaagcgctacctgccagccatcgtacgggaggctataaagcgtgggctgcggaccctcatcctggccccaacgcgggtcgtggcggccgaaatggaggaggcgctccgcggactccctatccggtaccagaccactgccatcaagaccgagcacacggggcgcgagattgtagacctgatgtgccacgcaaccttcaccatgcgtctgctcagccccgtcagggtgcccaactacaacctgatcattatggacgaggcgcactttaccgacccggccagcattgccgcccggggctacatatccacccgcgtggaaatgggggaggcggcggggatcttcatgaccgccacgccgcctggcagccgggaccccttcccgcagagcaacgcgcccatcatggacgaggagcgcgagatccccgagcggtcatggaactccgggcacgagtgggtcaccgacttcaagggcaagaccgtctggttcgtacctagcataaaggccgggaacgacatcgcggcatgcctacgaaagaacggcaagaaggtcatccaactatcccggaagacattcgacagcgagtacgtgaagacccgcgccaacgattgggacttcgtggtcaccacggacatcagcgagatgggcgctaacttcaaggccgagcgggtgatcgaccccaggcggtgcatgaagcccgtaattctgacggacggggaggagcgcgtcatcctggcggggcccatgcccgtgacccatagctccgcggcccagcgaagggggcggatcggccgtaaccccaagaatgaaaacgaccaatatatttatatgggggagcccctcgaaaacgatgaggactgcgcccactggaaagaggccaagatgctgctggacaacatcaataccccggagggaataataccgagcatgttcgagcctgagcgcgagaaagtggacgcgatcgacggggagtacaggttacgcggagaggcccggaagacttttgtcgacctgatgcgccggggggacctgcccgtgtggctagcgtataaggtagcggccgaggggatcaattacgcggaccggaagtggtgcttcgacggcatcaagaacaaccagatcttagaggagaacatggaggtcgagatctggactaaggagggcgagcggaagaagctgaagccccgctggttagatgcccggatttactccgacccgctggccctgaaggaattcaaggagtttgccgcaggccgcaagagcctcacgctgaacttaataaccgagatgggacgtctccccacgttcatgacccagaaggccaggaacgccctggacaacttggccgtactccacactgctgaggcgggaggccgagcctacaaccacgccctttccgagctgcccgagacactcgaaacgctgctgctcctgaccctcctggccactgtcacgggcggaattttccttttcctcatgagcggaaaggggatcggcaaaatgaccctcgggatgtgctgcatcattacggcaagtatcctactgtggtacgcccagatccagccacactggatcgccgccagcatcatcctcgagttcttcctgatcgtgctgctaataccagagcctgaaaagcagcgcacgccccaggataaccagctgacctacgtggtaatagccatactcaccgtcgtagctgcgaccatggccaacgaaatgggcttcctcgagaagaccaagaaagatctcggtctgggctccatcaccacccaggagagcgaaagcaacatcttagacatcgacctgcggcccgcctctgcctggaccctatacgccgtcgccaccactttcgtcaccccgatgctccgccatagcatagagaattctagcgtcaacgtctccctgacagccatcgctaaccaggcgaccgtgctcatgggcctcgggaagggatggccgcttagtaagatggacatcggtgtgcccctgctcgcgataggctgctactcccaagttaaccccataaccttgaccgccgccctgctcttgctggtggcccattacgcgatcatcggaccgggcctacaggcgaaggcgactcgggaagcccaaaagagggccgccgctggcatcatgaagaaccctactgttgacggcatcaccgtcatcgacctagagcctatcccctacgacccgaaattcgaaaagcaacttggacaggttatgctccttatcctgtgcgtgactcaggtcctaatgatgcgaacgacctgggccctgtgtgaagccctgactctcgccacggggcccatcagcacgttgtgggagggcaaccccggtcgcttctggaacacgaccattgcagtgtccatggctaacatcttccgcggcagctacctggccggagcaggcctcttattcagtattatgaaaaataccaccaatacccggagaggcaccgggaatataggcgagaccctaggcgagaagtggaagtcccggctcaacgcccttgggaaatccgagttccagatctacaagaagtccggaatacaggaggtggaccgcacgttggcgaaggaggggattaaaagaggcgagaccgaccatcacgcggtgagcagagggagcgccaagctccggtggtttgtggaacgcaacatggtaacccccgagggcaaggtcgtggacctggggtgcgggcggggcgggtggtcctattactgtggggggctgaagaatgttcgcgaggtcaaggggctcaccaagggtgggcccgggcatgaagagcccatccccatgagcacgtatggctggaacctggtgcggctgcagtccggggtggatgttttcttcacaccgcccgagaagtgtgataccctcctgtgcgacatcggggagagcagccccaacccaaccatcgaggccggccgcaccctgcgggtgctcaaccttgtggagaactggctgaacaacaacacgcagttctgcatcaaggtcctcaacccctacatgccctcggtgattgagaagatggaggccctgcagcgtaagtacggcggagcactggttcggaaccccctgagccgcaactccacccacgagatgtactgggtcagcaacgcaaccggcaacatcgtgagcagcgtaaatatgatctccagaatgctcatcaaccgatttaccatgaagcacaagaaggcaacgtacgagcccgacgtagacctggggagcggcacccggaacatcgggatcgagtccgagatcccaaatctcgacataatcggcaagcgcatcgaaaagatcaagcaggagcacgagaccagctggcactacgaccaggaccacccctacaagacctgggcataccacggctcctacgaaacgaagcagacagggtcggcatcaagtatggtgaatggcgtcgtccgcctcttaacaaaaccctgggacgtggtgcccatggtcacccagatggcaatgacggacaccacgccctttgggcagcaaagagtgttcaaggagaaggtggacactcgcacacaggagcccaaggagggcaccaagaagcttatgaagatcaccgcggagtggttatggaaggagttgggaaagaagaaaacgccccggatgtgcacgcgcgaggagttcacccgtaaggtcaggtccaacgcggccctcggtgccatattcaccgacgagaacaagtggaagtccgcgcgggaggccgtggaggacggccgtttctgggagcttgtggacagggaacgcaacctacacctggaggggaagtgcgagacctgcgtttacaatatgatgggcaagcgggagaagaaattaggggagtttggaaaggccaagggctcccgcgccatctggtacatgtggctcggggcgaggttcctcgagtttgaggccctcggctttctgaacgaggaccactggttcagccgggggaattccctaagcggtgtggagggtgaggggctacaccgtctggggtacatcctcagggatgttgggaagaaggaaggaggggccatgtacgccgacgacacggccggctgggacacccgcatcaccctcgaggacctgaagaacgaagagatggtcaccaaccacatgaagggtgagcacaagaagctggcggaggcaatcttcaagcttacgtaccagaacaaggtggtccgcgtgcagagacccaccccacgaggcaccgttatggacataatcagccggcgggaccagcgcggttcgggtcaggtcggaacctacgggttaaacacgtttaccaacatggaggcacagctgatccggcaaatggagggtgagggcatctttaagagcattcagcacttgaccgccaccgaagagatcgccgtccaaaactggctggcgcgcgtggggcgggagcgcctgtcgcggatggccatctcgggcgacgactgcgtggtgaagcccatcgatgaccgcttcgcgtccgcgttaacagccctgaatgacatgggtaaggtgaggaaggacattcagcagtgggagcccagccgcggatggaacgactggacgcaagtcccattctgctcccaccacttccatgagctcgtgatgaaggatgggcgggtgttagtcgtgccgtgccgcaaccaggacgagctgattggccgggctcgcatctcccagggcgccggatggtccttgaaggagacagcgtgcctgggtaagagctatgcccagatgtggaccctgatgtacttccaccggcgcgatctacggttagcagcgaacgctatttgctccgccgtgccctcacactgggtcccgacgtcccgcacgacctggagcatccacgcgaagcatgagtggatgaccaccgaagacatgctggcggtgtggaacagggtttggatccaggagaacccctggatggaggacaagacgccggtcgagtcctgggaggaggtgccgtacctggggaagcgcgaggaccagtggtgtggcagcctcattgggctgacctctcgggccacctgggccaagaacatccagaccgccatcaatcaggtgcgatccctgatcggcaacgaagagtacacggattacatgccaagcatgaagcgctttcggcgcgaggaagaggaggccggcgtcctctggtaa

SEQ ID NO: 25068 - RNA, 9876 nt, synthetic construct
  misc_feature 1..9876: note = derived and/or modified CDS sequence (opt11) from DENV-2__HQ705625__SS-prME
  source 1..9876: mol_type = other RNA
accgcgggcgtgatcgtcatgcttatccccaccgccatggctttccacctcaccacccggaacggagagcctcacatgatcgttggccgacaggagaagggcaagtcgctgctgttcaagaccgaggacggcgtgaacatgtgcaccttaatggccatcgaccttggggagctgtgcgaggacaccatcacctataagtgtcctctccttcgccagaacgagcccgaggacatcgattgctggtgcaacagcactagcacctgggtgacctatgggacatgcaccaccacgggcgaacaccggcgcgagaagcggtccgtggccctggtgccacacgttgggatggggctcgaaacccgcaccgagacttggatgagtagtgagggggcctggaaacacgtgcagcggatcgagacgtggattctgcgccacccgggcttcacaatcatggccgcgatccttgcctacacgatcggcaccacgcactttcagagagccctcatcttcatactgctgactgccgtggcgcctagcatgaccatgcgctgtatcggcatcagcaaccgggacttcgtggagggcgtgagcggggggtcatgggtggatatcgtcctagaacacgggagctgcgtgacgactatggctaagaacaaacccaccctggacttcgagttgatgaagaccgaggccaagcagcccgccacccttcgcaagtactgcatcgaggcaaagctgacgaacactaccaccgagtctcggtgccccacgcagggtgagcccagcctgaacgaggagcaggacaagcgcttcatctgcaagcactccatggtggaccgaggctggggaaacggctgcgggctgttcggcaagggcggaatcgtgacctgcgcgatgttcacgtgtaaaaagaacatggagggcaaggtggtgcaacctgagaacctggagtacaccatcgtgatcaccccccacagcggggaggagcacgccgtgggcaatgataccgggaagcacggcaaggaaattaagatcaccccacagtccagcatcaccgaggccgagcttaccggatacggcacggtcaccatggagtgcagcccacggactggactcgactttaacgagatggtcctgctccagatggaggacaaggcctggctcgtgcaccggcagtggtttctggacctgcccttgccctggctgccgggggccgacacccaggggagcaactggatccagaaggagaccctggtgaccttcaagaacccccacgcgaagaagcaggacgtggttgtcctcgggtcacaggagggggctatgcacacagctctaaccggcgccacggagatccaaatgtcatcaggcaacctcctgttcacgggccatctgaaatgccgcctgcggatggacaaactccagctgaaggggatgtcctacagcatgtgcaccggcaagttcaagatcgtgaaggaaatcgcagagacccagcatggaacgatcgtgatccgcgtacagtacgagggtgatggctccccatgcaagatccccttcgagatcactgatctggagaagcgacacgtgctcggacgcctgataaccgttaacccgatcgtgactgagaaggacagccccgtgaacatcgaggcggagccgcccttcggcgactcttacattatcattggggtggaaccgggccagctgaagctcaattggttcaagaagggcagctccatcggccagatgttcgagacgaccatgcgcggtgcgaagaggatggcgatcctgggagacacagcttgggactttggcagcctcgggggtgtcttcacctccatcgggaaagccctccaccaggtgttcggcgcgatctacggcgcagcgttcagcggggtgtcctggacgatgaaaatcctgattggcgtcatcattacctggatcgggatgaacagccgctccaccagtctgagtgtaagcctggtgcttgtcggcgtggtgactctctacctgggggccgtcgtgcaggcggactccggctgcgtggttagctggaagaacaaggagctcaagtgcggatccgggatctttatcacggataacgttcatacatggaccgaacagtacaaattccaaccggagtctccaagcaagctggccagtgccatccagaaggcccatgaggagggcatctgcgggatcaggagcgtgacccgcctggaaaacttgatgtggaagcaaatcacgcccgaactgaaccacatcctgtccgagaatgaggtcaagctcaccattatgaccggcgacatcaagggaatcatgcaggcgggcaaacggagcctgcgcccccagcccaccgaactgaagtattcatggaaaacgtggggcaaggctaagatgctcagcaccgaatcccacaaccaaaccttcctgatcgacgggccagagacagccgaatgcccgaacacaaaccgggcctggaactcactagaggtggaggactacggcttcggggtgttcaccaccaacatttggctcaagctgcgcgagaagcaggacgtattctgcgactccaagcttatgagcgccgccatcaaggacaatcgggcggtccacgccgacatgggctactggatcgagtccgccctcaatgatacgtggaagatggaaaaggcgagcttcatcgaggtgaagagttgccactggcccaagagccacaccctgtggtccaacggcgtcctggagagcgaaatgatcatccccaagaatttcgccgggccggtgtcccagcacaactaccgcccaggctaccacacgcaaactgcggggccctggcacctaggcaagctagagatggacttcgatttctgcgaggggaccacagtagtcgtgacggaggactgtggcaaccgcggtcccagccttcgaaccaccaccgccagcgggaagttgataactgagtggtgctgccggagttgcaccctgcccccgctgcgctaccgtggcgaggacggctgctggtacggcatggaaatccgccccctcaaggaaaaggaggagaacctggtgaacagcctagtcaccgctgggcacgggcagatcgacaacttctccctcggcgtgctgggaatggccctgttcctcgaggagatgctgcggacccgcattggcacaaagcacgctatcctgctagttgccgtcagcttcgtgactctgataaccgggaatatgtccttccgggacttgggccgcgtgatggtcatggtgggggccaccatgacagacgacatcggtatgggcgtgacctacctcgctctgcttgccgcatttaaggtcaggcccaccttcgccgccgggctactgctgcggaagcttaccagcaaggaactgatgatggccacgatcggaatcgcgcttctctcccaatctaccatccccgaaaccatcctggaactgacagatgcgctcgccctggggatgatggtgctgaaaatcgtgcgcaatatggaaaagtaccaactcgccgtcaccatcatggccatctcctgcgtgccgaacgccgtgatcctgcagaatgcgtggaaggtcagctgcaccatcctggccgccgtgtcagtaagccccctcctgctgacctccagccagcaaaaggccgactggatccccctcgcgcttaccatcaaaggcctgaatcccacggccatcttcctgaccaccctctctaggaccagcaagaagcgctcctggcccctgaacgaagcaatcatggccgtggggatggtgtcgatcctcgcgtccagcctgctgaagaacgacatacccatgacggggcccctcgtcgcgggcgggttactgaccgtgtgctacgtgctaaccggccggagcgccgaccttgagctggagcgcgccgccgacgtcaagtgggaggaccaggccgagatttcagggtcaagccccatactcagcataaccatatccgaagatggaagtatgagcatcaagaacgaggaggaggagcaaacgctgaccatcctgatccggaccggtctcctggtgatcagcggggtgttcccggtctccatccccatcaccgccgcggcctggtacctgtgggaggtcaagaaacagagagcgggcgtgctctgggacgtccccagcccgcctcccgtggagaaggccgagctggaggatggagcgtacaggatcaagcagcgcggcatcctgggctactcacagatcggcgctggcgtttacaaggagggcaccttccatacgatgtggcacgttacccgcggcgctgtcctcatgcaccgcggaaagcggattgagccctcctgggccgacgtgaagaaagacctgatcagctacggcggaggctggaagctggagggcgagtggaaggagggggaggaagtacaggtgctcgccctggagcccggcaagaacccccgcgcagtgcaaaccaagcccgggatcttcaagaccaacacgggcaccatcggggccgtcagtctggacttctccccaggcaccagtggctcccccatcgttgaccggaaggggaaagtggtcggcttgtacgggaatggcgtagttacacgcagcggggcctatgtctccgccatagcgcagacggagaagtccatcgaagacaaccccgagatagaggacgacatcttccggaagaagcgcctgaccatcatggacctgcaccccggggcaggtaagacaaaacggtacctccccgccatcgtgcgcgaggccatcaaacgggggctgcgcaccctgatactggccccgacgcgcgtagtcgccgctgagatggaagaggctctccggggcctgcccatccgctatcaaacgcctgccattaagaccgagcacactgggcgggagatcgtggacctgatgtgccacgccacgttcaccatgcgcctcttaagccccgttcgggtcccgaactacaacttaatcattatggacgaagcccacttcacagatcccgcctccatcgccgcacgcggctacatctctaccagagtggagatgggcgaggccgcggggatcttcatgacagccaccccgcccggctcgcgcgatccgtttcctcagtcaaacgcgcccatcatggacgaggagcgggagatccccgagcgctcctggaacagcgggcacgagtgggtgaccgattttaaaggcaagaccgtttggttcgtcccgagcatcaaggcgggcaacgacatcgcggcatgtctcagaaagaatggcaagaaggtgatacaactttcgcgcaagacgtttgattcggagtacgtgaagacccgggctaacgattgggacttcgtggtcaccaccgacatcagcgagatgggcgctaacttcaaggccgaacgcgtgatcgaccccaggcgctgcatgaagccggtgatccttaccgatggggaagagcgcgtgatcctcgcgggcccaatgccggtcacgcactcctcagccgcccagcgccgtgggcgcatcggcagaaaccccaagaacgagaacgaccagtacatctacatgggcgaacccctggagaacgacgaggattgcgcacactggaaggaggccaagatgctgctcgacaacataaacacgcccgagggcatcatcccctccatgttcgagcctgagcgggagaaggtggacgcaattgacggcgagtatcgcctccgcggggaggcccgcaagaccttcgtggatctaatgcggcgcggcgacctccctgtttggttagcttacaaagtggccgccgagggcatcaactacgcggaccggaagtggtgctttgacggcacgaagaacaatcagatcctggaagagaacatggaagtggagatctggaccaaggagggggagcgcaagaagctcaagccgcggtggctggacgcccgcatatacagcgaccccctagccctgaaggaattcaaggaattcgccgcgggccggaagagcttaaccctgaacctcatcaccgagatgggcaggctgcccacgttcatgacccagaaggcccggaatgccctggacaatctcgccgtcctgcacaccgccgaagccggcggtcgggcctataaccacgccctgagcgagctccccgagaccctggagacgctgcttctgctgacactgctggccaccgtaaccgggggtatctttctgttcctcatgtccggcaaagggatcggcaaaatgaccctagggatgtgctgtatcatcaccgccagtatcctgctctggtacgcacagatccagccgcactggatcgcggcctccataattctggagttcttcctgatcgtactcctgatacccgagcccgagaagcagcggacaccccaggacaatcagttaacatacgtggtgatagccatcctaaccgtcgttgccgcgacaatggccaatgagatgggctttctggagaagaccaagaaggacctcgggcttggcagcatcaccacccaggagagcgagtcaaacatcctggacattgacctgcgcccggctagcgcctggaccctctacgccgtggcgaccacctttgtcacccccatgctgcgtcactccattgagaacagcagcgtgaacgtgagcttgacggccatcgccaatcaggccaccgtcctcatgggcctggggaagggctggcccctgtcgaaaatggacatcggcgtacccctcctagcgatcgggtgctacagccaggtgaacccgataaccttaaccgccgccctccttctgctcgtcgcccactacgccatcatcgggccgggcctgcaggccaaagccactcgcgaggcccagaagcgggctgccgcgggtatcatgaagaaccccaccgtggatggcataactgtgatagacctggagccgatcccgtatgatcccaagtttgagaagcagctcggtcaggtgatgctgcttattctttgcgtgacccaggttctgatgatgaggaccacgtgggctctgtgcgaggccctcaccctggcaaccggccccatatccacgctgtgggagggcaaccccgggcggttctggaacaccaccatcgccgtcagcatggcaaatatctttcgcggctcatacttggccggcgccgggctgctgttcagcatcatgaaaaacaccacgtccacccgccggggcaccggcaacattggtgagacactcggggagaagtggaagtcccgcctgaacgccctggggaagtccgagttccagatctacaagaagtccggcatccaggaggtggaccggacgctggcgaaagagggtatcaagcgcggagagacggaccaccacgcggtgtcgcggggttccgccaagttacgctggttcgttgaacgaaacatggtgacccccgaggggaaggtggtcgatttggggtgcggtcgcggcgggtggtcctactactgcggcgggctcaaaaacgtgcgggaggttaagggcctgaccaaaggcgggcctggccacgaagagcccattcccatgagcacgtacgggtggaaccttgtcagactccagagcggagtggatgtgttctttaccccgcccgagaagtgcgacacgttgctgtgcgatatcggggagtctagccccaaccccacgatcgaagccggccggaccctccgagtcctaaacttagtagagaactggctcaacaataatacgcagttctgcatcaaggtgcttaacccgtacatgccctccgtcatcgagaagatggaggccctgcagcggcagtacggcggtgccctcgtgcgaaaccccctgagcagaaacagtacccacgagatgtactgggtgagcaacgccaccgggaacatcgtctccagcgtgaacatgatatcccgtatgctgatcaacaggttcaccatgaagcataaaaaggcgacgtatgagccggacgtggacttaggcagcggcacccgaaacatagggatagagtccgaaatccccaacctcgacatcatcggcaagcggatcgaaaagatcaagcaggagcacgaaataagctggcattatgaccaggaccacccttacaagacttgggcctaccacggttcctacgagaccaagcagacggggagcgcgtccagtatggtcaacggcgtggtgcgcctgcttacaaagccctgggacgtcgtgccaatggtgacccagatggcgatgaccgacacaacccccttcgggcagcagcgcgtcttcaaggagaaagtagacacccggacccaggaacccaaggagggcacgaaaaaactcatgaagatcaccgccgaatggctgtggaaggagctgggcaaaaagaaaacgccccgcatgtgtactcgtgaggagtttacgaagaaggtccgctcaaatgccgccctcggcgccatcttcaccgacgagaacaagtggaagagtgcgcgtgaggccgtcgaggacggtcgattctgggagttggtggaccgggagcgcaacctgcatctcgaggggaagtgcgagacctgcgtgtacaacatgatgggaaaaagagagaaaaagctgggggagttcggcaaggccaagggctcccgcgccatatggtacatgtggctgggagcgcggtttctcgagttcgaggcactaggcttcctgaacgaagatcactggttcagccgagggaatagcctctccggtgtcgagggggaggggctccatcggctgggatatatcttgcgagacgtgggcaagaaggagggcggggccatgtacgcagacgacaccgccggctgggacactcggatcaccctggaggacctgaagaacgaggagatggtcactaaccatatgaagggggagcacaagaaactcgcggaggcaatcttcaagctgacataccaaaacaaggtggtgcgcgtccagcggccgacgccccgggggaccgtgatggacatcatcagccggcgcgaccagcggggcagcggccaggtcgggacctacggactgaacaccttcacgaatatggaagcacaactcatccgccagatggagggcgagggtatcttcaagagcatccagcacctgaccgccaccgaggaaatcgccgtccagaactggctggcgagggtggggcgggagcgcctctcccggatggccatctcaggcgacgactgcgtggtaaagcccatcgacgaccgcttcgcgtccgccctgaccgccctgaacgacatggggaaggtgcggaaggacatccagcagtgggagcccagccgcgggtggaacgattggactcaggtgccgttctgctcccaccacttccacgagctcgtcatgaaggacgggcgggtgctggtggtcccctgcagaaaccaggacgaactgatcggccgggcgcgcatttcacagggcgccgggtggtcccttaaggaaaccgcctgcttagggaagagctacgcccagatgtggaccctgatgtacttccaccggcgggacctccgcctggccgctaacgccatctgctcggccgtgccgtcccattgggtgcccacctcaaggaccacttggagcatccacgcgaagcacgagtggatgaccaccgaggacatgctggccgtatggaatcgggtgtggatccaagagaacccatggatggaagacaaaacgcccgtggagtcctgggaggaggtcccttatctcggaaagcgggaggaccagtggtgcggcagcctgatcggcctgacgagccgggccacctgggcaaagaacatccagaccgcgatcaaccaggtgcgctccctcatcggcaacgaggagtacaccgactacatgcccagcatgaagcggttccgccgcgaggaggaggaggccggcgtcctgtggtga

SEQ ID NO: 25069 - RNA, 9876 nt, synthetic construct
  misc_feature 1..9876: note = derived and/or modified CDS sequence (opt11) from DENV-2__JF730052__SS-prME
  source 1..9876: mol_type = other RNA
accgcgggcgtgattgtcatgttaataccaaccgccatggcgttccacctcaccacgcgcaacggggagcctcacatgatcgtgggacgtcaggagaagggtaagtccctgctgttcaagaccgaggacggtgtcaatatgtgtacgctcatggccatcgacttgggggagctgtgtgaggatactataacctacaagtgtcctctcctgcgccagaatgaacccgaggatatcgactgctggtgcaacagcacctccacctgggtcacctatgggacctgcaccaccaccggggagcaccggcgtgagaagcggtccgtggccctggtcccccacgtggggatgggcctcgaaacccgcaccgagacctggatgtcctcagagggggcctggaagcacgtgcagcggatcgagacctggatcctgcgccatccgggcttcaccatcatggcggcgatcctggcctacaccatcggtacgacacactttcagcgggcgctgatcttcatcctgcttacggccgtggcgccctcgatgaccatgcgctgcattggcatcagcaatagagacttcgtcgagggagtgtccggtggcagctgggtggacatcgtactcgagcacgggagctgcgtgaccacgatggccaagaataagcccaccctggatttcgaactgatgaaaaccgaggcgaaacagcccgctactctccgcaagtactgcattgaggccaagctgacaaataccaccacagaatctcggtgtccgactcagggcgagccgtctctgaacgaggaacaggataaacgattcatctgcaagcacagcatggtggaccggggatgggggaatggatgtgggctgttcggcaagggcggaatagtaacctgcgccatgtttacctgcaagaagaacatggagggtaaggtggtgcagcccgaaaacctggaatacaccattgtcatcacgccacatagcggagaggagcacgccgtgggcaacgacaccgggaagcacggcaaggagataaagatcaccccgcagtccagcatcaccgaggccgagctgaccgggtacggaacggtgaccatggagtgctcgccccggaccggcctcgacttcaacgagatggtcctgctccagatggaagacaaggcctggctcgtgcaccggcagtggttcctggatctgccactcccctggctgccgggggccgacacgcagggcagcaactggatccagaaggagacgctggtcacgttcaagaatccccacgcgaagaagcaggacgtcgtggtcctagggagtcaggagggcgccatgcacaccgcgctgacaggggccacggagatccagatgagctctggtaacctcctgttcacagggcacctgaagtgccgcttaaggatggacaagctgcaactgaaggggatgtcctatagcatgtgcaccggcaagttcaagatagtgaaggagatcgccgaaactcagcacggtacgatcgtgatcagagtccaatacgagggcgacggctccccatgcaagatcccattcgagatcacggatctggagaaacggcacgtgctcggtagactgatcacagtgaaccctatcgtcacggagaaggacagccccgtaaacatcgaggcggagccgcctttcggcgactcctacatcatcatcggagtggagccgggacagcttaagctcaattggttcaagaaagggagctcaatcggccagatgttcgaaacgaccatgcgaggcgccaagcgcatggccatcctgggggacaccgcctgggacttcggcagcctcgggggtgtcttcacctccatagggaaggcgttacaccaggttttcggcgcgatctacggtgcagccttcagcggagtatcgtggacgatgaagatcctgatcggtgtcatcattacctggatcgggatgaacagtcgatccacctctttatccgtaagcctggtgctcgttggcgtggtaaccctgtatctgggcgcagtagtgcaggcggactccggctgcgtggtgagctggaagaataaggagctcaagtgcggctcggggatcttcataacggacaacgtccatacctggacggagcagtataagtttcaacccgagagccccagcaagctggcctcagccatccagaaagctcacgaggagggcatctgtgggatccgcagcgttacccgcctggagaacctaatgtggaaacagatcacgccggagctgaaccacatactgtccgagaacgaggtaaaactcaccatcatgactggtgatatcaaggggatcatgcaggcaggcaagcggagcctgcgcccgcagcccaccgaactgaagtactcatggaagacgtggggcaaggctaagatgctcagcaccgagtcccacaaccagacgttcctgatcgacgggcccgagaccgcagagtgcccgaacacgaaccgcgcatggaacagtttagaggtcgaggactacggattcggagtcttcaccaccaacatctggctgaaacttcgcgagaaacaagacgtcttctgcgactcaaagctaatgagcgcggccatcaaggacaaccgtgcagtgcacgccgacatgggctactggatcgagtccgccctcaacgacacttggaaaatggagaaggccagcttcatcgaggtgaagtcctgccactggcccaagagccataccctgtggtctaacggtgtcctggagagcgagatgatcattcccaagaactttgcagggcctgtctctcagcacaattaccgaccgggataccacacgcagaccgcggggccctggcatttgggcaagctggagatggacttcgacttctgcgaagggaccacagtggtcgttacggaggactgcgggaaccgcggcccctcactgcgcaccaccaccgcctcagggaagctcatcacagaatggtgttgccggtcctgtacccttcctccgctacgctatcggggcgaggacgggtgctggtacggcatggaaatccgccccctcaaggagaaggaggagaatctggtgaacagcctggtcaccgcggggcacgggcagatcgataatttctcgttgggagttcttgggatggccttgttcctagaagagatgctgagaacaaggataggcacgaaacacgcgattttgcttgtggcagtcagcttcgtgacccttaccactggaaacatgtccttccgcgatctaggccgcgtgatggtcatggtgggggccaccatgaccgatgacatcggtatgggtgtgacctacctagccctcctcgcagcgttcaaggtacgccccaccttcgccgcaggattgctgctcaggaaactcacaagtaaggagttaatgatggctaccatcggtatcgccctgctgtcccagagcaccatccccgagacaatcctggagctgacggacgcgctggccctggggatgatggtgctgaagatcgtgcggaacatggaaaagtatcagctcgccgttacaataatggcaatatcctgcgtaccaaacgcagtgatcctgcagaacgcgtggaaggtcagctgcaccatcctggccgccgtgtccgtgagcccactcttgctgaccagtagccagcagaaggcagactggatccccctcgcactgacgatcaagggcctgaatcccacggccatctttctaacgaccctgtcccggacgagcaagaagcgctcctggccgctgaacgaagccataatggctgtgggaatggtgagcatcctcgcgtctagcttgctcaagaacgacatcccaatgaccgggcccctagtcgcgggaggactgctgaccgtctgctatgtgcttaccggccggtccgctgacctagagctagagcgcgcggccgatgtcaagtgggaggaccaggcagagatttccgggagctcacctatactgagcattacgatctcggaagacggatccatgtccattaaaaacgaggaggaggagcagaccctgaccatcctgatacggaccggcctcttggtgatcagtggggtgttcccggtctccatccccatcaccgccgccgcctggtacctgtgggaggtgaaaaagcagagagctggggtactctgggacgtccccagccctcctccagtggaaaaggcggaactggaagatggggcttatcgcatcaagcagcgcggcatcctggggtacagccagatcggcgctggcgtgtacaaagagggaacctttcacaccatgtggcacgtgacccggggagctgttctcatgcaccgggggaagcggatcgagccttcttgggccgacgtgaagaaagacctaatttcctacggcgggggctggaagctggagggtgaatggaaggaaggcgaggaggtacaggtgctcgccctggaacccggtaagaacccccgggcggtgcagaccaagcccgggattttcaagacgaacacgggcaccatcggggctgtctccctagacttctcccccggtacaagcggctcccccattgtcgaccgaaaggggaaggttgtcggtctctacggcaatggcgtggtgacgcgtagcggcgcttacgtttccgccatcgcccagacagagaagtcgatcgaggataaccccgagatcgaggacgacatcttccggaaaaagaggctgaccatcatggacctgcatccaggggctgggaagaccaaacgttacctccccgccattgtgcgcgaagccattaaacggggcttgcgcacgcttatcctggccccgacgcgcgtggtcgcagccgagatggaggaggccctccggggcctgccaatcagataccagacccccgccattaagacggagcacacgggacgggagatcgtagacctaatgtgtcacgcgacctttaccatgcgcctccttagcccggtgcgcgtgcctaactacaacctgatcattatggatgaggcgcattttaccgaccccgcgtccatcgccgcccgcggctacatcagcacgcgggtggagatgggcgaggccgcgggcatcttcatgaccgccacgcctcccggctcccgcgacccgtttcctcaaagcaatgcccccatcatggatgaagagagagagattcccgagcgcagctggaacagcgggcatgagtgggtaaccgacttcaagggaaagacggtctggttcgtgccgagtatcaaggctgggaacgacatcgcggcctgcctccggaagaacggcaagaaagttatccagttgagccgcaagacgttcgactccgaatacgtcaagacccgagccaacgactgggacttcgtcgtgaccactgacatcagcgagatgggggccaattttaaggcagagcgcgtcatcgaccccagacgctgcatgaagccagtcatcctgaccgacggagaggaaagagtgatcttggcaggcccgatgccagtcactcactctagcgccgcccagcgccgcgggcgcattggccgcaaccccaagaacgagaacgaccagtacatttatatgggggaacccctggagaacgacgaggattgcgcccactggaaggaagcgaagatgctgctcgacaatatcaataccccggaggggatcatcccgtccatgttcgagcccgagcgggaaaaagtggacgcgatcgatggtgagtaccgactgagaggggaggccagaaagaccttcgtggatctgatgcggcgcggagacttacccgtttggctggcctacaaagtggccgccgaggggatcaactacgccgaccggaagtggtgctttgacggtacgaagaacaaccagatcctggaggaaaacatggaggtggaaatctggaccaaggagggcgagcgcaagaagctcaagccacggtggctggacgcccgtatctacagcgaccccctggccttgaaggagttcaaggaatttgcggcgggtcgtaagtccttaaccctgaacctcatcaccgaaatgggccgcttaccaacattcatgacccagaaggcccgaaacgccctggacaatctcgccgtactccacaccgccgaagccggagggcgcgcctacaaccacgcccttagcgagctcccagagacgctggaaacactgcttcttctgactcttctggccacggttactggaggcatttttctgtttctcatgtccgggaaggggatcggaaagatgactctagggatgtgttgcataatcaccgcgtccatcctactctggtacgcgcaaatccaaccgcactggatcgctgcctccatcatcttagagttcttcctaatcgtcctcctgatcccggagcccgagaaacagcggacccctcaagataaccaactgacgtatgtggtcatcgccatactcactgtcgtggccgcgaccatggccaacgagatgggcttcctggaaaagaccaagaaagacctgggactcggcagcatcacaacgcaggagagcgagtccaacatcctcgacatcgacctacgaccggccagcgcgtggaccctctacgccgtagcgaccaccttcgtgacgcccatgctccgtcactccattgaaaattcctccgtaaacgtgtccctgaccgccatagccaaccaggccacggtcctcatgggcctggggaaaggctggcctctgagcaaaatggacatcggtgtaccgctactcgcgattgggtgctacagccaggttaacccaatcactctcactgccgcattattacttctcgtcgcccactacgccataatcgggcccggcctgcaggcgaaggccaccagagaggcccaaaagcgggccgccgcgggcattatgaagaaccccaccgtggacgggatcacagtgatcgacctggagcccatcccgtacgaccccaagtttgaaaagcagctcggccaggtgatgctgctgatcctctgcgtgacacaggtcctgatgatgcgcaccacctgggcgctgtgtgaggccctcaccctggcgactggtcctatctccacgctgtgggagggcaaccccgggcggttctggaacacgacaatcgccgtatcaatggctaacatcttccgtggctcctacttagccggcgccggtctgctgttcagcattatgaagaacacgacctcgacccgccggggcaccggaaacataggggagacgttaggcgagaaatggaagtcccgcctgaacgccctggggaagtccgagttccaaatttataaaaagagcgggatccaggaggtggatcggacccttgcaaaggaggggatcaagcgcggcgagacagaccaccacgccgtgtccagggggagcgcgaagttaagatggttcgtcgaacggaatatggttaccccagagggcaaggtggtggatctgggttgcggccgcggcgggtggtcctactactgcggcgggctcaagaacgtgcgggaggtgaagggcctgacaaagggcggtccaggccacgaggaacccataccgatgagcacctacgggtggaatctggtccggctccagagcggcgttgacgtctttttcaccccgcccgagaaatgcgacacactgttatgcgacatcggggaatccagtcctaaccccactatcgaagccggccggacactccgtgtcctgaacctggtggaaaactggctaaataataatacccagttctgcataaaggtgctgaacccgtacatgccatccgtcatcgagaagatggaggccctgcagcgacaatacggcggtgcgctcgttcgcaacccactgagcagaaattcgacacatgagatgtactgggtgagcaacgcgactggcaatatcgtctcgagcgttaacatgatctctcgcatgctcatcaacagattcactatgaagcacaagaaggccacctatgagccggatgtggacctgggttctgggactcgcaacatcgggatcgagtccgaaatccccaacttggacatcatcggcaaacggatagagaagattaagcaggagcacgagattagctggcactatgaccaggaccacccctataagacctgggcctaccacggctcgtacgagacgaagcaaacgggttcagcctcgagcatggtcaacggcgttgtgcgcctgctgactaaaccctgggacgtcgtgccgatggtgacgcagatggcgatgacggacaccaccccatttggacagcagagagtctttaaggagaaggtggacacccgcacacaggagcccaaggagggcaccaagaaattaatgaagatcaccgccgaatggctctggaaagaattgggcaagaagaagacgcccaggatgtgcacgcgagaggagttcactaagaaggtccgctccaacgccgcccttggggctatctttaccgacgaaaacaagtggaagtccgcgcgggaggctgtcgaggatggccgcttctgggagctggtagatcgggagcgcaacctgcacttagagggtaagtgtgagacctgcgtgtacaatatgatgggcaagcgggagaagaagctgggggagtttggtaaggccaagggcagccgcgcaatctggtatatgtggctgggggcgcggttcctcgagttcgaggcgctgggcttcttgaacgaagaccactggttcagtcgcgggaactcgttgagtggagtcgagggggagggcctgcatcggctgggctatatcttacgcgacgtcgggaaaaaggaaggcggggccatgtatgccgacgacacggctggctgggacacccggatcaccttagaggacctgaagaacgaggaaatggtcaccaatcacatgaagggggagcacaagaagctcgcggaggccatctttaagctgacgtaccagaacaaagtggttcgcgtccagcggccgacgccccgtggaaccgtgatggacatcatctctcggcgcgaccagcgaggctccggccaggtgggaacatacggactaaacacctttaccaacatggaggcccagttaattcggcagatggagggcgagggcatcttcaagtctatacagcacctgaccgcaaccgaagagatagccgtccagaattggctcgcaagggtggggcgggagcgattgtcccggatggccatctcgggcgacgactgcgtggtcaaacccatcgacgaccgcttcgcatccgctttgacggccctgaatgacatgggtaaggtgcggaaggatatccagcagtgggagccctctcggggatggaatgactggacccaggtcccattctgctcgcatcacttccacgagctagtcatgaaggacggacgggtgttagtagtgccttgccgcaatcaagacgagcttatcgggagagcgcgcatctcccagggtgccgggtggagcctgaaggagaccgcctgcctgggcaagagctacgcccagatgtggaccctgatgtactttcaccgccgcgacctccggctagccgcaaacgccatctgctccgcggtacccagccactgggtgcctaccagccgcacgacctggtccatccacgcgaagcacgagtggatgaccacggaggacatgctagcggtctggaaccgtgtgtggattcaggagaacccgtggatggaggacaaaacgcccgtcgagtcctgggaggaggtaccctatttagggaagagagaagaccaatggtgcggcagcctgatcgggctgacctcccgggcaacctgggcaaagaacatccaaaccgccatcaaccaggtacgctccctcatcgggaacgaggagtacacggactacatgcctagcatgaagcggtttcgcagggaggaggaagaggccggcgtgctgtggtga

SEQ ID NO: 25070 - RNA, 9876 nt, synthetic construct
  misc_feature 1..9876: note = derived and/or modified CDS sequence (opt11) from DENV-2__EU482748__SS-prME
  source 1..9876: mol_type = other RNA
accgccggcgtaattgtcatgctgataccgaccgccatggcgttccacctcaccacccgcaacggggagccgcatatgatcgtcggccggcaggagaaggggaagtccctgcttttcaaaaccgaggacggggttaatatgtgcaccctcatggcgatcgacctgggggagctgtgcgaggagacgatcacctacaagtgtccactcttgcgccaaaacgagcccgaagacatagactgctggtgcaattctactagcacctgggtcacctacggaacctgcacgaccacgggagaacaccggagagagaaacggtcagtagccctcgtcccccacgtcgggatgggcctcgagacacgcaccgagacctggatgagctctgagggggcgtggaaacacgttcaacgaatcgagacctggatcctccgtcaccctggtttcacaatcatggccgcgatcttagcctataccattgggaccacgcacttccagcgggcccttatcttcatccttctgaccgccgtggcaccgagcatgaccatgcgctgcataggtatatccaacagggactttgtcgagggcgtgagcgggggtagctgggtggacatcgtgctcgagcatgggagctgcgtgaccacgatggccaagaacaaacccaccctggactttgaactgatcaagacggaggccaagcagcccgccactttacgtaagtactgcatcgaggcaaaactgacgaacaccaccaccgagtcgcgctgcccgacgcagggcgagccctcacttaatgaggaacaggacaagcgcttcatttgcaaacactctatggtggaccggggctgggggaacggctgcggtctgttcggcaaggggggcatcgtgacctgcgcgatgttcacgtgtaagaagaatatggagggtaaggttgtgcagcccgagaacctggagtacacgattgtcatcacaccccacagcggggaggagcacgccgtcggcaacgacaccgggaagcacggcaaggagatcaagatcactccgcagtcctccatcacagaggccgagctgaccgggtacggtacggtcaccatggagtgcagcccccgtaccggcctggactttaacgagatggtgctcctgcaaatggaagataaggcatggctcgtgcatcggcagtggttcctggacctgcccctcccctggctgccgggggccgacacccagggcagcaactggatccagaaagagacgctggtgaccttcaagaacccccatgccaagaagcaggatgtcgttgtcctcgggtcccaggagggcgccatgcacacagcactaaccggggctacggagatccaaatgagcagcggcaacctcctgtttacaggccatctgaagtgtcgccttaggatggacaagctccagctcaaggggatgagttactcaatgtgcaccggcaagttcaagatcgtgaaggagatcgctgagacccagcacggaactatcgtcatccgcgtccagtacgaaggggacggctccccatgcaagatccccttcgagatcaccgatcttgagaagcggcacgtgctagggcgactgatcactgtgaacccgatcgtgactgaaaaagacagcccggtgaacatcgaggcggagccgcccttcggagactcctacatcattatcggggttgagccaggccagctgaagctcaactggttcaagaaagggtcttctatcggccagatgttcgagacgaccatgcgcggcgccaagcggatggccatcctgggggacactgcttgggactttggcagccttggtggggtcttcacctccatcgggaaggccctccatcaagtcttcggcgcgatctatggcgccgccttcagcggagtgtcctggacgatgaagatcctgatcggcgttatcatcacttggatcgggatgaactcacgatccacaagcttgtccgtgagcctggtgctcgtcggggtggtcaccttgtatctgggggccatggtccaggcggattccggctgtgtggtgtcttggaaaaataaggagctaaagtgcgggtccgggatcttcatcaccgacaacgttcacacctggacagagcagtacaagttccaaccggaaagcccaagcaagctagcctccgctatacaaaaggcccacgaggaggggatctgcggaatccggagcgtgaccaggctagagaacctcatgtggaagcagatcacgcctgagctgaaccacattttatccgagaacgaagtgaagctcactataatgaccggcgacataaagggtatcatgcaggccggcaagcggtccctacgcccgcagcccaccgagctgaagtactcctggaagacgtgggggaaagcgaagatgttatcaacggagtcccacaaccagacgttcctgatcgatgggcccgagaccgccgagtgcccgaacacgaatcgagcatggaacagcttagaggtagaggactatggtttcggggtgttcacgaccaacatctggctcaagctgagagagaagcaggacgtgttctgcgactccaagctgatgagcgccgccataaaggacaaccgggcggtacatgccgacatgggctactggatcgaatccgccctcaatgacacctggaagatggaaaaggcaagctttatcgaggtgaagtcctgtcattggccaaagagccacacactgtggagcaacggggtactcgagagtgagatgataatccccaagaactttgccgggccagtctcccagcacaactaccgcccgggctaccatacgcagactgcggggccctggcacctcggcaaactggaaatggacttcgatctgtgcgaggggaccaccgtggtggtgactgaggactgcggcaaccggggcccgagcttgcgcacgaccaccgcttctgggaaactgattaccgagtggtgctgcaggtcatgcacactgccccccctccgctaccggggggaggacgggtgttggtacggaatggaaatccgccctctgaaggagaaggaggagaaccttgtgaacagcctagttaccgctgggcatggtcagatcgacaacttctccctgggcgtcttggggatggcgctcttcttggaagagatgctgcggacgcgcataggcacgaaacacgcaatcctcctcgtggccgtaagcttcgtcaccttgattactgggaacatgtccttcagggacctcggccgcgtcatggtgatggtcggcgccaccatgacggacgatatcggcatgggtgtcacataccttgctctgttagcggcgtttaaagtgcgccccaccttcgccgcagggcttctgctccggaagttaaccagcaaggagctgatgatggccacgatcggtattgcgctcctgtcacagagcaccatccctgagacaatcttagagctcaccgatgccctggccttagggatgatggtcctcaagatcgtgagaaatatggaaaagtaccagctggccgtaacaatcatggcaatctcctgcgtcccgaacgctgtgatcctgcaaaatgcatggaaggtcagctgtacaatcctcgccgccgtgtccgtttcaccactgttgctcacctccagccagcagaaggcggactggatccccctcgctctgaccattaagggtctaaaccccacggccatcttcctaaccactctgagccgaaccagcaaaaagcgctcctggcctctcaacgaggcgatcatggccgtcggcatggtgagcatcctggcttctagcctgcttaagaatgatatacctatgacagggcccctggtggcgggcgggctgctcacagtctgctacgttctcacaggacggagtgcggacctggagctcgagcgcgccgccgatgtgaagtgggaggaccaggccgagatatccggttcttcccctatattaagcatcaccatctccgaagatggcagcatgagtataaagaacgaggaggaggagcaaacgctgaccatcctcatccggaccggcctgctggtcatcagcggggtgttcccggtgtccatacccatcaccgcggcagcctggtacctctgggaggtcaaaaaacaaagagccggcgtgctgtgggacgtacctagccccccgcctgtggagaaggccgaactggaagatggggcgtaccgaatcaagcagcgcggcatcctcgggtactcgcagatcggcgcaggggtgtacaaggaggggaccttccacacgatgtggcacgtgactcggggcgccgtcctgatgcaccgcgggaagcggatcgaacctagctgggccgacgtgaagaaggacctcatctcctacggagggggctggaagttggagggcgagtggaaggagggagaagaggttcaagtcctggccctggagcccggcaagaatccacgtgcggtacagaccaagcccgggatcttcaagacaaacacaggtactatcggggccgtgagcctcgatttctcacctggaaccagcggtagtccgatcgtggatcggaaagggaaagtggtaggcctgtacgggaacggcgtcgtgacccgctctggcgcatacgtctccgccatcgcgcagacggaaaagtccatcgaagacaatcctgagattgaagacgacatcttccggaagaagcgcctgaccatcatggacctccaccccggggccggcaagaccaagagatacttaccggcaatcgtccgcgaagctataaagcgggggctccgcaccctaatcctcgccccgacgcgcgtggtggcggccgagatggaggaggccctgagaggccttcccatccgttaccagacccccgctataaagacggaacacaccggacgggagatcgtcgacctcatgtgccacgccacgttcaccatgcggttactgagccccgtgcgggtgccgaactacaacctcatcatcatggatgaggcgcacttcaccgaccccgcctccatcgccgcccgcggctacatcagcacccgggtcgagatgggcgaggcagcggggatcttcatgacggccacgccgcccggctcacgcgacccattcccccaaagcaatgctcccatcatggacgaggagcgggagatccccgagcgctcctggaactcaggtcacgaatgggttacagactttaagggcaagaccgtctggtttgtcccgtccatcaaagctgggaatgacatcgcagcctgcctgcggaaaaacggcaagaaggtgatccagctgtcgcgtaagacgttcgactccgagtatgtaaagaccagggctaacgactgggacttcgtcgtgaccaccgacatcagcgagatgggcgccaacttcaaggccgagcgcgtgatagacccccgacgctgcatgaaacccgtaatccttacagacggggaggagcgagtcatcctggcgggccccatgcctgtgacccactccagcgccgcccagagacggggtcgcatcggccgcaaccccaagaacgaaaatgaccagtacatctacatgggggaaccactggagaacgacgaggactgcgcccactggaaagaggctaagatgctcctggacaacataaataccccagagggcatcatcccgtccatgttcgagcccgagcgggagaaggtcgatgccatcgacggtgaatacagactgcgcggtgaggcccgtaaaaccttcgtcgacctcatgcggcgcggggacttgcccgtgtggctcgcctacaaggtcgccgccgagggaatcaactatgcggaccgaaagtggtgcttcgatggaataaagaacaaccagatcctcgaggagaacatggaggtggaaatctggacgaaggagggggagaggaagaagctgaagccgcggtggcttgacgctcgcatctacagtgacccccttgctctgaaggagttcaaggagtttgcggcgggacggaagagtctgacgttgaatctgataaccgagatgggcagacttccgaccttcatgacgcagaaggcccggaacgccctcgacaacttggctgtcctgcacaccgccgaggccgggggtcgcgcctacaaccacgctctcagcgaactgcccgaaaccctagagacgcttctgttgctcacgctgctggccacagttaccggcggcatcttcctgttcctaatgtctggaaagggaatcgggaaaatgacattgggaatgtgctgcattatcaccgccagcatcctcctttggtacgcgcagatccagccgcattggatcgccgcctccataatcctggagttctttctcatcgtactgctgatacctgaacccgagaagcaacggacgccccaggacaatcagctaacctatgtagtaatcgccatcctgaccgtggtcgcagcgactatggccaatgagatgggtttcctcgaaaagacgaagaaagacttgggactgggcagcatcactacccaagagtcggaaagcaacattctggacatcgacttgcgcccggccagcgcgtggaccctgtatgcagtagcgacgaccttcgtgacccctatgctgaggcactctattgagaacagctcagtgaacgtgagcctgactgcaatcgccaaccaggccacggtgctgatgggcctggggaaaggctggcccctcagcaagatggacatcggggtccccctgctggcgatcggttgctacagtcaggtgaacccgatcaccctcactgccgccctgctactattagtggcccactacgccatcatcggtccaggcctgcaggctaaggccacccgagaagctcagaagagggccgccgcgggcatcatgaagaacccgacggtagacgggatcaccgtgattgatctcgagcctatcccgtacgatcccaagttcgagaagcagctgggtcaggtgatgctcctcatcctgtgtgtcacccaggtgctgatgatgcggaccacgtgggccctttgcgaggccttaacactggccaccgggcccatctccaccctctgggagggcaaccccggtcggttttggaacacgaccatcgccgtgagcatggcgaacatctttcgaggctcctacctggccggcgccgggctcctgtttagcatcatgaagaacaccacctccacgcgccgggggaccgggaacatcggggagaccctgggcgagaagtggaagtccagactaaacgccttagggaagtccgagttccaaatctataagaagtctggcatccaagaggtagaccgtaccctggcgaaagaagggatcaagcgcggcgagacggaccaccacgccgtctcgagagggtcggccaagctgcgctggttcgtggagagaaacatggtcacaccggagggcaaggtggtcgacctcgggtgcgggcgcggcgggtggtcatactactgcggcgggcttaagaacgttcgggaggtaaagggcctgaccaaaggcggtccaggccacgaagagcctattcccatgtctacgtacgggtggaacctcgtgcgcctgcaaagcggtgtcgatgtgtttttcacgccgcccgagaagtgcgacaccctgctttgtgacataggggagtccagccccaacccgaccatcgaggccggccgtaccctgcgcgtgctgaacctcgtcgaaaactggctaaataacaacacccagttctgtatcaaagtgctaaacccatacatgccttccgtgattgagaaaatggaggccctccagcgaaaatacggtggggcgctagtacgcaaccctctgagccggaacagcactcacgagatgtactgggtgagcaatgccaccggcaacatcgtttccagcgtgaacatgatctcgcgcatgctgattaaccgcttcaccatgaagcataaaaagaccacgtatgagccggacgtggatctcgggagcggcacccgcaacatagggatagagagcgagatccccaacttggacatcatcggcaagcggatcgagaagatcaaacaggagcatgagaccagctggcactacgatcaggatcacccctacaagacctgggcctaccatggctcctacgagaccaaacagaccgggagcgcatcaagcatggtgaacggcgtcgtgcgcctgctcaccaagccctgggacgtagttccgatggtgacccagatggccatgacggacaccactcccttcgggcagcagcgcgtgttcaaggaaaaagtcgacacccggacgcaggagcccaaggaggggaccaagaagcttatgaagatcaccgctgagtggctctggaaagagctaggcaagaagaagactccccgcatgtgcacgcgggaggagttcacccgcaaggtgcggtccaacgccgccctgggggctatcttcaccgacgagaacaagtggaagtccgctcgcgaggcggtggaggacggacgtttctgggagctggtggaccgggagagaaacctccacctggaggggaagtgcgagacgtgcgtgtacaacatgatgggtaagcgagagaagaaactgggtgagttcggcaaggccaagggctcccgggccatatggtacatgtggctcggagctaggttcttagagttcgaggcgctaggcttcttgaacgaagatcactggtttagccggggtaatagcctgtccggggttgagggggagggactgcaccgcttaggctacatcctgcgggacgtcagcaaaaaggaaggaggcgccatgtacgctgacgacacagccggatgggatacccgcataaccctggaggacctcaagaacgaggagatggtgacaaaccatatgaagggcgaacacaagaagctggcggaggctatcttcaagcttacgtaccagaacaaggtcgttcgggtccagcgacctacgcctcgagggacggtcatggacatcatctcccgccgcgaccagaggggcagcggccaggtgggaacctacggcctcaacacgttcacgaatatggaggctcagctgatccggcagatggagggggaaggaatcttcaagtcaatccagcatctgaccgccaccgaggagatcgtggtccagaactggctcgcccgggtgggacgcgagcggttgtcgcgcatggccatctccggcgacgactgtgtggtgaagccgatagacgaccggttcgcaagcgccctgacggccctaaacgacatgggtaaggtgaggaaggacatccagcagtgggagccctccagggggtggaacgactggacgcaggtgccgttctgctcccaccactttcacgagctggttatgaaggacggccgcgtgctggtggtcccctgccggaaccaggacgagctcatcggtcgcgcaagaatctcgcagggtgccgggtggagcctgaaggaaaccgcctgcctggggaagtcctatgcccagatgtggaccctcatgtacttccacaggcgggacctgcgcctggctgccaacgccatctgcagcgcggtgcccagccactgggtgcccaccagccgcacgacctggagcatccacgccaagcacgagtggatgaccaccgaggatatgcttgcggtctggaatagagtttggatacaggagaacccctggatggaagacaagacgccggtggagtcgtgggaggaggttccctacctaggcaagcgggaggaccagtggtgcggcagcttgataggcctcacctcccgcgccacctgggcgaagaatatccagaccgctatcaaccaggtccggagcttaatcgggaacgaggagtacacggactacatgccgtccatgaagaggttccgccgggaagaggaggaggcaggcgtgctttggtga

SEQ ID NO: 25071 - RNA, 9876 nt, synthetic construct
  misc_feature 1..9876: note = derived and/or modified CDS sequence (opt11) from DENV-2__EU482749__SS-prME
  source 1..9876: mol_type = other RNA
accgcgggcgtgatcgtgatgctgatccccaccgctatggccttccatctaaccacccggaacggggagccgcacatgatcgttggtcggcaggagaaggggaagtccctgctgttcaagacggaggacggtgtgaacatgtgcaccttaatggccatcgaccttggggagctctgtgaggacactatcacttacaagtgtcccctcctacggcagaacgagcctgaagacatcgactgctggtgcaacagcaccagcacctgggtcacctacgggacctgcaccacaacgggagagcaccggcgcgagaaacggtccgtggcgctggtgcctcacgtcggcatgggcctcgagacccgaaccgagacatggatgagttccgagggggcctggaagcacgttcagaccatagagacgtggatccttcggcacccgggctttactatcatggcggcgatactggcctacaccatcgggacgacccactttcagcgcgcgctcattttcatcctgctgactgcagtagccccctcgatgacgatgcggtgtatcggaataagtaaccgcgacttcgtcgagggcgtgagcggtggctcttgggtggatatcgtactcgaacatggtagctgcgtgacgactatggccaagaacaaacccaccctagacttcgagctgattaaaaccgaggccaaacagcccgccacgctacgcaagtattgcatcgaagctaaactgacgaacaccaccacggagtcccgctgccctactcagggcgaacccagcctgtccgaggagcaggacaagcggttcatttgcaagcacagcatggtggacagaggctgggggaacggatgcgggctgttcggcaagggcgggatcgtcacgtgcgcgatgttcacgtgcaagaagaacatggaaggaaaagtggtgcagcccgagaacctcgaatacacaatcgtcatcacgccccactccggtgaggagcacgccgtgggcaacgataccggtaagcacggcaaagagataaagatcaccccccagtcgtccatcacagaagccgagctgaccggatacggcaccgtgaccatggagtgcagcccgcggaccggccttgacttcaacgaaatggtactgctgcaaatggaggataaggcctggctcgtgcaccgccagtggttcctggacctgcccctcccctggctgccgggtgccgacacacagggatccaactggatccagaaggagaccctggtcactttcaaaaacccccacgcgaagaagcaggacgttgtggtcctcgggagccaggagggggctatgcacaccgccctgacgggggccaccgagattcagatgagctccggcaatttactgtttaccggccacttgaagtgccggctgcgcatggacaagctccagctgaaggggatgagctactccatgtgtaccggcaagttcaagatcgtgaaggagattgccgagacgcagcacgggaccatcgtgatccgggtccaatacgagggcgacggaagcccatgcaagattcctttcgagattaccgaccttgagaagcgccatgtgctggggaggctaatcaccgtgaatccaatcgtgacggaaaaggactccccagtgaatatagaggcggagccgccgttcggcgatagctatatcattatcggggtggagccaggccagctgaagctcaactggtttaagaaggggagctccatcggtcaaatgtttgagaccaccatgcgaggcgcaaaaagaatggccatcctgggggacaccgcctgggacttcggctccctcgggggcgttttcacgtctatcgggaaggccctccaccaagttttcggcgcgatctacggcgccgcgttctccggggtttcgtggaccatgaaaatcctcatcggagtaatcataacctggataggtatgaactcgcggagcacctccctgagcgtgtccctggtgttagtcggcgtggtaacgctgtacctgggggccatggtccaggcggacagcgggtgcgtagtgtcctggaaaaacaaagaactcaagtgcggcagcgggatcttcataaccgacaacgtccacacatggacagagcagtataagttccagccagagagtccgtccaagctggccagcgccatacagaaggcccatgaggagggcatatgcggtatccgctccgtgacccggctggagaacttaatgtggaagcagataacgccggagctgaatcacatcttgtcggaaaacgaagttaagctcaccatcatgacaggcgacatccgcggcatcatgcaagccggcaagaggtccctgcgcccgcagcccactgagctgaaatactcttggaagacatggggcaaggcgaagatgctcagtactgagagccacaatcaaaccttcctgatcgacgggcccgagacagcggagtgcccgaacaccaaccgggcctggaactcactggaagtcgaggactacggattcggggtgttcaccacaaacatctggctcaagctgcgcgagaagcaggacgtcttttgcgatagcaaactgatgtcggccgccatcaaggacaaccgggctgtgcatgccgacatgggctactggatcgaaagcgccctcaacgatacgtggaagatggagaaggcatcctttatcgaggtcaagtcttgtcactggcccaagagccacacgctgtggtctaacggcgtgctggagtccgagatgatcatccctaaaaacttcgccgggcccgtgagccaacacaactaccgcccggggtatcacacccagacggcagggccctggcacctgggcaagctggagatggacttcgacctatgcgaggggaccacggtcgtggtcacagaggactgcggcaaccggggccccagcctccgaactaccacggcctccggcaagctgataaccgagtggtgttgccggagctgcaccttgcctccgctccgctaccgaggcgaggacgggtgctggtacggcatggagatccgacccctgaaggagaaggaagagaacctggtaaactcactcgtgaccgccgggcacggccaaatcgacaacttctcactgggtgtcctcggcatggccctcttccttgaggagatgcttcggacgcgaatcgggacaaagcacgcaatcctcctcgtagccgtgtccttcgtcactctgatcaccgggaacatgtcttttcgggacctcggccgcgtgatggttatggtcggggcgactatgactgacgacatcggaatgggcgttacatacctggcccttctcgccgcgttcaaggtgcgtccgaccttcgccgccgggctgcttctccggaagctcacgtcgaaggaactgatgatggccaccatcggcatcgccctcctttcgcagtcgacgatccccgaaactatactggagctgacggacgcgctagccttagggatgatggtcctcaagatcgtgcgcaatatggagaagtaccagctggccgtgactattatggcaatatcatgtgtccccaacgcggtgatccttcaaaatgcgtggaaggtgtcctgtactattctcgccgccgtcagcgtgtctcccctactcctaactagctcccagcagaaggccgactggatcccccttgcgctgactataaagggccttaaccctaccgccatcttcctgaccacccttagccggacctccaagaagcgctcatggcccctcaacgaggccatcatggccgtcggcatggtttccatactggccagctccttgctcaaaaacgacatacccatgaccggtccgctggttgcgggcgggctgctcacagtctgctacgtgctgacaggccgatccgccgacctcgagctagaaagagccgccgacgtgaagtgggaggaccaagccgagatctcggggtccagccccatcctgtccataacaattagcgaggacggctccatgtcaatcaagaatgaggaggaggagcaaacactgaccatcttgatccggaccggcttactggttatctccggtgttttcccagtgagcatccctatcacagcggccgcctggtatctctgggaggtcaagaaacagcgtgcgggagtactctgggacgtcccctcacccccccccgtggagaaggccgaactggaggacggggcataccggatcaagcagcgcggtatcctcgggtactcccagatcggtgccggcgtgtacaaggaggggacattccacaccatgtggcacgttacaagaggcgccgtcttgatgcatagggggaaacggattgagccgtcctgggccgacgtgaagaaggacctgataagctacggtgggggatggaagctcgagggcgagtggaaggagggagaggaggtgcaggttctggccctggagcccggcaaaaatccccgcgccgtacaaaccaaacccggaatattcaagaccaacaccggcaccatcggagctgtgtccctcgacttcagccccggcacctcaggtagcccgatcgtcgaccgtaagggaaaggtggtgggactatatgggaacggggttgtgacgaggtccggagcctacgtcagcgctatcgcgcagaccgaaaagagcatcgaggacaatccggagattgaggacgacatctttcggaagaagcgcttaaccattatggacctccacccgggtgccggcaagacgaagcggtacctgcctgccatcgtccgcgaggccatcaagcgggggctgcgcacgctgatcctcgcgccgacccgcgtcgttgcggcagagatggaggaggccctgcggggcctgcccatccgctaccagaccacggccatcaagactgagcacaccgggcgagagatcgtcgacctcatgtgtcacgccacattcaccatgcgcctcctgtcccccgtgcgcgtgcccaattataacctcattatcatggacgaagcgcacttcactgaccctgccagcatagccgctagaggctacatcagtacacgggtagaaatgggcgaggccgccgggatcttcatgaccgccacgccaccaggtagccgagatcccttcccccagtcaaacgctcccatcatggacgaggagcgggagatccccgagcgaagctggaactcggggcacgagtgggtgacggacttcaaaggtaagaccgtatggttcgtccccagcatcaaggccgggaacgacatcgcggcttgtctgcggaagaacggcaagaaggtgatccagctctcccgcaagaccttcgactctgagtacgtgaagaccagagccaacgactgggatttcgtcgtgacgaccgacatatccgagatgggcgccaacttcaaggctgagcgcgtgatcgacccgcggcgctgtatgaagccggtcattctcaccgacggggaggagcgggtgatactggcaggacccatgccggtgacacacagcagcgcggctcagcgccggggtcgcatcggccgtaacccgaagaatgagaatgaccagtacatctacatgggcgagcccctggagaatgacgaagactgcgcacattggaaggaagccaagatgctcttggacaatataaacacccccgagggcatcatcccctcgatgttcgagccggagcgggaaaaggtcgatgcgatcgacggcgaatacaggctccgtggcgaggcccgcaagacattcgtggacctgatgcgtcgcggcgacctgccggtttggctggcctacaaggtcgccgccgaagggattaactacgcggaccggaagtggtgcttcgatggcatcaagaataatcaaatcctcgaggaaaatatggaggtggagatctggaccaaggagggggagcgcaagaaactgaaaccccggtggctggatgcccgcatatactccgaccctctcgccctgaaggaattcaaagagttcgccgcgggcagaaagtcactgaccctcaacctgatcacagagatgggccgcctgcccaccttcatgacccagaaggctcgcaacgccctcgacaacctcgccgtgctgcacaccgccgaggccggtgggcgcgcctacaaccacgctctctccgagctccctgaaactctggaaaccctcttgctcctcactctgctggccaccgtcacaggaggcatctttctcttcctgatgagcggcaagggtatcggcaagatgacgctgggcatgtgttgcattatcactgcctccattctcttatggtacgcgcagatccagccccactggatcgctgccagcataatcctggagttctttctcatcgtgctactgatcccggagcccgagaagcagcgtacgccccaggacaatcagctcacttacgtggtgatcgccatcctgacggtggtcgccgcgaccatggcaaatgagatgggcttcctggagaaaacaaagaaggacctggggttgggatccattaccacgcaggagagcgagagcaacatcctggacattgacctccgccccgccagcgcctggaccctatacgccgtcgcgactaccttcgttacgcctatgctgcggcacagcatagagaactccagcgtcaatgtgtcgctcaccgcaatcgccaatcaggccaccgtcttaatgggcctggggaagggctggcccctaagcaagatggacatcggggttcctctgctggcgatcggatgctacagtcaagtgaacccaattaccctgactgcagcgctactgctcctggtagcccactacgctatcatcgggccaggcctgcaggcgaaagccacccgtgaggcccaaaagcgggctgccgcgggtatcatgaaaaaccccaccgtagacgggatcaccgtaatagacctcgagcctatcccctacgacccgaaattcgagaagcagctgggccaggtaatgctgctaatcctgtgcgtaacccaagtcctgatgatgcgcaccacctgggctctctgcgaggcgctgacgcttgcgactggtcccatcagcacactctgggagggcaacccggggcggttctggaacaccactatcgccgtgtccatggcaaacatcttccggggcagttatctggccggcgccgggctcctgttttcaatcatgaagaacaccactaatacccgccggggcaccgggaacatcggggagaccttaggcgagaagtggaaatcccgcttgaacgccctagggaagtccgaattccagatctacaagaaatccggcatccaggaggtcgaccggaccctggctaaggaggggatcaagcgcggggaaaccgaccaccacgccgtgtcacgggggtcggcaaagctgcgctggttcgtcgagcggaacatggttacccccgagggcaaggtggtagaccttgggtgcgggcgtggcgggtggtcctattactgcggcgggttgaagaacgtccgggaggtgaagggcctgacgaagggcgggccgggccacgaggaacccatcccgatgagcacgtacgggtggaacttggtgcgccttcagagcggagtcgacgtgttcttcacgccgcccgagaagtgcgacaccctgctctgcgacatcggcgagtccagcccaaatcccactatcgaggcaggcaggactctgcgcgtgcttaacctcgttgaaaattggctgaacaataacacccagttctgcatcaaggtgttgaacccgtacatgccctccgtgatcgagaagatggaggccttacagcggaagtacggcggggctctcgtccgcaatcccctgagccgcaactcaacgcacgagatgtactgggtgagcaacgccaccggcaacatcgtgtccagcgtcaatatgatttcccgcatgctgataaatcgattcacgatgaagcacaaaaaggccacctacgagcccgacgtggacttagggagcggaacccgtaacatcgggatagagagtgagattcccaacctggacatcatcggaaagcggatcgaaaagataaagcaggagcacgaaaccagttggcactacgaccaggaccatccctacaaaacgtgggcctaccatggcagttacgagacaaagcagaccgggagcgcctccagcatggtgaatggcgtggtgcgcctactcaccaagccatgggacgtcgtccccatggtgacgcaaatggcgatgaccgacaccaccccgttcggtcagcagagggtgttcaaggagaaggttgacacgcggacgcaggaacccaaggagggcacaaagaagctaatgaagatcaccgccgagtggctgtggaaggaactcggcaagaaaaagacgccccgtatgtgcacccgggaggagttcactcgcaaggtgcggtccaacgccgccctaggggccatcttcaccgacgagaacaagtggaagtccgcacgcgaagccgtggaggatggccggttctgggagttggtcgaccgcgagcgaaaccttcacctggaggggaagtgcgagacgtgcgtctacaacatgatgggcaagcgcgagaagaagctgggggaattcggtaaagccaaaggttcccgggccatctggtacatgtggctcggggcgcggttcctggagttcgaggccctgggctttctcaacgaggaccactggttcagccgggggaacagcctgtcaggggtggagggggagggcctgcaccggctcggctatatcctccgggacgttgggaagaaagagggcggagccatgtacgccgacgacaccgccgggtgggacacccgcataaccctggaagatctcaagaacgaggagatggtcaccaaccacatgaagggggagcacaaaaagctggcggaggccattttcaaactcacctaccagaataaggtagtgcgggtgcagcgccccaccccgcggggtacggtcatggacatcatcagcaggcgcgaccagcgtggctccggccaggtgggcacgtacggactgaacacgttcacgaacatggaggcccagttaatacgccagatggagggcgaggggatcttcaagagcatacaacacctgaccgccacggaagagatcgccgtgcagaactggctcgcgcgggtcgggagagagagactgtcccgcatggccatcagcggggacgactgcgttgtgaagcccatagacgacaggttcgcctcagctctgaccgccctcaacgacatgggtaaaatccgcaaggacatccagcagtgggagccttctcggggttggaacgattggacccaggtccccttctgctcacatcacttccacgagctggtcatgaaggacgggcgagtactggtcgtgccgtgccgcaaccaagacgagttgatcggccgagcccggatcagccagggcgccgggtggtccctcaaggagaccgcgtgtcttggaaagtcctatgctcagatgtggaccctcatgtattttcaccgccgggacctgcgcctggccgcgaacgccatctgctcggccgtgcccagccactgggtccctacgtccaggaccacctggtctatacatgccaagcacgaatggatgaccactgaggacatgttggcggtatggaatcgcgtgtggatacaagagaacccctggatggaagacaagaccccggtcgagtcctgggaggaggtgccgtaccttggtaagcgggaggaccagtggtgcggcagcctgatcgggctcactagccgcgcaacctgggccaagaacatccagacagcgatcaaccaggtgcgatccttaatcggcaacgaggaatacaccgactacatgccttcaatgaagcggtttcgccgtgaagaagaggaggccggcgtactgtggtga

SEQ ID NO: 25072 - RNA, 9876 nt, synthetic construct
  misc_feature 1..9876: note = derived and/or modified CDS sequence (opt11) from DENV-2__EU482751__SS-prME
  source 1..9876: mol_type = other RNA
accgcgggcgtgattgtcatgttaattccaaccgctatggcgttccacctcaccacccgcaacggggagccccacatgatcgtgggccgccaggagaaggggaagtcactgctcttcaagaccgaagatggcgtgaacatgtgcacgctcatggccatagacttaggggagctgtgcgaggacaccatcacctataagtgccccctcctgagacagaacgagcccgaagacattgactgctggtgcaactcaacatctacctgggtaacctacggcacttgcaccaccacgggcgagcaccgccgcgagaagcggtccgtggccctggtgccccacgtcgggatgggccttgagacgcgcaccgagacatggatgagcagcgagggtgcctggaagcacgtgcagcggatagagacctggatcttgcgccacccgggctttacgatcatggccgctatcctggcatacaccattggcacgacgcacttccagcgggccctcatattcatcctgctgactgccgttgcgcccagcatgactatgcgctgtatcggcattagcaaccgggacttcgtcgagggcgtgagcgggggcagctgggttgacatcgtcctcgagcacgggtcctgcgtcaccacgatggccaagaacaagcctactctagacttcgagctgatcaaaaccgaggccaaacagcccgccaccttgcgtaagtactgcatcgaggccaagctgacgaacaccactaccgagagccggtgcccgactcagggcgagccgagcctaaacgaagagcaggacaagcgtttcatctgcaagcactccatggtggaccgggggtgggggaacggctgcgggctgttcggcaagggcggcattgtgacctgcgcgatgttcacgtgcaagaagaacatggaggggaaggtggttcagcccgagaacttagagtataccatcgtcatcacgccccactctggggaggagcacgccgtgggcaacgacactggtaagcacggcaaagagatcaagatcacgccgcagtccagcatcactgaggccgagctgaccgggtacggcacggttaccatggagtgcagcccccggaccggcctcgactttaacgagatggtactgctgcagatggaggacaaggcctggctcgtgcaccggcagtggttcctggacctgcctttgccctggctgccgggggccgacacccaagggagcaactggatccaaaaggagaccttagtgaccttcaagaacccccatgcgaaaaagcaggacgtcgtggtcctagggagtcaggagggggccatgcacaccgccctgaccggggccacggagatccagatgagtagcggaaacctcctgttcaccggccacctgaagtgtcgcctgcgtatggacaagctacagctgaaggggatgagttacagcatgtgcacaggcaagtttaagatagtcaaggagatcgccgagacccagcacgggacgatcgttatccgagtccaatacgagggcgacggctccccctgcaaaatccccttcgagataactgacctggagaagcggcacgtgttagggaggctgatcaccgtgaacccgatcgtcaccgagaaggacagccccgtgaatatcgaggctgagccgccctttggcgactcctacatcatcattggggtggagccggggcaactgaagcttaactggttcaagaaggggagcagcatcggacagatgttcgagacgacaatgcgtggggccaagcggatggccatcctgggggacacagcatgggatttcggctctctaggaggagtcttcacatccattgggaaggcacttcaccaggttttcggcgcgatatacggagccgccttctcaggggtgtcttggacgatgaagatcctgatcggcgtaatcatcacctggatcggcatgaacagccgctccacctccttatccgtgagcctggtgcttgtaggcgtggtgacgttatacctgggggccgtcgtgcaggcggacagtggctgcgtggtcagctggaagaataaggagctcaagtgcggctccgggatattcatcacggacaacgtgcatacctggaccgagcagtacaagttccagcccgagagccccagcaagctggcctccgccatacagaaggcgcacgaggagggcatctgcgggatcaggtctgtgacccgcctggaaaacctcatgtggaagcagatcactcccgagctgaatcacatcctgtccgagaatgaagtcaagctcaccatcatgaccggcgacattaaggggatcatgcaagccggcaaacggagcctacgcccgcagcccaccgagctgaagtactcctggaagacgtggggcaaggcgaagatgctcagcactgagtcccacaaccagaccttcctgatcgacgggcccgagacagccgagtgtccgaacacgaaccgggcatggaatagcttggaggtggaggactacgggttcggggtgttcactaccaacatctggctcaaactcagagagaagcaggacgtcttctgcgacagcaagctgatgagcgccgcgatcaaggacaaccgggcggtgcacgccgacatgggctactggatcgagtccgccctcaacgacacctggaagatggagaaggctagcttcatcgaggttaaatcctgtcactggcccaagagccacaccctttggtccaacggcgtcttggagagcgagatgattatccccaagaacttcgccgggcccgtgtcacagcacaactaccgcccgggctatcatacgcaaaccgcggggccgtggcatctcggcaaactcgagatggattttgatttctgcgaggggaccactgtggtcgtgacagaggactgcgggaacaggggacccagcttgcgcaccaccacggcctccggcaagctcatcaccgagtggtgctgccggtcctgcacccttcctccgctgcgctacaggggcgaggacgggtgctggtacggaatggaaatccgacccctcaaggagaaggaagaaaacttggtgaacagcctagtaaccgccgggcacggccagatcgataatttctccttgggcgttcttgggatggcactgttcctagaggagatgttacggacgcgcatcggcacgaagcacgcgattctgctcgtcgccgtcagctttgtgaccctgatcaccgggaacatgtcctttcgggacctggggcgtgtaatggtcatggtgggggccaccatgacggacgacatcggcatgggcgtgacctacctcgccctgctggccgcgtttaaggtccgccccaccttcgccgcagggctcctgctgcgcaagctcaccagcaaagagttgatgatggccacgatcggcatcgcgttgctgtcccagtcgactatacccgagaccatactggagctgacggacgcgctcgccctaggcatgatggtgctgaagatcgtgcgcaatatggagaagtaccagctcgccgtcacgattatggccatctcctgcgtcccgaatgcagtaatcctgcagaatgcgtggaaggtcagttgcaccatcctggccgccgtgtccgtcagccctctcctactgacctccagccagcagaaggccgactggatacccctggcgctgacgatcaagggcctgaaccccacggccatcttcctcacaacactgagccggaccagcaagaagagatcctggcctcttaatgaggccatcatggctgtgggtatggtgtccatcctcgcctccagcctactgaagaacgacatccccatgacggggcccctcgtcgcgggcgggctgctgaccgtgtgctacgtcctcaccggccggtcggcggacctggaactggagcgcgccgccgacgtcaagtgggaggatcaagcggagatctccgggagctccccaatcctctccatcactatttccgaggatggcagcatgtccattaagaacgaggaagaggagcaaacgttaacgatcctgatcaggacaggcctcttagtgatcagcggcgtgttcccggtctccatccccattaccgcggccgcctggtatctgtgggaagtgaagaagcagcgggccggagtgctgtgggacgtccccagcccaccacccgtggagaaggccgagctggaagacggggcgtaccggatcaaacagcgcggtatcctagggtactcccagatcggcgctggcgtgtacaaggaggggacctttcacacgatgtggcatgtgacccgcggcgccgtactcatgcatcgcgggaaacggatcgagcctagctgggccgacgtgaagaaggacctgatctcctatggcgggggctggaagctggagggcgagtggaaggagggagaggaggtccaggtgctagccctagaacccggcaagaacccccgcgcggtgcagaccaagcccggaatcttcaagacaaatacgggcaccatcggcgccgtgtcactggatttctcccccggcaccagcggctcccccatcgtggatcggaaggggaaggtggtcggcctctacggaaacggcgtggttacccgcagcggggcctacgtctccgccatcgcccagacggagaagtctatcgaagataatccagagatcgaggacgacatcttccggaagaagcgcctgaccatcatggacttgcaccccggtgccggcaagaccaagcggtacctccccgccattgtgcgcgaagccatcaagcggggactgcgaacactgatccttgccccgacgcgcgtggtcgctgcagagatggaggaagccctccggggcctgcctatccgctaccaaactcccgccattaagaccgagcataccgggcgggagatcgttgacctgatgtgccacgccacgttcacaatgcgtctcctgagccccgtgcgcgtcccgaactacaacctgatcatcatggacgaagcgcacttcaccgaccccgcctctatcgctgcccgtgggtacatcagcacacgggtggagatgggcgaggccgccggaatttttatgacggcgacgccgcccggctcccgcgacccatttcctcaaagcaacgcccccatcatggacgaggagcgggagatccccgaacgctcctggaacagcgggcacgaatgggtgaccgatttcaagggcaagaccgtctggttcgtgccgtcaattaaagccgggaacgacatcgcggcctgccttcggaagaacggcaagaaggtgatccagctgagccgcaagacgttcgactccgagtatgtcaagacccgggccaacgactgggacttcgtggtgacaaccgacatctccgagatgggcgccaacttcaaggccgagcgcgtcatcgacccccggcgctgcatgaagcccgtgatccttactgacggggaggagcgggtgatcctcgcgggccccatgcctgtcacccactccagcgcagctcagcgccgggggcggatcggccgcaaccccaagaatgagaacgaccagtacatctacatgggggagcccctggagaacgacgaggactgcgcccactggaaggaagccaagatgctgctcgacaacatcaacacacccgagggcataataccgagtatgttcgagcccgagcgggagaaagtggacgcaatcgacggcgagtatcgtcttcgcggggaggcgcggaagaccttcgtggatctgatgcggcgtggcgaccttcccgtgtggctggcctataaagtggccgccgaggggatcaactatgccgaccggaagtggtgcttcgacggcatcaagaataaccagatcctggaggagaacatggaggtggagatatggaccaaagaaggcgagcgcaagaaactcaagccgcggtggctggacgcccgcatctactcagaccctctggcgttaaaggagttcaaggagttcgcggcgggccggaagtccctgaccctgaacctgataacagaaatgggccgcctgcccaccttcatgacgcagaaggcccggaatgctctggacaacctggcggtcctgcacaccgccgaggccgggggccgcgcctacaaccatgcgctgagcgaactccccgaaaccctggagactctgctcctgctgacgttactggccacagtgaccgggggcatattccttttcctgatgtccggcaaaggcataggcaagatgaccctggggatgtgctgcatcatcaccgcaagcatcctgctctggtatgcgcagatccagccacattggatcgccgccagtatcatactggagttcttcctgatcgtcctcttaatccccgagcccgagaagcagcggacgccgcaggacaaccagctgacctacgtggtaatagcaattttgaccgttgtggcagcgacgatggccaacgagatgggatttctggagaagacgaagaaggacctggggctcggcagcatcaccacccaagagagcgagtcaaatatcctggacatagacctgcgccccgccagtgcctggaccctgtatgccgttgcgacaaccttcgttactcccatgctgagacactccatcgagaatagttctgtgaacgtgagcctgacagcaatcgccaatcaggccacggtcctcatgggcctggggaagggctggcccctgtccaaaatggatatcggggtgcccctcctagcgatcggctgctacagccaggtgaatccgattacgctgaccgccgccctcttactgctcgtcgcacactacgccataatcgggcccggtctgcaggcgaaggctacccgcgaggcacagaagcgggccgccgcgggcatcatgaagaaccccacggtagacgggatcacggtgatcgaccttgagcccatcccgtacgaccccaagtttgagaagcagctcggccaggtcatgctgctaatcctctgtgtgacccaggtgcttatgatgcgcaccacgtgggccctatgtgaggccctcaccctggccaccgggcccatatctactctgtgggagggcaaccctgggcggttctggaatacaacgatagccgtaagcatggcgaacatcttcagaggctcttacttggccggcgccggcctcctattctctatcatgaagaacaccacttccacccgccggggcactgggaacattggcgagaccctcggcgagaagtggaagtcccgtctcaacgccctggggaagtccgagttccaaatctacaaaaagtccggcatccaagaggtggaccggacgctcgcaaaggaggggatcaagcgcggcgaaacggaccaccacgccgtgtcccgtggcagcgccaagctgcgctggttcgtcgagcggaacatggtgaccccggagggcaaggtggtcgacttaggctgcggccgcggcgggtggagctattactgcggagggctaaaaaatgttagggaggtgaaaggcctcaccaagggcgggcccggccacgaggagcccatccccatgagcacctacggctggaacctggtccgcctccagagcggcgtcgacgtattcttcacgccgcccgagaagtgcgacaccctgctctgtgacatcggggaatccagccccaaccccaccatcgaagccggccggaccctccgcgtcctgaacctggtggagaactggctcaacaacaacacccagttctgcatcaaggtgttaaacccgtacatgccctccgtcatcgagaagatggaggccctgcaacggcagtacgggggggcgctcgttcgcaaccccctgagccgcaactccacgcacgagatgtactgggtgagcaacgccaccggcaacattgtatcctcggttaatatgatctcccgcatgctgatcaaccggttcaccatgaagcacaagaaggccacctatgagccggacgttgacctggggtcgggcacgcgtaacatcgggatagagtcggagatccccaacctcgacatcataggcaaacggatcgagaagatcaagcaggagcacgagatttcgtggcactacgaccaagatcacccctacaaaacctgggcctaccacggctcctacgaaaccaagcagaccgggagcgcctccagcatggtcaacggagtggtgcgcctgctgacgaaaccgtgggacgtcgtgccgatggtcacacagatggctatgaccgacaccacgcctttcgggcagcagcgtgtcttcaaggagaaggtggacacccggacccaggagccgaaggagggcaccaagaagctcatgaagatcacggctgaatggctgtggaaggagctgggcaagaagaaaacgcctcgcatgtgcacgcgggaggagttcacccgcaaggtgcggtccaacgccgcccttggggctatcttcacggacgagaataagtggaaatcagcccgcgaagcagtcgaggacggccggttctgggagctggtggatcgcgagcgtaacctgcatctcgaggggaagtgcgagacctgcgtgtacaacatgatgggtaagcgcgagaagaagctgggggagtttggcaaggcgaagggttcccgggccatttggtatatgtggctgggggcccgcttcctagagttcgaggccttgggcttcctgaacgaggaccactggtttagccggggcaactccctcagcggggtcgagggggagggactccaccgcctgggctacatcctccgggacgtggggaaaaaggagggcggcgcgatgtacgctgacgacaccgccggttgggatacccgcattacgctggaggatctgaagaacgaggaaatggtcaccaaccacatgaagggggagcacaagaagctcgcggaggctatcttcaagttgacctaccagaacaaggtggttcgggtccagcgcccgacgccccgggggacggtcatggacatcatcagccgccgagaccagcgcgggtccgggcaggtcggcacctacgggttgaacaccttcaccaacatggaggcccaactcatccgccagatggaaggcgagggcattttcaagagcatccagcatctgacagccaccgaagagatagccgtccagaactggctggcgcgggtggggcgcgagagattgtcccggatggccatcagcggcgatgactgcgtggtcaagcccatagacgaccggttcgcctcagccctgaccgccctgaacgatatggggaaggttcgcaaggacatccagcagtgggagccaagccggggctggaacgactggacccaggtgccgttctgcagccaccacttccacgagctcgtcatgaaggacggtcgcgtgctggtggtcccgtgcagaaatcaggacgagctgatcggccgcgcgcggatcagccagggcgccgggtggtccctgaaggagacggcctgcttaggcaagagctacgcccagatgtggaccctgatgtacttccaccgcagagacctccgcctcgcggccaacgccatctgttcggctgtgcccagccactgggtacctacctccaggaccacctggagcatccacgccaagcacgagtggatgacgaccgaggacatgctggcggtctggaaccgcgtgtggatccaggagaacccgtggatggaagacaagacccccgtggagtcctgggaggaggtcccctacctcgggaagcgagaggaccagtggtgcggctcgctgattggtctgaccagccgtgccacgtgggccaagaacatacaggccgccatcaaccaggtgcggtccttgatcggaaacgaggagtacaccgactacatgccgagcatgaaacgcttccgccgagaggaggaggaggcgggcgtcctgtggtga

SEQ ID NO: 25073 - RNA, 9876 nt, synthetic construct
  misc_feature 1..9876: note = derived and/or modified CDS sequence (opt11) from DENV-2__GQ868604__SS-prME
  source 1..9876: mol_type = other RNA
accgcgggcgtgatcgtcatgctgattcccaccgccatggcgtttcacctcaccacacgcaacggagagccgcacatgatcgtggggcggcaggagaaggggaagtccctgctgttcaagacggaggatggcgtgaacatgtgtaccctcatggcgatcgacctgggggagctgtgcgaggacaccatcacatataagtgccccctcctgagacagaacgaacccgaggatatagactgctggtgcaatagcaccagcacctgggtcacctacgggacctgcaccacaacgggcgagcacaggcgcgagaagcggtcagttgcactggtcccccacgtcgggatgggtctcgagacccgaaccgagacctggatgtcgagtgagggagcctggaagcacgtgcagcggatcgagacgtggatccttcgccatccggggttcactatcatggccgcgatccttgcctacacaatcggaaccacgcacttccagcgggccttaatcttcatcctgctgaccgccgtggcgcccagcatgactatgcgctgcatcgggatcagcaaccgggacttcgtcgagggtgtgtcggggggcagctgggtggacatcgtcctcgaacacggcagctgcgtaaccacgatggccaagaataagccgactctggactttgagctgatcaagaccgaggccaagcagcccgccacccttcgcaagtattgcatcgaagccaagctgacgaacaccactaccgagtcccggtgcccgacccagggcgaaccaagcctgaatgaggagcaggacaaacgcttcatctgcaagcattctatggtggaccgaggctgggggaacggctgcgggctattcggcaagggcggcatcgtgacctgcgcgatgtttacgtgtaaaaagaacatggaggggaaggtggtgcagcccgagaacctggagtataccatcgttatcacgccccactctggggaggagcacgcggtgggcaacgacaccggaaagcatggcaaagaaatcaaaatcaccccccagtccagcatcaccgaggcggaactgaccgggtatggcacggtgaccatggagtgcagcccccgtaccggcctagacttcaatgagatggtcctgctgcagatggaggataaagcctggctcgtgcaccggcaatggttcctggatttacccctcccctggctgccgggggccgacacgcagggcagcaactggatccagaaggaaacgctcgtgacgttcaaaaaccctcatgccaagaaacaggacgtcgtggtactcggctctcaagagggcgccatgcacaccgccttaacgggggccacggagatccaaatgagcagcggtaaccttttgttcactggccacctgaagtgccgcttaagaatggacaagctccagctgaaagggatgtcctacagcatgtgcaccggcaagttcaagatcgttaaggagattgcggagacccagcacgggacgatcgtgatccgcgtccagtacgagggcgacgggtcaccctgcaagattcccttcgagatcaccgacctggagaagcggcatgtactagggcgcctgataaccgtgaacccgatcgtaaccgagaaggactctcccgtgaacatcgaggcggagccgcccttcggcgactcctacatcatcataggggtcgagccgggacagctgaagctcaactggttcaaaaaggggtcaagtattggacagatgttcgagacgactatgcgcggcgccaagcggatggccattctgggggacaccgcctgggacttcggcagcctcggcggcgtcttcacatccatcggcaaggccctccaccaggtgtttggggcgatttacggagccgcgttcagcggggtgagctggacgatgaaaatcctcatcggcgtcatcatcacctggatcgggatgaacagccgatccaccagcctatccgtgagcctggtgctcgtgggagtagtgaccctgtacctgggggccgtcgtgcaggcggattccgggtgcgtcgtcagctggaagaataaggagctcaagtgtggctccgggatcttcatcacggacaacgtgcacacctggaccgagcagtacaagttccagcccgagtcgcccagcaagctggcctccgccatccaaaaggcccacgaggaaggcatctgcgggatccgaagcgtgacccgccttgagaacctcatgtggaaacaaatcactcccgagttgaaccacatcctgtccgagaacgaagtcaagctcaccatcatgacaggcgatattaaggggatcatgcaagcgggtaagcgcagcctgcgaccacagcccactgagctgaagtactcctggaaaacgtggggcaaggctaagatgctcagcaccgagagtcacaaccagacttttctgatcgacgggcctgagaccgccgagtgcccgaacacgaaccgggcctggaacagcctggaggtggaagactacggctttggggtgttcactaccaacatctggttgaagctgcgcgagaaacaggacgtcttctgcgactccaagctaatgagcgccgccatcaaggacaaccgtgcggtgcacgccgacatgggctactggatcgagtccgccctcaacgacacctggaaaatggagaaagcctctttcatcgaggtgaagtcttgccactggccaaagagccacaccctgtggtccaacggtgtcctggagagcgagatgatcattccgaagaacttcgccgggcccgtgtcccagcacaactacaggcctggttaccacacgcaaaccgctggcccatggcatctcggcaagctcgagatggacttcgacctttgcgaggggaccaccgttgtcgttacagaggactgcggcaatagaggccccagcctccgcactaccactgcctctgggaagctgatcacggaatggtgctgccgctcctgcaccctgcccccgctccgctaccggggcgaggacgggtgctggtacggaatggagatccgtcccctgaaggaaaaggaggaaaacctggtgaacagcctcgtcactgccgggcggggacaaatcgataatttctccctgggcgtgctggggatggccctgttcctggaggagatgttacgcacaaggatcggcacgaagcacgcgatactcctggtggccgtcagctttgtgacccttatcaccggtaacatgtccttccgcgacctagggcgcgtgatggtcatggtgggggccaccatgacagacgacataggcatgggcgtgacctacctggccttactcgccgcgttcaaggtgcgtcccaccttcgccgccgggctgctcttacgcaagctgaccagcaaggagttaatgatggccacgatcggcatcgccctcctgtcacagagcaccattcccgagaacatcctggaactcaccgatgcgctggcccttgggatgatggtgttgaagatcgtcagaaacatggagaagtaccagctggctgtcaccatcatggcaatctcctgcgttccgaacgccgtgatccttcagaatgcgtggaaggtcagttgcacgatcctcgccgccgtgtccgtcagccccctgctgctcacctcaagccagcaaaaggcagactggatcccactggcgctgaccataaaaggcctcaaccccactgccatcttcctcacaaccctgtcccgcacctcgaagaagcggtcctggccgctcaacgaggcgatcatggccgtgggcatggtgtccatcctggcctccagcctactgaagaacgacatccccatgaccggtcccttggtcgctgggggtcttctcacggtgtgctacgtgttaaccgggcgcagcgcagacctcgagctcgaacgggcagccgatgtcaagtgggaggatcaagccgagatctcaggtagctcccccatcctatccataaccatctccgaggacggtagtatgtcaatcaagaacgaagaagaggagcaaaccctgacgatcctcatccgcaccggcctgctggtaatcagcggggttttcccggtctccattcccatcacagcggcagcctggtatctctgggaagttaagaagcagcgggccggcgttctgtgggacgtccccagcccaccgcccgtggagaaggccgaactggaggacggggcataccgcatcaagcagcgaggcattctcgggtactcccagataggtgctggcgtttacaaagagggaaccttccacaccatgtggcacgtgacgcgcggcgcagtgctgatgcaccgcgggaagcgcatcgagccaagctgggcggacgtcaaaaaggacctgatcagttacggcgggggatggaagctcgagggcgagtggaaggagggggaggaggtccaagtgctggccttagagcccggcaagaaccccagggcggtgcagacaaagcccgggatcttcaagaccaacaccggcacgataggggccgtcagcctcgatttctcccccggcaccagcggctcccccatcgtggaccgcaagggaaaagtggtaggcttatacgggaacggcgtggtgacccggagtggcgcctacgtctccgccatcgcgcagaccgaaaagtccattgaggataatcccgaaattgaagacgatatcttccgaaagaagcggctgacgatcatggacctccaccccggggccggcaagaccaagcgttacctgcccgctatcgtgcgggaggccattaagcgcgggctgcgcactctgatcctcgcaccgacccgggtggtcgcggccgagatggaggaggccctgcgcggcctgcccatacgctatcagacgccagccatcaagaccgagcacacagggcgggaaattgtggacctcatgtgccacgccaccttcacgatgcggctgcttagccccgtccgcgtccctaactacaacctcatcatcatggacgaggcgcattttaccgaccccgcttccatcgcggcccggggatacatcagcacccgggtggagatgggcgaggccgccgggatcttcatgaccgccaccccgccgggctcccgggacccgttcccccagtccaacgcccccatcatggacgaggaacgcgagatcccggagcggtcctggaactcagggcacgagtgggtgaccgacttcaagggcaagaccgtctggttcgtgcccagtatcaaagctgggaacgacatcgcggcatgtctccgcaagaacggcaagaaggtgatccagctgagccgaaagactttcgactccgagtacgtcaagacgcgcgccaacgattgggacttcgtggtgaccaccgacatcagcgagatgggcgccaacttcaaggccgagcgggtcatcgacccccgccggtgcatgaagcccgtgattctcaccgacggggaagagcgcgtgatcctggcgggccccatgccagtcacgcactccagcgcggcgcagcggcgcgggcgcatcggacggaaccccaagaatgaaaacgaccagtacatctacatgggtgagcccctggagaatgacgaggactgcgcccactggaaggaggccaagatgctcctggacaatataaatactcccgagggcatcatcccgagcatgttcgagcccgaaagggagaaggtggacgcgatcgacggcgagtatcggctgcgcggggaggcccggaagaccttcgtggaccttatgcgccggggcgacctgcccgtctggttggcctataaggtggctgccgagggaatcaactacgcggaccgcaagtggtgcttcgacggcatcaagaacaaccaaatactggaggaaaacatggaggtcgagatctggacaaaggagggggagaggaagaaactgaagccgaggtggctggacgcgcggatctacagtgaccccctcgccctgaaggagtttaaggagttcgccgcggggcgcaagagtctgacgctcaacctgatcacagagatgggccggctgcccaccttcatgacccagaaagcccgcaacgccttggataacctggccgtcctgcacacggccgaggcagggggcagagcctataaccacgccctcagcgagctgcccgaaaccctggaaaccctcctcctgctcaccctgctggcgacggttacagggggcatcttcctcttcttgatgtccggcaaggggatcggcaaaatgactctggggatgtgctgtatcattaccgccagcatcctcttatggtacgcgcagatccagccgcactggatcgccgcctccataatcctagagttctttctcatcgttctgctgatccccgagcccgagaagcagcgcacaccccaagacaaccagctcacgtatgtggtgatagcgatcctgaccgtcgtggcggccaccatggcgaacgagatgggcttcctggaaaagaccaagaaggacctcgggctaggctccatcacgacccaggagagcgagagcaatatcctggacatcgacctcagaccggcaagcgcctggacgctgtacgccgtggcgaccacgttcgtcacccccatgcttcggcactccatcgaaaactcatccgtgaatgtatcgctgaccgccatcgctaaccaggccacggtcctgatgggcctgggcaagggctggcccctttccaagatggacattggggtgcccctgttggcgatcggctgctacagccaggtgaacccgattacgctcaccgccgccttgctgcttctggtcgctcactacgccatcatcggacccggcttgcaggcgaaggccacccgggaggcccaaaagcgcgcggccgccggaatcatgaaaaaccccaccgtggacgggatcacggtgatcgacctagagccaatcccttacgaccccaaattcgagaagcagttgggccaggtcatgctgctcatcctgtgcgttacccaggtgctgatgatgcggaccacctgggccttgtgcgaggccctgacgctggccacagggcccatctctaccctttgggagggcaaccccggtcgcttctggaacacgacaatcgccgtgtccatggcgaacatcttccgcggctcctatctggcaggcgccgggctcctgtttagcatcatgaagaacacgacctccacacggagaggcacggggaacatcggcgagacactgggcgaaaagtggaaatcccggctcaacgccctggggaagtccgagttccagatctacaagaagtccgggatccaggaagtggataggaccctggcgaaggagggcatcaagcggggtgagaccgaccatcacgccgtgtcccgcgggagcgccaagcttcggtggttcgtagagcgcaacatggtaacgccggagggcaaagtggtcgatctcggatgcggccggggcgggtggtcatactactgtggcgggctgaagaacgtgcgcgaagtaaagggcctcaccaagggcggtcccggccacgaggagcccatccccatgtctacatacggttggaacctcgtccggctgcagagtggcgtggacgtattcttcaccccacccgagaagtgcgacaccctgctgtgtgacatcggggaatccagccccaaccccaccatcgaggccggccgcaccctgcgggtactgaacctcgtggaaaactggctgaataacaacacccagttttgcatcaaggtgctgaacccttacatgccctcggttatcgagaaaatggaggccctccagcgccaatacggaggggcacttgtgcgtaacccactgagccgtaattccacccacgagatgtactgggtaagcaatgccacgggtaacatcgtcagcagcgtgaacatgatctctcggatgctaatcaaccgcttcaccatgaagcataagaaggctacttacgagccggatgtggacctcggaagcggcacccggaacatcgggatcgagagcgagatacccaacctggacatcatcggcaaacgcatcgagaagatcaaacaggagcacgagatctcttggcactacgaccaggaccacccctacaagacgtgggcataccacggctcttacgagaccaagcagaccggtagcgcttccagcatggtcaacggcgtggtgcggctgctaaccaagccctgggacgtcgtgccgatggtgacacagatggcgatgactgacaccaccccttttgggcagcagcgtgtcttcaaggagaaggtggacacccgcacccaagagcccaaagagggcaccaagaagctgatgaagatcaccgcggagtggctgtggaaggagctcggcaagaagaagacccctcggatgtgcacccgagaggagttcaccaagaaggtgagatccaacgccgccctgggggccatattcaccgacgaaaacaaatggaaatccgcgcgcgaggccgtcgaggacgggcggttctgggagctcgtggaccgtgagcggaatctacacctggagggtaagtgcgagacgtgcgtgtacaacatgatgggcaagcgcgagaagaagttaggcgaattcggcaaggccaagggctcacgggccatatggtacatgtggctcggggcgcgcttcctggagttcgaggccttgggcttcctaaacgaagaccactggtttagccgggggaacagcctctccggcgtggagggggaaggcctgcaccgcctaggctatatcttgcgggacgtggggaaaaaggagggcggggccatgtacgcggacgataccgccggctgggacacccgaattaccctggaggacctcaaaaacgaggagatggtaactaaccatatgaaaggggagcacaagaaactggccgaggccatcttcaagctgacctaccaaaacaaggtggtgcgggtccagcgcccgacaccccggggaaccgtcatggacatcatcagccgccgggaccaacgcggctccgggcaggtcggcacgtatgggctcaacaccttcaccaacatggaggcccagctgatccgccagatggagggcgagggtatcttcaagagcatacagcacctgacagcgaccgaggagatcgctgtccagaactggctcgcgcgggtggggcgcgagcggctgtcccgcatggcgatcagtggcgacgactgcgttgtcaagcccatcgacgatcggttcgcctccgccctgaccgccctcaacgacatggggaaggtgcgcaaggacatacagcagtgggagccgagccggggctggaacgactggactcaggtgccgttctgctcccaccacttccacgagctggtcatgaaggacgggcgcgtactggtcgtcccttgccgtaaccaggacgagctcatcggccgcgcgcggatcagccagggcgccgggtggtccctgaaggagaccgcctgtctgggcaagagctacgcccagatgtggacgcttatgtacttccatagacgtgatttgcgcctggccgcgaatgccatctgctccgccgtgcccagccactgggtgccaacctcacgtaccacctggagcatccacgccaagcacgaatggatgacaaccgaggacatgttagcggtgtggaaccgcgtgtggatccaggagaacccttggatggaggacaagactcccgtggagtcctgggaggaggtcccctacctgggcaagcgggaagaccagtggtgcggatctctgatcgggctcaccagccgcgccacttgggccaagaacatccagacggctatcaatcaggtgcggtccctgatcggcaacgaggaatacaccgactacatgcccagcatgaagcgcttccgccgggaggaagaagaggccggcgtgctgtggtga

SEQ ID NO: 25074 - RNA, 9876 nt, synthetic construct
  misc_feature 1..9876: note = derived and/or modified CDS sequence (opt11) from DENV-2__EU482752__SS-prME
  source 1..9876: mol_type = other RNA
acggcgggggttatcgtcatgttgatacccaccgccatggcgttccacctaaccacccgcaatggcgaaccacacatgatcgttggccggcaggaaaaaggtaaatccctactcttcaagaccgaggacggcgtgaatatgtgcaccctcatggccatcgacttaggggagctatgcgaggacacaattacctacaagtgtcccttgttacgtcagaatgagcccgaggacatcgactgctggtgcaactcgactagcacctgggtcacatacgggacttgcaccaccacgggcgaacaccgccgcgaaaagcggtccgtggccctggtcccccacgtcgggatgggcctcgaaacgcgcacagagacctggatgtcaagtgagggcgcttggaaacacgtgcaacggatagagacgtggatcttgcgccaccctggctttaccatcatggccgcgatactggcgtacaccatcgggaccactcacttccagcgcgcgctaatcttcatcctgctgaccgccgtggctcccagcatgacgatgcggtgcatcggcatatccaatagggacttcgtcgagggcgtgagcgggggctcatgggtggacatcgttctcgaacacgggtcttgcgtgaccaccatggccaagaacaaaccgaccttggacttcgagctgatcaaaaccgaggccaagcagcccgccaccttgcgtaagtactgcatcgaggcgaagttaactaacactaccaccgaaagtcggtgcccgacgcagggcgagcccagcctgaacgaggagcaggacaagcgctttatctgtaagcacagcatggtggaccggggctgggggaacggatgcgggctgttcggcaaaggcgggattgtcacatgtgcgatgtttacgtgcaagaaaaatatggaaggcaaggtggtccagccggagaaccttgagtacaccatcgtcatcacccctcacagcggggaggagcacgcggtgggcaacgacaccgggaagcatggaaaggagatcaagatcactcctcagtccagcattaccgaggcggagctgacagggtatggcacagtgaccatggaatgcagcccccgtacagggctcgacttcaatgagatggtcctgctgcagatggaggataaggcctggctcgttcaccgccagtggttcctcgaccttcccctcccttggctgcctggggccgacacacagggctcaaactggatccagaaggaaacgctagtgaccttcaagaacccacacgcgaaaaagcaggatgttgtggtcctcgggagccaggagggagctatgcataccgccctaaccggggccacggagatccagatgagcagcggaaacttattatttacgggccacctgaagtgtagacttcggatggataaactccagttaaaggggatgagttattcgatgtgcaccggcaagttcaagatcgtgaaggaaatcgccgagacccagcacgggacgattgtgatccgcgtccagtacgagggcgacggctccccctgtaagatcccgtttgaaattaccgacctggagaagcggcacgtgctcgggcggctgatcaccgtgaacccgatcgtcaccgagaaagacagccccgtaaacatagaggcggagccgccattcggtgactcctacatcatcataggagtggagccaggccagctgaagctcaattggtttaagaaggggagctccatcggccagatgttcgaaacgaccatgcgcggcgccaagagaatggccattctgggcgacaccgcctgggatttcggcagcctcgggggtgtcttcacatccatcggtaaggccctccaccaagtgttcggcgctatctatggcgccgcgttcagcggggtgtcctggacaatgaagatccttataggcgtaatcatcacttggatcgggatgaacagccgctctaccagtctgtctgtctcactggtcctggtaggcgtggtgaccctatacctgggggccatggtccaggccgactccggctgcgtggtgagctggaagaataaggagctaaagtgcggctccggcatattcataacggacaacgtccacacctggacagagcagtacaagtttcagcccgagagcccgagcaagctggccagtgccatccagaaggcccacgaggagggcatctgcggaatccgtagcgtgactcgcctggaaaacctcatgtggaagcaaatcacgcccgagctgaaccatattctgtccgagaatgaggtgaaactcaccatcatgaccggcgacatccgggggatcatgcaggcgggaaagcggagcctgcggccccaacccaccgaacttaagtactcctggaaaacgtggggcaaggcgaaaatgctgagcaccgagtcccacaatcaaaccttcttgatcgacgggcctgagaccgccgagtgcccgaacactaacagagcgtggaactcactggaggtggaggactatggtttcggtgtgttcactaccaacatctggctgaagctgagggagaaacaggatgtcttctgcgactccaagttaatgagcgcagctatcaaagacaaccgcgccgttcatgccgatatgggctattggatcgagtccgcactcaacgacacctggaagatggagaaggccagctttatcgaggtcaaatcctgccactggcctaagagccataccctttggtcaaacggcgtgctggagagcgagatgataatccccaaaaacttcgccgggcccgtctcccagcacaactaccggccgggctaccacacgcagacggcggggccttggcatctcggcaagctggagatggattttgacctgtgcgagggtaccaccgtggtggttacggaggactgcggcaaccgcggccctagcctcagaaccaccaccgccagcggcaagctgatcacagagtggtgctgccgctcttgcaccttacccccgctccggtaccgcggcgaggacgggtgctggtacggcatggagatccgtcccctgaaggagaaggaggaaaatctggtgaacagcctcgttacagccgggcacggccaaatcgacaacttttcgctaggcgtactggggatggccctcttcctggaggagatgctgcgcacccggataggcactaagcacgctatcctcctggtagccgtgagcttcgtcaccctgatcacggggaacatgtcttttagggacttgggccgcgtgatggtgatggttggggccactatgacagatgacatcggcatgggcgtgacttacctggcgctcctcgccgcgttcaaggtacgtcctaccttcgccgcagggctgctgctccgcaagctgaccagcaaggagctgatgatggccacgataggcatcgccctcctgtcccaaagcaccatccccgagaatatcctggagttgacagacgcgctggccctggggatgatggtccttaagattgtacggaacatggaaaaataccagctggccgtcaccatcatggcgatctcctgcgtccctaatgccgtgatcctgcagaacgcgtggaaggtaagctgcactatcctcgcagcggtctccgtgagccccctgctcctcacctccagccagcagaaggccgactggatacccctggcgctgacgatcaaaggtctcaatcccaccgcgatctttcttacgaccctctcacgaacctctaagaaacgttcctggcctctcaatgaggccataatggccgtcggcatggtatcgatcctggcatccagtctcctcaagaacgacattcccatgaccgggcctttagtggctggcgggctgctcacggtctgctacgtcttgaccggccgctctgccgaccttgagttagaacgggccgctgacgtgaagtgggaggaccaggccgagatttccgggagctcccccatcctatcgatcaccatctccgaggacggcagcatgtccataaagaacgaggaggaggagcagaccctgacgatccttatccgcacaggcttactggtcatttctggggtgttcccggtttccatccccatcaccgcggccgcctggtacctttgggaggtgaaaaagcagcgggccggggtgctgtgggatgtgcctagcccgccgcccgtcgaaaaggctgagctggaagacggggcgtatcgcatcaaacaaagaggtatcctcgggtactcccagatcggcgccggcgtttacaaggaaggaaccttccacaccatgtggcatgttacgcgtggggccgtcctgatgcatcggggtaagcgcatcgaacccagctgggcggacgtgaagaaggacctgatctcctatggagggggctggaagctcgagggcgagtggaaggagggggaggaagtgcaagtcctggccctggaacctgggaagaacccgcgggcggtccagaccaagcccgggatttttaagacgaacaccggcacaatcggggccgtgagtctcgacttctcccccggcacgagcggatcgcccattgtcgacagaaaagggaaagtggtgggcctgtacgggaacggcgtcgttactcggagtggcgcctacgtgtccgccatcgcgcagaccgagaagtccatcgaggacaatcctgagatcgaagacgatatctttcgcaaaaagcgcctgaccatcatggacctccaccccggggccggcaaaactaagcgatacttacccgccatcgttcgggaggcgatcaagcgcggcctgcgtacccttatcctagcccctaccagggtggtggcggccgagatggaagaggccctcagaggcctgcccattcggtatcaaacgaccgccatcaaaaccgagcacactgggcgggagatcgtcgatttgatgtgccacgcaacattcaccatgcgccttctgagccccgtgcgcgtgcccaattacaacctcatcatcatggacgaggcgcacttcaccgacccggcctccatcgcggcccgcggctacatctccacccgagtcgagatgggcgaagcagcggggatcttcatgacagccacgccacccgggtcccgcgacccattcccgcagagcaatgccccgatcatggacgaggagcgcgagatcccggagcgttcctggaactcggggcatgagtgggtaaccgacttcaaaggcaaaaccgtatggttcgtcccctccatcaaggccgggaatgacatcgcggcatgcctcagaaagaacggcaagaaggtgatccagctgagccgcaagacgttcgactctgagtacgtgaaaacccgtgccaacgactgggacttcgtcgtgaccacagacatcagcgagatgggcgccaatttcaaggccgagagagtgattgacccgcgccggtgcatgaaaccggtcatcctcacggacggggaggagcgcgtgatcctagcaggacccatgcccgtcacacacagtagcgcagcccagcgacgcgggagaatcggccggaacccgaagaacgaaaacgaccaatacatctacatgggagaaccgctggagaatgacgaggactgcgcacactggaaggaagcaaaaatgctcctggacaacattaataccccagagggcatcatcccctccatgttcgagccagagcgcgagaaagtcgatgcgatcgacggtgagtaccggctgcgcggcgaggctcggaaaaccttcgtggatctcatgcgccggggcgacctgcccgtgtggctcgcttataaggtcgccgccgaggggatcaactacgcggatcgcaagtggtgcttcgacggcattaagaacaaccagatccttgaggagaacatggaggtggagatctggacgaaggagggtgaacgaaagaagctgaagccaaggtggcttgatgcccggatctacagcgacccgctcgccctgaaggagttcaaggagttcgccgcgggccgcaagtcactgaccctcaacctgattaccgaaatgggcagactgcccacatttatgacgcagaaggcccgcaacgctctcgacaacctcgccgtgctgcacaccgccgaggcagggggccgggcttacaatcacgcgctctctgaactcccggagaccctggagaccttactactgttgactctactcgccaccgtcaccgggggtatctttctctttctgatgtccggtaaagggatcggcaagatgaccctggggatgtgctgcatcatcaccgccagcatcctcctgtggtatgcacaaattcagccccactggatcgccgcgtcaatcatcctcgagttcttcctgatcgtgctgctgattccggagcccgagaagcagcgcacgccccaggacaaccagctcacgtatgtcgtgatagccattctgaccgtggttgccgctaccatggcgaacgagatgggcttcctggagaaaacgaagaaggatctcggtctgggcagcatcactacccaggagagcgagtccaacattctggacatcgacctccggcccgccagcgcctggactctgtacgccgtggcgacgaccttcgtgaccccgatgttacgccactcaatcgagaactctagcgtcaacgtgagcctcaccgccatcgctaaccaagccacggtgctgatgggtctggggaaaggttggcccctctcaaagatggatatcggggtccccctactggccatcggctgctacagccaggtgaacccgatcacgctcaccgctgccctgctgctcctggtggcccattatgccatcatcggcccgggcctgcaagcgaaggccacccgggaagcacagaaacgagccgcggcgggcatcatgaagaatcccacggtcgacgggatcaccgttattgacctcgagcctataccttacgacccgaaattcgagaagcagctgggacaggtgatgctgctcatcctgtgcgtcacccaggtgctgatgatgcgaaccacgtgggccttatgcgaggccctgaccctggccaccgggcctatatccacactctgggagggcaaccccgggcggttttggaacacgacaatcgccgtcagcatggcgaacatcttccgcggctcctacctggccggcgccgggctcctgttcagcatcatgaagaacacgaccaacacgcggcgcggcaccgggaacatcggcgagaccctgggcgagaagtggaagagtcggctgaacgcgctcggcaagagtgagttccagatctacaagaaatccgggatccaagaggtcgaccgaacgctcgcgaaggaagggatcaagcggggtgagacggaccaccacgccgtcagcaggggttccgccaaactccggtggttcgtggagcggaacatggtcactcccgaaggcaaggtggtggacctcggttgtgggcggggtgggtggagctactactgcggcggtctgaagaacgtacgcgaggttaagggcctgaccaagggagggccgggtcacgaagaacccatccccatgtccacctacgggtggaacctcgtgcgactgcagtccggggtagacgtgttcttcactccgccggagaagtgtgataccctcctctgtgacatcggggaaagctccccaaacccgaccatcgaggcagggcgcaccctgcgggtgctgaacctcgtagagaactggctgaacaacaacacccagttctgcatcaaggtgctgaacccctacatgccgagcgtgatcgagaaaatggaggccctacaacgcaagtacggcggggccctggtccggaacccgctgtcccggaacagcacccatgagatgtactgggtttccaatgccaccggcaacatcgtgtcgtcagtcaatatgatcagccggatgctgatcaaccgcttcacgatgaaacacaagaaagccacttacgagcccgacgtggatctcggatccggaacccggaacatcgggatagaaagcgagatcccgaacctggatatcatcggcaagcgcatcgagaagattaagcaggagcacgagacctcctggcactacgaccaggaccacccttacaagacctgggcctatcacggcagctatgaaaccaagcagacgggatccgccagctccatggtgaacggtgtcgttcgcttactcaccaagccctgggacgtggtccccatggtgacccagatggcgatgaccgacacgaccccatttggccagcagcgggtgtttaaggagaaggtcgacacccgcacccaggagcctaaggagggcacgaagaaacttatgaaaataaccgccgagtggctgtggaaggaattaggcaagaagaagacgccccggatgtgtacccgcgaggagttcacgcggaaagtgcgctcaaatgccgcgctgggggccatcttcaccgacgaaaacaagtggaaatctgcgcgtgaggccgtggaggacggccgcttctgggagctggtcgaccgggagaggaacctccacctggaggggaagtgtgaaacctgtgtgtacaatatgatgggcaagcgggagaagaagctgggggagttcggcaaggccaagggcagccgcgccatatggtacatgtggctcggggcgcggtttctcgagttcgaggccctgggcttcctgaacgaggaccactggttctcgcgcgggaactctctgagcggcgtagaaggggaaggccttcaccggctcgggtacatcctacgcgacgtggggaagaaggagggcggggccatgtatgcggacgacaccgcaggctgggacacacggattaccctggaggacttgaagaacgaggagatggtgaccaatcacatgaagggggagcacaagaagctggcggaagccatcttcaagctcacctaccagaacaaggtcgtgcgagtacagcggccgacgccgcgcggcactgtaatggacatcatcagtcggcgcgaccagcgcggctcggggcaggtcgggacctacggtctcaacacattcacgaacatggaggcccagctgatccggcagatggagggtgaaggaatcttcaagtccatccagcaccttacggccaccgaggagatcgccgtgcagaactggttagcgcgagtcgggcgggagcgcctgagtcggatggccatctccggtgacgattgcgtcgtaaagcccatagacgatcgcttcgccagcgctctgaccgccctcaacgatatggggaaagtccgcaaggacatccagcagtgggagccctcccgcggctggaacgactggactcaggtgcccttctgcagccaccacttccacgagctagtgatgaaggatgggcgggtactggtggtgccgtgccgcaaccaggacgagctcatcgggcgggcgcgcatctcccagggcgcagggtggagcctcaaggagaccgcctgcctgggcaagtcctacgcgcagatgtggaccctaatgtactttcaccggcgcgacctgcggctggctgcgaacgctatctgcagcgccgtcccctcccactgggtgcccacaagccgcaccacatggtccatccacgccaagcacgagtggatgaccaccgaggatatgctcgcggtgtggaaccgggtttggatccaggagaacccttggatggaggacaagaccccggtcgagagctgggaggaggttccctacctggggaagcgcgaagaccagtggtgcggttcgctgatcgggttgacgagccgagccacctgggccaagaacatacagaccgccattaaccaggtccgcagcttaatcggcaacgaggagtacactgactacatgccgtccatgaaaaggttcaggcgcgaggaggaggaagctggcgtgctgtggtga

SEQ ID NO: 25075 - RNA, 9876 nt, synthetic construct
  misc_feature 1..9876: note = derived and/or modified CDS sequence (opt11) from DENV-2__EU482753__SS-prME
  source 1..9876: mol_type = other RNA
accgcgggcgtgatcgtcatgctgatccccacagccatggcgttccacctcaccacccgcaacggggagccgcacatgatcgtgggccggcaggagaaggggaagtccctgctgttcaagaccgaagacggcgtgaatatgtgcaccctcatggccattgacctgggggagctgtgtgaggacaccatcacctacaagtgccccctcctgcgccagaacgaacccgaggacattgactgctggtgtaatagcactagcacctgggtcacctacgggacatgtaccactacgggtgagcaccggcgcgagaagcggtccgtggccctggtgccccacgtcgggatgggcctcgagacccgcacagagacgtggatgagcagtgagggggcctggaaacacgtgcagcggatcgagacgtggatcctgcgccacccgggctttaccatcatggccgcgattttagcctacaccatcgggaccacccacttccagcgggccctcatcttcatcctgttgaccgctgtggcgccctctatgaccatgcgctgcattggcatctccaaccgggacttcgtcgaaggcgtgagcgggggctcctgggtggacatcgtcctcgagcacggaagttgcgtgaccacgatggccaagaacaagcccaccctcgatttcgagctgatcaagacggaggccaagcagccagccaccttgcgcaagtactgcatcgaggccaagctgacgaacacgaccaccgagtcacggtgccctacacagggcgagcccagccttaacgaagagcaggacaagcgattcatctgcaagcactccatggtggaccggggctgggggaacggctgtgggcttttcggcaagggcgggatcgtgacttgtgcgatgtttacgtgcaaaaagaacatggagggcaaggtggtgcagcccgagaatctggaatacaccatcgtcatcacgccccacagcggagaggagcacgccgtggggaacgataccgggaagcacgggaaagagatcaagatcacgccgcagtcctctatcaccgaggccgagctgaccgggtacgggacggtgacaatggagtgctcaccccgcacaggactcgacttcaacgagatggtcctgctgcagatggaggacaaggcctggctcgtgcaccggcagtggttcctggacctgcccctcccctggctgccgggggccgatacgcagggcagcaactggatccagaaggagactctcgtgaccttcaagaatccccacgcgaagaagcaggacgttgtggtcctagggtcccaggagggcgcaatgcacaccgccctgaccggggccacggagatacagatgagcagcggcaacctcctattcacaggccacctaaagtgccgcctgcggatggacaagctccagctgaaggggatgtcctacagcatgtgcactggcaagtttaagatcgtgaaggagatcgccgagacccagcacgggacgatcgtaatacgggtccagtacgaaggcgacggctcaccttgcaaaatccccttcgagatcaccgaccttgagaagcggcacgtgctagggcgcctgatcaccgtcaacccgatagtcacggagaaggatagccccgtgaacatcgaggccgagcctcccttcggcgactcgtacataatcattggggtggagccgggccagttaaagctcaactggttcaaaaaagggtccagcatcggccaaatgttcgagactacgatgcgcggcgccaagcggatggccatcctgggggacaccgcctgggattttggcagcttagggggcgtcttcacctccattgggaaggccctccaccaggtgttcggagcaatctacggagccgccttctccggggtgtcctggacgatgaagatcctcataggcgtaatcatcacctggatcggaatgaacagccgctctacaagcctgtccgtgagcctggtgctcgtcggcgtggtgaccttgtacctgggggccatggtgcaggcggactccggatgcgtggtgagctggaagaacaaggagctcaagtgcggctccgggattttcattacggacaacgttcatacctggacggagcagtacaaattccagcccgaaagccccagcaagctggcctccgccatccagaaggcccatgaggaaggaatctgcggcatccggagtgtgaccaggctggagaacttaatgtggaagcagatcactccagagctgaaccacatcctgtccgagaacgaggtgaagctgactatcatgaccggcgacattcgggggatcatgcaggccggcaagcgcagcctgcggccacaacccaccgaactgaagtactcctggaagacgtggggcaaggcgaagatgctcagcacagaatcccacaaccagacattcctaatcgacgggccagagaccgcagagtgcccgaacacgaaccgcgcctggaactccctggaagtcgaggactacggcttcggggtgtttaccaccaacatctggctcaagctgcgggagaagcaggacgtgttctgcgattccaagttgatgagcgccgccatcaaggacaaccgcgcggtccacgccgacatgggttactggatcgagtccgccctcaacgacacctggaagatggagaaggcctccttcatagaggtgaagtcctgccactggcccaagagccacaccctgtggtccaacggcgtgctggagagcgagatgatcatccccaagaactttgccgggcccgtctcccagcataactaccggcctggataccacacgcaaaccgcggggccctggcacctcggcaagctggagatggacttcgacctgtgcgaggggaccaccgtggtagtcacggaggactgcggtaaccgaggccccagcctacggaccaccacagcctccggcaagctgattacggagtggtgctgtcggtcctgcaccttgcccccgttgcggtaccgcggcgaagacgggtgctggtacggcatggaaatacgacccctgaaggagaaggaggagaacctggtgaacagcctcgtaaccgcagggcacggccagattgacaacttctccctgggcgtcctggggatggccctattcctggaggagatgctgcgcacccggatcggcacgaagcacgcgatcctcctggtggccgttagcttcgtcaccctcataaccgggaacatgtccttccgcgacctcggccgcgtaatggtgatggtcggggccaccatgacggacgacattggcatgggcgtaacctacctggccctgctcgccgccttcaaggtgcggcccaccttcgccgcgggacttctgctccgcaagttgaccagcaaggaactgatgatggccactatcggaatcgccctcttgtcccaaagcaccatccccgagaccatcctggagctcaccgacgcgctcgccctggggatgatggtcctcaagatcgtgcgaaacatggagaagtaccaattagccgtgacgatcatggccatctcctgcgtcccgaacgccgtgattcttcagaacgcgtggaaggtgtcgtgcaccatcctcgccgccgtcagtgtgagccccctcctgttaacctccagccagcagaaagccgactggatccccctggcgctgacgatcaagggcctcaaccccaccgccatcttcttgaccaccctgtcccgcaccagcaaaaagcggtcctggccgctcaacgaggccattatggccgtaggcatggtatcgatcctggcctccagcctgctcaagaatgacatcccgatgacggggcccctggtggcgggggggctgctcacagtctgctacgtgctgaccggccgcagcgccgatctggaactcgagcgtgccgcggacgtgaagtgggaggaccaggcggagatctccggcagctcccccatcctgagcatcaccatctccgaggacggctccatgtccatcaagaatgaggaggaggagcaaaccctgacaatcctcattcgcaccggcttactggtaatcagcggggtgttcccagtgtccatccccatcaccgcggccgcctggtacctctgggaggtcaagaagcagcgggccggggtgctgtgggacgtgcccagccctccgccggtcgagaaggccgagctggaggacggggcgtacagaatcaaacagcggggcatcctcggttactcccagatcggggccggcgtgtataaggaggggaccttccacacgatgtggcatgttacccgcggagcagtgcttatgcaccggggcaagcgcatcgaaccctcatgggcggacgtgaaaaaggacctgatcagctatggcgggggctggaaactcgaaggcgagtggaaggaaggggaggaggtgcaagtcctggccctggagcccggcaagaacccccgggctgtgcagaccaagcccgggatcttcaagaccaacacgggcaccatcggggccgtgagcctcgacttctcccccggcaccagcggctcccccatcgtcgaccgcaaggggaaggtcgtcggcttgtatgggaacggcgtggttacccggagcggcgcgtacgtgtccgccatcgcgcagacggagaaatccatcgaggacaaccccgagattgaagacgacatcttccgcaagaagcggttgaccatcatggatctccatcccggggccggaaagaccaagcggtacttacccgccatcgtccgggaggccatcaagcgcgggctgcgaaccctgatcctcgccccgacgcgggtggtggcggccgagatggaggaggcactgcgcggcctgcccatccggtaccagaccaccgccatcaagaccgagcacacgggtcgtgagatagtcgacctcatgtgccacgccacctttaccatgcggctgctgagccccgtgcgcgtgcccaactataacctcatcatcatggacgaggcgcacttcaccgatccggcctccatagccgcccggggctacatcagcacgcgcgtcgagatgggcgaggccgcggggattttcatgaccgccacgccgccggggtcacgggaccccttcccgcagagcaacgcccccatcatggacgaggagcgcgaaatcccagagcggtcctggaatagcgggcatgaatgggtgaccgattttaagggaaagacggtttggtttgtcccctcgatcaaggccggtaacgacatcgcggcctgcctgcgcaagaacgggaaaaaagtcatacagctgagccggaagaccttcgactccgagtacgtcaagacccgcgctaacgactgggacttcgttgttaccactgacatcagcgaaatgggtgccaacttcaaggccgagcgggttatcgacccgcgcaggtgcatgaagcccgtcatcctcaccgacggggaagagcgcgtgatcctggccggccccatgcccgtgacccactcgagcgccgcacagcggcgcggacgcatcggccggaatccgaagaacgagaatgaccagtatatatacatgggggagccactggagaacgacgaggactgcgcacactggaaggaggccaagatgctcctggacaacatcaacacccccgagggaatcatcccctccatgtttgagcccgagcgcgagaaggtcgacgccatcgacggggagtaccggctgcgcggggaggctcggaagacgttcgtggacctcatgaggcggggcgatttacccgtgtggctggcatacaaggtcgccgccgaggggataaattacgcggaccgcaaatggtgcttcgatggcattaagaacaaccagatcttggaggagaacatggaggtggagatctggactaaagagggggagcggaagaagctgaagcctcgctggctggacgcccggatctacagcgacccgctcgccctgaaggagttcaaggagttcgccgcgggcagaaaatcactgaccctcaacctcatcaccgagatgggccgactgccaactttcatgacccagaaggcccgcaatgctctcgataacctggccgtgctgcacacggccgaggccgggggccgggcctacaaccacgccctcagcgaactgccggagactctggagacgctcctgctgctcaccctgttggccaccgttaccggcggcatcttcctgttcctgatgtcaggtaaggggatcggcaagatgaccctcggtatgtgctgtataatcacagccagcatcctcctttggtacgcgcagatccagccccactggatcgccgccagtatcatcttggagttcttcttgatcgttcttctgatcccagagccggaaaagcagcgcacgccccaggacaaccagctcacctacgtcgtgatcgccatcctgacagtggtcgctgcgacgatggccaacgagatgggcttcctggagaagacgaaaaaggatctcgggctgggcagcatcaccacccaagagagcgagagtaacatcctggatatcgacctcagacccgcctcagcatggacgctgtacgccgtggcgaccaccttcgttaccccgatgttacgccactccattgagaacagctccgtcaacgtgagcctcacggccatagccaaccaggctaccgttctgatgggcctggggaagggatggcccctctccaagatggacatcggggtccccctgctggcgatcggctgctactctcaggtgaaccccatcaccctgaccgccgccctgctgctcctggtggcccactacgcaatcatcggtccgggcctgcaggcgaaggcaacgcgggaggcccaaaagcgcgctgccgcgggcatcatgaagaaccccaccgtggacggtatcaccgtgatcgacctcgagccaatcccctacgatccgaagttcgagaagcagctgggacaggtgatgctgctcatcctgtgcgtcacccaggtgttaatgatgcggacgacctgggccctctgcgaggcccttaccttggccaccgggcccatatcaacgctctgggagggcaacccagggcgtttctggaacaccacgatcgccgtaagcatggctaacatcttccgaggctcctacttggccggcgccgggctcctgttcagcatcatgaagaacaccacgaacacgcggcgcggcaccgggaacatcggcgagaccctgggcgaaaaatggaagtcccggctgaacgctctcggcaagtcggagttccaaatatacaagaagtccggcatccaggaggtcgacagaacgctggcgaaggaggggatcaagcggggcgagacagaccaccacgccgttagccgcgggtctgccaagctgcggtggttcgtggagcgcaacatggtgacccccgagggcaaggtcgtggacctcggctgcggtcggggcggctggagctactactgcggcgggctgaagaacgtccgcgaggtgaagggcctcacgaagggggggccgggccacgaggagcctatccccatgtccacatacgggtggaacttggtgcggctgcagagcggcgtcgacgtgttcttcacgccgcctgagaagtgcgacaccctgctctgcgacatcggggagtcatccccgaatccgaccatcgaggccggccggaccctgcgggtgctgaacctcgtcgaaaactggctgaacaacaacacgcaattctgcatcaaagtgctgaatccctacatgccgagcgtgatcgagaagatggaggctctccagcgcaagtacggcggggcactggtccggaaccccctctccaggaacagcactcacgagatgtactgggtgtccaatgccacgggcaacatcgtgagctccgtcaacatgatcagccggatgctgatcaaccgcttcaccatgaagcacaagaaggccacgtacgagcccgacgtagacctggggtccggcactcggaacatcgggatcgagagcgagatcccgaacctggatatcatcggcaaacgcatagagaagatcaagcaggagcacgaaacttcctggcactacgatcaggaccacccctacaagacctgggcctaccacggcagctacgagacgaagcagaccgggtctgcaagctccatggtcaatggcgtcgtgaggttgctcaccaagccctgggacgttgtccccatggtgacccagatggcaatgaccgacacgaccccatttgggcagcagcgggtgtttaaggagaaggtcgacacccggacgcaggaacctaaggagggaaccaagaagctgatgaaaatcaccgcagagtggctgtggaaggagttgggcaagaagaagacgccccggatgtgcacgcgcgaggagttcacccggaaagtgcgcagcaacgccgcgttgggtgctatctttaccgacgagaacaagtggaagtccgcgcgggaggccgtggaggacggccgcttctgggagctcgttgaccgggagcgtaacttacacctggaggggaagtgcgaaacctgcgtgtacaacatgatgggcaaacgggagaagaagctgggggagttcggcaaggcgaaggggagccgcgccatctggtacatgtggctcggtgcgcggttcctggagttcgaggccctgggattcctcaacgaggaccattggttctcccgcggcaacagcctgagcggcgtggagggcgagggcctgcaccggcttggatacatactgcgcgacgtcgggaagaaagagggcggggccatgtatgccgacgacacagcagggtgggacacgcggattacgctggaggacctcaagaatgaggagatggtgaccaaccacatgaagggggagcacaagaagctggcggaggccatcttcaagctgacgtaccagaacaaggttgttagagtgcagcggcccaccccccgaggcaccgtcatggacatcatctccagacgcgatcaacgcggcagcgggcaggtcggcacctacgggctcaacacgttcaccaacatggaggcccagctgatccggcaaatggagggcgagggcatcttcaagtccatccagcacctgaccgccaccgaggagatcgccgtgcagaattggctcgcgcgcgtcgggcgggaacgcctaagccgaatggccatttccggcgacgattgcgtggtgaaaccgattgacgaccgattcgccagtgccctgacggccctcaacgacatggggaaggtccggaaggacatacagcagtgggagccctcccgcggctggaatgactggacccaggtgcccttctgcagccaccacttccacgagctggtaatgaaggacggtcgggtcttagtggtgccgtgccgcaaccaggacgagctcatcggacgggcgcgcatctcccagggcgccgggtggagcctgaaagagaccgcctgcctgggcaagtcgtacgcacagatgtggaccctcatgtacttccaccggcgcgacctgcggctggcggcgaacgccatctgcagcgccgtaccctcccactgggtgcccaccagccgcactacctggtccatccacgcgaagcacgagtggatgaccaccgaggacatgctagcggtgtggaaccgtgtctggatacaggaaaacccgtggatggaggacaagacgccggtggagagctgggaagaagtgccctacctggggaagagagaagaccagtggtgcggctccatgatcgggctgacctctcgggccacatgggccaagaacatccagaccgccatcaatcaggttcgcagcctcatcggcaacgaggagtacacggattacatgccttccatgaagcgctttcggcgcgaggaggaggaggccggcgtgctgtggtag

SEQ ID NO: 25076 - RNA, 9876 nt, synthetic construct
  misc_feature 1..9876: note = derived and/or modified CDS sequence (opt11) from DENV-2__EU482680__SS-prME
  source 1..9876: mol_type = other RNA
acagctggtgtaatcgtcatgctgatccccaccgccatggcgttccacctcaccacccgcaacggcgagccccacatgatcgtgggccggcaggagaaggggaagtcactgttgttcaagaccgaggacggggtgaatatgtgcactctcatggccatcgacctgggggagctgtgcgaggacaccatcacctacaagtgccccctcctgagacaaaacgagccggaggatatcgactgctggtgcaactccactagcacctgggtaacatacggcacttgcaccaccacgggcgagcaccgccgcgaaaaacggagcgttgccctggttccgcatgtcggcatgggtctagagacccgcaccgaaacatggatgagcagcgagggggcgtggaaacacgtacagaggatagagacatggatcctgcgccacccgggcttcacgataatggccgctattctggcgtacaccatcgggaccacgcacttccaaagggccctcatctttatccttctgaccgccgttgctcccagcatgaccatgcgctgcatcggcataagcaaccgtgacttcgtcgagggcgtgagcgggggatcctgggtcgacatcgttctcgaacatggcagctgcgtgacgacgatggccaagaataagccgacattagacttcgagctgatcaagaccgaagctaagcaacctgccactctccgcaagtattgtatcgaagccaagctgaccaacaccacaacggaatcccggtgccctacacagggcgagccaagcctgaacgaggagcaggacaagcgctttatctgcaaacattcaatggtggaccggggctggggtaatggctgtgggctgttcggcaagggcggaatagtgacctgcgcgatgttcacgtgcaagaagaacatggaaggcaagatcgtgcagccggagaatcttgaatacaccatagtgattacgccccactcaggggaggagcatgccgtcgggaatgataccggaaagcacggtaaggaaataaagatcacaccgcagtccagcatcaccgaagccgagctgaccgggtacggaacagtgacgatggagtgcagcccccgcaccggcctcgacttcaacgagatggtgctgctgcaaatggaggacaaagcctggctcgtccaccggcagtggttcctggatctgcccctcccatggttaccaggtgcagacacccagggctcaaactggatccagaaggagacgctggtgaccttcaagaacccccacgcgaagaagcaggacgtggtcgtgctcgggtctcaagagggcgcaatgcacaccgccttgaccggggccacggaaatccagatgagcagcggtaacctcttattcaccggccatctgaagtgccgcctgcggatggataagctacagctgaaggggatgtcctattcgatgtgtaccgggaagttcaaaatcgtcaaagaaatcgcggagacccaacacgggacgatcgtgatccgcgtccaatacgagggcgacggctccccctgtaagataccattcgagatcactgaccttgagaagcgccacgtcctcgggagactgatcactgtgaacccgatcgtgaccgagaaggactcgccggtcaacatcgaggcggagccgccgttcggggactcctacatcatcatcggggtggagccaggccagctgaagctaaattggttcaagaaggggagctccataggtcagatgttcgagactacgatgcgaggcgccaaacggatggccatactgggagacacagcctgggactttgggagcctaggtggcgtgttcacgtcgatcggcaaggctttgcaccaggtttttggagcgatatacggtgccgcattcagcggggtgtcctggacgatgaagatcctgatcggggtgataatcacctggattgggatgaacagccgatccactagcttatccgtatcgctggtactcgtgggcgtcgtgacactgtacctaggggctatggtacaggcggactccggctgtgtggtaagctggaagaacaaggaattaaagtgtggcagcggcatcttcatcaccgacaacgtgcatacctggacagagcagtacaagttccagcccgagagtccctccaagctggccagcgccatacagaaagcccacgaggaggggatctgcgggatacggtcggtaacccgactggagaacctgatgtggaagcagatcacgcccgagctgaaccatatcctgtcagaaaacgaggtgaagttgacgatcatgaccggcgacatccggggcatcatgcaagccggcaagcgcagcctgcgcccccagcccaccgagctgaagtactcctggaagacgtggggcaaagctaagatgctcagcaccgagtcccacaaccagacgtttctgatcgatgggcctgagaccgccgagtgcccgaacacgaaccgcgcttggaacagcttagaagtagaggactacggcttcggggtctttaccaccaacatctggctcaagctacgagagaagcaggatgtgttctgcgactccaagctgatgagcgccgcaatcaaggataatcgagcggtccacgccgacatgggctactggatcgaatccgccctcaacgacacctggaagatggagaaggccagcttcatcgaggtcaagagctgccattggcccaaaagccacacactgtggagcaacggtgtgctggaaagcgagatgatcatccccaagaacttcgccggccccgtatcccagcacaactaccggcccggctaccatacgcagaccgcggggccctggcatctaggcaaactggaaatggatttcgatttgtgcgaggggaccaccgtggtagtgacggaggactgcgggaacaggggccccagcctcaggaccacgaccgccagcggtaaattgatcacggagtggtgctgccgctcctgcaccctgcccccgctccggtaccgcggcgaagacgggtgttggtacggcatggagatccggcccctgaaggagaaggaggaaaacttagtcaatagcctcgtgaccgccgggcacggccagatcgacaacttctctctgggagtgctgggtatggccttattcctggaagagatgctacgcacccgcataggtacgaagcacgcgatactcctggtcgccgtgtcattcgtgaccctgatcacagggaatatgagcttccgcgacctcgggcgcgtcatggttatggtgggggcaaccatgacggatgatattggcaccggtgtcacctacctcgccctgctcgccgccttcaaggtgcggcccacgttcgccgccgggctcctgctccgcaagctgacgtcaaaggagctgatgatggcgaccatcggaatcgccctgctgtcccagagcacaatccccgagactatcctggagttgacggacgccctggccctggggatgatggtgctcaagatcgtccggaatatggaaaagtaccaactggccgtcactattatggccatttcatgcgttccgaacgccgtcatcttgcagaatgcatggaaggtcagctgcaccatccttgccgccgtaagtgtctctcccctgctcctcacctcctcccagcagaaggcagactggattcctctggcgttgacgatcaagggcctgaaccccaccgccatcttcctgaccactctgtcacgaacaagcaagaagcgtagttggccgctcaacgaggccatcatggccgtgggcatggtgagcatcctggcctcctctctgctcaagaacgacatcccaatgaccggacccttagtggcgggcggtctgttgactgtgtgctatgtcctgaccggtcgcagcgccgatctggagttagagcgggccgccgacgtgaagtgggaagatcaggccgagatctccggaagctcccctatattgagcatcacgatttccgaggatggctcgatgagcattaaaaacgaagaggaggagcagaccctgaccatcttaattaggactgggctactggtgatctcgggggtattcccggtgtccatccccatcaccgcagcagcttggtacctctgggaggtcaaaaagcagcgggccggagtactgtgggacgtgcccagcccgccgcccgtggaaaaagccgaactggaggatggggcgtacaggatcaagcagcggggcatcctcgggtactcccagatcggcgctggcgtctataaggagggaacgttccacaccatgtggcacgtgacccgcggtgccgttttgatgcacagggggaagagaatcgagccctcctgggccgacgtaaagaaagacctgatttcctacggcggaggctggaagttggaaggcgagtggaaggagggggaggaggtccaggtgctggccctggagcctggcaagaatccccgggctgtacagactaaacccggaatcttcaagacgaacacgggcaccattggagccgttagcttagactttagtcccggcaccagcggctcccctatcgtggaccgcaaggggaaagttgtaggcctgtacgggaacggcgtggttacgcggagcggagcgtatgtgtccgcgatcgcgcagaccgagaagtccattgaggacaacccggaaatcgaggacgatatcttccgaaagaagaggcttaccataatggacctccacccgggagccggcaagaccaaacgctacctacccgccatcgtgagagaggccatcaagcgcgggctgagaacgttgatcttagcgccgacccgggtcgtcgcagccgagatggaagaggcgctgagaggtctgcctatccgataccagaccacagccatcaagacggagcacactgggcgcgagatcgtagacctcatgtgccacgcgacattcactatgcgactgctgagcccagtccgcgtgcccaactacaacctgattatcatggatgaggcgcatttcactgatccggcctccattgcagcacgcggctatatcagcaccagagttgagatgggcgaggccgcggggatctttatgacagccacgccgcccgggtcacgggacccctttccgcagtctaacgctcccatcatggacgaggagcgcgaaattcccgagcgctcgtggaacagtgggcacgagtgggtcactgatttcaaaggcaagaccgtgtggtttgtgccatccatcaaggccgggaatgacatcgctgcttgtttaagaaagaacggcaagaaggtcattcagctgagccggaagaccttcgactccgaatatgtgaagacacgcgccaacgactgggacttcgtggtaacgacagacatcagcgagatgggcgcaaacttcaaggcagagcgggtgatcgacccacgcagatgcatgaagcccgtgatcttaacggacggagaggagcgcgtcatcctggcgggcccaatgcccgttacccactccagcgccgcccagcgtagaggaaggatcggccgaaacccgaaaaacgagaacgaccagtacatctacatgggcgaacccctggagaatgacgaagactgcgcccactggaaggaggccaagatgctcctggacaacattaacacaccagagggcattatcccatccatgttcgagccggagagagagaaggtggacgcgatcgacggtgagtacagactgcgtggcgaagcccggaagacctttgtcgacctcatgcgccggggcgacctgcctgtatggctggcctacaaggttgccgctgaggggatcaattacgccgaccgcaagtggtgctttgacgggattaagaacaaccagatcctcgaggagaacatggaggtggaaatctggaccaaggagggggaacggaagaagctgaagccccgctggctggacgcccggatctactcagacccgctcgccctcaaggaattcaaagagtttgccgcgggccgcaagtccctgactctcaatctgatcacggaaatgggccgactgccaaccttcatgacacagaaggccaggaacgccttggacaatctcgccgtcctgcataccgccgaggccgggggaagggcatacaaccacgccctcagcgagctgccagaaacgctggaaacactcctactcctcactctactggccaccgttaccgggggcatcttccttttcttaatgtccgggaaaggaatcggtaagatgacgctggggatgtgctgcatcatcaccgccagcatcctcctctggtacgcgcagatccaaccccactggatagccgcttccattatcttagagttcttcttaattgtcttgttaattccggagccagagaaacaacgaacgccccaggacaaccagttaacctacgtggtgatcgccatccttacggttgtggccgcgactatggccaacgagatgggctttctagagaagaccaagaaggacctaggtctgggcagcatcaccacgcaggagagcgagtccaacatactggacatcgacctccggccggccagcgcctggactttgtacgccgtcgctaccacgttcgtgacgccgatgcttcgccactccatcgagaatagcagtgtgaatgtctcccttaccgccattgccaaccaggccaccgtgctgatgggcttggggaagggatggccactgtcgaaaatggacatcggggtgccgctgctggcgatcggttgctacagccaagtcaaccccatcaccctcacggccgccctgctcctactggtggcccactacgccataattgggccgggtcttcaggccaaagctacccgggaggcccaaaagcgcgccgccgccggcataatgaagaaccccaccgtggacggcatcactgtcatcgacttggagccgatcccgtacgacccgaagttcgagaagcaattgggccaggtgatgttattaatactgtgcgtcacacaggtcctgatgatgagaaccacctgggccctctgcgaggccctcaccttggccacgggccccatcagtaccctgtgggagggcaacccaggccgattctggaacactaccatcgcagtgtctatggcgaacatcttccgaggtagttacctcgccggcgcgggtctcctgttcagtatcatgaagaacacgacaaacacccgcaggggcaccgggaacatcggcgagacgctgggcgagaagtggaaatcccggctgaacgccctcggcaagagcgagttccagatatacaagaagtccggaatccaggaagtggaccgcaccctggcgaaggagggcatcaagcgaggcgaaaccgaccatcatgccgtaagccgcgggtccgcgaagctgcggtggttcgtggagaggaatatggtaacccccgagggcaaggtcgtagatctaggctgtggccgaggcgggtggagctattactgcgggggcctgaagaacgtccgcgaggtcaagggcttaacgaagggcgggccgggtcatgaggagcccatccccatgtccacttatgggtggaatctcgtgcggttacaaagcggcgtcgacgtctttttcacgcctcctgagaaatgcgacaccctactatgcgatattggggagagctcccccaaccccaccattgaggcgggccgaacactgagggtgctgaacctcgtagagaattggttaaacaacaacacccaattctgcattaaggtcctgaatccctacatgccttctgtcatcgagaaaatggaggcactccagcgtaaatacggcggtgcgctggtgcggaaccccttatcccgcaacagcacccatgaaatgtactgggtcagcaatgccaccggcaacatcgtgtcttccgtcaacatgatcagccggatgcttatcaacagattcacgatgaagcacaagaaggccacttacgagccggacgtcgacctcggctccggtacccgcaacatcgggatcgagagcgagaagccgaaccttgacatcatcggcaaacgcatagaaaagatcaagcaggagcacgagacctcctggcactacgaccaggaccacccctataaaacgtgggcctaccatgggagctacgagaccaagcaaaccgggtccgccagttccatggtgaacggcgtggtccgcctgctgaccaagccctgggacgtggtgccgatggtcacgcagatggcgatgaccgataccaccccctttgggcagcagcgggtgtttaaggagaaggtggacacgcgcacccaggagcccaaagagggaaccaagaagctaatgaaaataaccgccgagtggctgtggaaagagctcggcaagaaaaagacgccccggatgtgcacccgggaggagttcactcgaaaggtccgcagcaacgcggccttgggggcaatcttcaccgacgagaacaagtggaagtccgcgagagaggccgtggaggacggccgattctgggagctggtagaccgtgagcgcaacctccacctcgaaggaaagtgcgagacgtgcgtgtataacatgatgggcaaacgggagaagaagctgggggaattcggaaaggccaagggaagcagagccatttggtacatgtggctcggtgcacggttcttggaattcgaggccttgggatttctcaatgaagatcactggttcagtcgcggtaacagcctgtcaggcgtggagggggagggcctgcatcggctcggctacatcctgagggacgtggggaagaaggaaggtggagccatgtacgccgacgacactgccggctgggacacccgtatcaccctggaagacctcaagaacgaggagatggtcacgaaccatatgaaaggcgagcacaaaaaactcgcagaggccatattcaagctgacctaccagaacaaggtggttagagtccagcggcccaccccccgcggcaccgtgatggacatcatctcccggcgcgatcagcggggcagcggccaggtcggtacgtatggccttaacaccttcaccaacatggaggcccagctgatccggcagatggagggagaaggcatcttcaaatccattcagcacttaaccgcgacggaggagattgccgtgcagaactggctcgctcgcgtagggagggagcgcctgagccggatggccatctctggcgacgactgcgtagttaaaccaattgacgatagatttgcgtcagcccttaccgccttaaatgacatggggaaggtccggaaggacatccagcagtgggaaccctcccgcggctggaatgactggacccaggtccccttctgcagccatcacttccacgagctggtgatgaaggacgggcgggtgttggtggtgccctgccgcaatcaggacgagttgatcggtcgtgcgcgcatctcccagggcgctgggtggagcctgaaggaaaccgcatgtctgggcaaatcctacgcgcagatgtggacactcatgtatttccacagacgcgacctgcggctggcagcaaacgccatctgctcagccgtgccatcccactgggtccccacgagccgcaccacttggtccatccacgctaagcacgagtggatgactacggaggacatgctcgcggtatggaatcgggtatggatccaggagaacccctggatggaggacaagacgccggtggagagttgggaggaggtaccctacctagggaaacgcgaggaccagtggtgcggcagcctcatcgggctcacatctcgggcgacgtgggccaagaacatccagacggccataaatcaggtccgcagcctcatcggcaatgaggaatacactgactacatgcccagcatgaagcgcttccggagggaggaggaggaggccggcgtgctgtggtga

SEQ ID NO: 25077 - RNA, 9876 nt, synthetic construct
  misc_feature 1..9876: note = derived and/or modified CDS sequence (opt11) from DENV-2__EU482754__SS-prME
  source 1..9876: mol_type = other RNA
accgcgggagtgatcgtaatgctgatccccacagcaatggcgttccatctgaccacgaggaacggagagccgcacatgattgttggccgtcaggagaaggggaagtcgctgttgttcaagacagaagacggtgtaaacatgtgtactctcatggcaatggacctgggggagttgtgtgaggacaccatcacctataagtgccccctccttcgccagaacgaacccgaggatattgactgctggtgcaacagcactagcacatgggtcacctatggtacctgcaccactacgggcgagcatcgacgcgagaagcggtcagtggccctagtgccccatgtcggaatgggattggagactcgcaccgagacttggatgtcctccgaaggggcctggaagcacgtgcagcggattgagacttggatcctgaggcaccctggttttactatcatggccgcgatcttagcctacaccattgggaccacccactttcagcgggcattgatattcattctgttgaccgcagtcgcgcctagcatgaccatgcggtgcatcggcatctcgaaccgggactttgtagagggagtaagtgggggctcctgggtggacatcgtcctcgaacacgggagctgtgtcaccaccatggccaagaataagcccacattggacttcgagctcatcaagaccgaggctaaacagcctgccacgctccgcaagtattgcatagaggccaagctgacgaacacgaccacagaatcccggtgccccacgcagggcgagccctccctgaacgaggagcaggataaacgtttcatttgcaagcacagtatggtggaccggggttgggggaacggttgcgggttatttggcaagggagggatcgtaacctgcgcgatgtttacgtgcaagaagaacatggaggggaaggtggtccagcccgagaacttagaatacactatcgtcatcacgcctcacagcggggaggagcatgctgtggggaacgacaccggcaaacacggcaaggagatcaagatcacgccacagtccagcattaccgaggccgaactgacagggtacggcacggtgaccatggagtgcagcccccgcacgggcctggatttcaacgagatggtcctcctgcaaatggaggacaaagcctggcttgtgcaccggcagtggtttctggacctgcccctcccctggctgccgggggccgacacccagggttccaattggatccagaaggaaacgctggtgaccttcaagaatccgcatgcaaagaagcaggacgtagtggtcctcggatcccaagagggcgctatgcacaccgccctaacgggggccacggagatccaaatgtcaagcgggaacctccttttcaccggccacctaaagtgccgcctgcgtatggataagctccagctcaaggggatgtcctacagcatgtgcacaggcaagttcaagattgtgaaggaaattgccgagacacagcacggcacgatagtgatccgggttcagtacgagggcgacggaagtccgtgcaagattcccttcgagatcaccgatctggaaaagcggcacgttcttgggcgtcttatcactgtaaaccctatcgtaacggagaaagacagcccagtgaacatcgaagctgagccgccgtttggggactcctatatcatcataggggtggaaccgggacaactgaagctgaattggtttaagaaaggcagctccattggccagatgttcgaaacaacaatgcgcggcgctaagcggatggccatcctgggggacaccgcctgggactttggcagcctcgggggcgtcttcacgtccataggaaaggccctccaccaggttttcggggccatctacggagccgcgttcagcggggtgtcctggacgatgaagatcctgattggcgtcattataacgtggataggcatgaacagccgctccacctctctgtccgtgagcctggtcctcgtcggcgtagttaccctgtacttgggcgcaatggtccaggcggactctggctgtgtggtgagctggaagaacaaggagctcaagtgcggctccgggatcttcatcacggataacatccacacctggactgagcagtacaagtttcagccagaatccccatcaaagctggcctcggccatccagaaggcccacgaggagggtatatgcggcatccggagcgtcaccagactggagaacttgatgtggaagcaaattacgcccgagctgaaccacatcctgtcggagaacgaggtgaagttgaccatcatgacaggcgacatccggggcatcatgcaagccggtaagcgaagtttaagacctcaacccaccgagctgaagtattcctggaagacgtggggtaaagctaaaatgctctcaacagaatcacataaccagacgttccttatcgacggcccggagaccgcggagtgtcctaataccaatagagcctggaacagtctggaagtggaagactacggcttcggggtctttaccaccaatatctggctcaagctgcgggagaaacaggacgtgttttgcgattccaagctgatgagcgcggccataaaagacaaccgcgcggtccacgccgatatgggctactggatcgagtccgcactaaacgacacgtggaagatggagaaagccagcttcattgaggtgaaaagctgtcactggccgaaaagccacaccctgtggtccaacggcgtgctggaatcagagatgatcatccccaagaacttcgccgggcccgtttctcagcacaactaccggccggggtaccacacccagacagcggggccgtggcatctcggcaagttggagatggattttgatctttgcgaagggaccaccgtcgtggtgacggaggattgcggcaaccgcggccccagcctccggactaccacggccagcggtaagctcatcacggagtggtgttgccgctcctgcacactgcccccgctccggtacaggggcgaggatgggtgctggtacggaatggagatccggcccctgaaggagaaggaggaaaatcttgtgaatagcctcgtgaccgcaggacacggccagattgacaacttctccctgggcgtgctggggatggcactcttcctggaggagatgctgcggacccggatcggcacgaagcacgccatcctcctggtagctgtttctttcgtgaccttgatcactgggaacatgtcctttcgcgacttaggccgcgtcatggtgatggtgggagccacgatgacagatgatatcggcatgggggtgacctacctggccctgctagctgcgttcaaggtacggccgacctttgctgccggactgctgctccgcaagctgaccagcaaggagctgatgatggccaccatcggaatcgcgttactttcccagagcaccatccccgagacaatcctggaactcaccgacgcactggcgctggggatgatggtcctcaagatcgtccggaacatggagaaataccagctagcggtgacaattatggccatctcctgcgtgcccaacgcagtcatcttacagaacgcgtggaaggtgagttgcaccatactcgccgccgtttctgtcagcccgttactgctcacgtcgagtcagcaaaaagccgactggatcccgctggctctgacaatcaaaggcttgaacccgacggccattttcctgaccacgctttcccgtaccagcaagaaacggtcctggccgctcaatgaggcaataatggccgttggaatggtcagtattttggcctccagcctgctcaaaaacgatattccgatgactggcccgcttgtggcgggcggtctacttactgtctgctatgttctgaccggtcgaagcgccgatttagagctcgaaagggctgccgacgtcaagtgggaggatcaggccgagatttccgggagctcgcccatcttaagcatcacgatctccgaagacggcagcatgtccatcaagaatgaggaggaggaacaaactctgaccatactcatacgaaccggcctcctggtgatctcgggagtttttccggtgtcgatcccaatcacagcagccgcctggtacttgtgggaagtgaagaagcaacgggcgggggtcctttgggacgtcccctccccgccgccggtagaaaaggctgagctcgaggacggggcgtaccggatcaaacagcgggggatcttgggatactcccagatcggagccggcgtctacaaagaggggaccttccacacgatgtggcacgtgacccgcggggccgtgctgatgcaccgggggaagcgcatcgagccgtcgtgggcagacgttaagaaggacctaatctcctacggcgggggctggaagctcgaaggcgagtggaaggagggcgaggaagtccaagtgctggcccttgagccgggcaagaacccccgggcggttcaaacaaagcccgggatcttcaagaccaacacgggcaccatcggggccgtcagcctcgacttctctcccggcaccagcggatcgcccatcgtggaccgaaagggcaaggtagtgggtctgtacgggaacggcgtagtcacacgtagcggtgcctacgtgtccgctattgcgcaaacggagaagtccatagaggacaaccccgaaatcgaggacgacatcttccgcaagaagcggctcactatcatggacctccaccctggggccggcaagactaagcgctatctgcccgccatagtgcgggaggccattaagcgagggctgcgcacgctgatcctcgcgcccactagagttgtggcggccgaaatggaggaggcactgcgcggcctgcccattcggtatcagactaccgcgatcaaaaccgagcacaccgggcgcgagatcgtggacctcatgtgccatgccacattcactatgcggctgctgtctcccgtccgtgtgcccaactacaacctcatcattatggacgaagcgcacttcaccgatccggcctccatcgcagcccggggctatatcagcacgagggtggaaatgggcgaggccgccggcatcttcatgaccgcgacgccgcccggctcccgggatcccttcccgcagagcaacgcccccatcatggacgaggagcgcgagatccccgaacgaagttggaactctgggcacgaatgggtcaccgacttcaagggcaagacggtctggttcgtgcccagcatcaaggccggtaacgacatcgcggcgtgcctacgcaaaaacggcaagaaggtcatccaactgagccgtaagaccttcgatagtgaatacgtgaagacccgcgcaaacgactgggatttcgttgtcaccacggatatcagcgagatgggtgccaactttaaggcagagcgggtgattgacccacgccgttgcatgaaacccgtgatcttaaccgacggagaggaacgagttatcttagccgggccgatgccggtgacccactcctccgccgcgcaacgacgcgggcgcatcggccgaaatccaaagaacgagaatgaccaatacatctacatgggggagcccctggagaacgacgaggactgcgcacactggaaggaggccaagatgctcctggataacatcaacacccccgaaggcatcataccctcgatgttcgagccggagcgcgagaaggtagacgccatcgacggtgaataccggctgcgcggagaggcccggaagacgttcgtagaccttatgcgcagaggggatttacccgtgtggctcgcctacaaggtggcagccgaggggattaactatgctgaccgcaagtggtgcttcgacggcataaagaacaaccagatcctagaagaaaacatggaggtagagatatggacaaaggagggagagcggaagaagctcaagccccgctggctggacgcccggatctacagtgatccgttagcgctgaaagagttcaaggagtttgccgcgggccgcaaatccttaaccttgaacctaattaccgagatggggcggctcccaacatttatgacccaaaaggcacgcaacgcccttgacaacctggctgttcttcacaccgccgaagccgggggcagagcatacaatcacgccctctctgagttaccggagacactagagacgcttttattgctcaccttactggccaccgtaacgggaggcatttttctcttcctgatgtccggcaaggggatcggaaagatgaccctgggaatgtgctgcatcatcacggccagtatcctcctgtggtacgcgcagatccagccccactggatcgccgcctccatcatcctggagttcttcctgatcgtcctgttaatcccggaacctgagaagcaacgcacgcctcaggacaaccagctcacttacgtggtcatcgccatcctgaccgtggtggccgcgactatggcgaacgaaatgggcttcctggagaagaccaagaaggacctaggtctgggcagcataacaacgcaagagtctgagagtaacatcctcgatatcgacttgcggcctgcaagcgcgtggacgttatacgcggtcgcgaccaccttcgtaacgccaatgctgcgccactccatcgaaaattcgtcagtgaacgtcagtttgacagccattgccaaccaggccacggttctgatgggtcttgggaagggctggcctctcagcaaaatggacattggtgttcccctactagctatcggctgttatagccaggtcaaccccataacactcaccgccgcgctgttgctcctggtcgcccactacgctatcatagggcccggcctgcaagcgaaggcaacgcgggaggcccaaaagcgcgctgcagcgggaataatgaagaaccccacggtagacgggattaccgtcatcgacctagagcccatcccctacgacccgaagttcgagaaacagctgggacaggtgatgctgctcattctctgtgtgactcaggttctgatgatgcgtacgacttgggccctctgcgaggcactgacgttggccaccggccccataagtacgttgtgggagggcaaccctggacgcttttggaataccaccatcgcggtgagcatggctaacatcttccgcggctcgtacttagccggcgccgggctactgttctctatcatgaagaacaccacgaacacacgacgcggcaccggcaacatcggcgagacgcttggggaaaagtggaaatcccggctgaacgccctcggcaagtccgagttccagatctataagaaatccggaatccaggaggtggatcgcacactggcgaaggaagggatcaagcggggcgagacggaccaccacgcggtctctcgcggttcggccaaactgcggtggttcgtggagcgcaacatggttacccccgaaggcaaagtggtcgacctcggttgtgggcgaggcgggtggtcatattactgcggaggactgaagaatgtgagggaggtcaaaggccttacaaagggcggaccaggccatgaggagcccatcccgatgtctacgtacggctggaacctagtgcggcttcagagcggcgttgacgtgttcttcactccgcccgagaagtgtgacaccctgttatgtgacatcggggagtcttcccccaatcctacgatcgaagcgggccgcaccttgcgggtccttaacctcgttgaaaactggctgaacaacaacacgcagttctgtatcaaggtcctgaacccgtacatgccatccgtgatcgagaagatggaggccctccaacgtaaatacggcggggctctggtgcgaaatcccttgtccagaaacagcactcacgagatgtattgggtatccaacgccactggcaacatcgtgtcctccgtgaacatgatctcgcggatgctaatcaaccgcttcactatgaagcataagaaggccacgtacgagcccgacgtcgaccttgggtccggcacacggaatatcgggatcgagagtgaaattccgaacctcgacatcatcggcaagcgtatagagaagatcaagcaagagcacgagacttcctggcactacgaccaggaccatccctacaagacgtgggcttatcacggtagctacgaaactaagcagaccgggtcagccagctcaatggtgaacggcgtggtccggctgcttaccaagccctgggatgtggtgccaatggtcacccagatggccatgacggacaccaccccattcggtcagcagcgggtatttaaggagaaggtggacacccgcacccaggagcccaaggaaggtacaaagaagctgatgaagattacggccgagtggctgtggaaggagctcgggaagaaaaagacgcccaggatgtgcacccgcgaggagttcacccgtaaggtccgaagtaacgcggcccttggagcgatcttcaccgacgagaacaaatggaaaagcgcaagagaagctgtagaagatgggcgcttctgggagctggttgacagggagcgcaacctccatctcgaaggcaagtgtgagacttgcgtctacaacatgatgggtaaacgggagaagaaacttggggagttcggcaaagcgaaggggagccgcgcaatctggtacatgtggctgggggcgcggttcctggagttcgaggccctgggcttcctaaacgaagaccattggttctcgcgtgggaacagcctgagcggagtagagggggaaggcctgcaccggttgggttatattctacgcgacgttggcaagaaggagggtggggccatgtacgccgacgacacggcgggatgggacacccggatcacactggaagatctcaagaacgaggaaatggtaacgaatcacatgaaaggagagcacaagaaacttgctgaggccatctttaaactgacgtatcaaaacaaagtggttcgcgtgcaaagaccaaccccgcgcggcaccgtgatggatattatctcccgtagagatcagaggggcagcgggcaagtcgggacttacgggttaaatacttttaccaacatggaagcacagctcatccggcagatggaaggtgagggaatcttcaagtccattcagcacctgaccgctaccgaggagatcgccgtgcagaattggctcgctcgcgtgggaagggaaagactgagccggatggccatcagtggcgatgactgcgtcgtgaaacccatcgacgaccgctttgccagtgcactaacggccctcaatgacatgggcaaggtcaggaaagatatccaacagtgggaaccctcacgcggatggaacgactggactcaggtcccgttttgtagccaccatttccacgagctggtgatgaaagacgggcgggtgctggtcgtaccatgccgaaaccaggatgagctaatcgggcgggcgcggatctcccagggcgccggatggtctctgaaggagacggcctgcctggggaagtcctacgcacagatgtggaccctcatgtatttccaccggcgcgacttacggctggccgccaacgccatctgcagcgctgtcccctcccattgggtccccacctcccgtaccacctggtccatccacgccaagcacgagtggatgaccactgaggacatgttggccgtatggaaccgggtctggatccaggagaacccctggatggaagacaagacaccggtcgagagctgggaagaggtgccatacctggggaagagggaagaccagtggtgcggctctctgataggactaacctctcgggcaacctgggccaagaacatacagaccgccatcaatcaggtccgctcactaatcggcaacgaagaatatacggactacatgccctccatgaagcgcttccggcgcgaggaggaagaggcgggcgtactgtggtga

SEQ ID NO: 25078 - RNA, 9876 nt, synthetic construct
  misc_feature 1..9876: note = derived and/or modified CDS sequence (opt11) from DENV-2__FJ478455__SS-prME
  source 1..9876: mol_type = other RNA
actgccggtgtgatcgtcatgctgatccccaccgccatggcgttccatctcaccactcgcaatggggagccacacatgatcgtcggcagacaagagaagggaaagtctctgctgttcaagaccgaggacggcgttaatatgtgcaccctcatggccattgacctgggggaactgtgcgaggacaccatcacctacaagtgccctctcctgcggcagaatgaacccgaggacatagactgttggtgtaacagcaccagcacctgggtaacctacgggacttgcaccacgactggcgagcaccggagagagaagcggagcgtcgctctggtgccccatgtcgggatgggactggagacccgcaccgagacttggatgagcagcgagggggcgtggaagcacgtccagcggatcgagacctggatcctgcgccacccgggcttcaccataatggcggcgatactggcctacacgatcgggactactcatttccaacgggccctcatcttcattttgctgaccgccgtggcgccctcaatgactatgcgatgcatcggcatttcgaaccgggacttcgttgagggcgtctcagggggaagctgggtggacatcgtcctcgagcacgggagctgcgtcaccacgatggccaagaataagccaaccctcgacttcgagctgataaagacggaggccaagcagcccgctaccctccgcaagtactgcatcgaggccaagctgacgaacaccaccaccgagtcccggtgcccgactcagggggagccctcccttaacgaggagcaggacaaacgcttcatctgcaagcattccatggtggatcggggctgggggaacggctgcggtctcttcggcaagggcggcatcgtgacctgcgcgatgttcacgtgcaagaagaacatggagggcaaggtggtccaacctgagaatttagaatacacaatcgtcattacgcctcacagcggagaggagcatgccgtcggcaacgacaccgggaagcacggtaaggagatcaagatcaccccgcagtcgtccatcacagaggccgaactgaccggctacggcacggtgaccatggagtgcagcccccggactggcttggacttcaacgagatggtcttactgcagatggaggacaaagcctggctcgtccaccggcagtggttcttagacctgcccctaccctggctaccaggggccgacacccagggcagtaactggatccaaaaggagacgctggtaaccttcaagaacccccacgcaaagaaacaagatgtcgtggtccttgggtcccaggagggcgccatgcacaccgctctgaccggggccacggagatccagatgagcagcggcaacctcctgtttacgggccacctgaaatgccgcctccggatggacaagctccagcttaaggggatgtcctacagcatgtgtaccggcaagttcaagatcgttaaggagatcgccgaaacgcagcacggtacgatcgtcatccgtgtccagtacgagggcgatggctccccctgcaagatccccttcgagatcactgacctggagaagcggcacgtgctcggtcgcctaatcaccgtgaaccccatcgtcactgagaaggacagccccgtgaacatcgaagcggagccgccgttcggcgactcctacatcatcatcggggtggagccgggccagctgaagctaaactggttcaagaaggggagcagcatcggccagatgttcgaaacgaccatgaggggtgccaagaggatggccatccttggggacaccgcctgggatttcggcagcctcggcggcgtctttacctcgatcgggaaggccctccatcaggtattcggcgcgatctacggcgccgccttcagtggggtgtcctggaccatgaagatcctgatcggcgttatcatcacctggatcggaatgaatagccgcagtaccagcctgtcagtatcgctggtcctcgtcggtgtggtaaccctttatctgggggcagtcgtgcaggcagactccggctgcgttgtgagctggaaaaacaaagagctcaagtgcggttccggaatcttcatcacggacaacgtgcacacctggacggagcaatacaagttccaacccgagtcacccagcaagctggcctctgcaatacagaaggctcacgaggagggcatctgcgggatccggagcgtgactagactggaaaacctcatgtggaagcaaataacgcccgagttgaaccacatcctctccgagaacgaggttaagctcaccatcatgaccggcgacataaagggtatcatgcaggccgggaaacgctctctacgcccacagcccacagagttaaagtattcctggaagacgtggggcaaggcgaagatgctcagcacagaaagccacaaccagaccttcctgatagatgggcccgagacggtcgagtgtcctaacacgaaccgggcctggaacagcttagaggtggaggactatgggtttggtgtgttcaccaccaacatctggctcaagctgcgcgaaaagcaggacgtgttctgtgactccaaactgatgagcgcggccattaaggacaatcgcgccgtgcatgcggacatgggctactggatcgagtccgccctgaacgacacctggaagatggagaaggcctcgttcatcgaggtcaagtcttgtcactggcccaagagccacaccctgtggtccaacggcgtgttggagagcgaaatgatcataccaaagaactttgccgggcccgtctcccaacataactaccgcccgggctaccacacgcagacggcagggccctggcaccttggcaagcttgaaatggacttcgacttttgcgaagggaccaccgtcgtagtcacggaggactgtggcaacaggggccccagcctgaggacgacgacggcgagcgggaagttaattacggagtggtgctgccggtcctgcaccctgccaccactcagataccggggcgaggacgggtgctggtacggcatggagatcaggcccctcaaggaaaaggaggagaacctggtcaacagcctggtgaccgcggggcacggccagatcgacaacttttccttgggcgttctagggatggccctgttcctcgaggagatgcttcggactcgcattggcacaaagcacgcaatcctcctcgtcgcggtctctttcgtgaccttgatcactgggaatatgtccttccgggacctaggccgcgtcatggtgatggtgggggccaccatgacggacgacatcggcatgggcgtcacctacctggccctgctggcggcattcaaggtgcgccccaccttcgcggccggtctcctactgcggaagctcaccagtaaggagctgatgatggcgacgatcggcatcgccctgctctcccagagcaccatccccgaaaccatactggagctgaccgacgccctcgcacttgggatgatggtcctcaaaatcgttcgtaacatggagaagtatcagctcgcagtgactatcatggcgatctcctgtgtgccgaacgccgtcatcctgcaaaatgcctggaaagtgagctgcaccatcctcgcggcagtctccgtgagccccttgctgttaaccagtagccagcagaaggccgactggattcccttggcccttaccatcaaggggctgaaccccaccgccatattcctcaccaccctgtcgcggacctcgaagaaacgctcatggccgttgaacgaggccatcatggccgtgggcatggtcagtatccttgcctccagcctgctgaagaacgacatacccatgacggggcccttggtagccggagggctgctgaccgtgtgctatgtactcaccggccgctcagcggacctggagctggagcgcgcagccgatgtgaagtgggaggaccaggccgaaatctccgggagctcccccatcctgagcattaccatctccgaggacggcagcatgtctatcaagaatgaggaagaagagcagaccctgacgatccttatccggaccggtctcttggtcatcagcggggtctttcctgtgtcgatcccaatcacggcagcggcctggtacctatgggaggtaaagaagcagcgcgctggcgttctctgggacgttcccagcccgccgcccgtggaaaaggccgagctggaggatggggcctatagaataaagcaacgtggcatcttagggtattcccagatcggcgcgggtgtctacaaggaggggaccttccacactatgtggcatgtcacgcggggcgcggttctcatgcaccgcgggaagcgcatcgagcccagctgggccgacgtcaaaaaggatctcatctcttacggcgggggctggaagctggagggcgaatggaaggagggggaggaggtgcaggtcctcgccctggagcccggcaagaacccccgcgccgtccagaccaagcctggaatctttaagacaaatactggcaccatcggggcggtgtcgctggacttctcccccggcacaagtggctccccgatcgtggaccgcaaggggaaggttgtggggctctacggaaacggcgtggtcacccgctcaggtgcatacgtatccgcaatcgcccagacggagaagtccatcgaggacaacccagaaatcgaggacgacatcttccggaagaagcgcctgaccatcatggatcttcaccccggggcgggcaagaccaaacggtatctccccgccatcgtccgcgaagccataaaacgggggctccgcacccttatactggctccgacgcgcgtcgtggccgcggagatggaggaggctctccggggcttacccatccgctaccaaaccccagcaatcaagaccgagcacacggggcgggagatcgttgacctgatgtgccacgcgacgttcaccatgcgtctcctgagccccgtccgggtgccgaactacaacctgatcataatggatgaggctcactttaccgatccggcctccatcgcagcacgaggctacatcagcactagggtcgaaatgggcgaggccgccggtatcttcatgacagcgacgccgcccggctctagggacccgttcccccaaagtaacgcccccataatggacgaggagagagagatcccggagcgctcctggaacagcggtcacgagtgggtcacagattttaaaggcaagaccgtgtggttcgtgccgtctataaaggcggggaatgacattgcagcgtgcctccgtaagaatggcaagaaggtcatccagttaagccgcaagacgttcgactctgagtacgttaagacccgagccaacgactgggacttcgtagtaaccaccgacatcagcgagatgggcgccaacttcaaggccgagagggtgatcgaccccaggcgctgcatgaagccggtgatcctgacggacggggaggagcgggtcatcctcgccggcccaatgccggtgacacactcctcagcggcccagcgccggggccggatcggccgcaacccaaaaaacgaaaacgaccagtacatctatatgggggagcccttggagaacgacgaagactgcgcccactggaaggaagccaaaatgctgctcgacaacatcaatacccccgagggcatcatcccctccatgttcgagcccgaaagggagaaggtagacgccatagacggggagtaccgcctccgcggggaagcacgcaagaccttcgtcgatctgatgcgccgcggtgacctccccgtatggctggcgtacaaggtggccgccgaggggataaactacgccgaccgtaaatggtgcttcgacggcatcaagaacaaccagatattggaagagaacatggaggttgagatttggactaaggagggggagcgcaagaaactcaagcccaggtggctcgacgcgcgcatctattctgaccccttagccctcaaggagttcaaggaattcgctgccgggcggaagtccctgaccctcaacctcataacagagatgggccggctgcctacgtttatgacgcaaaaggcgagaaacgcactggacaacttggcagtgctgcacaccgccgaggccggggggcgagcgtacaaccacgccctaagcgagctcccagaaacgctggagaccctgcttctgctcacgcttctggcaaccgtcacagggggaatcttcctcttcctcatgtccggcaaaggaatcggcaagatgaccctaggcatgtgctgcataatcacggccagcatcctgctctggtacgcccagatccaaccccactggatagcggcctccatcatcttagaattcttcctgatcgtgctcctgatcccagagcccgagaagcagcggacgccgcaagacaaccagctgacctatgtggtcattgccatcctcacagtggtggccgccaccatggcgaacgagatgggcttcctagagaaaacgaaaaaggacttggggctgggctccattaccacccaggagtctgaatcaaacatactggacatcgatctgcgcccggccagcgcttggaccctctacgccgtcgccacgaccttcgtgacgcccatgctgcggcacagtatagagaacagctccgtgaacgtttcgttgaccgcgatcgccaaccaggccacggtgcttatgggtcttgggaaaggctggcccctgtccaagatggacatcggggtgccgttgttagcgatcggctgctattcgcaggtgaacccgatcacactgacagcagccctcctgctactcgtggcccattacgccattataggtcccggtctgcaggccaaggccactcgcgaggctcaaaagcgggccgctgccgggatcatgaagaaccccacggtggacggaatcaccgtaatcgacctggaaccgataccttacgatccgaagtttgagaagcagcttggtcaggtgatgctgctgattctctgcgtgacgcaggtcctgatgatgcgcaccacgtgggcgctctgcgaggccctcacgctggccaccgggcccatctccaccctgtgggagggtaacccggggcggttctggaacactaccatagcggtctctatggccaacatcttccgcggctcatatttagctggcgccgggctgctgttcagcatcatgaagaataccacctccacgcgccggggcaccgggaacatcggggaaactctcggggagaagtggaagtcccggctgaatgccctcggcaagtccgagttccagatctataaaaagtccggcatccaggaggtggaccggactcttgccaaggaggggatcaagcgcggagagacggaccaccacgcggtctctcgggggtcggctaagctgcgatggttcgttgagcggaacatggtgacccccgaaggcaaggttgtggacctgggctgcggacgcggtgggtggtcctactactgcggcgggctcaagaacgtgcgggaggtcaagggcctgaccaagggtgggcccggccacgaagagccaatcccaatgtcgacctacgggtggaacttggttcgcctccagagcggagtggacgtcttcttcacgcctccggagaagtgcgacaccctactgtgcgacatcggggagtccagccccaaccccaccatcgaagccggccgcacactccgcgtattgaaccttgtggagaactggctcaacaacaacacccagttctgtatcaaggtcctgaacccgtacatgccctccgtgatcgagaagatggaggccctgcaacggcagtacggtggggctctcgtgcgcaaccctctgagccggaattccactcatgagatgtactgggtcagtaacgccaccggcaacatcgtctccagcgtgaacatgatctcccgcatgctcatcaaccggttcaccatgaagcacaagaaggctacttacgagcctgacgtcgacctggggagcggaactagaaacatcgggatcgagtctgaaatccctaatcttgacatcataggcaagcggatcgagaagatcaagcaggagcatgagatcagctggcactacgaccaagaccacccctacaagacctgggcctaccacggctcctacgagaccaaacaaaccgggagtgcttccagcatggttaacggggtggtcagactattgacgaagccctgggatgtggtgccgatggtcacccagatggccatgacggacactacgcccttcgggcaacagcgcgtgttcaaggaaaaggtggatacaaggactcaggagccaaaggagggtaccaaaaaactcatgaagatcactgccgagtggctatggaaggaattaggcaagaagaagacgccccgcatgtgtacccgtgaggagttcacccgcaaggtccggtctaatgccgctttaggagccatattcacagacgagaacaagtggaagtccgcgcgcgaagcggtggaggacggccgcttctgggagctggtggaccgcgagaggaacctgcacctcgagggcaagtgcgagacctgcgtctacaacatgatgggcaagagggagaagaagctgggggagtttggcaaggcaaagggctccagagccatctggtacatgtggctaggggccagattcctcgagttcgaggcgctgggcttcctgaacgaggaccactggttcagccggggaaattctctctccggagtcgagggggagggcctgcaccgcctgggctacatcctccgggacgtcgggaaaaaggagggcggggccatgtacgccgatgacaccgccggctgggacacacgcatcacgcttgaggaccttaagaacgaggagatggtgaccaaccatatgaagggtgaacacaagaaattggccgaagcgatctttaagctgacctaccaaaacaaggtggtccgagtgcaacggccgacgcccagaggcacggtaatggacatcatcagccgccgggaccagcgcggcagcggtcaagtcggcacctacggtctgaacacttttacaaacatggaagcccagctcatcagacagatggagggcgaaggcatattcaagtcgattcaacatctgacggccaccgaagagatcgccgtacaaaactggctggcacgggtgggtcgtgagcggctctcccgaatggcgatcagcggcgacgactgcgtcgttaagcccatcgacgacagatttgcctccgccctgaccgcactgaacgacatggggaaagtgcgtaaggacatccaacagtgggaaccctcacggggatggaacgactggacccaggtcccgttctgttctcaccacttccatgagctcgtgatgaaggatgggcgcgtgctggtcgtgccttgccgaaaccaggacgagctaataggcagggcccgaatctcgcagggtgcggggtggtccctcaaggagacggcctgcctgggtaagtcatacgcccagatgtggaccctcatgtatttccaccgtcgggatctccgcctggccgccaacgctatctgctccgctgtgcccagccactgggtacccacctcccgtacaacctggagtatacacgccaagcacgagtggatgacgaccgaagacatgctggccgtttggaaccgcgtttggatccaggagaacccgtggatggaggacaagacacccgtcgagtcctgggaggaagtgccatacctcgggaagcgggaggatcagtggtgcggcagcctgatcggcctcacctcacgcgctacgtgggctaagaacattcaggccgcaatcaaccaagtgcggtccctcataggtaacgaggaatacaccgactacatgcccagcatgaagcgcttccgccgggaggaggaggaggccggggtcctgtggtag

SEQ ID NO: 25079 - RNA, 9876 nt, synthetic construct
  misc_feature 1..9876: note = derived and/or modified CDS sequence (opt11) from DENV-2__EU482756__SS-prME
  source 1..9876: mol_type = other RNA
accgcgggggtgatcgtcatgctgatccccacagctatggcgtttcacctcacgacacgcaatggggagccgcacatgatcgtgggccggcaggagaagggtaagtccctactgtttaagaccgaggatggcgtgaatatgtgcaccctcatggccatagacctgggggagttatgtgaggacaccatcacctacaagtgccccctcctgcgccagaacgagcccgaagatatcgactgctggtgcaactcgacctctacctgggtcacctacgggacttgcaccaccacgggcgagcaccggcgggagaagcggtccgtggcactggtgccccacgtcggaatgggtttggagacccgcaccgagacctggatgtcatctgagggcgcatggaagcacgtgcagcggatcgagacctggatattgcgacacccgggctttaccataatggccgcgatcctcgcctacaccatagggaccacccactttcagcgggccctcatattcatcctgttgaccgccgtggcgcccagcatgaccatgcgttgtatcggcatctccaatcgggacttcgtcgagggcgtgagcggtgggtcctgggtggatatcgtcctcgaacacgggagctgcgtaaccacgatggccaagaacaaacccacgctggacttcgagttaatcaagacggaggccaagcagcccgctaccctacgcaagtactgcatagaggccaagctgaccaacactacgaccgagtcacggtgcccgacgcagggcgagcctagcctcaacgaggagcaggacaagcgcttcatctgcaagcattccatggttgaccgggggtgggggaatggctgcgggttattcggcaagggcgggatcgtgacctgtgcgatgttcacgtgtaagaagaacatggaaggcaaggtggtgcagcccgagaatcttgagtataccatcgtcatcacgccacacagcggcgaggagcacgccgtgggcaacgacaccgggaagcacggcaaggaaatcaagataacaccgcagtccagcatcacggaggccgagctgacagggtacggaaccgtgaccatggagtgcagcccacggaccggcctagacttcaacgagatggttctgctgcagatggaggacaaggcttggctcgtgcaccggcagtggttcctggacctgcccctcccctggctcccgggggccgacacacagggtagcaactggattcagaaggagacgctggtgaccttcaagaacccccacgcgaagaagcaggatgttgtcgtcctggggtcccaggagggcgcgatgcacaccgccctgaccggggccacggagattcagatgagctcgggtaatctcctattcaccggccacctgaaatgccgtttacggatggacaagctgcagctgaaggggatgtcatacagcatgtgcaccggaaaattcaagatagttaaggagatagccgaaacccagcacggaaccatagtgatacgggtacagtacgagggcgacggttccccatgtaaaatccccttcgagatcaccgacctggagaagcggcacgtgctcgggcgtttaatcaccgtgaacccgattgtcaccgagaaggacagccctgttaacatagaggcggagccgccatttggcgatagctacatcataataggagtggagccgggccagctgaagctcaactggttcaaaaagggaagcagcatcggccagatgttcgagacgaccatgcgcggcgcaaaacggatggccatcctgggggataccgcctgggattttggcagcctcggaggggtcttcacctccatcgggaaagcactacaccaagtattcggagcgatttacggcgctgccttctccggggtgagttggacgatgaagatcctgatcggcgttatcatcacctggatcgggatgaactcgcgctctacctccctgtccgtgagcctggtgctcgtcggcgtggtgaccctgtacctgggcgccatggtccaagcggactccggttgcgtggtgtcctggaagaacaaggaactcaagtgtggcagtgggatctttatcactgacaacgtccacacatggactgagcagtacaagttccagcccgagtcacccagcaagctggcatccgccatacagaaggcacacgaggagggtatctgcgggatccggagcgtaacccggctggagaacctcatgtggaagcagatcacacccgagttaaaccacatactgagcgagaatgaggtgaagttaacaatcatgaccggagatatccgggggatcatgcaggctggcaagcgcagcctgcggccccagccgaccgaactgaaatacagctggaaaacgtggggcaaggcgaagatgctcagcaccgagagccacaatcagaccttcctgatagacggtcccgaaaccgccgagtgccccaatacaaatagggcctggaacagccttgaggtcgaggactacggctttggagtgtttaccaccaacatctggttaaagctgcgggagaagcaggacgtcttctgcgactccaagctcatgagcgccgccatcaaggacaaccgcgcggtccacgccgatatgggctactggatcgagtccgccctaaacgacacctggaagatggagaaggcctctttcatcgaagtgaaatcctgtcattggcccaaatcccacaccctgtggtcgaacggagtgctcgagagcgagatgatcatcccgaagaatttcgccgggcccgtctcccagcacaactatcggccgggctaccatacacagaccgcggggccatggcacctgggaaagctagagatggacttcgacctgtgcgaagggacaaccgtggttgtcacggaggactgcggcaaccgcggccccagtttaaggacaaccacggccagcgggaaactgattacggagtggtgctgtcgctcctgtaccctccctccgctgcggtatcgcggcgaggacgggtgctggtacggcatggagattcggcccttaaaggagaaggaggagaacttggtaaactcgctcgtgacggctggacatggccagatcgacaacttcagtcttggcgtacttggtatggccctcttcctggaggagatgctgcgaacccggatcggcacgaagtatgcgatccttctggtggccgtgagcttcgtaaccctgatcaccgggaacatgtccttccgagatctcggccgagttatggtgatggtaggggccactatgactgacgatatcggcatgggggtgacctatttagccctgctcgctgcgttcaaggtacggcccaccttcgccgccgggctgctgctccgcaagctgacgagcaaggagctgatgatggctacgatcggcattgccctcttgtcccagagcaccatccccgagactatccttgagctgaccgacgcgctggccctggggatgatggtcctcaaaatcgtgcggaacatggagaaataccaactggcagtgacgataatggccatctcctgcgtcccgaacgccgtgatcctgcagaatgcgtggaaggtgagctgtacgatccttgccgccgtctccgtatccccactgctattaacgtcaagccagcagaaggccgactggatccccctggcgctgacaataaagggcctcaatccaacggccatcttcctgacgactctttcccgcactagcaagaaaaggtcctggccgttgaacgaggccatcatggcagtcggaatggtcagcatcctggcgtccagcctgctcaagaacgatatccccatgaccgggcccctagtggcgggcgggctactcaccgtctgctacgtcctgacggggcgcagcgccgacttagaactcgagagagccgccgacgttaaatgggaagaccaagccgagattagcgggagctcccctatcctgtctattacaatctccgaggacggcagcatgtccatcaaaaatgaggaggaggaacagacgcttaccatcctcatccgcaccggcctgctggtcatcagcggagtgttccccgtgtccatcccaatcacggcggccgcctggtacctctgggaggtgaaaaagcagcgcgccggagtgctatgggacgtgcccagcccgccgcccgtcgagaaggcggagcttgaggacggcgcgtaccgcatcaagcagcggggtatcctcggctactcccaaatcggcgccggcgtgtacaaagaggggaccttccatacaatgtggcacgtgacccgcggggccgtcctaatgcaccgggggaagcggatcgagcccagttgggccgatgttaaaaaggatctgatctcatacggcgggggctggaaactcgagggcgagtggaaagagggggaggaggtgcaggtccttgcactggagcccggcaagaacccccgggcggtgcagaccaagcccgggattttcaaaacgaacacgggcaccatcggggccgtgagcctggacttctctcccggcacctcaggctcgcccatcgtcgaccgcaagggtaaggtggtcgggctctacgggaatggcgtggtgacccgttcgggcgcatatgtgtcagccatcgcgcaaacggaaaagagcatcgaggacaaccccgagatagaggacgatatcttcagaaagaagcgtctcaccattatggacctgcaccccggggccggtaagaccaagcgctacctgcccgcaatagtccgcgaggcgatcaagcgcgggctgcggaccctaatcctcgccccgaccagggtggtggcggcggaaatggaggaagccctgcgtggcctgcccatccggtatcagacaacggcaatcaagaccgagcacacggggcgcgagatagtcgacttaatgtgccacgccacctttaccatgcgattactgtcaccggtgagagtgcccaactacaacctgatcatcatggacgaggcgcatttcaccgacccggcctccattgccgcgaggggctacatctcgactcgggtggagatgggcgaggccgcggggatcttcatgacagccacgccgccaggcagccgggaccccttcccgcagagcaacgcccccattatggacgaggagcgggaaatccccgagagatcctggaactctgggcacgagtgggtgacagacttcaaaggcaagacggtatggttcgtcccatccatcaaagccgggaacgatatcgcggcctgcctgcgtaaaaacggcaagaaggtgatccagctgtctcggaagaccttcgactccgagtacgtgaagacgcgcgccaacgactgggatttcgtcgtgaccacggacatcagcgagatgggagcgaacttcaaagccgagcgggtgatcgatccgagaaggtgcatgaaacccgttatactcaccgacggggaggagcgcgtgattctggcgggcccgatgccagtgacccatagcagcgcagcccagaggcgcggacgtatcggcaggaacccgaagaatgagaatgaccagtacatctacatgggggagcccctggagaacgacgaggactgtgcacactggaaggaggccaagatgctcttggataacatcaacacccccgaaggcatcataccctccatgttcgagccagagcgcgagaaggtcgacgcgatcgacggcgagtatcggttgagaggggaagcccggaaaacgttcgtcgacctcatgcgcaggggtgatctgccggtgtggctggcctacaaggtcgcggcggaggggatcaattacgcggaccgcaagtggtgcttcgacggcatcaagaacaaccagatcctcgaggagaacatggaggtcgagatctggaccaaggagggggagcggaagaaactcaagcccagatggctggacgcccgcatttacagtgacccgctcgctctgaaggagtttaaggaatttgcggcgggaagaaagtcgctgaccctcaacttgattaccgagatggggaggctgcccacgttcatgacccaaaaggcccgcaacgcgctcgacaaccttgctgtgctgcataccgccgaggccgggggccgggcgtataaccacgcgctgagcgagctgcccgagaccttagagacgctactgctgctgaccctactggccaccgtcaccgggggcatcttcctctttctgatgtcgggcaaggggataggcaagatgaccctgggcatgtgctgtatcatcacggcctctatcctcctgtggtacgcccagatccagccacactggattgccgcgtcaattatcctggagttctttctcatcgtgctgctcatcccggagcccgaaaaacagcgcacgccacaagacaaccagctcacctacgtcgtgatagccatactgaccgtggtggccgccacgatggccaacgagatgggcttcctggagaaaacgaagaaggacctagggctgggtagcatcaccacccaggagtccgagtcaaacatccttgatatcgacctccggcccgccagcgcatggaccctgtacgccgtggcgaccacattcgtcaccccgatgctgagacactccatcgagaacagctcggtcaacgtgagcctcaccgctatcgccaaccaggccaccgtgttgatgggcttagggaaaggctggcccctgtcaaagatggacatcggggtccccctactcgcgattggctgctacagccaggttaatcccatcaccctcaccgccgccctgctgcttctggtggcccactacgccatcatcgggccaggcttacaggcgaaggccacgcgggaagcccagaagcgagccgccgcaggcatcatgaagaatcccactgtcgacggcataaccgtgatcgacttagagcccatcccatacgacccgaagttcgagaagcagctagggcaagtaatgctgctcatcctgtgcgtcacccaggtgctgatgatgcgcacgacctgggcactctgtgaggccctgaccctggcaaccgggcccatctcgaccctctgggagggaaaccccggccgcttctggaacaccacaatcgccgtgagcatggctaatatcttccgcggcagctacctcgccggagcggggctcctgttcagtatcatgaagaacactaccaacacccgtaggggcaccgggaatattggcgagaccctgggcgagaagtggaagtcgcggctgaacgccctcggcaagtctgagttccaaatctacaaaaagtccgggatccaggaggtagaccgcacgttggcgaaggaggggataaagcggggtgaaaccgaccaccatgccgtgagccgcgggtcggccaagttacggtggttcgtggagcgcaatatggtcacccccgagggcaaagtggtggatttaggctgcgggcggggagggtggagctactactgcggcgggttaaagaacgtccgcgaagtgaagggccttaccaagggcggtcctggccatgaggagccaatccccatgtccacgtacgggtggaatctggtgcggctgcagagcggtgtcgacgtcttcttcaccccgcccgagaagtgcgacacactgctctgcgacattggggaaagctcgcctaacccaaccattgaagccgggcgtacgctccgggtactgaacctcgtcgaaaactggctgaacaacaacacccagttctgcatcaaagtgctgaacccgtacatgcccagtgtgatcgagaagatggaggccctgcagcgcaagtacggcggggcgctggtccggaacccactctctcgcaactccacccacgagatgtattgggtgagtaacgccaccggcaacatcgtgagctccgtcaacatgatcagcagaatgctgatcaaccggttcaccatgaagcataagaaagccacctacgagcccgacgtggacctcggatccggaacccggaacataggaatcgagagtgagatcccgaacctggatatcataggtaaacgcatcgagaagataaagcaagagcacgaaacctcgtggcactacgaccaggaccatccctacaagacgtgggcctaccacggcagctacgagacgaagcagacgggttccgcatcgagcatggtgaacggcgtcgtgcgcctgcttaccaagccctgggacgtggtgcctatggtgacgcaaatggcgatgacggacaccacaccattcggccagcagcgggtgttcaaggagaaggtcgacacccgcacgcaggagcccaaggagggcaccaagaaacttatgaaaatcaccgccgaatggctatggaaggagctcggcaagaagaagacgccccggatgtgcacgcgcgaggagtttactcggaaggtgcgctccaacgccgccctgggtgctatcttcaccgatgagaataaatggaagtccgcgcgggaggctgtggaggacggccgcttctgggaactcgtcgaccgggagcgcaacctccacctagaagggaagtgcgagacctgcgtgtacaacatgatgggcaagcgggagaagaagctgggggagttcggcaaagccaagggtagccgcgcaatctggtacatgtggctcggggcgcggttccttgagttcgaggctctgggtttcctcaatgaggatcactggttttcccgcgggaacagcctgagcggagtggagggggagggcctgcaccggctcggctacatactcagagacgtcgggaagaaggagggcggggccatgtatgccgacgatacggccggctgggatacccggatcactttagaggacttgaagaacgaggaaatggtcaccaatcacatgaaaggagagcataagaagctggcggaggccatcttcaagctgacgtaccagaacaaggtagtgcgggtgcagagacccacgccccgtggcaccgtcatggacatcatctcccggcgcgaccagcggggcagcgggcaggtcggtacctacgggctcaacacgtttaccaatatggaggcgcaactgatccggcagatggagggagaaggcatcttcaagtcaatacagcacctgactgccaccgaggagatcgccgtgcagaattggctcgcgcgcgtaggtcgggagaggctgtcccgtatggcgatatccggcgacgattgcgtggtgaagcccatcgacgaccgcttcgccagtgccctgacggctctcaacgatatggggaaggtccggaaggatatccagcagtgggaacccagccgcggctggaacgactggacgcaggtacccttctgcagccatcatttccacgagctagtgatgaaggacgggcgggttctggtagtgccgtgccgcaaccaagacgaactcataggccgggcccgcatctcacagggcgccgggtggtcactgaaggagaccgcctgcctgggcaagtcttacgcccaaatgtggacgctcatgtacttccaccggcgcgacctgcggttggcggcgaacgccatctgcagcgccgtcccctcccactgggtgccaaccagccgcacgacctggtcgatccacgcaaagcacgagtggatgaccaccgaggatatgctagcggtgtggaaccgagtctggatccaggagaacccctggatggaggacaaaacgccggtggagtcttgggaggaagtgccttacctggggaaacgcgaggaccagtggtgcggttccctgatcgggctcaccagccgggccacctgggccaagaatatccagaccgccatcaaccaggtccgcagcctgatcggtaacgaagagtacacggactatatgccaagtatgaagcgctttcggcgcgaggaggaagaggccggcgtgctgtggtga

SEQ ID NO: 25080 - RNA, 9876 nt, synthetic construct
  misc_feature 1..9876: note = derived and/or modified CDS sequence (opt11) from DENV-2__EU482757__SS-prME
  source 1..9876: mol_type = other RNA
accgcgggcgtgatagtgatgctgatcccgaccgccatggcgttccacctaacgacgcgcaacggggaaccacacatgatcgtggggcggcaggagaaggggaagagtctgctgttcaagaccgaggatggcgtgaacatgtgtactctcatggcaatagacttaggggaactgtgtgaagatacaatcacctacaagtgtcccctgctccgccagaacgagccagaagacatcgattgctggtgcaactctaccagtacctgggtcacttacggtacctgcaccacaacgggcgagcaccggcgcgagaagcggtcggttgccctggtgccccacgtcgggatgggcctcgaaaccaggactgagacttggatgagcagcgagggggcctggaagcacgttcaacggatcgagacctggatcctgcgccaccctggcttcaccataatggccgcgatcctcgcctacacgatcggtactacccactttcaacgggcgctcatctttattctgctgaccgccgtggcgccctcaatgaccatgcggtgcatcggcatctcgaacagagatttcgtggagggcgtaagcgggggcagctgggtggacatagtcctcgagcatgggagctgcgtgaccacgatggccaagaacaagcccacgctggacttcgaactcatcaagaccgaagccaaacagcctgcgaccctgcgcaagtactgcatagaggctaagctcacgaacacaaccacagagtcccggtgcccaacgcagggcgagccaagcctcaacgaggagcaggacaaacgcttcatctgcaagcactccatggtggaccgtggctggggtaacggctgcgggctgttcggcaagggcgggatcgtgacctgcgcgatgttcacgtgcaagaagaacatggaggggaaggtcgtacagcccgagaacttagagtacacaatcgtaattacgccgcactcaggggaggaacacgcagtggggaacgacacagggaagcacggcaaggagatcaagatcaccccgcagtcgagcataaccgaagccgagctgaccgggtacggcactgtgactatggagtgcagtccccgtacaggcctcgacttcaacgagatggtcctgctgcagatggaggacaaggcctggctcgtgcatcggcagtggttcctggacctgcccctcccctggttaccgggggccgacacccagggcagcaactggatccagaaggagacgctggtgactttcaagaacccccacgcgaaaaagcaggacgtcgtggtcctcggttcccaggagggtgccatgcacaccgccttgaccggcgccactgaaatccagatgtcgagcggtaacctcctgttcaccggtcacctgaagtgccgcctgcggatggacaagctacaattgaaggggatgtcctacagcatgtgcacagggaagttcaagatcgtgaaagaaatcgccgagacccagcacgggacgatcgtgatccgcgtccagtatgagggcgacgggtcaccctgcaagatccccttcgagatcaccgacttggagaagcggcatgtgctcggcagactgatcaccgtgaacccaatcgtcaccgagaaagactcgcccgttaatatcgaggcggagccaccattcggagactcctacatcatcatcggggtggagccgggccagctgaagctcaactggtttaagaaggggagctccatcggccaaatgttcgagacaaccatgcgcggagccaagcggatggccatactgggggacaccgcctgggacttcggcagcctcggcggcgtctttacgagtattggcaaagccctccaccaggtattcggcgctatttacggcgccgccttcagcggggtgtcctggacgatgaagatcttaatcggcgtaatcattacctggatcgggatgaactctcgctccacgtctctgtccgtgagcctggtcctcgtcggcgtggtgaccctgtatctgggggccatggtccaggcagactctggctgcgtggtgagctggaaaaacaaggagctcaagtgtgggtccgggatctttataacggacaacgtccacacgtggaccgaacagtacaagttccagcccgagagccccagcaagctggcttccgccatccagaaggcccacgaggagggaatctgcgggatccggagcgttacacgcctggaaaacctaatgtggaagcaaatcacgccagagctgaaccacatactgtccgagaacgaggtcaagctcaccattatgaccggcgacatcaaggggatcatgcaggcaggcaagcggagcctgaggccccagcccactgagttaaagtacagctggaagacgtggggaaaagcgaagatgctcagcaccgagtcccacaaccaaactttcctgatagacgggcccgagaccgccgagtgcccgaacactaatagggcttggaacagcctggaggtcgaggactatggcttcggggtgttcaccaccaacatttggctcaagttacgcgagaaacaggatgtgttttgcgacagtaagctgatgagcgccgccatcaaggacaaccgggcggtccatgcagatatgggctactggatcgagagtgccctcaacgacacatggaagatggagaaagcgagcttcatcgaggtgaagagttgccactggcccaagagccacaccctgtggtccaacggcgttctggagagcgagatgattatccccaaaaacttcgccggacccgtcagccagcataactacagaccggggtatcacacgcagaccgccgggccctggcacttgggtaagctcgagatggactttgatctgtgcgagggaaccaccgtggtggtaacggaagactgcggcaaccgggggccctccctgcgcaccaccaccgctagcgggaagctgatcactgaatggtgttgccggtcgtgtaccctgcccccgctacgctaccggggcgaggacggctgttggtacggaatggaaatccgtcccctcaaggagaaagaggagaacctcgtgaactccctcgtgacggccggacacggccagatcgataacttctccctgggcgtcctggggatggcgttgttccttgaggagatgctgcgtacacgaatcggaacaaagcacgcgatcctcctggtggcggtgtcattcgtcaccctgataacagggaacatgtccttccgggatctgggccgcgtcatggtaatggtaggggccaccatgactgacgacatcggaatgggcgtgacctatcttgcactgctcgccgcgttcaaggtacgccccaccttcgccgccggtctcctgctccgaaagctgaccagcaaggaactgatgatggccaccattggtatcgctttattgtcgcaatctacaattccggagactattctcgagctcaccgacgcgcttgcgctggggatgatggtactaaagatcgtgagaaacatggagaaataccagcttgccgtgacgatcatggccatatcctgcgttccgaacgccgtgatactgcagaacgcgtggaaggtaagctgtaccatccttgccgccgtatccgtgagcccattgttacttacctcctcgcagcaaaaggccgattggatccccctagcgctgacgatcaagggccttaaccccacggcaatcttcctgaccaccctgagccggaccagcaaaaagcgctcctggccgctcaacgaagccatcatggccgtcgggatggtgtccatactggcctctagcctgcttaagaacgacatcccgatgacggggcccctggtcgcgggaggtctgctcaccgtctgctacgtgctgaccgggcggagcgctgacctcgaacttgagcgagccgccgacgttaaatgggaggaccaagcggagatatccgggagctcccccatcctgtccatcacaatttcggaagacggctccatgtcgatcaagaacgaagaggaagaacagacgctgaccatcctcatccggaccggcctgctggtcatcagcggggttttcccggtttccatccccatcacggcggccgcctggtacctctgggaggtgaagaagcagcgcgcaggcgtgctgtgggacgtgccaagcccgccacccgtcgagaaggccgagctcgaagacggggcgtatcgtatcaaacagcgggggatactcggatattcccaaatcggcgccggcgtgtacaaggaggggacatttcacacgatgtggcatgtgacccggggcgccgtcctgatgcatcgcgggaagaggatcgagccaagctgggccgacgtgaagaaggacctgatctcctacggcgggggatggaagctcgagggcgagtggaaggaaggcgaggaggttcaggtcctggccctggagcccggcaagaacccacgtgcggtgcaaaccaagcccgggatcttcaagaccaacacgggcacgataggtgccgtgagcctcgatttctcccccggcacctcgggctcccccatcgtcgatcggaagggaaaggtggtgggattatacgggaacggcgtcgtgacccgcagcggcgcctacgtgtctgccatagcgcagacggagaagtccatcgaggataaccccgagatcgaggacgacatcttccggaagaagcgcctgaccataatggacctccaccccggtgcaggtaagacaaagcgatacttacccgccattgtcagagaggccatcaagcgggggctgcgcaccttgatactagctccgacgcgcgtggtggcggccgagatggaggaggccctaaggggcctgcccatccgctaccagaccccggccatcaagactgagcacaccggccgtgagatcgttgacctcatgtgccatgcgacgtttacgatgcgcctgctgtctcccgtgcgggtgccgaattacaacctcatcatcatggacgaggcgcatttcaccgaccccgcctccatcgcggcccgaggctacattagcacccgagtcgagatgggcgaggctgcggggattttcatgacggctacgccgcccggctcccgcgacccgttcccccagagcaacgcccccatcatggacgaggagcgggagatccccgagcgctcctggaacagcgggcacgagtgggtcaccgacttcaaaggaaagacagtgtggtttgtcccgtctatcaaggccgggaacgacattgcggcttgcctgcggaagaacgggaagaaggtgatccaactgtcacgcaagacgtttgacagtgagtacgtgaagacccgggccaacgactgggacttcgtcgtgaccacagacattagcgagatgggcgcgaatttcaaggctgagcgcgtgatcgacccgcgccgctgcatgaagcccgtcatcctcacggacggagaggagagggtgatattagcgggcccaatgccggtgacccactccagcgccgcacagcgccggggacgcataggccgcaatcccaagaacgagaacgaccagtacatctacatgggggagcccctggagaatgacgaggactgcgcccactggaaggaggccaaaatgctactggacaacatcaatactcccgagggcatcatcccgtccatgtttgagcccgagagggagaaggtcgacgcgatcgacggcgagtaccgcctgcgcggggaggcacgcaaaaccttcgtagacctcatgaggcgcggcgacctccccgtgtggctggcctacaaggtcgccgccgaggggatcaactatgcggaccggaagtggtgcttcgacggcatcaagaacaaccagatcctcgaggagaacatggaagtggaaatatggacgaaggaaggcgagcgcaagaaacttaagccacggtggctcgatgcccggatttactccgaccccttagccctgaaggagttcaaagagttcgccgcggggcggaagtccctgacacttaatctgatcaccgagatgggccgcctgcccaccttcatgacgcagaaggcgcggaacgccttggacaatctggccgtgctgcacacggccgaagccggagggcgcgcgtacaaccacgccctcagcgagctacccgagaccctagagaccctccttctgttaacgctgttagccaccgtcaccgggggcatattcctattcctgatgtccggcaaggggattggcaagatgaccctggggatgtgctgcatcatcaccgccagcatcctcctgtggtacgcgcagatccagccgcactggatcgcagcctccatcatacttgagttcttcctcatcgttctactgattcccgagcccgagaagcagcggacgccccaggacaaccagctaacctacgtcgtgatcgccatcctgaccgtcgtcgccgccaccatggcgaatgagatgggcttcctggagaagacgaagaaggacctcgggctgggtagcatcaccacccaggagagcgagtccaacatcctggacatagacctccgcccggccagcgcttggaccctgtacgctgtggcgacgaccttcgtgacccccatgctgcggcacagcatcgagaatagctccgttaacgttagcctcaccgctatcgccaaccaggccacagttctgatgggcctggggaagggttggcccctctccaagatggacatcggggtccccctactggccatcggctgctatagccaggtgaacccgattaccctcaccgccgccctgttgctcctagtggcgcactacgccatcatcgggcccggcttgcaggcgaaggccaccagggaggcccagaagcgggccgcagcaggcattatgaagaaccccactgtagacgggatcaccgtgatcgacctggagcccattccgtacgaccccaagtttgagaagcagctgggacaggttatgctgctcatactgtgtgtgacccaagttctgatgatgcgcaccacatgggccctctgtgaggccctcaccttagcaaccggcccaatctccactctctgggagggcaaccccgggcggttctggaacactactatcgccgtgagcatggcgaacatcttccgcggctcctacctggccggcgcaggtctcctgttcagtatcatgaaaaacacgaccagtacccgccgaggcaccgggaacatcggcgagaccctcggcgagaagtggaaatcccgcctgaacgccctaggaaaatccgagtttcaaatctacaagaaatccggaatccaggaggtcgatcggaccctggctaaggaggggatcaagcgcggggagacggaccatcacgccgtgtcccgaggtagcgccaagctgcgctggttcgtcgagcggaacatggttaccccggagggcaaagtagttgacctgggctgcgggcgcggcgggtggtcgtactactgcggagggctgaagaacgtccgggaggtcaagggcctgactaagggcgggcccggccatgaggagcccattcccatgagcacctacggatggaatctcgtgcggctgcagagcggggtagacgtgttcttcacgccacccgagaagtgcgacaccctgctatgtgacatcggggaaagcagccccaacccgaccatagaagccggcaggacgctgcgcgtgctgaacctcgtcgagaactggctgaacaacaacacccagttctgcatcaaggttcttaatccgtacatgccgtccgtgatcgagaagatggaagcgctccagcggaagtacggcggggcgctcgtacgcaaccccctcagcagaaattccacgcatgagatgtattgggtgagcaacgccaccggcaacatcgtgtcttcggtcaacatgatctccagaatgctaatcaaccgattcaccatgaagcacaagaaggccacctacgagccggacgtcgatctcgggtccggcacgcgcaacatcggaatcgagtccgagattcccaacctggacatcatcggcaagcggatcgagaagatcaagcaggaacacgagacgagctggcattatgatcaggaccacccctacaagacctgggcctaccacggctcctacgaaaccaaacagaccgggagcgcctccagcatggtgaacggggtcgttagactgctcactaaaccctgggacgtggtcccgatggtgacccagatggcaatgaccgacactaccccctttgggcagcagcgcgtgttcaaggaaaaggtagacacccggacccaggagcccaaggagggcacgaagaaactgatgaagatcaccgcggagtggctatggaaggagctcggcaagaagaagacaccacgcatgtgcacacgagaggagttcactcgcaaggtgcgtagcaacgcggcgctcggggccatcttcaccgacgaaaacaagtggaaatccgcgcgcgaggccgttgaggacggccggttctgggagctagtcgacagagagcggaacctacacttagagggtaagtgcgagacctgcgtgtacaacatgatgggcaagcgggagaagaagctgggggagttcggtaaggccaagggctcccgggccatctggtatatgtggctcggagcgcgcttcctggagttcgaggccttgggcttcctcaacgaggaccactggttcagccgggggaacagcctcagcggcgtggagggagagggcctgcaccgcctcggctacatcctgcgagacgtcagcaagaaggaaggaggtgccatgtatgcggatgacaccgcggggtgggacactcgcataaccctggaggacctcaagaacgaggaaatggtgaccaaccacatgaagggtgagcacaagaaacttgcggaggccatcttcaagctgacctaccagaacaaggtggtgcgggtgcaacgcccgacgccccgggggaccgtcatggacatcataagccgccgggaccagcgtggcagcggacaggtggggacctacgggcttaacacctttacgaacatggaggcccagctgattcggcagatggagggggagggcatcttcaagtccatccagcacctgactgccacagaggaaatcgtggtccagaactggctcgcccgggtcggcagggagcggctttcaaggatggcgatctctggggacgattgcgtagtcaagccgatcgatgaccggttcgccagtgccttaaccgccctcaatgacatgggaaaagtgcgcaaggacatccagcagtgggagccttcccgggggtggaacgattggacccaggtgcccttctgtagccaccacttccacgagctggtaatgaaagacggccgcgtgctggtggtcccctgccggaaccaggatgagctgatcggacgcgcccggatcagccagggggcgggatggagcttgaaggagaccgcttgcctggggaaatcgtacgcacaaatgtggaccctcatgtacttccaccgacgtgacctgcgcctggccgccaacgccatctgtagcgctgtgccctcccactgggtgcccaccagccgtacaacgtggtccatccacgccaagcacgagtggatgaccaccgaggacatgctcgcagtgtggaatcgcgtgtggattcaggaaaacccgtggatggaggacaaaacccccgtggagagctgggaggaggtcccttacctgggcaaacgggaggaccaatggtgcggaagcctgatcggcctcacgtcccgcgcgacctgggccaagaacatccaaaccgctatcaaccaggtgaggagcctgatcgggaacgaggaatacaccgactacatgccaagcatgaagcggttccggagagaggaggaagaggccggggtgctgtggtga

SEQ ID NO: 25081 - RNA, 9876 nt, synthetic construct
  misc_feature 1..9876: note = derived and/or modified CDS sequence (opt11) from DENV-2__FJ906956__SS-prME
  source 1..9876: mol_type = other RNA
accgccggcgtgatagtcatgctgatccccaccgccatggcgtttcacctcaccacccggaatggggaaccccacatgatcgtggggaaacaggagaaggggaaatcactgctgttcaagaccgaagacggagtgaatatgtgcaccctcatggcgatcgacctgggtgaactgtgtgaggacaccattacctacaaatgccccctcctgcggcagaacgagcccgaggatatcgattgctggtgtaacagcacctcgacctgggtcacctacgggacctgcaccaccacgggggagcaccgccgcgaaaagcgctcggtggccctggtgccccacgtcggtatgggcctcgagacccggacagagacctggatgagcagtgagggggcctggaagcacgtgcagcggatcgaaacctggatcctgcggcaccccggcttcaccataatggccgcgattctggcatacacgatcgggaccacccacttccagcgggccttaatcttcatcctgctgaccgccgtggcgcccagcatgactatgcggtgcatcggcatctccaaccgcgacttcgtcgagggcgtgtcagggggctcctgggtggacatcgtcctcgaacacgggagctgcgtgaccacgatggccaagaacaagcccaccctcgacttcgagctgatcaagaccgaggccaagcagcctgccacgctccgtaagtattgcatcgaggccaagctgacgaacacgacgaccgaatcccggtgcccgacccagggcgagcccagccttaacgaagaacaggacaagcgcttcatatgcaagcactccatggtggaccgcggctgggggaacggctgcggcctgttcggtaagggcgggatcgtcacttgtgcgatgttcacgtgcaagaaaaacatggaaggcaaggttgtgcagcccgaaaacctggagtacaccatcgtcatcacgccccatagcggggaggagcacgcggtgggcaacgacaccgggaaacatggcaaagaaatcaagatcaccccgcagtcctccataaccgaggccgagctcaccgggtacggcacggtgaccatggagtgctctccccggactggactagacttcaatgaaatggtccttctccagatggaagataaggcctggctcgtgcaccgccagtggttcttggatctgccgctcccctggttacctggggccgacacccaggggagcaactggatccaaaaggagacgctggtaaccttcaagaatccgcacgcgaagaaacaggacgtggttgtcctcgggtcccaggaaggcgccatgcatacagcgctaaccggggccacggagatccagatgagctcgggcaacctcctgttcaccggccacctgaagtgccggctgcgcatggacaagctccagttgaaggggatgtcctacagcatgtgcaccggcaaattcaagatagtgaaggagatcgccgaaacgcaacacgggacgattgtgatccgcgtccagtacgagggcgacggctcgccctgcaagatccccttcgagatcaccgacctggaaaagcgccatgtgctcgggcgtctgatcaccgttaaccctatagtcaccggcaaggatagccccgttaacattgaagcggagccgccgttcggggactcctacataatcatcggggtggagccggggcagctgaaactcaactggttcaagaaaggcagcagtatcggccagatgtttgaaacgaccatgcgaggggccaagcgcatggcaattctgggggataccgcgtgggactttgggagcctgggtggggtcttcacctccattggaaaggccctccatcaggttttcggcgcgatctacggggccgcctttagcggcgtgtcctggacgatgaagattctgataggggtcattatcacctggatcggcatgaactcccggagcaccagcttgtccgtgagcctcgtgctcgtcggggttgtgacgctgtacctgggagcgatggtgcaagcggactccggctgcgtggttagctggaagaataaggaactgaagtgcgggtccggcatcttcatcactgacaacgtccacacctggaccgagcagtacaagttccagcctgagagcccctcgaagctggccagtgccatacaaaaagcccacgaggaggggatctgcggtatccgcagcgtgacccggctggagaacttgatgtggaagcaaatcacgcctgagctgaaccacatcctgtccgagaacgaagtgaagctcacaatcatgaccggggacatccgcggcatcatgcaggccggcaagcggagcttgcgacctcagcccacggagttaaaatactcctggaagacgtgggggaaggcgaagatgttaagcaccgaaagtcataaccagacctttttaatcgatggccccgagacagccgagtgcccgaacacaaatcgggcctggaacagccttgaggtggaggactatgggtttggcgtgttcaccaccaacatctggctcaaactgcgcgagaaacaggacgtgttctgcgactccaagctgatgagcgccgccatcaaggacaaccgggcggttcacgccgacatgggctactggatagagtccgccctcaacgacacctggaagatggaaaaggcctcatttatcgaggtcaagagctgccattggcccaaatctcacaccctgtggtccaacggtgtgctggagagcgaaatggtcatcccaaagaattttgcaggccccgtgtcccaacacaattatcgccccgggtatcacacgcagaccgcgggtccctggcatctcgggaagctggaaatggacttcgatctatgcgagggcaccaccgttgtcgtgacggaggactgcgggaaccggggtcccagcttacgcaccaccaccgccagcggaaagctgatcaccgagtggtgttgccggtcctgcactctgccgcccctccgctaccgcggggaggacggctgctggtacgggatggagatccgccccctgaaagagaaggaagagaacctggtgaacagcctcgtaaccgccggccacggccaaatcgataacttttccctgggggtgcttggaatggcgctattcctggaggagatgctgcggaccaggatcggtactaagcacgcgatcctgctggtggcagtcagcttcgtaaccttgatcaccggcaacatgtccttccgggacctcgggcgcgttatggttatggtgggcgccacgatgaccgacgatatcggcatgggggtgacctacctggccttactcgccgcatttaaggtacgccccaccttcgccgcgggcctgctgttgcggaagctgacaagcaaggagctgatgatggccacgatcgggatcgccctcctgagtcaatcaaccatacccgagaccatcctcgagctcaccgacgcgctagcactgggcatgatggtgctcaagatcgtgagaaatatggaaaagtatcagctggccgtcacgatcatggccatctcctgtgtgccgaacgccgtaatcctgcagaacgcgtggaaggtttcctgtaccatcctcgcagcagtgtccgtgagccccctgctgctcacctcaagccagcagaaggccgactggatcccgctggcgctgaccatcaagggcctcaaccccactgccatcttcctgacgactctctcccggacaagcaagaagcgcagctggccgctaaacgaggcaatcatggccgtggggatggtgagcatcctggcctcgagcctgctgaagaacgatatccccatgacgggcccgctggtcgccggtgggctgttaaccgtgtgctacgtgctgaccgggcggagcgccgacctggagctcgagcgtgccgccgacgtcaagtgggaggaccaggccgagatctccgggagctcccccatcctgagcatcaccatctccgaagacgggagcatgtccatcaagaatgaggaggaggagcagacgctcaccatcctcatccggaccggtctgttagtaatcagcggcgtgttcccggtctccatccccatcacagccgccgcctggtacctctgggaggtgaagaagcagcgcgctggggtgctgtgggacgtcccctcaccgccacccgtagaaaaagctgagctggaggacggcgcgtaccggatcaaacaacgcgggatcctcggctactcccagatcggcgcgggggtgtataaggagggcacgttccatacgatgtggcacgtcaccaggggcgccgtactgatgcatcggggtaagcggattgagccgagctgggctgacgttaagaaggacctaatctcctacgggggtggctggaagctcgaaggggagtggaaggaaggcgaggaggtccaagtgcttgctctggagcccgggaagaaccccagggccgtgcagaccaagcccggaatcttcaaaaccaacacgggaacgatcggagccgtgagtctcgacttcagccccggcaccagcggctccccgatcgtggaccggaaaggcaaggtggtcggcctttacggcaatggagtggtaacccgcagcggcgcttacgtttccgccatcgcgcaaacagagaagtcaatcgaggacaaccccgagatcgaagacgacatcttccggaagaagcgcctgaccattatggacctccaccccggcgcagggaagaccaagcggtatctaccggccatcgtacgcgaggccatcaagagaggcctgcgtaccctgattctcgccccgacgcgcgtggtcgcggccgagatggaggaggccctgcgtgggctgcccatccgataccagacgaccgccatcaagaccgagcacacgggccgggagatcgtggacttgatgtgccatgccaccttcactatgaggctgctgagccccgtgcgggtgcccaactataacctcatcatcatggacgaggcgcacttcacagaccccgcctccatagccgcgcgcggctacatctccacgagggtggagatgggggaggccgcgggcatattcatgaccgccacacctcccgggagtcgcgatcccttcccgcagagcaacgcccccatcatggacgaggagcgagagattcctgagcgcagttggaactctggtcacgagtgggtgaccgacttcaaggggaaaacggtctggttcgtgccctccatcaaggctggcaacgacatcgcggcctgcctgcgcaagaatggcaagcgcgttatccagctgagccggaagaccttcgactccgagtacgtcaagacgcgggccaacgactgggactttgtcgtgaccacggacatcagcgagatgggggctaacttcaaagccgagagagtcatcgacccacgtaggtgcatgaagcccgtgatcctcaccgacggcgaggagcgcgtgatcctggcggggcccatgcccgtcacacattcgagcgccgcccagcggcgcggccgcattgggcggaacccgaagaacgagaatgaccaatacatctacatgggcgaacccctggagaatgacgaggactgtgcccactggaaggaggccaagatgctcctggacaacatcaacacccccgagggtatcatcccctccatgtttgagccggagcgcgagaaggtcgacgcgatcgacggggagtaccggctgcggggcgaggcccggaaaacgtttgtggacctcatgcgccgcggggacctgccagtctggctggcttacaaagtggctgccgagggcatcaactacgcggaccgcaagtggtgtttcgatgggatcaagaacaatcagatcctcgaggagaacatggaggtggagatctggaccaaggagggcgagcgcaaaaagctgaagcctagatggctggacgcgcggatctatagcgacccgttggccctgaaggagttcaaggagttcgctgccggccgcaagagcctgaccctcaacctgatcaccgagatgggtcgtctgcccacgttcatgacccagaaggctcgcaatgccctagacaacctggccgtcctgcacaccgctgaggcgggcggacgggcgtacaatcacgccctcagcgaactgcccgagaccctggaaactctcctgctgctcactctgctggctaccgtgacaggcggcatcttcctcttcttgatgtccgggaaggggatcgggaaaatgaccctgggcatgtgctgcatcatcacggccagcatcttactgtggtacgcgcagatccagccccattggattgccgcctccatcatcctggagtttttcctcatcgtattgctgatcccagagcccgaaaaacagcgcacgcctcaggacaaccagctaacctacgtggtgatagccatcttgaccgtcgtggcagcgacaatggccaacgagatggggttcttggagaagaccaaaaaggacctcggcctgggctcgatcaccacacaggagagcgagtcgaacatcctggacatcgacctccggcctgctagcgcctggacgctgtacgcggtggcgaccaccttcgtaacaccgatgttacgccactccatcgagaacagttccgtaaacgtcagcctcacggccatcgccaatcaggccaccgtcctgatggggctaggcaaggggtggcccctctcaaaaatggacatcggcgtacctctgctggcaatcgggtgttacagccaagtgaaccccatcactctcaccgccgcgctgctcctattagtcgctcactatgccatcatcggaccgggtctgcaggcaaaggccacgcgggaggcccagaagcgcgccgccgcggggattatgaagaaccccactgtggacggcattacggtgatcgatctcgaacccatcccctacgacccgaagttcgagaagcagctggggcaggtcatgctgcttatcctgtgcgtgacccaggttctgatgatgcggacgacctgggccctctgtgaggccctgacccttgcaactggcccgatctccacgctctgggaagggaatcccggccgcttctggaataccaccatcgctgtaagcatggcgaacatcttccgcggttcctaccttgccggggccggcttgctcttttcaatcatgaagaataccacgaacacccggcgcgggaccggcaacattggcgagaccctaggagagaagtggaagtcacggttaaacgccctcggcaagagcgagttccagatctacaagaagtctgggatccaagaggtggaccgcactctagcgaaggaagggatcaagcgaggggagaccgaccaccatgcagtatccagaggctccgccaaactacggtggttcgtcgagcgcaacatggtgaccccagagggtaaggttgtcgatctcgggtgtggccgcggcgggtggagctactactgcggaggtctgaaaaacgtgcgcgaagtgaaggggctaaccaagggcggcccggggcacgaggagcccatacccatgtccacgtacggctggaatctagtccggctgcagagcggggtggacgtcttctttacgccgcccgagaagtgcgacaccctgctctgcgacattggcgagagttcccccaaccccaccatagaagcgggccgaaccctgcgggtgctgaacctcgttgagaactggctaaataacaacacgcaattctgcatcaaagtgctgaacccctacatgcccagcgtcattgaaaagatggaagccctccagcgcaagtacgggggcgcgctggtgaggaaccccctttcccgcaacagcacccacgagatgtactgggttagtaacgctaccgggaacatcgtctcttctgtgaatatgatcagccggatgctgatcaaccgcttcaccatgaagcacaagaaggccacttacgagcccgacgtggacctcggctccgggacgcggaacatcggcatcgagagcgagataccgaacctggacatcatcggcaagcgcatcgagaaaatcaagcaggagcatgagacctcctggcactacgaccaggaccacccctacaagacatgggcctaccacgggagctacgagacgaaacagacggggtccgcgagctccatggtcaacggggtggttcggctgttgacaaagccctgggacgtcgtccccatggtgacccagatggcaatgacagacactaccccgttcggacagcagcgggtcttcaaggagaaggtggacacccgcacacaggagcccaaagagggcactaagaaattgatgaagatcaccgccgaatggctgtggaaggagctcggcaagaagaagacgccgcgcatgtgcacgcgcgaggagttcacccgcaaggtgcgaagcaacgccgcccttggcgccatcttcaccgatgagaacaagtggaaaagtgcgcgggaggccgtcgaagacgggcgcttctgggagttagtggatcgagagcgcaacctccacctggagggcaagtgcgagacctgcgtctacaacatgatggggaaaagagagaagaagctgggtgagtttgggaaggcaaaggggagccgcgctatctggtacatgtggttaggcgcccgtttcctggagttcgaggccctggggttcctcaacgaggaccactggttctcccgaggcaacagcctgagcggggtcgagggcgagggcctgcacaggctcgggtacatcctgcgcgacgtgggaaagaaggagggaggcgccatgtatgccgacgacacggccgggtgggacacccggatcaccctggaggacctcaagaacgaggagatggtcaccaaccacatgaagggcgagcacaagaagttggccgaggcgatctttaagctgacgtaccaaaataaggtggtgcgcgtccagcggcccacccctcgcggcaccgtgatggacattatatcccggagagaccaacgcgggtcaggccaggtcgggacctacggtctcaacacgttcaccaacatggaagcccaactaatccggcagatggagggagaagggatctttaagtcgatccagcatctgaccgccaccgaggagatagccgtccagaactggctcgcgagggtgggccgggagcgcctgagccggatggccatttccggagacgattgcgtggtcaagcccatcgacgatcgcttcgcctcagccctgactgccctcaacgatatgggcaaggtacggaaggacatccagcagtgggagccctcccgaggttggaacgactggacccaggtgcccttttgcagccaccacttccacgagttggtcatgaaggacggccgggtcctggtggtcccgtgccgcaaccaggacgaactgatcggccgggcgaggatctcccagggagccggctggtcactgaaggaaaccgcctgcctgggcaagtcttacgcccaaatgtggaccctcatgtacttccaccggcgcgacctgcggttggccgcgaacgccatttgctctgccgtgccctcccactgggtgcctaccagccgcacgacctggtccatccacgccaaccacgaatggatgaccaccgaggacatgctcgcagtatggaaccgggtgtggattcaagagaacccgtggatggaggacaagacgccggtggagagctgggaggaggtcccctacctgggcaagcgcgaggaccagtggtgcgggtccctgattggactcacctcacgggccacctgggccaagaacatccagaccgccatcaaccaggtgcgcagcctgatcggcaatgaggagtacacggactacatgccctccatgaagcgctttcgtcgcgaggaggaggaggcgggggtactgtggtga

SEQ ID NO: 25082 - RNA, 9876 nt, synthetic construct
  misc_feature 1..9876: note = derived and/or modified CDS sequence (opt11) from DENV-2__EU482759__SS-prME
  source 1..9876: mol_type = other RNA
accgccggggtgatagtcatgcttatacctactgcaatggcatttcacctcaccactcggaacggggagccgcacatgatcgtgggccggcaggaaaaggggaagtccctgttgttcaagacagaggacggggtgaatatgtgcaccctaatggccatcgaccttggggagctgtgcgaagacactatcacctacaagtgccccctcctgcggcagaacgaacccgaagatatcgactgttggtgcaactcgacgtcgacctgggtcacctatgggacgtgtactaccacgggcgagcaccggcgagaaaagaggtccgtagccctggtgcctcacgtcgggatgggtctagagacccgcaccgagacctggatgtcttccgaaggggcttggaagcacgtgcagcgcatcgaaacatggatcctccggcaccccgggttcaccatcatggcggcgatccttgcctacacaattgggactacccactttcaacgagcattgatcttcatcctactgaccgcagtggcgcccagcatgactatgcgctgcatcggcatctccaatcgcgacttcgtggagggagtgagcggagggagctgggttgacatagtcctggagcacggcagctgtgtgaccacgatggccaagaacaaacctactctggactttgaattgatcaagacagaagcaaagcaacccgccacgttgcgcaagtactgcatcgaggccaaactgacgaacacaacaacggagagtcggtgcccgacccagggcgagcccagcctgaatgaggaacaggacaagcggttcatctgcaagcactccatggtggatcggggctgggggaacggctgcggactattcggcaagggcggcattgtgacgtgcgcgatgtttacgtgcaagaagaacatggagggcaaggtggtgcagccggaaaacctggagtataccatcgtcattacgcctcacagcggagaggagcacgccgtgggtaacgataccgggaagcacgggaaggaaatcaagatcaccccgcaaagttctatcacggaagcggagctaaccggatacggcacggtgaccatggagtgctcgccccgcactggcctagacttcaacgagatggtcctgttacaaatggaggacaaggcctggctcgtgcaccggcagtggttcctggaccttccactcccctggctcccgggggccgacacccagggctccaactggatccaaaaggaaacgctggtgacatttaagaaccctcatgctaaaaagcaggacgttgtagtcctcggctcacaggaaggcgccatgcacaccgccctgacgggggccaccgagatccagatgagcagcggcaacctcctttttaccggccatctgaagtgccgcctgcggatggacaagctccagctcaagggaatgtcctatagcatgtgtaccggcaagttcaagatcgtgaaagagatcgccgaaacccagcacgggaccatagttatccgcgttcaatacgagggcgacggttctccctgcaagatccccttcgagattactgaccttgagaagcggcatgtcctcgggcgcctgatcacggtgaaccctatcgtcactgagaaggacagccctgtcaacatcgaggccgagccaccgtttggtgactcttacattattataggggtcgagccaggacaattaaagctcaactggttcaagaaggggagcagcataggacagatgttcgagacgaccatgcgcggagctaagcggatggcgatcttgggggataccgcctgggacttcggcagcctcggcggggtgttcacctccatcgggaaggccctgcaccaggtcttcggggcgatctacggggccgccttcagcggcgtgtcctggacgatgaagatcctcatcggggtaatcatcacgtggatcgggatgaatagccggagcactagcctctccgtaagccttgtgctcgtcggcgtggtgaccctttacctgggggccatggtccaggcggactctggatgcgttgtatcatggaagaacaaggagctaaagtgtggttccggcatcttcatcaccgacaacgttcacacctggaccgagcagtataagttccagccagaaagcccatcgaagctggcttccgctatccagaaggcgcatgaggagggcatctgcgggatccgtagtgtaacccgtttagagaatctcatgtggaagcaaataactccagagctgaatcacatcctgtcagagaacgaggtgaagctcacaatcatgacgggtgacatacggggaatcatgcaggcaggaaagaggagcctgcggccgcagcccaccgaactgaagtacagctggaagacctgggggaaagcgaagatgctctcaacagaatcccacaaccagacattcctgatagacggtcccgagaccgccgaatgcccgaacacaaaccgagcctggaactcactggaggtcgaagattacggcttcggagtattcacgacgaacatctggctcaagctgcgggagaagcaggacgtgttctgcgacagcaaactgatgtcggccgcgatcaaggataacagggcggtccacgccgacatgggctactggatcgagtcggcccttaacgacacctggaagatggaaaaggccagcttcatcgaagtgaagtcctgtcactggcccaagagccataccctgtggtccaacggggtcctggaaagcgagatgatcatccccaaaaacttcgccggtcccgtgtcccagcacaactaccggccggggtaccacacccagaccgcggggccctggcaccttggcaagctggagatggatttcgacctctgcgaggggacaactgtggtggtcacggaggattgtggcaacagaggcccttcattacgaaccacgacagcaagcgggaagctgatcacggagtggtgctgccgctcctgcacactgcccccgctcagatatcgcggcgaagacggttgctggtacggcatggagatccggccactgaaggagaaggaggaaaatctggtcaatagccttgtcaccgccgggcacggtcaaatcgacaacttctccctaggtgtcctggggatggccctgttcctggaggaaatgctgcgcacgcgcatcggcacgaaacacgcgatactcctggtggccgtgagcttcgtcaccttgatcaccgggaacatgtccttccgggacctcggccgcgtgatggtgatggtcggggccacgatgaccgatgacatcggaatgggtgtcacctacctggccctgcttgccgcgttcaaggtgcgtccgaccttcgctgccgggctgctgctccgcaagctgacgagcaaagagctgatgatggccacgatcggcattgccctgctgtcccagagcacgatccccgaaaccatcctggagctcacggacgccctggctctggggatgatggtcctcaaaatagtgagaaacatggagaagtaccaacttgctgtgacgatcatggcgatctcttgtgtccctaacgccgtgatcttgcagaacgcctggaaggtcagctgtaccatcctcgctgctgtgtcggtgagcccgctccttctcacctccagccaacagaaagccgattggatccctctggcccttacaatcaagggccttaaccccacggctatcttcctgactaccctgtcccgcacctccaagaagcggtcctggccgctaaacgaggcgatcatggccgtcggcatggtgtctatcctagcgtcctccttgctcaaaaacgacattcctatgacggggccattagtggccggcgggctgctaaccgtatgctatgtgctaacgggacgtagcgccgacttagaactcgagcgggcagctgatgtgaaatgggaagaccaggcggagatatcaggtagctcccccatcctgagcattacaatctccgaggatggatcaatgtccattaaaaacgaggaggaggagcagacgctcaccatccttatccgcactggactactcgtcatcagcggggtctttcccgtgtctatccctatcaccgcggccgcctggtatctctgggaggtcaaaaagcagcgggccggcgtgctgtgggacgtgccgagtccgccgcccgtcgagaaggccgaactggaggacggggcgtatcgcatcaagcaacggggcatcctcgggtactcgcagatcggcgccggcgtgtataaggaggggacatttcacacgatgtggcacgtgacccgcggcgccgtactaatgcatcgggggaagcgaatagaacctagctgggcggacgtgaagaaggatctgatctcctacggcggtggctggaagctcgaaggcgaatggaaggagggggaagaggtgcaggtactggccctggagcccggcaagaatcctcgagcagtgcaaactaagccggggatcttcaagaccaacactggaacgatcggagccgtttccctcgacttctcccccggaaccagcggctcgcccatcgtcgaccgcaaagggaaggtggtcggcctatacggcaatggagtcgtaaccagatcaggagcttacgtgagtgccatcgcgcagacggagaagtccatcgaagacaatcctgagatagaggacgacatcttccgcaagaagcggctgacaatcatggacctccaccctggcgctgggaagaccaagcgctacctgcccgcaatcgtcaggggtgccataaagcgcggcctgagaaccctcatcctcgctccgacgcgggtggttgcggccgaaatggaagaagccctaagggggctgcccatccgatatcagaccacggcgatcaaaacagaacacacggggcgcgagatagtcgatttgatgtgccacgcgacctttactatgcggctgctgtcgcccgttagggttcccaattacaacctcatcatcatggacgaggcgcactttaccgacccggcctccatcgcagcccgcggatatatctctacgcgagtcgagatgggagaagccgcaggcattttcatgaccgccacgccgcccgggtcacgggatccctttccgcagagcaacgcacccattatggacgaggaacgcgagatccccgagcggtcctggaacagcgggcacgaatgggtcacagatttcaaggggaagacggtgtggttcgtcccttccatcaaagccggcaacgacattgctgcctgcctgcggaagaacggaaagaaggtcattcagttaagcaggaagaccttcgactcagaatatgttaagacgcgcgccaacgactgggactttgtcgtgaccacggatatctcggagatgggcgccaactttaaggcagaacgggtgatcgacccccgccgttgtatgaagcctgtcattctcaccgacggagaggagcgcgtgatcttagctgggcccatgcccgtaacccactccagcgcagcccagcggcgcggccgcattgggcggaaccctaagaatgagaatgatcagtatatatatatgggcgagccccttgaaaacgatgaggactgcgcccattggaaggaggccaagatgctcctcgataatataaacacccccgaggggataatcccatccatgttcgagccggagcgcgagaaggtcgacgcgatcgatggggagtaccgccttcgcggcgaggcccggaaaacgttcgtggacctaatgcgccgaggggacttgcccgtgtggctggcatacaaggtcgccgcagaaggtatcaattacgcagaccgcaagtggtgcttcgatgggattaaaaacaaccagatcctcgaggagaacatggaggtcgagatctggaccaaagagggcgagcggaagaaacttaaaccccgctggctggatgcccggatctatagcgacccgctcgcgttaaaggaatttaaagagttcgctgctggcaggaagtctctaaccctcaatctgatcaccgagatggggcggctgcccacgttcatgacccagaaagcccgcaacgccctcgacaatctagcggtcttacacacagccgaggctggagggcgggcgtataaccacgccctctcggagctgccagagaccctggaaacgctcttactactcaccctgctagccaccgttaccgggggcatctttctattcttgatgtctgggaagggcatcgggaagatgaccctaggcatgtgctgcatcattaccgcctcaatactgctgtggtacgcacagatccagccccactggatcgcggcctctatcatcctggagttctttctaatagtcctgctgattccggagcccgagaagcagcgtacgccccaggataaccagctaacctatgtagtgatcgccatcctgactgtggtagccgctacgatggcgaacgaaatggggttcctggagaagaccaagaaagacctagggttaggctctatcactacccaggaaagcgaatctaacatcctggatatcgacctcaggcccgccagtgcctggacactgtacgccgtggcgaccactttcgtaaccccgatgctacgacattcaatcgaaaacagctcggtcaacgtttctctcacggctatcgccaaccaggccaccgtgctgatggggctgggtaaggggtggccgctctccaaaatggatatcggtgtccccctgttagcaatcggatgttacagccaggtcaacccaatcaccctgacggcagccctcctcctattagttgcccactatgcgataatcggccctggtctgcaggcgaaggcaacacgggaagcgcagaagcgagcagccgcggggatcatgaaaaaccccactgtcgacgggataaccgtgatcgacctcgagcccatcccatacgacccgaagtttgagaagcagctcgggcaggtcatgctgcttatcctgtgcgtaacccaggtactaatgatgagaaccacgtgggctctctgcgaggctctgaccctggccaccggccccatttccacgctctgggaggggaaccccggtcgcttctggaacacgaccatagctgtcagcatggcaaacatcttccgcggctcctacttagccggggccggactcctctttagcattatgaagaacacaacgaacacacgtcgcgggaccggaaacataggcgaaactctgggtgagaagtggaagtccagactgaacgccctcggcaagtccgagttccaaatctacaaaaagagtggcatccaggaggtcgacaggacgctggcaaaagagggcataaaacgcggggagacagatcaccacgccgtgagcaggggctccgcgaaacttcggtggttcgtagaacgcaatatggtgaccccggagggcaaggtggtggaccttgggtgcggccgtgggggctggtcgtactattgcggtggtctgaagaacgtccgcgaagtaaagggcttgactaaaggcggcccggggcatgaggagcccattcccatgtctacgtacggctggaacctcgttcggctgcagagcggggtggacgtattcttcaccccgccagagaagtgcgacacactgctctgcgatatcggcgagagctctcccaaccccacgatagaggctgggcgcaccttgcgggtgctgaacctcgtcgagaattggttgaacaacaacacacaattctgtatcaaggtgctaaacccatacatgccttcagtgattgagaagatggaagccctccagaggaagtacgggggcgcgctggtgcgtaaccccctgagtcgcaactctacgcacgagatgtattgggtctcaaacgccactggcaacatcgtgagctcggtgaacatgatctcccggatgctaataaaccgttttaccatgaagcacaagaaggcgacatacgagcccgacgtagacctcggctccgggacccggaatattggcatagaaagcgaaatcccgaatctggatattattggcaagagaatcgagaagatcaaacaagagcacgaaacctcttggcactatgatcaggatcatccttataaaacctgggcttaccatgggtcttacgagaccaaacaaaccggctcggccagctccatggtcaacggggtcgtgcgcttattaaccaaaccttgggatgtggtccccatggttacgcagatggcgatgactgacacgaccccctttggccagcaacgagttttcaaggagaaggtggacacccgaacccaggagccaaaggagggtaccaagaaactgatgaagatcaccgccgaatggctgtggaaagaactagggaagaaaaagacgccccggatgtgtacgcgcgaggagttcacgcggaaggtgcgttccaacgccgctttaggcgccatcttcaccgatgagaacaagtggaaatccgcccgggaggccgtggaggacggccgcttttgggagttggtcgatcgggagcgcaacctgcaccttgagggcaagtgcgagacttgcgtgtataacatgatgggaaagcgggagaaaaagctgggcgagttcggcaaggccaaaggatcgcgcgccatctggtatatgtggcttggcgcccggttcctggagtttgaggcattggggttcctcaacgaggaccactggttctcgcgcggcaactcactgagcggggtagaaggtgagggactacaccggctcgggtacatcttgcgcgacgtcggcaagaaggagggaggggccatgtacgccgacgatacggcgggatgggacactcggatcacattggaagacctcaagaatgaggagatggtaaccaaccacatgaagggcgagcacaagaaacttgccgaggccatctttaagctgacgtaccagaacaaggtcgtgcgtgtccagcgccccacccctagaggcaccgtcatggatataatctcccgccgagaccaacgtgggtcgggccaggtcgggacctacggcttaaacacgttcaccaatatggaagcacagctgatacgccaaatggagggtgaagggatattcaagtccatccaacacctcactgccaccgaagagatagccgtacagaactggctcgcccgcgtcggccgggagcgcctgagccggatggccatatcaggtgatgactgcgtcgtgaaaccgatcgacgaccgcttcgcgagcgcccttacggctctcaacgacatggggaaagttcgcaaggatatccaacagtgggaaccctcccggggttggaacgactggacccaggtgccattctgcagccaccacttccacgaactggtgatgaaggacggacgggtcttggtggtgccctgtcgaaaccaggatgagctgatcgggcgtgcacgtatcagccagggggcggggtggagcctgaaggagactgcctgcctgggtaagtcgtacgcccagatgtggactctcatgtacttccatcggagagacctccggctcgccgccaatgcaatctgtagcgccgtgccctcccactgggtaccaacctcgcgcacgacctggtcaatccatgctaagcatgagtggatgaccaccgaggacatgttggccgtgtggaatcgggtctggatccaggaaaacccatggatggaagacaagacgccagtcgaatcttgggaggaggttccatacctggggaaacgcgaggaccagtggtgtggctccctgataggcctcacaagtagagccacctgggcaaagaacatccaaacagccatcaaccaggtacgcagcctaataggcaacgaggagtacacagactacatgccctcaatgaagcgcttccggcgcgaggaggaggaggccggggtcctgtggtga

SEQ ID NO: 25083 - RNA, 9876 nt, synthetic construct
  misc_feature 1..9876: note = derived and/or modified CDS sequence (opt11) from DENV-2__EU482760__SS-prME
  source 1..9876: mol_type = other RNA
accgcgggcgtgatcgtcatgctgatccctaccgccatggcgttccacctcaccacccgcaacggcgagccccacatgatcgtgggccgacaggaaaaggggaagtccctgttattcaagaccgaggacggtgtgaacatgtgcaccctcatggccattgacctgggtgagctgtgcgaggacactatcacctacaagtgtccactcctgcgccagaatgagcccgaggacatcgactgctggtgtaactcgactagtacgtgggtcacttatgggacatgtgccaccaccggtgagcaccggcgcgaaaagcggtccgtagcactggtgccccacgtgggaatgggcctcgagacccggacggagacttggatgagttccgagggagcctggaagcatgtacaacggatcgagacctggatcctgagacacccgggattcacgatcatggcggccatcctggcttacaccatcgggaccacccacttccagcgagccctcattttcatcctgctgacggcagttgcgcctagcatgaccatgcgctgcatcggcatttcaaaccgggacttcgtagagggcgtgagcgggggttcctgggtggacatcgtacttgagcatggtagctgcgttaccaccatggctaagaacaagcccacgttggacttcgagctgatcaagacggaagccaagcagcccgctacccttcgcaagtactgcatcgaggcgaaattgaccaacaccaccaccgaatcccggtgccctactcagggcgaacccagcctgaacgaggagcaggacaagcgcttcatctgcaagcattccatggtcgacaggggctgggggaacgggtgcgggttgttcggcaagggagggatcgtcacttgcgcaatgttcacatgcaagaagaatatggaaggcaaggtcgtgcagcccgagaacctggagtacaccatcgtcatcacgccccacagcggggaggagcacgccgtgggtaatgacacggggaagcacggcaaggagatcaagatcaccccgcagtcctctatcaccgaggcagagctgaccgggtacggcaccgtgaccatggagtgttcccccaggactggcctggactttaacgagatggtcctgctgcagatggaggataaagcctggctcgtgcaccgtcagtggttcttggatctcccccttccttggctgccgggggcggacacccaggggagcaactggatccagaaggagaccctagttacgttcaagaacccacatgccaagaagcaggacgtcgtggtcctcgggtctcaagagggggccatgcacaccgccctgaccggggccaccgagatccagatgtccagcggaaacctcttattcacgggccaccttaagtgccgattacgtatggacaagctccagctgaaggggatgtcgtacagcatgtgcaccggcaagttcaagatcgtaaaagagatcgcggagacccagcacggaaccatcgtgatccgcgtccagtacgagggcgacggctccccctgcaagatccctttcgagataactgacctggaaaagcggcacgtgctagggcgcctgatcaccgtgaacccgatcgtgaccgaaaaggacagccccgtgaacatcgaagccgaaccgcccttcggcgattcctacataatcatcggggtggagccgggccagctgaagctcaactggttcaagaaggggagcagtatcggccagatgttcgagacaaccatgaggggcgccaagcggatggcaatcctgggggacaccgcctgggacttcgggagcctcggcggggtcttcacctccatcgggaaggcgctccatcaggtattcggagccatctatggcgccgccttcagcggggtgtcctggaccatgaagattctgatcggcgtcatcatcacgtggatcgggatgaattcacgcagtactagcctgtccgtcagcctggtgctcgtcggcgtggtgacgctgtacctgggggcgatggttcaggccgactccggctgcgtggtgagctggaagaacaaggaactcaagtgcggctcagggatctttattaccgacaacgtccacacttggaccgagcaatacaagttccagccggagagccctagcaaacttgcctccgcaatccagaaggcccatgaggagggcatctgcgggatccggagcgtgacccgcctggagaatctcatgtggaagcagatcacccccgagctgaaccacatcctctccgagaacgaggtgaagctcacgatcatgaccggcgacatccgggggatcatgcaggcgggaaagcgcagcctgcggccgcagcccaccgagctcaagtactcgtggaaaacctggggaaaggccaagatgctctcaactgagtcccacaaccagacattccttatcgacgggcccgagaccgctgagtgcccgaacaccaatcgcgcctggaacagcctggaggtcgaggactacggctttggggtgttcacgaccaacatctggctgaagttacgggagaagcaggacgtgttttgcgactccaagctaatgagcgccgcgattaaagacaacagagccgtccacgcggacatgggctactggatcgaatccgccctcaatgacacctggaagatggagaaggccagcttcatcgaagtgaagtcctgccactggcccaagagccacaccctgtggtccaatggcgtgttagagagcgagatgattatccccaagaacttcgcgggacccgtatcccagcataattacagaccaggctaccacacgcagaccgcagggccctggcacctcggcaagctggagatggactttgacctgtgtgaggggaccaccgtggtggttaccgaggactgcggcaaccgcggaccctcattacggaccaccacggccagcggcaagctgatcaccgagtggtgctgccgctcctgtactctgcccccgctccggtaccgtggcgaagacgggtgttggtacgggatggagattcggcccctgaaggagaaggaggaaaacctggtgaacagcttagtgaccgccggtcacggccagatcgacaacttcagtctgggcgtcctggggatggccctgttcctggaggagatgctgcgcacccggataggcaccaagcacgccatcctcctggtggccgtgagctttgtaacgttaatcaccgggaacatgtccttccgcgacctcggccgcgttatggtgatggtcggggccaccatgaccgacgacatcggcatgggagtgacctacctggccctgctcgcggcatttaaggtgaggcccaccttcgctgccggtctgctgctccgcaagctgaccagcaaagaactcatgatggccacgatcggcatcgctctcctgtcccagtctacgataccagagaccatccttgaactgacggacgccctggcgttggggatgatggtcctcaagatcgtgcgcaacatggagaagtatcagctggccgttaccatcatggctatctcctgcgtcccgaacgcggtgatcctgcagaatgcctggaaggtgagctgcacgatccttgccgcggtctcagtatctcccctgctgctcacctcgagccagcagaaggcggactggatacccctagccctgaccatcaagggcctcaacccaaccgccatcttcctgactaccctgtcccgcaccagcaagaaacgatcctggccgctcaacgaagccattatggccgtcggtatggtgagcattctggcgtcaagcctgctgaagaacgacatccccatgaccggacccttagtcgccggcgggctgctcacagtctgctacgtgctgaccggccgcagcgccgacctggagctcgagcgggcggccgacgtaaagtgggaggaccaagcggagatctccgggtcttcccccatcctgagcatcaccatctcagaagacggctcaatgagtatcaagaatgaggaagaggagcagaccttaacgatcctcatacgcaccgggctgttggttatttcaggcgtgttcccggtgtccatacccatcaccgccgccgcatggtacctctgggaagtcaagaaacagagggctggcgtgctatgggacgtgcccagcccgccgccagttgagaaagcggagctggaggacggggcataccgcattaaacagcgcggcatcctcggatactcccagattggcgccggagtatacaaagaagggaccttccacaccatgtggcacgtgacgcgcggcgccgtcttgatgcatcgggggaaacgcatcgagcccagctgggccgacgtgaagaaggatctgatctcctatggcgggggatggaagctcgagggggagtggaaagagggggaagaggtgcaagtcctggccctggagcccggcaagaacccccgggctgtgcagaccaagcccggtatcttcaagaccaacaccggaacgataggggccgtcagcttggacttttcacccggcacaagcggctccccaattgtcgaccgcaagggtaaggtggttggcttgtatgggaacggcgtggtgacccggagcggcgcctacgtgtccgcgatcgcccaaacggaaaagtccatcgaggataacccagagatcgaggacgacatcttccgcaagaagcggctgaccatcatggacctccaccccggggccggcaagacgaagagataccttcccgccatcgtgagagaggctatcaagcgcggactacgtaccctcatcctcgcaccgacccgggtggtggccgccgagatggaagaagccctccgcggcctacccatccgataccagacaaccgccattaagaccgagcatacagggcgcgagatcgttgaccttatgtgccatgcgacgttcaccatgcggctgctgagccctgtgcgcgtgcccaactacaatctcattatcatggatgaggcccactttacggatccggcctccatcgctgcccgcggctacatcagcacccgcgtcgagatgggcgaggcggccggcatcttcatgacggctaccccgcccggctcccgtgaccccttcccgcagagcaacgcccccatcatggatgaggagcgcgaaatcccagaaagatcctggaacagtgggcatgagtgggtgaccgactttaaaggcaagaccgtttggttcgtcccctccatcaaggcggggaacgatatcgctgcctgcctgcgcaagaacggcaagaaggtgatccagctgtcacgcaagacgttcgactccgagtatgtgaagacccgcgctaacgactgggacttcgtcgtgaccaccgacatcagcgagatgggcgccaactttaaggcggagcgggtgatcgatccgcgccggtgtatgaagccagtcattctcacggacggggaggagcgcgtgatcctggccggccccatgcccgtgacccactccagcgcagcccagcggcgcgggcgtatcggaagaaacccgaagaacgagaacgaccagtacatctacatgggggagcccctggaaaacgatgaggactgtgcccactggaaggaagcgaagatgctcttggacaacatcaacacgccggaaggcattatacccagtatgttcgagccggagcgcgagaaggtcgacgccatcgacggcgagtaccggctgcgcggggaagcccggaagaccttcgtcgacctcatgcgacgaggcgatctgcccgtgtggctggcctacaaggtcgcagcggagggaatcaactacgccgatcgcaagtggtgcttcgatggcatcaagaacaaccagatcctcgaggagaacatggaggtggagatatggactaaggagggggagcggaagaagctgaagccccgctggctggacgcccgcatctactcagacccgctcgcgctcaaggaattcaaggagttcgcggctggccgaaagagcctgactctcaatctgataaccgagatgggccggctacccaccttcatgacgcaaaaggcaaggaatgccctcgataacttagccgtgctgcacacagctgaggctgggggccgggcgtacaaccatgccctcagcgagttgcctgaaactttagagacgctcctgctgctcacactgctggctaccgttaccggcggcatcttcttgtttctgatgtccggcaaggggatcggcaaaatgacgcttgggatgtgctgcatcatcaccgcgagcatcctcctgtggtacgcgcaaatccaaccccattggatcgccgcctctatcatcctagagtttttcctcatcgtgctgctgattccggagcccgagaaacagagaacgcctcaggacaaccaactgacctacgtagtgatcgccatcttaaccgtggtcgcggccaccatggccaacgagatgggcttcctggagaagacgaagaaggaccttgggctcggcagcattaccacccaggagagcgaatccaatattctggatatcgacctccggccagccagcgcctggactctttacgcggtggccactacctttgtaaccccgatgctgcgccactccatcgagaattcatccgtcaacgtcagcctcaccgccatcgccaaccaggcgacggtgctgatgggcctggggaagggctggcccttatccaagatggatatcggggtccccctcctggccatcggctgctacagccaggtgaacccgattaccctcaccgccgccttgctactacttgtcgcccattacgcgattatcgggccgggcctgcaggccaaggcaacccgggaggcccagaagcgcgccgctgccggcataatgaagaaccccacggtcgacggtatcaccgtcatcgacttagagcccataccgtacgatccgaagttcgagaagcagctgggccaggtgatgcttctcatcctgtgcgtaacccaggtgctgatgatgagaaccacgtgggccctctgcgaggccctgaccctggcgaccgggcccatctccaccctctgggagggcaaccccgggcgcttctggaacacgacaatcgcggttagcatggccaacatatttcgaggctcgtacctggccggcgctgggcttctattcagcatcatgaagaacaccacgaacactcgtcgtggcaccggtaacatcggcgagacccttggcgagaagtggaagagccggctgaatgcgctcggcaagagcgagttccaaatctacaagaagagtggaattcaggaggtcgatcgcaccctggccaaggaagggatcaagcgcggcgagacggaccaccacgccgtgtctcgggggtccgccaagctccggtggtttgtggagagaaacatggtcactcctgagggcaaagtggttgatctaggctgcggacggggcgggtggagttactactgcggcgggttgaagaacgtccgcgaggtgaagggcttgaccaagggcggtccgggccacgaggagcctatccccatgtccacgtacgggtggaacctcgtgcgcctgcaaagcggtgtcgacgtgttcttcacgcccccggagaagtgcgacaccctactctgcgatatcggtgagagctcccccaaccctaccatcgaggcaggccgcaccctgcgggtgctgaacctggtcgaaaactggctgaacaacaacacccagttttgcatcaaggtgttgaacccctacatgccgagcgtgatcgagaagatggaggcgcttcaacggaaatacggcggggccctggtccggaaccccctgtcgcgcaacagcacgcacgagatgtactgggtgagtaacgcaaccggcaacatcgtgtcttccgtcaacatgattagccggatgcttatcaaccgtttcaccatgaagcacaagaaggccacctacgagccggacgtggacttagggtccggcactaggaatatcgggatcgagagcgagatcccaaacctggacattatcgggaagcgcatcgagaaaatcaagcaggagcatgagactagttggcactacgaccaggaccatccctacaagacctgggcctaccatggcagctacgagaccaagcagacggggtcagcaagttccatggtgaacggcgtagtgcgcctgctcacgaagccctgggacgtagtcccaatggtgacccagatggccatgaccgacacgacacccttcgggcagcagcgggtgttcaaggagaaggtcgacacccgcacccaggagcccaaggagggcacgaagaagctgatgaagatcaccgccgagtggctgtggaaggaactcggcaagaagaaaacgccccgaatgtgtacccgcgaggagttcacgcggaaggtccgctccaatgccgccctcggcgcgatcttcaccgacgagaacaagtggaagtccgcccgggaggccgtggaggacggcagattctgggagcttgtcgacagggagaggaacctccacctggaggggaagtgcgagacctgtgtgtacaacatgatgggaaagagggagaagaagctgggtgagttcggcaaggccaaggggagccgcgcgatctggtacatgtggctcggggcccggttcctggagttcgaggccctgggtttcctcaacgaggaccactggttctcccgcgggaactctcttagtggcgtggaaggggagggactgcaccggctcggctacatcctgcgggatgtaggaaagaaggagggcggggctatgtacgccgacgacaccgcggggtgggacacgagaataaccttggaggacctcaagaacgaagagatggtgaccaaccacatgaagggggagcacaagaagctagctgaggccatcttcaagctgacctaccagaacaaggtcgttcgcgtgcagcgacccacgccgcggggcaccgtcatggacatcatcagccgtcgcgaccagcgcggcagcggccaggtgggcacctacgggctcaacaccttcacgaacatggaagcccagctaatccggcagatggagggcgagggcatcttcaagtccatccagcacctgaccgccaccgaagagatcgcggttcaaaactggctcgcccgcgtcgggcgggagcgcctgagccggatggccatctccggcgacgactgcgttgtgaagcccatcgacgaccgcttcgctagcgccctgaccgcattaaatgacatggggaaaatccggaaggacatacaacagtgggagccctcccgcggatggaatgactggacgcaggttcccttctgcagccaccacttccacgagctagtgatgaaggatgggcgggtgctggtcgtgccttgccgcaaccaggacgagctcatcggccgggcccgcatctctcagggcgccgggtggagcctgaaggagaccgcctgcctgggcaagtcatatgcccagatgtggacccttatgtacttccaccggcgcgatctacggctggcggccaacgcgatctgtagcgcagtcccctcccactgggtccccactagccgcaccacgtggtccattcacgcgaagcacgagtggatgaccaccgaggacatgctcgccgtgtggaaccgggtctggattcaggaaaacccctggatggaggacaagaccccggtcgagagctgggaggaggtgccctacctgggtaagcgagaggaccagtggtgcggctccctcatcgggctcacgagccgggccacctgggccaagaacatccagactgcaatcaaccaggtgcgcagcctaatcggcaacgaggaatacacagactacatgccctccatgaagcgcttccggcgcgaagaggaggaggcgggcgttctgtggtag

SEQ ID NO: 25084 - RNA, 9876 nt, synthetic construct
  misc_feature 1..9876: note = derived and/or modified CDS sequence (opt11) from DENV-2__EU482762__SS-prME
  source 1..9876: mol_type = other RNA
acagccggagtgatcgtcatgctaatacctactgccatggcgttccaccttacaacaaggaatggagaaccgcacatgatagtaggaagacaggaaaaaggaaaaagtctactattcaaaacggaagatggcgtgaacatgtgcacattaatggcgatcgacctcggcgaactatgcgaagatactataacatacaaatgcccccttctacgccaaaacgaaccagaagacattgactgctggtgtaactcaacctccacgtgggtgacttacgggacgtgcacaacaaccggcgaacaccgccgagagaaacgaagcgtagcactcgtccctcatgtgggaatggggctagaaactcgaacggaaacgtggatgtcctccgaaggagcgtggaaacatgtacaacgtatagagacgtggattctccgtcaccccgggttcaccatcatggctgcaattcttgcgtacactataggcacaacgcacttccaaagggcgttaatattcatcctacttacggcagtagcaccctcaatgacaatgcggtgcatcggcatcagcaaccgagacttcgttgagggtgtaagcggtggaagctgggtcgatatcgtactggaacacgggagttgcgtaacgacgatggctaaaaacaaacccacgttagattttgaattaatcaaaaccgaggccaaacaacccgcgacacttcgtaaatactgcatagaagcaaaactaacgaacacaaccacagagtcacgctgccccacccaaggagaacccagccttaacgaagaacaagataagcgattcatctgcaagcactccatggtcgacaggggatggggaaacggctgcggactgttcggcaaaggaggaatcgtaacttgcgccatgtttacttgcaagaaaaatatggagggaaaagtagtgcaaccggaaaacctggagtatacaatagtaataacgccacacagtggggaggaacacgcagtcggaaacgacacgggaaagcatggcaaagagattaaaataactccacagtccagcatcacagaggcggagctaacgggttacggaacagtcacaatggagtgctcacctcgaaccggactcgattttaacgaaatggttctgctacaaatggaagacaaagcgtggctggtacacaggcagtggttcttggacctaccgttaccatggctccctggtgccgacacgcagggatcaaactggatccaaaaagaaacccttgtcacattcaaaaacccgcatgccaagaaacaagacgttgtagtgcttggatcccaggaaggcgcaatgcatacagctctgacgggcgcgacagaaatccaaatgagctctgggaacctgttgttcactggccaccttaaatgcaggctcaggatggacaaactccaactcaaagggatgtcctactcaatgtgcactggtaaattcaagattgttaaggaaatagcggagacccaacacggaaccatagtgatacgggtacaatatgagggggatgggagtccttgcaagataccgttcgagatcaccgatctcgagaaaagacacgtactcggacgtttaataaccgtgaacccaatagtgacagaaaaagactcacccgtcaacatagaggccgaacccccgtttggcgacagctacatcataataggcgtagaacctggacaactaaaactgaactggttcaaaaaggggtcatccattgggcagatgttcgaaacaacaatgcggggagccaagcgcatggcaatcctgggagataccgcatgggacttcggcagcctagggggcgtgttcacctccatcggaaaggcactacaccaggtattcggggccatctacggcgcggctttcagcggcgtatcatggaccatgaaaatattgataggggtcatcataacctggattgggatgaacagtcgaagcacgagcttgtcagtaagtctcgtccttgtcggggtagtaactctgtatttgggcgcgatggttcaagcagattccggatgcgtcgtctcatggaaaaacaaggagctgaagtgcggatctggtatattcatcacggacaacgtacacacatggaccgaacaatacaagttccagcccgagtcaccttccaaactcgcaagcgcaatccaaaaagcgcatgaagagggcatctgcggcatacgttccgtgactcgactcgaaaacctaatgtggaagcagattacaccagagctcaatcacattttaagcgagaatgaggtaaaacttaccatcatgacaggcgacatcagaggtataatgcaagccgggaagcgcagtctcagaccacagccgacagaactcaagtacagctggaaaacttgggggaaagcaaaaatgctctcaactgagagccacaaccaaacattcttaattgacgggcccgaaacggccgaatgcccgaataccaacagagcctggaactcactcgaagtcgaggactacggcttcggcgtgttcaccacgaatatatggctaaaactcagagagaagcaggacgtattttgcgacagcaagctaatgagtgcggcaataaaagacaacagagccgtgcacgcggacatgggctactggatcgaaagcgccctgaatgacacctggaaaatggagaaggcatccttcatagaagtcaaaagctgctactggccaaaatcgcacaccctatggagcaatggagtcctcgagagtgagatgataatccctaaaaacttcgccggcccagtatcacagcataactacagacccggataccacacccaaaccgcggggccatggcacctcgggaagctagaaatggacttcgacctgtgcgaagggaccactgttgtagtaacggaggactgtggcaaccgcggaccctccctccggacaaccaccgcctctggcaaactgatcaccgagtggtgttgccgatcgtgcacactgccacccctacgatatcgaggggaggacggttgctggtacggaatggaaatccgaccgctgaaggagaaagaggagaatctagtgaacagcctagtcacagcgggccatggacaaattgataactttagtcttggcgtactaggcatggccctatttctcgaggagatgctacgtacacgaatcggcacaaagcacgcgatcctcctggtggcagtgagcttcgtgacactgattaccggcaacatgagctttcgggacttaggacgtgtcatggtaatggtaggagcaacaatgaccgacgacatcgggatgggagtgacatacctcgccctactagcagcgttcaaggtgagaccgacattcgcggctggcctcctcttaagaaagctaacctcaaaggaactcatgatggccacgataggaatagcacttctgagtcagagcacgataccggaaaccatactggagctcaccgacgcattagcgctaggaatgatggtcctcaagattgtaaggaacatggaaaaataccaactcgccgtcaccatcatggcaatatcatgcgttccaaacgcggtaatcctacagaatgcctggaaggtctcatgtacgatcctggccgccgtaagcgtttccccactgctccttacatcgtcacaacaaaaagcggattggatcccactagcactaacaattaagggcctaaatcccaccgcaatattcctcacaactctctcacgcacatcgaagaagcgtagctggccccttaacgaagccataatggccgtcggaatggtatctatacttgcaagttcactattgaagaacgacataccaatgacaggccctctagtggccgggggactactcacggtgtgttacgtgctgactggacgctcggccgacctagaactggagcgcgccgccgatgtgaagtgggaggaccaagcagaaatttcggggtcatcacccatcctctcgatcacgatctcggaagatggctctatgtcaattaaaaatgaggaagaggaacagactcttaccatactaataagaacgggacttcttgtgatctcgggggtcttcccggtatcaatcccgataacagccgcagcatggtacctctgggaggtcaagaaacagcgcgcgggcgtactctgggacgttcctagtcccccgcccgtagaaaaagctgagctggaagatggcgcatacaggattaagcaaagaggcatactaggctacagccagataggcgctggcgtatataaagagggcacatttcacaccatgtggcacgtgacacgaggtgccgtcttaatgcaccgcggcaagagaattgagccaagctgggctgacgtaaagaaggacctcatcagttatggaggaggctggaaattggagggagaatggaaagagggggaagaggttcaggtattagcattggagccgggcaaaaacccacgcgccgtccagacaaagccaggcatattcaaaacaaacacaggaacgatcggagcagtatcactcgacttttccccgggcacgtcgggctcgcccatcgtcgatcgtaaaggcaaagttgtagggctctacggaaatggcgtcgtcacgcgcagtggcgcgtacgtgagtgctatcgcccaaacggaaaagagcatagaggacaacccagagattgaagacgacatcttcagaaagaaacgcctaaccataatggacctacatcccggggctggcaaaacaaaaagatacctccccgccatagttcgtgaagcaataaaacgcggactaagaacactcatcctagcgccaacacgcgtagtcgctgccgagatggaagaggccttacgaggactcccaataagatatcaaacaaccgccataaaaaccgagcacactgggagggaaatcgtcgacctgatgtgccatgcgacctttacaatgaggctgctcagtccagtcagagtaccgaactataatttgataatcatggacgaggcgcactttactgacccggcatccattgccgcgcggggctatatatctacacgcgtggaaatgggagaagcagcgggtatcttcatgaccgcaaccccgccaggctcacgagatcccttcccgcaatccaacgccccaattatggacgaggaacgagaaataccagaaagatcatggaactcagggcacgagtgggtgacagacttcaaaggtaaaacagtgtggtttgtcccctcaatcaaagccggaaacgacatagcggcatgcctacgtaaaaacggaaagaaagtaatccaactatcaagaaaaactttcgacagcgagtatgtgaaaacgagggcaaacgactgggatttcgtcgtgacaacggacatcagtgaaatgggagcgaacttcaaagccgagagagtaatagaccccaggcgctgtatgaaaccagtcattctaacagacggagaagaacgagtcatcctggccgggcccatgcccgtaacacactcgtcagcggcacaaagacggggacgaatagggcgcaacccgaaaaacgaaaacgaccaatacatatacatgggcgaaccactcgaaaacgacgaagactgtgcacactggaaagaagctaaaatgcttcttgacaacattaatacgccggagggcatcataccaagcatgttcgaacccgagagagaaaaagtggacgcaatcgacggcgaatatcgattaaggggtgaggcacgcaagaccttcgtcgacctgatgaggagaggggacctgccggtgtggcttgcctacaaggtcgccgcagagggcattaattatgccgacaggaaatggtgctttgacggcataaagaacaatcaaatactcgaggaaaatatggaagtagaaatctggactaaagaaggcgagcgtaagaaactgaaaccaagatggctggacgcgcggatatactcagacccgctagccttgaaggaatttaaggagttcgccgcggggcgcaaatcactaacactcaacctaattacggagatgggccgcctaccaaccttcatgacccaaaaggcccgcaacgcgctagacaacctcgccgtactccacactgcagaggcgggcggacgcgcgtacaatcatgcgctgagtgagctcccagaaacattagaaacgctgttactactgaccctgctcgccacagtaaccgggggcatattccttttcttaatgtcaggaaaaggaattggaaaaatgaccctagggatgtgctgtataataacagcgagtatccttctatggtacgcccagatacaaccacattggatagccgcctcgatcatcctcgagttcttcttgatcgtacttcttatacccgagcccgaaaaacaacgaacaccacaagacaatcaactcacctatgtcgttattgctatcttaaccgtagttgcggcaacgatggcaaatgaaatgggattcttggagaaaactaagaaagacctcgggttaggtagtataacaactcaggaatcagagtccaacatactggatattgatctaagaccggctagcgcttggacattatatgccgtagctaccacgtttgtcacccccatgttaaggcactccattgaaaactcaagcgtaaacgtttcgctaacagccatagcaaatcaagcaacagtacttatggggctgggcaaaggatggcccctaagtaaaatggatataggggtaccgctgctagcaataggatgttacagccaagtaaatcccatcacccttaccgcagcgttgctcctgttggtagcacactacgcaatcatcggacccgggctgcaagccaaagcaacccgggaggcacaaaaacgcgcagctgcagggattatgaaaaatccaacagtagacggtatcactgtgattgatttggaacctatcccctatgaccccaagttcgagaaacagctgggccaggtgatgctactaattctatgcgtaacccaggtactaatgatgaggacaacctgggccctctgcgaggctctgaccctagcaaccggcccaatttcaacgctgtgggaaggtaaccccgggcgtttctggaacacgaccattgcagtaagtatggccaacatcttccgaggtagctacttggcgggagcaggactgctgttcagtattatgaagaacacaacgaacacccgacgaggtaccggaaatatcggagaaaccctcggcgaaaagtggaagtccaggctaaacgcactagggaagagtgaatttcaaatttataagaaatcaggaatccaagaggtcgaccgtacactcgcgaaagagggcatcaagcgaggggaaacggaccaccatgcagtgagcaggggttccgcaaaactgagatggttcgtggaacgaaacatggtgacaccggaaggaaaggtcgtagacctgggttgcggacgcggaggatggtcatactactgtggcggcttaaagaacgtaagggaggtgaagggactaacgaaaggcggtccaggacatgaggaacccatcccgatgagtacgtacggatggaatctggtcaggctccaatctggagtggatgtattctttactccgcctgagaaatgcgacaccctgctctgcgacataggtgagtcctcccccaacccgaccatcgaggcgggaaggacactgagagtgctaaacctggtcgaaaattggctgaacaacaacacccaattctgcattaaggtactcaacccctacatgccatccgtaatagagaaaatggaagccctgcagcgaaagtacggaggcgcgctagttcgcaatccgctatcgagaaactcaacgcacgagatgtactgggtgtcaaacgccaccggaaacatagtcagcagtgtgaatatgataagcagaatgctaatcaatcgatttaccatgaagcataaaaaggcaacctacgagccggacgtcgacctggggtcgggaactcgaaacataggcatagagtcggaaatcccaaacttagacatcataggcaaacggatcgagaaaatcaagcaagagcacgagacaagttggcactacgatcaggatcatccgtacaagacatgggcgtatcatggttcctatgaaacgaagcaaacgggaagtgcaagctcaatggtcaatggcgtagtgcgtctactgacaaagccgtgggatgtcgtccctatggtgacacagatggcaatgactgacacaacgccgttcgggcaacagcgcgtcttcaaagaaaaagttgacacgaggacacaagaaccgaaagagggcacgaagaaactcatgaagattacggcggagtggctttggaaggaattaggcaagaagaaaacccccagaatgtgcaccagagaagagtttaccagaaaggtccgtagtaacgcagcgctaggcgcaatcttcacagatgaaaacaagtggaaaagcgcccgcgaggccgtggaagacggtaggttctgggaactggtagaccgcgaaaggaatctccacctagaaggaaaatgcgagacatgcgtatataacatgatgggcaaacgcgaaaagaagctaggggagtttggcaaagcaaagggaagcagggcaatatggtacatgtggctaggagcgcgcttcctggagttcgaagccctggggttcctaaacgaagaccactggtttagccggggcaatagcctatccggggtggagggtgagggcctccaccgactaggctatatactgagagacgtaggcaagaaagaaggaggagcgatgtacgctgacgacacggctggttgggacaccagaatcaccctggaagacctcaagaatgaagaaatggtgacgaaccacatgaaaggggaacacaagaagctcgccgaggctatattcaagttgacttaccaaaacaaagtcgtgagagtacagcgcccaacaccccgtggaaccgtaatggacataatctccagacgcgaccaaagaggctcaggacaagtcggaacctacggcctcaacacctttacgaacatggaagcccaacttatacgtcagatggagggggaggggatattcaaatcgattcaacaccttaccgcaaccgaagaaatagcagtccagaactggctcgcaagagtggggcgggagcgtctcagccgcatggctatatccggagacgactgtgtggtaaagcccatcgacgatcgcttcgcaagtgccctaacggcactcaacgacatgggaaaagtacggaaagacattcaacaatgggaaccaagcaggggctggaacgactggacacaggtgccattttgctcccaccacttccacgaactcgtcatgaaagacggccgagtgcttgtcgtaccctgcagaaaccaagacgaactcatcgggagagcacgcatcagccagggagcgggatggtcgctaaaagaaacggcatgccttggaaaatcatacgcacaaatgtggacactgatgtacttccatcgcagagacctgcgtctcgctgcaaacgcaatatgctccgcagtaccctcccactgggttcccacctccaggacgacctggtccatacacgcaaaacacgagtggatgacgacagaggacatgctagcagtgtggaacagggtttggatacaagagaacccatggatggaagacaagactccagtagagagctgggaagaagtaccatacctagggaaaagggaagaccagtggtgtggaagtttaatcggtttgaccagtagagccacgtgggccaagaacatccagaccgcaatcaaccaggtccgctcactaatcgggaacgaggagtatacagactacatgccatcaatgaagcgcttccgacgggaggaagaggaagccggagtgttatggtga

SEQ ID NO: 25085 - RNA, 9876 nt, synthetic construct
  misc_feature 1..9876: note = derived and/or modified CDS sequence (opt11) from DENV-2__EU482763__SS-prME
  source 1..9876: mol_type = other RNA
accgccggcgttatcgtcatgttgatccccaccgccatggctttccacctgactacccgtaacggggaaccgcacatgatcgtgggccggcaggaaaaggggaagtccctgctgttcaagaccgaggatggcgtgaacatgtgcaccctcatggcgatggacctgggggagctgtgcgaggacactataacctacaaatgccccctcctgcgccagaacgagcccgaggacatcgactgctggtgcaacagtaccagcacctgggtaacttacgggacctgcacgacgacgggggagcaccggcgcgagaagcggtctgtggccctggtgccccatgtcgggatgggcctcgagacccgcaccgagacctggatgtcttccgagggggcgtggaaacacgtgcagcggatcgagacgtggatcctgcgccaccccggcttcaccatcatggccgcgatactggcttacacaatcgggaccacgcatttccagcgggctctcatcttcattctgctgacggccgttgcccccagcatgaccatgcgctgcatcggcatctccaaccgggacttcgtcgagggcgtgagcggtgggtcctgggtggacatcgtcctcgagcacgggagctgcgtgaccacgatggccaagaacaagcccactctggacttcgagctgatcaaaaccgaggcgaagcagcccgctaccctccgcaagtactgcatcgaagccaagctgacgaacaccactaccgagtcccgctgtccgacgcagggcgagccctctcttaacgaggagcaggacaagcgctttatttgcaagcactccatggtggaccgtggctggggaaacggctgcgggctgtttggcaagggcgggatcgtgacctgcgcgatgttcacatgcaagaaaaacatggagggcaaggtggtgcagcccgagaaccttgaatacaccatcgtcatcacgccgcacagcggtgaggagcacgctgtgggcaacgacaccggtaagcatggaaaagagatcaagatcacgccccagtccagcatcaccgaggccgagctgaccgggtacggcacggtgaccatggagtgcagcccccgcaccggcctcgacttcaacgaaatggtcctgctgcagatggaggacaaagcctggctcgtgcaccggcagtggttcttggacctgccactcccgtggttgcctggggccgacacacaggggagcaactggatacagaaagaaacgctggtcacgttcaagaacccgcacgcgaagaaacaggacgtcgtggtactcgggtcacaggagggcgccatgcacaccgccctgaccggggccacggaaattcagatgagtagcggcaatctcctgtttaccggacatttaaagtgccgtctgcggatggacaaacttcaacttaaggggatgtcctactcaatgtgtaccggcaagttcaagatcgtgaaggagatcgccgagacccaacacggaacgatcgtaatccgtgtccaatatgagggtgacggctccccatgcaaaatccccttcgagattaccgacctggagaagcggcacgtgctcgggagattgatcacggtgaatccgatcgtcaccgagaaggacagccccgtcaacatcgaagcggagccacccttcggcgactcttacatcattataggggtggagccggggcagctgaagctcaactggttcaagaaggggagctccatcggccagatgttcgagacgacgatgcgcggcgccaaacgaatggccatcctgggggacaccgcgtgggacttcggctcgctcggaggtgtttttacctccatcgggaaggccttgcaccaggtgtttggggcaatctacggcgccgccttttccggggtctcctggacaatgaagatcctgatcggcgtaatcatcacctggatcgggatgaacagcagatccactagcctgtccgtgagcctggtgcttgtaggcgtggtgacgctgtatctgggtgcgatggtccaggcggactccggctgcgtggtgtcctggaagaacaaggagctgaagtgtggcagcgggatattcataacggacaacgtccacacctggaccgagcagtacaagttccagcccgagagcccctccaagctggcttctgccatccagaaagcacacgaagagggcatctgcgggatccggagcgtgacgcgcctggagaacctaatgtggaagcagatcacgccggagctgaaccacatcctgtccgagaacgaggtgaagctcaccataatgactggcgacatcagggggatcatgcaggccggcaagcgcagcctgcggccccagcccactgaactgaagtactcctggaaaacgtggggcaaagcgaagatgctcagcaccgaatcccacaaccagaccttcctgatcgacgggcccgagaccgccgagtgcccgaacacgaaccgtgcgtggaacagcttagaggtcgaggactacggcttcggtgtgttcaccaccaacatatggcttaagctgcgagagaagcaggacgtgttctgcgactccaaactcatgagcgccgccatcaaggacaatcgagcggtccacgccgacatgggatactggatcgagtcagccctcaacgacacctggaagatggagaaggcctccttcatcgaggtgaaaagttgccactggcccaagagccacaccctgtggtcaaatggcgtgctggagagcgaaatgatcatccccaagaacttcgccgggcccgtctcccagcacaactaccggcctggttaccacacgcaaaccgcggggccctggcacctcggcaagctggagatggactttgacctgtgtgaagggacgaccgtggtggtgacggaggattgcggcaaccgcggcccgagcctgcggacaactaccgccagcgggaaacttatcacggagtggtgttgccgttcctgcaccctgccacccctccgctaccgcggagaggacggatgctggtacggcatggagatccggcccctgaaagagaaggaggaaaacctcgtgaacagcctcgttacggctggccacgggcagatcgacaactttagtctgggcgtactgggaatggcactcttccttgaggagatgctgcgcacccggatcggcacgaaacacgcgatcctcctggtggccgtgagcttcgtcaccctgatcaccgggaacatgtcctttcgcgatctcggccgcgttatggtgatggtcggggctaccatgacggacgacatcggcatgggcgtgacctacttagctctgttagccgccttcaaggtgaggcccaccttcgccgccgggctgctgttaaggaagctgaccagcaaggagctgatgatggccacgatcggcatagccctcctgtcccagagtaccatccccgaaacaatactggagctcaccgacgctctcgccctcgggatgatggtcttgaagatcgtgcggaacatggagaagtaccaactggccgtcacgattatggccatctcctgcgtcccgaacgccgttatcctgcagaacgcgtggaaggtcagctgtaccattctcgctgcggtttccgtgagccccctgctgttgacgtccagccagcagaaggccgactggatacccctcgctctgaccatcaagggactaaatccgacggccatcttcctgacgaccttgtcccgcacaagcaagaagcggtcctggccactgaacgaggcgatcatggccgtcggcatggtgagcatcttagcctccagcctgctcaagaacgacatacccatgacggggcccctggtcgcgggtggcctgctcacggtctgttacgtgctgaccgggcgctctgccgacctggagctcgaacgtgccgccgacgtgaagtgggaagatcaagcagagatctcggggagctcgccaatcttaagcatcaccatctccgaggacggctctatgagcatcaagaacgaggaagaggagcagacgctgacgatcctcatccgcaccggcttgctagtcatcagcggggtgttcccggtatccatccccatcaccgcggctgcctggtacctctgggaggtcaagaagcagcgggccggcgtgctgtgggatgtcccgagcccgccgcccgtcgagaaggccgagctggaggacggggcgtacaggatcaagcagcgaggcatcctcgggtactcccagatcggcgccggggtctacaaggagggtaccttccacacgatgtggcacgtgacccgcggtgctgtcctgatgcaccgggggaagcggatcgagcccagctgggcggacgtgaaaaaggacctgatatcttacggaggtgggtggaagctcgagggggagtggaaggagggagaggaggtgcaagtcctggccctggagccgggtaagaaccctcgggcggtgcagaccaagcccgggatctttaagaccaacacgggtaccataggggccgtgagcctcgacttctcccctggaacaagcggctcacccatcgtcgaccgcaaggggaaagtagtgggcctgtacgggaatggcgtcgtgacccggtcaggcgcctacgtgtccgccatcgcccagacggagaagtccatcgaggacaatcccgagatcgaggatgacatcttccgcaagaagcgactgaccatcatggacctccatcccggggccggaaagaccaagaggtacctgcctgctatagtccgggaggccatcaagcgaggcctgcgcaccctgattctcgcccctactcgtgtcgtggcagccgagatggaagaagccctgcgcggcctgcccatccggtaccagactaccgccataaagaccgaacacacggggagagagatcgtcgacctcatgtgtcacgccacctttaccatgcggctgctcagcccagtgcgcgtgcccaactacaacctcatcatcatggacgaagcgcacttcaccgaccccgcctccatcgccgctcgaggttatatcagcacgcgcgtcgaaatgggcgaggccgcgggaatcttcatgaccgccactccacccggatcccgggacccattcccgcaaagcaacgccccaatcatggacgaggaacgcgagatccccgaacggtcttggaactctgggcacgagtgggtgaccgacttcaagggcaagacggtgtggttcgtgccctccatcaaggccgggaacgatatcgcggcgtgcctgcgcaagaacgggaagaaggtgatccagctgagccgcaagacctttgactcagagtacgtgaagacccgtgccaacgactgggatttcgtcgtgaccacggacatctcagagatgggcgcgaacttcaaggccgagcgggtgatcgaccctcgccggtgtatgaagcccgtcatcctcactgacggggaggagcgcgtgatcctggcgggccccatgcccgtgacccactccagcgcggcccagcggagagggcgcatcggtcggaacccgaagaacgagaacgaccagtatatctatatgggcgagccactggagaacgacgaggactgcgcccactggaaggaggccaagatgctccttgacaatattaacaccccagagggcatcatcccctccatgttcgaaccggagcgagaaaaggtcgacgcgatcgacggcgagtaccggctgcgcggggaggcccggaagacattcgtggacctcatgcgccgtggcgacctgcctgtatggttagcctacaaggtcgcagccgaggggataaattacaccgaccgtaagtggtgcttcgacggcatcaagaataaccagatcctcgaagagaacatggaggttgaaatctggaccaaggagggggagcggaagaagctgaagccccgctggctggacgcacggatctactcagacccgctcgccctcaaggagttcaaggagttcgccgccggtcgcaagtctctgactctcaacctgatcacggagatgggccggctgccaaccttcatgactcagaaggcgcgaaacgccctcgacaacctggccgtgctgcataccgccgaggccgggggccgggcgtacaaccacgccttaagcgagctgccagagacgctggagaccctcctgctgctcaccctgctggccaccgtcaccggagggatcttcctcttcctgatgtccggcaaggggatcggcaagatgacgctggggatgtgttgcatcattactgcctcgatcctcctgtggtacgcgcaaatccagccccactggattgcagccagtataatcctcgagtttttcctcatcgtcctgctgatcccggaacccgagaagcagcgcacgccccaggacaatcagctcacctacgtcgtgatcgcaattctgaccgtggtcgccgccaccatggctaacgagatgggattcctggagaagacaaagaaggacctcgggctgggtagcatcactacgcaggagagcgaatccaacatcctggacatcgacctcagacccgctagcgcctggaccctgtatgccgtagccacgacgtttgtgacgccgatgctaaggcactccatcgaaaactcgtccgtcaacgttagcctcaccgcgatcgccaaccaggctaccgtcctgatgggcctggggaagggttggcccctctccaagatggatatcggggtcccgctgctggccatcggctgctacagccaggtgaaccccatcaccctcacggccgccttgctgctcctggtggcccattatgccatcatcgggccggggcttcaggctaaggccaccagggaggcccagaaacgcgctgccgccggcataatgaaaaaccccaccgtcgacgggatcacagtgattgatctcgaacccatcccttacgacccgaaatttgaaaagcagctgggccaagtcatgctgctgatcctgtgcgtcacccaggtcctgatgatgcgtaccacctgggcgctctgcgaggccttgacactggccacgggtcccatctccaccctctgggagggcaaccccggccgcttctggaataccaccatcgccgtgagcatggccaacatattccgcggctcctacctggctggagccgggctcctgttctcaatcatgaagaacacgaccaacacccggcgaggcaccgggaacatcggcgagaccttaggcgagaagtggaaaagccggcttaatgctctaggcaagtcagagttccagatctacaagaagtccggcatacaggaagttgaccgcaccctggccaaggaagggataaagcggggcgagaccgaccaccacgcggtgagccgcggatccgccaagctgcggtggtttgtggagcgtaacatggtcacccccgagggcaaagttgtggacctcggctgcgggagaggcgggtggagctattactgcggcgggctgaagaacgttagagaggtgaagggcctaacgaagggagggccgggtcacgaggagcccatccccatgtcgacctatggctggaacttagtgcggctgcagagcggcgtcgacgtgttcttcacaccgccggaaaagtgcgatactctgctctgcgacatcggggagagcagtcccaatcccaccattgaggccggccgtacgctgcgggtgctgaacctcgttgagaactggctgaacaacaatacccagttctgcatcaaggtgctgaacccctacatgcctagcgtgatcgagaagatggaagccctccaacgaaagtacggcggggccctggtccggaaccccctgtcccgcaacagcacccacgagatgtactgggtgtccaacgcgacgggcaacattgtgagctccgtcaacatgatcagccggatgcttattaatcgcttcacgatgaagcacaagaaggcgacctacgagcccgacgttgatctcgggtccggcacccgcaacattggtatcgagagcgagataccgaatctggacatcataggcaagcgcattgagaaaatcaagcaagagcacgagacctcctggcattatgaccaggaccacccctacaagacgtgggcctaccacggcagctacgagaccaagcagaccggttccgccagctccatggtgaacggcgtcgtgcggctgctcacaaaaccctgggacgtggtccccatggtgacgcaaatggccatgaccgacacgaccccattcggacagcagcgcgtcttcaaggagaaagtcgacacacgcacccaggagccgaaggagggtaccaagaagctgatgaagatcaccgcggagtggctgtggaaggagctcggtaagaaaaagacaccccggatgtgcacccgcgaggagttcacgcggaaggtgagatcaaatgccgccctgggggcgatattcacagacgagaacaagtggaagtccgccagggaggccgtggaggacggccgcttctgggaactggtggaccgggagcgcaacctccacctggaggggaagtgcgagacatgcgtttacaacatgatgggcaagcgggaaaagaagctgggtgagttcggcaaagccaagggcagccgcgccatctggtacatgtggctcggcgcacggttcctggagttcgaagccctgggcttcttaaacgaagaccattggttctcaagggggaacagcctcagcggagtggagggggagggcctccaccggctgggctatatcctgcgcgatgtagggaagaaagagggcggcgccatgtacgcagatgacaccgccggttgggacacccggatcacactcgaggacctcaagaatgaggagatggttacgaaccacatgaagggggagcacaagaagctggccgaggctatcttcaaactgacctaccagaataaggtcgtccgcgtacagcgtcccacgccacgcggcaccgtcatggacattatctcgcggcgcgaccagcgcgggagcggacaggtcggcacgtacgggctgaacaccttcaccaacatggaggctcagctgatccggcagatggagggcgaggggatcttcaagtccatccagcacctgaccgcaacggaagagatcgccgtgcagaattggctcgcccgcgtcgggcgggagcgcctgagccggatggcgatctccggcgacgactgcgtggtgaagcctatcgacgaccgctttgcgagcgccctgaccgcactcaacgacatggggaaagtccggaaagacatccagcagtgggagcccagccgcggttggaacgattggacgcaagtgcccttctgcagtcatcacttccacgagctagtgatgaaggacgggcgggtcttagtggtgccgtgtcgcaaccaggatgagctcatcggacgtgcccgcataagccagggcgcgggctggtcactgaaggagaccgcatgcctggggaaatcctatgcccagatgtggaccctcatgtacttccaccggagggacttacggctggccgctaacgcgatctgcagcgccgtaccctcgcattgggtgcccacgagccgcacgacctggtccatacacgccaagcacgagtggatgaccacggaggacatgttggccgtgtggaatcgggtctggatccaggagaacccctggatggaggataagaccccagtcgagagctgggaggaagttccctacctggggaagcgcgaagaccagtggtgcggctccctgatcggtcttacctcccgggcgacctgggccaagaatatccaaacggcgatcaatcaggtccgctccctaatcggcaacgaggagtacactgactacatgccctccatgaaacgcttccggcgcgaggaggaggaggccggtgtgctgtggtga

SEQ ID NO: 25086 - RNA, 9876 nt, synthetic construct
  misc_feature 1..9876: note = derived and/or modified CDS sequence (opt11) from DENV-2__EU482444__SS-prME
  source 1..9876: mol_type = other RNA
acggcgggggtaatcgtcatgttgatcccaactgccatggctttccatctcacgacacgcaacggcgagccgcacatgatcgtgggcagacaggagaaggggaagagtctgctgttcaaaaccgaggacggcgtaaatatgtgtactttaatggccatggatctcggggagctgtgcgaggacaccatcacctataagtgccccttgctgcgtcagaacgagcccgaggatatagattgttggtgtaacagcacgtcaacctgggtcacctacgggacctgcacaaccaccggcgagcatcgacgcgagaagcggtctgtggcgctggtgccccacgtcgggatgggcctagagacccgcacggagacctggatgagctccgagggggcctggaagcacgtgcaacgtatcgagacgtggatcctgcgacacccgggatttaccatcatggcggcgatcctggcctacaccattggaacgactcatttccaaagggccctgatcttcatcctgctgacggccgtggcgccaagcatgacaatgcgctgcatcggcatatccaacagagacttcgtcgagggcgtgtccggtggctcatgggtggacatagtcttagagcacgggagctgcgtaaccacgatggccaagaacaagcccaccttggatttcgagctgatcaagaccgaagccaagcagcctgccacactccgcaagtactgtatcgaagccaagttgacgaacaccaccaccgagtcgcggtgcccaacacagggcgagccaagcctgaacgaggagcaggacaagcgcttcatctgcaagcacagtatggtggatcgaggctgggggaacggctgcgggttattcggtaagggcgggatcgtgacctgcgcgatgtttacgtgtaagaagaacatggagggcaaggtggttcagcccgaaaacctagagtataccatcgtgatcactcctcacagcggcgaagaacacgccgtgggcaacgacacagggaaacacgggaaggaaattaagatcaccccgcagtccagcatcaccgaggccgagctgaccggatacggcacggtaaccatggagtgctctccccgcaccggtctcgacttcaacgagatggtcctgctgcaaatggaggacaaagcctggctcgtgcaccggcagtggttcttggatctgcccctaccctggctgccgggggccgacacccaaggaagcaactggatccaaaaggagacgttggtcaccttcaagaatccccacgccaagaagcaagacgtggtggtccttgggtcacaggagggtgccatgcacaccgcgctaaccggcgcaacggagatccagatgagcagtggcaacctcttgttcaccggtcacctgaagtgccgcctgagaatggacaagctccagctgaagggcatgtcctactccatgtgcaccggcaagttcaaaatcgtgaaggaaattgccgagacccagcacgggacgatagtgatccgcgtccaatacgagggcgacggttccccctgcaagatacccttcgaaatcaccgacctggaaaagcgacacgtgctcgggcgactgattacagtgaacccaatcgtcaccgagaaagacagcccagtgaacatcgaagcagagccgccctttggcgactcctacatcatcattggggtggagccgggtcaattgaagctcaattggttcaagaaggggagctccatcggccagatgttcgagacgacaatgcgcggcgccaagcgtatggctatcctgggggacaccgcctgggatttcggcagcctcgggggcgtcttcacatcgatcggcaaggcactccaccaggtgttcggagcgatctacggcgccgccttctctggggtgtcctggaccatgaagattctgatcggggtcatcataacctggataggaatgaacagccgctccaccagcttatccgtaagccttgtcttggtcggcgtggtgaccctgtacctgggcgccatggtccaggcggactccggctgtgtggtgagctggaagaacaaggagctcaagtgtggcagtgggatcttcatcacggataacgtccacacctggactgaacaatacaaattccaacccgagagcccgtccaagctcgcctccgccattcagaaggcacacgaggagggtatctgcgggatccgtagcgtcacccgcctggagaacctcatgtggaagcagatcacgcctgagcttaatcatattctcagcgagaacgaggtaaagctcaccatcatgaccggcgacatccgtggaataatgcaggccggcaagaggagcctgcgaccgcagccgaccgagttaaagtactcctggaaaacgtggggcaaggcgaagatgctgagcactgaatcccacaaccagacctttttgatcgacgggcccgagaccgccgagtgcccgaacacgaaccgcgcatggaactccctggaggtcgaggattacggcttcggagtcttcaccaccaatatctggctcaagctccgtgagaagcaggacgtcttctgcgactccaagttaatgagcgccgccatcaaggataatcgcgcggtccacgccgacatgggctactggatcgagtccgccctgaatgacacatggaagatggagaaggctagcttcatagaggtgaagtcctgccattggcctaagagtcacaccctgtggtccaacggcgttctggagagcgagatgatcatccccaagaacttcgctgggcccgtttcccagcacaactaccggccggggtaccacacgcagaccgcgggaccctggcatctcggcaagctggaaatggacttcgatctgtgcgaggggaccaccgtggttgtcacggaggactgcggcaaccgcggtccgagcctgcggaccacgaccgcaagcgggaagctgataacggaatggtgctgccgttcatgcacactgccgccactcaggtatcgcggcgaggatgggtgttggtacggcatggagattcggcccttgaaggaaaaggaggagaacctggtgaacagtctggtcaccgccgggcacggccagatagacaacttttccctgggagttctggggatggccctgttcctggaggaaatgctgcgcacccggattggcacgaagcacgcgattctcctggttgccgtgtcgttcgtcaccctgattacggggaacatgtctttccgggacctcggccgcgtgatggtgatggtcggggccacaatgaccgacgacatcggcatgggcgtaacctacctagcactgctcgccgcattcaaggtacggcctaccttcgccgccgggctgctgctccgcaagctgactagcaaggagctgatgatggccacgatcggcatagccctcctatcccagagcactatccccgagacgattctggagctcaccgacgcgctggctctgggaatgatggtcctcaagatcgtgcggaacatggagaagtaccagctcgccgtgacgataatggcaatctcctgcgtaccgaacgcagtgatcctgcagaacgcgtggaaggtgtcgtgcactatccttgccgccgtctccgtgtcgccgcttctgctcacttcctcacagcaaaaggccgactggatccccttggcgctcactatcaagggcctcaaccccacggccatcttccttacaaccctctctcgcaccagcaagaagcggagttggccgctcaacgaagccataatggccgttggcatggtgagtatcctggcctcctctctgttaaagaacgatatacctatgacggggcccctagtggcgggcgggttgctcaccgtctgctacgtgttaaccggccgaagcgccgacctcgagctcgagagagctgccgacgtgaaatgggaggaccaggccgaaataagcgggagctctccaatcctgtctatcactatctccgaggacggcagcatgtccataaagaacgaggaggaggagcagacgctgaccattctcatcaggaccggcctgcttgtcataagcggggtattcccggtgtccatccccatcactgcagccgcctggtatctgtgggaggtcaagaagcagcgcgccggagtgctgtgggacgtgccttccccgccgcccgtcgagaaggcggagcttgaggacggggcgtaccgcattaagcaacggggaatcttgggatactcccagatcggcgccggtgtctacaaggaggggacctttcacacgatgtggcacgtgactcgtggcgcggtcctgatgcaccgcgggaagagaatcgagcccagctgggccgacgtgaagaaggacctcatctcgtatggtgggggctggaagctcgagggcgagtggaaggagggggaggaggtacaggtactggccctggagcccggcaagaacccccgggcggttcagaccaagcccgggatctttaagaccaacaccggcacaatcggggccgtttctctcgacttctcgcccggcacaagcggctcccccatcgtcgaccgcaaagggaaagtggtgggcctgtacgggaacggcgtcgttacccggtctggagcatatgtgtccgccatagcccagacggaaaagtccatcgaggacaaccctgagatagaggacgacatatttagaaagaagcggctgaccatcatggacctccaccccggggccggcaagaccaagcgctacctgccggcgatcgtccgggaggcaataaagcgcgggttgcgcacccttatcctcgcacccacgcgggtggtcgcagcagagatggaagaagcactgcgcggtttacccatccggtaccagactaccgccatcaagaccgagcacacagggcgcgaaatcgtcgacttaatgtgtcacgccacgttcaccatgcggttgttaagccccgtacgcgtgcccaattacaacctcattatcatggacgaggcgcattttaccgaccccgcctccattgccgcccggggatacatctccacgcgcgtcgagatgggtgaggccgcggggatcttcatgacagccaccccacccggctcccgggaccccttccctcagagcaacgcccccattatggacgaggagcgcgagatccctgagcgtagttggaacagcggtcacgagtgggtgaccgacttcaagggcaagacggtgtggtttgtcccgtccatcaaggccgggaacgacatcgcggcttgcctgcgcaaaaacggcaagaaggtgatccagttgagcaggaaaaccttcgactccgagtacgtcaagacccgcgctaacgactgggacttcgtcgtcacaaccgacatcagtgagatgggcgcaaacttcaaggctgaacgggtgatcgatccgcgcagatgcatgaagcccgtgatcctcaccgatggggaggagcgcgtgatattagcgggcccaatgcccgtgacccattcctccgccgcccaacggcgcgggcgcatcggccggaaccccaagaatgagaacgaccaatacatctacatgggagagccgctagaaaacgacgaggactgcgcccactggaaagaagccaaaatgctcctggacaacatcaacacgcccgagggcatcatcccatccatgttcgagccagaacgcgagaaggtcgacgcgatcgacggcgagtacaggttaaggggagaggctcggaaaacgttcgtagacctgatgcgccggggtgacctgcccgtgtggctggcctacaaggttgccgccgagggtatcaattacgcggaccgcaagtggtgcttcgacggcataaagaacaaccagatcctagaggagaatatggaggtggaaatttggactaaggagggagagcggaagaagctgaagccgcgctggctggacgcccggatctacagcgatccgctcgccctgaaagagttcaaggaattcgcagcgggcaggaagagcttgaccctcaacctcattactgagatggggcgtctgcctacgttcatgacccagaaggcccgcaacgccctagacaacctggccgtactgcataccgcagaggccggaggccgggcctataaccacgcgctaagcgagcttcccgagaccttggagacgctcctcctacttaccctgctggccacagtcaccggcggtatcttcctcttcctgatgagcggaaagggtatcggcaagatgaccctggggatgtgctgtatcatcacggccagcatcctcctgtggtacgcgcagatccagcctcactggatcgcagcctccatcatcctcgagttcttcctcatcgtgctgctgatcccggagccagagaagcagcgcaccccccaggacaaccagctcacctacgtggtcattgccatcctgaccgtggtcgcggctaccatggcgaacgaaatgggcttcctagagaagaccaagaaagatctcgggctgggcagcatcactatccaggagagtgagtccaatatcctggacatcgatctccggcccgcttcggcctggaccttatatgccgtggcgacgacgttcgtgaccccgatgctgcgccactccatcgagaactcgtccgtcaatgtaagcctcactgccatcgccaaccaggccaccgtgttgatgggcctggggaagggctggcccctatccaagatggacatcggggttcccctgcttgcgatcggttgctacagccaggtgaaccccattacgctcaccgccgccctgctgctcctcgtggcccattacgcaatcatagggccaggcttacaggcaaaggccacccgggaagcccagaagcgcgctgccgcaggcatcatgaagaaccccacggtcgacggcattaccgtgatcgacctcgagcctatcccctacgacccgaagttcgagaagcagctgggccaggtgatgctgctcatcctgtgcgtcacacaggtcctgatgatgcggaccacgtgggcactctgcgaagccctgacccttgccaccggacccatttccactctctgggagggcaatcccgggcgcttctggaacacgaccatcgccgtgagcatggcgaacatcttccgcggctcctacctggccggagccgggctcttattcagcatcatgaagaacacgaccaacacgaggcgcggcaccgggaacatcggcgagacccttggcgagaaatggaagtcccggctgaacgccctcggaaagtcagaattccagatctacaagaagtccggtatccaggaggtcgaccgcacccttgcgaaggaggggattaagcggggggagacggaccatcatgcggttagccgcggaagtgccaagctgcggtggttcgtggagcgcaacatggtcacacccgagggcaaagttgtggacctcggctgcggaagaggagggtggagctactactgcggggggctgaagaacgtccgagaggtgaaaggactgaccaagggagggccggggcatgaggagcccatccccatgtccacgtacgggtggaacctcgtgaggcttcaaagcggcgttgacgtgttcttcacgcccccggagaagtgcgatactctgctctgcgacatcggggaaagctcccctaaccccacaattgaggccgggcgcaccctgcgggtgctaaacctcgtcgagaactggctgaacaacaacacccagttctgcatcaaggtgctgaacccctacatgccgtccgttatcgaaaagatggaagccctccagcgaaagtacggcggtgcgctcgtacggaacccattatcccgcaactctactcacgaaatgtactgggtctcgaacgccaccgggaatatagtgagctccgtcaacatgatcagccggatgctgatcaaccgctttacgatgaagcacaagaaggccacctatgagcctgatgtggatctcgggtccggtacgcggaacatcgggatcgagagcgagatcccgaacctggacatcataggcaagcggatcgagaaaatcaagcaggagcacgagacctcctggcactacgaccaggaccacccctacaagacctgggcgtaccacggcagctacgagaccaagcagacggggtccgccagctcaatggtgaatggcgtagtgaggctgctcaccaagccctgggacgtagtccctatggtgacccagatggcgatgaccgacaccaccccgttcgggcagcagcgggtgttcaaggagaaggtggatactaggacccaagaaccgaaggaaggcacgaagaaactgatgaagatcaccgccgagtggctttggaaagaactcggaaaaaagaagacgccccggatgtgcacacgcgaggagttcacccgcaaggtgcgcagcaacgccgccctgggggcaatattcaccgacgagaacaagtggaagtccgcgcgggaggccgtggaagatggccgcttctgggaactggtcgaccgggagcgcaacttgcacctggagggaaagtgcgagacctgcgtctacaacatgatgggtaagcgagagaagaagctgggggagttcggcaaggccaagggaagcagggccatatggtacatgtggctgggggctcggtttttggaattcgaggcgctgggcttcctaaacgaggaccactggttctcccgcggtaactcattaagcggggtggaaggggagggcttacatcggctcggctacatcctgcgcgacgtcggaaagaaggagggaggggttatgtacgccgacgacactgccggctgggacacccggattaccctggaggacctcaagaacgaggagctggttacaaaccacatgaagggagagcataagaagctggcggaggcgattttcaagctcacctaccagaacaaggtggtgagagtccagcggcctacgccgagaggcaccgtgatggacatcatctcacggcgggaccagcgaggcagtgggcaggttggcacctacgggctaaacactttcaccaacatggaggcccagctgatccggcagatggagggcgagggtatattcaaatccatccagcacctcactgcgaccgaggagatagccgtccagaattggctggcccgagtggggagggagcgcctgtctcggatggcgatctctggtgacgactgcgttgtcaagcccatcgacgaccgcttcgccagcgccctcaccgccttaaacgatatgggcaaggtgagaaaagacatccagcagtgggagccctcgcgcggctggaacgattggacccaggttcccttttgcagccaccacttccacgagctggtcatgaaggacggccgagtactcgtggtcccttgccgcaaccaggatgaattgatcggtagggcccgcatctcccagggcgcagggtggagcctaaaggagaccgcgtgcctcggcaagtcctacgcccagatgtggactctgatgtacttccacaggcgcgacctgcggctcgccgcgaacgcgatctgtagcgcggtcccctcccactgggttcccacctctcggaccacttggtccatccatgcgaaacacgagtggatgaccaccgaggacatgctggccgtatggaatcgtgtatggatccaggaaaatccctggatggaggacaaaaccccggtggagagctgggaagaggtcccctacctggggaagcgtgaggaccagtggtgcgggtccctgataggcctgacgagccgggcgacatgggcaaagaatatacaaaccgctatcaaccaggtgcgcagcctgatcggcaacgaggagtacaccgactacatgccctccatgaaacgcttccgaagagaggaggaggaagccggtgttctctggtga

SEQ ID NO: 25087 - RNA, 9876 nt, synthetic construct
  misc_feature 1..9876: note = derived and/or modified CDS sequence (opt11) from DENV-2__EU482684__SS-prME
  source 1..9876: mol_type = other RNA
acagccggcgtgatcgtcatgctgataccgaccgccatggcctttcatctcacaacccgcaacggggagcctcacatgatcgtaggtcgccaggaaaaggggaagtccttgttattcaagaccgaggacggcgtaaacatgtgtaccctcatggccatcgacctgggggagttatgcgaggatacgatcacctacaagtgcccccttctgagacagaacgagcccgaggacatcgactgctggtgcaatagcaccagcacctgggtcacctacgggacttgcactaccactggagagcacagacgcgagaagaggtccgtggccctggtgccccacgtgggtatgggcttggaaacccgaactgagacctggatgtcgagcgagggggcgtggaagcacgtgcagcggatcgagacctggatccttcggcatcctggcttcacgatcatggctaccatcctggcttacaccatcggaaccacccattttcagcgagccctcattttcatattgctgaccgccgtggcccccagcatgactatgcgctgcatcggcattagcaacagagatttcgtcgagggcgtttcgggcggctcgtgggtggacatcgtgctcgaacacgggagttgcgtgacgaccatggcgaagaacaagccaaccctggatttcgagctgatcaagaccgaagccaagcagcccgctaccctccgcaagtactgcatcgaagctaagctgaccaacaccacaacggagtccagatgccctacacagggcgagccatcgctgaacgaagaacaggacaaacgctttatctgcaaacattccatggtggatcgggggtgggggaatggctgtggactgtttggaaaaggcggcatcgtgacctgtgccatgtttacgtgcaagaagaacatggaggggaaggtagtgcaacccgagaacctggagtacacgatcgtcatcaccccgcatagcggggaggaacacgcggtgggcaacgacaccgggaaacacggcaaagagattaagataaccccccagtccagcatcaccgaggccgagctgacgggttacggtaccgtcactatggagtgcagcccccggactgggttggacttcaacgagatggtgctgctgcagatggaggacaaagcctggctggtgcaccggcagtggttcctggatttgcccctaccctggctgcccggggccgacacacagggctctaactggatccagaaggagaccctagtaaccttcaaaaacccgcacgcaaagaaacaagacgtcgtggtgctggggtctcaggagggcgcgatgcacacagccctgacgggggccaccgagatccagatgtcctcgggcaacctcttattcaccggccacctgaaatgtaggcttcggatggacaagctccagctgaagggaatgtcctattctatgtgcaccggcaagtttaagatcgtgaaggagatcgccgagacgcaacatggtaccatcgtgatcagggtacaatacgagggagacgggagtccctgcaagatcccctttgagataacagatctggagaagcgtcatgtgctcgggcggctgatcaccgtgaacccgatcgtgaccgagaaggattctcccgtgaacatcgaagcggagccccctttcggtgattcgtatatcatcatcggcgtggagccgggccagctgaagttaaactggtttaagaaggggagctccatcggccagatgttcgaaacaaccatgagaggcgcgaagcgaatggccatcctgggggacactgcctgggacttcgggagcctcgggggcgtcttcacttcgataggcaaggccctacaccaggtgttcggcgccatctacggcgcagccttctccggtgtgtcgtggaccatgaagatcctgatcggagtcatcatcacgtggatcgggatgaacagccgctccaccagtctgtccgtgtctctggtactcgtcggtgttgtcacactatatctgggggccgttgtgcaggccgactccggctgtgtggtcagctggaaaaacaaggagctaaaatgcgggtccgggatcttcatcacggacaatgtacatacctggaccgagcagtacaaatttcaacctgagagcccaagcaaactggcgagtgccattcagaaggcccatgaggagggaatctgcggaatacggtccgtgacgcggctggagaatctcatgtggaagcagattacccccgagctgaatcacatcctttccgagaacgaggtcaagctaacaatcatgaccggcgacatcaaagggatcatgcaggcgggcaagcggagccttcgcccgcagccgacggagctcaagtactcctggaagacctggggcaaggcgaagatgctctcaaccgagtcccacaaccagaccttcctgatcgacgggccagagactgcggagtgcccgaacacaaatagggcgtggaacagcctggaagtggaggactacggctttggagtgttcaccaccaacatctggctcaagctgcgcgagaagcaggacgttttctgcgattccaagcttatgtcggccgccataaaggataaccgggccgtgcacgcggacatgggctactggatcgagtccgccctcaacgatacgtggaagatggagaaggcaagctttatcgaggtaaagagctgccactggcccaagagccacacgctgtggtccaacggtgttctggagagcgagatgatcatccccaagaacttcgcgggccccgtgtcccagcataactacagaccgggctatcacacccagaccgccggcccctggcatctcggcaagctcgaaatggacttcgacttctgcgagggcactacggtggtggtgactgaagactgcggcaacaggggcccttcgctaagaactaccacggcgagcgggaagctcatcacggagtggtgttgccggtcttgtaccctccccccactgcggtaccggggcgaggacgggtgctggtacgggatggaaatccgccccttgaaggagaaggaggagaatctggttaactctcttgtaaccgctgggcacggccagatcgataacttttccctcggtgtgctggggatggccctgttccttgaggagatgctgaggacgcggatcggaaccaaacatgccattctgctagtcgccgtcagcttcgtgaccctgatcaccgggaacatgtcgttccgggacctaggtcgcgttatggtcatggtgggggccacgatgaccgacgacattggaatgggtgtgacctaccttgcgctgctggccgcattcaaggtccggcctacattcgcggccgggttattactgcggaagcttacgagcaaggagctgatgatggcaaccatcggcatcgccctcctctcacagtctaccatccccgaaacgatattagaactgacagacgctctcgcgctggggatgatggtgctgaagatcgtgcgcaacatggagaaataccagctcgcagtcaccatcatggcaatctcctgcgtgccgaacgcagttatcctccagaacgcctggaaggttagctgcaccattctggcggcggtgtctgtcagccccctgttgcttacaagcagccagcagaaagcagactggattcctcttgccctgacgataaaaggcttaaatcccaccgcgatctttctcaccaccttgtcacggacgtccaagaagcgctcctggccgctgaacgaggccataatggctgtggggatggtgtccatcctagcatcctctctactaaagaacgacattcccatgaccgggcccctcgtcgccggagggctgctgaccgtatgttacgtgctcaccggccgtagtgcagacctggaacttgagcgcgccgctgatgtaaaatgggaggaccaggccgagatatcagggtcttcccctattctcagcatcactatctccgaggacggcagcatgagtattaagaacgaggaagaggagcagacccttactatattgatccggaccgggttgctggtgatctccggagtgttccccgtctccatccccatcaccgccgccgcctggtacctgtgggaggtaaaaaagcagcgcgccggcgtcctctgggacgtccccagccccccgccagtggagaaggccgagctggaagacggtgcgtaccggatcaagcagcgcggcatcctgggctactcacaaattggagcgggcgtttacaaggaggggactttccacacaatgtggcacgttacccggggagcggttctaatgcatcgcgggaagagaatagagcccagctgggctgacgtgaagaaggaccttatctcctacggtggtgggtggaagctcgaaggagaatggaaggagggcgaggaagtccaagtgctcgccctggaacccggtaagaatccccgcgctgtgcagaccaaacccgggatattcaagaccaacaccggcaccatcggggcggtcagccttgacttttcccccggcactagcggctcgcccatcgtggaccggaaggggaaggttgtgggcctctacgggaatggcgtggtgacccgctctggggcatacgtatccgcgatagcccagaccgagaagtccatcgaggacaaccccgagatcgaggacgacatattccggaagaagcgcctaactatcatggacttgcacccaggagcgggaaaaaccaaacggtaccttcccgccatcgtgagggaagccatcaagcgggggctgcgcacgctgatcctggctcccacccgcgtggtcgccgcggagatggaggaggccttacggggcctacctatccgctaccaaaccccggcgataaagaccgagcatacgggccgggagatcgtggacctgatgtgccacgcaacattcaccatgcgcctcctgtcccccgttcgggttccaaactacaacctgatcatcatggacgaggcccacttcacagaccctgcatccattgccgcccgcgggtacatctcaacgcgggtggagatgggcgaggccgccggaatcttcatgaccgcgacgccgcccggctcacgcgacccgttcccccagtccaatgccccgataatggacgaggagcgggaaatccccgaacgctcgtggaactccggtcacgaatgggtcaccgacttcaagggcaaaactgtctggttcgttccgagcattaaggccgggaacgacatcgcagcgtgcctccggaagaacggaaagaaggtgatacagctgagccgtaaaactttcgactccgaatacgtcaagacccgggcaaacgactgggacttcgttgtcaccacggacatatccgagatgggggcgaactttaaggccgagcgcgtcatcgaccccaggcgctgtatgaagccggtgatcctcaccgatggcgaggagcgggtgatactcgccggtccgatgccagtcacccattccagcgcggcccagagaagagggcgcatcggccgcaaccccaaaaacgaaaacgaccagtacatctacatgggggagcccctggagaacgatgaggactgcgcccactggaaagaggcgaagatgctgctcgacaacattaacacccccgagggaataatcccatccatgttcgagcctgagcgggagaaagtagacgcaatcgacggcgaataccgcctacgcggggaggcgaggaagacattcgttgacctaatgcggcgcggcgacctccccgtttggttagcctacaaggtggccgccgagggcatcaactatgcggacagaaagtggtgcttcgacggcatcaaaaacaaccagatcctcgaggagaacatggaggtggagatctggaccaaggaaggggagcgcaagaagctcaagccgcggtggctggacgcccgcatttacagcgaccccctggccttgaaggagttcaaggagttcgccgccggccggaagagcctgaccctgaatctcatcacagaaatggggcgcctgcctacattcatgacgcagaaggcgcggaacgcgctggacaaccttgcagtactgcacacggccgaggccgggggccgcgcgtacaaccacgccttgagcgagctccccgagaccctagaaacgctgctcctgttaacgctcctggcgaccgtgacgggcggcatcttcctcttccttatgtccggaaaggggatcggcaaaatgacactggggatgtgctgcatcatcacggcaagcatcctactatggtacgcacaaatccagccgcattggattgctgcctccatcatactagaattcttcctgattgtacttctaatccccgagcccgaaaagcagcggacgccccaggacaaccagctgacctatgtggtaatcgctattttaaccgtcgtggccgctactatggcgaacgagatgggtttcctggagaagaccaagaaggacttagggttaggcagtatcaccacccaggaatccgagtccaatatcctggacatcgacctgcgcccggcctcggcctggacgctctacgccgtggccaccaccttcgtcacccccatgctgcgacactcaatcgagaacagctccgtgaatgtcagcctgacagccatcgccaaccaagcgaccgtcctcatgggattagggaaggggtggccactctccaaaatggacatcggggtgcccctcctggcaatcggctgctacagccaggtgaacccgatcaccttgaccgctgccctcctgctgctcgtcgcccactacgcgatcatcgggcccggcctccaggcgaaggcaacgcgcgaggcccagaagagggccgcagccggaatcatgaaaaaccctaccgtggacgggatcaccgttatcgacctggagccaatcccctatgatcccaagttcgagaagcagctcggccaggtcatgctgctgattttatgtgtaacgcaggtgctcatgatgcgtacgacctgggcgctgtgcgaggcgctcactcttgccacagggcccatctccaccctgtgggaagggaatcccgggcggttctggaataccactatcgccgttagcatggccaacatcttccgcggtagctatctcgcgggagccgggctgctgttttccatcatgaagaacacaacgagcaccagacggggcacggggaacatcggcgagaccttgggcgagaaatggaagagccgcctgaacgcactgggcaagtcggagtttcagatctataagaaatccggcatccaggaagtggaccggacactcgcaaaggaggggatcaagcgcggcgagaccgaccaccacgcggtgtcaagagggagcgccaaactacgctggttcgtcgaacggaacatggttacgccggagggcaaagtggtagacctgggctgtggacgaggcgggtggagctattattgtggtggcctcaagaacgtgcgggaggtaaagggcttgaccaagggcgggcctggccacgaagagcccattcccatgagcacgtacgggtggaatctggtccgcctacagagcggcgtggatgtgttttttacaccgcccgaaaagtgcgacacactgctatgcgacatcggcgagagcagccctaatcccaccatcgaggccggccgtaccctccgcgtccttaacctagtggagaactggctcaataacaacacgcaattttgcatcaaggtgctgaacccgtacatgccatccgtcatcgagaaaatggaggccctacagcggcaatacggcggggccctcgttcgcaaccccctgagccggaactccacccacgagatgtattgggttagcaacgcaaccggcaacattgttagcagcgtgaatatgatatcccgcatgctgattaaccggttcaccatgaagcacaagaaggctacgtacgaaccggacgtcgatctgggcagtggaacccgcaacatagggatagagtcagagatcccaaatctcgacatcataggcaagcgtatcgagaagatcaaacaggagcacgagatttcttggcactacgaccaggaccacccttacaagacctgggcctaccatggctcgtatgagaccaaacagacggggtctgcctcctcgatggtcaacggtgtggtacgcctgttaaccaagccatgggatgtcgtgcccatggtgacccagatggccatgacggatacgacgccgttcgggcagcagcgcgtttttaaagagaaggtggacacccgtactcaggagccgaaggaaggcacgaagaaactcatgaagataaccgcagagtggctgtggaaggagcttggcaagaagaagacgccccgaatgtgtacgcgggaggagttcactaagaaggtgcgctccaatgccgccctcggggccatcttcaccgacgagaacaagtggaagtcagcccgggaggcggttgaagacggcagattctgggaactggtcgaccgggagcgcaacctgcacttagaggggaagtgcgagacctgtgtgtacaacatgatgggcaagcgggagaagaagctgggcgaattcggcaaggccaagggctcacgcgccatttggtacatgtggctgggggcaaggttcctggagttcgaggcgctgggctttcttaacgaggaccactggttcagccgcgggaacagcctctccggcgtcgagggggagggcctacaccggctcggctacattctcagagatgtggggaagaaggaggggggggctatgtatgccgacgacaccgcaggatgggatacgcggataacccttgaggacctgaagaatgaggagatggtgaccaaccacatgaaaggtgagcacaaaaagctggccgaggcaattttcaagctgacctatcagaacaaggtggttcgcgtgcagcggcccacgccccgcggtacggtgatggacatcatctcccggcgcgaccagaggggctccggtcaggtcggaacctacgggctgaacaccttcacgaacatggaggcccagctcatccgccaaatggagggcgaaggcatcttcaagagcatccagcacttaacagccacggaagagatcgccgtccagaactggctggcccgtgtggggcgtgagcgcttatcccggatggcgatatcgggagacgattgcgtggtcaagcccatcgacgatcgcttcgcgtcagccttgaccgccctgaatgacatggggaaggtgcgcaaggacatccagcagtgggaaccctcgcgcggctggaatgactggacgcaggtgcctttttgctcccaccacttccacgaactcgtcatgaaggatggaagggtgctggtagtcccatgccgcaaccaagacgaactgatcggtcgagcccgcatctctcaaggggctgggtggtcgctcaaggagaccgcatgcctggggaagagctacgcgcagatgtggacactgatgtacttccacagaagggatttacggctggctgccaacgcgatctgctccgccgtgccctcccattgggtgcccacctcccggaccacatggagcatccacgccaagcatgagtggatgaccactgaggacatgttggccgtctggaaccgtgtgtggatacaggagaacccgtggatggaggacaagacccccgtggagtcctgggaggaggttccctatctggggaaacgagaggaccagtggtgtggcagcctgattgggctaacaagtcgggcgacctgggccaaaaacatccagactgccatcaaccaggtgcgctccctgatcggcaatgaggaatatacagactatatgcccagcatgaagcggttccgtcgagaggaggaggaggctggcgtgctgtggtga

SEQ ID NO: 25088 - RNA, 9876 nt, synthetic construct
  misc_feature 1..9876: note = derived and/or modified CDS sequence (opt11) from DENV-2__EU482685__SS-prME
  source 1..9876: mol_type = other RNA
accgcgggcgtgatcgtaatgctcatccccaccgccatggcgttccatctgaccacccgcaacggggagccccatatgatagtcggacggcaggaaaaggggaagtccctgctctttaaaacggaagacggcgttaatatgtgtacactcatggcgatagatctgggggagctgtgtgaggacaccatcacgtacaagtgccccctcctgcgccaaaatgagccggaggacatcgactgctggtgcaactcaacctctacctgggtcacctacggaacttgcaccaccacgggagagcacagacgcgaaaagcggtccgtagccctggtgccacatgtagggatgggactagagacgcgcacggagacgtggatgagctctgagggggcctggaagcacgtgcagcggatcgagacctggatcctgcgccaccctggcttcaccatcatggctgcgatcctggcctataccatcgggaccacgcatttccagcgggcgctgatcttcatcctcctgaccgccgtggcgccctctatgacgatgcgctgcatcggtatcagcaaccgcgacttcgtcgagggcgtctcaggcggcagctgggtggatatcgtcttagaacacgggtcttgcgtgaccaccatggccaaaaacaagcccacgctggactttgagctgataaagaccgaggcgaaacagcccgcaaccctacgcaaatactgcatcgaggctaagctgacgaacaccaccaccgagtcccggtgcccgacgcagggcgagcccagcctgaacgaggaacaggataagaggttcatctgcaagcactccatggtggaccgggggtggggcaacgggtgtgggctgttcggtaagggcggcatcgttacctgcgcaatgttcacgtgcaagaagaacatggagggcaaggtggtgcagcccgagaatctggagtacactatcgtcatcacgccccactctggcgaggaacacgccgtgggcaacgatacgggaaagcacggaaaggaaatcaagatcacaccccagtccagcatcacagaagccgagctcaccgggtacggcactgtgactatggaatgcagcccccggacaggcctcgacttcaacgagatggtactgctgcagatggaggacaaggcttggctcgtgcaccgacagtggttcctcgacctgccccttccatggctgcccggggctgatacccagggcagcaactggatacagaaggaaacgcttgttacgtttaagaatccccacgctaagaaacaggacgttgtagtcttaggatcccaggaaggcgccatgcacaccgccctgaccggggccacggagatacagatgtctagcggcaacctattatttacaggccaccttaagtgccgcctccggatggataagctccagctaaaagggatgagttatagcatgtgcaccggcaagttcaaaattgtaaaggaaatagccgagacccaacacgggacgattgtgatccgcgtccagtacgagggcgacggcagcccctgcaagatccctttcgagatcacagacctcgagaagcggcacgttctcgggcgcctgataaccgtgaacccgatagtcactgagaaggacagccccgtgaatatcgaggcggagccgccattcggagactcctacattatcatcggggtcgagccgggtcagctgaaactcaactggtttaagaaagggagcagtatcggccagatgttcgagacgacgatgcgaggcgccaagcggatggccatcctgggggacaccgcctgggacttcggcagcctcgggggcgtctttacctccatcggaaaggccctccatcaggtgttcggcgcgatatacggcgcagcctttagcggtgtttcctggacaatgaagattctgataggcgtgattatcacctggatcggtatgaactctcgctccacctcgttgtcagtgagcctggtgctcgtcggcgtggtgactctgtacctgggggcagtcgttcaggcggactccggctgcgtggtcagctggaagaataaggagctcaagtgcggctctggaatctttataaccgataatgtacacacctggaccgagcagtacaaattccagcctgaaagccccagcaaactggcctccgccatccagaaggcccacgaggagggcatctgcgggatccgctctgtgacccgcttggagaacctcatgtggaagcaaattacgccagaactgaaccacatcttatccgagaacgaggtcaagctcaccatcatgaccggtgacatcaaggggatcatgcaggccggcaagaggagcctccgcccgcagcccaccgagctgaagtactcctggaagacgtggggcaaagccaaaatgctctccaccgagtcccacaaccagaccttcttaatcgacggacccgaaacggccgagtgcccgaatacgaaccgggcctggaattcactggaagtggaggactacggattcggggtgttcaccactaacatctggctcaagctacgcgagaagcaggacgtcttctgtgacagtaaattaatgagcgcggccataaaggataacagggcagtacatgccgacatgggctactggatcgagtccgcccttaacgacacctggaagatggagaaggcctcctttatagaggtgaagtcctgccactggcccaagtcacacacgttgtggtctaacggcgtgcttgagagcgagatgatcatccccaagaacttcgccgggcccgtgtcccagcacaattacagacctggataccacacgcaaaccgcagggccctggcacctcggcaagctggaaatggacttcgacttctgcgaggggaccacagtggtcgtgacggaggactgcggtaacaggggccccagcctgcgcacaaccaccgcgagcgggaagctcatcacggagtggtgttgccggtcgtgcaccctgcccccgctgagatacagaggcgaggacgggtgctggtatggcatggaaatccggcccttgaaggagaaggaggagaacctggtcaacagcctggtcacggccgggaacggccagatcgataacttctccctcggcgtgctggggatggccctgttcctcgaggagatgctgcgtacgagaataggcacgaaacacgcgatcttactagtggccgtcagcttcgttaccctgataactgggaacatgtccttccgggacttaggccgcgtgatggtcatggtgggggccaccatgacggacgacatcggcatgggcgtgacctacctcgccctgctggccgcgttcaaggtccgcccgaccttcgctgcaggattacttctgcggaagctcaccagcaaggagctgatgatggctacgatcggcatcgccctgctctcccagagcaccattccggagacgatcctagaactgaccgacgcgctcgcccttgggatgatggttctgaagatcgtgcgtaacatggagaagtaccagctcgccgtcacgatcatggccatcagttgcgtcccgaatgccgtgatcctgcagaatgcttggaaggtcagctgcaccatcctagccgccgtgtccgtgagccccctcttactgacatcaagccagcagaaggcggactggatacccctcgcgttgacaatcaaagggctgaaccccacggcgatcttcctcaccaccttatcccgtacctcgaagaagcgctcgtggccgctgaatgaggcaataatggctgttggcatggttagcatcctcgcctccagccttctgaagaatgacatcccaatgacggggccccttgtggcggggggtttgctgaccgtgtgctacgtgctcaccggcagaagcgccgatctggagctggagcgcgccgcagatgtcaagtgggaggaccaggcagagatctccggtagctccccaattctctctataaccatttccgaggacggcagcatgtcaatcaaaaacgaggaggaagagcagacgctgaccattctgatccggaccggccttctggtcatcagcggtgtgtttccggtctccatccccatcaccgcggcagcttggtatctttgggaggtgaagaagcagagggccggcgtgctctgggacgtccccagcccccctcccgtggaaaaggcggagctggaggacggggcgtaccggataaagcagcgtggaatcctagggtattcccagatcggcgctggcgtatacaaggagggcaccttccacacgatgtggcacgtcactagaggagccgtgctcatgcatcgcggtaagcgcatcgaacccagctgggctgacgtcaagaaagacctgatctcctacggcgggggatggaagctggagggggaatggaaggagggggaggaggttcaggtgttggccctggaacctggcaagaaccctcgtgcggtgcaaactaagcccgggatcttcaagactaacacggggactatcggcgccgtcagcctagacttctccccaggtacctcgggctccccaatcgtggaccggaaaggaaaggtggtcggattatacggaaacggcgtggtgacccgctcaggcgcctacgtctccgccatcgcgcagacggagaagtccatcgaggacaatcccgaaatcgaggatgatatctttcggaagaaacgcctgaccatcatggacctgcaccccggggcgggcaagacgaagcggtacctccccgccatagtgcgagaggccatcaagagagggctgcgcaccctgatactggcccccacgcgcgttgtagctgctgagatggaggaggccctccggggcctgccgatcagataccagacgcccgccatcaaaaccgagcacacgggaagggaaatcgtggacctgatgtgccatgccacgttcaccatgcgccttctcagccccgtccgggtcccgaattataacctgatcatcatggacgaggcgcacttcaccgaccccgcctccatcgccgcccgcggctacatcagcacccgcgtggagatgggcgaggcggcgggcatcttcatgacggccacgccgccgggctcccgcgacccgttcccccaatctaatgcccccatcatggatgaggagcgagagatccccgagcgctcctggaacagcggacacgagtgggtgaccgacttcaaaggcaaaaccgtgtggttcgtgccgtctatcaaggccgggaacgacattgcggcctgcctccggaagaacggaaagaaggtgatccagctgagccgcaagacgttcgattccgagtatgtcaagactcgggccaatgactgggactttgtggtgaccaccgacataagcgagatgggtgccaacttcaaggccgagcgcgtcatcgacccccggcggtgcatgaagcccgtgatcctgacggacggggaggagcgggtgattctagcggggccaatgccggtcactcactcaagcgccgcccagcgccgggggcgcatcggacgcaatcccaagaatgagaatgaccagtacatctacatgggggagcccctggagaacgacgaggactgcgcccactggaaggaggcgaaaatgctgttggacaacattaacacccccgaaggcatcatccccagtatgttcgaacccgagcgggaaaaggtggacgctatcgatggcgagtaccgcctgcgcggggaagcccgcaagaccttcgtggacctgatgcggcgtggagacctaccggtctggcttgcctacaaggtggcggccgaagggatcaactatgcagaccggaagtggtgcttcgatgggatcaagaacaaccagatcctcgaggaaaacatggaggtggagatctggacgaaggagggggaacgaaagaagcttaagccgcggtggctcgacgcccgcatctacagcgaccccctcgccttgaaggagttcaaggagtttgccgcgggccggaaatccctaaccctgaacctcataactgagatggggcgcctgcctaccttcatgacgcagaaggcaaggaacgctctggacaatctcgccgtactgcacaccgcggaggccgggggccgcgcatacaaccacgctctgagcgaactacccgagaccctggagaccctgctccttttaacgctcctggcgaccgttacgggaggcatcttcctgttcctaatgtccggcaaggggatcggcaagatgacactggggatgtgctgtatcatcaccgccagcatcctactctggtacgcgcagatacagccacactggatcgccgccagtatcatcctggaatttttcctgatcgtcttactgatccccgagcccgagaagcaacggaccccccaggacaaccaactgacctacgtggttatcgccatcttaaccgtggtcgccgcgactatggccaacgagatgggcttcctagagaagaccaaaaaggaccttggactcggctccatcaccacccaggagtccgagtccaacattcttgatatcgaccttcgcccggcctcggcgtggaccctctacgccgtggccaccacctttgtcactcccatgttgaggcactccattgagaactcatccgtgaacgtgagcctgacggccatcgccaaccaggccacggtcctcatgggcctggggaagggctggcctttatccaagatggacatcggggtgcccttgctggcaatcgggtgctatagccaggtgaatccgatcaccctgaccgctgccctcttgctgctcgtcgcccactacgccatcattggacccggcctacaagcaaaggccacccgagaggcgcagaagcgggctgcagcgggcattatgaagaacccgacagtggacggcattaccgtgatcgacttagagcccattccgtacgaccccaagttcgaaaaacagctcggccaggtcatgctgctgatcctctgcgtcacacaggtgctgatgatgcgaaccacgtgggccctgtgcgaggccttgacactagccacgggtcccatctccaccttgtgggagggcaatcccgggcggttttggaatacgactatcgccgtcagcatggctaacatattccgcggctcttacctcgccggcgcggggctgttattctccatcatgaagaacaccacctccacgaggcggggcaccgggaacattggcgagaccctcggcgagaaatggaaaagccgcctgaacgccctggggaagagtgagtttcagatctacaagaagtcagggattcaggaggtcgaccggaccctagcaaaggagggtatcaagcgcggcgagacagaccatcacgccgtgtcccggggcagcgccaagctgcgctggttcgtcgagagaaacatggtgactccggagggcaaggtggtagacctggggtgcgggcgcggcggttggtcctattactgtggcgggctcaagaacgtgcggcaggttaaagggctgaccaagggcgggcccggccacgaagagcccattccaatgtctacctacgggtggaacctggtccggctccagtctggcgtggacgtgttcttcacgccgcccgagaagtgtgacaccttattatgcgacatcggagagtccagccccaaccccacgattgaggccggccgtaccctccgcgtcctgaacctggtggagaactggctcaacaataacacccaattctgcataaaagtgctgaacccttacatgccctccgttattgagaaaatggaggccttgcagcggcagtacggaggggcgctcgtgcgcaaccccctgagccggaacagtacgcacgagatgtactgggtcagcaacgccacgggtaacatcgtctccagcgtgaacatgatctcccgcatgctaatcaatcgattcaccatgaagcacaaaaaggccacctatgagcccgacgtggacttgggcagcggcacgcgcaacatcgggatagagtccgagataccgaatcttgacataatcggcaagcggatcgagaagatcaagcaggagcacgaaatatcgtggcactatgaccaggaccacccatataagacctgggcataccacgggtcctacgagaccaagcaaaccgggagtgcaagcagcatggtcaatggagtggtgcgcctgctcacgaagccctgggacgtcgtccctatggtaacccagatggcaatgaccgataccactcccttcgggcagcaacgcgtctttaaggaaaaggtagacacccggactcaggaacctaaagaaggcactaaaaagctcatgaagataaccgccgagtggctctggaaggagcttggcaagaagaaaacgccgcgcatgtgtaccagagaggaatttactaagaaggtgcgcagcaacgccgccctcggggctatcttcaccgacgagaacaagtggaagtccgcacgggaggccgtagaggacggacgcttctgggagctggtagaccgggagagaaaccttcacctagaggggaagtgcgaaacgtgtgtgtataacatgatgggtaaacgggagaaaaaactgggggagttcggcaaggccaagggctcccgcgccatctggtacatgtggctgggggcgcggtttctagagtttgaggccctgggattcttaaacgaagaccactggttctcgcgcgggaacagcctctctggcgtcgagggtgagggcctgcacaggttaggctacattctccgcgatgtgggtaagaaggaaggcggggccatgtacgccgacgacaccgccggctgggacacccgcattacgctggaagacctaaagaacgaggagatggtcaccaatcacatgaagggggagcataaaaagctcgcggaggccatcttcaagctgacctatcagaacaaggtggtgcgcgtccagcggccgacgcccagagggactgtgatggatataatcagccggcgcgaccagcggggatccggccaggtaggcacctacgggctgaataccttcaccaatatggaggcccaactcatccgccagatggagggcgagggcattttcaagagtatccagcaccttacggctaccgaagagatcgccgtccaaaactggctggcccgcgtgggacgggagcgcctatcccggatggccatcagcggcgacgattgcgtggtcaagcccatcgacgaccgctttgcctcagcgctgacagccctgaatgacatggggaaggtgcggaaggatatccagcagtgggagcctagccgcggctggaacgattggacccaggtgccgttctgctcacaccacttccacgagctcgtcatgaaggacgggcgggttctggtggtcccgtgccgcaaccaggatgagcttataggccgggcgcgcataagccaaggagctgggtggtccctgaaggagacggcctgcctagggaagagctacgcccaaatgtggactctgatgtacttccatcggcgcgaccttcggctggcagctaacgccatctgctccgctgtgccaagccactgggtccccacctcccgcaccacctggtctatccacgccaagcacgagtggatgacaaccgaggacatgctggcggtctggaaccgggtatggatccaggagaatccgtggatggaggataagacccccgtcgaatcatgggaagaggtcccctatctcggtaagcgcgaggaccagtggtgcggcagcctgatagggctgacctcgcgggccacgtgggccaaaaacatccagacggcgatcaaccaggtgagatctcttataggcaacgaggaatacactgattacatgccctccatgaagcggttccgccgcgaggaggaagaagcaggcgtgctctggtga

SEQ ID NO: 25089 - RNA, 9876 nt, synthetic construct
  misc_feature 1..9876: note = derived and/or modified CDS sequence (opt11) from DENV-2__EU482687__SS-prME
  source 1..9876: mol_type = other RNA
accgcgggggtgatcgttatgctcatccccaccgccatggcgttccacctcaccacccgcaacggggagccccacatgatcgtcgggcggcaggagaaggggaagtccctgctgttcaagaccgaggacggcgtgaacatgtgcacactcatggcgatcgacttgggggagttatgcgaggacaccatcacgtataagtgccccctccttcgacaaaacgagcccgaggacatcgactgctggtgcaacagcaccagcacctgggtcacttatggcacgtgtaccaccacgggcgagcaccggcgcgagaagcgatccgtggcccttgtgccccacgtcgggatgggtctcgagacccgcaccgagacttggatgtcgagcgagggcgcgtggaaacacgtgcagcggatcgaaacatggatcctgcgccaccctggtttcactatcatggcggccgtgctggcctacaccatcgggaccacgcacttccagagagccctcatctttgtcctgctgaccgccgtggctcccagcatgaccatgagatgtatcggcatcagcaaccgggacttcgtggagggcgtcagcggcggaagctgggtggacatcgtgctcgagcacgggagttgcgtcacaacgatggccaagaacaagcctacactggacttcgagcttatcaagaccgaggccaagcagcccgctaccctccgcaagtattgcatcgaagccaaactgacgaataccactaccgagagtcggtgcccgacgcagggcgagcccagcctgaacgaggagcaggataagcgtttcatctgcaagcactccatggttgaccggggttgggggaacggctgcggcctgttcgggaaaggagggatcgtaacctgcgcgatgttcacgtgcaagaagaacatggagggcaaggtcgtgcaacccgaaaacctggaatacaccatcgtgatcactccccatagcggggaggagcacgccgtcggcaacgacaccgggaagcacggcaaggaaatcaagataacccctcagtcctcaataaccgaagccgagcttaccgggtacggcacggtgaccatggagtgttcacccagaaccggcttagacttcaacgagatggtgctgctccagatggaggacaaggcctggttggtccatcggcagtggttcctggacctgccgctcccctggctcccgggggccgacacccagggcagcaactggatccagaaggagaccctagtgacatttaaaaatccccacgcgaagaaacaggacgttgtcgtgctcggctcacaggagggggccatgcacaccgccctgaccggggccactgagatccagatgagcagcggcaacctcctcttcaccggccacctgaagtgccgcttgcggatggacaagctccagctgaagggcatgtcctacagcatgtgcacaggcaagttcaaaatcgtcaaggaaatagccgagacccagcacgggaccatcgtgatacgggtgcagtatgaaggcgacggctccccctgcaagatcccctttgagatcacagacctggagaagcgacacgtgctcgggcgcctaatcaccgtgaacccgatcgtgaccgagaaagacagccccgtcaacatagaggcggaacctccgttcggcgactcctacatcatcatcggggtggagccgggccagttaaagttgaactggttcaagaaagggagctccatcggccagatgttcgagacgaccatgcgcggcgccaaacggatggccatcctgggggataccgcctgggacttcggctcattagggggcgtgtttacgtccatcggtaaggcccttcaccaggtgtttggcgcaatctacggcgccgccttcagcggagtgtcctggaccatgaaaattctgatcggcgtgatcattacctggatcgggatgaactcacgttccacctcgctgtccgtcagcctagtgttagtgggcgttgtgaccctgtacctgggggcagtggtccaggcggactcaggctgcgtggtgagctggaagaataaggaactcaagtgcggatccgggatattcataacggacaacgttcacacctggaccgagcagtacaagttccaacccgagagccccagcaaacttgcctccgccattcagaaggcccacgaggaggggatctgcgggatccggagcgttacccgccttgagaacctcatgtggaagcagatcacgcccgagctgaaccacattctgtccgagaacgaagtcaagctcacaatcatgactggcgacatcaaaggcatcatgcaggccggcaagcggagcctgcgcccacagccaaccgagctgaagtactcctggaaaacgtggggcaaagctaagatgttaagcaccgagtcccacaaccagacattcctgatagacgggcccgagacagccgagtgcccgaatacgaaccgggcctggaacagcctggaggtcgaagactacggcttcggggttttcaccaccaacatctggctcaagctgcgcgagaagcaggacgtattctgcgacagcaagctaatgagcgccgccatcaaggataaccgggcggtccacgccgacatgggctactggatcgagtcagctctaaacgacacctggaagatggagaaggctagcttcatcgaggtaaagagctgccattggcccaagtcccacaccttatggtccaacggcgtactggagagcgagatgataatacctaagaactttgccgggcccgtctcccagcacaattaccgcccgggataccacacgcagaccgctgggccctggcatctcggcaagttagagatggactttgacttctgcgagggtaccacggtggtggtcacggaggactgcggcaaccggggcccctcactgcgcaccactaccgccagcgggaagctcatcacagaatggtgctgccggtcctgcaccctacccccgctgcgctaccgcggggaagacgggtgctggtacggcatggagatacggcccctcaaggagaaggaggagaacctggtgaacagcctggtgaccgctgggcacggccagatcgacaacttctccctcggcgtcctgggtatggccctgttccttgaagagatgctacgcacccgcatcggcactaaacatgcgatactgctcgtggccgtgagcttcgtcaccctaattaccgggaatatgtcctttagggacctcggccgcgtgatggtcatggtcggtgcaaccatgacggacgacataggcatgggcgtgacttacctcgccctgttggcagcgttcaaggtgcgccccaccttcgcagccgggctcctgctaaggaagctcaccagcaaggagctgatgatggccacgatcggcatcgccctgctctcccagagcaccatccccgagaccatcctagagctgaccgacgcgttagccctgggtatgatggtcctgaaaatagtgcgcaacatggagaagtaccagctcgccgtgacgattatggccatcagttgcgtcccgaacgccgtgatcctgcagaacgcgtggaaagtctcgtgcacgatcctggccgccgtgtcggttagccccctcctgctgacctcctcgcagcaaaaggccgactggatccctttggcgcttaccatcaagggactgaaccccacggccatctttctcaccaccctgtctcggaccagcaaaaagcgctcctggccgctgaacgaggccatcatggcagtcgggatggtgagcatcctcgcgtccagtctgcttaagaacgatatccccatgacgggcccgcttgtcgcgggcgggctgctgaccgtatgctacgtgctcaccggccggagcgccgacctggagctggagcgcgctgcggacgttaaatgggaggaccaggcggaaatatccgggagcagcccgatcctctctatcaccatctctgaggacggcagcatgtccataaagaacgaggaggaggagcagaccctgactatcctaatccggaccggcctcctggtcatcagcggggtgttccctgtgtccatccccattaccgcggctgcctggtacctgtgggaggtcaagaaacagcgcgcaggcgtgctctgggacgtgcccagcccgccgcccgttgaaaaggcagagctggaggacggggcgtaccgtatcaagcaacgcggcatcctggggtactcccagattggggccggcgtgtataaagaggggacctttcacacaatgtggcacgtcacccgcggcgccgtcctaatgcaccgtgggaagcggatcgagcccagctgggccgacgtgaagaaggatcttatctcctatggcggaggctggaagctggagggcgagtggaaggagggtgaggaagtgcaagtgcttgccctggagcccggcaagaatccaagagccgtgcagaccaagcccgggatcttcaagaccaacacgggcactatcggggccgtaagtctggacttctcccccggcaccagcggctccccgatcgtcgatcggaagggtaaagtggtcggcctctacggcaatggcgtcgttacccggagcggcgcctacgtgtccgccattgcccagacggagaaatccatcgaggacaatcccgagatcgaagacgacatcttccggaagaagcgcctgaccatcatggacctgcaccccggggcgggtaaaactaagcggtacctcccagccatcgtccgcgaggctatcaagcgggggttacgcaccctcatcttggcccccacacgcgttgtggcggccgaaatggaggaagccctcagaggcctgcctatccgctaccagacccccgccattaagaccgagcacaccggtcgggagattgtcgacctgatgtgccacgccacgttcaccatgcgcctcctgagccccgtgcgggtgccgaactacaacctgatcatcatggacgaggcgcacttcaccgaccccgcctccatcgccgcccgcggctacataagcacccgtgttgagatgggggaagccgctgggatctttatgacggccacgcctcccggctcccgggacccgttcccccaaagcaacgcccccataatggacgaggagcgggagatccccgagcgcagttggaacagtgggcatgagtgggttacagacttcaagggcaaaaccgtgtggtttgtcccgtcaataaaagccgggaacgacattgcggcctgtctccggaagaacggcaaaaaggtgattcagctgagtcgcaagacgtttgactccgagtacgttaagaccagggccaacgactgggacttcgtcgtaaccaccgatattagcgaaatgggcgccaacttcaaggccgaacgcgtgatcgaccctcggcgctgcatgaagccagtaatccttacggacggggaggagcgtgtgatcctcgcgggacctatgccagtgacccactcctcagccgcccagagacggggcagaataggcagaaaccccaagaacgaaaacgatcagtacatctacatgggggagccactggagaatgacgaggattgcgcccattggaaggaggccaagatgctgctcgataacatcaacacacccgagggaatcatcccgtccatgttcgagccagagcgggagaaagtcgatgccattgatggcgaataccgcctgcgcggggaagcccgcaagacattcgtggacctgatgcggcgcggggacttaccggtgtggctggcttataaggtcgccgcggaggggataaactacgcggaccggaaatggtgctttgacggcatcaagaacaaccagattctggaggagaacatggaggtcgagatctggacaaaggagggggagcgcaagaagctcaagccacggtggctagacgccagaatctactccgacccgttagcactcaaggagtttaaggagttcgccgcgggccggaaatccctgacccttaaccttataaccgagatgggccgcctgcccaccttcatgacgcagaaggcccggaacgcccttgacaacctcgccgtcctgcacacagccgaggccgggggccgcgcttacaaccacgcgctgagcgagctccccgagaccctggagacccttctgctgctgacattactggccactgtgaccggcggaatcttcctgttcctcatgtccggcaaggggatcggcaagatgaccttggggatgtgttgcatcattaccgctagcatcctcctctggtatgcgcagatccagccacattggattgccgcatccatcatcttggagttcttccttatcgtactcctgatccccgagcccgagaaacagcggactccacaggacaaccagctgacatatgtcgtgatagccatactaacagtggtagccgcgaccatggcgaacgagatgggcttcttggagaaaacgaagaaggacctggggctcggcagcatcacgacacaggagagcgaatccaacatcctggacatcgacttgcgcccagccagcgcctggaccctctacgccgtagcgactaccttcgtgacgccgatgctgcggcactccatcgagaatagctccgtcaatgtgagcctgaccgctatcgccaaccaggccaccgtgctgatgggcctggggaagggctggcccctgtccaagatggatattggggtcccactcttggcgatcggctgctacagccaggtgaacccgatcaccctgactgccgcactcctcctgctcgttgcgcactacgccatcattgggcccggcctgcaggcgaaggccaccagagaggcccaaaagcgggctgcagccggtatcatgaagaatcccacggtcgacgggatcaccgtgatcgatctggagccgatcccgtacgatcccaagttcgagaagcaattaggccaggtgatgctactgatcctctgcgtgacccaggtgctgatgatgaggaccacgtgggcactgtgcgaggccctcaccctggccacagggcccatatcgaccctgtgggagggcaaccccgggcggttttggaacacgaccatcgccgttagcatggcgaacatcttccgcggctcctacctggccggcgccggactgctgttcagcatcatgaagaacaccacctccacgcgccggggcaccgggaacatcggtgagaccctcggagagaagtggaagtctcgcctgaacgccttagggaagtctgagttccagatctacaagaagtccggtatccaagaggtcgaccggaccctggcgaaggaagggatcaagcgcggcgaaacggaccaccacgcagtgtcacgggggagcgccaagctgcgttggttcgtggagcggaacatggtgacgcccgagggcaaggtggtggacctaggctgtgggcggggtgggtggtcctactactgcggcgggctaaagaatgtccgggaggtcaaaggtctgaccaagggcgggcccggccacgaggagcccatccccatgtctacctacgggtggaacctggtacgcctccagagcggggtcgacgtgttctttactccgccggagaagtgcgacaccctgctgtgcgacatcggggagtccagccccaatcccaccatcgaggccggccggactctccgcgtgctgaacctggtcgagaactggctcaacaacaatacccaattctgcataaaggtgctgaatccgtacatgccatccgtcatcgagaagatggaggcactgcagagacagtacggcggggcactcgtccgaaaccccctgagccggaacagtacgcacgaaatgtattgggtgagcaacgccaccggcaacatcgtgtcctccgttaacatgatatcccgcatgctgatcaaccgtttcaccatgaagcacaagaaagccacctacgaaccggacgtggacctggggagcggcacgcgcaatattgggatcgagtccgagatccccaacctcgacataatcggcaagcggatcgagaagatgaagcaggaacacgagatcagctggcattatgatcaagaccacccctacaagacctgggcgtaccatggctcctacgaaaccaagcagaccgggagcgcctctagcatggtgaacggcgtcgtccgcctgctcacgaagccgtgggacgtggtcccgatggtgactcaaatggccatgaccgacaccacgcccttcgggcagcagagagtgtttaaggagaaggtcgacacacgcacccaggagccgaaggagggaacgaagaagctcatgaagatcacggccgagtggctgtggaaggagctgggtaagaagaagacgccacgcatgtgcacccgggaggagttcacccgcaaggtgcggtcaaacgccgccctcggtgccattttcacggacgagaacaaatggaagtccgcgcgcgaggccgtggaggacggccgcttttgggagctggtcgatagagagcggaacctgcacctcgaggggaagtgcgaaacgtgcgtctacaacatgatgggtaagcgcgagaagaagctgggggagttcggcaaggccaaggggtcccgggccatttggtatatgtggctaggggcgcgcttcctcgagttcgaggccctgggcttcctgaacgaggaccactggttctcacgggggaatagcctctccggcgtagagggggagggtttacaccgcctgggctacattctccgggacgtgggcaaaaaggaaggaggggctatgtatgccgacgacaccgccggttgggacaccaggataacgctcgaagacctgaagaacgaggagatggtaactaaccacatgaagggcgagcataagaagctcgcggaagcgatattcaagctgacctatcagaacaaagtcgtccgggtgcagcgcccgacgccccggggaacggtcatggacattatcagccgccgggaccagcgcggatccggacaggtggggacatacggattaaacacctttactaacatggaagctcagctcatccgacagatggagggcgagggcatattcaagagcatccagcacctgacggccaccgaggagatcgccgtgcaaaactggctggcgcgcgtcggacgcgagcggctctcccgcatggccatcagcggcgacgactgcgtggtcaagcctatcgatgaccggttcgcttccgccctgaccgccctgaacgacatgggcaaagtcagaaaggacatccagcagtgggagcccagccggggctggaacgactggacacaggtgccgttctgttctcaccacttccacgagctcgtgatgaaggatgggagagtgctggtggtgccctgccggaaccaagatgagctgatcggccgcgcgcggatcagtcaaggtgccgggtggtccctcaaggagactgcctgcctgggcaagagttacgcccaaatgtggaccctgatgtactttcaccgccgggacctgcgcctggcggcgaacgccatctgttccgccgtacccagccactgggtgcctacctcccggactacctggagcatccacgccaagcacgagtggatgacgaccgaggacatgctggcggtctggaaccgtgtttggatccaggaaaacccgtggatggaggacaagacgccggttgaatcctgggaggaggtgccctacctgggtaagcgggaggaccagtggtgcggcagtctgatcgggctgaccagccgtgccacttgggccaagaacatccaggccgccattaaccaggtccggtccctcatcggaaacgaggagtataccgactacatgcccagcatgaaacgcttccgccgagaggaggaggaggcgggagtcctctggtga

SEQ ID NO: 25090 - RNA, 9876 nt, synthetic construct
  misc_feature 1..9876: note = derived and/or modified CDS sequence (opt11) from DENV-2__EU482688__SS-prME
  source 1..9876: mol_type = other RNA
accgcgggcgtcatcgtcatgctgatccccacagccatggcgtttcacctcaccacccgcaacggggagccccacatgatcgtgggccggcaggagaagggtaagtccctgctgttcaagaccgaggatggagtaaacatgtgcactctcatggccatagacctgggtgagctgtgcgaggacaccatcacttataagtgccccctccttcgccagaacgagcccgaggatatcgactgctggtgcaatagcaccagcacctgggtcacctacggaacctgcaccaccacgggcgagcaccggcgagagaagcggtccgtggccctcgtgcctcacgtcggtatgggactcgagacgcgcaccgagacgtggatgtcgtctgagggggcttggaagcacgtgcagcggatcgagacgtggattctacgccatccgggcttcaccatcatggccgcgatcctggcctacaccatcggtaccacgcacttccagcgggccctcatcttcattctgctgaccgccgtggcgccctcgatgaccatgcgctgcatcggaatctccaatagagacttcgttgaaggcgtgagcggaggctcctgggtggatatagtcctcgaacacgggagctgtgtaaccacgatggccaagaacaagcccaccctggatttcgaactgataaagaccgaggccaagcagcccgccaccctcagaaagtactgcatcgaggccaagctgacgaacaccaccaccgaatcccggtgtccgacgcagggcgagcccagcctaaacgaggagcaggacaagcgcttcatctgcaagcactccatggtggaccggggctgggggaacggctgcggcctcttcggaaaaggggggatcgtgacatgtgcgatgttcacgtgcaagaagaacatggaagggaaggtggtgcagcccgaaaacctggagtataccatcgtcataacgccccacagcggggaggagcatgcagtgggcaacgacaccgggaagcatggcaaggagatcaagatcaccccgcaatcaagcatcaccgaggctgagctaaccggctacggcacggtgaccatggagtgcagcccccggaccggcctcgacttcaacgagatggtcctgctgcagatggaggataaggcctggctcgtgcaccggcagtggttcctggacctgccactcccctggcttccgggggccgacacccagggctcgaactggatccagaaggagacattagtgaccttcaagaacccccacgcgaagaaacaggatgtcgtggtcctagggtcccaggagggcgccatgcacaccgccctcaccggggccacagagatccagatgagctcaggcaacctcctgttcaccggtcacctgaagtgccgcctgcggatggataagctccagctaaaagggatgtcctacagcatgtgcactggcaagttcaagatagtgaaggagatcgccgagacccagcacgggacgatcgtgatccgggtccagtatgagggcgacggctcaccatgcaagatcccgttcgagatcaccgacctagagaagcggcacgtgctcgggagactgatcaccgtaaatccgatcgtcatcgaaaaggacagccccgtgaacatcgaggccgagcctcccttcggcgactcctatattatcatcggggtggagccgggccagctgaagctcaactggttcaagaaggggagctccatcggccagatgttcgagaccacgatgaggggcgccaagcgaatggccatcctgggtgacaccgcttgggacttcggcagcctcgggggcgtatttacctccatagggaaggcccttcaccaggtgttcggcgcgatatacggggctgcctttagcggggtgtcctggacgatgaagatcctgataggcgtcataatcacctggatcggcatgaacagccgctccacgtcgctctccgtgagccttgtgctggtcggtgtggtgacactgtacctgggggccatggtacaggcagactccggctgcgtggtgagctggaagaataaggagctcaagtgcggctcagggatcttcatcaccgacaacgtacacacgtggaccgagcagtacaagttccagccggagagccccagcaagttagcgtccgcaattcagaaagcccacgaggagggtatatgcgggatccgaagcgtgacccgccttgagaacctcatgtggaaacaaatcactcccgaactgaaccacattctgtccgagaacgaagtgaagctcacgatcatgaccggcgacatccggggcatcatgcaggccggcaagcgctccttgcgcccgcagcctaccgagctgaagtactcctggaagacctggggcaaggcgaagatgctcagcacggaatcgcataaccagacattcctgatcgacgggcccgagacagccgagtgcccgaacaccaaccgcgcctggaacagcctggaagtcgaggactacggctttggggttttcacgacaaacatctggctcaagctgagagagaagcaggacgtcttctgcgattcaaagctgatgagcgccgctattaaagacaaccgcgcggtccacgccgacatgggctactggatcgagtccgccttgaacgatacctggaagatggagaaggccagcttcatcgaggtgaagtcctgccactggccaaagtcgcacaccctgtggtccaacggcgtgctggagagcgagatgatcatccccaaaaacttcgccgggcctgtttcccagcacaactaccggccgggctatcacactcaaacggcgggtccgtggcatctcggcaaactggagatggacttcgacttgtgcgaagggaccactgtagtggtcaccgaggactgcggcaacagaggccccagcctcagaacgaccaccgcttctgggaagctcatcacagagtggtgttgccgctcctgcacgctgcccccgctccggtatcgcggcgaagacgggtgctggtacggcatggagatccggcctttgaaggagaaggaggagaacctggtaaatagtctagtaaccgcggggcacggccaaatcgacaacttctctctgggcgtcttggggatggccctcttcctggaagaaatgctgcgaactcggatcggcaccaagcacgcgatcctcctggtggccgtctccctcgtcacgctcataaccgggaacatgtccttccgtgatctgggccgcgtgatggtgatggtcggggccaccatgaccgacgacatcggcatgggcgtgacgtatctggcactcttggccgcgttcaaggtgcggcccactttcgccgctgggttgcttctgcgcaaattgacaagcaaggagctcatgatggcaaccatcggtatcgctctgctgtcccagtctacgatccccgagaccatcctagagctaaccgacgcgctggccctgggaatgatggtcctaaagattgtgcggaacatggagaagtaccagctggccgtgaccatcatggcaatctcctgcgtacccaacgcagtgatactccagaacgcttggaaggtgagctgcacaatcctggccgccgtatccgtgagccccctgctcctgacctccagccagcagaaggccgactggatccccctggcgcttaccataaagggcctgaatcccaccgccatcttcctgacgaccctctccagaacaagcaagaaacggtcctggcctctgaacgaggccattatggcggtcggaatggtgagcatcctagcctccagcctcctgaaaaacgacatccccatgaccgggcccctggttgcgggcgggctcctgacggtctgctacgtgctgaccggccgctcagccgacttagagttggagagagcagcggatgtgaagtgggaggaccaggccgaaatatcggggagtagcccgatcctgagcatcaccatcagcgaggatggcagcatgtccataaagaacgaggaggaggagcagaccctcacgatcctgatccgcaccggcctgctcgtcatcagcggagtattcccggtgtcgatacccatcaccgccgccgcctggtacctgtgggaggtcaagaagcagcgggcgggcgtgctttgggacgtgccgtctccgccccccgtcgagaaggcagaactcgaggacggggcgtaccgcatcaaacagcgaggcattctgggatactcgcagatcggcgccggcgtctacaaggaagggaccttccacactatgtggcacgtgacgcgcggcgccgtcctgatgcaccggggtaagcgcatcgaaccaagctgggccgacgttaaaaaggacttgatctcctacggcggggggtggaagctcgagggcgagtggaaggagggggaggaggtacaggttctggccctcgagcccggcaagaacccgcgtgcggtacaaactaagcccgggatcttcaagactaacaccggcactattggggccgtatcactggacttttccccgggcaccagcggctcccccatcgtcgatcgcaaggggaaggtggtgggcctgtacggaaacggcgtcgtgacacggagcggcgcctacgtatctgccatcgcgcagaccgagaagtccatcgaggacaacccggagatcgaggatgacattttccgcaaaaagcggctcacgatcatggacctgcaccccggggccggcaaaaccaagcgctacctgcccgcgattgttcgggaggctatcaagcggggactgcgcacactcattctggccccgaccagagtagtagcggccgagatggaggaagccctccgcggtctccctatccggtaccaaacgaccgccatcaagaccgagcacactgggcgcgagatcgttgacctgatgtgccatgctacgttcaccatgcggctactcagccccgtgcgcgtgcctaactataacctcatcatcatggacgaggcgcacttcaccgacccggcctctatcgccgctcgcggctacatcagcaccagagttgagatgggcgaagccgcggggattttcatgacggccacgcctcccggctcccgggatccctttccgcaaagcaacgcccccatcatggatgaggagcgcgaaatccccgagcggtcctggaacagcgggcacgagtgggtgacagactttaagggcaagaccgtctggttcgtcccctccatcaaggcggggaacgacatcgcggcatgcttgagaaaaaatggcaagaaggtgatacagctctcccgtaagacgttcgactccgaatacgttaagacccgggccaacgattgggacttcgtcgtgaccaccgacatttctgagatgggtgccaacttcaaggccgagcgggtgatcgacccacgccgttgcatgaaacccgtcatcctgacggacggcgaggagcgggtgatactggcgggccccatgcccgttacccactcctcggccgcccagcggcgtgggaggatcgggcggaacccgaaaaacgaaaatgaccaatatatctacatgggggagcctctcgaaaacgacgaggactgcgcccactggaaggaggccaagatgctgctggacaatattaacacccccgaggggatcataccttccatgttcgagccggagcgagagaaagtcgacgcgatcgacggcgagtaccgacttcgcggggaggcccgcaaaaccttcgtggatctaatgcgccgcggcgatctccccgtgtggttggcctacaaggtcgccgccgaagggatcaactacgcggaccgcaaatggtgcttcgacggcataaagaacaaccagatccttgaggaaaatatggaggtggagatctggacgaaggagggggagcgaaagaagctgaagccccgctggctcgacgctcggatttacagcgacccgttagccctgaaagagttcaaggagtttgccgcgggccgcaaatctttaaccctgaacctaatcaccgagatgggacggcttccaaccttcatgacgcaaaaggcccgcaacgctctggacaatctggcagtgctccacaccgccgaggctgggggcagagcctacaaccatgcgctgagcgagctgcccgagacgctcgagaccctgctgctcctgacgctcctcgccaccgtcaccgggggcattttcctgttcttaatgtcaggcaaggggatcggcaagatgaccctcggaatgtgctgcatcatcaccgcgagcatcctgctctggtacgcccagatccagcctcactggatagccgcgtccatcattcttgagttcttcttgatcgtgttgctcattccggagcccgagaagcagcgcacgccccaggataaccagctgacgtacgtcgtgatcgctatcttaaccgtggtcgccgcgaccatggccaacgagatgggcttccttgagaaaacgaagaaggacctggggctgggcagcatcaccacccaagagtcggagtcaaacatcctcgacattgatctgcggcccgccagcgcgtggaccctgtatgcagtggcgacgaccttcgtaaccccgatgctccgccactccatcgagaactcttccgttaatgtgagcctgactgccatcgccaaccaggccaccgtgctgatgggcttgggaaagggttggcctctgtccaagatggacatcggggtccccctgctcgcgatcggctgctactcgcaggtgaacccaataaccctgaccgccgccctgctcctgctggtagcccattacgccatcatcgggccgggcttgcaggcgaaggcaacccgggaggcccagaagcgcgccgctgcgggcatcatgaagaaccccacggtcgatgggatcaccgtgatcgatctggagcccatcccctacgacccaaagttcgaaaagcagctgggccaggtcatgctcctcatcctgtgcgtcacccaagtgcttatgatgcggaccacgtgggccttatgcgaggccttgaccctcgcgaccgggcctatatccaccctttgggagggcaacccaggacgtttctggaacacgaccatcgccgtgtccatggcgaacatctttagaggctcctacctggccggcgccgggctcctattcagcatcatgaagaacaccaccaacacgcggcgcggcacagggaatattggcgagaccctgggcgagaagtggaagtcccggctcaacgccctgggcaagtcagaattccagatctataagaagtccggcatccaggaggtcgaccgcaccctggcgaaggaggggataaagagaggcgagactgaccaccacgccgtttcacgcgggagcgccaaactccggtggttcgtggagcgcaacatggtcacccccgagggcaaggtggtagacctgggctgcgggagaggcggttggagctattactgcggagggctgaagaatgtccgagaggttaagggcctcaccaagggtggccctggccacgaggagcccatccccatgtccacctacgggtggaatctggtgcggctgcagagcggcattgatgtcttctttacgccccccgagaagtgcgatacactcctgtgcgacattggggagagctccccgaaccccaccatcgaggccggccgcaccctccgggtgctcaatctggtggagaactggctgaacaacaacacccaattctgcatcaaggtcctcaacccctacatgccgagcgtgatcgagaagatggaggccctgcagcgcaagtacgggggggcgctggtgcgcaatcccttgagtaggaacagcactcacgaaatgtactgggtctccaatgccacaggcaacatcgttagctccgtgaacatgatttcacggatgttaataaatcgcttcaccatgaagcacaaaaaggccacctacgagcccgatgtcgacctggggtcgggcacgagaaacatcgggatcgagtctgagatcccgaacctggacatcatcggcaagcgcatcgagaagattaagcaggagcatgagacctcctggcactacgaccaggaccacccctataagacctgggcctaccacggcagctacgagaccaagcagacggggtccgccagctcaatggtgaacggcgtggtccgactcctgaccaagccgtgggacgtggtgcccatggtcacccagatggcgatgaccgacacgaccccgtttgggcagcagcgggtgttcaaggagaaggtggacacgcgcacccaggaacctaaagagggcacgaagaagttgatgaaaatcacagccgagtggctctggaaggagctgggcaagaaaaagacccccaggatgtgcacccgcgaggagttcacgcggaaggtccgcagcaatgccgccctgggggccatcttcaccgatgagaacaagtggaagtccgctcgggaggccgtggaggacggccgcttctgggagctcgtagacagagaacggaacctgcatctggaagggaagtgcgagacctgcgtctacaacatgatgggcaagcgcgagaagaagctcggtgaattcggcaaagcaaagggaagtcgcgcaatctggtatatgtggctgggagcgcggtttctggaatttgaggccctcggcttcctgaacgaggaccactggttctcccgcggcaacagcctgagcggcgtggagggggagggcctccatcgactcggatatatcctgcgcgacgtcgggaagaaggagggcggggccatgtatgccgacgacaccgccggctgggacacgcggataaccctcgaagacctgaagaacgaggagatggttaccaaccacatgaagggggagcacaagaagctggcggaggccatctttaagctcacataccagaataaagtggtccgcgtccagcggcccacgccgcgcggaaccgttatggacatcatctcccggcgcgaccagcgtggtagcgggcaggtcggcacatacgggctgaacacattcactaacatggaggcccaactaatccggcagatggagggcgagggcatcttcaagtccatacaacacttaaccgccaccgaagagatcgccgtgcagaactggcttgcgcgcgtggggcgggagcgcctgagccggatggccatttccggcgacgattgcgtggtcaagcccatcgacgatcgcttcgcctcggccctcaccgccctcaacgacatgggtaaggtgcggaaggacatccagcagtgggagccctcccgcgggtggaatgactggacgcaggtccccttctgcagccaccacttccatgaactggtgatgaaggacgggcgggtgctcgtcgtgccctgccgcaaccaggacgagctgatcggccgggcccgcatctcgcagggcgccggctggagcctgaaggaaacggcctgcctcgggaagtcctacgcccagatgtggacactgatgtacttccatcggcgcgatctgcggctcgccgcgaacgcgatctgctcagccgtgccctctcactgggtcccaactagtcgaacaacatggtccatccacgccaaacacgagtggatgaccactgaggacatgctagctgtgtggaaccgcgtgtggatacaggagaacccctggatggaggataagaccccagttgagtcctgggaggaggtgccctacctggggaagcgcgaggatcaatggtgcggatcgatgatcgggttgacatcacgggccacctgggccaagaatattcaaacggcgatcaaccaagttcgctccctgatcgggaacgaggagtacactgactacatgccctccatgaagcggttccggcgcgaggaggaagaggccggcgtcctctggtag

SEQ ID NO: 25091 - RNA, 9876 nt, synthetic construct
  misc_feature 1..9876: note = derived and/or modified CDS sequence (opt11) from DENV-2__EU482691__SS-prME
  source 1..9876: mol_type = other RNA
accgccggcgtcatcgtcatgctgataccgacggccatggcgttccacctaaccactcgcaacggagagccacacatgatagtcggtcggcaagagaaggggaaatccctgctgttcaagacagaggacggggtgaacatgtgcaccctcatggccatcgacctgggggagctgtgcgaggacaccatcacctataagtgccccctcctgcgccaaaacgagcccgaggacatagactgctggtgcaacagcaccagcacctgggtcacatacgggacctgtaccaccacgggcgagcaccggcgcgagaagcggtccgtggctttggtaccccatgtaggaatgggcctggagacccgcaccgagacctggatgagcagcgagggtgcatggaagcacgtgcagcggatcgagacgtggatcctgcgccaccccggcttcacaatcatggccgcgatccttgcctacaccatcgggaccacgcacttccagcgtgccctcatttttatcctgctgactgccgtggctccaagcatgacgatgcgctgcatcggaattagcaaccgggacttcgtcgagggcgtttcaggtggcagctgggtggacatagtcctcgagcacgggagctgtgtgacaacgatggccaaaaacaagccaaccctggacttcgagctgatcaaaaccgaagcaaaacagcccgcaacgctccgcaaatactgcatcgaagccaagctgacgaacaccaccacggagtcccggtgcccgacgcagggagagcccagcctgaacgaggaacaggacaagcgcttcatctgtaagcactccatggtcgaccgaggctgggggaacggctgtggcttattcggcaagggcggaatagtgacctgcgcgatgttcacatgcaagaagaacatggagggcaaggttgtgcagcccgagaatctggagtatacgattgtcataacgccccatagcggggaggagcacgcagtgggcaatgacacaggcaagcacggcaaggagattaagatcaccccgcagtcaagcatcaccgaggccgagctgaccgggtacggcacggtgacaatggaatgcagcccccgcaccggcttagacttcaacgagatggtcctgcttcagatggaggacaaagcgtggctcgtccaccgccaatggttcctggacctgcctctcccatggctgccgggggccgacacccagggcagcaactggatccagaaggagacgctggtgaccttcaagaacccccacgcgaagaagcaggacgtagttgtactcggctcccaggagggcgcgatgcacaccgccctgaccggggcaactgagatccaaatgagctccggcaacctcttgttcaccggccacctgaagtgccgtctgcggatggataagcttcagctgaaggggatgtcctacagcatgtgcaccggcaaatttaagatcgtgaaggaaatcgccgagacccagcacggaacgatagtgatcagggtccaatacgagggtgacggatccccttgcaagatccccttcgagatcaccgacttagagaagcggcatgtgctcgggaggcttatcaccgtgaacccgatcgtcaccgaaaaagactctcccgtaaacatcgaggcggagccccccttcggcgactcatacatcatcataggggttgagcctggccagttaaagctcaactggttcaaaaaggggtcatccatcggtcagatgttcgaaacgactatgcgcggcgccaagcggatggccatcctgggggataccgcctgggacttcggctcactcgggggtgtgttcaccagtatcggtaaggcccttcaccaggtgtttggtgcgatatacggcgcggcctttagtggggtgtcctggacgatgaagatactgatcggcgtcatcatcacctggatcgggatgaatagcagatccaccagcctgtccgttagcttagtgctcgtaggcgtggtgaccttgtacctgggggccgtcgttcaggcggactccggctgcgtggtcagctggaagaacaaagagctcaagtgcggctccggaattttcatcacggacaacgtgcacacctggacggagcaatacaagttccaacccgagtcaccctctaagcttgcctccgccatccagaaagcccacgaggagggcatatgcggtatccgatcagtgacccgactagagaacctcatgtggaagcagatcacgcctgagctgaaccacatactgtccgagaacgaggtcaagctcaccatcatgaccggcgacatcaaggggatcatgcaagccggcaagcggagcctgcgcccacaacccaccgaactgaagtactcatggaagacgtggggcaaagcgaagatgctaagcaccgagtctcacaatcagaccttcctgatcgacgggcccgagaccgccgagtgcccgaacatcaatcgggcctggaacagcctagaggtggaggactatggcttcggggtgttcacgaccaacatctggttgaagctgcgcgagaagcaggacgtcttctgtgactccaaactgatgagtgcggccatcaaggacaaccgggcagttcacgccgatatgggctactggattgagtccgcactgaacgacacctggaagatggagaaggccagctttatagaggtcaaaagctgccactggcctaaatcacacacgctgtggtccaatggggtcctggaatcagagatgatcatcccaaagaacttcgccgggccggtctcccaacacaactaccgcccgggctaccacacgcagaccgctggtccgtggcacttaggcaagctggagatggacttcgatttctgcgaggggaccaccgtggttgtgacagaggattgcggtaaccgggggcccagcttgcgcacgaccaccgcctctggtaagctcatcaccgagtggtgctgcaggtcctgcactttgcccccgctgcgctaccgtggtgaggatgggtgctggtacggaatggagattcgacctttgaaggagaaggaggagaacctggtgaacagcctggtcaccgccgggcacggccaaatagacaacttctccctcggggtgctggggatggccctgtttctcgaggagatgttgcggactcgcatcggcactaagcacgcgatcctgctcgtggccgtctccttcgtgaccctgatcactgggaacatgtccttccgggatctgggccgagttatggtcatggtgggggccactatgactgacgacatagggatgggcgtgacgtacctcgccctgctggccgcgtttaaggtccgcccaactttcgcggccgggctattattgcggaagcttaccagcaaggaactgatgatggctaccatcggaatcgccctgctctcgcagtcgacgattcccgagaccatcctcgagctgaccgatgcgctcgccctggggatgatggtgctgaagatcgtccgaaacatggagaagtaccagctcgccgttacaatcatggcaatctcctgcgtgccgaacgcagtgatcctgcagaacgcgtggaaggtgagctgcacgatcctggccgcggtgtccgtaagccccctcctgttaacctcgagccagcaaaaggccgactggattcccctcgcgctcaccatcaagggcctgaaccccaccgccatctttctcactaccctgtcccggacctcaaagaaacgcagctggcctctgaacgaggccatcatggccgtgggcatggtgtctatactcgcatcttctctgctgaagaacgatatacccatgaccggccccctcgtcgcgggcgggcttctcacggtatgctacgtactcacaggtcggagcgcggatctggagctggagcgcgccgcagacgtgcggtgggaggaccaggcggagatctccgggtcgtcccccatcctcagcatcaccatttccgaagacggcagcatgtccatcaagaacgaggaggaggagcagaccctgacgatactgatccgcaccgggctcctggtgatcagcggtgtgttcccggtctccatccccatcaccgcggctgcctggtacctgtgggaggtgaaaaagcagcgcgccggggtgctctgggacgtccccagcccgcctccagtggagaaggccgagctggaggatggggcgtaccgcatcaagcagcgcggcatcctagggtactcccagattggcgctggcgtgtacaaggaagggaccttccacaccatgtggcacgtcacgcggggtgctgtcctcatgcaccgggggaagcgcatcgagccaagctgggctgacgtaaagaaggacttgataagttacggcggaggctggaagctggaaggtgagtggaaagagggagaggaggtccaagtgctcgcgctggaacccggcaagaaccctcgggcggtgcagaccaagccagggatttttaagaccaacaccggaaccatcggggccgtcagcctggactttagtcccgggaccagcggatcccccatcgtggacaggaaagggaaggtggtcggcctctacgggaacggcgttgtgacccggtccggtgcgtatgtctccgcaatcgcgcaaaccgagaaatccatcgaggataaccccgagattgaggacgacatcttcagaaagaagcggctgacgatcatggacctgcaccccggggccggaaagacgaaacgctacctccctgctattgtacgtgaggccataaagcgcgggctgcgcaccttaatcctggcccctacccgcgtggtcgcagcggagatggaggaagctcttcgcggcctgcccattcgataccagacgcccgccataaagaccgagcacacagggcgcgagatcgtagacttgatgtgccacgccaccttcactatgcggctcctgtctcccgtgcgagtcccgaactacaacctgataatcatggacgaagctcatttcaccgaccccgcgtccatcgccgcccgtggctacattagtacccgcgtggaaatgggcgaggccgcgggtatcttcatgaccgctactccgcccggatcccgggaccctttccctcagtcgaacgcaccgattatggacgaggagcgcgaaatccccgagcggtcctggaactcagggcacgagtgggtgaccgatttcaagggcaagaccgtctggttcgtgccgtccataaaggcgggtaacgacatcgctgcctgcttacgcaagaacggcaagaaggtgatacaactgagccggaagaccttcgactccgaatatgtaaaaacgcgcgccaacgactgggacttcgtggtaaccaccgatatcagcgagatgggagccaacttcaaagccgaacgggttatcgacccccgccgctgcatgaagcccgtgatcctgacggacggggaggagcgagtaatcctcgcgggcccgatgccggtcacgcactcctcggcagcccagcggcgcggtcggattggccggaaccccaagaatgagaacgatcagtacatctatatgggggagcccctggaaaacgatgaggactgcgcccactggaaggaggcaaagatgctgctcgacaatatcaacacccccgagggcatcatcccgagtatgttcgagcccgagcgcgagaaggtggatgcgatcgacggcgagtaccggctgcgcggagaagcacgcaagacctttgttgacctgatgcgccggggcgatctgcccgtctggctggcctacaaggtggccgccgaagggatcaactataccgatcgcaagtggtgcttcgacggtatcaagaataaccagatcctggaggagaacatggaagtggaaatctggacgaaggagggggagcggaagaagcttaaaccccgctggttggacgctcggatctacagcgatccccttgcattgaaagagtttaaagagttcgccgccggccgcaagtctctgaccctaaacttaattaccgagatgggccgacttcccacgttcatgacgcagaaagcgcgcaatgccctggacaacctcgctgttctgcacaccgccgaggccgggggccgcgcgtacaaccacgccttaagcgagctccccgagaccctggagaccttgctgttactgacgctactggccaccgtgacggggggcattttcctgttccttatgtccggtaaggggatcggcaagatgactctagggatgtgttgcatcatcaccgcaagcatcctcctctggtacgctcagatccagccgcactggatagcagcgtcaattatcctggaattctttctgatcgtcctgctgatcccagagcccgagaaacagcgcacgccccaggacaaccagctgacctacgttgtgatcgccatcctcaccgtcgtggccgccacgatggccaacgagatgggcttcctggagaagacgaagaaagacttagggttaggtagcatcaccacgcaagagtctgagtccaacatcctggacatcgacctccggccggccagcgcctggaccctctacgccgtggctactactttcgttacccccatgctgcgccacagcatcgagaacagctccgtgaacgtcagtctcactgcgatcgcaaaccaggccacggtcctcatgggcctggggaagggctggcccctgtccaaaatggacatcggggtgcccctcctggccatcggatgctacagccaggtgaacccgattacactaaccgcggccctcctactgctcgtagcacactatgcgatcatcggacccggcctgcaggccaaggcgactcgggaagcccagaaacgcgccgctgccggcatcatgaagaaccccacggtggatgggatcaccgttatcgacttggagcccataccgtacgacccaaaatttgagaagcagcttggccaggtgatgctgctgatcctctgcgtgacccaggtgcttatgatgcggaccacgtgggccctgtgcgaggccctcacccttgccaccgggcccatctccacattatgggagggcaaccctgggcgcttctggaatacgaccatagcagtcagtatggcaaacatctttcgcggttcctacctcgcgggcgccgggttgctgttcagcataatgaagaacactacctccacacggcgcggcaccggtaacataggcgaaaccttaggtgagaagtggaagtcgcggctgaatgccctggggaagagtgaattccaaatctataagaagtccggcatccaggaggtggatcgcaccctcgccaaggaggggatcaagcgcggggagacggatcaccacgcggtaagcaggggcagcgccaagttgcggtggttcgtggagcgcaatatggtcaccccggagggcaaagtggtcgatctgggatgcgggaggggtgggtggtcctactactgcggagggctaaagaatgtgcgcgaggtgaagggcctgaccaagggcggccccggccacgaggagccaattcccatgtccacctacgggtggaacctggtacgtctccagagcggcgtggacgtattcttcacgccgcccgaaaagtgcgacaccttactgtgcgacattggggagagtagccccaatcccaccatcgaggccggcagaaccctcagggtccttaacctggtcgagaattggctcaacaataacactcaattctgcgttaaggtcttaaatccgtatatgccctccgtgatcgagaaaatggaggccctccaacgccagtacggcggggccctcgtgcggaaccccctgagccgcaactccacgcatgaaatgtactgggttagcaacgctacaggcaacatcgtgtccagcgtcaacatgatctcgcggatgttgatcaatcgctttactatgaagcacaagaaggccacatacgagccggacgtagatctgggtagcggcacacggaatatcgggatcgagtccgagatcccaaatctggacatcataggcaagcgcatcgagaagatcaagcaggagcacgagatcagctggcactacgaccaagaccacccttacaagacctgggcttaccacggctcctacgaaaccaagcagaccgggtccgccagtagcatggtgaacggggtagtgcgcctgctgacaaaaccctgggacgtggtgccgatggtcacccaaatggccatgaccgacaccacccccttcgggcagcagcgggtgttcaaggagaaggtggatactcgtacccaggagcctaaggagggcaccaagaaacttatgaagataacggcggagtggctttggaaagaactgggaaagaaaaagacgccccgcatgtgcacccgcgaagagttcacccggaaggtcaggtccaacgccgccctcggggcgatcttcacggacgagaacaagtggaagtccgcccgggaggcggttgaggacggccgcttctgggagctggtcgaccgggagcgtaacctgcacttagaagggaagtgcgagacgtgcgtatacaacatgatgggtaagagagagaaaaagctgggggagttcgggaaagccaagggttcccgcgctatctggtacatgtggctgggggcccgtttcctggagttcgaggcgctgggcttcttgaacgaggaccactggtttagccgagggaattccctctccggagtagagggggagggcctccacagattaggctacatcctccgcgacgtcgggaagaaggagggcggagccatgtacgccgacgacaccgctggctgggacacccgaataacgctcgaagacctgaagaacgaggaaatggtgaccaaccacatgaagggggagcacaagaagctggcggaggcaatcttcaagctgacctaccagaacaaggtggtcagagtgcagcgaccgacgccccgcggcacggtgatggacatcatcagccggcgcgaccaacgcggatccggtcaggtcggcacctatgggctgaacacctttaccaacatggaggcccagctaatccggcagatggagggcgagggcatcttcaaaagcatccagcatctgacggccactgaggagatcgcagtgcagaactggttggcccgggtggggcgggagcgcctctcccgcatggcaatctctggtgacgactgcgtagttaagcccatcgacgaccgcttcgccagtgccctaaccgccctgaacgacatggggaaggtacggaaggatatccagcaatgggagccatctaggggctggaatgactggacacaagtcccgttctgctcccaccacttccacgagctcgtcatgaaggatggacgggtcctcgtcgtgccctgccgcaaccaagatgagctaatcggccgagcgcgcatcagccagggcgcggggtggtccctaaaagagacggcctgtctgggcaagagctatgcacagatgtggaccctgatgtacttccacagacgcgacttgagactggctgccaacgcgatctgctccgccgtgccctctcactgggtcccaacctccagaacgacctggagcatccacgccaagcatgagtggatgacaaccgaagacatgctggccgtgtggaaccgggtgtggatccaggaaaacccttggatggaggacaagacccccgttgaatcatgggaggaggtcccctacctcgggaaacgcgaggaccagtggtgtggcagcctaattgggctgaccagtcgcgccacctgggccaagaacattcagacagccataaaccaggtgcgctcgctgatcggcaacgaggaatacaccgactacatgccctccatgaaacgattccggcgcgaggaggaagaggccggtgtcctatggtga

SEQ ID NO: 25092 - RNA, 9876 nt, synthetic construct
  misc_feature 1..9876: note = derived and/or modified CDS sequence (opt11) from DENV-2__EU482693__SS-prME
  source 1..9876: mol_type = other RNA
accgcaggagtcattgtgatgttaataccaacggcgatggcattccatctcacaacccgtaacggtgaaccacacatgatcgtgggtcgacaagaaaaagggaaatctttgctctttaaaacggaagatggagtcaacatgtgcacactgatggcgatcgacctgggagaactgtgcgaagatacaatcacctacaaatgcccacttttacggcagaatgaacctgaagatatagactgctggtgcaactcgaccagcacgtgggtgacgtacggaacttgtaccacgacaggtgaacaccggcgtgagaaacgatccgtggcgcttgtcccacacgtcggcatgggtctggaaaccagaacagaaacgtggatgagctcggaaggagcatggaaacatgtgcagaggatagaaacgtggatcctacgccatccaggcttcaccatcatggcagcaatactagcctatacaatcggtacgacccactttcagcgggcgctcatatttatactgctgaccgcggttgccccaagtatgacaatgcgctgtatcggaataagcaacagagactttgtagaaggggtcagcggaggcagttgggttgacattgtgcttgaacacgggtcctgtgtaaccactatggccaaaaacaagccgacactagacttcgaactgataaagacagaagccaagcaaccagcgacacttagaaagtattgtatagaagctaaacttaccaacaccacgaccgagtcacgctgcccaacacaaggcgaaccctcgcttaacgaagaacaggacaagcgcttcatatgtaagcacagtatggtagaccggggctggggaaacggatgcggccttttcggaaaaggagggatagtcacgtgcgcgatgttcacttgcaagaaaaacatggaaggaaaagtcgttcagccagaaaacttagagtatacaattgtaatcacgccacactcgggagaggaacatgcggtcgggaacgacacaggaaaacacggcaaagagataaaaataacgccacagagcagcatcacggaagcggaactcactggctacggtacagttaccatggaatgtagccctaggaccggactagacttcaacgaaatggtgctattacagatggaagataaggcctggctcgtacaccggcagtggtttctagacttaccattaccatggctacctggggccgacacgcagggctccaactggatccagaaggaaaccctagtaaccttcaagaatccacatgccaagaaacaggacgtagtcgtactgggttcgcaagaaggtgcgatgcacacagcactaacgggtgcgaccgaaatccaaatgtcctctggaaatctattattcaccggacacctaaaatgcagactgcgaatggacaagctccagctaaaagggatgagttattccatgtgcaccggaaagttcaagattgtcaaggaaatcgcggaaacacagcacggaacgatagtcatccgggtgcaatacgagggagacggttcgccctgcaagataccgttcgagataacggacctagaaaaacgacatgtcttaggaaggctaattacagtaaacccgatagttaccgaaaaagactcgccagttaatatcgaagcagagccaccctttggagacagctacatcataattggggtggaaccggggcaactcaaactcaactggttcaagaaaggcagctcaatcggtcagatgttcgaaacgacaatgcggggagccaaaagaatggcaatactcggggacactgcgtgggacttcggtagtctaggcggggtatttactagcataggaaaggcactacaccaggtattcggagcaatatatggcgcagctttctcaggagtcagctggacgatgaagatactcatcggtgtaatcataacctggataggaatgaactcacgctcgacgtctctctcggtgagtctagtccttgtcggagtggttaccctatacctaggcgccgtagtgcaagcagacagcggctgtgtcgtaagctggaagaacaaagagttgaaatgtgggagtggaatttttatcaccgataatgtgcacacatggacagaacaatacaaattccaaccagagagtccgtcaaagctcgcgtccgcgattcaaaaggcacacgaggaaggcatatgcggaatccgcagcgtaacaagattggaaaacctaatgtggaaacaaataacccccgaactaaaccacatcctatccgaaaatgaagtaaaacttacaataatgaccggagacatcaaaggtatcatgcaggcgggtaaaagatcgctaaggccacaaccgaccgaacttaagtacagttggaagacctggggaaaagcgaaaatgctatcgacagaaagccacaatcagaccttcctgatagacggccccgagacggccgagtgcccaaatactaaccgcgcatggaactcactggaagtagaagattacggctttggagtgttcacgacaaacatatggctgaaactacgggaaaagcaagacgtattctgcgactccaagctaatgagtgcggcgataaaagataaccgcgccgtgcacgccgacatgggatactggatcgaatcagctctgaacgatacctggaagatggagaaagcatcatttatagaggttaagtcatgccactggccaaagtcccacactctgtggtccaacggggtattagaaagtgagatgatcatacccaaaaatttcgcaggtcccgtgtctcaacataattatcgaccaggctatcatactcaaaccgcgggaccctggcacttgggaaagctggagatggatttcgacctctgcgaaggcaccacagtcgtcgtaacagaggactgtgggaataggggccccagcttacggacaacgacagcgagcgggaaactaattactgagtggtgttgtcgtagctgtacactgcccccgctgaggtaccgtggcgaagacgggtgctggtacgggatggagatccgaccgctaaaggagaaagaggaaaatctggtgaacagtttggtaaccgcaggtcatggccaaatagacaactttagcttaggtgtccttggaatggccctattcctagaagaaatgctacgcacgaggatcggcaccaaacacgcgaccctactcgtcgccgtatcatttgtaacactgattacggggaacatgagcttccgagacttaggccgggtaatggtgatggtcggggccaccatgaccgacgacataggcatgggcgtaacatacctagcgttgctcgcggcattcaaagtgcggcccacattcgcagcagggctcctgctaaggaagctcacaagtaaagaattaatgatggccacgatcggaatagcgttactaagccaaagcacaataccagaaaccatcttagaattaaccgacgctttagcactaggcatgatggtccttaagatcgtccgcaacatggagaagtaccaactcgcggttacaataatggcaatcagctgtgtgccgaacgccgtaatcctgcaaaacgcatggaaagtctcatgcacaatactagcagcagtgtccgtgagtccattactgctgacgtcgtcccagcagaaagcagactggatacccctagccctgacaataaaaggcctcaatccgaccgctatattcctaactacgctcagccggacgagcaagaaacggagctggccgctgaacgaagccatcatggccgtgggaatggtctccatcctagcaagcagcttactaaagaatgatataccgatgacaggaccacttgtagcgggcggcctactcacggtatgctacgtactaacaggaagaagcgccgacctggaattagaacgagcagcagatgttaaatgggaagatcaggccgaaataagcggttcatccccaatactaagcattacgatatcagaagacggctccatgtccatcaaaaacgaggaagaagaacagacgctaaccatactaatccgaaccggactactcgtaataagcggggtattcccagtcagcataccaataaccgctgccgcgtggtacctctgggaggtaaagaaacaacgggccggggtcctgtgggacgtcccaagcccgccacccgtagagaaggcggagctagaggacggggcataccggatcaaacaacgggggattttaggctatagccaaataggggcaggcgtatataaagagggaacgttccacactatgtggcacgtgactagaggggcggttctgatgcacaggggaaagcgcatcgaaccatcatgggccgacgtcaagaaagatctcatctcgtacggtgggggatggaaactcgaaggggagtggaaggaaggcgaagaagtacaggtccttgcactggaaccggggaaaaacccacgggcagtccaaacaaaaccaggaatctttaaaactaatacaggcaccattggagctgtaagcctcgactttagcccaggaaccagcgggagcccgatagtagaccgaaaaggaaaagtcgtgggcctctacggaaacggcgtggtaactaggagtggagcatacgtatctgcgatagcccagacagaaaaatcaatcgaagacaacccagagatagaagatgatatatttaggaagaaacgtctgacaataatggatctccacccaggagctgggaagacgaagaggtacctgccagcaatagtccgagaggccatcaaaagaggcctgcggacattaatactcgctcctactcgagtagtggcggccgagatggaagaggcactccgagggctgcccatccgataccaaacaccagcaatcaaaacggaacacaccgggcgcgaaattgtagatctcatgtgccacgccacctttactatgcgactcttatccccagtacgcgtaccgaattataaccttatcatcatggacgaagcgcactttactgaccctgcgtcaattgcggctcgcgggtacatatcgacacgtgtagagatgggggaagcggcgggaatatttatgacagccaccccacccggatcacgagacccatttccacaatcaaacgcaccaataatggacgaagaacgcgaaattccggagcggtcctggaatagtggacacgagtgggtcaccgatttcaaaggtaaaacggtatggtttgtaccaagcatcaaagccggaaatgacatcgcagcctgcctcaggaagaacggtaagaaggtgatacagctgtctcggaagacattcgatagcgaatacgtcaagacacgagcgaatgactgggacttcgtcgtaaccaccgatatcagcgaaatgggcgcgaatttcaaagcggagcgcgtgatagacccgaggcgatgcatgaagccagtaattttaaccgacggtgaagaacgcgtgatcctcgcaggacccatgcccgtgacacactcctcagcggcccagagacgaggccgcatagggaggaacccgaagaacgagaacgaccaatacatctacatgggagaaccccttgaaaatgacgaagactgcgcccattggaaagaggccaaaatgctgctggacaacatcaacacgccagaagggataataccaagtatgttcgaaccggagcgagaaaaggtagacgctatagacggagaatacagactacgaggcgaggcgagaaaaacgttcgtggacctcatgagacgtggcgacctaccggtttggctagcctacaaagtcgcagcggagggcattaattacgcggacagaaagtggtgtttcgacggaattaagaacaaccagatcctcgaggaaaacatggaggtagaaatatggaccaaggagggcgagagaaagaaactcaaaccgagatggctcgacgcacgaatatattcagatccactcgctctcaaagagttcaaggagttcgcagcgggtaggaaatcgctcacactgaacttgataacggagatgggtcggctaccgaccttcatgacccagaaagcccgcaacgccctagacaacctcgccgtcctgcacacggctgaggccggaggacgagcctacaatcatgcactgtcggagctgcccgaaaccttagaaacactactgctcctgacattgctcgcaaccgtcacaggaggcatattcctcttcctaatgagcggcaaaggaatcggcaaaatgaccctgggcatgtgctgtataattaccgcatctatcctactctggtacgcacaaatacaaccgcattggatagctgcctcaatcatactagagttctttctgattgtactactgattccggaacccgaaaaacaacgcacaccccaagacaaccagttaacctacgttgtcatagcaattctcaccgttgttgccgccaccatggcaaatgagatgggcttcctagagaaaacgaagaaagacctagggctaggatccatcacgacccaagagagcgagagcaacatactagacatagacttacgccccgcgtcagcctggacgctatacgcggtcgccacgacattcgttaccccaatgctgcgccacagtatagagaactcatccgtgaacgtgagcctaacggccatcgcgaaccaggcgaccgttttgatgggcctaggcaagggatggccgctatccaagatggacataggcgtcccactgcttgcgattgggtgctatagccaggtcaacccgatcaccctcaccgccgccctactcctcttagtcgcgcactacgcaatcatcggtcccggcttacaagcgaaagctacccgcgaggcccagaagcgagccgcagcgggaataatgaaaaatcccacagtggacggcatcacggtcatagacctagagcctataccctacgaccccaagttcgaaaagcagctcgggcaagtcatgctgttgatcctttgcgtcacccaagttttgatgatgcgaaccacgtgggccctctgtgaagcgttgactctagcgaccggcccgatcagcacactctgggaaggcaatccaggccgcttttggaacacaacaatagcggtaagcatggccaacattttccgcggatcgtatttagcgggcgctggcctcctcttctcgataatgaagaacaccacttccacacgacggggtacaggcaacattggcgaaaccttaggagaaaaatggaagtcaaggctcaacgcactcggaaaatcagaatttcaaatatataagaaaagcggtatccaagaagtggaccggacactggcgaaagaaggcataaaacgcggtgagactgaccaccacgctgtctcaagaggttccgcaaagctgcgctggttcgtcgagaggaacatggtgaccccagagggcaaagttgtggacttaggctgtggaaggggtggctggagttattactgcggcggcttgaagaacgtgcgcgaagtaaaagggctaaccaagggcggccccggacacgaggagccgatccccatgtcaacatacggctggaaccttgtaagacttcagtcaggcgtagacgtattcttcaccccgccggaaaaatgcgatacactcctttgcgacattggcgagagctccccgaacccaacgatcgaagccggacggacattaagggtattaaaccttgtcgagaactggctcaataacaacacacagttctgcataaaagtcctgaatccgtacatgccttctgtcatagagaaaatggaggcactccaaaggaagtacggaggggcactcgtcagaaaccccctgagcagaaactcgacacacgaaatgtactgggtaagcaacgcgaccggcaatatcgtcagctcggtgaacatgatttcacggatgttgatcaacagattcacgatgaaacacaagaaagccacatatgaaccggacgtagacctaggtagcggaactcgcaacatagggatcgagagcgagatcccaaacctggacataataggaaaacgaatagagaaaatcaagcaggaacatgaaacttcgtggcactacgaccaagaccacccttataagacatgggcataccacggatcatacgagaccaaacaaaccggatcagcatcctcgatggtgaatggggtagtacgcttactgaccaaaccctgggacgtcgtcccaatggtaacccagatggccatgaccgacactaccccgttcggacagcagagggtattcaaagaaaaggtggacacacgcacacaggaaccaaaagagggcaccaagaaattgatgaaaatcacagcagaatggctatggaaagaactcggcaagaagaagacaccacgcatgtgtacaagggaggagttcacgcggaaggtacgttccaacgcagctctgggcgcgatattcacagatgaaaacaaatggaaatcggcaagggaagcggttgaagacggccgcttctgggaacttgtggaccgcgagcgcaatcttcacctagaaggcaagtgcgaaacatgcgtctataacatgatgggaaagagagagaaaaagttaggagagttcgggaaggcaaaaggatcacgcgctatatggtatatgtggctcggggccaggttcctcgagtttgaagcgctcggttttctcaacgaagaccactggttcagcaggggcaacagcctatcaggggtggaaggagaagggctacaccgactggggtatatattgcgcgacgtgagcaagaaagaaggtggcgccatgtacgccgacgataccgccggctgggacacccgaatcacactagaagacctcaagaacgaagagatggtcacgaaccacatgaagggggagcacaagaaactcgccgaggccatattcaaacttacctaccagaacaaggttgtaagagtacagcgaccaactccacggggaacggtgatggacataatatcccgacgcgaccagaggggttcaggacaagtcggaacctacggactcaatactttcacaaatatggaagcacagctgatcagacaaatggagggcgagggaatattcaaatcaatacagcacctgacagcagcggaagaaaatgtcgtccaaaactggctagcgagagtaggccgagagcgactcagcagaatggcgatcagcggggatgactgcgtagtcaagccaatcgatgatcgattcgcctccgccctgactgccctgaacgacatggggaaagttcgtaaggatatccaacaatgggaaccctcacggggttggaacgactggacacaagttccgttttgcagccatcacttccacgaattagtgatgaaagacggacgagttctcgtcgtgccctgcagaaaccaggacgaactcatcgggcgagcccgaatctcacaaggcgcaggatggtcactaaaggaaaccgcatgcctcggcaaatcctacgcacaaatgtggacgctcatgtacttccaccgacgagacttacgactcgcggcgaatgcaatatgttcggcagtccccagtcattgggtgccgaccagccgcacaacgtggtcaatacatgctaaacacgagtggatgacgacagaagacatgctcgccgtctggaacagagtttggatccaagagaacccttggatggaagacaagaccccagttgagagttgggaagaagtgccatatctaggtaagagagaagaccaatggtgcggtagcctcataggtctaacctcaagagcaacttgggccaagaatatacagacagcgatcaaccaggtccggagtctaataggtaacgaggagtacacggattacatgccgtcaatgaagcgattccgcagggaggaagaagaagcaggagtactatggtag

SEQ ID NO: 25093 - RNA, 9876 nt, synthetic construct
  misc_feature 1..9876: note = derived and/or modified CDS sequence (opt11) from DENV-2__EU596483__SS-prME
  source 1..9876: mol_type = other RNA
accgccggtgtgatcgtcatgctgatcccgaccgccatggcgtttcacctcaccacccgcaacggggaaccgcatatgatcgtgggtcggcaggaaaagggcaagagcctgctgttcaagacggaggacggggtgaacatgtgcaccctcatggccatagaccttggggagctgtgcgaggacaccatcacctacaagtgccccctcctgcgccagaatgaacccgaggacatcgactgttggtgtaatagcaccagcacctgggtcacctacgggacctgcaccaccacgggcgagcaccgacgagagaagcggtccgtggcactggtgccgcacgtcgggatgggcctcgagacgaggaccgagacctggatgagcagcgagggggcctggaagcacgtacagcggatcgagacgtggatcctccgccatccgggcttcaccatcatggccgcgatcctggcttacaccatagggaccacgcacttccagcgggccctcattttcatcctgttaaccgccgtggcgccctcgatgaccatgcgatgcatcggcataagcaaccgtgacttcgttgagggcgtcagcgggggctcatgggtggacatcgtcctcgagcatgggagctgtgtgaccacaatggccaagaacaagcccaccctggactttgagctgatcaagaccgaggcaaaacagcccgccaccctccggaagtattgcatcgaggccaaactcacgaacaccaccaccgagtcccggtgcccgacgcagggggagccctccctgaacgaggagcaagacaagcgcttcatctgcaagcactccatggtggaccgtggctgggggaatggctgcgggctgttcgggaagggtggcatagtgacctgtgcgatgttcacgtgcaagaagaacatggagggcaaagtggttcagcccgaaaacttggagtacacaattgtcatcacaccccattccggggaggagcacgccgttgggaacgacaccggtaagcatgggaaggagatcaagatcaccccgcagtccagtataaccgaggccgagctgaccgggtacggcacggtgaccatggagtgtagcccccggaccggcctagactttaacgagatggtccttctgcagatggaagacaaggcctggctcgtgcaccggcagtggtttctggacctgcccctcccctggctgcctggggcagacacccagggctctaactggatccagaaagaaacgctagttacattcaagaacccccacgcgaagaagcaggacgttgtcgtgctcgggtcacaggaaggcgccatgcacaccgccctgacaggtgccacggaaattcagatgagctcgggcaacttactgttcactggccacctcaaatgccggctgcggatggacaagctccaactgaaggggatgtcctacagcatgtgcaccgggaagttcaagatcgtaaaggaaatcgccgaaactcagcacgggacgattgtgatccgagtccagtacgagggcgatggctccccatgcaaaatacccttcgagatcactgacctggagaagcggcacgtgctcgggagactgatcacagtgaaccccattgttactgagaaggattcgcccgtgaacattgaagcagagcctcccttcggcgacagttacatcatcatcggggtggagccgggtcagctgaaactcaactggttcaagaagggcagctccatcgggcagatgttcgagacaaccatgaggggcgccaaacggatggctatactgggggacaccgcctgggacttcggatcgctcggcggcgtctttacctcgatcgggaaggccctccaccaggtgttcggcgcgatatacggagccgccttcagcggggtgagctggaccatgaaaatcttgatcggggtcatcatcacatggatcggcatgaacagcagatccaccagcctaagtgtgtcgctggttctcgtcggcgtggtaactctttacctgggtgccgtagttcaggcggacagcggctgcgtggtcagctggaagaataaggaactcaagtgcggctccgggatcttcatcacggacaatgtgcacacctggaccgagcagtacaaattccagccagagtcgcccagcaagctggcatccgcaatccaaaaggcccacgaggaggggatctgcggtatccggagcgtcacacgcctggaaaacctaatgtggaaacagataacccccgagctgaaccacatcctctccgaaaacgaagtgaagttaaccatcatgaccggagacatcaaggggatcatgcaggccggcaagcggagccttaggccgcagcctaccgagctgaagtactcctggaagacgtggggcaaggcgaagatgctcagcacagagtcccataaccagacgttcttgatcgacgggcccgagaccgccgagtgcccgaacacgaaccgtgcctggaacagcctggaggtggaggactacggcttcggggtgttcaccaccaacatctggctcaagctacgcgaaaagcaggacgttttctgcgactccaagctgatgtcggccgccattaaggacaaccgggcggtgcatgcagacatgggctactggatggaaagtgccctcaacgacacctggaaaatggaaaaggcctcgttcatcgaagtgaagtcctgccactggcccaagagccataccctgtggtccaacggcgtgctggagagcgagatgatcatcccgaagaatttcgccggacctgtttcccagcacaactaccgcccgggctaccacacacagaccgccgggccctggcacctcggtaaactggagatggactttgacttctgcgagggcacaactgtggtcgtgacggaggattgcggcaaccggggacccagcctgcgcaccaccaccgccagcgggaagctcatcactgagtggtgctgccggtcctgcaccctgccgccgctgcgctaccgaggtgaggacgggtgctggtacggcatggagatccgccccctcaaagagaaggaggagaatttggtgaactctctggtcacggccgggcatggccagattgacaacttctccctcggcgtgctggggatggccctgtttctggaggagatgctgcggacccggatcggcacgaagcacgctattctactcgtggccgtcagcttcgttacccttatcaccgggaacatgtcattccgagacctgggtcgcgttatggtcatggtgggggccactatgaccgacgacatcggcatgggcgtgacctatttggccctgctggcggcgttcaaagttcgccccaccttcgccgccgggttactgctgcggaagctcaccagcaaggagctgatgatggcgactatcggcatcgccctcctctcccagagcacgatccccgagaccattctcgaacttacagacgcgctcgctctggggatgatggtgctgaagatcgtccgcaacatggagaagtaccagctcgccgtcacgatcatggccatttcctgcgtgccgaacgccgtgatcttacagaatgcgtggaaggtctcttgcacaatcctggccgccgtgtccgtcagccccctcctgttaacatccagccagcaaaaggccgactggatcccccttgcgctgaccatcaaagggctgaatccgaccgcgatattcctcacaaccctgtcccggaccagcaaaaagcggtcctggccgctgaacgaggccatcatggccgtgggcatggttagcattttagcgtcctcgctgctgaagaacgacatccccatgacgggacccctcgtcgccggtgggttactgaccgtgtgctacgtgctcaccggccgcagcgctgacctggaattagagcgtgctgcagacgtcaagtgggaggaccaggccgagatcagcgggagttccccaattctcagcattaccatatcagaggatggcagtatgtccatcaagaacgaggaggaggagcagacgctgacaatcctgatccggaccggcctcctggtaataagcggtgtattcccagtctccatccccataaccgcggccgcctggtacctatgggaggtgaagaagcagcgcgccggcgtgctctgggacgtccccagcccgccgcccgttgagaaggccgagctggaagacggtgcgtacaggatcaaacaacgcgggatcctggggtactcccagatcggcgctggtgtatataaagaagggaccttccacacgatgtggcacgtgacccgaggcgccgtgctcatgcaccgcgggaagcggattgagcccagctgggccgatgtgaaaaaggacctaatctcgtacggagggggctggaagctggagggcgagtggaaggagggggaggaggtccaggtgctggccctggagccgggcaagaaccctcgagcggtgcagaccaaacccgggatcttcaaaaccaacacgggcacaatcggggccgttagcttagacttctccccgggcaccagcgggtcccccattgtggaccggaaagggaaagttgtcggtctctacggcaatggcgtagtaacccgctcaggcgcctacgtctccgccatagcgcaaacggaaaagtccatcgaagacaatccagagatcgaggacgatatcttccggaagaagcgccttaccatcatggacttgcacccaggggccggcaagaccaaacggtacctccccgctatcgttcgagaggccattaaacgggggctgcgtaccctcatcctggcaccgacgagagtggtcgcggccgagatggaggaagcgctcaggggcctgcccatccgctatcagacccctgccatcaaaacagagcacaccgggcgggagatcgtggacctaatgtgtcacgcgacgtttaccatgcgcctcctaagtccagtacgggtcccaaactacaacttaatcataatggacgaggcgcacttcactgaccccgcttccatcgccgcacggggctacatcagtacgcgggtggagatgggagaagcggcgggcatcttcatgacagccaccccgcccggttcccgcgaccctttcccgcagtccaacgcccccatcatggacgaggaacgtgagattcccgagcgctcctggaacagtgggcacgagtgggtgaccgatttcaagggtaagaccgtatggtttgtgccgtccatcaaggcagggaacgacatcgcggcgtgcctccggaagaacggaaagaaggttatccagctgagtcgcaagacgttcgactccgagtacgtcaagacccgggccaacgactgggatttcgtggtgacaactgacatcagcgaaatgggtgctaacttcaaagcggaaagagtcattgacccccggaggtgcatgaagcccgtgatactgacggacggggaggaacgggttatcctcgcgggcccaatgcccgtcacccactccagcgccgcccagcgccgtggacgcattggccgcaacccaaagaacgaaaacgaccagtacatctacatgggggaaccattggagaatgacgaggactgcgcccactggaaggaagccaagatgctactcgacaatatcaacacccctgagggcatcatcccgtccatgttcgaacccgagcgggagaaggtggacgcgatcgacggtgagtaccgcctgaggggcgaggcccgcaagacctttgtggacttaatgcggcgcggggacctcccagtttggctggcctacaaagttgccgctgaggggatcaactacacggacagaaagtggtgctttgacggaatcaaaaacaaccagatactggaggaaaacatggaagtggagatttggaccaaggagggggagcgcaagaagctcaagccgcggtggctggacgcgcgcatctacagtgatcccctggccttgaaagagtttaaagagttcgctgccgggcggaagtccctgaccctaaatctcattaccgagatgggacgcctcccaaccttcatgacccagaaagcgcgtaacgcgctggacaacctcgccgtcttgcacaccgccgaggccggtggccgcgcgtacaaccacgccctgagcgagctccccgagaccctagaaacactgctcctgctgaccctcctggctaccgtgaccgggggcatctttctgttcctcatgtccggcaaggggatcgggaagatgaccttagggatgtgctgcattatcaccgctagcatcctgctctggtatgctcagattcagccacactggatcgcagcctccatcatcctagagttcttcctgatcgtcttactgatccccgaaccggagaagcaacggacgccacaggacaaccagctgacctacgtggtaattgccattctaacagtcgtggccgcgacgatggcgaacgagatgggcttcttagagaagacaaagaaggacctcggcctcggcagcatcaccactcaggagtcggagtccaatatcctcgacatcgacttgcgcccggcctcggcctggactctctacgccgtggcaacgacgtttgtcactcccatgctgcggcactctatcgaaaacagctctgtgaacgtgagtcttactgcgatcgccaaccaggctaccgtcctgatgggcttgggaaagggctggcctttaagtaagatggacattggagtgccccttctggccattggctgctacagccaggtcaacccgatcaccctgaccgcggccctgctgctgctcgtcgcccactacgccatcattggacccggcctgcaggccaaggcgacgcgcgaggctcaaaagcgagccgccgctggcatcatgaaaaaccccaccgtggatggtatcaccgtcattgacctggagcccatcccctacgaccccaaatttgagaagcagctaggccaggtcatgctgctcatactttgcgtaacacaggtgttgatgatgcgcacgacctgggcgctatgcgaggccttaaccctggccacagggcccatctccacgttatgggagggcaaccccgggaggttttggaacaccaccatagccgtaagcatggccaacatcttccgaggttcgtaccttgcaggcgccgggctgcttttcagcataatgaagaacaccacgtccacccgccggggcaccggtaatataggggagacgctcggtgagaagtggaaaagtcgcctgaatgcactggggaagtctgagtttcagatatacaagaagtccggaatccaggaggtggaccgtacgctcgccaaggaggggatcaagcgcggcgagaccgaccaccacgcagtgtccagggggagcgccaaactgcgctggttcgtcgagcggaacatggtgaccccggagggcaaggtggttgacctgggctgcgggcgcggagggtggtcctactactgcggcgggctcaagaacgtacgggaggtcaagggcctgacgaaaggagggcccggccacgaggagcccatcccaatgtctacgtacgggtggaacctggtacgtctccagtctggcgttgacgtatttttcaccccgcccgagaagtgcgacaccttgctgtgcgacatcggggagtcctctcccaacccgacgatcgaggccggccgcaccctccgtgttctgaacctggtggagaactggctaaacaacaatacgcaattctgtatcaaggtgctgaacccgtacatgccctcggtcatcgagaagatggaggcccttcagcggcagtacggcggggccctcgtgagaaaccccctgagccggaacagtacccatgagatgtactgggtgtccaacgcgaccggcaatatcgtctcttccgtcaatatgatctcccgcatgttaataaaccggtttaccatgaagcacaaaaaggccacgtacgagccggacgtggacctggggagcggcacccggaatatcgggatcgagagtgaaatccccaacctcgacattatcggcaaacggatcgagaagatcaaacaagagcacgagataagctggcattacgaccaggatcacccctacaaaacgtgggcctaccatgggtcctacgagacgaagcagacggggagcgcctcgagcatggtgaacggcgtggtgcgcctgctgaccaagccctgggacgtcgtgccaatggtgacccagatggctatgaccgacacgaccccattcgggcagcagcgcgtgttcaaggagaaggtggacacccgtactcaggagcccaaggaaggaacgaagaagctgatgaagatcaccgcggagtggctctggaaggaactgggcaagaagaagacgccccgcatgtgcacccgggaagagttcacgcgcaaggtgcggtccaacgcggccctcggggccatattcaccgacgagaacaagtggaagtccgcccgcgaggcggtcgaggacggtcggttctgggaactggtggaccgtgagcggaacctgcatctcgaggggaagtgcgagacctgcgtgtacaacatgatgggcaagcgcgagaagaagttaggggagttcggtaaggccaagggctcacgggccatctggtatatgtggctgggggcccgcttcctcgagttcgaggcgctgggcttcctaaacgaagaccactggttcagccgggggaacagcctctcaggcgtggagggggagggcctgcatcggctgggatacatactccgggacgtagggaagaaagagggcggggccatgtacgctgacgacaccgccggctgggatacacgcataacactggaggacttgaagaacgaggagatggtgaccaaccacatgaagggggagcacaaaaagctcgccgaggccatcttcaaactgacctaccagaataaagtagtacgggtccagcgcccgacgccccggggcacagtgatggacatcatatcgcgtcgggaccagcgcggctccgggcaggtcggtacctacgggctgaatacatttacgaatatggaagcacagctcatccggcagatggaaggcgagggaatcttcaagagcattcagcacctgaccgccaccgaagagatcgctgtccagaactggctggcccgggtagggcgcgaacggctcagtcgcatggcgatcagcggagacgactgcgtcgtcaagccgatcgacgatcggttcgcctcggccctaaccgccctgaacgacatggggaaggtgcgcaaggacatccagcagtgggagccctcacggggctggaatgactggacccaggtgccgttctgctcccaccacttccacgagctcgtcatgaaggatgggcgagtgctggtggtgccgtgccggaaccaggatgagctgatcggccgggcacggatcagccagggcgcgggttggtcgctcaaggagaccgcgtgcctgggcaagagctacgcccagatgtggaccctgatgtacttccacagacgggatctccgcttggccgcgaacgcgatatgctcagctgtgcccagccattgggtgcctacctcacggaccacgtggagcatccacgccaagcacgagtggatgacaacagaggacatgcttgccgtctggaaccgcgtgtggatccaggagaacccgtggatggaggacaagacccccgtggaatcctgggaggaggtgccctacctcgggaagcgggaggaccaatggtgcggcagcctgattgggctgacgagccgcgcgacctgggccaagaatatccagaccgcaatcaaccaggtgcggtccttaataggcaatgaggaatacactgactatatgcccagcatgaagcgctttcgtcgagaggaggaggaaacgggcgtgctgtggtaa

SEQ ID NO: 25094 - RNA, 9876 nt, synthetic construct
  misc_feature 1..9876: note = derived and/or modified CDS sequence (opt11) from DENV-2__EU482597__SS-prME
  source 1..9876: mol_type = other RNA
accgccggtgtgatcgtcatgttaataccgacggcaatggctttccacttaaccacgcgcaacggggagccgcacatgattgtgggccgtcaggagaaggggaagtccctgttgttcaagaccgaggacggcgtgaacatgtgtaccttgatggccatcgacttaggggagctgtgtgaggataccatcacctataagtgccccctccttcggcagaacgaacccgaggacatcgactgctggtgcaacagcaccagcacctgggtaacctacgggacttgcaccactaccggcgagcaccgacgtgagaagcgctccgtggccctggtgccccacgtcgggatgggactggaaacccgaaccgaaacttggatgagctcagaaggagcgtggaagcatgtccagcggatagagacctggatcctgcgccacccgggcttcactatcatggccgcgatcctggcctacactatagggacaacccatttccagcgggccctcatcttcatcctgcttacggccgtagcacccagcatgaccatgagatgcatcggcatcagcaaccgtgatttcgtcgaaggcgtgtccggcggctcctgggtggacatcgtcctcgagcacggctcatgcgtgaccacaatggcaaagaacaagccgaccctggactttgagttaattaagaccgaggccaagcaaccggcgaccctccggaagtactgtatcgaagccaaacttactaacactacgaccgagagccgctgcccgacgcagggcgagccctctctgtccgaagaacaggacaaacgcttcatctgtaagcacagcatggtggacagaggctggggtaacggctgcggcctgttcggcaagggtggcatcgtgacctgcgcgatgttcacgtgcaagaagaacatggagggaaaggtggtacagcccgagaacctggagtacaccatcgtgatcacgccccactcgggggaagaacacgcggtgggcaacgacaccgggaagcacggcaaggagatcaagattaccccgcagtcctcgatcaccgaggcagagctgacgggttatggcacggtgaccatggagtgcagccccaggaccgggctcgactttaacgaaatggtcctgctccagatggaagacaaggcctggctggtgcatcggcaatggttcttggatctgcccttaccgtggctaccgggtgctgacacccagggctccaactggatccagaaggaaacgctggtgacctttaagaatccacacgcgaagaaacaggatgtggtggtactagggagccaggagggcgccatgcacaccgccctgaccggggctacggagatccagatgtcctccggaaacctcctattcaccggccatctgaagtgtcgcctgcggatggacaaattgcagttaaagggcatgagctattccatgtgcaccggtaagttcaaaatcgtaaaggagatcgccgagacccagcatgggactatcgtgatccgcgtccagtacgagggagatggcagcccttgtaagatccccttcgaaatcaccgacctggaaaagcgtcatgtgcttgggcgcctcatcaccgtgaacccgatcgtcactgagaaagactcccccgtgaacattgaggctgaaccgcccttcggcgattcctacatcatcataggagttgaaccgggccagctgaaacttaactggttcaagaaggggtcaagcatcggtcagatgttcgagaccaccatgcgcggcgccaagcggatggccatattgggggacaccgcgtgggatttcgggtcattagggggagtcttcacttctatcgggaaggccctccaccaggtgttcggggcaatctacggcgccgcgtttagcggtgtgagctggacaatgaagatcttaatcggggtcatcatcacttggatcggcatgaactcgagaagtacatccctgagcgtgtccctggtgctcgtcggagtggtcaccctgtacctgggggccatggttcaggcggacagcggctgtgtcgtgtcctggaagaacaaagagctaaagtgtggcagcgggatctttatcacagacaacgtgcacacctggactgagcaatacaagtttcagccagagtcaccgtccaagctggccagcgccatccagaaggcccacgaggaggggatatgcgggattcggtcggtgacacggctggagaacctgatgtggaagcaaatcacgcccgagctgaatcacatcctgagcgagaatgaggtaaagctcacaatcatgaccggggacatccggggaatcatgcaggcgggcaagcgcagtctgcgaccgcaacccaccgagttaaagtatagctggaagacctggggcaaggctaaaatgctatcaaccgaaagccacaaccaaaccttcctgatcgatgggcccgaaactgccgagtgtccgaacactaaccgcgcctggaactccctggaggtcgaagactacggattcggtgtgtttaccactaacatatggctaaagctacgcgaaaagcaggacgtattctgcgacagcaagctcatgtccgccgccatcaaggacaaccgcgcggtgcacgccgacatgggctactggatagagagcgccctcaatgacacctggaagatggagaaggcctccttcatcgaggtgaaaagctgccactggcctaaatcccacaccctctggagcaatggggtgttggagtccgagatgatcatcccgaagaacttcgccggaccggtgagccaacataattaccggccgggataccacacgcaaaccgcgggaccctggcacctcggtaagctggaaatggactttgacctgtgcgaggggaccaccgtggtggtgacggaggattgcggcaaccgcggacctagcctccggaccaccacggcctccgggaaacttatcacagaatggtgttgtcgcagctgcaccctgcccccactccggtacaggggcgaggacgggtgttggtacggaatggaaatccggcccctcaaggagaaggaagaaaacctcgtaaattccctcgtgaccgccggacacggccagattgacaatttcagcctgggcgtcttggggatggccctcttcttagaggagatgttgcgcacgcggatcgggacgaagcacgcaatcctacttgtagccgtgagttttgtaaccttaataaccgggaatatgagcttccgggacctcggccgagtaatggtgatggtgggcgccactatgacggacgacatcggaatgggcgttacctatctggcgctgcttgccgcgttcaaggtccggcccacctttgccgccgggttgctgctccgcaagctgacctccaaggagcttatgatggcgacgatcggcatcgccctactgagccagtcgaccatcccggagaccatattagagctaactgacgcactggcactggggatgatggtcctcaagatcgtccggaatatggagaagtaccagctggccgttacaatcatggccattagctgcgtaccgaatgccgtgatactgcagaacgcgtggaaggtgtcatgcaccatcctcgccgccgtcagcgtgagcccccttctactcaccagttcccagcagaaggcggactggatccccttagccctgaccatcaagggcctcaacccgacagccatcttcctgaccacactgtcgcgaacctccaagaaacggagctggcccttgaatgaagccatcatggccgtcggcatggtgtccatcctggcttcgagcctgctaaagaacgatatcccgatgaccgggcccctggtggctggcgggctgctcaccgtctgctacgtgctgaccggccgatccgccgacctggagttagagcgggcggccgatgtgaagtgggaagaccaagctgagatcagcgggagcagccccatcctgagcatcacgataagcgaggacggctccatgagcatcaagaacgaagaggaggaacagacgctgaccatcctcatccgcacgggcctgctggtaatctccggggtgttcccagtgagcataccgataaccgcggccgcctggtacctctgggaggttaagaagcagagagccggcgtgctctgggacgtgcccagcccgccaccggtcgagaaggctgaactggaggacggggcctaccgcatcaagcaacggggcatcttaggatacagccaaatcggcgcaggcgtatacaaagaggggacgtttcatacaatgtggcatgtgacccgtggggccgtcctgatgcaccgggggaagcgcatcgagccaagctgggccgacgtcaagaaggacctgattagctacggtggaggctggaagctggagggcgaatggaaggagggggaggaggttcaagtcttggccctggagcccggcaaaaacccccgcgcggtgcagaccaagccagggatttttaagaccaacacaggcaccattggagccgtgtcgcttgacttcagccccggcacaagtggcagccccatagtcgaccgcaagggaaaggttgtgggcctgtacgggaacggcgtagtcacccggtccggtgcctacgtgagcgcgatcgcccagacggagaagtccatcgaagacaaccccgagatcgaggacgatatcttcagaaagaagcggctcaccatcatggacctccaccccggggcgggaaagaccaagcgctacctgcccgctatcgttagggaggctatcaaacgcggcttacgtaccctaatcttagccccgactcgggtcgtcgcggccgaaatggaggaggctctgcgcggcttaccgatccgctaccaaacgaccgccatcaagactgaacacaccgggagagagatcgtcgacctcatgtgccatgccacctttacgatgcgactgctgtcccccgtgcgcgtgcccaactacaaccttattatcatggacgaggcccacttcaccgacccagcctccatcgccgcgagagggtatatctccacgcgcgtcgaaatgggagaggccgcggggatcttcatgacagccacaccacccggcagtcgcgaccccttcccccagtccaacgcccccatcatggatgaggaacgcgagatacccgagcggagctggaactccgggcacgaatgggtgaccgattttaagggaaagacggtatggtttgttcctagcatcaaggccgggaacgacattgcggcctgtctgcgcaagaacggcaagaaggtgatccagctgtcccggaaaaccttcgacagcgagtacgtaaagacccgcgctaacgactgggacttcgtcgtcacgactgacatttccgaaatgggcgccaactttaaggccgagagggtgatcgacccccgccgctgcatgaagcccgtcatcctcaccgacggtgaagaacgcgtgatactggcgggcccaatgcccgtgacccacagcagtgccgcacaacggcgcgggcggataggccgcaacccgaagaacgagaacgaccagtatatatacatgggggaaccattagagaacgatgaggattgcgcccactggaaggaggccaaaatgctcctggacaacatcaatacacccgagggcatcatcccgagcatgtttgagcccgagcgcgagaaagtcgacgccatagatggcgagtatcggctacgcggggaggcccggaagactttcgtggacctcatgaggaggggcgacctaccggtttggctcgcttacaaggtcgcagcggaggggatcaactacgcggaccgaaagtggtgcttcgacggcatcaagaacaaccagatcctcgaagagaacatggaggtggagatctggactaaggagggggaacgaaagaagctgaaaccacgctggctggacgcgaggatctactccgacccgttggccctaaaggagttcaaggaatttgccgcgggtcgcaagagcctgaccctcaacctgatcacggagatgggccggctgcccacgttcatgacccagaaggcccgtaatgccctcgacaacctggcggtgttgcacaccgccgaggccgggggccgggcctataaccatgccctctccgagttgcccgagaccctggagactctcctgctgctcaccctgctggccaccgtcacagggggcatcttcctcttcctgatgtctggcaaggggataggcaagatgacccttgggatgtgctgcatcatcacggcctcgatactcctgtggtacgcgcagatccagccccactggatcgccgcctcgatcatcctggagttcttcttgatcgtgttgctgatcccggagcccgagaagcagcgcacgccccaggacaaccagctcacgtacgtcgtgatcgccattctcaccgttgtcgccgcgacgatggccaacgagatgggatttttggagaagaccaagaaggatctcgggctaggcagcatcaccactcaggagtccgagtcaaatatactggacatcgacctgcgtcctgcctccgcctggacgctgtacgccgtcgcaactacctttgtgacccccatgttgcgccatagcatcgagaactccagcgtaaacgtgtccctcacggccatcgctaaccaggccaccgtactcatgggactgggtaagggctggcccctctcaaagatggacataggtgtccccttgctggcgatcggctgctactcccaggtgaatccgataaccctcaccgccgccctgctgctgctggtggcacactacgccatcatcggaccgggcctgcaggcgaaggccacccgggaggcacagaagcgcgctgccgcgggtatcatgaagaacccaaccgtcgacgggataactgttatcgatctcgagcccattccctacgatccaaagtttgagaagcagctaggccaggttatgttactcatcctgtgcgtcacccaggtcctgatgatgaggacgacctgggccctctgcgaagccttgacgttagccaccgggcccatctccaccttgtgggaaggcaatcccgggcgattttggaataccacaatcgccgtgtccatggcaaacatcttccgcggaagttacctggccggagccgggttgctgttctccattatgaagaacacgacgaatacccggcgaggcaccggcaatatcggcgagaccctgggcgaaaagtggaaatcccggctgaacgcgctcggcaaatccgagtttcagatctacaagaagagtggcatccaggaggtcgaccgcacgttggcgaaagaggggatcaagcgcggcgagaccgatcatcacgccgtatcccgcggttcagccaagctgcggtggttcgtggagagaaacatggtcacgccggagggcaaggtcgttgatctcggctgcggacggggcgggtggagctactactgtggcgggttaaagaatgtccgcgaagttaaggggcttactaaaggagggccgggacacgaggagcctatacccatgagtacgtatgggtggaacctggtaaggctccagtcgggcgttgacgtgttcttcacgccgcccgagaagtgcgacacccttctatgtgacataggcgaatcaagccccaaccccaccattgaggccggccgtaccttacgggtgctgaacctcgtcgaaaactggctgaacaataacactcagttttgcatcaaggtgctgaacccgtacatgccgtccgtgatcgagaagatggaggccctccaacgcaagtacggcggggctctagtcaggaaccctttaagccgtaactccacccacgagatgtactgggttagcaatgcaaccggcaacattgtgtccagcgtcaacatgatctccagaatgctgatcaaccgttttaccatgaagcacaagaaggcaacgtacgagccggacgtggacctcggaagtggcacccgtaacatcgggatagagtccgaaatcccgaacttagacatcataggcaagcgcattgagaaaatcaagcaggagcacgagacctcatggcactacgaccaggaccatccctacaagacctgggcctatcacggctcctatgagacgaagcagaccgggagcgcctcgagtatggtgaacggcgtagtgcgcttactcaccaaaccctgggacgtcgtcccaatggtgacccagatggcgatgacggacactacgccgtttggccagcagagggtcttcaaggaaaaggtggacacccgcacgcaggagcccaaagagggcaccaagaaacttatgaagattaccgccgaatggctgtggaaggagcttggcaagaagaagacgccccggatgtgtacccgcgaggagttcacccggaaggtgcggtccaacgccgccctgggagcaatcttcacggacgagaataagtggaagtccgcgcgcgaagccgttgaggacggccgcttctgggagctcgtcgaccgtgagaggaacctccacctggagggtaagtgcgagacctgcgtctacaacatgatgggaaaacgggagaagaagttgggggagttcggcaaggccaagggctcccgcgcgatctggtacatgtggctcggtgcgcggttcctggagttcgaggccctgggcttcttgaacgaggatcattggttctcgagagggaatagtctgagtggcgttgagggagagggccttcacaggctcggctatatactgcgcgacgttggtaagaaggaaggaggggccatgtacgcggatgacacggccggctgggatacccggatcaccctggaagacttgaagaacgaggagatggtaacaaaccatatgaagggggagcataagaaactggcagaagccatcttcaagctgacgtaccaaaacaaagtcgtgcgcgtacagcgccccaccccgaggggcactgtgatggacattattagccggagggaccagcgcggctccgggcaggtcgggacttacggtttaaataccttcaccaacatggaggcccagctgatacggcagatggagggcgaggggatattcaagagtatccagcatctaacagcaacagaggagatcgccgtgcagaactggctggcgcgcgtcgggcgggagagactgtcgcggatggccatcagcggagacgactgtgtggtgaaacccatcgatgaccgcttcgcgtccgcactgacagccttgaacgatatggggaagataagaaaagacatccagcagtgggagccttcccgtgggtggaacgactggacccaggtccccttctgcagtcaccacttccacgagctggtgatgaaagatgggcgagtcctggtcgttccttgccgcaaccaggacgaactcatcggccgggcgagaatcagccagggcgcgggctggtccctgaaggagaccgcctgcctgggaaagagctacgcccaaatgtggaccctgatgtacttccacagacgcgacctgcggctcgccgcgaacgccatctgctccgccgtgcccagccattgggtccccaccagtcgcacgacctggtcaatccacgccaagcacgagtggatgaccaccgaagacatgctcgccgtatggaacagggtgtggatacaggagaacccttggatggaggacaaaacgccggtcgagtcctgggaagaggtgccgtacctggggaagcgcgaggatcagtggtgcggcagcctcatcggcttgacaagccgtgcaacctgggctaaaaacatccagaccgccatcaaccaggtgcgcagcctgatcggaaacgaggaatacacggactatatgcccagcatgaagcgcttccggcgcgaagaggaggaggccggcgtactgtggtag

SEQ ID NO: 25095 - RNA, 9876 nt, synthetic construct
  misc_feature 1..9876: note = derived and/or modified CDS sequence (opt11) from DENV-2__EU482598__SS-prME
  source 1..9876: mol_type = other RNA
accgcgggcgtgattgtcatgctgatccccactgccatggcgtttcatctcaccactcgtaatggggagccgcatatgatagtgggccggcaagaaaaggggaaaagtctgttgttcaagaccgaagatggcgtgaacatgtgcaccctcatggccatcgacctgggggagctgtgcgaagacaccatcacctacaagtgcccccttctgaggcagaacgagcccgaggacattgactgctggtgcaactctacaagcacctgggtcacatacgggacttgcaccaccacgggcgagcatcgacgcgaaaagcgcagtgtagccctagtgccccacgtggggatgggccttgaaacccgcactgagacctggatgagctccgaaggtgcttggaagcatgtgcagcggatcgagacctggatcctgcgccacccgggattcaccatcatggccgcgatcctcgcttacaccatcggtaccacccatttccagcgggccctcatctttattctgttaaccgctgtggctcccagcatgaccatgcgctgcatcgggatctccaaccgggacttcgttgagggggtgtctggggggtcctgggtggacatcgttctcgagcacgggagctgcgtgaccacaatggcaaagaacaagcctaccctggacttcgagctgatcaagacagaagccaagcaacccgccaccctccgcaagtactgcatcgaagccaagctgacgaacaccaccaccgagtcccggtgcccgacgcagggcgagcccagcctgaatgaagagcaggataagagattcatctgcaagcacagtatggtagaccggggctggggaaatggctgcgggctgttcggcaaaggcggtatcgtgacgtgcgcgatgttcacgtgcaagaagaacatggagggcaagatcgtgcagcccgagaacctagaatacaccatcgtcatcacgccccattcgggggaggagcacgccgtcggtaacgacaccgggaaacacggcaaggagataaagatcaccccgcagtctagcatcacggaggccgaactgaccgggtacggcacggtgaccatggagtgtagtcccagaaccggcttagacttcaacgagatggtactgttacagatggaggacaaggcgtggctcgtccaccgccagtggttcctggacctgccattgccctggctgccgggggctgacactcagggcagcaactggatccagaaggagacgctggtcaccttcaagaatccccatgcgaagaagcaagacgtggtagtgctcggatcccaggagggcgccatgcacaccgccctgaccggcgccacggagatccagatgtctagcggcaacctcctgttcaccggccacctgaagtgccgcctgcggatggataagttacagctgaagggaatgtcctactccatgtgcaccggcaagtttaagatcgtaaaggagatcgccgagacccagcacgggaccatcgtgatacgcgtgcagtacgagggcgatggctccccctgcaagatccccttcgagatcaccgacctggagaagagacacgttctcgggagactgatcaccgtgaacccgatagtgaccgaaaaggacagccccgtcaacatcgaggcggaaccgccattcggcgactcatacatcatcatcggggtggagccgggccagctgaagctcaattggttcaagaaggggagctccatcggccagatgttcgagacgaccatgcgcggggccaagcggatggccatactgggtgacacggcctgggacttcggcagcctcgggggagttttcacctccatcgggaaggccctccaccaggtcttcggcgcgatctacggcgccgccttcagcggggtttcctggacgatgaagatactgattggcgtgataatcacgtggatcgggatgaactccagatccacctctctgtccgtctcattggtgctcgtgggcgtagtgaccctctacctgggggccatggtgcaggcggattccggctgcgtcgtgagctggaaaaataaggagcttaagtgcggctctgggatcttcatcacggacaacgtgcacacctggaccgagcagtataagttccagcccgaaagccccagtaagctcgcctccgccatccagaaagcccacgaggaaggcatctgcgggatccggagcgtaacccgcctggagaacctcatgtggaagcagatcactccggagctgaaccacatcctgtcggaaaacgaggtcaagctcaccatcatgaccggcgacatcagaggaatcatgcaggccggcaagcgatccctccggccacaacccaccgagttgaagtactcctggaagacgtggggaaaggcgaagatgctcagtaccgagtcccacaaccagaccttcctcatcgacgggcccgagaccgccgagtgcccgaacacgaaccgcgcctggaacagcctggaggtggaggactacggctttggcgttttcacaactaatatctggttgaagctgcgggagaagcaggacgtgttctgcgactcgaaactgatgagcgccgccataaaagataacagagcggtacacgccgacatgggctattggatcgagagtgccctaaacgacacgtggaagatggagaaggccagcttcatcgaggtcaaatcctgccactggcccaagagtcacactctgtggtccaacggcgtgctggagtcggagatgatcatacccaagaacttcgcagggcccgtgagccaacacaactaccggccgggctaccacacgcagaccgcggggccctggcacctgggcaagctggagatggacttcgacctgtgcgaggggaccaccgtcgtggtgacggaggactgcggcaaccgcggcccctccctccggaccacaaccgccagcgggaagctgataacggagtggtgctgccgcagttgcaccctgcccccgctccggtaccggggcgaagatggatgctggtacggaatggagatcagacccctgaaggagaaggaggagaacctggttaacagcctcgtgaccgccggacacggccaaatcgacaacttcagcctgggcgtgctgggcatggctctcttccttgaagaaatgctgcgcacacggatcggcaccaagcacgcgatactcctcgtcgccgtgagcttcgtgaccctaattaccgggaatatgtccttccgcgatctgggccgcgtcatggtgatggtgggggccaccatgacggacgatatcggcatgggcgtcacttatctggcgctgctagcagcgttcaaggtgcggcccaccttcgccgccggactgctgctccgaaagttaaccagcaaggagctgatgatggccacaatcggaatcgcgctcctgtcccagagcaccatacccgagaccatcctggaactcacggacgcgctagccttggggatgatggtactcaagatcgtccggaacatggagaagtaccaactggccgtgacgataatggctatctcctgcgtgccgaacgcggttatcctgcagaacgcgtggaaggtgtcttgcactatcctggccgccgtgtccgtcagccccctgctgctcacctccagccagcagaaggccgactggatcccccttgctctgaccatcaaggggctcaaccccacggctatcttcctgaccaccctgtcccgcacctcgaagaagcgctcctggccgctcaacgaggccatcatggccgtggggatggtcagcatcctggcctcctctctcctaaagaacgacatccccatgacggggcccctggtagcgggggggctgctcaccgtgtgctacgtcttaaccgggcgctcagccgacctcgagctcgaacgggccgccgacgtgaagtgggaggaccaggccgagatctccggaagctcccccatcctgagcatcaccatctccgaggacggcagcatgtccatcaagaacgaggaggaggagcagacgctgaccatcctcatcaggacgggcctgctggtgatcagcggggttttcccggtgtccatcccaatcaccgcggcggcctggtacctctgggaggtgaagaaacagcgggccggcgtcctgtgggacgtgcccagccccccgcccgtggagaaggctgaactggaggacggagcctatcgcatcaaacagcgtggcatcctcgggtactcccagatcggggccggcgtctacaaggagggcaccttccacacgatgtggcacgtgacccgcggcgccgtgctgatgcaccggggaaagcgcatcgagcccagctgggccgatgtgaagaaggacctgatctcttacggcggaggctggaagctcgagggagagtggaaggagggggaggaagtccaagtcctggccctggagcccggcaagaacccccgggcggtccagaccaagcccgggatcttcaagaccaacacaggtaccatcggcgccgtgagcctcgacttctcccccggcaccagcggctcccccatcgtggatcgcaaggggaaggtagttggcctgtacgggaacggtgtggtcacccggtccggcgcctacgtgagtgccatagcgcaaactgagaaatccatcgaggacaatcccgagatcgaagacgacatcttccgaaagaaacggctaaccatcatggacttgcaccccggagccggtaagactaagagatatctgcccgccatcgtcagagaggccatcaagcgcgggctgcgcaccctgatcctcgccccgacgcgagtcgtagcggccgagatggaggaggctctgagaggcctgcccatccggtaccagaccacagccatcaagaccgagcacacggggcgcgagattgtggacctgatgtgccacgctaccttcaccatgcgtctgctgagccctgtccgcgttcccaactacaacctcattatcatggatgaagcacacttcaccgacccggcctccattgccgctcgtggttacatctcaacgcgcgtggagatgggagaggcggcagggatcttcatgaccgccaccccgccaggttcccgggaccccttcccgcagagcaacgcacccatcatggacgaggagcgtgagataccggagcggtcctggaacagcgggcacgagtgggtcacggacttcaagggtaagacggtgtggtttgtgccctccatcaaggccggaaacgacatcgcagcctgcctgcgcaagaacggcaagaaggtgatccagctgagccggaagaccttcgattccgagtatgtgaagacccgcgccaacgactgggacttcgtggtcaccacggacatcagcgaaatgggcgccaacttcaaggccgagcgggtaatcgacccgcgccggtgcatgaagcccgtgatcctcaccgacggcgaggagcgcgtcatcctggcgggccccatgccagtaactcactccagcgccgctcagcggcgcgggcgcattggccggaacccgaagaacgagaacgaccagtacatctacatgggcgagcccttagagaacgacgaggactgtgcccactggaaggaggccaaaatgctcctagacaacatcaacacccccgaggggatcatcccctccatgttcgaaccggaacgagagaaggtggacgccatcgacggcgaatataggttgcgcggggaggcccgaaaaacgttcgtagatctcatgaggcggggagacctacccgtgtggctggcctacaaggtggccgcagaggggattaactacgcggaccgcaagtggtgctttgacggcattaagaacaaccagattctcgaggagaacatggaggtcgagatctggaccaaggagggggagcggaagaaactgaagccccgctggctggacgcccggatctacagcgacccgctcgccctgaaggaattcaaggagtttgccgcgggcagaaagtccctgaccctgaacctaatcacagagatgggacggctgcccacgttcatgacgcaaaaggcccgtaacgctttggacaacctggccgtgcttcacaccgccgaggccggaggccgggcctacaatcacgcccttagcgagctgcccgagactctggagacgctcttgctgctcaccctcctggccaccgtgaccggcggcatcttcctattcctgatgtccggcaaggggatcggcaagatgacactagggatgtgctgcatcatcacggcctccatccttttgtggtacgcccagatccagccccactggatcgccgcctccatcatcctggaatttttcctaatcgtcctgctgatccctgagcccgaaaagcagcgcacgccccaggataaccagctcacctacgttgttatcgccatcctgacagtggtggccgcgacgatggctaacgagatgggcttcctggagaagaccaagaaggacctggggctgggctccatcaccactcaggagagcgagtccaatatcctggacatcgacctccggcccgccagcgcctggactttgtacgcagtggcaaccaccttcgtgacccctatgctgagacattccatcgagaacagctccgtgaacgtaagtctcacggctatcgccaaccaggccaccgtgctaatgggcctggggaaaggctggcccctcagcaagatggacatcggggtacctctgctggcgatcggctgttacagccaggtcaaccccatcaccctaaccgccgcccttctgctgctggtggctcactacgccatcatcgggccgggcctgcaggcgaaggccacgcgtgaggcccagaagcgcgcggcagcgggcatcatgaagaaccccactgtggacgggatcaccgtcatcgacctcgagccgatcccctacgacccgaagttcgagaagcagttaggccaggtgatgcttctcattctgtgcgtgacacaggtcctgatgatgcggacgacatgggccttatgcgaggccctgacgctggccaccgggccgatctccacgctctgggagggcaaccccgggcgcttttggaacaccaccatcgccgtaagcatggcgaatatcttccgaggctcctacctggcaggcgccggtctgcttttcagcatcatgaagaacacgacgaacacccggcgcgggactggcaacataggggagaccctgggcgaaaagtggaagtcccggctgaacgcgctcggcaagagcgagttccagatatacaagaagtccggtatccaggaagtggaccgcacgctggcgaaggaggggatcaagcggggcgagacagatcaccacgccgtcagccgcggctccgcgaagctgcggtggttcgtggagcgcaacatggtgacccccgagggcaaagtcgtggacttaggctgtgggcggggtggctggagctactactgcggcgggctgaagaacgtacgtgaggtcaagggcttaaccaagggcggaccggggcatgaggagcccatccccatgtccacgtacgggtggaacctcgtgcggctgcaaagcggcgtggatgtcttcttcacgccgccagaaaagtgcgatacactgctctgcgacatcggggagagctccccgaaccccaccatcgaagccggccgcaccctgcgggtgctgaaccttgtggagaactggctgaacaataacacgcagttctgcatcaaggtcctgaacccctacatgccgtctgtcatcgagaagatggaggccttacagcgcaagtacggaggggcgctggtacggaaccccctgtcccgaaatagcacccacgagatgtactgggtctccaacgcaaccgggaatatcgtgagctccgtaaacatgatcagccgcatgctgataaacagattcacgatgaagcacaagaaggccacatacgagcccgatgtcgatctagggtccggcacgcgtaacatcgggatcgagagcgagatcccgaatctggacatcataggtaagcgcatcgagaagattaagcaagagcacgagacctcctggcactacgaccaggatcacccctacaagacctgggcctaccatggcagctacgagactaagcagacggggtctgcctcttccatggtgaacggcgtggtccgcctgctcactaagccctgggacgtggtgccgatggtcacgcagatggcgatgacggacacgacccccttcgggcagcagcgggtcttcaaggagaaggtggacactcgcacgcaggaacctaaagagggcaccaagaagctcatgaagatcactgccgagtggctgtggaaggagcttggaaaaaagaagacaccccggatgtgcacgcgtgaggagttcacccggaaggtccggtctaacgccgccctaggcgccatattcaccgacgagaacaagtggaaatcggcgcgggaggccgtggaggacggccgcttctgggagctggtggaccgggaacgaaatctccacctggaggggaagtgcgaaacgtgcgtgtacaatatgatgggcaagcgggagaagaagctgggggaattcggcaaggcaaagggaagccgcgccatctggtatatgtggttaggagcgaggttcctggaattcgaggccctgggatttctcaacgaggaccactggttctctaggggaaacagcctgagcggcgtcgagggggaggggctgcaccgcctcggctacatcctgcgcgacgtggggaaaaaggagggcggggcaatgtacgccgacgatacggccggctgggacactcggataacccttgaggacctcaaaaatgaggagatggtcacaaatcatatgaagggggagcacaagaaactggcggaggccatcttcaagttgacttatcagaacaaggtggtcagagtgcaacgtcctaccccgcgcggcaccgtgatggacattatctcccggcgtgaccagcgcggaagcgggcaggtcggcacctacgggctcaatacgttcaccaacatggaggcccagctgatacggcagatggagggggagggcatttttaagagcatccagcacctgacggccaccgaagagatcgccgtacagaactggttggcgcgcgtggggcgggagcggttgtccagaatggccatcagtggcgacgactgcgtcgttaagcccatcgatgaccgcttcgccagcgccctgacggctctgaacgacatgggaaaagtgcggaaggacatccaacagtgggagccctcccgcggctggaacgactggacacaggtccccttctgctcgcaccacttccacgagctggtgatgaaggacgggcgggtgctggtcgtgccgtgtcgcaatcaggatgagctcatcggcagagcgcgcatctctcagggcgcaggatggagcctaaaggagaccgcttgcctaggcaagtcctacgcccagatgtggacactaatgtatttccaccggcgcgacctgcggctggccgcgaacgccatatgttcagccgtgccctcccactgggtccccaccagccgcacgacttggtccattcacgcgaagcacgagtggatgaccacggaggacatgttagctgtgtggaaccgggtgtggatccaggagaacccatggatggaggataaaacgcctgtcgagagctgggaggaagtgccctacctggggaagcgtgaggatcagtggtgtggctccctgatcgggcttaccagccgggccacgtgggcgaagaacattcagaccgccatcaaccaggtgcgaagccttatcggcaacgaggagtacaccgattatatgccctccatgaagcggttcaggcgcgaggaggaggaagccggggttttatggtga

SEQ ID NO: 25096 - RNA, 9876 nt, synthetic construct
  misc_feature 1..9876: note = derived and/or modified CDS sequence (opt11) from DENV-2__EU482603__SS-prME
  source 1..9876: mol_type = other RNA
accgcgggcgtaatcgtcatgctgatccccaccgccatggccttccacctcaccaccagaaacggggaaccgcacatgatagtggggcgccaggagaaggggaagtccttgctcttcaagaccgaggacggcgtgaatatgtgcactctcatggccatcgacctgggggaactttgcgaagacaccatcacctacaaatgccccctcttgcgccagaacgagcccgaagacatcgactgctggtgcaattcaacttccacctgggtcacctacggcacctgcaccacgacgggtgagcaccggcgtgagaagcggagtgtggccctggtgccccatgtcggcatgggcctagaaacaagaacggagacatggatgagcagcgagggcgcgtggaagcacgttcaaaggatcgagacctggatactgcggcacccgggctttaccatcatggctgcgatcttggcctacacgatcggcaccacacacttccagagggccctcatcttcattctgctgaccgccgtggcgcccagtatgactatgcgctgtatcggaatatccaatagagactttgtcgagggcgtaagcgggggttcatgggtagatatcgttctcgagcatgggtcttgcgtgacgacgatggccaagaacaagccaaccctggactttgaattaatcaagaccgaggccaagcagccggccacccttcgaaagtactgcatcgaggccaagctgacaaatacaactacggagtccagatgcccgacgcaaggcgaaccatcgctcaacgaggagcaagacaagcgattcatctgcaagcattccatggtggatcgggggtgggggaacggctgcgggcttttcgggaagggtgggattgtgacatgcgcgatgtttacgtgtaaaaagaacatggagggtaaggttgttcagcccgaaaacctggaatacaccatcgtgatcactccccatagcggggaggagcacgcggtgggaaatgacaccgggaagcacgggaaagagatcaagataacccctcaatccagcatcaccgaagccgaactgaccgggtacggaacggtgacaatggagtgttccccccggaccggccttgatttcaacgagatggttttgctacagatggaggacaaggcatggttagtgcaccggcaatggttcctggacctccccctcccctggcttccgggggctgatacacagggcagcaactggattcagaaggagacgctggtgaccttcaagaatccccacgcgaagaaacaagatgtcgtggtcctcgggtcccaggaaggcgcaatgcatacagccctaaccggggcaacggaaatacagatgagctcgggcaatctcttgtttaccgggcacctgaagtgccgcctgcggatggataagctccagctgaaggggatgtcctacagcatgtgcacgggaaaattcaagattgtaaaggaaatcgccgagacccagcacgggacgatagttatccgcgtccaatacgagggagacggctccccctgcaagattccgttcgagatcacagatctggagaagcggcacgtgttggggagactgataaccgtcaacccgatcgtcaccgagaaggacagtccggtgaacatcgaggccgagccacccttcggcgattcctacatcataatcggggtagagcccggccagctgaaactgaactggtttaaaaaggggagttcaatcggccagatgtttgagactaccatgcgtggcgcgaaacggatggcaatattaggggacacagcctgggacttcggcagcctgggtggtgtatttacctccatcgggaaggccctacaccaggtgttcggtgcaatctatggagccgcattcagcggggtatcctggacgatgaagatcctgatcggcgtaatcatcacctggattgggatgaattcccgcagtacaagcttatccgttagtctggtgcttgtaggcgtcgttaccctgtacttaggtgcaatggtccaggcggactccggctgtgtggtatcctggaagaacaaagagttgaagtgcgggtccgggatcttcatcactgataacgtacatacttggaccgagcaatacaagtttcagcccgaaagcccttcaaaactggcttccgccattcagaaggcccacgcagaagggatctgcggtatccggagcgtaactcgcctcgagaacctcatgtggaagcaaatcacgcccgagctcaaccatatcctgtccgagaacgaagtgaagctcaccatcatgacaggagacataaagggcattatgcaagcgggaaagcgtagcttgcgcccgcagcccaccgagctgaaatactcctggaagacgtgggggaaggccaagatgctctccacggagtcccacaaccagaccttcctgatcgacggccccgagaccgccgagtgcccaaacactaaccgggcgtggaacagcctggaggtcgaggactacggcttcggagtgttcacgaccaacatctggcttaagctacgagaaaagcaggacgtgttctgcgattccaagctgatgagcgccgctatcaaagacaatcgggcggtccacgccgacatgggctactggatagagtccgccctcaacgacacctggaagatggaaaaagccagctttattgaggtgaaaagttgccactggcccaagagccacactctatggtccaatggcgtcctagaaagcgagatgatcatccccaagaacttcgcgggtcccgtctcccagcataactaccgtccggggtaccacacgcagaccgctgggccctggcatctcggcaagctcgagatggacttcgatctttgtgaggggaccaccgtagtggttaccgaggactgcgggaaccgcggcccctcattacgtaccaccaccgccagcgggaagctgatcaccgagtggtgttgtcggagctgcacactgcccccgctccgctacaggggtgaagacggatgctggtacggaatggaaattcgccccctgaaggagaaagaagagaacctggtgaacagcctcgtaactgccggccacggccagatcgacaacttctccttaggcgtcctgggcatggccctcttcctggaggagatgctacggacccgcataggaacgaagcacgccatcctcttagtggccgtgagcttcgtgaccctcatcacgggcaacatgtcattcagagacctaggtcgcgtgatggttatggtcggggccaccatgaccgacgacatcggcatgggcgtgacctacctggccctgttagcagccttcaaggtgcggcccaccttcgccgcgggtctcctcctccggaagcttacaagtaaggaactaatgatggcgacgatcggcatcgcgttgctttctcaatcaaccatacccgaaacgatactagagctcaccgacgccctggctctgggcatgatggtccttaaaatcgtacgtgacatggaaaaataccaactggccgtgacgatcatggccatcagctgcgttccgaatgctgtcatcttgcaaaatgcctggaaagtgtcatgcaccatcctcgccgccgtttctgttagccctctgcttctcacctccagccagcagaaagcggattggatcccactcgccttgactatcaagggcctgaaccccacagctatcttcttgaccacactgtcccggaccagcaagaagcgctcctggccgcttaacgaagccattatggcagtcggcatggtgagcatcctagcatccagcctgctcaagaatgacatccccatgacagggcccctagtggctggcggccttctcaccgtatgttacgtgctgaccggtcggagcgccgacttggaactggaaagagccgccgacgtgaagtgggaggaccaggccgagataagcggttcttcccctattctgagcatcaccatctccgaagatggcagcatgagtatcaagaacgaggaagaggaacagacgctaaccattctcatcaggacgggtcttctagtaatcagcggggtattccctgtgtccattcccatcaccgccgccgcctggtatctctgggaagtcaaaaaacagcgcgccggcgtgctgtgggacgtgccttctccgccgcccgtcgaaaaggcggaactcgaggatggggcctaccggatcaaacagcgcggcatcctcgggtactcccagatcggagctggcgtgtacaaggagggtacattccacacgatgtggcacgtcacccggggggccgtcctgatgcaccgagggaagcgaatagagcctagctgggcggacgtgaaaaaggatctgatatcctacggggggggctggaaactcgagggcgagtggaaggagggtgaggaggtccaggtcctggcgctggaacccggaaagaatccgcgagccgtgcagaccaagccggggatcttcaaaacaaataccggaactattggggccgtgtctctcgactttagccctggaaccagcggctcccccatcgtcgaccggaagggcaaggtcgtgggcctgtacgggaacggcgtcgtcaccaggagcggtgcttacgtgtccgcaatcgcccagacggagaaatccatcgaggacaaccccgagatagaggacgacatctttcgcaagaagcgcctcacgatcatggacttgcacccgggggccggcaagaccaagagatacctgccggccatcgttcgcgaggcaataaagcgaggactgcgcaccctgatcctcgcaccaactagggtcgtggctgctgagatggaggaggccctgcggggcctgcccattaggtaccaaacgcccgcgatcaagaccgagcatactggtcgggagatagtcgatttaatgtgccacgcgaccttcacaatgaggttgctttcaccagtccgggtgccaaactacaacctaatcatcatggacgaggcccacttcaccgaccccgcttccattgccgctcgcggctacatctccacccgggttgaaatgggcgaagcggctggaatcttcatgactgcgacgccccccgggtcgcgggatcctttcccccagtccaatgccccaattatggacgaggagcgggagatccccgagcgttcctggaactcgggtcacgagtgggtaacagacttcaaaggaaagacggtgtggttcgtcccctcaataaaggcagggaacgacatcgcagcctgcctacggaagaacggcaagaaggtgatccagctgtcacgcaaaacgttcgactccgagtacgtaaaaacccgggccaacgactgggattttgtcgtgaccaccgacataagcgaaatgggggccaacttcaaggcggagcgagtgatcgacccacgtaggtgtatgaagcccgtcatcctcacggacggggaagagcgggtaatactagcaggcccaatgccggtgacgcattcctctgccgcccaacgccgggggcgcatcggccgcaatcccaagaacgagaacgaccagtacatctatatgggtgagccgctggaaaatgacgaggactgcgcccactggaaggaagcgaagatgctgctggacaacataaatacccccgagggcattattccatccatgttcgagcccgagcgggaaaaggtcgacgccattgatggcgagtaccgcctgcgtggcgaggccagaaagaccttcgtggacctgatgcggcgaggcgaccttccggtgtggctagcttacaaggtggcagcagagggaatcaattacgccgacaggaagtggtgcttcgatggcatcaagaacaaccagatcttggaagagaacatggaggtggagatctggacgaaggagggagagcgcaaaaagctaaagccgcgttggctcgatgcgcgcatctacagcgacccgctcgcactcaaggagttcaaggagttcgcggctggccggaagtccctgaccctcaacctaattacggaaatgggccgcctgcccaccttcatgacgcagaaggcccggaatgccctcgacaacctggccgtgctgcatacggcagaggccggtggccgcgcctacaaccacgcgttgtctgagttgcccgagactcttgaaaccctcctactgttaacgctgctcgccacggtcactgggggtatctttctcttccttatgtcgggcaaggggataggcaaaatgactctcggcatgtgttgtattatcacagcgagcatcctcctgtggtacgcgcagatccagccgcactggatcgccgcctccataattctggagttctttctcatcgtgctgctgatccccgagcctgagaagcagcggaccccacaggataaccagttaacatacgtcgtaatcgccatactgaccgtagtcgcggccaccatggctaacgagatgggtttcctggagaagacgaagaaggacttagggctgggcagcataacgactcaggagtcggagtccaacattcttgacattgacctcagacctgccagcgcctggaccttgtacgcggttgccacgacgttcgtcacgcctatgttgcggcactccatcgagaattcttctgtaaacgtgagcctcacagcaatcgcaaaccaagcgacggtcctgatgggtctgggaaaaggatggcccctcagcaagatggacataggcgtccccctgctggccatcggctgctatagccaagtgaatcccattaccttaactgccgccctgctgctccttgtagcccactacgccatcatcgggcccggcttgcaggccaaggcgacccgcgaggcccagaagcgggctgcggcaggcatcatgaaaaaccctacggtggatgggataaccgtgatcgacttggaacccattccgtacgatcccaagtttgagaagcaactgggccaagtgatgctgctgatcctgtgcgtcacccaggtgctaatgatgaggacgacgtgggccctctgcgaagccctgaccctggccaccgggcccattagcaccctctgggagggcaaccccggccggttctggaacacgacgatcgcggttagcatggccaacatcttccgcggctcctatctggcaggcgccgggctccttttctcgatcatgaagaacaccacctccacacgccggggaaccgggaacatcggcgagaccctgggtgagaagtggaagtctcgattgaatgctctcgggaagtcggagttccaaatctacaagaagtccggcatccaggaggtagaccggaccctggccaaggagggtatcaaacggggagaaacggatcaccatgcagtgtcccgggggagtgccaagcttcgctggttcgtggaaaggaatatggttaccccggagggtaaggttgttgatctcggctgcgggcgcggcgggtggtcctactactgcggcggcctgaagaacgtacgggaggttaagggcctgacaaagggcgggcccggccacgaagaacccattcctatgagcacctacggttggaaccttgtgcgacttcaaagcggcgtagatgttttcttcacgcccccggagaagtgtgacaccctgctctgcgacatcggcgagtccagccccaaccccactatcgaggctggtagaaccctgcgcgtgctgaacctcgttgagaattggctgaacaataatacccagttctgcatcaaggtgcttaacccatacatgccctccgttatcgagaagatggaggcactccagaggaagtatggcggcgccctggtgcgaaaccccctgagccgaaactcaactcacgagatgtattgggtgagcaatgccacgggcaacatcgtgtccagcgtcaatatgatatcccgaatgctgataaaccgttttacgatgaagcataaaaagaccacgtacgagcccgacgtagacctcgggtcagggacccgcaacatcggaatcgagtcagagatccccaacctcgacattataggcaagcggatcgagaagataaagcaggagcacgagaccagctggcactacgaccaggaccacccatacaagacctgggcttaccacggctcatacgaaacgaagcagacgggatcggcctccagcatggtgaacggggtcgtgcgtctgctcacgaagccctgggatgtggtcccgatggtcacccagatggcaatgacggacaccactccgtttggtcagcaacgcgtgttcaaagaaaaggtcgacacccggacgcaggagcccaaggagggcaccaagaagctgatgaagatcaccgccgaatggctatggaaggagctcgggaagaagaagacgccgcggatgtgcacgcgggaggagttcacccgcaaggtgcggtccaatgccgcccttggggctattttcacggacgagaacaaatggaaatccgcgagggaagccgttgaggacggccggttttgggagttggtcgaccgtgaaaggaacctccacctggaggggaaatgtgagacgtgtgtgtacaacatgatgggtaagagagagaagaagctgggagagttcggcaaggccaaaggcagtcgggctatttggtacatgtggctcggggcgcgcttcctggaattcgaagccctcggctttctcaacgaggaccattggttctcacgcgggaatagcctgagcggcgtcgagggggaaggactgcaccgcctaggctatatcctgcgggacgtcagcaaaaaggagggaggcgccatgtacgcggatgacacggccgggtgggacacccgcatcaccctggaggacctcaagaacgaggagatggttacgaaccacatgaagggtgagcataagaagttggcggaggccatcttcaaactgacgtaccagaacaaggttgtgagagttcagcgcccgacgccccggggaaccgtcatggacatcatcagtcgccgcgatcaacgcggtagcggccaagtggggacttacggcttgaatacgtttaccaacatggaggcccagctgatccgccaaatggagggggagggcattttcaagtctatccagcacctgactgccaccgaagagatcgttgtccaaaactggctcgcccgggtaggccgtgagcggttgagcaggatggccattagtggggacgactgcgtggtaaagccgatcgatgatcgctttgcaagtgccctgacggcgctcaatgacatgggcaaggtgagaaaggatatacagcaatgggagccatccagaggttggaacgactggacccaagtgccgttttgcagtcaccacttccacgaacttgtcatgaaggacggcagggtacttgtggtcccctgccggaatcaagatgaactgatcgggcgagcacggatctcccagggcgcgggctggagcctgaaggagactgcctgtctgggtaagtcctacgcacaaatgtggacgctcatgtatttccaccgccgggacctgcgtctggccgccaacgcgatctgcagtgccgtgccctcccactgggtgcctaccagccgtacgacctggtccattcatgcaaagcacgaatggatgacaaccgaggatatgcttgcggtctggaaccgcgtgtggatccaggagaacccgtggatggaggacaaaacccctgtggagagctgggaggaggtcccctacttaggcaaacgggaggaccagtggtgcgggagcctgataggtctaacttcccgcgcgacttgggccaagaacatacagactgcaataaatcaggtgcggtcgctcatcggtaacgaggagtacacggactacatgccttcaatgaagcgctttcggcgggaggaggaagaggccggcgtgctgtggtga

SEQ ID NO: 25097 - RNA, 9876 nt, synthetic construct
  misc_feature 1..9876: note = derived and/or modified CDS sequence (opt11) from DENV-2__EU482599__SS-prME
  source 1..9876: mol_type = other RNA
actgccggcgttatcgtcatgctgatccccaccgccatggctttccacctcaccacccgcaacggcgagccgcacatgatcgtagggcggcaggagaagggtaagtccctgttattcaagacggaagacggcgtgaatatgtgcaccctcatggcaatagacctgggggagctgtgcgaagacacgatcacctacaagtgccccctcctgcgccagaacgaaccagaggatatcgactgctggtgcaacagcaccagcacctgggtcacgtacgggacctgcaccaccaccggggagcaccggcgcgagaagaggtccgtggctctggttccccacgtcggaatgggcctcgagacacgcaccgagacctggatgtcatccgagggggcctggaagcacgtacagcggatcgaaacctggattctgcgccacccgggcttcaccatcatggccgctatccttgcctacaccatcgggacgacccacttccagcgggccttgatcttcattctgctgacagctgtggctcccagtatgaccatgcgatgcatcgggatctccaatcgtgacttcgtcgagggcgtgagcgggggctcctgggtggacatcgtcctcgagcacggctcttgcgtgaccacgatggccaagaacaagcccaccttagactttgagctgattaagaccgaagccaagcagcccgctaccctccgtaagtactgcatcgaggccaagctgacgaataccacaaccgaatcccgttgccctacgcaaggcgagcctagcctgaacgaggagcaggacaagcggttcatttgtaagcactccatggtggatcgcggctggggtaacggctgcggactgtttggcaagggcgggatcgtgacctgcgcgatgttcacttgcaaaaagaacatggaaggaaaggtcgtgcagccggagaacctggagtacaccatcgtcatcaccccccacagtggggaggagcatgccgtgggcaatgacaccgggaagcacggaaaggagatcaagatcaccccgcagtcctcgataacggaggccgagctaacggggtacggcacggtaacaatggaatgctccccccgcaccggcctggacttcaacgaaatggtccttctacagatggaggataaggcctggctcgtgcaccggcagtggttcctggacctgccgcttccgtggttgccgggtgccgacacccagggctcaaactggatccaaaaagagacgctggtgaccttcaagaaccctcatgcgaagaagcaggacgtcgtggtcctcggctcccaggaaggcgccatgcacaccgcgctgaccggggccacggagatccagatgtcaagcggcaacctcctgttcaccggccacctgaagtgcaggctgcggatggataagctccagctgaagggaatgtcctacagcatgtgcacgggcaagtttaagatcgtgaaagagatagccgaaactcagcatgggacgattgtgatccgcgtccagtacgaaggcgatggcagcccttgtaagatccccttcgagatcacagacttggaaaaacggcacgttctcgggcgcctgatcacggtgaacccgatagtcaccgagaaggattcgcccgtcaatatcgaggcggagccgccctttggggactcgtacataatcatcggggtggagccgggtcagctaaagctaaactggttcaagaaagggtcgtccatcgggcagatgttcgagacgaccatgcgcggagccaaaagaatggcgatcctgggcgacactgcatgggactttggcagcttggggggagtctttaccagtatcggtaaggctctccaccaggtgttcggcgcgatatacggggccgcgtttagcggggtgtcctggacgatgaaaatactgatcggcgtgattatcacctggatcgggatgaacagccgctccaccagcttatccgtgtctctggtgctcgttggagtggttaccctgtacctgggagccatggtgcaggcggactccgggtgcgtggtgagctggaagaacaaggagcttaagtgtggctccggaatctttataactgacaacgtacatacgtggaccgagcagtataagttccaacccgagtcccccagcaagctggcctcggccatccagaaggcccacgaggaaggaatctgcgggatccggagcgttactcgcctggagaacctcatgtggaagcagatcacgcccgagctgaaccacatcttatccgaaaacgaagtgaagctcaccatcatgaccggcgacatccgtgggatcatgcaggccggtaagcgctcactgcggccacaacccaccgagctgaagtattcctggaagacctggggcaaggcgaagatgttaagcaccgagagtcacaaccaaaccttcctgatcgacgggcccgagacagcggagtgcccgaacacgaaccgagcctggaacagtttggaagtcgaggattacggtttcggcgtgtttacaacaaacatctggctgaagctgcgggagaagcaggacgtgttctgcgactccaagttgatgagcgccgccatcaaggacaaccgcgcggtccacgccgacatgggttactggatcgagtctgccctaaatgacacttggaaaatggagaaggcaagcttcatcgaagtgaagtcctgccactggccaaagtctcacaccctgtggtccaacggcgtgctggaaagcgagatgatcatcccaaagaatttcgccgggcccgtctcccagcacaactaccggcccggctatcacacgcagactgcgggcccatggcacctgggtaaactggagatggacttcgacctgtgcgaggggaccaccgtcgtggttacggaggactgcggcaatcgcggcccctcgctaaggaccaccaccgcctcagggaaactgatcacggagtggtgctgccgctcctgcaccctgcccccactcagataccgcggcgaggacgggtgctggtacggaatggaaattcggcccctgaaggagaaagaggagaacctggtaaatagcctcgtgactgcagggcacggacaaatcgacaacttctccctgggagtcttggggatggccctcttcctggaggagatgctgcgcacccggatcggcacgaagcacgcgatcctcctggtggccgtgtcattcgtaaccctgataaccgggaacatgtccttccgcgacctcggccgcgtcatggtcatggtcggcgccaccatgaccgatgacattggcatgggcgtgacctacctggctctgttagcggctttcaaggtgcggccgacctttgccgccgggctgctcctccgcaagctgaccagcaaggagctgatgatggccacaattggtatcgccttactgtcccagagcaccatccccgagacgatcctggagttgaccgacgcgctggcactgggcatgatggtcctcaagatcgtgagaaacatggagaagtaccagcttgcagtcacgatcatggtcatcagttgcgtgccgaacgcagtgatcctgcagaatgcctggaaggtcagctgcaccatcctcgcggccgtgtccgtcagcccccttctgctcacaagtagccagcaaaaggccgactggatcccgttagccctgaccatcaagggcctaaaccccacagcgatcttcctgactaccctgagccgcacctccaaaaagcggtcctggccgctcaatgaggcaatcatggcggtgggaatggtgagcatcctggccagcagcttgctcaagaacgacatccccatgacgggccctctggtcgccggaggattgctaaccgtgtgctatgtgctgaccggccgcagcgcggacttagagctcgagcgcgccgccgacgtcaagtgggaggaccaagccgagatctccgggagctcccccatcttaagcatcaccatttccgaggacgggagcatgtccatcaagaacgaggaggaggaacagaccctcaccatcttgatccgcactggcctactggtgatatcgggcgtgttccctgtctccatccccatcaccgcggccgcctggtacctatgggaggtgaagaaacagcgggccggcgtcctgtgggacgtacccagccccccgcccgtggaaaaagccgagctggaagacggggcctaccgcatcaagcagcggggcatcctcgggtacagccagatcggagcgggcgtgtataaggaggggacctttcacacgatgtggcacgtcacccgtggggccgttctcatgcaccgaggcaagcgcatcgaaccgagctgggccgacgttaaaaaggacctaatcagctacggcgggggctggaaactggagggtgagtggaaagagggggaggaggtccaggtgctggccctggagccgggcaagaaccccagagccgtacaaacgaaaccagggatcttcaagaccaacacgggtaccatcggggcggtttctctcgatttctcccccggcaccagtggctcccccatagtcgaccgcaaggggaaggtagtcggcctgtatgggaacggcgtggtaacccggtctggcgcatacgttagtgcgatcgcccagacggagaagtcaattgaggacaaccccgagatcgaagacgacatattccgcaagaagcggcttaccatcatggacttacaccccggggcgggaaaaacgaagcgctatctgccagccatagtgagggaggccattaagcgcgggctgcgcactctgatcctagcccctacgcgggtggtcgccgcggagatggaggaggcgctgcgaggactgcccatccggtaccagaccaccgccatcaaaaccgagcacacgggacgcgagatagtggacctcatgtgccacgccaccttcaccatgcggctgctgagccctgtccgcgtgcctaactataatctcatcatcatggacgaggctcattttaccgacccggcgtccatcgccgcccgagggtacatcagcacgcgcgtggagatgggtgaggccgccgggatcttcatgaccgctacgccgcccggctcccgagaccctttcccgcagagcaacgcccccatcatggacgaggagcgcgagattcccgagcggtcatggaacagcgggcacgaatgggtgactgacttcaagggaaagacggtctggttcgtaccgtccatcaaggctggcaacgacatcgccgcgtgcctgcgcaagaatggaaaaaaggtgattcagctgagccggaagaccttcgacagtgaatacgttaagacccgcgctaatgactgggacttcgtggtgaccacggacatcagcgaaatgggggcgaactttaaggccgagcgggtgatcgacccgcgccggtgcatgaagcccgtgatcctcaccgacggggaggagcgggtaatcttagccggcccgatgcccgtcacccactcaagcgcggctcagcggcgcgggcgcatcggccggaacccgaagaacgagaacgaccagtacatctatatgggtgagcccttggagaatgatgaggactgcgcccactggaaggaggccaagatgctgctggacaacatcaacacgcccgagggcataatcccctccatgtttgagcctgaacgcgagaaagtggatgcaatcgacggcgagtaccggctgcgcggagaggcgcggaaaacattcgtggacttaatgcgccggggggacctgcccgtctggctcgcctacaaggtggccgccgaggggatcaactacgccgacagaaagtggtgcttcgatggcatcaagaacaaccagatcctcgaggagaacatggaggtggagatttggaccaaggagggcgagcggaagaagctcaagccccgttggctggacgcgaggatctacagcgatccactcgcactaaaggagttcaaagagttcgccgccggcaggaagtctttgaccctcaacctgatcacggaaatgggccggctgcccacgttcatgacccagaaggcgcgcaacgcattggacaatctggccgtcctgcacacagctgaggccgggggcagagcgtacaaccacgccctctcggagctgcccgagacccttgagacgctcttactgctcacattgctcgccaccgtgaccgggggcatattcctattcctgatgagtggaaagggaatcggcaagatgaccctgggtatgtgctgtatcataacagccagcattctcctgtggtatgcccagatccagccccactggatcgcggcctccatcatactcgagttcttcctcatcgtgctcctaatcccggagcccgagaaacagagaacgccccaggataaccagctcacctacgtggtaatcgccatcctgaccgtcgtggccgccactatggcgaacgagatgggctttctggagaagaccaagaaagacctcgggctgggcagcatcaccacccaagagagcgaatccaacattctggatatcgacctccggcccgccagcgcctggactttatacgccgtagccacaaccttcgtcaccccgatgctgcgccactccatagaaaacagctctgtgaacgtgtctctcaccgcgatagctaaccaggccaccgtcctgatgggcctggggaagggctggcctctctccaaaatggacataggagtgcccctacttgccatcggctgttacagccaggtgaatccaattaccctgaccgcggccctgctgctcctcgttgcccattacgccatcattgggccaggcctgcaggccaaagcgacgcgggaggcccagaagcgcgccgccgccggcatcatgaagaaccctaccgtggacgggataactgtgatcgatctcgagcccataccatacgacccgaaattcgagaagcaactgggccaggtcatgctgctcatcctgtgcgtgacccaggtgttgatgatgcggacgacctgggcgctctgcgaggccctgactctggctaccgggcccatctccactctctgggagggcaaccccgggcgcttctggaacaccacgatcgccgtcagcatggcaaacatattccgcggctcttacctggcgggcgcagggctcctgttcagcatcatgaagaacaccacgaacacccggcgcgggaccgggaacatcggtgaaaccctcggcgagaagtggaagtccaggctgaacgccctcggcaagtcggagttccagatatacaaaaagtccggcatccaggaggtggaccgcacgctggccaaggagggaatcaagcgcggcgagaccgaccaccacgcggtgtcccgcgggtccgccaagctgcggtggttcgtagagcgcaacatggtgacgcccgagggcaaggtggtcgacctcggttgcgggcggggaggttggagttactattgcggcgggctgaaaaacgtgagggaggtgaagggcctaaccaagggcgggccgggccacgaggagccaattcccatgtccacgtacgggtggaacctcgtccggctgcagagcggcgtggacgtgttttttacaccgcctgagaaatgtgacactctgctctgtgacatcggggaaagctcccccaaccccaccatcgaggccggccgcaccctgcgggtcctgaacctcgtggagaactggctaaataacaacacacagttctgtatcaaggtgctgaacccctatatgccgtccgtcatcgaaaagatggaggccctccagcgcaagtacggcggggcgctggttcggaacccgctgtcccgcaacagcacccacgagatgtactgggtgtctaacgcgaccggcaacattgtcagctcagtgaacatgatctctcggatgctgatcaaccgctttactatgaagcacaagaaggccacgtacgaacctgacgtcgacctcgggtcagggacccggaacatagggattgaaagcgagatcccgaatttagacataatcggcaagcgaatcgagaaaatcaagcaggagcacgagacctcctggcactacgaccaggaccacccctacaagacttgggcctaccatggcagctacgagacgaagcagaccgggtccgcctcttccatggttaacggcgtggtgcgactcctcaccaagccctgggacgtcgtacctatggtgacccagatggccatgacggataccaccccgttcgggcaacaacgggtcttcaaggagaaggtggatacccgcactcaggaacccaaggagggcaccaagaagctgatgaagattaccgcggagtggctgtggaaggagcttggcaagaagaagacgcctcgtatgtgtacgcgcgaggagttcacccggaaggtgcggagcaacgccgccctgggggccatcttcaccgacgagaacaagtggaagagtgcccgggaggcggtagaggacggccgcttctgggagctggtagaccgggagcgcaacttacacctggaagggaagtgcgaaacctgcgtgtataacatgatgggaaagcgggagaagaagctgggggagttcggcaaggccaagggcagcagagctatctggtacatgtggctcggcgcccggttcttagagttcgaggcactgggcttcctcaacgaggaccattggttctcccgcgggaacagcttgagcggcgtcgagggggagggcctgcatcggctcggatacatcctgcgcgacgtcgggaaaaaggaaggcggggccatgtacgccgatgatactgccggatgggatacccgaatcaccttagaggatctcaagaacgaggagatggtcacgaaccacatgaaaggggagcacaaaaagctggccgaggcgatcttcaagcttacgtaccaaaacaaggtggttagagtccagcggccaaccccgcgcggcaccgtgatggacataatctcccggcgggaccagcgcggatcggggcaggtcggcacctacgggcttaacacgttcaccaatatggaagctcagttgatccggcagatggagggtgagggcatcttcaagtccatccaacacctgaccgcaaccgaggagatcgccgtccaaaactggctcgccagggtgggccgggagcgtctgagccggatggcgatttccggcgacgattgcgtggttaaacccatcgatgaccgcttcgccagcgccctgactgccctcaacgatatgggtaaagtgcggaaggacatccagcagtgggagcccagccgcggctggaacgactggacccaggtccctttctgctcccaccacttccacgaactcgtcatgaaggacgggcgggtgctggtggtcccatgccgcaaccaggacgagttgatcggacgcgcccgcatttcccagggggcagggtggtccctcaaggaaacggcatgcttaggcaagtcctacgctcagatgtggactctcatgtacttccaccggcgcgacctgcggctggccgccaacgcgatctgcagcgccgtgccctcccactgggtgccaaccagccgcacgacctggagtatccacgccaagcacgaatggatgactactgaggacatgttagcggtctggaatcgtgtatggattcaggagaacccatggatggaagacaagacgcctgtggagtcctgggaggaggtgccctacctggggaagcgcgaggaccaatggtgtggctccctgatcgggctcactagccgggcgacttgggccaaaaatatccagaccgccatcaaccaggtgcgcagcctgattgggaacgaagagtacacggactacatgccctcgatgaagcgcttccggcgcgaggaggaagaggcgggcgtgctgtggtga

SEQ ID NO: 25098 - RNA, 9876 nt, synthetic construct
  misc_feature 1..9876: note = derived and/or modified CDS sequence (opt11) from DENV-2__FJ898436__SS-prME
  source 1..9876: mol_type = other RNA
accgcgggggtgatcgtcatgctgatccctaccgccatggcattccacctcaccacccgaaacggggaaccgcatatgatcgtgggccggcaggaaaaaggtaagtccctgctgttcaagaccgaagacggcgtcaacatgtgtaccctcatggccatcgacctgggggaactgtgtgaagatactatcacctacaagtgtcccttgctcagacaaaacgagcctgaagacatcgactgttggtgtaactcgactagcacctgggtaacctacgggacctgcactacgacgggagagcatcggagagagaagcggtccgttgccctggtcccccatgtcgggatgggcctcgaaactcgcaccgagacctggatgagctctgaaggggcctggaagcacgtgcaacggatcgaaacatggatcctgcgccacccgggcttcaccatcatggcggctatcctggcctacaccatcgggacgactcacttccagcgggccctcatcttcattctgcttaccgccgtggcgcccagcatgaccatgagatgtatcggcatctccaacagggactttgtcgagggcgtcagcggcggctcatgggtggacatcgtgctcgagcacgggagctgcgtgacaactatggccaagaacaagcccaccctggacttcgagttgatcaagaccgaggccaagcagcccgcgaccctacgcaagtactgcatcgaggctaagctaacgaacacgaccaccgagtcccgctgtccgacgcaaggcgagcccagcctcaacgaggagcaggacaagcgatttatctgcaagcactccatggtggatcggggctggggcaacggatgcgggttattcggtaaaggcgggatcgtaacctgcgcgatgttcacgtgcaagaaaaatatggagggcaaggtggtacagcccgagaacctggagtacaccatcgtgatcacgccccactcaggggaggaacatgccgttggcaacgacaccggtaagcacggcaaagagatcaagatcacaccgcaaagtagcatcaccgaagccgaactcactgggtacgggacggtgaccatggaatgcagcccgcgcaccggcctggattttaacgagatggtcctgttgcagatggaggataaggcgtggctcgtgcaccggcagtggttcctggacctgcccctcccctggttgccgggggccgacacccagggcagcaattggatccaaaaggagactctggtgacctttaagaacccccacgcgaagaaacaggacgtcgtggtcctaggcagccaggagggagccatgcacaccgcactgactggggccacggagatccagatgagcagtggtaatctcctattcaccggccatctaaagtgccgcctgaggatggacaagctccagctgaaaggtatgtcgtacagcatgtgcacgggcaagtttaaaatcgtgaaggagattgccgaaacccagcacggcacgattgtgatccgggtccagtacgaaggcgacgggtccccctgtaagatcccattcgagatcaccgatttggagaagcgtcacgtgttggggaggctgattactgtgaacccaatcgtcacggaaaaagactcccccgtaaacatcgaagcggagccgcctttcggtgactcctacatcatcataggcgtggaacctggccagctgaagttaaattggtttaagaaagggagctccattggccagatgttcgagactaccatgcgcggcgccaagcggatggccatcctgggtgacaccgcctgggacttcggcagcctcgggggcgtgttcacctccattggcaaggcactccatcaagtgttcggtgcgatctacggcgccgcattcagcggggtgtcctggacgatgaagatcctgatcggcgttattatcacctggatcgggatgaactctcgctccacttcgctttccgtctcgctggtgttagttggcgtggttaccctctacctgggtgccatggtccaagcggactccggttgcgtggtgtcttggaaaaacaaggagctcaagtgcggctctggaatcttcatcacggacaatgtacacacatggaccgagcaatacaagttccagcccgagtcacccagcaagctagcctccgcgatccagaaggcccacgaagagggcatctgcgggatcagaagcgtcaccaggctggagaatctcatgtggaagcagatcacgcccgagctgaaccacatcctgtccgagaacgaggtcaaacttaccattatgacaggggacatacggggaatcatgcaggcagggaagagatctctgcgaccgcagcccaccgagctgaagtactcctggaagacctggggcaaggcgaagatgctcagcaccgagtcccacaatcagaccttcttgatcgacggaccggagaccgccgaatgcccgaacacgaaccgagcctggaacagcctggaggtcgaggactatggctttggtgtattcaccacaaatatctggttaaagctgagagagaagcaggacgtcttctgcgactccaagctgatgtcggccgcaatcaaagacaaccgcgcggtccacgccgacatgggctactggatcgagtccgccctcaatgacacatggaagatggagaaggccagcttcatcgaggtaaagagctgccattggccaaagtcacacacactttggtctaacggcgtgttagagagcgagatgatcatccccaagaacttcgccgggcccgtttcccagcacaactatcgcccgggctaccacacgcagaccgcggggccctggcatcttggaaagctggagatggacttcgacctctgcgagggaacaacagttgtggtcacggaagactgtggcaaccgcggccccagcttgcggacaaccactgccagcgggaaactgatcaccgagtggtgttgtcgctcctgcactctgccacccctccgttaccgcggcgaggatgggtgctggtacggcatggaaatccggcccctgaaggagaaggaggagaacctcgtgaacagcctcgtgaccgccgggcacggccagatcgacaacttctcactgggcgtccttgggatggcgcttttcctagaggagatgctgcgcacccggatcggtactaagcacgcaatcctcctagtagctgtgagcttcgtcacccttatcaccgggaacatgtccttccgcgacctcggccgcgtgatggtgatggtaggggcaacaatgacggacgacatcggcatgggagtaacatacttggccctgctcgcagccttcaaggtccggcccaccttcgccgccgggctgctacttagaaagctgaccagcaaggagctaatgatggccacgatcggcatcgccttgctgagtcaaagcactatccccgagacgattctggagctcacagacgcccttgccctggggatgatggtactcaagatagtgagaaacatggagaaatatcagttggccgtgacgatcatggctatcagttgcgtccctaacgcggtaatcttgcagaatgcgtggaaggtgagctgcaccattctcgccgcggtgtccgtgagccccctgctgctcacatcctcacagcaaaaggctgactggatcccccttgccctgaccatcaagggcctcaaccccacggccatctttctcacaacactgtcacggaccagcaagaaacgttcctggccgctcaacgaggcgatcatggccgtcggaatggtgagcatcctggccagcagcctgttaaagaacgacatccccatgacggggcccttagtggcagggggtctgctaacggtctgctacgttttgacgggccgaagcgcggacctggagctcgaacgggccgccgatgtgaagtgggaggatcaggctgaaatctctggcagctccccaatcttaagcatcactatctcagaggacggcagtatgtccatcaagaacgaagaggaggagcagactctgaccatcctaatacgcacgggcctgctcgtcatcagcggagtctttccggtatccatccctatcaccgcggccgcgtggtatctttgggaggtcaagaagcagcgtgcaggcgttttatgggatgtgcccagcccgccacctgtggagaaggccgagctggaagacggggcgtacaggatcaagcagcggggaatcttgggttactcccagatcggagcaggcgtgtacaaggaagggactttccacacgatgtggcacgttactaggggagccgtactgatgcatcgggggaaacgcatcgaacccagctgggcagatgtgaagaaagacctgatatcctacggcgggggctggaagttagagggagaatggaaggagggggaggaggtgcaagtccttgcgctcgaacccggaaagaatccccgggcggtgcaaaccaagcccgggatctttaagactaatacagggaccataggagccgtctcactcgacttctcccccggcaccagcgggagccctatcgtcgaccgcaagggaaaggtggtgggcctgtacggtaacggcgttgtgactagatcgggagcctacgtttccgctattgcacagacggagaagtccatcgaggacaaccctgagatcgaggacgatatattccgcaagaaacggttaactatcatggacctccaccccggggccggcaagacgaagagatacctgcccgccatcgtccgggaggccatcaagagagggctgcgcaccctcattctagccccgacgcgggtagtggcggccgaaatggaggaggccctgaggggactgcccattagataccagactacggccatcaagactgaacacacggggcgcgagatcgtcgacctcatgtgccacgccacctttaccatgcgcctgctgtctcctgtgcgcgttcccaactacaacttgatcatcatggacgaagcgcatttcaccgaccctgcctctatcgccgctcgtggctacattagtacgcgcgtcgagatgggcgaggccgcaggaatttttatgaccgcaacgccgccgggatctcgtgaccccttcccgcagagcaacgcccccatcatggacgaggagcgcgagattcccgaacggtcatggaactctgggcatgagtgggtgaccgactttaagggcaagacggtctggttcgtcccctccatcaaggccggcaacgatatcgctgcctgtttacggaaaaatggcaagaaggtgatacaactgagcagaaagaccttcgattcggagtacgtgaaaacccgggccaacgactgggactttgtcgtgaccacggacattagcgagatgggcgcgaacttcaaggccgagcgagtgatcgatcctcgccggtgtatgaagccggtaatcctcaccgacggtgaggagcgcgtgatactggcgggccctatgcccgtgacccatagtagcgccgcccagagacgcgggcggatcggacggaaccctaagaacgagaacgaccagtacatctacatgggggagcccttggagaatgacgaggactgcgcgcactggaaagaggccaagatgttgctggacaacatcaacacccccgaaggcatcatcccctccatgttcgagccggagcgggagaaggtcgatgcgatcgacggcgagtaccgactgcgcggggaggccaggaagacattcgtggaccttatgcgccggggcgacctgcccgtgtggctggcctataaggtcgccgccgaagggataaactacgcggaccgcaagtggtgcttcgatggcatcaagaacaaccagatcctagaggagaacatggaggtcgagatctggaccaaggagggtgaacgaaagaagctcaagccccgctggctggacgcccggatctactctgacccacttgccctgaaggagttcaaggagttcgccgccgggaggaagtccctgaccctcaacttgatcaccgagatggggcggttacccactttcatgacccagaaggcccgcaacgcgctcgacaacctggccgtgcttcacacagccgaggctgggggtcgggcctataaccacgcgctcagcgagctgcccgagaccctggagacgttgctcctgctcactttattagcaaccgtcaccgggggaattttcctctttctgatgtccggcaaggggatcggcaaaatgaccctggggatgtgctgtatcattacagccagcatcctcctgtggtacgcgcagatccagcctcattggatcgcggcctccatcatcttggagttcttcctcatcgtgctactgatcccggagccagagaaacagcgcactccccaagacaaccaactaacctacgttgtgatcgccatactgacggtggtcgcagcgacaatggccaacgaaatgggattcctggagaagacaaagaaggacctggggctgggctcgatcacaacccaggagagtgaaagtaacatcctcgacatcgaccttcggcccgcgtcggcttggacgctgtacgccgtggccactaccttcgtgaccccgatgctgaggcacagtatcgagaactcatccgtcaacgtgtccctcactgctatcgccaaccaggctacagtgctgatgggcttgggcaagggctggcccctctccaagatggacataggggttcccctcctggcaatcggttgttacagccaggtgaaccccatcaccttaaccgccgccttgctgctgctcgtagctcattacgccattatcgggccgggacttcaagcgaaggccacacgggaggcccagaaacgcgccgccgcgggcatcatgaaaaaccccacagtcgacgggatcaccgttatcgacctagagcctatcccatacgatccgaagttcgagaagcagctgggccaagtgatgctattaattctctgcgttacccaggtgctgatgatgcggacgacatgggccctctgcgaagccttaaccctggccaccgggcccatcagtacgttgtgggagggaaatcccggccgcttctggaacaccacaatcgcggtgagcatggcgaacatattccgcgggtcctacttggccggggccgggctcctgttttccataatgaaaaatacaacgaacacccgcaggggaacgggaaacataggcgagaccctcggcgagaagtggaagtccaggttgaacgccctgggcaagagcgagttccaaatctataagaagtccggcattcaggaggtcgaccgcacactggcgaaggaggggattaagcggggcgagaccgatcaccacgccgtcagccgagggtctgctaaactgaggtggttcgtggagagaaacatggtcacacccgagggtaaggtggttgatctcggctgcgggaggggcgggtggagctattactgcggcgggctgaagaacgtccgggaggtgaaaggcctgactaagggcgggccaggacacgaggagcccatccccatgtcgacctatggctggaacctcgtgcggcttcagagtggcgtcgacgtgttctttacgccgcccgaaaagtgcgacaccctcctgtgcgacatcggtgagagctcccccaaccctaccatcgaggccggccgtaccctgcgggtcctcaacctcgtggagaattggctgaacaacaacacccagttctgcatcaaagtgctgaacccatacatgccttccgttatagagaagatggaggccctccagcgcaagtacggcggcgcactcgtccgcaaccccctgagccgcaacagcacccacgagatgtattgggtttccaacgccactggcaatatcgtttcgtcggttaacatgatcagccggatgctgattaatcgcttcaccatgaaacacaagaaagccacgtatgagcccgacgtggacctcgggtccggcacccggaatatcgggatagaatcggaaatcccgaacctggacatcataggcaagcgcatagagaagatcaagcaggagcacgagacctcgtggcactacgatcaggaccacccgtacaagacctgggcctaccacggcagctatgagactaagcagaccggttcggcaagctcaatggtaaacggcgtcgtaagattactcaccaagccatgggacgtagtccccatggtgacgcagatggccatgacggacaccacaccgttcggacagcaacgggtgttcaaggagaaggtcgatacccgcactcaagagcccaaggaaggcaccaagaagttaatgaaaatcacggcggcctggctgtggaaggagctcggcaagaagaagacaccccggatgtgcactcgggaggagtttacccgtaaggtccgtagcaacgctgccctgggagctatcttcacggacgagaacaagtggaagtccgcccgggaagcagtggaggacggtcgcttctgggagctggtcgaccgggaacgcaacttgcaccttgaggggaagtgtgagacctgcgtgtacaacatgatgggcaagcgggagaagaagctgggggagttcggcaaggccaagggaagcagagccatttggtacatgtggttgggcgcccggtttcttgagttcgaggcgctgggattcctaaacgaggaccactggtttagtaggggcaacagcctgagtggcgttgaaggagagggcctgcaccggctcggctatatacttcgcgatgtcgggaagaaagaaggaggggccatgtacgccgatgacaccgcgggttgggacaccagaataacactggaggatctcaagaacgaggagatggtgaccaatcacatgaagggtgagcacaagaagctggccgaggccatcttcaaacttacgtaccagaacaaggtcgtacgcgtgcaacggcccacgccgcgcggaacggtaatggacattatctccaggcgcgaccagcgcggcagcgggcaggtcggtacctatgggctcaacaccttcactaacatggaggcgcaactgattcggcagatggaaggcgaggggatctttaagtccatccagcacctgactgccacagaggagatcgcggttcagaactggttagcgcgcgtcggtcgggaaagactgagccggatggcaatctcgggcgacgactgtgtggtgaagccaatcgacgaccgcttcgccagcgccctgacggcgctaaacgatatggggaaggtccggaaagacatacaacaatgggagccgtcccgcggctggaacgattggacccaagtacccttctgcagccaccacttccacgagctcgtcatgaaggacgggcgagtcctggtggtgccatgccgcaaccaggacgagctcatcggtcgggcacgaatctcccagggagccgggtggagcttaaaggagaccgcctgcctggggaagtcctacgcccagatgtggaccctcatgtactttcaccggagagacctgcggttagctgccaatgccatctgcagcgccgtcccttcccattgggtcccaacctcacgtaccacctggtccatccatgcgaagcacgagtggatgaccacagaggacatgctagccgtgtggaaccgggtctggatacaggagaacccctggatggaggacaagacgccggtagagagctgggaagaggtgccctatctggggaaaagagaagaccagtggtgtgggtccctgatcgggctaaccagccgggccacgtgggccaaaaacattcagacggcgataaatcaagtccgcagcttaatcggtaacgaggaatacacggactacatgccaagcatgaagagattccgtcgcgaggaggaggaggcgggcgtcctgtggtga

SEQ ID NO: 25099 - RNA, 9876 nt, synthetic construct
  misc_feature 1..9876: note = derived and/or modified CDS sequence (opt11) from DENV-2__EU482634__SS-prME
  source 1..9876: mol_type = other RNA
accgcgggggttattgtcatgttgatacccaccgcaatggcgtttcacttgactacccgaaatggagaaccccatatgatcgtgggccggcaggagaaggggaagtccctgctgtttaaaacggaggacggcgtcaacatgtgcacccttatggcaatcgacctgggggagctgtgtgaggacaccataacctacaagtgccccctactgcgccagaacgagcctgaggacatagactgctggtgcaactcgaccagcacctgggtcacttacggtacctgcaccacaacgggcgagcaccggcgcgagaagcggagcgtagccctggtgccccacgtcgggatgggcttagagacccgcacggagacctggatgtctagtgaaggggcgtggaaacatgtccagcggatagagacttggatcctgcgccaccccggctttaccatcatggccgccatcttagcctacaccatcggcacaacacacttccaacgggccttaatattcattttgctgaccgccgtagcgccgagcatgacgatgcgctgcatcggcatcagcaatcgggactttgtcgaaggagtgtccgggggatcatgggttgatatcgtactcgagcacgggagttgtgtgaccacgatggccaagaacaagccaactctcgacttcgaactgattaaaaccgaggcgaagcagcccgccacccttcgcaagtactgcatcgaggccaaactgacaaacactaccaccgagtccaggtgtccgacgcaaggcgagcccagcctgaatgaagaacaagacaagcgttttatctgcaagcactccatggtagaccggggctgggggaacggctgcgggctgttcggcaagggcgggatcgtaacctgcgcgatgttcacgtgcaagaagaatatggaaggcaaagttgtgcaacctgagaatctggaatataccatcgttatcactccccacagcggggaggagcacgctgtgggcaacgacaccgggaagcatggcaaggagatcaagataaccccgcaatcctcaatcacagaggccgagttaacaggatacgggacagtgaccatggagtgcagtcctcggacgggcctcgacttcaacgaaatggtactgctgcagatggaggataaggcgtggctcgtgcaccggcagtggttcttagacctgcccctcccctggctgccgggggccgacacccaaggcagtaactggatacagaaagagacgcttgttaccttcaagaacccccacgcgaagaaacaggacgtcgtggtcctcgggtcccaggagggcgccatgcacaccgccctgaccggggcgacggagatccagatgagctctggcaaccttctgttcaccggccacctgaagtgcagactgcgcatggacaagctccagctaaagggcatgtcctacagcatgtgcaccggcaagttcaaaatcgtgaaggagatcgcagagacccagcatgggacgatcgtaatcagggtccagtatgagggcgacggttcaccctgcaagatccccttcgagatcaccgacctggagaagcggcacgtgctcgggcgccttatcacggtgaacccgatcgtgaccgagaaggacagcccagtaaacatcgaagcggaaccccctttcggagattcctacatcatcattggggtggaaccgggccagttaaaactcaactggttcaagaaggggagctccatcggacaaatgttcgagacgaccatgcgcggagccaagcggatggcaatcctgggggacaccgcctgggacttcggctcactcgggggcgtatttacctccattgggaaagcactccaccaggtgtttggcgcaatctacggcgctgccttcagcggggtgtcttggacgatgaagatcttaatcggcgtcatcatcacttggatcgggatgaacagccgctctacgagcctgtccgttagtctggtgctcgtcggcgtcgtgacgctgtaccttggggccatggtccaggcggactccggatgcgtggtgagctggaagaacaaggagctgaagtgtggcagtggaattttcattacggacaacgtccacacctggacagagcagtacaagtttcagccagagagccccagcaaactggcctccgccatccagaaggcccatgaggagggcatttgcgggatccggagcgttacgaggctggagaatctcatgtggaagcaaatcacgcccgagctgaaccatatactggccgagaatgaggtgaaacttactatcatgacaggtgacatcaaggggatcatgcaagcgggcaagcggtccctgcgcccgcagcccacagagttaaaatacagctggaagacgtggggaaaggctaagatgctctcaacggaaagccacaaccagactttcctgatcgacgggcccgaaacagctgagtgcccgaacacgaacagggcttggaactccctggaagtcgaggattatggtttcggggtgttcaccaccaacatctggctcaagctgcgcgaaaagcaggacgtgttctgcgacagcaagttaatgtccgcggcgatcaaggataaccgggccgtccacgccgacatgggctactggatcgaaagcgccctcaacgacacctggaagatggagaaggcctctttcatcgaggtcaagagctgtcattggcccaagtcccacaccctgtggagcaacggcgtgctggagtcggaaatgataatcccgaagaacttcgccggccctgtgagccagcacaactaccgcccgggttaccacacgcagacggctgggccctggcacttaggcaagctggagatggatttcgacttatgcgaggggaccacggtcgtggtcacggaagactgcggtaatcgaggcccatctctccgcaccaccacggcctccgggaagctgataacggagtggtgctgccggtcttgcaccctgcccccgctcagataccggggcgaggacgggtgctggtacggcatggagattcgacccctgaaggagaaggaggagaacctggtcaactccctcgtgaccgccgggcatggccagatcgataacttcagcctgggggtcctggggatggcactgttcttagaggagatgctgagaactcgcatcggtacgaagcacgccatcctcctcgtcgccgtgtccttcgtgaccctgatcaccggaaacatgtcgtttcgggacctcggcagagtgatggttatggtcggggccaccatgacggacgacatcggcatgggcgtgacctatctcgccctgctcgcggcctttaaggtgcgcccaaccttcgcggccgggctgctcctccggaagctgacctcgaaggagctgatgatggccacgatcggcatagcgctcctgagccaatccaccatccccgagaccatcctggagttaaccgacgcattagccctggggatgatggtcctaaagatcgttagaaacatggagaagtaccagctggccgtgacgatcatggcgatcagctgcgtcccgaacgcggtgatcctgcaaaatgcctggaaggtcagttgcaccatcctcgccgctgtcagcgtaagcccattgctactcaccagctcccaacagaaggcggactggatccccctggcgttgacgatcaagggcctaaaccccacggccatctttctgaccacattgagccggactaataagaaacgctcctggccactgaacgaagccataatggccgtcggcatggtgagcatcctggcatccagcctgctcaagaacgatataccaatgacgggacccctggtggccggcgggctgctcacagtctgctacgtgctgaccggccggagtgcagacctggagctcgagcgcgcggccgacgtgaagtgggaggaccaggctgagattagcgggagctccccgattctgtctatcacgatctcagaagacggcagcatgtccatcaagaacgaagaggaggagcagaccctgacgatcctcattcggaccggtctcctggtcatctcaggcgtgttcccagtgtccatccccatcaccgccgctgcgtggtacctgtgggaggtaaagaagcagcgagcgggagtgctgtgggacgtgccctccccgccgccggtcgagaaggctgagctggaagacggggcatatcggattaagcagcgcggtatcctcgggtattcccagataggcgctggcgtttataaggagggaaccttccacaccatgtggcacgtgacccggggcgccgtactgatgcaccgtggcaagagaatcgagcccagctgggccgacgtgaaaaaggacctgatctcttacggcgggggctggaagctcgaaggggagtggaaagagggggaggaagtgcaggtcctggcgctggagcccggcaagaacccccgcgccgtacagactaagcccgggatcttcaaaaccaatactggcaccattggtgccgtgagcctcgatttctctccaggcaccagcggatcccctatcgttgatcggaagggcaaagtggtgggcctgtacgggaacggggtcgtgacccggagcggcgcttatgtctccgcgattgctcagactgagaaaagcatcgaagataaccctgaaatcgaggatgacatattcaggaaaaagcgcttaaccattatggacttgcaccccggggccggaaagacaaagcggtacctacccgctatagtgcgcgaggccatcaagagaggcctgcgcaccctgatcctggcgccgacgcgcgtggtggcagcggagatggaggaggccctgcggggcctgcccatacgctaccagacgccggccattaaaaccgagcacacagggcgggagatcgtcgacctcatgtgccacgcgacgttcaccatgcgcctgctgtccccggtgcgggttccaaactacaacctaatcatcatggacgaggctcatttcactgaccccgccagtatcgcagcccgcggctatatcagtacacgggtcgaaatgggcgaggcggccggtatattcatgactgccacgcccccaggcagtcgggatccgttcccccagtctaacgcccccatcatggacgaggaacgggaaatccccgagcgctcctggaactccggacacgagtgggtgactgattttaagggcaagaccgtatggttcgtcccgtccatcaaggcagggaacgacatcgctgcctgtctgcgaaagaatggcaagaaggtaatccagttgagtcgcaagacgttcgattccgagtacgtgaaaacgcgtgccaacgattgggatttcgtcgtgacaactgatatcagtgaaatgggcgctaacttcaaggcggagcgcgtgattgacccaaggcgttgcatgaagcccgtcatccttacagacggggaggagagggtaatcctagccggccccatgcctgtgacccactccagcgccgcgcagcgccgggggcgcatcggccgcaaccctaaaaacgagaacgaccagtacatctatatgggcgagcccctggaaaacgacgaggactgcgcgcactggaaggaggctaagatgctgctggacaacatcaacacccccgagggtatcatcccgtcgatgtttgagcccgagcgggagaaggtcgatgccatcgacggcgagtaccgcctgcgcggtgaggcacgcaagaccttcgtggacctcatgcggcgcggtgacctgcccgtgtggctggcctacaaggtcgcagctgaagggatcaactacgccgaccgcaagtggtgctttgacggtatcaagaataaccagatactcgaggagaatatggaggtggagatctggacgaaggagggggagcgtaaaaagctgaagccgcggtggctggacgcccgcatttacagcgaccccctggccctcaaggagttcaaggagttcgcggccggccggaagtcactcacattaaacctgattaccgagatgggtcgcctgcccaccttcatgacgcagaaggcccgaaacgctctcgacaacctggcagtcctgcacaccgcggaggccgggggtcgcgcctacaatcacgccctcagcgagctgcccgagacactggaaaccctcctgctgctcaccctgttggccaccgtcaccggcggcatctttctcttcctgatgtccggcaaggggatcggcaaaatgaccctggggatgtgttgcataattaccgcgagcattctcttatggtacgcccagatccagccccactggattgccgccagtatcatcctggagtttttcttaatcgtgctgctgatccccgagcccgaaaagcaacggacgcctcaggacaaccagttaacctacgtcgtgatcgcaatcctgaccgtcgtcgcggccacaatggcgaacgaaatgggtttcctcgagaagacgaagaaggacttagggctcggctcgataactacccaggaatccgagtcgaacatactagacatagacctccgcccggcaagtgcctggacgctgtacgctgtggccacgacatttgtgacccccatgctgaggcatagtatcgagaacagctccgtcaacgtaagcctgacggccatcgccaaccaggcgactgttctgatgggcctggggaaagggtggcccctctccaaaatggacataggtgtgccgctactggccatcggttgctacagccaggttaacccgatcacactcaccgccgccttgctgctcctggtagcccactacgctatcatcgggccaggcctgcaggccaaggccacccgcgaagcccagaagcgcgccgcagcaggcatcatgaagaaccccacggtcgacggtatcactgtgatcgacttggagcccattccgtacgaccccaagttcgagaaacagctcggacaggtgatgctgctgatcctttgtgtcacccaggttctgatgatgcgcacgacttgggccctctgcgaggccctaactctggccaccgggcccatctccaccctctgggaggggaaccccggccgattttggaacacgaccatcgctgtgagcatggccaatatcttcagaggttcctacctggccggggccgggctcctcttcagcatcatgaagaacacgacctccacgcgcagagggacaggcaatatcggcgagaccctcggcgagaagtggaaaagccgcctgaacgcgctcgggaagtccgagtttcagatctacaagaagtccggtatccaggaggtagaccgtaccctggccaaagagggaataaagcgcggcgagacggaccaccatgcggtgagccgggggagcgccaagctgcgctggttcgtggagcggaacatggtcacgccggagggcaaagtggtggacctcggttgcgggcgcggcgggtggtcctactactgcggcgggctgaagaatgtccgggaggtgaagggattgaccaagggcgggcccggccacgaggaacccatacccatgagcacctacggttggaatctagtgcgcctgcagagcggcgtcgacgtgtttttcacgccgcccgagaagtgcgacaccctgctctgcgatatcggggagagcagccccaaccccaccatcgaggcgggccggaccttacgcgtgctaaacctcgtcgagaattggctgaacaacaacaccaaattctgcatcaaggtgctgaacccctatatgccctccgtgatcgagaaaatggaagctctccagagaaaatacggcggggccctggtccgcaaccccttaagccggaactccacgcacgagatgtattgggttagcaatgccaccgggaacatcgtgtcctcggtcaatatgatctcccggatgctgatcaaccggtttaccatgaagcacaaaaaggccacctacgagccggacgtggacctcgggtccggcacgagaaacatcggaatcgagtccgagatcccaaacctggacataatcggaaagcggatcgagaagatcaagcaagagcacgagaccagctggcactacgaccaagaccacccttacaagacctgggcataccatggctcctacgagaccaaacagacggggagcgcgtccagcatggtgaacggtgtcgtgcgcttgttaaccaagccctgggatgtggtcccgatggtgacccagatggccatgaccgacacgaccccgttcgggcagcagcgcgtgttcaaggagaaggtggacacccggacgcaggagcccaaggagggtacgaagaagctgatgaagatcacagctgagtggttgtggaaggagctggggaagaaaaagacgcctcgcatgtgcaccagagaggagttcacgcgaaaagttcggagtaacgccgctctgggggcgattttcaccgacgagaacaagtggaagtcagctcgcgaagcggttgaagacggccgattttgggagctggtcgaccgcgaacggaatcttcacctggaggggaagtgcgagacctgcgtgtacaacatgatgggcaaacgcgagaagaagctaggtgagttcggaaaggccaaaggctctcgggcgatctggtacatgtggctcggggcccgcttcctggagttcgaggccctgggcttcctgaacgaggaccattggttctcgagaggcaactccttgagcggcgtggagggtgagggcctgcaccgcctcggctacatcttgagggacgtcagcaagaaagagggcggcgccatgtacgccgatgacaccgcggggtgggacacccgcatcaccctggaagacctcaaaaacgaagaaatggtgaccaaccacatgaagggcgagcacaagaagttagccgaggccatctttaaactcacctaccaaaacaaggtcgtccgcgttcagcgcccgacgccccgggggaccgtcatggacatcatatccaggagggaccagcgcggttcgggccaagtgggcacatacggcctcaacaccttcacgaatatggaagcccagctgatacgccaaatggagggtgaaggcatcttcaagtctatacagcacctgaccgccaccgaggaaattgtcgtccagaactggctggcgcgggtgggccgcgagaggctgagccgcatggccatttccggggacgattgcgtggtcaagcccatagacgaccgcttcgctagcgccctgaccgctctcaatgacatggggaaggtgcgcaaggacatccagcagtgggagcctagtcgggggtggaacgactggacccaggtcccattctgcagccaccacttccacgagctagtcatgaaagacgggcgggtgctggtagtcccctgccggaaccaggacgagctcatcgggcgcgctcggatatctcagggcgcaggctggagcctcaaggagaccgcttgcctggggaagtcctacgcacagatgtggaccctcatgtatttccatcgccgggacttgcgtttagccgccaacgccatctgcagcgccgtgccctcccactgggtgcccaccagccggaccacgtggtctatccacgcgaaacacgaatggatgaccaccgaggacatgctcgccgtctggaaccgcgtgtggatccaggagaacccgtggatggaggacaagacccccgtggagtcctgggaggaggtcccctaccttgggaagcgggaagaccagtggtgcgggtctctgatcgggctcacgagccgcgcgacctgggccaagaacatccagaccgcgatcaaccaggtgcggagcctgatcgggaacgaggagtacaccgactacatgccttccatgaagcgcttccgccgggaggaggaggaggccggcgtcttgtggtaa

SEQ ID NO: 25100 - RNA, 9876 nt, synthetic construct
  misc_feature 1..9876: note = derived and/or modified CDS sequence (opt11) from DENV-2__EU482635__SS-prME
  source 1..9876: mol_type = other RNA
accgcgggcgttattgtcatgctgatcccaaccgccatggctttccatctaaccacccgcaacggtgagcctcacatgatcgtgggtcgtcaagagaaaggaaagtccctgcttttcaaaaccgaggatggcgtcaacatgtgtacgctcatggctatcgacctgggggagctgtgcgaggataccatcacctacaagtgccctctcctgcgccagaacgagccagaggatatcgactgttggtgcaactcaaccagcacctgggtaacatatgggacctgcaccacaacgggcgaacatcgccgcgagaagcggagtgtggctctagtaccccacgtcgggatgggcctcgagacccgcactgagacctggatgagctcggaaggcgcctggaagcacgtgcagcggatcgagacctggatcctgagacacccgggcttcacaatcatggccgcgatcctggcctacactatcggcactacccacttccagcgcgccctcattttcatcctgctgaccgccgttgcccccagtatgaccatgagatgcatcggcatctcaaatcgggatttcgtagagggtgtcagtggtggctcctgggtcgatatagtcctcgaacacgggagctgcgtgaccaccatggccaagaataagcccacactggatttcgagcttatcaagaccgaagctaagcagcccgcaaccctcaggaagtactgcattgaggccaaacttacgaacaccaccaccgaatccaggtgtccgactcagggcgagccaagcctgtcggaagagcaggacaagcggttcatctgcaaacattcgatggtggaccggggctgggggaacggatgcgggctgtttggcaaaggcggaatagttacatgcgcaatgttcacgtgcaagaagaacatggagggaaaggtggtccagcccgagaatctggagtacaccatagtcataactccccactccggagaggaacacgccgtgggcaacgataccgggaagcacgggaaagagattaaaatcacgccgcagtcatcaataacagaggccgagctaaccgggtacggcacggttaccatggagtgtagcccccggacgggactcgacttcaatgagatggtcctgctgcagatggaggacaaggcgtggctcgttcaccggcaatggtttctggacctgcccctcccttggttgccaggggccgatacccagggttccaactggatccagaaagaaaccctggtcactttcaagaatccccatgcaaaaaagcaggacgtagtagttttgggtagccaagagggcgccatgcacactgccctgaccggggctacggagattcaaatgagctccggcaacctcctgtttaccggccacctgaagtgccgactccggatggataagctccagcttaaggggatgagctactccatgtgtactggaaagttcaagatcgtgaaggagatagcagagacccagcacggaaccatagtgatccgggtccaatacgagggcgacggtagcccctgtaagatacccttcgagatcaccgacctagaaaaacggcacgtcctcggtcggctgatcaccgtgaaccctatcgtaaccgagaaagactccccagtcaatatcgaggcagagccgcccttcggcgactcttacatcatcatcggggtggaaccggggcaactgaagttaaactggttcaaaaaggggtccagcataggccagatgttcgagacgaccatgcgcggcgctaagcggatggcgatcttaggggacaccgcctgggacttcggaagcctgggtggtgtgttcacttcaataggtaaggcgctccaccaggtatttggggcgatctacggggccgccttctccggtgtttcatggacgatgaagatcctgatcggcgtcatcataacatggatcgggatgaactcccgcagcacatccctcagtgtatcacttgtgttagtgggcgtggtaactctgtacctgggcgccatggttcaagcggactcggggtgcgttgtgtcctggaagaacaaagagctcaaatgtggcagcgggatcttcattactgataacgtccacacctggaccgaacagtacaaattccagcccgagagcccttccaaattggccagcgccattcagaaagcccatgaggaaggcatctgcggcatccggtctgtcacgcgcctggaaaatttgatgtggaaacagatcacaccggagctgaaccacatcctgtcggagaatgaagttaagctaaccatcatgaccggcgacattagagggatcatgcaggcaggtaagagatcactgcggccgcagcccactgaacttaagtacagctggaagacctggggaaaggcgaagatgctttccaccgaaagtcacaaccagaccttcttgattgatgggccagagaccgccgagtgtccgaatacaaaccgcgcatggaactccctggaggttgaagactacgggttcggggtgttcaccacaaacatctggttaaagctgcgggagaaacaggatgtattctgcgactctaaactgatgtccgctgccatcaaggacaatcgcgcggtccacgccgacatggggtactggattgagtcggcccttaatgacacgtggaaaatggaaaaggctagcttcatcgaagttaagagttgccactggccgaagagccacaccctctggtctaatggcgtgctggagtccgaaatgatcatacccaagaacttcgccggaccagtcagccagcacaattaccggcctggctaccacacgcaaaccgctgggccgtggcacctgggcaagcttgagatggacttcgacctatgcgaggggaccaccgttgtcgtaacagaagactgcggcaacaggggcccgagcctccgcaccaccaccgcctctggtaaattgatcacggaatggtgctgccgatcctgcaccctccctccgctcagatatcgcggggaggacgggtgttggtatggaatggagatccgacccctgaaggagaaggaggagaacctggtgaactcactagtgacagcaggtcatggacagatcgacaacttcagcctgggcgtgctgggcatggccctcttcctggaagagatgctgaggacacgtatcggcactaagcacgccatcctcctagtggcagtgtcctttgttacactaatcactgggaacatgtcgttccgcgatctcggccgcgtcatggtgatggtaggggccacaatgacagacgacatcggcatgggtgtcacctacctggccctgttagccgcgttcaaggttcgccccaccttcgcagccggattgctcctccgaaaactgacatcaaaggagctgatgatggccactatcgggatagcgctcctgagccagtccaccatccccgaaaccatcctggagcttacagacgcgctggcactagggatgatggtactcaagatcgtgcggaacatggagaagtaccagctggcggtgactatcatggcgatctcgtgcgtaccgaacgccgtgattctccagaacgcgtggaaggtgtcctgtaccatactcgccgcagtcagcgtttcccctctcctcctcaccagctcccagcagaaagcggactggattcccttagccctgactatcaagggcctcaaccccacggccatttttctgaccaccctgtcacgcacttctaaaaagcggtcctggccactcaatgaggccataatggcggtcggcatggtgagcatcctggctagcagcctcctcaagaatgacatccccatgacagggcccctggtggcgggcgggctcctcaccgtttgctatgtgctgaccggccgctccgcagatctagagctagagcgggccgccgatgtgaagtgggaggatcaggccgaaatcagcgggtcgtcaccaatcctgtccattaccatctctgaggacggcagtatgagcattaagaacgaggaggaggaacaaactctaaccattctcatcagaacgggcctgctagtcatctccggggtgtttccggtgagcatccccataaccgcggcagcctggtacttatgggaggtaaagaagcagagggccggtgtgttatgggatgtgcctagcccaccgccagttgagaaagctgagttggaggacggagcgtataggataaagcaacgagggatcctcgggtacagccagataggcgccggcgtctacaaggaggggacctttcacacgatgtggcacgtgacccgaggggccgttctcatgcaccgtgggaagcgaatcgagccctcctgggcggacgttaagaaggaccttattagttatggagggggttggaaactcgaaggcgagtggaaagaaggggaagaggtgcaggtgctggcacttgagcccggtaagaatccccgagcggttcaaactaagcccggaatattcaagaccaacactgggacaatcggggccgtctccctcgattttagcccgggcacctcgggaagccccattgtcgacagaaaggggaaggtagtagggctctatgggaatggcgttgtgacccggtccggcgcctacgtatccgctattgcgcagacagaaaagtccatcgaggacaaccctgagatagaggacgacatcttccgcaagaagcggctgaccatcatggacctccaccctggggcaggcaagaccaagcgctacctgccagccatagttcgggaggctatcaaacgtgggctacgcaccctgatactcgcacctacgcgggtcgtggcggctgagatggaagaggccctgcgcggcctaccgatccggtaccaaacgaccgccattaagaccgagcacaccgggcgcgagatcgtagatctaatgtgtcatgccacatttaccatgaggttattgtcaccagtgcgtgtccccaactacaacttaataattatggacgaggctcatttcaccgaccctgcgagcatcgccgccagaggttacattagcacgcgcgtcgagatgggcgaggctgcgggaattttcatgaccgccacgccgccaggctcccgtgaccccttcccgcaatccaatgcccccatcatggacgaggagcgcgagatccccgagcggtcatggaacagcgggcacgaatgggttacagacttcaagggcaaaacggtttggttcgtgcctagcatcaaggccgggaatgacatcgcggcctgcctgcgtaagaacggcaagaaggtgatacagctgtcacgtaagaccttcgactctgaatatgtgaagacccgcgccaacgactgggatttcgttgtgactacagacatatccgagatgggcgcaaacttcaaggctgaacgggtcatcgacccccgccggtgcatgaagcccgtcatcctgaccgacggagaggagcgcgtgatactggcgggccccatgcccgtgacacacagtagtgcagcccagcggcgcgggcgcatcggtcggaatcccaagaatgagaatgatcagtacatctatatgggggagccactcgagaacgacgaagattgcgcccactggaaggaggcaaagatgctcctggataatatcaacactccggaggggatcatcccctcgatgtttgagcctgagcgcgagaaggtcgacgcgatagacggcgaataccggctaaggggggaggctcggaaaacgtttgtggatctcatgagacggggcgacctgcctgtatggctggcgtacaaggtcgctgccgaggggatcaattacgcggaccgcaaatggtgtttcgatggcattaagaataaccagatcctcgaagaaaacatggaagtggagatctggaccaaggagggagaaagaaagaagctaaaacccagatggttagacgcccgtatatactcagatccgttagcccttaaggagttcaaggaattcgccgctggccgcaagtcgctgacccttaatctgatcaccgaaatgggacgcttgcccacctttatgactcagaaggctcgcaacgccctcgataacttggctgtgctgcacactgccgaggcaggcgggcgggcgtataaccacgccttgtccgagctgcccgagacacttgagacacttctgctgttgaccttattagctacagtcacaggcggcattttcttattcctgatgagtgggaagggaatcggcaaaatgaccctgggtatgtgctgtataatcaccgccagtatcttgctgtggtacgcacaaatccagcctcactggatcgctgcgagtataatcttggagtttttcctgatcgttctgctgatcccggagcccgagaaacagcggacgccccaggacaaccagctcacctacgtcgtgatcgcaatattaactgtggtcgcagcaaccatggccaacgagatgggcttcttagagaaaacgaagaaagacctcgggctgggcagcatcacgacccaagaatcagaaagcaatatacttgacatagaccttcgtcccgcctcggcctggacactatatgccgtggcgaccaccttcgtgaccccgatgctgcgacattcgattgagaactccagcgtcaacgtgtccctcaccgccatcgccaaccaggccactgtgctgatgggcttagggaaagggtggcccctttccaagatggacattggagtccccctgctggcgatagggtgctactctcaagtcaaccccatcaccctcaccgccgccttgctgctcctggtcgcacactacgcaatcatcgggccaggcctgcaagcgaaagctacgagagaggctcagaagcgcgccgccgcgggaatcatgaagaacccaaccgtcgacgggataaccgtgatcgacctcgaacccatcccctacgacccgaagttcgagaagcaactgggccaggtgatgcttcttatcctctgcgtcacccaggttctgatgatgcggacgacctgggccctgtgcgaggcactgaccctggccacaggacccatctccacactatgggagggcaaccccgggcgcttctggaacaccaccatcgccgtgtcgatggcaaacatcttccgcggcagctatctggccggcgccgggttgctgttctcgatcatgaagaacacaacgagcacccggcgcggcacggggaacatcggagagaccctcggcgagaagtggaagtcccggctgaacgcactcggtaagagcgagttccagatctacaagaagagtggcatccaggaagtggaccgcaccctggcgaaggagggaattaagcggggggagactgatcaccacgccgtgagccgtggctccgccaagctgcggtggttcgtagaaaggaacatggtcactccagaaggcaaggtggtggatctcggctgcgggcggggcgggtggagctactactgcggcggacttaagaacgtccgcgaggtgaagggcctgactaagggcggaccgggacacgaagagcccattcccatgagcacgtacgggtggaacctcgtgaggctacagtccggcgttgacgtcttcttcacgccgcccgagaagtgcgacaccctgctttgcgacatcggcgagagctcccccaatcctaccatcgaggccggccggaccctgcgtgtgttgaacctcgtagagaattggctaaacaacaatacccaattctgcatcaaggtgctgaacccctacatgccctcggtgatcgagaaaatggaagccttgcagcgcaagtacggaggagcgctggtccggaatcctctttccagaaacagcacacacgaaatgtactgggtctccaacgcgacaggaaacatcgtgtcgtccgtcaacatgatcagcagaatgctgataaacaggtttaccatgaagcataagaaggccacctatgagccagacgtagacctcggttcaggaactcgcaacatcgggattgaaagcgagattccgaatctggacattatcggtaagcgaatcgagaagatcaaacaggagcacgagacgtcctggcactacgaccaggatcacccctacaagacgtgggcataccatgggagctacgagacgaagcagaccgggtccgctagctcaatggttaacggcgtcgtgcgcctgcttaccaagccctgggatgtggtccccatggtaacccaaatggcgatgacagacaccaccccgttcggtcaacagcgggtgttcaaggagaaagtcgacaccaggacgcaggagcccaaagagggcaccaagaagctgatgaagattaccgccgagtggctgtggaaggagttgggcaagaagaagacaccgcgtatgtgcacgcgagaggagttcacccggaaggtgagatccaacgccgctctgggggccatattcaccgacgaaaacaaatggaagtccgctcgggaggcggtggaggacggcaggttctgggagttagttgaccgggaacgaaatctccacttagagggcaaatgcgagacgtgcgtatacaatatgatggggaaacgggagaagaagctgggcgagttcggtaaggccaagggtagccgggccatctggtacatgtggctcggcgcgcgctttctggagttcgaggccctgggcttcctcaatgaggaccactggttcagccgcgggaattccttgagcggagtggaaggtgagggcctgcatcggctcgggtacatactgcgtgacgtgtccaagaaagagggcggcgcgatgtatgccgacgacacggcgggctgggatacccggatcacgctggaggatttgaagaacgaggagatggtgacgaaccatatgaagggcgagcacaagaagctggcggaggctatcttcaagctgacgtaccaaaacaaggttgtgcgcgttcagcggccgacgccgagggggaccgtaatggacatcatctcccggcgcgaccagcgcggctccggtcaggttgggacttatggcctcaacacgtttacaaacatggaggcacagcttatcaggcaaatggagggggagggaatcttcaaaagcattcagcacctgactgcgaccgaggagatcgcagtacagaactggctggcgcgcgtcggccgggaacgactttcccgtatggccatcagcggagacgactgtgtcgtgaagcccattgacgaccgattcgcgtccgccctcacagccctcaacgacatgggcaaggtgcgcaaagatatccagcaatgggagccaagtcgaggatggaatgactggacgcaggtcccattttgctcacaccacttccacgagctagtgatgaaggacggccgtgtcctcgtggtgccgtgccgcaaccaggatgagcttataggccgcgctagaatcagccagggcgcggggtggagcttgaaggagaccgcgtgcctgggcaagagctatgcccagatgtggacccttatgtacttccaccgacgcgacctgcgactggccgctaacgcgatctgctcagccgtccccagccattgggttccgacctccagaacgacctggtcaatacacgctaagcacgagtggatgaccaccgaggacatgcttgcggtgtggaatcgagtctggatccaggagaacccctggatggaagacaaaacgcctgtggagagctgggaggaggtgccctacctgggcaaacgagaggaccagtggtgtggttccctgatcggcctcaccagccgggccacgtgggccaagaatatccagaccgccatcaaccaggtccggtctctgataggtaacgaggagtacacggactacatgcccagcatgaaacgcttccggcgcgaggaggaagaagccggggtgttgtggtga

SEQ ID NO: 25101 - RNA, 9876 nt, synthetic construct
  misc_feature 1..9876: note = derived and/or modified CDS sequence (opt11) from DENV-2__GQ199874__SS-prME
  source 1..9876: mol_type = other RNA
actgctggcgtgatcgtaatgctgatccccaccgctatggcgttccacctcaccacgcggaacggggagccgcacatgattgtggggcggcaggagaaggggaaatccctactgttcaagaccgaggacggcgtgaacatgtgcaccctcatggccatggacctgggagaactgtgtgaggacaccatcacctacaagtgccccttgttacgccaaaacgagcccgaagacatcgactgctggtgcaatagcactagcacctgggtcacctatgggacttgcaccaccacgggcgagcaccggagagaaaagcgctccgtggctctggtcccccacgttgggatgggcctcgagacccgtacagagacctggatgagctccgagggtgcgtggaagcatgtgcagcgtatcgagacctggatcctgcgccacccgggctttactatcatggccgcgatcttggcctacaccatcgggaccacccatttccagcgggctctaatcttcattctgctgacggccgtggcacctagcatgacaatgcgctgtatcggtatctcaaaccgggacttcgtggaaggggtgagcggcggctcctgggtggacatagtcctcgagcacggttcatgcgtgaccaccatggctaagaacaagcctaccctggacttcgagctgatcaaaaccgaggcgaagcagcccgccacacttcgcaagtactgcatcgaggccaagctgacgaacaccaccaccgagtcacggtgcccgactcagggcgagccctccctgaacgaagaacaggacaagcgcttcatctgcaagcattccatggtggaccggggctgggggaacggctgcggtctttttggcaagggcgggatcgtgacctgcgcgatgttcacgtgcaagaaaaacatggaggggaaagtagttcagcccgaaaacctggaatacaccatcgtcatcacgccccacagcggggaggaacatgccgtgggcaacgacaccgggaagcatggcaaggagatcaaaatcacaccgcagtccagcatcaccgaagccgagcttaccgggtacggcacggtgaccatggagtgcagcccccgtaccggcctcgacttcaacgaaatggtcctgctgcagatggaggacaaagcctggctcgtacaccggcaatggttcctggacctgcccctcccctggctaccgggggccgacactcagggcagcaactggatccagaaggagacgctggtaaccttcaagaatcctcacgcgaagaagcaggacgttgtcgttctcggcagccaggagggcgccatgcacacagcgctgaccggggccacggagatacaaatgtcttccggcaacctcctgttcaccggccatctgaagtgccgcttacggatggataaactccagctaaagggtatgtcgtactcgatgtgcaccggaaagttcaagatcgtgaaggagatcgccgagacccagcacggcacgatcgtgatacgcgtgcaatacgagggcgacggctccccctgcaaaattcccttcgaaatcacagacctggagaagaggcacgtcctcgggcgcctcataacagtgaatcctatcgtcaccgaaaaggactcgcccgtgaacatcgaggcggagccgcccttcggcgattcatacatcattatcggggtggagccgggccaattgaagttaaactggttcaaaaaggggagctccatcggccagatgttcgagactactatgcgcggcgccaagaggatggccatcctaggggataccgcgtgggacttcggcagccttgggggcgtcttcacctccatagggaaagccctccaccaggtgttcggcgcgatatacggcgccgccttcagcggggtgtcctggacgatgaaaatccttataggcgtcatcatcacgtggatcgggatgaactctcgctccaccagcctgtccgtgagcctggtgctcgtcggcgtggtgaccctgtatctgggcgccatggtacaggcggactcaggctgcgtggttagctggaaaaacaaggagctaaagtgcggctccgggatctttatcacggacaacgtccacacctggaccgaacagtacaagtttcagcccgagagcccctctaagctggcctccgccatccaaaaggcccatgaagaaggcatctgcgggatccgcagcgtgacccgcctggagaatcttatgtggaagcagatcacacccgagctgaaccatatcctttccgaaaacgaagtgaagctcaccattatgacgggagatatccgggggatcatgcaggccggcaagcgcagcctgcgaccccagcccactgagctgaaatactcctggaagacctgggggaaggcgaagatgcttagcaccgagtcgcataaccagactttcctgatcgacgggcccgaaacagccgagtgcccgaacacgaaccgcgcgtggaacagcctggaggttgaggactatgggttcggggtgtttaccactaatatctggctcaagctgcgggagaagcaagatgtgttctgcgactccaaactgatgagtgcagccatcaaggacaaccgcgcggtacacgcagacatgggctattggatcgagtccgccctcaacgatacctggaagatggagaaggcctccttcatcgaggtgaagtcctgccactggcccaagagtcacacgctgtggtccaacggcgtgctagaaagcgagatgatcataccgaagaacttcgccgggcccgtctcccagcacaactaccggccgggctaccatactcagaccgcggggccctggcacctcggcaagctggaaatggacttcgacctgtgcgagggtaccaccgttgtggtcaccgaagattgtggcaaccgtggaccgtccctccggaccaccaccgcttcagggaagctaatcacggagtggtgctgccggagctgcaccctgccgccgctccggtaccgcggcgaggacgggtgttggtatggtatggagatccggcccctgaaagagaaggaggagaatcttgtgaactccctcgtgaccgctgggcacggtcagattgacaatttcagcctgggcgtcctagggatggccctcttcctcgaggagatgctgcgcacacggatcggcacgaagcatgcgatcctcctagtggccgtatccttcgtgaccctgatcaccgggaacatgtccttccgtgatctggggcgagtcatggtaatggtcggggcaaccatgacggacgacatcggcatgggcgtgacctacctggccctacttgccgccttcaaagtgcggcctaccttcgccgctgggttattactccgcaagctgaccagcaaggagttaatgatggccacgatcggcatcgcacttctgtcccagtcaacgatccccgagactatcttggaacttacggacgcgctggccctgggaatgatggtcctaaagatcgtgaggaacatggagaagtatcagctggccgttacgatcatggccatctcgtgcgtcccaaacgccgtgatcttacagaatgcgtggaaggtgagctgcactattctcgccgccgtctctgtaagccccctgctgcttaccagcagccagcagaaagcagactggatccccctggcgctaactatcaagggcttgaacccgacagcaatcttcctcaccacactgagccgcaccagcaaaaagcgatcctggccgctcaacgaggccattatggccgtcggcatggtgtcgatcctggcctccagcctattaaagaacgacatccccatgaccggtcccctggtggcgggcggtctgctcacagtctgctacgtgctgaccggacgcagcgcggacctagagctcgagcgggccgccgacgtgaaatgggaggatcaggccgaaatcagtgggtcttcccccatcctgagtatcaccatatccgaagatggcagcatgtccatcaagaacgaggaggaagaacagacgctgaccatcctcatcaggaccggtctgctggtcatcagcggggtgttccccgtgtccatccccatcaccgcggccgcgtggtacctctgggaggtcaagaagcagcgggccggcgtgctgtgggacgttcccagtccaccgcccgtagagaaagccgagctcgaggacggggcctatcgcatcaagcagagaggaatcttagggtattcccagatcggcgccggcgtatacaaggaggggaccttccacacgatgtggcatgtgaccaggggcgccgttcttatgcaccgggggaagcgcatcgagcccagctgggcagacgtcaaaaaggacctaatctcctacggcgggggctggaagctcgaaggcgagtggaaagaaggggaggaggtgcaggtcttagccctggaacccggcaagaacccccgggcggtccaaacaaagcccggtatatttaagaccaacacgggcaccatcggggcagttagcttagacttctcccccggaacctctgggtcccccatcgtggaccgcaaggggaaggtcgtggggctatacgggaacggcgttgtaacccggtcaggcgcctacgtctccgccatcgcgcagacggaaaagtccatcgaggataaccccgaaatcgaggacgacatcttccgcaagaaacggctgactatcatggacctccatcccggtgccggtaagacaaagcgctacctgcccgccattgtgagggaggcgatcaagcgcgggttgcgcaccctgatcttagccccgacgcgggtggtggccgccgagatggaggaggccctccgcgggctgcccatccggtaccagaccaccgccatcaagaccgagcacacgggacgcgagatcgtcgacctcatgtgccacgccacctttaccatgagactgctgagccccgtgagagtgccgaactataaccttatcataatggacgaggcgcacttcacggatcctgcttccatcgcggcccggggatacatcagcacgcgcgtcgagatgggcgaggcagcgggtatcttcatgaccgccaccccgcccggttcccgggaccccttcccacagagcaacgcccccatcatggacgaggaacgcgagatcccggaaaggtcgtggaactcagggcacgagtgggtcaccgactttaagggcaagacggtatggttcgtcccctccatcaaggctgggaacgacatcgcggcctgtctgcgcaagaacggcaagaaagtgatccaactgtcgcggaagaccttcgactcggagtacgtgaagacccgcgcaaacgactgggacttcgtcgtaaccacagacatcagcgagatgggggccaacttcaaggccgagcgggtgatcgatccgcggcggtgcatgaaacccgtcatcttgacggatggggaggagcgagtgatactagcggggcccatgcccgtgacccactccagcgctgcccagcggcgcggtcgtatcggtcggaatccgaagaacgagaacgaccagtacatctacatgggggaacccctggagaacgacgaggactgtgcccactggaaggaagccaagatgttgcttgacaacatcaacacacctgagggcattatcccctccatgttcgaaccggagagggagaaggtcgacgccatcgatggcgagtaccggctaagaggtgaggcgcggaagactttcgtggacctcatgcgccggggtgacctgcccgtgtggctcgcatacaaggtcgccgccgaggggattaattacgctgatcggaagtggtgcttcgatgggatcaagaacaaccaaatcctcgaggagaacatggaagtggaaatctggactaaagagggggagcggaagaaacttaagcccagatggctggacgcgaggatctacagcgatccgctcgccctgaaagagtttaaggagttcgccgcgggccgaaagtcactgacccttaacctgatcaccgagatgggccggctgccaacgttcatgacccaaaaagcacgcaacgctctagacaacctggcggtgttacacaccgctgaggccgggggccgcgcctacaaccacgcgctaagcgaactacccgagacccttgagacgttactgctactcacactgctggccaccgtcaccggcggcatcttcttgttcctgatgtctggcaaagggatcggcaagatgaccctggggatgtgctgcataatcacagccagcatcctcctgtggtacgcgcaaatccagccgcactggattgccgcctccataatcttggagttctttctcatcgtgctgcttataccggagcccgaaaaacagcgcacgccccaggacaaccagcttacctatgtcgtgatcgccatcctgaccgtggtcgccgcgacgatggcgaacgagatgggcttcttggagaagaccaagaaagacctcgggctgggatcaattaccacccaggagtccgagtccaacatccttgacattgacctccgacccgccagcgcatggacgctatacgccgtcgcgaccactttcgtgaccccgatgctgcggcactccatcgaaaacagctccgtcaatgtgtctttgacggccatcgccaaccaggcaaccgtgttgatgggcttgggaaagggctggcccctctccaagatggacattggggtacccttactggcgatcggctgctatagccaggtgaaccccatcaccctcacggccgcactgctcctcctggtggcccactacgccatcatcgggccgggcttacaggcgaaggccacgcgggaggcccagaagcgtgccgccgcaggaatcatgaagaaccccacggtcgacggcatcactgtgatcgacctcgagcccattccttacgacccgaaattcgagaagcagctgggtcaagtgatgctgctcatcctgtgcgtcacccaggtgctgatgatgcggacgacttgggcgctctgcgaagcactcaccctagccacggggccgatcagcacgctatgggagggcaaccccgggcgcttctggaacaccaccatcgccgtgagcatggcgaacatattccgcggctcctacctggctggcgccgggctcttattctccataatgaagaacaccacgaatacccggcgtgggaccgggaacattggcgagactcttggagagaaatggaagtcccggctcaatgcactcggcaagagcgagttccagatctacaagaagtccggcatccaggaggtagaccgcacgctggcgaaggaggggatcaagcggggcgagaccgaccatcacgccgtaagccgcgggtccgccaagctgcggtggttcgtggagcgcaacatggtcacgcccgagggtaaagtggtggacctcggctgcgggcgtggagggtggagctattactgtggcggtctgaagaacgttcgcgaggtgaaggggttaaccaagggtgggcccggccacgaggaacccatacctatgtccacttacgggtggaacctcgtgcggttacagagcggcgtcgatgtattctttacgccacccgagaagtgtgacactctgctctgcgacatcggggaaagctcccccaaccccaccatcgaggcgggcaggaccctgcgggtgctgaacctcgttgaaaactggctcaacaacaacactcagttctgcatcaaggtgttaaacccctacatgccgagcgtaattgagaagatggaggccctccagcgcaaatacggcggggcgctggtgcgcaaccccctgtcgcgcaacagcacccacgaaatgtattgggtgtccaatgccaccggcaatatagtcagctcagtcaacatgatcagccgaatgctgatcaacagattcacgatgaaacacaagaaggcgacgtacgagccggacgtggacctcgggtcgggcacccgaaacatcggaatcgagagcgagatcccgaacctcgacattatcgggaagcgcattgaaaagatcaagcaagaacacgaaacctcttggcactatgaccaggaccacccgtataagacctgggcctaccacggatcgtacgaaacgaagcagaccgggtccgccagctccatggtgaacggggtcgtgagacttttgaccaagccctgggacgtggtccccatggttactcagatggctatgacagatactactccattcggtcaacagcgagtattcaaagagaaggtggacacccgcacacaagagccgaaggaaggcactaaaaagctcatgaagatcactgccgagtggctgtggaaggagctaggaaagaagaagacaccccggatgtgcacgcgggaggaatttacccggaaggtgcggagcaacgccgcactgggcgccattttcacagacgagaataagtggaagtccgcccgggaggccgtggaggacggtcggttttgggagctggtagatcgggagagaaacctacacctggagggcaagtgcgagacctgcgtctacaacatgatgggcaagcgggaaaagaagctcggggagttcggaaaggccaagggcagtcgtgccatttggtatatgtggctcggggcgcggttcctggagttcgaggccctgggcttcctcaacgaggatcactggttctcgcgcgggaacagcctgagcggcgtggagggggaaggcctccaccggctcggctacatcctgcgcgacgtcgggaaaaaggaaggcggggctatgtacgccgacgacaccgcgggctgggacacaaggatcaccctggaagacctcaagaacgaagagatggtgaccaaccacatgaagggcgagcataagaagttagctgaggccatctttaagctgacgtatcagaataaggtcgtgcgcgtgcagcgacccaccccgcgaggaaccgtcatggacatcatcagccggcgcgaccagagaggtagcggtcaggtcggcacatatgggctcaacacgtttaccaacatggaggcccagctgatccggcagatggagggggagggcatcttcaagtcaatccagcaccttaccgccaccgaggaaatcgcggtgcagaactggcttgcgcgcgtcgggcgagaacgcctcagccggatggccattagcggagatgactgcgtggtaaagccaatcgatgaccgcttcgccagcgctctgacggctctaaacgacatgggtaaggtccggaaggacatccagcaatgggagccctcacgcggctggaacgactggacccaggtgcccttctgcagccaccacttccacgagctggtcatgaaggatgggcgggtcctcgtggtgccatgtcggaaccaggacgagctcatcgggcgggcgcgcatttcccaaggcgctggatggtcactgaaggagaccgcctgcctgggcaagtcctatgcccagatgtggaccttgatgtacttccaccgacgcgacttgcggctggccgcgaacgccatctgcagcgccgtccccagccactgggtgcccaccagccgcacgacctggtcgattcacgccaagcacgagtggatgaccaccgaagatatgttagctgtgtggaatcgggtctggatccaggagaacccctggatggaggataaaacgccggtggagagctgggaggaggttccctacctggggaagcgcgaggatcagtggtgcggctcgctgatcgggcttacctctcgcgctacatgggcgaaaaacatccagacagccatcaaccaggtccgctcactgatcggcaacgaggaatacacggactacatgccctccatgaagcgcttccggagggaagaggaggaggccggcgtgctgtggtga

SEQ ID NO: 25102 - RNA, 9876 nt, synthetic construct
  misc_feature 1..9876: note = derived and/or modified CDS sequence (opt11) from DENV-2__EU482639__SS-prME
  source 1..9876: mol_type = other RNA
accgcgggcgtgatcgtcatgctgatccccaccgccatggcgttccacctaaccacacgcaatggtgagccgcacatgatagtgggccggcaggagaagggtaagagtctgctgttcaaaaccgaggacggcgtgaacatgtgcaccctcatggccatcgacctgggagagttatgcgaggacaccatcacctacaagtgccccctccttcgccaaaacgagcccgaggacatcgactgctggtgcaacagcacaagcacctgggtcacctacgggacctgcaccaccacgggcgagcaccgccgcgaaaagcggtccgtggcactagtcccccacgtcgggatgggcctcgaaacccgcaccgagacctggatgagctccgagggtgcctggaaacatgtgcagcggatagagacctggattctgcgccaccctggttttaccatcatggcagcaatcttggcctatacgatcgggaccactcactttcagcgggcattgatcttcattctgctgaccgccgtggcgcccagcatgacaatgcgctgtataggcatctcgaaccgggacttcgttgagggcgtgagcgggggcagctgggttgacatcgtcctcgaacacgggagctgcgtgaccacgatggccaagaacaagccaaccctggacttcgagctgatcaagaccgaggccaaacagcccgcgaccctccgtaagtactgcattgaggccaagctgacaaacaccaccaccgagtcacggtgcccgacgcaaggcgaacccagcctgaacgaggagcaggacaagcgctttatttgcaagcactcaatggtcgaccggggctggggcaacggttgtgggctgttcggcaagggcgggatcgtgacttgcgcgatgttcacgtgcaagaagaacatggaggggaaggtggtgcagccagagaacttggaatacaccatcgttatcacgccccatagtggggaggagcacgccgtgggcaacgataccggcaagcacggcaaggagatcaagatcaccccgcagagtagcatcaccgaggccgagctgaccggttacgggacggtgaccatggaatgcagcccccgcacgggcctcgacttcaatgagatggtgctgctgcagatggaggacaaggcctggctcgtgcaccggcagtggttcctggacctgcccttaccctggctgcctggggcggacacccagggcagcaattggatccagaaggagacgctcgtgacctttaagaacccccatgcgaaaaagcaggacgtcgtggtcctcgggtcccaggaaggcgccatgcacaccgccctgactggggccacggagatccaaatgagcagcggcaacctcctattcaccgggcacctgaagtgccgcctgcggatggacaagttacagcttaaagggatgtcgtatagcatgtgcacggggaagttcaagattgtgaaggaaatcgccgaaacccaacatgggacgatcgttatccgtgtccagtacgaaggcgatggctccccctgcaagatccccttcgagatcactgacctggagaaacggcacgtgctcggacgcctaatcaccgtgaacccaatcgtcactgagaaggacagtccggtgaacatcgaggcggagccgccatttggcgactcgtatatcatcatcggcgttgagccagggcagctcaagctcaactggttcaaaaaggggtcgtccattggccagatgttcgagacaaccatgcggggagccaagcggatggccatcctgggggacaccgcctgggacttcggcagcctcgggggagtcttcacctccatcgggaaggccctccaccaggtgttcggcgctatctacggcgccgccttcagcggggtgtcctggacaatgaaaatcctgatcggcgttattatcacctggatcgggatgaacagccgctctaccagcctgtccgtgagcctggtcttagtaggcgtggtgaccctctacttgggtgccatggtccaggcggactccggctgcgtggtgagctggaagaacaaggagctcaagtgcggctccgggatctttatcacggacaacgtccacacctggacagagcagtataagttccagcccgagagcccatcgaagttagcctccgcgatccaaaaggcacatgaggaaggcatctgcggcatacggtctgtgacccgccttgagaacctcatgtggaagcaaatcacaccagagctgaaccacatcctgagcgagaacgaggttaaattgaccatcatgaccggcgacatccggggcatcatgcaggctggtaaacggagcctgagaccgcagccaaccgagctgaagtactcctggaagacgtggggcaaagcgaagatgctcagcaccgagtcccataaccagaccttcttaatcgacgggcccgagactgccgagtgcccaaacacgaaccgcgcctggaacagcctggaggtcgaggactacggattcggggtgttcactaccaacatctggctcaaactgcgggagaagcaggacgttttctgcgactccaagctgatgagtgccgccataaaagacaaccgcgcagtacacgccgacatgggctactggatagagtccgccctcaacgacacctggaagatggagaaggcgagcttcatcgaggtgaaatcctgtcactggcccaagtcacacaccctgtggtccaacggcgtgctagagagcgagatgatcatacccaagaacttcgccgggcccgtcagccagcacaattatcgacctggctaccacacgcagaccgcggggccctggcacctcggcaagctggagatggacttcgacctgtgtgaggggaccaccgttgtggtcaccgaggactgcggcaaccgcggcccttcgctcagaaccaccaccgcctcagggaagttgataacggagtggtgttgtcgctcctgcaccctgccgccgctgcggtaccgcggggaggacggttgctggtacggcatggagatacggcccctgaaagagaaggaggagaatctggtgaatagcctcgtaacagccgggcatggccagattgacaatttctccctgggcgtcctggggatggcccttttcctggaggagatgctgcgcacccgaatcggcactaagcacgctattctcctggtggctgtaagcttcgtcacactaatcaccgggaacatgtccttccgcgacctcggccgcgtgatggtgatggtcggcgctaccatgacggacgacatcgggatgggcgtgacctacctagccctgcttgcagcgttcaaggtgcggcccaccttcgccgctgggctgttgctccgcaagctgaccagcaaggagttaatgatggccacgatcggcatcgccttgctaagtcagtccaccatccccgagacgatcctggaactcacagacgcacttgccctggggatgatggtattaaaaatcgtaagaaacatggagaagtaccagctggcggtgacgatcatggccatctcctgtgtaccgaacgccgtgatcctgcaaaacgcgtggaaggtgagctgcaccatcctcgcggccgtctccgtaagccccctgctcttgacctctagccagcagaaggccgactggattcccctggcgctgaccatcaaggggctcaatcccacggccatcttcttgaccacattgtcccgcaccagcaagaaaaggtcctggccgctcaacgaggccataatggccgtgggcatggtgagcatcctggcctccagcctgctcaagaacgacatccccatgacgggacccttggtcgcgggcgggcttctcaccgtctgctatgtgctgaccggccgtagcgccgatctggaattggagcgagccgccgatgtgaagtgggaggaccaggccgagatctccgggagctcccccatcctgagcatcaccatcagtgaggacggctcaatgtcaataaagaacgaggaggaggagcaaacactgaccatcctcatccgcaccggcctcttagtcatcagcggggtgttcccggtgtccatccccatcaccgcggccgcatggtacctctgggaggtaaagaagcagcgggccggcgtcctgtgggatgtgcccagcccgcccccagtcgagaaggccgagctggaggacggggcataccgcatcaagcagcggggcatcctcgggtactcacagatcggggccggcgtgtacaaggaggggaccttccacacgatgtggcacgtgacccggggtgccgttctgatgcatcgagggaagcgtatcgagcccagctgggccgacgtgaagaaggacctgatcagttatggcgggggctggaagcttgagggcgaatggaaagagggagaggaggtgcaggtcctggccctggaacccggtaagaacccgcgggcggtgcagaccaagcccgggatctttaagaccaacacgggcaccatcggggccgtgtcattggacttctcccccggcacctcaggctcccccatcgtcgacaggaaggggaaggtggtgggcctctacggaaacggggttgtgacccggagcggcgcttacgtgtccgccatcgcgcaaaccgagaagtccatcgaggacaaccccgaaatcgaggacgacatctttcgcaagaagcggctgaccattatggacctccaccctggggcgggaaaaacaaagcgctacctgcccgccatcgtccgggaggccatcaagcgagggctgagaaccctgatccttgccccgacgcgggtggtggctgccgagatggaagaagccctgagaggcctgccaatccggtaccagaccaccgctatcaagaccgagcacaccggtcgtgagatcgtcgacctcatgtgccacgccaccttcaccatgcggctcttgtcgcccgtccgcgtccccaactacaacttaataatcatggacgaggcgcatttcaccgacccggcgtcaatcgccgccagaggctacattagcacgcgcgtcgagatgggcgaggccgccgggattttcatgacggccacccctcccggctcaagggaccccttcccgcaaagcaacgcgccaatcatggacgaggagcgcgaaatccccgagcggtcctggaacagcggccacgagtgggtgaccgacttcaagggcaaaacggtgtggtttgtcccttccatcaaggccggtaacgatatagcggcctgcctgcgcaaaaacggcaagaaggtgatccagctaagccgaaaaaccttcgattccgagtacgtcaagacccgcgccaacgactgggatttcgtcgttaccacggatataagcgagatgggcgccaatttcaaggcggaacgggtgatcgacccgcgccggtgtatgaaacccgtcatcttaaccgacggagaggagcgcgtgatactggcgggaccaatgcccgtaacgcactccagcgccgcccagcggcgcggacggataggccgcaacccgaagaacgagaacgaccagtacatctacatgggggagcccctggagaacgacgaggactgcgcccactggaaggaggccaagatgctcctggacaacatcaatacccccgagggtatcatcccatccatgttcgagccggagcgcgagaaggtcgacgcgatcgacggcgaatatcggctgcgcggcgaggcccggaagacgttcgttgacctcatgcgcaggggagatctgcccgtgtggctagcctacaaggtagccgccgaggggattaattacgcggaccgcaagtggtgctttgacggtatcaagaacaaccagatcctcgaggaaaacatggaggtggaaatctggacaaaggagggggagcggaaaaagctgaagccccgctggctggacgcccggatttacagcgatcccctcgcgctgaaggagttcaaggaattcgctgcgggccgcaagtccttgaccctcaacctgatcaccgagatggggaggctgcccacgtttatgacccagaaggcccgcaacgccctcgataacctggcagtgctccacaccgccgaggccgggggccgggcatacaatcatgcactcagcgagctgccagagaccctggaaacgctccttctgctcaccctgctggccaccgtcaccggtggcatattcctcttcctgatgtccggcaaggggatcggcaagatgaccctggggatgtgctgcataatcacagccagcatattgctgtggtacgcgcaaatccagccccactggatcgccgcctccatcatcctggagttcttcctcattgtgctgctcatcccggagcccgagaagcagcgcacaccacaggacaaccagctcacctacgttgtgatcgccatcctgaccgtggtcgccgcgacgatggccaatgaaatgggattcctggagaagaccaaaaaagacctcgggctgggcagcatcaccacgcaggagtcagagtcgaacatcttggacatcgatttgcggcccgccagcgcctggacgctgtatgcagtggcgaccaccctggtgacccctatgctcagacacagcatagaaaactcctccgtcaacgtgagcctgacggccatcgccaatcaggccaccgtgctaatgggcctcgggaagggctggcccctgtccaaaatggacatcggggtccccctcctcgcgatcggctgttactcacaggtgaaccccattaccctgaccgccgccctgttactcctggtggcccactacgccatcattgggccgggcctccaggcgaaggccacgcgggaggcccagaaacgtgccgctgcgggcatcatgaagaaccccaccgttgacgggatcaccgtaatcgatctggaacccatcccctacgacccgaagtttgaaaagcagttaggccaagtgatgctcctgatcctgtgcgtcacgcaggtgctcatgatgcggacgacctgggccctgtgcgaggccctgaccctcgccaccggacctatctccaccctgtgggagggcaaccccgggcgcttctggaacaccaccatcgccgtgagcatggcgaacatcttccgcggctcatacctggcgggcgcaggtctcctgttcagcatcatgaagaacaccacgaacacccggcgcggcaccgggaacattggcgagaccctaggcgaaaagtggaaatcgcggcttaacgccctgggcaagtcagaatttcagatctacaaaaagtccggcatccaggaggtcgaccgcacgttagcaaaggaggggatcaagaggggggaaaccgaccaccatgctgtgagccgtgggagcgccaagctgcggtggtttgtggagcgcaacatggtcacccccgagggcaaggtggtagatctgggttgtgggcggggcgggtggagctactactgtggcgggctgaagaacgtccgcgaggtgaagggcctcaccaagggcgggccgggccacgaggagcccatccccatgtccacgtacggttggaacctggtgcggctgcagagcggcgtcgacgtgttcttcacgccgcccgagaagtgcgaaaccctcctgtgtgacataggggagtcttcccccaaccccaccatcgaggcaggccgcaccctacgggtgttaaacctggtagagaactggctgaataataacacgcaattctgcataaaagtactcaacccctatatgcccagcgtgatcgagaagatggaggccctgcagcgcaagtatggcggggcgctggtccggaaccccctgagtcgcaacagcacccacgagatgtactgggtgtccaatgcgaccggcaacatcgtcagctccgttaacatgatcagccggatgctcatcaaccggttcaccatgaaacacaagaaggccacgtacgagccggatgtagaccttggttctggaacccggaatatcgggatcgagagcgagattcctaaccttgacatcatcgggaagaggatcgagaagatcaagcaagagcacgagacctcctggcactacgaccaagaccacccctataaaacttgggcctaccacggcagctacgaaactaagcagaccgggtccgctagctccatggttaatggggtcgtccgtctcctgaccaaaccctgggacgtggtccccatggtgacccaaatggcgatgactgataccacccctttcgggcagcagcgggtattcaaggagaaggtcgacacccgaacgcaggagcccaaggagggcacaaagaagcttatgaagataaccgccgagtggctctggaaggagctgggcaagaagaagacgccccggatgtgtacgcgcgaggagttcacccggaaggtgcgcagtaacgccgccctgggtgctatcttcacggacgagaacaaatggaagtccgcgcgtgaggccgtagaggacggccgattctgggagctcgtcgaccgggagcgcaacttacacctggaggggaagtgcgagacctgcgtgtacaacatgatgggcaaaagggagaagaaattaggcgagttcgggaaggcgaagggaagcagggccatctggtacatgtggctgggggcacggttcctggagttcgaggccctcggcttcctgaacgaggaccattggttttcccgcgggaatagccttagcggggtggaaggggagggtctccaccggcttggctacattctgcgcgatgtcggtaagaaggaaggcggtgccatgtacgccgacgacacggccggctgggacacccggatcactctcgaggacctgaagaacgaggagatggtgacgaatcacatgaagggggagcacaagaagctcgcggaggccatcttcaagctcacgtaccagaataaggtcgtgcgcgtgcagcgaccaaccccgcgcggcaccgttatggacatcattagtaggcgagaccagcgcggcagcggacaagtcggcacctacgggctgaacacgttcaccaacatggaggcacagctgatccggcagatggagggcgagggcatctttaagtcaatccagcatctcaccgccacagaagagatcgccgtgcagaactggctggcacgcgtcggccgggagcgcctgagcagaatggcgatttccggcgacgactgcgttgtgaagcccatcgacgaccgcttcgccagcgccctcacggccctgaacgacatggggaaaatccgaaaggacatacagcagtgggagccctccagaggctggaacgactggacccaggtccctttttgcagccaccacttccacgagctcgtgatgaaagatggacgggtgctggtcgtgccttgccgcaaccaggacgagctgatcggccgagcgcgcatatcgcagggcgcggggtggagcctgaaggaaacggcctgcctcggcaagtcctacgcgcagatgtggaccctgatgtactttcaccggcgcgacctgcggctcgccgctaacgccatctgcagcgccgtgccctcccattgggtccccaccagccgcactacctggtccatacacgccaagcacgagtggatgaccaccgaggacatgttagcggtgtggaaccgggtgtggatacaggagaacccgtggatggaggacaagacgccggtcgagagctgggaggaggtgccctatctggggaagcgcgaggaccagtggtgcggttccttaatcggactgaccagccgggccacctgggcgaagaacattcagacggcgatcaaccaagtgcgcagcctgatcggcaacgaggaatacacggactacatgccttcgatgaagcgctttcgtcgcgaggaggaagaggccggcgtcctctggtga

SEQ ID NO: 25103 - RNA, 9876 nt, synthetic construct
  misc_feature 1..9876: note = derived and/or modified CDS sequence (opt11) from DENV-2__EU482766__SS-prME
  source 1..9876: mol_type = other RNA
accgcgggcgtgatcgtcatgctgatccccaccgctatggccttccacttgaccacccgaaacggggagccccacatgatagtgggccggcaggagaaggggaagagcctgctgttcaagacggaagacggcgtgaatatgtgcacactcatggccattgacttgggggagctatgcgaggataccatcacctacaagtgcccgcttctgcgccagaatgagcccgaggacattgactgttggtgcaactccacaagcacttgggtcacctacgggacgtgcacaaccacgggtgagcaccgccgagagaaacggtccgtggctttagtgccccacgtagggatgggcctcgagacccgcacagagacctggatgagcagtgagggcgcctggaagcacgtgcagcggatcgagacgtggatactgcgccaccccggcttcaccatcatggccgcgattctggcctacacaatcgggaccacccacttccagcgggcactcatctttatactcctcactgctgtggcacccagcatgacaatgcgctgtattggcatctcgaaccgggacttcgtcgagggcgtgtctggtggttcttgggtagatatcgtcttggagcacggaagctgcgttaccacgatggccaagaacaagcctaccctggacttcgagcttatcaagaccgaggccaagcagcccgccactctcaggaagtactgtatcgaggctaaactgaccaacaccaccaccgagtctcgttgtcccacgcaaggcgagcccagtttaaacgaggaacaggataagagattcatctgcaagcactccatggtggaccggggctgggggaacggctgcgggctctttggcaagggcggtatcgtgacctgcgcgatgttcacgtgtaagaagaatatggagggcaaggtggttcagcccgagaacctggaatacaccatcgtcatcaccccccatagcggggaggagcacgccgtgggcaacgacacggggaagcacggcaaggagatcaagatcacaccgcagtctagcataaccgaggcggagctgaccgggtacggcacggtgaccatggagtgcagtagcaggaccggcctcgacttcaacgaaatggtccttcttcagatggaggacaaggcctggctcgtccaccgccagtggttcctggacctccctctcccatggctcccgggggccgatacccagggctccaattggattcagaaggagacgctggtgaccttcaaaaaccctcatgccaaaaagcaggacgtagtggtcctcggctcccaagagggggccatgcacacggcccttaccggtgccaccgagatccaaatgagctccggcaacttgcttttcaccggccacttaaagtgccgcctgcggatggataagctccagctgaaggggatgagctactccatgtgcaccggcaagttcaagatcgtgaaggaaatcgccgagactcagcacggtacgatcgttatacgcgtgcagtacgagggcgacggcagcccgtgcaaaatccccttcgagataaccgacctggagaagcggcacgttctcggaaggttgatcaccgtgaaccccatcgtcactgagaaggactccccggtgaatatcgaagcggagccgcccttcggagactcctatattattatcggggtggagcctggccaactcaagctcaactggttcaagaaagggagcagcatagggcagatgttcgagacgaccatgcgcggcgccaagcggatggcgatcctgggggacaccgcctgggacttcggttccttgggaggcgtcttcaccagcatcgggaaggccctccaccaggtattcggcgcgatctatggcgccgccttctctggggtgagctggacgatgaagatcttgatcggcgtcatcatcacgtggatcgggatgaactcccgcagcacctcactgagcgtatctcttgtgctggttggggtggtgaccctatacctgggggccgtcgtccaggcggacagcgggtgcgttgtttcctggaaaaataaagaactcaagtgcggtagcgggatctttatcacggacaatgtgcacacgtggacagagcagtacaagttccagcccgagtccccttcgaagctggccagcgccatccagaaggcccacgaggaaggcatttgcgggatccggtccgtaacccgactggagaatctcatgtggaagcagatcacgcctgagctgaaccacatactgtcggagaacgaagtaaagctcacgatcatgacaggggacatcaaggggatcatgcaggccggcaagcggtccctacggccccagccgaccgagctgaaatacagctggaagacctggggtaaagcgaagatgctctccacagaaagccacaaccaaactttcctgatcgatgggcccgagaccgccgaatgccccaatacgaatcgcgcctggaactctctggaggtggaggattacggattcggggtgttcaccacgaacatctggctcaagctgagagagaagcaagacgtcttctgcgattcgaagctgatgagtgccgccatcaaggacaaccgggcggtgcacgccgatatgggctactggatcgaaagcgccctaaatgacacctggaagatggagaaggcctccttcattgaggttaaaagctgtcactggcccaaatcccacaccctgtggagcaacggtgtgctcgagagtgagatgatcatccctaagaattttgcggggcctgtgtcgcagcacaactaccgcccgggctatcacacgcaaaccgcgggaccgtggcacctcggcaagctggagatggatttcgacttttgtgaagggaccacggtggtcgttacggaagactgcggcaacaggggccctagcctgcggacgaccacggcttccgggaagctcatcacagagtggtgctgccggagctgtaccttgccgcccctgcgctaccgtggcgaagacgggtgctggtatggcatggagatccgcccgctcaaggagaaggaggaaaacctggtgaattccttagttaccgccgggcatgggcagatcgataacttcagtctaggggtcctggggatggcgctgttcctggaagaaatgctgaggacccgcatcggaacgaaacacgcgatcctgctcgtggccgtctccttcgtgaccttgatcaccgggaacatgagcttccgggatcttggccgcgtgatggtaatggtcggggccactatgacggacgacatcggcatgggcgtgacctacctcgcgctgctggccgcgttcaaagtaagacccaccttcgctgccgggctcctgctgcggaagctcacctccaaagagctgatgatggccacgattggcatcgccctgctcagccagtccactatccccgagactatactagaactgacggacgcgctcgccctggggatgatggtgctgaagatcgtgcgcaacatggaaaagtaccagctcgccgtcacaatcatggccatctcctgcgtgccaaacgccgtgattctgcaaaacgcgtggaaggtcagctgcacaatcctggctgccgtgtcagtcagcccgcttctgcttacgagctcccagcaaaaggccgactggatcccactcgctctgaccatcaagggactgaaccccacggcaatcttcctcaccacgctgagccgaacctccaagaaacgtagctggcccctgaacgaggccatcatggctgttggcatggtgtccatcctcgcgtctagccttctgaagaacgacatcccgatgacggggcccctcgtcgcgggcggccttctgactgtatgctacgtgcttacgggccggtccgccgacctggagctggagcgcgctgcagacgtcaagtgggaggaccaggccgagatcagcgggagttccccaatcctttccatcacaattagcgaggatggttccatgagcatcaagaacgaggaggaggagcaaacactgacgatcctgatcagaaccggcctcttagtgatctccggcgtgttccccgtcagtataccgatcaccgcagccgcctggtatctgtgggaggtaaagaagcagcgcgcgggggtgctctgggacgtcccctctcccccgcccgtggagaaggccgagctggaggatggggcctaccgcataaagcaacgcggcattctgggttactcgcaaattggcgccggcgtgtacaaggaggggaccttccacacgatgtggcacgtcacgcggggcgctgtcttaatgcatcgcgggaagcggatcgagccatcctgggccgacgtgaagaaggacctgatctcgtacggcggggggtggaagttggagggcgagtggaaggagggcgaagaagtccaggtccttgccctggaacccgggaagaacccccgcgctgtgcagaccaagccagggatcttcaaaaccaacacgggtaccatcggggcagtctccctggacttcagccccggcacatcgggcagccctattgttgaccgaaaggggaaggtggtaggcctctacggaaacggcgtggtgactcgctcaggcgcctacgtcagtgcgatcgcgcagacggagaaatccatcgaggataacccggagatcgaggacgacatattccggaaaaagcgcctgaccatcatggacctgcacccgggggccggcaaaaccaagcggtacctccctgcaatcgtgcgcgaggccatcaaacgggggctgcgaaccctgatactggctcctacgcgcgtggtcgcggcagagatggaggaagccctcagaggactgccgattcgttaccaaaccccagccatcaagaccgagcatacggggcgggagatcgtagacctgatgtgccacgccacgttcacgatgcgcctcctgtccccagtgcgggtgcccaactacaacctcatcattatggacgaggcgcacttcaccgacccggcctccatagccgcccgcgggtacatctccacccgggtggagatgggcgaggcagcgggaattttcatgacggccacgccgcccggcagcagagacccctttccgcaatccaacgcccccattatggacgaggaacgtgagatccccgagcgctcgtggaactccgggcacgagtgggtgaccgacttcaagggcaaaaccgtgtggttcgtgccctcgatcaaagcggggaatgacatagcggcgtgtctccggaaaaacggcaagaaggtgatccagctgtcacgcaagacgtttgactctgagtacgttaagacccgcgccaacgactgggacttcgtggtgacaacagatatttccgagatgggcgccaacttcaaggccgagcgcgtcatcgacccgcggaggtgcatgaagcccgtaatcctgacggacggggaggaacgcgtgatcctcgccggccccatgccagtcacccactcttcggccgcccagcgccgtgggcgcatcggcagaaacccaaagaatgagaacgaccagtacatctacatgggtgagccgctagagaacgacgaggattgcgcccactggaaggaggctaagatgctgctcgacaacatcaatacccccgagggtattatccccagtatgtttgagccggagcgggagaaagtggacgcgatcgatggcgagtaccgcctgcgcggcgaggctcgcaagaccttcgtggacttgatgcggcgcggtgacttacccgtctggctggcctacaaggtggccgccgagggcataaattacgcggaccgtaagtggtgtttcgacggaatcaaaaacaaccagatccttgaagaaaacatggaggtcgaaatctggactaaggagggagaacgcaagaagctcaagccgcggtggctggacgcccgcatctactccgaccccctggccctcaaggagttcaaggaattcgccgcgggccgcaagagcctgaccctgaacctcatcaccgagatgggccgcctgcctaccttcatgactcagaaagcccggaacgcactggacaacctcgcagtcttacacaccgccgaggccgggggccgcgcctacaaccacgcccttagcgagctccctgagaccctggagaccctgctcctgctgactttgctggccactgtgaccgggggcatcttcttgttcctcatgagcggcaaggggatcggaaagatgaccctgggcatgtgctgcatcatcaccgcctccatcctactctggtacgcgcagatccagccccattggatcgccgcgagcatcatcctagagttcttcctgatagtgctcttaatcccggagccagagaagcaacggacgccccaagacaaccagctgacctacgtggtgatcgctattctcaccgtcgtggccgcgaccatggcaaatgagatgggcttcctggagaagacgaagaaggacctggggctcgggagcatcactacccaggagtccgagagcaacatcctggacatcgacctccgccccgcctccgcctggaccctctatgccgtcgctaccaccttcgtgacgccgatgctgcggcacagcatcgagaactcaagcgtgaacgtgtcactcaccgccatagccaaccaggccacagtcctcatgggactgggaaagggctggcccctgagcaagatggatatcggtgtgcccctccttgccatcggttgctactcgcaggtgaatcccatcactctaacggccgccctactactcctcgtcgcccattacgccataatcgggcccggtctgcaagcgaaagccacccgcgaggcacagaagcgagccgccgcgggcatcatgaagaaccccactgtggacgggatcaccgtaatcgacctggaaccgatcccctatgacccgaagttcgagaagcagctcggccaggtcatgctcctgatcctgtgcgtgacgcaggtgctgatgatgcgcacaacctgggcactttgcgaggccctcacccttgccaccgggcccatcagcaccctgtgggagggcaatcccggtcggttctggaataccacgatcgcagtctccatggcgaatatcttccgcggcagctacctcgcaggggccgggctgttattctccataatgaagaacaccacatctacgcgccggggcaccggtaacatcggcgaaaccttgggcgaaaagtggaagtcgcgactaaacgccctgggcaagtcagagttccagatctacaagaaatccggcatccaagaggtggaccgtacactcgcgaaggagggaataaagcgcggcgagaccgaccaccacgcagtgagccgggggtccgccaagctgcgttggtttgtcgagcggaatatggtgacccccgagggcaaagtggtagatctgggctgcgggcgcggcggctggagctactactgcggcgggttaaagaacgtgcgtgaggtcaagggcctgaccaagggcggacctggccacgaagagcctatccccatgagcacctatgggtggaatctggtccgccttcagtctggcgttgatgtattctttacgccccctgagaaatgcgataccctgctgtgcgatatcggggaatcttcccccaatcccaccatcgaggccggcaggaccctccgcgtcttgaatctggttgagaactggctaaataacaacacacagttctgcatcaaggtcctgaatccctatatgccttcggtcatcgagaaaatggaagccctgcagagacaatatggcggggccctcgtgcgaaacccactgtccagaaatagcacgcacgaaatgtactgggtgtccaacgccaccggcaacatcgtcagctccgtgaacatgatcagccgcatgctgatcaaccgcttcactatgaagcacaaaaaggctacctacgagccagacgtggacctcgggtccggtacgcgcaacatcgggattgaaagcgaaatcccgaacctcgacatcatcggcaagagaatcgagaagatcaagcaggagcacgagatctcctggcactacgatcaggaccacccctacaagacctgggcttaccacggtagctacgagaccaagcagaccggctccgccagcagcatggtcaacggcgtggttcgcctgctgacgaagccatgggacgtcgtgcccatggtgacccaaatggcgatgaccgacacaaccccgttcggccagcagcgcgtcttcaaagagaaggtggacacccggactcaagagccgaaggagggcaccaagaaactcatgaagattacagccgagtggctgtggaaggagctgggcaagaagaaaacgccccggatgtgcacccgggaggagttcacacgtaaggtgagaagcaacgccgccctcggggccatcttcacggacgagaacaagtggaagtctgcacgcgaggccgtcgaggacggcaggttctgggaactggttgaccgtgagcggaacctgcacctcgaggggaagtgcgagacctgcgtttacaacatgatgggcaagcgggagaagaaactgggagagttcggcaaggcaaagggcagcagagccatttggtacatgtggttgggggcgcgcttcctcgagttcgaagccctgggcttcctgaacgaggaccactggtttagccgggggaactccctcagcggcgtggagggggaaggcctgcaccgcctgggctacattctcagagacgtgggtaagaaggaaggcggggccatgtacgccgacgacaccgccggctgggatacccgcatcacgctggaggacctgaagaacgaggagatggtaaccaaccatatgaagggtgaacacaaaaagctcgcggaggccatattcaagttaacgtaccaaaacaaggtagtccgggtccagcgccccaccccgcggggcacggttatggacatcatctctcgccgagaccagcgcggctcggggcaggtaggaacttacggcctgaacacctttaccaacatggaggcccagttaattcgccaaatggagggggaaggcatattcaagtcaatccagcacctgacggccaccgaagaaatcgcggtccagaactggctcgcgagagtggggagggagcgtctttctcgcatggccatttccggtgacgattgcgtcgtcaagccgatcgacgaccggttcgccagcgccctgaccgccctgaatgatatggggaaagtgcgaaaggacatccagcagtgggagccctcccgtggctggaacgattggacccaagtacccttctgcagccaccactttcacgagctcgttatgaaggacgggcgcgtgttggtggtcccatgcaggaaccaggacgaactcatcggccgcgcccggatctcccagggagcggggtggagcctcaaggagacggcctgcctaggcaagtcatacgcccagatgtggaccctgatgtatttccaccgccgggatcttcgcctggccgccaacgccatctgtagcgcggtgccctcgcactgggttcccacctctcgaaccacctggagcatccacgccaagcacgagtggatgacgaccgaggacatgctagcggtatggaaccgcgtgtggatacaggagaatccctggatggaggacaagaccccggtggagtcctgggaggaggtcccatacctcggcaaacgggaggaccagtggtgcggatcactgatagggctaacctcacgcgcaacgtgggccaagaacatacagaccgctattaatcaagtgcggtcgctcatcggcaacgaggagtacaccgattatatgccctccatgaagcgcttcaggcgggaggaagaggaggccggggtgctttggtaa

SEQ ID NO: 25104 - RNA, 9876 nt, synthetic construct
  misc_feature 1..9876: note = derived and/or modified CDS sequence (opt11) from DENV-2__EU482695__SS-prME
  source 1..9876: mol_type = other RNA
acggcgggcgtgatcgtcatgttaatccctactgcgatggcgttccacctcaccacccgcaacggggaaccgcatatgatcgtgggtaggcaggaaaaagggaaatccctgctgttcaaaaccgaggatggcgtgaacatgtgcacccttatggccatcgacctgggggagctatgcgaggacacgataacctacaaatgccccctgttgcgacaaaatgagcccgaggacatcgattgctggtgcaattccacaagtacctgggtcacgtacgggacctgtaccactactggagagcaccggcgggaaaagaggtccgtggccctcgtaccccacgtagggatgggcctcgaaacccgcaccgaaacctggatgtccagcgagggggcttggaagcatgtgcagcgcatcgagacgtggattctgcgccatccgggatttaccataatggccgcaatactagcctacactatcggtaccacccactttcaacgggcccttatctttatcctcctgaccgccgtagcgcccagcatgaccatgaggtgcattggcatatctaaccgggacttcgtcgagggtgtgagcgggggctcctgggtggacatcgtcctggagcacggcagctgcgtcacaacgatggccaaaaacaagcccacactggacttcgagctgattaaaacagaagctaagcagcccgctacactccgcaagtattgcatcgaggctaagctgacgaataccaccaccgagtcccggtgtcccacgcagggggagcccagcttaaacgaagaacaggacaaacgttttatctgcaagcactcaatggtggaccgcggctgggggaacggatgcgggttgtttggcaagggcgggatagtaacctgcgcgatgttcacatgcaagaagaacatggagggtaaggtggtacagcccgagaacctggagtacactatcgtaatcacaccccacagtggcgaagaacatgccgtgggcaacgacacggggaaacatggcaaggagatcaagatcaccccgcagtccagcatcaccgaggcagagctgacggggtacggtaccgtgaccatggagtgctcgccccgcaccggcctggatttcaacgagatggtcctgctgcagatggaagacaaggcctggctcgtgcaccggcagtggttcttggatttgcccttaccctggctgccgggggccgacacgcagggctcaaactggatccagaaggagacgctggtgactttcaagaacccccacgcgaagaaacaggacgtcgtggtactcgggtcccaagagggcgccatgcacacggccttgaccggtgccacggagatccagatgagtagcggaaacctcctctttactggtcacctgaagtgtcggctgcgcatggataagctccagctaaaggggatgtcctactccatgtgcaccggcaagttcaagatagtgaaggagatcgccgagacccagcatgggacgattgtgattcgcgtccagtacgaaggggacggctccccatgcaagatccccttcgagataaccgacctggaaaagaggcacgtactcggccgcctgattaccgtgaacccgatcgtcaccgagaaggacagccccgtcaacatagaggcggagccgcccttcggcgactcatacatcatcatcggagtggagccggggcaactgaagttaaactggttcaagaagggttcgtccatcggccagatgttcgaaacgactatgcgcggcgccaagcggatggccatcctgggagacaccgcttgggacttcggcagcctcggaggggtctttaccagcatcgggaaggccctccaccaggtgttcggcgcgatctacggagccgccttctctggggtatcatggacgatgaaaatcctgatcggagtcatcatcacgtggatagggatgaacagcaggtccaccagcttgtccgtgagcctggtgctcgtaggcgtggtgaccctatatctaggggccatggtccaggcggattccggctgtgtcgtcagctggaagaacaaggagctcaagtgcggctccggaatctttattacagataatgtccatacctggaccgagcagtacaagttccagcccgagagccccagcaaactcgcctccgccatccaaaaggcccacgaggagggcatatgtgggattcgcagcgtgaccaggctggaaaacctcatgtggaagcagatcacgcccgagctgaaccatatcttatccgagaacgaggtgaagttaaccatcatgaccggagacatccgggggatcatgcaggccggcaaacgttccctgagaccgcaacccactgagctcaagtactcttggaaaacgtgggggaaggcgaaaatgttaagcaccgagtcccacaaccagaccttcctgatcgacgggccggagacagccgaatgcccgaatactaatagggcctggaactctttagaggtcgaagactacggattcggggtgttcaccactaacatctggctgaagctacgggagaagcaggacgtgttctgcgactccaagctgatgagcgctgccataaaggataaccgggcggtgcacgccgacatggggtactggattgaatccgctctcaacgacacgtggaagatggagaaagccagcttcatcgaggtgaagtcctgccactggcccaagagccataccctgtggtcaaacggtgtgttagagagtgagatgatcattcccaagaacttcgccgggcctgtaagtcagcacaactacagaccgggttaccacacgcaaaccgcggggccttggcacttgggcaagctggagatggactttgacctgtgcgaggggaccaccgtagtggtcacggaggactgcggcaaccgcggcccgtcactccggacaacgaccgcctctgggaaactgatcacggagtggtgctgccgcagttgcacccttccccctctccgttaccgcggcgaggacgggtgctggtacggcatggagattcggccactgaaagagaaggaggagaacctggtgaacagcctggtgacagccgggcacgggcagatcgataacttcagcctgggcgtgttagggatggccttgttcctggaagagatgctgcgcactcggatcggcacgaagcacgcgatcctcctggtggccgtgagctttgtcacactgatcaccgggaacatgtccttccgagacctcggccgcgttatggtgatggtcggggccaccatgacggacgatatcggcatgggcgtgacatacctggccctgctcgccgccttcaaagtgcggccaaccttcgccgccggtcttctgttaaggaagctgacatccaaggagctgatgatggcaacgatcggcatcgccctcctgtcccagagcaccatccccgagaccatcctggagctcaccgacgccctggcactggggatgatggtactcaagatcgtccggaacatggagaagtatcaacttgccgtgactattatggccatctcctgcgtcccgaatgccgtgatactccaaaacgcgtggaaggtgtcgtgcaccatactggcagcggtctccgtgagtcccctgctgctcaccagtagtcagcagaaggcagactggatccccttagctctgaccatcaaagggctcaaccccacggccattttcctgacgaccctgtcccgcacctccaagaaacggtcctggcctctcaatgaggccatcatggcggtcggcatggtgtcgatcctggccagtagcctgctcaagaacgatataccaatgacggggcccctggtggcgggtgggttgctcaccgtctgctatgtgctgacgggccgcagcgccgacctggagctagagcgggctgccgacgtgaagtgggaggaccaggcagagatctccggcagctccccaatcctgagcatcacgatctccgaagacggctccatgagcatcaagaatgaggaggaggagcagacgctgacgatactcatccgcaccgggcttctggtcatcagcggagtgttcccggtctccatccccattaccgcggccgcctggtacctctgggaggtcaaaaagcaaagggccggggtgctgtgggacgtacccagccctccacccgtcgagaaggccgagctggaggacggggcgtatcgtatcaagcaaagaggcatcttaggttactcgcaaatcggcgccggagtgtacaaggaagggacgtttcacacgatgtggcacgtgaccagaggcgccgtcctgatgcatcgggggaaacgcatcgagccaagctgggccgacgtgaagaaggacttaatctcgtacggcggcggctggaaactcgagggcgagtggaaggaaggggaagaggtgcaggtcttagccttagagcccggcaaaaacccccgtgcggtgcagaccaagcctgggatcttcaagaccaacacgggcaccataggcgccgtgagcctcgatttctccccaggcaccagcggctcccccatcgtggacagaaaagggaaagtggtgggactttacggtaacggcgtcgtgacccggtcgggcgcgtacgttagtgccatcgcgcagacggaaaagagcatcgaggacaaccccgagatcgaagacgacatctttcgcaaaaagcggctgactatcatggacctccacccgggcgctggcaaaaccaaacgctatctgcccgccatcgtccgggaggcgatcaagcgaggtcttcgaaccctgattttagccccgacgcgagtggtcgctgccgagatggaggaggccctgaggggcctgccaattcgttaccagaccacggccatcaagaccgagcacaccgggagagaaatcgtcgacctaatgtgccacgccaccttcactatgcggctgctgagcccggtgcgagtcccgaattacaacctcatcatcatggatgaagcgcacttcaccgaccctgcctccatcgctgcgcggggctacatcagcactcgcgtcgagatgggcgaggcggcggggatcttcatgaccgcgacgccgcccgggtcccgggacccctttccccagagcaacgcacccatcatggacgaggagcgagagatccccgagcggtcctggaacagcgggcacgagtgggtgaccgatttcaagggaaagacggtgtggttcgtcccttccataaaagccgggaacgacatcgctgcctgcctgcgcaagaatggcaagaaggtgatccagctaagccgtaaaacctttgactccgagtatgtgaagacgcgcgccaacgattgggacttcgtcgtaaccaccgacattagcgaaatgggcgccaacttcaaggccgagcgcgtgatcgacccacgcagatgcatgaagcccgtcatcctcaccgacggggaggagcgcgttatcctggcgggccccatgcccgtcacccactccagcgcagcccagcggcgcggccgaattggccggaacccgaagaacgagaatgatcagtacatctacatgggcgaaccgctggagaacgacgaggactgtgcgcactggaaggaggccaaaatgctcctggacaatatcaacacgccagagggcataattccttccatgtttgagccggagcgcgagaaggtcgacgcgattgacggcgaataccggctacgcggggaagccagaaagacgttcgtggacttaatgaggaggggcgatctgcccgtgtggttggcctacaaggtcgccgccgaggggatcaactacgcggaccgcaagtggtgtttcgacgggattaagaacaaccagatcctcgaggagaacatggaggtcgagatctggaccaaggagggggagcggaagaagctgaagcctcgctggctggacgcccggatctatagcgacccactcgcactgaaggagtttaaggagttcgccgccggtcgcaagtccctgacccttaacctcatcaccgaaatgggccgactgcccacgttcatgacccagaaggccaggaacgccctcgacaacctggccgtgctgcacaccgccgaggccgggggccgggcgtataaccacgccctcagcgagctgcccgagaccctggaaacgctgctgctgctaaccctgctggccaccgtcaccgggggcatcttcttattcctgatgtccgggaagggtattggtaaaatgacactggggatgtgttgtatcatcacggccagtatactcctgtggtatgcgcagatccaaccccactggattgccgcctccataattctggagttcttcctcatcgtgctcttgatcccggagcccgaaaagcagcgcacgccccaggacaatcagctgacttatgtcgtgatcgccatcctgacggtagtcgcagcgaccatggcaaacgagatgggtttcctggagaagaccaagaaagacctcgggctgggctccataaccacccaggagagcgagtcaaacatcctagacatcgatctcagaccggcatctgcctggacgctgtacgccgtggcgactaccttcgtgacccctatgcttcgtcactccatcgagaacagctccgtcaacgttagcctcacggctattgccaaccaagccacagtgctgatgggcctggggaagggctggcccctctccaaaatggacatcggggtgcccctgctggcgatcgggtgctactctcaggtaaacccaattaccctgactgctgccctactgctgctggtggctcactatgccatcatcgggccgggcctacaagcaaaagccacgcgggaagcgcaaaaacgcgccgctgcgggtatcatgaagaaccccactgtcgacggcatcaccgtgatcgacctcgaacccatcccctatgacccaaagttcgagaagcagctgggacaggttatgctgctcatcctgtgcgtcacccaagtgcttatgatgaggacgacctgggccctctgtgaggctctgaccctggcaaccggtcctataagtacgctctgggagggcaaccccgggaggttctggaacaccaccatcgccgtgagcatggcgaacatattccgcgggtcctacctggctggggccggcctactgttcagcatcatgaagaacaccacgaatacccgaagaggcaccgggaacatcggcgagacgctgggcgagaagtggaagtcccggctgaacgcccttggcaagagcgagtttcaaatctacaagaagtccgggatccaggaggtcgaccgcacactggcgaaggagggcatcaagcggggcgagaccgaccatcacgctgtgagccgagggagtgccaaactgcggtggttcgtcgaacgcaacatggtcacccccgagggcaaggtcgtggacctcggatgcgggcggggcggatggtcatactactgcggcgggctgaagaacgtccgcgaggtgaagggcctcaccaagggaggaccgggccatgaggagcccattcccatgtccacctatgggtggaacctcgtgcggctccagagcggcgttgacgtcttcttcacgcccccggagaagtgcgataccctgctctgcgacattggggagagctcccccaaccccactattgaggccggacgcacactgcgggtgctgaacttggtagagaactggctgaacaacaacacgcagttctgcataaaggtgctgaatccctacatgcctagcgtgatcgagaaaatggaggccctccagcgcaagtacggcggcgcgctggtccggaatccactctccaggaacagcacacacgaaatgtactgggtatccaatgcgaccggcaacatcgtgagcagtgtcaacatgatcagccggatgctgatcaatcgcttcaccatgaaacacaagaaagccacctacgagcccgacgtggatctcgggtctggcacccgtaacatcggtattgagtccgagatcccgaacctagacataatcggaaaacgcatcgaaaagatcaaacaagagcatgagacgtcatggcactacgaccaggatcacccctacaagacctgggcttaccacggcagctacgaaacaaagcagactggctccgcgagctccatggtgaacggcgtagttcggctgctcaccaaaccctgggatgtcgtccccatggtgacccagatggcgatgaccgacaccaccccgttcggtcagcagagggtattcaaggagaaagtcgacacgcgcacgcaggagccaaaagagggtaccaagaagctgatgaagatcaccgctgaatggctgtggaaggagcttggcaagaagaaaactccccggatgtgtacgcgagaggagttcacccgaaaggtgcgcagcaatgccgccctgggagccatcttcaccgacgagaacaagtggaaaagcgcgagggaggctgtggaggacggccgcttttgggagctggtcgaccgggaacgcaacctccatctggaggggaagtgcgagacctgcgtttacaacatgatgggcaaacgagagaagaagctgggggagttcggcaaggccaagggctcacgcgccatttggtacatgtggctcggggcgcggttcctagagttcgaggccctgggcttcctcaacgaggatcactggttctcccgcggtaatagcttaagcggtgtggagggggagggcttgcaccgactcggctacatcttacgcgacgtcgggaagaaggagggcggggcgatgtatgcggacgacacggccggctgggacacccggatcacgctggaggaccttaaaaacgaggagatggtgaccaatcacatgaagggggagcacaagaagctggcggaagctatatttaagctgacgtaccagaacaaggtcgtgcgcgtgcagcggcctaccccgcgcggcacagtaatggatataatctcccggcgcgatcagcgcggcagcgggcaggtcgggacctacggactgaacacattcaccaacatggaggctcagttgatccggcagatggagggagagggcatctttaagagtatccaacacctgaccgcaaccgaggagattgcagtgcagaattggctcgcgcgcgtcgggcgggagcgcctgagccgtatggccatctcgggcgatgactgcgtggtgaagcccattgacgaccgcttcgccagcgccctgacggccctcaatgacatgggaaaggtccggaaggacattcagcagtgggaaccctcccgcggctggaacgactggacccaggtgcccttttgcagccaccacttccacgagttagtgatgaaggatggtcgggtcctggtggtgccgtgccgcaaccaggacgagctcatcggccgggcgcgcatatcccagggggccgggtggagcctcaaagagaccgcctgcctgggtaagtcctacgcccaaatgtggacactcatgtacttccaccggcgagatctgcggctggctgcgaatgccatctgtagcgccgtaccgtcccattgggtgcccaccagcagaacgacctggagcatccatgccaaacatgaatggatgactacggaagatatgctcgcggtgtggaacagagtctggatccaggagaatccatggatggaggataagacgccggtagagagttgggaggaagtgccctatttaggcaagcgcgaggaccagtggtgtggctccctaatagggctcaccagtcgggccacctgggccaagaatatccagaccgccatcaaccaagtgcgcagcctgatcggcaatgaggaatacacggactacatgccctccatgaagcgcttccggagggaagaagaagaggccggcgtcctgtggtga

SEQ ID NO: 25105 - RNA, 9876 nt, synthetic construct
  misc_feature 1..9876: note = derived and/or modified CDS sequence (opt11) from DENV-2__EU482769__SS-prME
  source 1..9876: mol_type = other RNA
acggcaggggtaattgtgatgctaatacctactgcaatggcattccatctgaccaccaggaacggagaaccccacatgatagtcgggcgccaggaaaaagggaaaagtctactattcaaaactgaagacggggtcaacatgtgtacactgatggcgatcgacctaggggaactatgcgaagacacgatcacttacaaatgccccctcctgcgccaaaacgaaccggaagacatcgactgctggtgtaacagcacgagcacgtgggttacctatggaacttgcacaacaacaggtgaacatagacgcgaaaaacgaagcgtggcgctcgtaccgcacgtaggtatggggttagaaactagaacagagacatggatgtcttccgagggcgcctggaaacacgtccaacggatcgagacatggatcctacggcatcccggcttcacaatcatggcagccatcctcgcctacactataggaacgacgcattttcaacgggcgctaatattcatactactcacggctgttgccccctcaatgacgatgagatgtatcggcataagcaatagagacttcgtcgaaggggtaagcggaggatcatgggtagatatcgtattagagcatgggtcatgcgtaacaaccatggccaaaaacaaaccgacgctggatttcgagctcataaaaacagaagcaaagcaacccgccacactgcgaaaatactgcatcgaagccaagctcacaaataccaccacagaaagccgttgtcccacacagggcgagccatcactgaacgaggagcaggacaaaagattcatctgcaaacactcaatggtagaccgaggatggggcaacggatgcggactgttcggaaaagggggtattgtaacatgcgccatgttcacatgcaaaaagaacatggaggggaaagtagtccaacccgagaatttagaatacactatcgtcatcactccccacagcggggaagaacacgccgtaggcaacgacaccggaaagcacggcaaagaaatcaaaataaccccacagagcagcataaccgaagccgagctaacgggttacggcaccgtcactatggaatgctcaccaagaacgggtttagactttaacgaaatggtgctgctccagatggaggataaagcatggcttgtacataggcaatggttcctagatctaccactcccatggctgccaggcgcggatacccaagggagcaactggatacagaaggagacactcgtaacatttaaaaacccccacgcaaagaaacaggacgttgtagtactggggtcccaagaaggcgctatgcacactgccttgacaggcgcaaccgagatccaaatgagtagtggcaacttactcttcacaggacacttgaagtgcaggcttcgaatggacaagctccaactgaagggcatgagctactcaatgtgcacgggcaaattcaaaattgttaaggaaatagctgaaacccagcacggaacgatagtaatacgagtgcaatacgagggagacggatccccctgcaagattccctttgaaataacagacctcgagaaacgacatgtactaggaagacttatcacagtaaaccccatagttacagaaaaggattctccggtaaatatcgaggccgagccacccttcggggattcatacataataattggtgtggagcccggccagctcaaactgaactggtttaagaaagggtccagcataggacagatgttcgaaaccaccatgagaggggccaagcggatggccatactgggggacactgcctgggacttcgggagtctaggtggcgtcttcacaagcatcggtaaagcgcttcatcaggtgtttggagcgatctatggagcagcgtttagcggggtgagctggaccatgaagattctgatcggcgtaatcatcacttggataggaatgaatagtaggtctacaagtctgagcgtctcacttgtgctagttggcgtagtcacgctttacttgggggccatggtccaagccgacagcggctgtgtggtctcatggaagaacaaagaattaaaatgtggctcggggatattcataactgataacgttcacacctggacagaacagtacaagtttcaaccggaatccccatcgaagctagcatccgcgatccaaaaggcacacgaggaaggcatctgcggaatacgctccgtaacacgcttagaaaatctcatgtggaaacaaatcacccccgagctaaaccatattctgagcgaaaacgaggtcaaactcaccattatgacaggagacatccgcgggataatgcaggcgggaaaacgtagcctaagacctcaacccaccgaactgaaatattcctggaaaacctgggggaaagcgaagatgctttccacggagagccacaaccagacatttctaatcgacggccccgaaacagctgagtgcccgaacacgaacagagcctggaactccctagaagtcgaggattatgggtttggggtcttcacaacaaacatctggctcaagctgcgcgagaagcaagacgtgttctgcgatagtaaactgatgagtgccgcaatcaaagacaatagagcagtacatgctgacatgggctactggatcgagagtgccctaaatgatacctggaaaatggaaaaggcatcgtttatcgaagtgaaatcctgtcactggcccaagtcgcacacactctggagtaacggagtactcgagtcagaaatgatcatccccaaaaacttcgctggacccgtaagccaacacaactaccgacccggctaccacacacagacagcgggaccctggcatttgggtaaactggaaatggactttgacctatgtgaggggacgacagtcgtggtaacggaagattgcggcaacagggggccatccctgaggaccactacagcgtcgggtaagctgatcacggagtggtgctgccgatcgtgcacattaccacccctacgatacagaggggaggatgggtgctggtacggaatggaaataagaccgctgaaggagaaagaggagaacctagtgaatagtctcgtaacggcgggacatgggcagatagataatttttccttaggggtgctcggtatggcgttgttcctggaggagatgttgaggacccgaataggaacaaagcacgccattctcttagtggcagtcagcttcgtaacactaattacagggaacatgagctttagagacctgggcagagttatggtaatggtcggtgccaccatgacggacgacataggcatgggagtgacatacctagccctcttagccgcgttcaaagtgcgccccacgttcgccgcagggctactcctgcgtaaactcacctcgaaggagctcatgatggccacgattggaatagcactcctctcacaaagcacaatcccagaaaccatacttgaacttaccgacgcgctcgcactaggcatgatggtcttgaaaatcgtgcggaacatggaaaagtaccaactggcagtaacgataatggccatatcatgtgtaccgaacgcagtgattctacaaaatgcgtggaaagtcagttgcacaatactagccgctgtcagcgtaagccctttattgctaacatcaagccagcagaaagccgattggatccctctggcactgactatcaagggcttaaatccgacggctatattcttgaccacgttatcccgaacaagcaagaaaagatcgtggcccctaaacgaagcgataatggctgtaggcatggtcagtatactagcatcctccctcctcaaaaacgacataccaatgacaggtcccctcgttgcaggcggattgctaacagtatgttacgtgctaacaggccgcagcgccgaccttgagctcgagcgggccgcagatgtcaagtgggaggaccaagcagagatttcggggagcagtccaattcttagcatcacaatatcagaagatggaagtatgtcgatcaaaaacgaagaggaggagcagaccctaacgatactcatccgaacagggctgctggtgatctccggagtattcccagtatctatacccatcacagcggcggcgtggtatctctgggaggtcaagaaacaacgcgcaggagtgctatgggacgtaccatcaccaccacccgtggagaaagcggaactagaggacggagcgtacaggataaaacaaagaggaatattaggctatagccagatcggggctggggtgtacaaagaaggaacgttccacacaatgtggcacgtcacccgtggcgcagtactaatgcaccgcggcaaacgcatagagccgagttgggcagacgtgaaaaaggacctcatatcctatgggggaggctggaagctcgaaggagaatggaaagagggcgaagaggtacaagtactagccctagaacccggcaaaaacccaagagcagttcaaaccaaacccggaatcttcaaaaccaacacaggaacgatcggagcagtctcacttgatttctcacccgggacatcaggaagtccaatcgtagatagaaagggaaaggtagttgggttatacggcaacggggtggtcacgagaagcggcgcctacgtctcggccatagcgcagaccgaaaagtcgatcgaggacaaccccgaaatagaagatgatatcttccggaaaaagcggctgaccattatggatctccacccgggggcgggaaaaacgaaacggtacctcccggccatagtaagggaggccataaagcgcggtctacgaactttgatcctggcgccgacacgggtagtcgccgcggaaatggaagaggcactacgcggccttccgatacgctaccaaaccaccgccatcaaaactgaacacacgggccgcgagattgtcgatttaatgtgccatgccacgttcacgatgcgcttactgtccccagtgagagtgcctaactacaaccttattatcatggacgaagcccatttcaccgatcccgcaagcatcgccgctaggggctacataagcacacgagtcgaaatgggggaagcagctggaatcttcatgactgccacgccgccaggaagtagggacccgttcccacaatcgaacgcacccataatggacgaagaacgagaaattccagagcggagctggaacagtggacacgaatgggttactgactttaagggtaagactgtttggtttgtgccgagcatcaaggcgggcaatgacatcgccgcatgcctgcgaaagaacggcaagaaggtgatccagttgtccagaaagacgtttgacagcgagtacgtgaagacacgggcaaacgactgggacttcgtcgtgacaacagatatcagcgaaatgggagctaattttaaagccgaacgagtaattgacccgagacgctgcatgaaaccggtgatccttacggacggagaggagagagtcatactagcggggccgatgccagtaactcacagctcggcagcccaacgccgaggccgaatagggcggaaccccaaaaacgaaaacgatcagtacatatacatgggtgagcccttagaaaacgacgaggattgcgcgcactggaaagaggcgaaaatgctgctggacaacataaacacgcccgaagggatcatcccctctatgtttgagcccgaacgtgagaaagtggacgcgatcgacggcgagtatcgcttgagaggggaagcgaggaagaccttcgtggacttgatgcgccgaggcgacctgccggtctggctagcctacaaagtcgcagcggaaggaataaactacgcggaccgcaagtggtgctttgatgggataaagaacaaccaaattctcgaggagaacatggaagtggaaatctggaccaaagaaggtgagaggaagaaactgaagccgaggtggctcgacgccagaatatacagcgatccactcgcacttaaggagttcaaagaatttgccgctggccgcaagtccctcacgttgaacctcatcaccgaaatgggcagactaccaaccttcatgactcagaaagcaaggaacgccctcgacaatctcgcagtgctccacacggccgaggccggcggcagagcgtataatcacgcactctccgaactgccagaaacactcgagaccctgctgctcctcacactcctggcgacagtgaccggaggaatcttcctgtttctaatgtcggggaagggcatcggcaaaatgaccctaggcatgtgttgtataatcacagcgagtattctcctttggtacgcccaaatccaaccacactggatagcggcatcgataatcctagagttcttcttgattgtgctcttgatcccggaacccgaaaaacagcgaacgccccaggacaaccaattaacgtacgtcgtgattgccatcctaaccgttgtagcggccactatggccaacgagatgggattcctggagaaaacaaagaaagacctgggtctaggctctatcaccacacaagagagcgaatctaacatcctcgatatagatctacgaccggcctcggcgtggactttatacgcggttgccacaacattcgtcacccccatgctcaggcactcaattgaaaacagctcagtaaacgtaagtctgaccgccatcgcaaaccaagcaacggtactgatgggcttaggtaaaggctggccactatcaaaaatggacataggcgttcctctactggcgataggttgctattctcaagtaaacccgataacgttgacagccgctctactgcttttggtagctcactacgccataatcgggcccggcctacaagcaaaagcgaccagagaggcccaaaagcgagcggcggctggcataatgaaaaaccccactgtagacggaataacagtcattgacctcgagccaatcccttacgacccaaagttcgaaaagcagctggggcaagtgatgcttctaatcctctgcgtgacacaagtcctaatgatgcggacaacttgggccctctgcgaggccctcacgctagcgacagggccgatatccacgctctgggagggcaaccccggccgattttggaatacgacaatagccgtaagcatggcgaacatattccgaggtagctacttagcgggtgccggactcctgttcagcataatgaaaaacactaccaatacacgacggggtacaggcaacatcggcgagacgttgggagagaaatggaaatccagactgaacgcgcttgggaagtccgagttccagatttataagaaatcaggcatccaagaagtagatagaacactagcgaaagagggtataaaaaggggagagaccgaccaccacgcggtcagccgcggctccgcaaaactgcgatggttcgttgagcgcaacatggtcaccccagaagggaaggtagtagacctaggctgcggacggggcgggtggtcatactactgcgggggactcaaaaacgtaagagaggtgaaaggtctaactaagggagggcctgggcacgaagaaccgatcccaatgagtacgtacggttggaacctggtaagacttcagagcggggtagatgtcttctttaccccgcccgaaaagtgtgacactttactctgcgatatcggagagtcatcacccaacccaaccatcgaggcggggcggactctcagggtcctgaacctcgtagagaactggctaaacaataacacacagttctgcattaaagtcctaaacccgtatatgccgtccgtaatagaaaagatggaagctctacagcgtaaatacggcggggccctggtccgaaacccgctcagcagaaactccacccacgaaatgtactgggtgagcaacgcaacgggtaatatagtgtcgtcggttaacatgatatcaagaatgcttattaacaggttcacaatgaaacacaaaaaggcaacgtacgaaccagacgtggacctaggctcggggacccgcaatatcggtatagaaagcgaaatcccgaatctggacataatcggaaagcggatcgagaaaatcaagcaagaacacgaaacatcttggcactatgaccaggatcacccttataaaacctgggcttaccacggcagctacgagactaaacagacggggagcgcaagcagcatggtaaacggggtagtgcgacttctcaccaaaccatgggatgtcgtccccatggtcacacaaatggccatgacggacacaacccccttcggtcagcaaagggtatttaaggagaaagtagacacccgaacgcaggagcccaaagaaggaactaagaaattgatgaaaatcaccgcggaatggctttggaaagagctcggcaagaagaaaacaccgcgcatgtgtacaagagaagagttcacacggaaagtacgatcaaacgcagcactgggggcaatttttaccgacgaaaacaagtggaagagtgcacgggaagcagtcgaagacgggcgcttctgggagctagtagaccgagaacgaaatttgcacctagagggcaaatgcgagacttgcgtatataacatgatggggaaacgagagaagaagctaggagagtttggcaaagccaaaggctctagagcaatatggtacatgtggctaggagccagattcctcgagttcgaggcgctggggttccttaacgaagaccactggttcagcagaggaaatagtttatctggagtagagggagaaggactccaccgcctgggctacatcttaagagacgtggggaagaaagaaggaggggcgatgtatgccgacgatacggccggatgggacacaaggataacgctagaggacctgaagaacgaggaaatggtaacgaaccacatgaagggcgaacacaaaaagttggcagaagcaatattcaagctgacctatcagaataaagtcgtgcgagtccagcgtccaaccccacgagggacagttatggatattattagcagacgagaccaaagagggagcggacaagtcggaacctacggattaaacaccttcaccaacatggaagcccagctcataagacaaatggagggagaaggaatatttaaatccatccaacacctcactgccacagaagaaatcgccgtgcaaaactggctggcccgtgtaggccgcgagagactctcacgaatggcaatttccggcgacgactgtgttgtgaagcccatagatgaccgctttgcctcagccctaactgcgttgaatgatatggggaaggtccggaaagacatccaacaatgggagccttcacgcggttggaatgactggacgcaagtgccgttttgcagccaccactttcatgagttggtaatgaaggacggacgagtgctagtcgtgccctgccggaaccaagacgagcttataggtagagcaagaataagccaaggtgcagggtggagcttaaaagaaacagcctgtctcggcaaatcatacgcgcagatgtggacccttatgtacttccacaggagagatctcagactagctgcgaacgcaatctgtagcgcggtcccatcccactgggtccccacgtcccgaacgacttggtctatacacgccaaacatgaatggatgaccaccgaagatatgcttgctgtatggaatcgagtgtggatacaagaaaatccatggatggaagacaagaccccagtcgaatcatgggaagaagttccttatctgggcaaacgcgaggaccagtggtgcggcagcatgatcgggctgacctcaagagcgacgtgggccaaaaacattcagactgccatcaaccaggtccgatcactcatcggcaacgaagagtacatagactacatgccatccatgaagcggttccgaagagaagaagaagaggccggtgtgttatggtaa

SEQ ID NO: 25106 - RNA, 9876 nt, synthetic construct
  misc_feature 1..9876: note = derived and/or modified CDS sequence (opt11) from DENV-2__EU482696__SS-prME
  source 1..9876: mol_type = other RNA
accgcgggcgtgatagtcatgctgatccccacggccatggcgttccacttaaccactcgtaacggggagccacacatgatcgtgggtcggcaggagaagggtaagtccctgctgttcaagaccgaggacggcgtgaacatgtgtaccctaatggctatcgatctgggggaactttgcgaagataccattacctacaaatgccccctcctgcgccagaatgagccagaggatatagactgttggtgtaacagcaccagcacctgggtcacctatgggacctgcaccaccacgggcgagcaccggcgcgagaagcgctccgtcgccctggtccctcacgtcgggatgggcttagagacccgtaccgaaacctggatgagcagcgagggggcctggaagcacgtgcagcgtatcgaaacttggattctgcgccatcctggtttcaccatcatggccgcgatattggcctacacgatagggaccacccacttccagcgcgccctgatattcatcctgttaaccgctgtggcgccctcaatgacaatgagatgcatcggcatctctaatcgggatttcgtcgagggggtgtcagggggatcttgggtggacatcgtcctcgagcacgggagctgcgtgaccacgatggcgaagaacaagccgacgctggacttcgagctgatcaaaaccgaggccaaacaacccgccacactacgcaagtactgcattgaagccaagttaacgaacaccaccacagagtcccggtgtccgacccagggagagcccagcctaaatgaggagcaggacaagcgcttcatctgcaagcactccatggtcgacaggggttgggggaacggctgcgggctttttggcaaaggagggatcgtaacctgcgctatgttcacatgcaagaagaacatggagggcaaggtggtgcagccagagaacttagaatacacgatcgtcatcacaccccacagcggggaggagcacgccgtgggtaacgacaccggcaagcacggcaaggagatcaagatcacaccccaatccagtatcacggaggcagagctgaccggttacggaacggtcaccatggagtgcagcccccggaccggtctcgacttcaacgagatggtcctgcttcagatggaggacaaggcctggctcgttcatcgacagtggttcctggacctgccccttccctggctgcctggcgccgacacccagggctccaactggatccagaaggagacgctcgtaaccttcaagaacccccacgcgaaaaagcaggacgtcgtcgtcctcgggagtcaggagggcgcaatgcacacagccctgaccggggccacggagatccagatgagcagcggcaacctactattcactggccacctgaagtgcagattgcgaatggacaagctccagttaaaaggtatgtcgtactcgatgtgcaccggcaaattcaaaatcgtgaaggagatcgccgagacccagcacgggactatcgtgatccgcgttcaatacgagggcgacgggtccccgtgcaagatcccattcgagatcaccgatctggagaagaggcacgtgctcgggcgcttaatcaccgtgaacccgatcgtcaccgagaaggatagccctgtgaacatcgaggcagagccgcccttcggcgactcctacattatcatcggcgtggagccgggccagcttaaacttaactggttcaagaagggtagctctatcggtcagatgtttgaaacgaccatgcgcggcgccaagcgaatggccatactgggagacacagcctgggacttcggcagcctcgggggcgtcttcacatcaatcgggaaggctctccaccaggtgttcggtgcgatctacggcgccgccttcagtggggtgtcctggacgatgaagatccttataggcgttatcatcacctggatcggaatgaatagcagatcgaccagcctgtccgttagcctggtgctggtcggagtggtgacactgtacctcggggccatggtccaggcggactccggctgcgtagcttcctggaagaacaaagaacttaagtgcggttccgggatattcattaccgataacgtccacacctggaccgagcagtacaagttccagccggaaagcccctctaaactggcctccgccatccagaaggcccacgaggagggcatctgcgggatccggagcgtcacccgcctggaaaacctcatgtggaagcaaatcacgcccgagctgaatcacatcctgtccgagaacgaggtgaagctcaccatcatgaccggcgatatcaaggggatcatgcaggctggaaagcggagcctgcgcccgcagccgaccgagctgaaatactcctggaagacgtggggcaaggccaaaatgctctctaccgaatctcacaaccagacattcttaatcgacgggccggagaccgctgagtgcccgaacacgaatcgggcctggaacagcctggaggttgaggactacggcttcggggtattcacaactaacatctggctcaagttgagggagaagcaggacgtgttttgcgactccaagctaatgagcgccgcgataaaggacaaccgggccgttcacgcagacatgggatactggatcgaatccgccttaaatgacacctggaagatggagaaagcgagcttcatcgaggttaagtcctgccactggcctaagtcccacaccctgtggtccaatggagttctggagagcgagatgataatccccaagaacttcgcggggccagtgtcccaacacaactacagaccgggctatcacacacagaccgccgggccgtggcacctcggcaagctggagatggactttgacctgtgtgaggggaccaccgtcgtggtcactgaggactgtggcaaccgcggtccctcactccggaccaccacagccagtgggaagctgatcacggagtggtgctgccggtcgtgcaccctgcctccgctccgctaccggggcgaggacgggtgctggtacggcatggaaatccgccccctgaaggagaaggaggagaacctcgtcaattctcttgtcaccgcgggtcacggccagatcgacaatttctccctgggagtgctcgggatggccctattcctggaggagatgctgcggacccgcatcggcaccaagcacgctactctcctagtcgccgtgtccttcgtgaccctgataaccgggaacatgtccttccgagacctcggcagggtgatggtgatggtaggggctacgatgacagacgatatcggcatgggcgtcacctacctggccctgctcgcggccttcaaagtgcgccctaccttcgccgccgggctgctactccggaaacttacgtctaaggagttgatgatggccacaatcggcatcgcactcctgtcccagagcaccattccggaaaccatcctggaactcacggatgccctggcccttggcatgatggtgctcaagatagtccgtaacatggagaaataccagctggcagtgactatcatggcaatatcctgcgtgcctaatgcggtaatcctgcagaatgcctggaaggtttcctgcaccatcctcgccgccgtttccgttagccccctgctgctcacctccagccaacagaaggcggactggatccctctggccctgacgatcaagggcctcaaccctacggccattttcctgaccaccctgtcaaggacgagcaagaagaggtcctggccgctcaacgaggccatcatggccgtgggtatggtcagcatcctggcttccagccttctcaagaatgatatccccatgaccgggccgctggtagccggcgggctgctcaccgtgtgctacgtgctgaccgggcggtccgccgatctggagctcgagcgtgccgccgacgttaagtgggaggaccaggcggaaatctccgggagctcacccatactgagcatcaccatctccgaggatggttccatgtccatcaagaacgaggaggaggagcaaaccctgaccatcctcataaggaccggcctcctggtgatcagcggcgtctttccggtatccatccccataaccgccgccgcatggtacctttgggaggttaaaaagcagcgcgccggcgtgctatgggacgtgcccagcccgccgcctgtggagaaggcggagttagaggatggggcctatcggatcaaacagcgcggcatcctggggtactcgcagatcggcgcgggagtctacaaagagggcacgtttcatactatgtggcacgtgacccgaggggccgtgctgatgcaccgaggaaagcggatcgagccctcttgggcagacgtcaagaaggacctcatctcctacggtggtggctggaagctcgaaggggagtggaaagagggggaggaggtccaggtgctggcattagagcctggcaagaacccccgcgcagtccagaccaagcccggaacgttcaaaaccaatacaggcactataggtgccgtgagcctcgacttctcccccggcacgagcggcagcccaatcgtggaccggaagggtaaggtcgtggggctctacgggaacggcgtcgtaacccgcagcggcgcctacgtgtccgccatcgcccagacagagaaaagcatcgaggataatcccgagattgaagacgacatcttccggaagaagcgcctgaccatcatggacctgcaccccggcgccgggaagacgaagcggtatcttcccgccattgtccgcgaggctatcaagcgggggctgagaaccctgatcctcgcgccaactcgcgttgttgccgccgagatggaagaggccctgcggggcctgcccatccgctaccagacccctgccatcaagacggagcacaccgggcgggagattgtggacctcatgtgccacgcgacgttcacgatgagactgctgagccccgttcgcgtgccgaactacaacctcatcatcatggacgaagcccacttcacagaccccgcttccatcgcggcgcgcggctacatcagcacccgcgtggagatgggcgaagctgccgggatcttcatgacggccacgccgcccggctcccgcgacccgttcccccagagcaacgcacccatcatggacgaggagcgggagatccccgagcgctcctggaacagtgggcacgagtgggtcaccgacttcaagggcaagaccgtatggttcgtcccgtcaatcaaggcgggaaacgacattgccgcttgcctgcggaaaaatgggaagaaggtcatccagttaagcagaaagactttcgattccgaatacgtaaagacacgagccaacgactgggactttgtggtcacgacagatatctcagagatgggcgccaacttcaaagcagagcgcgtgattgacccacgacgctgcatgaagcccgtaatcctcacggacggggaggagcgcgttatcctcgccggccccatgccggtgacccactcgagcgccgcccagcgccgggggcgcataggccgcaatcccaagaatgagaacgaccagtacatatacatgggagagccgctggagaacgacgaggactgcgcacattggaaggaggcgaaaatgctcctggacaacattaacacgccggaggggatcatcccgtccatgttcgagcctgagagagagaaggtggatgcgatcgatggcgagtatagactgcgtggggaggcccgcaagacattcgtcgacttgatgcggcgcggcgacctgcccgtgtggctagcctacaaggtagccgcggaagggatcaactatgcagaccggaagtggtgcttcgatggcataaagaacaatcaaatcttagaggagaacatggaggtcgaaatctggactaaggagggggaacgcaagaagctgaaaccgcggtggcttgacgccagaatctactcggacccgctcgcgctgaaggagttcaaggaatttgcggctggtcggaagtccctgaccctcaaccttatcacggagatgggtaggcttcccaccttcatgacgcagaaagcccggaacgcgctcgacaatctggccgtgctgcacaccgcggaggccgggggccgagcatacaaccacgccctcagcgagctgcccgagacgcttgagaccctcctgctgctcacccttctggccacggtgactgggggtatattcctcttcctgatgtccggtaaaggtataggtaagatgacgttggggatgtgctgcatcatcaccgcgtctatactgctgtggtacgcccagattcagccacactggatcgccgcctccatcatcctggagttcttcctcatcgtcctgctgatcccggaacctgagaaacagcgtacgccacaggacaaccagctcacctacgtagtcatcgcgatcctgacggtggtggcggcgaccatggccaacgagatgggcttcctggagaagaccaagaaagacctcggtctgggcagcataaccacgcaggagagcgagtccaacatcctcgacattgacttgcgcccggccagcgcttggacgttgtacgcggtcgcgacaacattcgtaacgcccatgctgcggcattccattgagaacagctcggtgaacgtcagcctcaccgccattgccaaccaggcgaccgtgttgatgggcctggggaaaggctggcccctctccaagatggacatcggtgtgcccctgttggccataggatgctacagccaggtcaacccgatcaccctcacggccgcgctcctgttgctggtggcccactacgcgattatagggcccggcctgcaagccaaggctaccagggaagcccaaaaacgggccgcggcaggaatcatgaagaaccccaccgtagacgggattaccgtcatcgacctcgaacccatcccttatgatccaaagttcgagaagcagctgggccaagttatgcttctcatactgtgcgtgacgcaggtcctaatgatgcgcaccacctgggccctctgcgaggccttaaccctggccacggggcccatctccaccctctgggaaggaaatcccgggaggttctggaatacaactatcgcggtcagcatggctaacatcttccgcggttcttacctggccggcgctgggctcctcttcagcattatgaaaaacacaacctccacccgacggggcactgggaacatcggcgagacgctgggtgagaagtggaagtcgcgcctgaatgcgctcggcaaatctgagttccagatctacaagaagtccggaatccaagaagttgaccggaccctggccaaggaggggattaagcgcggcgagacagatcaccacgccgtcagtcggggaagcgccaagctcaggtggttcgtagagcggaatatggtgaccccggagggcaaggtcgtggacctcgggtgcgggcgcggtgggtggtcctactactgcgggggtctcaagaacgtgcgggaagttaagggccttacgaagggaggccccggccacgaggagcccatccccatgtcaacctacgggtggaacctagtgcgcctgcagagcggcgtggacgtcttcttcaccccgcccgaaaagtgcgacaccctgctttgcgacatcggggagtccagccccaaccccaccatcgaggccggccggacgctccgcgttctgaatttggtagagaactggttgaataacaacacacaattctgcatcaaggtccttaacccgtacatgccctcagtgatcgagaagatggaggccctccagcggaagtatggcggtgccctggtacgcaacccactgagccggaactccacccacgagatgtattgggtcagcaacgccactggcaacatcgtgtccagcgtgaacatgatctcccgcatgctgataaaccgtttcacgatgaagcacaagaaggccacgtacgagccggacgttgacctcgggagcggcacccgcaatattgggatcgaatccgagatccccaatttggacatcatcggcaagcggatcgagaagatcaagcaggagcacgagaccagctggcactacgatcaggatcatccctacaaaacgtgggcctatcacggatcgtacgaaactaagcagaccgggagcgccagtagcatggtgaacggcgtggtccgcctgctcacgaagccctgggacgtggtgccgatggtgacacagatggcaatgaccgacaccacccccttcgggcagcagcgcgtgttcaaggagaaggtggacacgcggacccaggagcccaaggagggcaccaagaagctgatgaagatcaccgccgagtggttatggaaagaactcggcaagaagaagacgccccgcatgtgcacacgggaggagttcacgcgcaaggtccggtcgaatgccgcgctgggggcaatcttcaccgacgagaataagtggaagtccgcccgcgaagccgtggaggacggccggttttgggagctagtagacagagagcggaacctacacctagaggggaagtgcgagacttgcgtctataacatgatgggcaaacgcgagaaaaagctgggggagtttggcaaggccaaggggtctcgggcaatttggtacatgtggctcggggctcgtttcctcgagttcgaggccctaggattcctgaacgaagaccactggttcagccggggcaacagcctcagtggcgtagaaggggagggtctgcatcgcttaggctacattctgcgggacgtcagcaagaaggagggcggcgccatgtacgccgacgacaccgcggggtgggacacccgtatcacgctggaggacctgaaaaatgaagagatggtcacgaaccacatgaagggcgagcataagaagctagccgaggccatcttcaagctaacctaccagaacaaggtggtccgggtgcaacgcccgacgcccagagggatagtcatggacatcatctcgcgccgggaccagcgcggctctggccaggtcgggacctatggcctcaacacgttcaccaacatggaggcccagctgatccgccagatggagggggagggcattttcaagtccatccagcacctgaccgccgctgaggagatcgtggtgcagaattggctagcgcgggtcggccgcgagcggctgagtaggatggccatcagcggggacgactgcgtggtgaaacccatcgacgaccggttcgcctccgccctgaccgcgctcaacgacatgggcaaggtccgcaaggacatccagcagtgggagccctcccgggggtggaacgactggacccaggtcccgttttgctcccaccactttcatgagctggtgatgaaggatggcagagtcctggtagtcccttgtaggaaccaggacgagctcatcgggcgagcccggatctcccagggcgcaggttggtcactcaaggagacagcctgcctgggtaaatcctatgcacaaatgtggaccctcatgtactttcaccgccgggacctgcgcctggcggccaacgccatctgcagcgccgtgccctcacactgggtccctacctcacgaaccacatggtccatccacgccaagcacgagtggatgactaccgaagacatgctcgccgtatggaaccgcgtctggatccaggagaatccgtggatggaggacaagacccccgtggagagctgggaggaggtgccctatttggggaagcgggaggaccagtggtgcgggagcctcatcggcctgacgtcccgcgccacctgggccaagaacatccagaccgctatcaaccaggtacggagcctgatcgggaatgaagagtacaccgactacatgccatccatgaagcgattccggcgggaggaggaagaggccggtgtgctgtggtga

SEQ ID NO: 25107 - RNA, 9876 nt, synthetic construct
  misc_feature 1..9876: note = derived and/or modified CDS sequence (opt11) from DENV-2__KC294207__SS-prME
  source 1..9876: mol_type = other RNA
actgcaggggtgatagtcatgctcattccgaccgcgatggcattccacttgaccacgcgaaacggggaaccccatatgatagtggggaggcaggaaaaaggaaaaagcctcctatttaaaaccgaagatggggtgaacatgtgtacactaatggcgatcgacctaggcgaactctgcgaagatacaataacgtacaaatgtcccctgcttaggcagaacgaaccggaagacattgactgctggtgcaattcgacgtcaacgtgggttacctacggaacctgcacgacgactggggagcacaggcgggaaaaacggagcgtcgcacttgtcccgcacgtaggcatgggcctggaaacaaggactgaaacgtggatgagtagcgagggagcgtggaaacatgtgcagcgcatagaaacatggatactccgtcatcccgggttcaccattatggccgcaatactagcgtatacgataggaacgacccattttcagagggcgctcatattcatcctactcacagccgtcgcaccgagcatgacgatgcgctgcataggtatatcaaatcgagactttgtagaaggcgtgagcggaggctcttgggtggacatagtcctagagcacggctcctgcgtaacgacaatggcgaaaaacaaaccgacactagacttcgaactgattaaaacagaggcaaaacaacccgctacgctccgaaaatattgcatagaagcaaaactcacaaacacgacaacagaatcgaggtgccccactcaaggggagccaagcctaaacgaggaacaagacaaacgcttcatatgcaaacacagtatggtagacaggggttggggtaatgggtgcgggctgttcgggaaaggcgggatcgttacgtgcgctatgtttacatgcaagaaaaacatggaaggcaaaatagtccaaccagaaaacctggaatacacaatagtgattacgccacactcaggcgaggaacatgcggtcggcaacgacaccggaaaacacggtaaagaaatcaaaataacaccccaaagtagtacaaccgaggcggagcttactgggtacgggaccgttaccatggagtgtagtcctcgtacagggctggatttcaatgaaatggttcttctacaaatggaggacaaagcgtggctggtccacaggcagtggttcctcgacctccccctcccgtggctcccaggggctgacacacaaggatctaattggatccaaaaggaaaccctagtgaccttcaaaaacccccacgctaagaagcaggacgtcgtcgttttaggctcgcaagaaggcgcaatgcacaccgccctaactggagcaaccgaaatccagatgtcgagtgggaacctcctgtttacgggacatctaaaatgccgactgagaatggacaaactacagctcaagggcatgagctattgtatgtgtacagggaaatttaagatcgttaaggaaatagcagagacacaacacggtacaatagtcatacgcgtacaatatgaaggggacggctcaccctgcaagattcccttcgagataacggacctggaaaagcgacacgtcctaggacgcctgatcacagtcaaccctatagttaccgaaaaggactcacccgtaaatatcgaagcagaaccgccgtttggggactcgtatataatcgtcggtgtagagccaggccagttgaaactaaactggttcaagaagggaagtagcatcgggcagatgtttgagaccacaatgcggggcgccaagcgaatggcaatcctgggagataccgcctgggacttcggatcactgggaggggttttcacatctatcggtaaagctctacaccaggtattcggcgcgatatacggcgccgcattctccggcgtatcctggaccatgaagatactgatcggggtcatcataacctggatcggcatgaactcgagaagcacgagccttagcgttagtttggtccttgtgggagtagtgaccttatatctaggcgccatggtgcaagccgactctggttgcattgtgagctggaaaaacaaagaacttaagtgtggatcggggattttcataacggacaacgttcacacttggacagaacaatacaaattccaacctgagtcccccagcaagctggcttcagcaatacagaaggcccacgaggaaggaatctgtggaatcagatcagtaacacgattagaaaacctcatgtggaagcaaataacaccggaactcaaccacatactaagcgagaacgaagtgaaactaaccatcatgacgggagatataaagggcattatgcaagcgggaaaaagatccctgcgcccgcaaccgacggaattaaagtatagctggaaaacttgggggaaggcaaagatgttatccacggaaagccacaatcaaaccttcttaatagacggcccggaaacagcagaatgcccgaacactaaccgcgcatggaatagcctagaggttgaagactacgggttcggcgtgttcacaaccaacatctggctaaagctgagggaaaaacaggatgtattctgtgactccaaactgatgagtgcggctatcaaagacaaccgtgccgtccacgccgacatgggatactggatcgagagcgcgctgaacgacacgtggaagatggagaaggcgtcattcattgaggttaaaagttgtcactggcccaagtcgcacacactttggagtaacggcgtcctagagtcagaaatgattattccgaagaatttcgccggccccgtttctcaacacaactacagaccgggttatcacacacaaacagccggcccaggacacctaggcaaactggaaatggacttcgacctgtgtgagggaacaacggtagtcgtcaccgaagactgcgggaaccgtggaccatctttgcggacaacaacagccagcggaaaactaatcaccgagtggtgctgcaggtcatgcacccttcctccacttcgataccgaggagaggatggatgttggtacggaatggagatcagaccactaaaagagaaagaagaaaacctcgtaaatagcctggttaccgcaggccacggacagatcgacaacttttcgctaggagtcttaggcatggcactcttcctagaagaaatgctcaggactcgcgttgggacaaagcacgcaatacttttagtagctttatcatttgtaacactcatcacagggaacatgagcttccgagatctaggccgagtcatggtaatggtgggcgcgacgatgacagacgatattggcatgggtgtaacatacttagcgctactcgctgccttcaaagtccgcccaacgttcgctgccggattattgttaagaaagttgacatccaaagaactcatgatggccaccatcggcatagcactgttgtcacagtccacactccccgagacgatattggagctgactgatgccctggcactaggtatgatggcccttaagatcgtgaggaacatggaaaagtatcaactcgcggtcacgattatggcgatatcgtgtgtcccaaatgccgtgatactccaaaacgcatggaaggtcagttgcactatcttggctgccgtcagcgtatcgcccctactgctgacatcaagccagcagaaagcggactggatccctctcgcactcaccatcaagggactaaaccccacagcgatatttcttaccaccctcagcagaacctccaagaaaaggagttggccattaaacgaggccattatggcggtagggatggtatccatactagcaagctcgctgctcaaaaatgacataccaatgacaggcccgcttgttgccggagggctgcttacagtttgctacgtactcaccggaaggagcgccgacctcgagctagaaagggcggcagatgtgaaatgggaagatcaagcggagataagcgggagcagcccgatactatcaatcaccataagtgaagacggaagcatgtcgatcaaaaatgaagaggaggaacaaactctaactattctgatcaggacgggactactcgtaatctctggcgtgtttccagtctcaattccaatcaccgcggctgcatggtacttgtgggaagtcaagaaacaacgggcaggcgtactctgggatgtaccatccccacccccagtcgggaaagccgaacttgaagacggcgcgtaccggatcaagcaaagagggatactcgggtatagccaaataggagcaggagtctacaaagagggaacctttcacactatgtggcatgtgacccgcggtgcagttctgatgcaccgaggaaagcggatagaaccctcatgggccgacgttaagaaagacttgataagctacggtggcgggtggaaacttgagggcgagtggaaggaaggtgaagaagtccaagtattagcgctcgaaccgggcaagaacccccgcgcagtgcaaaccaagccgggaatcttcaaaacaaatactggtacaattggcgccgtaagcctagacttctccccaggcacaagcggcagccccatagtcgacaggaagggaaaggtagtaggcctatacggaaacggggtcgtaacgagaagcggggcttacgtatcggccatcgcacaaacagagaaaagcatagaagacaacccagagatcgaagatgacatcttcaggaagaagcggctgaccattatggaccttcaccccggggccggcaaaaccaaacgctacctaccggctatcgtgcgcgaagccatcaaacgaggattacgtacgctgatactggccccaacgcgcgttgtagcggctgaaatggaagaagcactccgaggcctccccatccgctaccaaacccctgcaatcagagcagagcacacgggcagggagattgttgacctgatgtgccacgctaccttcacgatgagactactctctccggtccgagtaccaaattacaacctgatcatcatggatgaggcccacttcacagacccagcgagcatagcggcgcgggggtacatctcaacccgcgtcgagatgggcgaagcagcgggaatcttcatgaccgcgactcccccaggcagcagagatccattccctcagtcgaacgctcccatcatggacgaagaacgagaaatcccggagaggagctggaacagcggacacgaatgggtgacggacttcaaagggaaaaccgtttggttcgtgccaagcattaaagcgggaaacgacattgccgcctgcctcagaaagaacggaaagaaagttatccaactttcccgcaaaacatttgacagcgaatatgtcaagactagggcgaacgactgggacttcgtagtcacaaccgacataagcgagatgggagcaaactttaaggcagaacgcgtaatagacccacgccgctgcatgaaaccagtaatactaaccgatggtgaagaacgggttatcctcgccggacccatgccagtaacccacagcagcgcggcccaacgccgtggcagaataggaagaaacccaaagaacgagaacgaccagtatatttatatgggcgagccactagaaaatgacgaagactgcgcccactggaaagaagcaaaaatgctgctcgataacataaacacgccagaaggaataatcccgagcatgttcgagcccgagcgggaaaaagtcgacgctatagacggagaataccgcctgcgaggcgaagcgagaaaaacctttgtggacttaatgcggcgcggagacctaccagtatggttagcatacaaggtcgcagcggaaggaataaactacgcggatcgaaagtggtgttttgacgggatcaaaaacaaccaaatcctagaggaaaatgtagaagttgaaatatggacgaaagaaggagaaagaaagaaactgaagcctcgctggctggacgcgaggatctacagtgaccccctagccctaaaggaatttaaagaatttgccgcgggcaggaaaagcctaacgctaaacctcatcacagaaatggggcgtctacccacgttcatgactcaaaaagcccgcaatgcgctagacaatttggcagtcctgcacacggcggaggtaggagggaaagcgtatacccacgcgctcagtgaactgcccgagacgctcgagacactgctcttgctcacactactggcggccgtcaccgggggaatattcctcttcctcatgtcgggaaaaggcgtgggaaaaatgacactgggcatgtgctgtatcatcaccgcatccatcttactgtggtacgcacagatacaaccgcattggatagccgccagtataattctagagttcttcctaatcgtcctattaatacccgagccagaaaaacagcgaacgccacaagacaaccaattaacgtacgtagtaattgcgatcctaacagtagtcgcagcaacaatggcaaatgagatgggcttcctcgagaaaaccaaaaaggacctcggcttcggcagtataacaacgcaagaaagtgaatcgaatatactcgacatagacctacggccggcgagcgcatggaccctgtatgctgtcgccactacattcgtcaccccaatgctgagacactctatcgaaaattcatcagtaaatgtgagcttaacagcgattgcgaatcaggcaaccgtgttaatgggtctcggtaaaggatggccattgtccaaaatggatattggagtcccgttattagccatcggctgctactctcaggtcaacccaatcacattgacggcggccctcctccttctagtagcccattacgccattataggcccgggactgcaagccaaagcgacacgagaagctcagaaaagggcagccgcaggcatcatgaagaaccccaccgtagacggcatcacagtaatagacctggagcccatcccgtacgacccaaaattcgaaaaacagctaggacaggtcatgctactgatattatgcgtaactcaagttttaatgatgcgaacaacttgggccctttgcgaagcactaacgcttgccacaggaccgatctccacgctgtgggagggtaatccggggaggttctggaacaccacgatcgcagtaagcatggctaacatcttccgaggttcctacctagcaggggccggcctactcttcagtataatgaaaaacacaaccaacacacgccgggggaccggaaacgtaggggaaactctcggggaaaaatggaaaagccggctaaacgcactcgggaaatcagagttccagatatacaaaaagagcggaatccaagaagtagatcggactttagcgaaggaggggatcaaacgcggggaaacggaccaccacgccgtaagccgaggatcggcaaaattacgctggttcgtcgaacgcaatatggtaacgccagagggaaaagtcgtcgaccttggctgcggacggggagggtggagttattactgcggtggactcaaaaacgtccgagaagtcaaaggcctaacgaagggcggcccgggccacgaagaaccaatcccgatgagcacgtacggctggaatctagtcagactccaatccggtgtagatgtgttcttcactccacccgagaaatgcgacacactcctatgcgacataggtgaaagctcaccgaacccaacgattgaggcaggacgcacattgcgagtactcaacctagtagaaaattggttgaacaataatacacaattttgtataaaagtgctgaacccgtatatgccaagcgtcattgaaaagatggaaacgctccagcggaagtacggcggtgccttggtcagaaatccgctgtcacgcaatagcacccatgagatgtactgggtctcgaacgctaccgggaacatagtcagctcggttaatatgatcagccgaatgctgatcaaccgattcaccatgaaacataaaaaggcgacttatgagcccgacgtcgacctaggcagcggtactagaaacatcggaatcgaaagcgaaataccaaacctcgacatcgttggcaagagaatagaaaagatcaagcaggaacatgaaaccagctggcactatgaccaagatcacccatacaagacatgggcataccacggatcatacgaaactaagcaaacaggcagcgcatcaagcatggtgaacggggtagtaagactccttaccaaaccttgggacgtagtacccatggtgacgcagatggcaatgaccgacactacacccttcgggcagcaaagggtcttcaaggaaaaagtcgacacaaggacccaggagcctaaagaggggacgaagaaactcatgaaaatcacagccgaatggctttggaaggaactaggcaaagagaaaacacccaggatgtgcacacgggaagagttcacacgcaaggtccgaagtaacgccgcacttggggccgtatttacagatgaaaacaagtggaagtccgcaagggaagcggttgaggacggtcgattctgggagttagtggatcgggaaagaaacctgcatctcgaaggcaaatgcgaaacgtgtgtctacaatatgatgggcaaacgagaaaagaaactgggagagttcggcaaagccaaaggaagccgcgcgatatggtacatgtggctaggcgcccgctttcttgagttcgaggcgctaggcttcttaaacgaagaccactggttttcgcgaggcaattcgcttagcggggtggaaggcgaaggacttcaccggctaggctacatactacgggaggtaggtaagaaagagggaggggccatgtatgccgacgatactgccgggtgggacacccgcatcactctcgaggacctcaaaaacgaggagatggtcacgaaccacatgaagggagagcacaagaaactagccgaggccatattcaaattaacgtatcagaacaaagtggtccgagtccaaaggccaacaccacgcggaacggtgatggacataatctcccgaaaggaccagcgggggtccgggcaagtaggaacctatggactcaataccttcacaaatatggaagcacagttaataaggcagatggagggggagggaatattcaaaagtatccaacacttgacagcgactgaggaaatcgcagtacaaaattggctagcacgtgtggggcgggagaggctcagtcgtatggctatatcgggggatgattgcgtcgtaaagccaatcgacgaccgatttgcctccgcgttaaccgcgctcaatgatatggggaaagtacgaaaagacatccaacaatgggaaccctcacgaggatggaacgattggacccaggtgcccttttgctcccaccacttccacgagctcgtcatgaaagacgggagagtgctggtggttccatgccgtaaccaagatgaactcatcgggagggcgcgtattagtcagggcgccggatggagcctgaaggaaaccgcatgcctaggcaaatcatacgcccaaatgtggacactgatgtactttcacaggagagacctccggctcgctgcgaatgccatttgcagcgcagtgccctcccactgggtcccaacctcgaggacaacctggagcatccatgctaaacacgagtggatgactaccgaagacatgctagtcgtatggaacagggtgtggattcaggaaaacccttggatggaagacaagacaccggtggagagttgggaagaagtaccttacctcggcaaacgcgaggatcaatggtgcgggagcttaattgggctgaccagtagggcaacctgggcgaaaaacatccagacggcaataaaccaagtgagatcacttatcggaaacgaagggtacacagactatatgccatcaatgaagcggtttcggcgggaagaagaagaagctggcgtcctatggtaa

SEQ ID NO: 25108 - RNA, 9876 nt, synthetic construct
  misc_feature 1..9876: note = derived and/or modified CDS sequence (opt11) from DENV-2__KC294208__SS-prME
  source 1..9876: mol_type = other RNA
accgccggcgtaatagtcatgctgataccgaccgccatggcgttccacctaaccactcggaacggggagccccacatgatcgtgggacggcaagagaaggggaagtccctgctgttcaagactgaagacggcgtgaacatgtgtacgctcatggctattgaccttggcgagctgtgcgaggacaccatcacgtacaagtgccccttgctgcgccagaacgagcccgaggacatcgactgttggtgcaacagcaccagcacctgggtaacctacggcacctgtaccaccacgggcgagcaccggcgagagaagcgctctgtggccctagtgcctcacgtcggcatgggactcgagacccgcaccgagacttggatgagcagcgaaggggcctggaagcacgtccagcggatcgagacctggatactgcgccacccgggcttcacaatcatggcggcgatactggcctacaccatcgggaccacgcacttccagcgggccctcattttcatcctcctgaccgcggttgcgcccagcatgaccatgcgctgcatcggcatctccaaccgagacttcgtcgaaggcgttagcgggggctcctgggtggacatcgtcctcgagcacggcagctgcgtgaccacgatggccaagaacaagcccaccctggacttcgagctgatcaagaccgaagccaagcagcccgccacccttcgcaagtattgcatcgaggccaagctgaccaacaccaccaccgagtcccggtgcccgacgcagggcgaacctagcctgaacgaggaacaagacaagcgcttcatctgcaagcactcgatggtagaccggggctgggggaacgggtgcgggctgttcggcaagggcgggatcgtaacctgcgcaatgttcacgtgcaagaagaacatggaaggcaagatcgtgcagcccgagaatctagagtacaccatcgtgatcacgccccacagcggggaggaacacgctgtcggcaatgacacagggaagcacggcaaggagatcaagatcaccccgcagtcctcgaccaccgaggctgagctaacgggttacggcaccgtgactatggagtgctccccacggaccggcctcgacttcaatgagatggtattgctgcagatggaggacaaggcctggctcgtccaccggcagtggttcctggacctgccactcccctggctgcctggggcagacacgcaaggctcaaactggattcagaaggagaccctagtgaccttcaagaacccccacgccaagaagcaggacgtggtggtgctaggttcccaggagggcgccatgcacactgccctaacgggcgctacggagatacagatgtccagcggcaacttactgttcaccgggcacctgaagtgccgcttgcggatggacaagctccagctaaaagggatgtcctatagtatgtgcacgggcaagtttaagattgtcaaagaaatagccgagacgcagcacgggaccatcgtgatccgcgtgcagtacgagggcgatggctcaccctgcaagatccccttcgagattaccgaccttgagaagcggcacgtccttggtcgcctgatcaccgttaacccgatagtgacggaaaaggacagccccgtgaatatcgaggccgagccgcccttcggtgactcctacataatcgtgggggtggagccgggccaactgaagctaaactggttcaagaaagggagctccatcggccagatgttcgagacgaccatgcgcggcgccaagcggatggccatcctgggggacacagcctgggactttggcagcctcggcggggtgttcacgtccatcgggaaggccctccaccaagtgttcggggcgatatacggcgccgccttcagcggagtttcctggacgatgaagatcctgatcggcgtgatcatcacctggatcgggatgaacagccgctccacgagcctgagtgtgtccctggtactcgtcggcgtggtcacgctctacctgggcgccatggtccaggcggactctggctgtatcgtgagttggaagaacaaggagcttaagtgcggctccgggatcttcatcaccgacaacgtacacacctggaccgaacagtacaaattccagcctgaaagccccagcaagcttgcctccgccatccagaaggcccacgaggaaggcatttgcggtatcagaagcgtaacgcgccttgagaacctcatgtggaagcagatcacgcccgagctgaaccacatcctgtccgaaaatgaggtgaagctcacgatcatgactggcgacatcaaggggatcatgcaggccggcaagcggagcctgcgcccgcagcccaccgagctgaagtactcctggaaaacctggggcaaggcgaagatgctctccaccgagtctcacaaccaaacgttcctgatcgacgggcccgagacggccgagtgccctaacaccaaccgggcgtggaacagcctggaggtcgaagattacggcttcggagtcttcaccactaacatctggctcaagctgcgagaaaaacaagacgtgttctgcgattccaagctgatgagcgccgccatcaaggacaaccgggcggtgcacgcagacatgggatactggatcgagagtgccctcaacgacacctggaaaatggagaaggccagcttcatcgaggtgaagtcctgccactggcccaagagccacactctgtggtcaaacggcgtcctggagagtgagatgatcatccccaagaacttcgccggccctgtgtcccagcacaactaccgcccgggctaccacacccaaaccgcggggccctggcacctcggcaagctggaaatggacttcgacttttgcgaggggaccacagtcgtggtcaccgaggactgcggcaatcggggcccgtctctgcgcaccaccacggccagcgggaagcttatcaccgagtggtgttgcaggtcttgcaccctgcccccgctgcgctacaggggtgaggacgggtgctggtacggcatggagatccgcccgctcaaggagaaagaagagaaccttgtcaactccctggtgaccgccgggcacggacagatcgacaacttctccctcggagtactggggatggcgctgtttctcgaggagatgctgcgcacgcgcgtcggcaccaagcacgcgatcctgctcgtagccctgagcttcgtgaccctgataaccgggaacatgtccttccgagatcttggtcgcgtcatggttatggtgggcgccacgatgaccgacgacattggcatgggcgttacctacctggccctgctcgccgcgttcaaggtgcgccccacctttgctgctgggctgctgctccggaagctgactagcaaggagctgatgatggccaccatcggcatcgccctcctgtcccagagcaccctgcccgaaaccatcctcgagctgacggacgcgctggcacttgggatgatggccctcaagatcgtacgcaacatggagaagtaccagctggccgtcaccatcatggccatctcttgcgtgccgaacgcggtgatcctgcagaacgcctggaaggtcagctgcaccatactagcggccgtgtccgtaagccctctgctcttaacctcaagccagcagaaggctgactggatacctctggccctcacgatcaagggccttaatcctaccgccatcttcttgaccaccctctcccgtacgagcaagaagcgatcctggccgctgaacgaggccatcatggcagtcggcatggtgagcatactggcatccagcctgctgaagaacgacatcccaatgaccgggcccctggtcgccggcgggctcctgaccgtgtgttatgtgctgacaggccggagcgccgatctcgagctggaacgcgccgccgacgtcaagtgggaggaccaggctgagatctccgggtcatcccccatcctgagcatcacgatatccgaggacgggagcatgtccatcaagaacgaggaggaggagcaaaccctcaccatcctgatccgtaccggtctgcttgtcatcagcggggtattcccggtctccatacccatcaccgccgccgcctggtatctgtgggaggtgaagaagcagcgcgccggagtgctgtgggatgttccgagcccacctccagtggggaaggcggagctcgaggacggcgcctaccggataaagcagcgcgggatcctgggctactcgcagatcggcgctggcgtgtacaaggagggaactttccacactatgtggcatgttacccgcggagccgtgctgatgcacaggggcaaaagaatcgaacctagctgggccgatgtgaagaaggacctcatctcctatgggggcggctggaagctggagggggagtggaaggagggcgaagaggtgcaggtgctagcgctcgagcccgggaagaacccccgcgccgtccagaccaagcccggcatcttcaaaacgaacaccgggaccattggcgccgtcagcctagatttctcccccggtaccagcgggtcccccatcgttgaccggaaaggcaaggtggtcgggctgtacggcaacggcgtggtgacgcggagcggggcctacgtctccgcgatcgcccagactgagaagtcaatcgaagacaaccccgagatcgaggacgatatcttccggaagaagagacttaccatcatggatctgcaccccggcgccgggaagaccaagcggtacctgcccgccatcgtgcgcgaggcaatcaagcggggcctgcgcacgctcattctggcgccgacccgcgtggtcgcagcagagatggaggaggccctgcggggactccccatacgctaccagacccccgccatccgcgcggagcacaccggaagggagatcgtggacctgatgtgccatgccacattcacaatgcgcctgctcagcccggtgcgcgtcccgaactacaacctgatcatcatggacgaggctcacttcaccgaccccgcctcgatcgcggcgcggggctacatctctacacgagtggagatgggggaggccgccggcatcttcatgaccgcgacgccgcccgggtccagggatccattcccccagtcaaatgcgcccatcatggatgaggaacgggagatccccgagcggtcctggaacagcggccacgaatgggtgaccgacttcaaggggaagaccgtctggttcgtgccgtcaatcaaggccggcaacgacatagccgcctgcctacggaagaacggcaagaaagtgatccagctcagtcggaagacgttcgactccgagtacgtcaagacgcgcgccaacgactgggacttcgtggtgaccacggacatcagcgagatgggagcgaacttcaaagctgagcgggtcatcgatccccgccggtgtatgaagcccgtgatcttgacggacggcgaagagcgcgtgatcctggcagggcccatgccggttacccactccagtgccgcacagcggcgcggaagaatcgggcggaaccccaagaacgagaacgaccagtacatctacatgggcgagcccctagagaatgatgaggattgtgcgcactggaaggaggccaagatgctgctggacaacataaacaccccggagggaatcatcccgagtatgttcgagccggaacgtgagaaggtggacgcaatagacggggagtaccggctccgcggagaggcccggaagacatttgtggacctgatgcgccgaggggacctgcccgtctggctcgcttacaaggtggcggccgaggggatcaactacgccgaccgcaagtggtgtttcgacgggatcaagaacaaccagatcctggaggagaacgtggaggtcgaaatctggactaaggaaggcgagcggaagaagttaaagccgcgctggctcgacgcgcggatctacagcgaccccctggcgctgaaagagttcaaggaattcgccgccggccgcaaatccctcaccctgaacctgatcaccgagatgggtcggctcccaaccttcatgacgcagaaggcccgtaacgcactggataacctcgcggtgctccataccgccgaggtgggcgggaaagcctacacccacgcgctgagcgagctgcccgagacactcgaaacgttactgctcctgaccctgctagccgcagtcaccggcggtatcttccttttcctgatgtccggaaagggcatagggaaaatgaccctcggtatgtgctgcataatcaccgcctctatcctgctgtggtatgctcagatccagccgcactggatcgcagcctccatcatcctcgagttctttctgatcgtgctgctcatccccgagcctgagaagcagcggacaccccaggacaatcagctgacctacgtcgtgatcgcaatcctgaccgttgtcgccgccactatggctaacgagatggggttcctcgagaagacaaagaaggacctgggcttcggctccatcaccacccaagaatcagagtccaacatcctggacatcgacctgcgccctgccagcgcgtggactctgtacgccgtcgccacgaccttcgtgaccccaatgctgcggcactccatcgagaatagcagtgtcaacgtgtcgctcacagctatcgcgaaccaggccacggtcctgatgggtctgggcaaggggtggcccctctccaagatggatattggcgtccccctgctggccattgggtgctactcgcaggtgaacccgataaccctcactgccgcactgctgctcctggtcgctcattacgccatcatcggccccggcttgcaggcgaaggcgacccgcgaggcccagaagcgggccgccgctgggatcatgaagaaccccacggtcgacggtatcaccgtgatcgatctcgagcccataccgtacgaccccaagttcgagaagcagctcgggcaagtgatgctcctcatcctgtgcgtcacccaggtgctgatgatgcgcaccacgtgggccctttgcgaggccctgacactggcgaccggcccgatctccaccctctgggagggggacccaggccggttctggaacaccaccatcgcggtcagcatggccaacatcttccgcggatcctacctggccggggcgggtctactgttcagcatcatgaagaacaccacaaatacgcgccgggggaccggcaacgtcggcgagaccctaggggagaaatggaaatcccgcctcaacgctcttggcaagtcagagttccagatctacaagaagtccgggatccaggaggtagaccggaccctggccaaggaggggataaagcgcggggagacggatcaccacgcggtcagccggggctccgcgaagctacgctggttcgtcgagcggaacatggtcaccccggagggcaaggtcgtcgacttggggtgcggcagggggggctggagctactactgcggcggcctgaagaacgtgcgggaggtaaagggcctgacaaagggcggccctgggcatgaagagcccatacccatgtccacctacggctggaacttggtacgtttacagagcggggttgacgtgttcttcacgccgcccgagaagtgcgacacgctgttgtgtgacatcggcgagagcagccctaacccgaccatcgaggcaggccggaccctgcgcgtcctgaatctcgtcgagaactggctgaataacaatacccagttttgcatcaaggtcctgaacccttacatgcccagcgtcatcgagaagatggagacgctccagcggaagtacgggggggcactggtgcgcaaccccctgtcccggaactctacccacgagatgtactgggtgtctaacgccacggggaacatcgtaagctcggtaaacatgattagccgcatgctaatcaatagatttaccatgaagcacaagaaggccacgtacgagccggatgtggacttaggcagtggaacccgcaacatcggcatcgagagcgagatcccaaacctggacatcgtgggtaagcgaatcgagaagatcaaacaggagcacgagacgtcctggcactatgaccaggaccacccctacaaaacgtgggcctaccacgggagctacgagacgaagcagactggctccgccagctccatggtgaacggggttgtccgactactcaccaagccctgggatgtggtgccgatggtcacccagatggctatgacggacaccacccccttcggccagcagcgcgtgttcaaggaaaaggtggacactaggacgcaggagccaaaggagggcaccaagaagctgatgaagatcacagccgagtggttgtggaaagagctcgggaaggagaagaccccccgaatgtgcacacgtgaggagttcacccgcaaggtccggagcaacgccgccctgggcgcggtgttcacggacgagaacaagtggaagtccgcccgcgaggcggtagaagacgggcggttctgggaactggttgatcgcgaacggaacctccacctggagggcaagtgcgaaacctgcgtgtataacatgatggggaaaagggagaagaagctgggcgagttcggcaaagccaaggggtcgcgcgccatctggtacatgtggctcggcgcccgcttcctggagttcgaggccctagggttcctcaacgaggaccactggttctcccggggcaacagcttaagcggcgtcgagggcgagggcctacaccgcctcggttacatcctgcgggaggtaggcaagaaggaaggcggcgcaatgtacgccgacgatacggcgggctgggatacccgcatcaccctggaggacctcaagaacgaggagatggtgacgaaccacatgaagggcgaacacaagaagctggccgaggccatcttcaagctgacgtaccagaacaaggtcgtgcgggtgcagcgcccgacgcccaggggcaccgtaatggacatcatctcccgaaaggaccagcgaggatccggccaggtggggacctatggcctcaacacgttcaccaacatggaggcccagctgatccggcagatggagggcgaggggatcttcaagtccatccagcacctgaccgccaccgaggagatcgcggtgcaaaattggctcgcccgtgttggccgggagcgcttaagcaggatggccatctccggggatgactgcgtagtgaagcccatcgatgaccgattcgccagcgccctgacagcgctcaacgacatgggtaaggtgcggaaggacatccagcagtgggagccatcccgcgggtggaatgactggactcaggtgccgttctgcagccaccacttccacgagctggtgatgaaggacggccgagtcctggtggtgccctgccgcaaccaggacgagctcatcggccgggcccgcatctcacaaggggcgggatggagcctgaaggagaccgcctgcctggggaagtcctacgcccagatgtggaccctcatgtacttccacaggcgcgatctacgcctggccgccaacgccatctgcagcgccgtcccatcccactgggttcccaccagccgcacgacctggtccattcatgcgaagcacgagtggatgactaccgaagacatgctcgtggtttggaacagggtgtggattcaggagaacccgtggatggaggacaagacgcccgtggagtcatgggaggaagtcccatacctgggcaagcgcgaagaccagtggtgcgggtccttgattggcctcacgagccgggcaacctgggccaagaacatccagacggccatcaaccaggtgcggagcctgattggcaacgaggggtatacggactacatgccgtccatgaagcggttccgccgcgaggaagaagaagccggtgtgctgtggtaa

SEQ ID NO: 25109 - RNA, 9876 nt, synthetic construct
  misc_feature 1..9876: note = derived and/or modified CDS sequence (opt11) from DENV-2__KC294209__SS-prME
  source 1..9876: mol_type = other RNA
accgccggcgtcattgtgatgctgatacccaccgctatggcgttccacctcacgacccgcaacggggagccccacatgatcgtggggcgccaggagaagggaaagtccctgctgttcaagaccgaggacggcgttaacatgtgcaccttgatggcaatcgacctaggcgagctgtgtgaagacaccatcacctacaagtgccctctcttgcgccagaacgagcctgaagacattgactgctggtgcaactccacttctacctgggtcacttacgggacctgtaccaccacgggcgaacatcgccgcgagaagcggtccgtcgccctagtgccccacgtcggtatgggcctcgaaactcgcaccgagacctggatgagctccgagggcgcctggaaacatgtgcagcgaatagagacttggatcctgcgtcaccccggcttcaccatcatggccgcgatccttgcctacaccatcgggaccactcatttccaacgagcactcatcttcatcctgctaacagcagtggcgcctagcatgacaatgagatgcattggcatctccaaccgggactttgtcgagggcgtgagcgggggctcctgggttgacatcgtcctcgagcacgggagttgcgtgaccacgatggctaaaaacaagcccaccctggacttcgagctaataaagaccgaggcaaagcagcctgccaccctgcgcaagtactgcatcgaggccaaactgacgaataccaccaccgagtcccgatgccctacccagggagagcctagcctaaacgaggaacaagacaagcgcttcatctgcaagcactccatggtggatcgtgggtgggggaacggctgcgggctgttcggtaagggcgggatcgtgacctgtgcaatgttcacgtgtaagaaaaacatggagggaaagatagtgcagcccgagaacctggagtataccatagtgatcacgccccacagcggtgaggaacacgccgttggcaacgacaccgggaagcatggcaaggagatcaagatcaccccgcagtccagcacaaccgaggccgagctcacggggtacggcaccgtgaccatggaatgcagcccgcggaccggtttagacttcaacgagatggtcctgttacagatggaggataaggcgtggctcgtacacaggcagtggttcctggaccttcctctcccttggctgcccggagccgatactcaggggagcaactggatccagaaggaaaccctagtgaccttcaaaaaccctcacgccaagaaacaggatgtcgtagttctcggatctcaggagggagcaatgcacacagccctgacgggagctaccgaaatccagatgtccagcggcaacctcctgttcacgggccacttaaagtgccgcttgcggatggacaagctccagctaaaggggatgtcctacagcatgtgcaccggcaagtttaagatcgtgaaggagattgctgagacacagcacgggacgattgtaattcgtgtacagtacgagggtgacggctccccctgtaagatcccctttgagataaccgacctagagaaacgccatgtcctcgggagattaatcaccgtgaatcctattgtgacggagaaggacagcccagtcaacatcgaggcagagccgcccttcggagattcctacattatcgtgggggtggaaccgggccagctaaagctcaactggttcaagaaggggagctccatcggccagatgttcgaaactacgatgagaggggccaagagaatggccatcctaggggacacagcctgggactttggctctttaggcggggtcttcacttccataggaaaggccctccaccaggtgttcggtgcgatctatggcgccgccttcagcggggtgagctggacaatgaagatcctgatcggcgtcattatcacctggatcgggatgaacagccgttccacttctctgtccgtgagccttgtcttggtcggcgtcgtgacgctttacctgggggccatggtacaggcggactccggatgcattgtgagctggaagaacaaggagctcaagtgcgggtcggggatctttattacagacaacgtgcacacctggaccgaacagtacaaattccagcccgagagccctagcaaacttgcatccgccatccaaaaggcccacgaagaaggcatctgcgggatccggagcgtcacccgcctggagaacctcatgtggaagcagataaccccagagctgaaccacatcctgagcgagaatgaggtgaaactcaccatcatgacaggtgacatcaaagggatcatgcaagccggcaagagatcactgagaccgcagcccacagagctgaagtacagttggaagacctggggcaaggcgaagatgctgagcaccgagtcccacaaccaaaccttcctgatcgatggacccgagacggccgagtgcccaaacacaaaccgcgcctggaacagcctggaggtcgaggactatggcttcggggttttcacgaccaacatctggctcaagttgcgggaaaagcaggacgtgttctgcgattcaaaacttatgagcgccgccatcaaggacaaccgcgccgtgcacgccgacatggggtactggattgaatccgccctcaacgacacctggaagatggaaaaagccagctttattgaggtcaagtcctgccactggcccaaaagccacacgctgtggtccaatggcgttctggagtctgagatgattatacccaagaacttcgccggacctgtttcacagcataactaccgaccagggtaccacacccagaccgcaggcccctggcacctcggcaagctggagatggactttgacttctgcgaggggaccacggtcgtggtgaccgaggattgcggaaaccggggcccctccctgcgcactaccacggctagcgggaagctcatcacggagtggtgctgccgatcctgcacactgcccccgctgcgctaccggggcgaggacggatgctggtacggcatggagatccgccccttgaaggagaaggaagagaacctagtcaacagcctggtaaccgccgggcacggccaaatcgataactttagtctcggcgtgctggggatggccttattcctcgaggaaatgctgagaacacgagtcggtacgaagcatgcgatcctgctcgtggctctgagcttcgttaccctaatcaccggaaatatgagtttccgagatctcggccgcgttatggtgatggtgggggccacaatgacagatgacataggcatgggagtaacttatttggccttgctggccgcgttcaaagtgcgacccactttcgccgccgggctgcttctccggaagctgacgagcaaagagcttatgatggcaaccatcggcatcgccctcctgtcccaaagcaccctgcccgagactatcctggaactgaccgatgccctcgccctcgggatgatggctctgaaaatcgtgagaaacatggagaaatatcagctagccgtaaccatcatggccatctcctgcgtgccgaacgccgtgatcctccagaacgcctggaaggtcagctgtacgatcttagccgccgtgtccgttagccccctgctcctgaccagttcccagcagaaagcggactggatccctctggcgctcacgatcaagggcctgaacccaaccgcgatttttcttacaaccctctcccggacgagcaagaagcgtagttggccgctaaacgaagccataatggctgtcggcatggtgtcaatcctggcgtctagtttactgaagaacgatatacccatgactgggccgctggtcgccggcggcctcctgaccgtatgttacgtgctgaccgggcgatccgccgatctcgaactggaacgagccgccgacgtcaagtgggaggaccaagcggaaatctccgggagttcccccatcctgtccatcacgatttccgaggatggtagcatgtccatcaagaacgaagaagaagaacaaaccctcaccattcttatccgtaccggcctgctcgtgatttcaggggtgttcccagtctccattcccatcacggccgccgcatggtatttatgggaggtgaagaaacagcgcgccggggtgctgtgggacgtccccagcccgcctccggtggggaaggctgagctcgaagacggagcttaccgaatcaagcagcgcgggatcctgggctacagtcagataggggcgggggtgtataaggagggcacgtttcacacaatgtggcacgtcacccgcggtgctgtactgatgcaccgcgggaagcgaatcgagcccagctgggccgatgtcaagaaggacctcatctcctacggcggaggctggaagctggagggggagtggaaggagggcgaggaggtccaggtactggctttagagcccgggaagaacccccgcgccgttcaaaccaagcccggcatcttcaaaacgaacactgggaccatcggagccgtctcgctggacttctcacctggcaccagtgggtcccccatcgtggaccggaagggcaaggtggtggggctgtacggcaacggcgtggtcaccagaagcggggcctacgtctctgccattgcccagaccgagaaatccatcgaagacaacccggagatcgaggatgacatcttcaggaagaaacgactcacgattatggatcttcacccgggcgccggaaaaaccaagcggtacctacccgccatcgtgcgcgaggccatcaagaggggcctccgcacgctcatcctcgcgcctacgcgcgtggtggccgccgagatggaggaagccctgcgggggctcccgatccgctaccagacccccgccatccgggcggaacacaccggccgagagatcgtggacttgatgtgccatgctactttcacaatgcggttgctctcgccggtgcgcgtccctaattacaacctgatcatcatggacgaggcgcatttcacggaccccgcgtcgatagccgcgcggggttacataagcacccgcgtggagatgggtgaggctgccggcatcttcatgacggctacaccgccggggtcccgagacccgttcccacagagcaatgcgcccatcatggacgaggagcgagaaatccccgagaggtcgtggaacagcggccacgagtgggtgaccgacttcaaggggaaaacggtctggttcgtgccgagcatcaaggccggtaacgacatcgctgcctgcctgcgtaagaacggcaagaaggtgatccagctctcacgaaagaccttcgacagtgagtacgtcaagacccgcgccaatgactgggacttcgtggtgaccactgacatcagcgagatgggggcgaacttcaaagccgagcgggtcatcgacccccgacggtgcatgaaacctgtgatactgacggatggcgaggagcgcgtgatactggcggggcctatgccggttacccactccagcgccgcccagcggcgcggccgcatcggtcgtaaccccaagaacgaaaacgatcaatatatctatatgggtgagcctttagagaacgacgaggactgtgcgcactggaaggaggcgaagatgctgttagataacatcaacacccctgagggcatcatcccgtcgatgttcgagcccgaacgcgagaaagttgacgccatcgacggggagtaccggctcaggggcgaggcccggaagacctttgtggacctgatgcgccgcggggacctgcccgtctggctcgcctacaaggttgcggccgagggcatcaactacgcagaccgtaaatggtgcttcgacgggataaagaacaaccagatcctggaggaaaacgtggaggtcgaaatctggaccaaggagggcgagaggaagaaattaaaaccaagatggctcgacgctcggatttacagcgacccattggcgctgaaggagttcaaggagttcgccgcaggaagaaaatccctcaccctgaacttaatcacggaaatggggcggctccccaccttcatgacgcagaaggcacgcaatgctttagacaacctggcagtgctccacacagccgaggtcggcgggaaggcctacacccacgccttaagcgagctacccgagaccctcgagacgctgctgctcctcaccctgctcgcagcggtcaccggcggcatctttctgttcttgatgtcagggaaaggcgtggggaagatgaccctcggcatgtgctgcattatcacggccagcatcttgctctggtacgctcagatacagccgcactggatcgccgcttcaatcatactcgagttcttcctgatcgtgctgctcatccccgagcccgagaagcagcggacgccccaggacaaccaactcacctacgttgtcattgcaatcctgaccgtcgtggcagccacaatggccaacgaaatggggttcctagagaagacgaagaaagacctaggatttggcagcattaccacccaggagtctgagtccaacatcctggacattgacctccgcccagccagcgcgtggaccttatacgccgtcgccactacattcgtcaccccgatgctgcggcacagtattgaaaattcctccgtaaatgtcagcctcaccgctatcgctaaccaggccacggtcttgatggggcttgggaaggggtggcccctctccaagatggatatcggtgtgcccctgctggccatcgggtgttactcacaggtaaaccccatcaccctcaccgccgccctgctgctcttggtcgcccactacgccatcatcggcccgggcctgcaggctaaggctaccagggaagcccagaagcgggcggccgccggtatcatgaagaatcccacagtggatggcatcaccgtgatagacctcgaacccatcccgtacgaccccaaattcgagaaacagctgggccaggtcatgctgctgatcctgtgcgtcacccaggtactgatgatgcgcaccacgtgggccttgtgtgaagccctaactctggcgaccggccccatctccaccttgtgggaggggaacccgggccggttctggaacactaccatcgccgttagcatggccaacatctttcgaggctcctacctggcaggggcgggcctcctgtttagcatcatgaaaaacaccaccaacacccgccggggaaccggcaacgtgggtgagaccctgggggagaagtggaagtcccgcctgaacgcactcggcaagtctgagttccagatctacaaaaagtcggggatccaagaggtggaccggaccctagccaaggagggaatcaaacgcggggagacggaccaccatgccgtaagccggggttcggctaagctgaggtggttcgttgaaaggaatatggtgacgccggagggcaaggtcgttgacctcgggtgcggtcgcggtggctggagctactactgtgggggcctgaagaacgtgcgagaggtcaagggactgaccaagggcgggcccgggcacgaggaacccatccccatgtccacgtacggttggaacctagtgcgccttcaaagcggcgtcgacgtcttcttcactccgcccgaaaagtgtgacaccctgctgtgcgatatcggcgaaagctcccccaatcccaccatcgaggcgggcagaaccctgcgtgtgctgaacctcgtggaaaattggctgaacaacaacacccaattttgcatcaaggtcctgaacccttacatgccctcagttattgagaagatggagacgctacaaagaaagtatggcggagcccttgtccgtaatccgttaagtcggaactccacccacgagatgtactgggtatccaacgccaccggcaatatcgtgagctctgtcaacatgatcagccgcatgctgattaaccgctttaccatgaagcataagaaggccacgtacgagccggacgtggacctaggcagtgggacccgtaacatcggtatcgaaagcgagatccccaatctagatatagtgggcaaacgtatcgagaagataaaacaagagcacgaaacctcctggcactacgaccaggatcatccctacaagacctgggcctatcacggctcatacgagacgaaacaaacaggctccgcgagctccatggtgaacggggtggtgcgtctgctcaccaagccctgggatgtggtcccgatggtgacccaaatggccatgacggatactaccccattcggccaacaacgggtattcaaagaaaaagtcgacacgcggacgcaggagcctaaggaaggcaccaagaagctgatgaagatcaccgctgagtggctgtggaaggagctcggtaaggagaagacccctcggatgtgcacgcgggaggagttcacccgcaaggttcggagcaacgccgccctgggcgcggtgttcaccgacgagaataaatggaagtccgctcgcgaagccgtggaggacgggcggttctgggagctggtggaccgcgagcgcaatctccacttagagggcaagtgcgagacatgtgtctacaacatgatgggaaagcgggagaagaagctgggggagttcggcaaggctaaggggagccgggcaatttggtatatgtggctcggcgcccgcttcctcgaatttgaggccctggggttcctcaacgaagaccactggttctcccgaggaaattccctgtcaggtgtggagggagagggactgcatcgcctcgggtatatactgcgggaagtgggcaagaaagaaggcggcgccatgtacgccgatgatacggctgggtgggacacccgcataaccctggaagacctgaagaatgaggaaatggtcaccaatcacatgaaaggggaacacaagaaactggcagaggccatctttaagctaacgtaccagaacaaagtggtgcgggttcagcgcccgactccccggggaaccgtgatggacataatctcccgcaaggaccagcggggaagcggtcaggtggggacctacggcctcaatacgttcaccaacatggaggcccagctgatccgccaaatggagggcgaggggatatttaagtccatccagcacctgaccgccaccgaggagatcgcggtccagaactggttggcccgggtgggcagggaacgtctgagccgaatggccatcagtggtgacgattgcgtggtcaagcccatcgacgaccgcttcgccagcgccctgacggcactcaacgacatggggaaggttagaaaggacatccaacagtgggaaccctcccgcgggtggaacgactggacccaggtgccattctgttcacaccactttcacgagttagttatgaaagatggccgagtgctggtggtcccgtgccgcaaccaggatgagctcataggccgcgcccgcataagtcagggtgccggatggagcctgaaggagaccgcctgtctaggtaagtcctacgctcagatgtggacgcttatgtatttccaccggcgcgacctgcgacttgcagccaacgcaatttgcagcgccgtgccatcccattgggtgcccacgagtcggacgacctggtccatacacgcaaagcacgagtggatgaccacggaagacatgctagtcgtgtggaaccgtgtgtggatccaggaaaacccatggatggaggacaaaacgcccgtcgaatcatgggaggaggtgccttacctggggaagcgcgaggaccagtggtgcggttccttgatcggcctcaccagccgggccacctgggccaagaacatccagaccgccatcaatcaagtacgcagcctgattggcaacgaggggtacacagactatatgccgtctatgaagcggttcagacgcgaggaagaagaggccggcgttctgtggtga

SEQ ID NO: 25110 - RNA, 9876 nt, synthetic construct
  misc_feature 1..9876: note = derived and/or modified CDS sequence (opt11) from DENV-2__KC294214__SS-prME
  source 1..9876: mol_type = other RNA
actgccggcgtgatcgtcatgctgatcccaaccgccatggcgttccacctcaccacacggaacggggaaccccacatgatcgtggggcggcaggagaaggggaagagtctgttgttcaaaaccgaggacggcgtaaacatgtgcaccctcatggccatcgacctgggggagctgtgcgaggacaccatcacctacaagtgccccctcctgaggcagaacgaacccgaagacatcgactgctggtgcaatagcaccagcacctgggtcacctacgggacctgcaccaccactggcgagcaccggcgcgaaaagcggtccgttgcgctcgtgccccacgtcgggatgggcctcgagacgcgtactgagacctggatgagttccgagggggcctggaagcacgtgcagcggatcgagacgtggatcctgcgccacccgggcttcaccatcatggccgcgatcctggcctacaccatagggaccacacacttccagcgggccctcatcttcatcttgctgaccgccgttgcgccgagcatgaccatgcgctgcatcggtatctcgaaccgggatttcgtcgagggcgtgagcgggggctcctgggtggacattgtcctcgagcacggtagctgcgtcaccacaatggcgaagaacaagcctaccctggacttcgaactgatcaagaccgaggcaaagcaaccggccaccctccgcaaatactgcatcgaggccaagctgacgaacactaccaccgagtcacggtgcccgacgcagggcgagcctagcctgaacgaggagcaagataagcgtttcatctgcaagcactccatggtcgaccgtggctgggggaacggctgcggtctgttcggcaagggcggcatcgtgacctgtgcgatgtttacgtgtaagaagaatatggagggcaagatcgtgcaacccgagaatttagagtacactatcgtgatcacgccccacagcggggaagagcacgccgtcggcaacgacaccgggaaacacggcaaggagatcaagatcaccccgcagtccagcaccaccgaagccgagctgaccgggtacggcacagtgacaatggagtgcagcccccggaccggcctcgacttcaacgagatggtgctgctgcagatggaggacaaggcctggctggtccaccgacagtggttcttggatctgcccctcccatggctgccgggggcggacacgcagggcagcaactggatacagaaagagaccctggtaaccttcaaaaacccccacgcgaagaagcaagacgtggtcgttctcgggtcccaggaaggcgccatgcacactgccctgacgggcgccaccgagattcagatgagctccggcaaccttctgttcaccggccacctgaagtgccgcctgcggatggacaagctccagctgaaggggatgtcctacagcatgtgcaccggcaagtttaagatcgtaaaggagatcgctgagactcagcacggtactatagtgatccgcgtgcagtatgagggcgacggctccccctgcaagatcccctttgaaataaccgacctggagaagcggcacgtcttagggagattgatcaccgtgaacccgatagtgacagagaaggacagccccgtcaacatcgaagcggagccacccttcggcgactcctacatcatcgtgggggtcgagccgggacagctcaagctcaactggttcaagaaggggtcctccatcgggcagatgtttgagaccaccatgcgcggcgccaagcggatggctatcctgggggacaccgcctgggactttggcagcctcggcggtgtgttcacgtccatcgggaaggccctccaccaagtcttcggggctatctacggcgccgctttcagcggggtgtcctggaccatgaagatactaatcggggttatcatcacatggattgggatgaacagccgctccactagcctgtccgtgagcctggttctcgtgggggtagtgacgctttatctgggggccatggtccaggcggactccggatgtatcgtgagctggcggaataaggagctcaagtgcggctccgggatcttcataaccgacaacgtgcacacctggacagagcagtacaagttccaaccggagagcccgagtaagctggcgtccgccatccagaaggcccacgaggagggcatctgcgggatccgctctgtcacccgactcgagaacctaatgtggaagcaaatcactcccgagctgaaccacatcctgtccgagaacgaggtgaagctcaccataatgaccggcgacattaaggggatcatgcaggccggcaagcgctccttacgaccgcagcccacggaactgaagtactcctggaagacctggggcaaggcgaagatgctcagtacagagtcgcacaaccagaccttcctgatagatgggcccgagacggccgagtgcccgaacaccaaccgcgcctggaacagcctggaagtggaggattatggcttcggggtcttcactaccaatatctggctcaaactgcgggagaagcaggacgtgttttgcgactccaagttgatgagcgcagccatcaaagacaaccgcgccgtgcacgccgacatgggctactggatcgagtccgccctcaacgatacttggaagatggagaaagccagcttcatcgaggtcaagtcctgccactggcccaaaagccacacgctgtggtccaacggtgtgttagagagtgagatgatcatccccaagaacttcgcagggcccgtgtcccagcataactaccgtccgggctaccatacccagaccgcggggccctggcacctgggtaagctggagatggacttcgacttttgcgaggggacgacggtagtggtgaccgaagactgtggcaaccgcggcccctcgttacggaccaccaccgccagcgggaagctcatcacggagtggtgttgccgctcctgcaccttacccccgctgcggtaccgcggtgaggacgggtgctggtacggaatggaaatccgcccccttaaggagaaggaggagaacctggtcaacagcttggtgactgccgggcacggtcagatcgacaacttctcactcggcgtcctggggatggcgctgttcctcgaggaaatgctgcgtacgagagtcggcactaagcacgcgatcctgctcgtggcactgagcttcgtgaccctgataaccgggaacatgtccttccgggacttgggccgcgtcatggtaatggtgggggccacgatgacggatgatatcggcatgggcgtcacttacctggccctgctcgccgcgttcaaagtgcggccgaccttcgccgctgggctgctgctcaggaagctgacgagcaaagagctgatgatggccaccataggaatcgccctattatcccagagcaccctgcccgagacgatcctcgagctgacggacgcgctggccctcgggatgatggccctgaagatcgtgcgcaacatggagaagtaccagctggcggtcaccatcatggctatctcctgcgtgccgaatgcggtgatcctccagaacgcctggaaggtcagctgtacgatactggccgccgtttcagtgagccccttactccttacctccagccagcaaaaggccgactggatccccttagccctcacaatcaaaggcctgaatccgacagccatattcctgaccaccctcagtcgcacgagcaagaaacggtcctggccgcttaacgaggccataatggccgtgggaatggtgagcatcctggcctccagcctcctgaagaacgacattcccatgacggggcccttggtcgccggcggtctcctcaccgtctgctacgtgctgaccgggcggagcgccgacctagagctagaacgggctgccgacgtcaagtgggaagatcaggcggaaatctccgggagctcccccatactgagcatcacgatcagcgaggacggctcgatgtccattaaaaatgaggaggaggaacagaccctcaccatcttaatccggaccggcctgctcgtgattagcggggtgtttccggttagtatccccatcactgccgccgcctggtacctgtgggaggtgaagaaacagcgtgccggtgtgctgtgggacgtcccctcgccgccgcccgttgggaaagcggagctggaggacggcgcgtaccgcatcaagcaacggggcatcctgggctactcccagatcggcgccggggtgtacaaggagggcacgttccacaccatgtggcacgtcacccgcggggccgtgcttatgcaccggggcaagaggatcgagcccagctgggccgacgtgaagaaggacctcatctcctacgggggaggctggaagctggagggtgagtggaaggaaggcgaagaggtacaggttctggccctcgagcctgggaagaacccccgggccgtgcagaccaagcccggcatcttcaagacgaacaccgggaccatcggcgccgtcagcctggacttctcccccggcacaagtgggtcgcccattgtggaccgcaagggcaaggtggtcgggctgtacgggaacggcgtggtgacgagatcgggagcctacgtaagcgcgatcgcccagacagagaagtcgatcgaagacaaccccgagatagaggatgacatcttccgcaagaagagactcaccatcatggacctccaccccggagccggtaaaaccaaacgctacctgcccgccatcgtccgggaggccatcaagcgtggtctgcgcacgctcatccttgcgccgacccgggtggtcgccgccgaaatggaagaggccttgcgggggctacccatccggtaccagaccccagccatacgcgcggagcacaccggccgggaaatcgtggacctaatgtgccacgccacgttcaccatgcgcctgctctcccccgtaagagttccgaattacaacctgatcatcatggacgaagcccacttcacagacccagcgtccatcgccgcgcgtggctatatcagcacgagagtggagatgggggaggccgccggcatcttcatgacggccacaccgcccggctcccgcgaccctttcccccagagtaacgcgcccatcatggacgaggagcgggagatccccgagagatcctggaactctggccacgagtgggtgactgacttcaaagggaagaccgtctggttcgtgccatccatcaaggccggtaacgacatcgccgcctgcctgcgcaagaacggcaagaaggtgatccagctcagccgtaagacatttgactccgagtacgtcaagacccgggcaaacgactgggacttcgtggtgaccacagacatctccgagatgggagccaacttcaaagccgagcgggtcatcgacccccggcgctgcatgaagcccgtcatcctgacggacggcgaggagcgggtcatactggctgggcccatgccggtcacccactccagcgccgcccagcgcaggggccggatcgggaggaaccccaagaacgagaatgaccagtacatctatatgggcgagccgctcgagaacgacgaggactgcgcgcactggaaggaggccaagatgctgctggacaacatcaacacccccgagggcatcatcccgtctatgttcgagcccgagcgggagaaggtggacgccatcgacggggagtacaggctcagaggagaggctagaaagaccttcgtcgacttgatgcgaagaggggatctgcccgtctggctcgcctacaaggtggcagccgagggcatcaactacgccgaccggaaatggtgctttgacggaatcaagaacaaccagatcttagaggagaacgtggaggtcgagatctggacgaaggagggagagcggaagaagctgaagccgcgatggcttgacgccagaatctacagcgaccctctcgcgttaaaggagttcaaggagttcgcagccggccggaagtccctcaccttgaacctgatcacagagatggggcgcttgcccacctttatgacgcaaaaggcccggaacgcgctggataatctggcggtgctccacaccgccgaggtgggcgggaaggcctacacccacgccctgagcgaactccctgagaccctggagacgctgctgctcttaaccctcttagctgcggtcaccggaggcatcttcctgttcttgatgtccgggaagggcatcgggaagatgaccctcggcatgtgctgcatcatcaccgcgagcatcctgctctggtacgcgcagatccagccgcactggatcgccgccagcattattctcgagtttttcctgattgtgctgctcattcccgagccagagaaacagcgcacgccacaggataaccaactgacgtacgtcgtgatcgctatcctcaccgttgtcgccgccaccatggccaatgagatgggtttcctcgagaagacgaagaaggacctcggcttcggcagcatcaccactcaggagagcgaatccaacattttagatatcgaccttcggccggcctccgcgtggaccctgtacgccgtggcgactaccttcgtaactcccatgctgcgccactccatcgagaacagctccgtcaacgtgagcctcaccgcaatcgcgaaccaggccactgtgctgatgggcctgggcaaggggtggcccctctccaagatggacatcggcgtccccctgctggccattgggtgctacagccaggtgaacccgatcaccctcaccgccgccctgctgctactggtggctcattacgccatcatcggacccggcctacaggccaaggcgacccgggaggcccagaaacgcgctgccgccgggatcatgaagaatcccacagtcgacggcatcaccgtgatcgacctggagcccatcccatatgaccccaagttcgagaagcagctggggcaggtcatgcttctcatcctgtgtgtcacccaagtgctgatgatgcggaccacgtgggccctctgcgaggccctgaccctggcgaccggcccaatctccaccctctgggaggggaaccccggccgattctggaacaccaccatagccgtgagcatggcaaacatcttccgcggctcctacctagccggggcgggcctcctgttcagcatcatgaagaacaccaccaacacgcggcgcgggactggcaacgtgggcgagaccctgggtgagaagtggaaatcgcggctgaacgccctcgggaagagtgagttccaaatctacaagaagtccgggatccaagaggtcgaccgcacgctcgctaaggagggaatcaagcgcggggagacggaccaccacgctgtgagccgcggcagcgccaaactgcgatggtttgtagagcgcaatatggtaaccccggagggcaaagtggtcgacttaggctgcggccgcgggggatggagctattactgcgggggcctgaagaatgtgcgcgaggtgaagggcttgaccaagggcggccccgggcacgaggagcccatccccatgtccacctacggctggaacctcgtccggctgcagagcggggttgacgtcttttttacgccgcccgagaagtgcgataccctgctctgcgacatcggagagagctcgcctaaccccaccatcgaggcgggccgcaccctacgggtgctgaacctcgtggagaactggttaaacaacaacacccagttttgcatcaaggtactgaacccgtacatgcccagcgtcattgagaagatggagacgctccagcgcaagtacggcggcgccctggtgcgaaaccccctgtcccgcaattcgacacacgagatgtactgggtgagtaacgccaccgggaacattgtaagctctgtgaacatgatcagccggatgctgatcaaccgcttcaccatgaagcacaagaaagcgacgtacgagcctgacgtggacctcggctccgggacgcggaacatcggcattgagagcgagattcccaacctggacatcgtcggcaagcgaatcgagaagattaagcaggagcacgagacctcttggcactatgaccaagaccacccttacaagacctgggcctatcacggcagctacgagacgaagcagaccggctccgctagctcaatggtcaacggggtagtccgtctgctcaccaagccctgggacgtggtgccgatggtcacccagatggccatgacggacaccaccccctttggtcagcagagagttttcaaggagaaggtagacacccgcacgcaggagcccaaagagggtaccaagaagctgatgaaaatcacagccgaatggctgtggaaggaactggggaaggagaagacgccccggatgtgcacgagagaggagtttacacggaaggtccgaagcaacgccgccttgggtgcggtcttcaccgacgaaaacaagtggaagagtgcccgggaggccgtggaggacgggcgcttctgggaactagtcgaccgggagcgcaacctacatctggagggcaagtgcgagacctgcgtctacaacatgatgggaaaaagggagaagaagctgggcgagttcggcaaggccaaggggagccgcgcgatatggtacatgtggctcggcgcccggtttctggagttcgaggccctggggttcctcaacgaagaccactggttctcccgcggcaactctctgagcggcgtcgagggagagggcctgcaccggctcgggtacattctgcgcgaggtgggcaaaaaggaaggcggcgccatgtacgccgacgacaccgcggggtgggacacccgcatcaccctggaggacctcaaaaacgaggagatggtaactaatcacatgaagggcgagcacaagaagctagccgaggccatcttcaagcttacgtaccagaacaaagtcgtgcgcgtccagcggccgacgccccggggcaccgtcatggacatcatcagtcggaaagaccagagggggagcggacaggtggggacctacggactcaacacgttcacgaacatggaagcccagctgattcgccagatggagggcgagggtatcttcaagtccatccagcacctgaccacgacagaagagatcgccgtgcagaactggttggcgcgggttggccgagagcggctgagccgcatggccatctccggcgacgattgcgtggttaaaccgatcgacgaccgtttcgccagcgcgctgaccgccctcaatgacatgggcaaggtccgcaaggacatccagcagtgggagccatcacgagggtggaacgactggacccaggtgccgttctgttcacaccacttccatgagctggtgatgaaggacggccgcgtactggtggtgccctgccggaaccaggacgagctgatcgggcgcgcacgtatctcacaaggagccggctggagcctgaaggagaccgcctgccttgggaagtcctacgcccagatgtggacgctgatgtactttcaccgccgggacttacgcctggccgccaacgccatctgtagcgccgttccctcccactgggtgcccactagccggaccacctggtccatacacgccaagcacgagtggatgaccacggaggatatgctcgtcgtctggaatcgcgtgtggatacaggagaatccgtggatggaagacaagactcccgtggagagctgggaggaggtcccctacctgggaaagcgggaagaccaatggtgtgggtccctgatcggcctcaccagtcgcgcgacctgggctaaaaacatacagacggcgatcaaccaggtgcggagcctgatcggcaacgaagggtacaccgactacatgccctccatgaagcgatttagaagggaggaggaggaggccggcgtgttgtggtga

SEQ ID NO: 25111 - RNA, 9876 nt, synthetic construct
  misc_feature 1..9876: note = derived and/or modified CDS sequence (opt11) from DENV-2__KC294205__SS-prME
  source 1..9876: mol_type = other RNA
actgccggggttatcgtcatgctaatccccaccgccatggcgttccacctcaccacacgtaacggggagccccatatgatcgtgggccgtcaggagaaagggaagtcgttactgttcaaaacagaggacggcgtcaacatgtgcaccctcatggccatcgacttgggggagttatgcgaggataccatcacatacaagtgcccactcttgcgccaaaacgagcccgaggacatagactgctggtgcaatagcaccagcacctgggtcacctatgggacatgcacgaccacgggcgagcaccggagggaaaagcggtccgtggcattagtgccccacgtcgggatgggtctcgaaactcgcaccgagacttggatgagttccgagggggcctggaagcacgttcaacggatcgagacttggatcctacgccacccaggcttcaccatcatggccgcgattctcgcctacaccattgggaccacgcacttccagagagccctcatctttatactgctgaccgccgtggctcccagcatgacaatgcgttgcatcggtatctccaaccgggacttcgttgagggtgtaagcggaggcagttgggtggacattgtcttggagcacgggagctgcgtaactacgatggcaaagaataagcctaccctggacttcgagttaataaagaccgaggctaagcagccggccaccctccgcaaatactgcattgaggctaaactgactaacaccaccaccgagtcccggtgtccgacgcagggtgagcccagcctgaatgaagagcaggacaaacgcttcatctgcaagcatagtatggtggatcggggatgggggaacggctgtgggctgttcgggaagggcgggatagtgacctgcgcgatgttcacttgcaaaaagaatatggaaggcaagatcgtacagccggagaacttggagtacacaatcgtgatcacgcctcactccggggaggagcacgccgtcggaaacgacaccgggaagcatggcaaggagatcaaaatcacaccgcagtccagcacaacagaggccgagctgacagggtacggcaccgttacgatggaatgtagcccaagaaccggcctcgacttcaacgagatggtgctgctgcagatggaggacaaggcctggttagtccaccggcagtggttcctcgacttaccactcccctggctgccaggcgctgatacgcagggaagtaactggattcagaaggagaccctggtgaccttcaaaaacccccacgccaagaagcaggatgtggtagtgttagggtcccaggagggcgccatgcacaccgctctgacgggggcgacggagatacagatgagcagcggcaacctcttgtttacaggccacctgaagtgccggcttcggatggataaactccagcttaaggggatgtcctacagcatgtgcactgggaagtttaagatcgtaaaggagattgcagaaacgcaacacgggaccatcgtcatccgagtgcagtacgagggggacggcagcccctgcaagatccccttcgagatcacagacctcgagaagcggcacgtgctcggtcgcctgatcactgtgaacccaatcgtgactgagaaggacagcccggtcaacatagaggcggagccgcctttcggagactcctacatcatcgtgggggtggagcccggtcaactaaagctaaactggttcaagaaggggtcgtcaataggccagatgttcgagactactatgcgcggcgccaagaggatggcaatcctgggggataccgcttgggactttggatccctcggaggggtcttcacgtccatcgggaaggcactccaccaggtcttcggagcgatctacggcgccgccttcagcggggtgtcgtggaccatgaagatcctgataggcgtcatcatcacctggatcggtatgaacagccggtccaccagcctgtccgtgagcctggtgctcgtgggggtggtgacattgtacctgggtgccatggtccaggcggattccgggtgtatcgtgagctggaaaaataaagagctcaaatgcggctccgggatcttcatcacagacaacgtccacacctggaccgagcagtacaagtttcagcccgaaagcccttctaagctggcctcggcaatccagaaagcccatgaggagggcatctgcgggatcagaagcgtcacccgcttggaaaacctcatgtggaagcagatcaccccagagttgaaccacatcctgtccgaaaacgaggtgaaactcaccatcatgaccggcgatatcaaggggatcatgcaggccggaaagcgttccctgcgcccgcagccgacggagctgaaatacagctggaagacctggggcaaggcgaagatgctcagcaccgagtcccataaccaaaccttcctgatcgacgggccagagacagccgaatgcccaaacaccaaccgggcctggaactctctggaggtggaagactacggcttcggggtgttcacgactaatatttggctcaagctgcgtgaaaaacaagacgtgttctgcgatagcaagctcatgagcgccgccatcaaggataaccgtgcggtccacgctgacatgggctactggatcgagagcgccctcaacgacacgtggaagatggagaaggctagcttcatcgaggttaagtcctgccactggcccaagagccacacgctgtggtcaaacggcgtactggagtccgagatgatcatccccaaaaacttcgccgggcccgtgtcccagcacaactatagacctgggtaccacacacagaccgcgggaccctggcatttaggcaagctggagatggatttcgacttctgtgagggcacgacggtagtggtgacagaggactgtggcaaccgtggtccgtctctgcgcaccaccacggccagcggcaagctcatcaccgagtggtgctgcagatcctgcaccttgcccccgctgcggtaccggggcgaggacggctgctggtacgggatggagatccgccccctcaaggagaaggaagagaacttagtcaacagcttggtcacagccggtcatggacaaatcgacaacttttccttaggggtgctaggaatggcccttttcctcgaggagatgctgagaacgcgcgttggtacgaagcatgcgatcctgctcgtggccctgtctttcgttactcttatcacgggaaacatgagtttccgggacttgggacgcgttatggtgatggtgggagccaccatgaccgacgatatcggcatgggcgtaacctacctggccctgctggcggcttttaaggtgcgccccaccttcgccgccgggctgctcctccggaaactgacctccaaggagctgatgatggccaccatcggcatcgccctactctcccagtccaccctgcccgaaactatcctcgagttaacggacgcgctggcactcgggatgatggccctgaagatcgtgcgcaacatggagaagtaccagctagccgtcaccatcatggccatttcctgcgtgcccaacgcggtgatcctccaaaatgcatggaaggttagctgtacgatcctggctgccgtatccgtgagccccctgcttctgacttccagccaccagaaggcggactggatccccctggcactcacgattaagggcttaaaccccaccgcaatttttctgaccactttgtcccggacgtcgaagaagagatcgtggccgctgaacgaggccatcatggccgtcggcatggtgagcatcctggcgtccagcctcctcaagaacgacatcccaatgaccgggccactggtcgccggtgggctccttaccgtgtgctacgtgctgaccgggcggtcggcagacctcgaactggagcgcgccgccgacgtcaagtgggaggaccaggcggaaatctccggtagttcccccatcctgtctatcacgatatcggaggacggttcaatgtccatcaagaacgaggaagaagagcagacccttaccatcctgatccggactggcctactcgtgatctcaggggtgttcccggtcagcatcccgataacggccgccgcctggtacctatgggaggtcaaaaaacaacgcgctggtgtgttgtgggacgttccaagcccgccccccgttggaaaggcggagttagaggatggcgcctaccggatcaaacagagaggaatccttggatactcccagatcggcgcgggggtgtacaaagagggcacgttccacaccatgtggcatgtcacccgcggggccgttctgatgcaccgtggcaaacggatcgagcccagctgggcagatgtgaagaaggaccttatcagctacggcggtggctggaagctggagggagagtggaaggagggcgaggaagttcaggtgcttgcgctagagcccgggaagaacccgagagccgtgcagaccaaacccggcatcttcaagaccaataccggtaccataggcgccgttagcctggacttctcccccggcaccagcgggagtcccatagtggatcggaaggggaaggtagtcggactgtacggcaacggcgtggttacacgatccggtgcttatgtctccgcgatcgcccaaacggagaagtccattgaggacaacccggaaattgaggacgacattttccggaagaagcgcttaaccatcatggacctgcaccctggcgctggaaagaccaaacggtatctccccgcgattgtacgtgaggctataaagcggggcctgcgtacacttatcctggcgccgaccagggtggtcgccgcggaaatggaggaggccctgcgggggctgcccattcgctaccagacccccgcgatacgggcggagcataccggacgtgagatcgtcgacctgatgtgccacgctacatttacgatgcggctgctcagccccgtgcgcgtaccgaactataacctgatcatcatggacgaggcgcacttcaccgaccccgcctccatcgccgcgcgtggctacataagcacccgcgtggagatgggggaggctgccggcatattcatgacggccaccccacccggctcccgggacccgttcccccaaagtaacgcgcccatcatggatgaagagcgagagatacccgagcggtcatggaacagcggccacgagtgggtgactgacttcaaggggaagaccgtttggtttgtaccctccatcaaggcaggcaacgacatcgccgcctgcctgagaaagaacgggaagaaggtgattcaactcagcagaaagacgtttgattccgagtacgtcaagacacgcgcaaatgactgggatttcgtggtaactaccgacatctctgagatgggagctaactttaaagccgagcgggttatagacccccgccggtgcatgaagcccgtcattctcactgacggggaggagcgcgttatactagcagggcccatgccggtcacccactcctccgccgcccaaagacgcggccgcatcggtcggaaccccaaaaacgagaacgatcaatacatctacatgggcgagcctctcgaaaacgacgaagactgcgcgcattggaaggaggccaaaatgcttctggataacatcaacacccccgaagggatcatcccgtccatgttcgagcccgagcgcgagaaagtggacgccatcgacggggaataccgcctccgaggcgaagctcggaagaccttcgtggacctaatgagaagaggggacctgccagtttggctcgcctacaaagtggcagccgagggcatcaactacgctgaccgcaagtggtgcttcgacgggatcaaaaacaatcaaatcctggaagagaacgtagaggtcgagatctggacgaaggagggcgagcggaagaagctgaagccgcgatggctggacgcccggatctacagcgatcccttggcgctgaaggagttcaaggagttcgccgccggtcgcaagtcgctcaccctgaatctaatcactgaaatgggaagactccccaccttcatgactcagaaggcccggaacgccctcgacaacctggccgtgctccataccgccgaagtcggcgggaaggcctatacgcacgcgctgagcgagctgccggagaccctggaaaccctactattgctaaccctgctcgccgcggtcaccggcggcatattcttgttcctgatgtcagggaagggcatcgggaagatgacgctcggcatgtgctgcataataaccgcctccatcctgctctggtacgcccagatccagcctcactggatagcagcctccatcatcctggagttcttcctgatcgtcctgttaatcccagagcccgagaagcagcggacgccacaggataaccagctgacctatgtcgttatagcgatcttgaccgtggtcgccgccacaatggccaacgagatgggattcctagagaagacgaagaaggatctgggcttcggcagcattaccacgcaggagtcggagagtaatatcctggacatagacctccgcccggcctcagcctggaccctatacgccgttgccacgacgttcgtgaccccgatgctgagacactcaatcgaaaacagctccgtcaacgtgagcctcaccgctatcgcgaaccaggcgacagtgctgatggggctcggcaaggggtggcccctctcgaagatggacatcggtgtgccactgctggccatcggctgttacagccaggtaaacccaatcaccttgaccgccgccctgctgctcttagtggcgcactacgcaataatcggccccggattgcaggcgaaggcgacccgcgaagcccagaagcgggcggccgccggaatcatgaaaaaccctacggttgatggcatcacggttatagatctcgaaccaatcccgtacgaccccaagttcgaaaagcagctggggcaagttatgctgctcatcctgtgcgtcacccaggtgctgatgatgcgaaccacttgggccctctgcgaggccctgaccttagcgacagggccaatctcaaccctctgggagggtaatcccggtcgcttctggaacacaaccatcgcggttagtatggccaacatctttcgcggctcctatctagccggggcgggcctcttgttttcaatcatgaaaaacaccaccaacacgcgcagagggaccggcaacgtcggcgagaccctcggggagaagtggaagtcccgcctaaacgcactcggcaagagcgaatttcagatctataagaagtccgggatccaggaggtggaccggacactggccaaggaaggcatcaagaggggggagacggaccaccacgcggtgagccgggggtccgcgaagctgcgctggttcgtcgagcggaacatggttacaccggagggaaaggtggtcgaccttgggtgtgggagagggggctggagttactactgcgggggcctgaaaaatgtacgggaggtgaagggcctgaccaagggcggccctggacacgaggaacccatccccatgtccacgtacggctggaatctcgttcgcttacaaagcggcgttgatgtgttcttcacgccgccagaaaagtgcgacaccctgctctgtgacataggcgagagctcccccaaccctaccatcgaggcgggccggacgctgcgagtgctcaacttagttgaaaactggctgaacaccaatacccagttttgtattaaagttctcaatccgtacatgcccagcgtcatcgagaaaatggaaactcttcaaaggaaatatgggggcgccctcgtgcgcaacccgctgtcccgaaacagcacccatgagatgtactgggtgtccaatgccaccgggaacatcgtcagctcagttaacatgatcagccgcatgctgattaaccgtttcacgatgaagcacaagaaggccacctacgaacccgatgtggacctcgggtccggtacccgcaacattgggatcgagagcgagatccctaacctggacatagtcggcaaacggatcgagaagatcaaacaggagcacgagacctcctggcactacgatcaagaccacccctacaaaacgtgggcctatcacgggagctatgagaccaagcagaccggctcagctagctccatggtaaacggggttgtccgcctgctcaccaagccctgggacgtcgtgccaatggtcactcagatggccatgaccgatacgacccccttcggccagcaaagggtgttcaaagagaaggtagacacgagaacccaggagcccaaggagggcacaaagaagctgatgaagattactgccgagtggctgtggaaggaactcgggaaggagaaaacgccacgtatgtgcacgagggaagagtttacccgtaaggtccggagcaacgcagctctgggcgcggtgtttaccgacgagaacaagtggaaatccgccagagaggccgtggaagacgggcggttctgggagctggtcgaccgcgagcggaacttgcacctagaggggaagtgcgagacgtgcgtgtacaacatgatggggaagcgcgagaagaagctcggggagttcggcaaggccaagggcagccgggcgatctggtacatgtggctcggcgcccgcttcttagagttcgaggcgctggggttcctcaatgaggaccactggtttagtcggggcaactcactaagcggggtcgagggcgaaggcctgcaccgcctcgggtacatcctgagggaagtgggcaaaaaagagggcggggccatgtacgcagacgacaccgcggggtgggacacccgtatcaccctggaggacctcaagaacgaggagatggttacgaaccatatgaagggcgagcataagaagctcgcggaggccatcttcaaactgacataccagaacaaggtagtgcgggtgcagcgcccgacgccccgtggcaccgtcatggacattatctcgcgcaaggatcagcgggggagcggacaagtggggacgtatggactcaatacctttaccaacatggaagcccagctgatccgccagatggagggtgaggggatctttaaatccatccaacaccttaccgccacggaggagatagcggttcagaactggttggcccgcgtgggacgggagcgcctcagccggatggccatctcgggggacgactgcgtggtgaagcccatcgacgaccgcttcgcctcggccctcaccgcgttgaatgacatgggaaaagtccggaaggacatccagcagtgggagccgtcccgcgggtggaacgactggacccaagtgccgttctgcagccatcatttccacgaactggtaatgaaggatggccgggtcctagtggtgccctgtcgcaaccaagatgagctcatcggacgcgcccgcatttcccagggggctggctggtcgctgaaggaaaccgcatgcctcgggaagtcctacgcccaaatgtggacgctcatgtacttccaccggcgcgacctgcgtctcgcggccaacgccatctgcagcgccgtcccatcccattgggtccccacatcccgcacgacgtggtccatccacgctaaacacgagtggatgacaacggaggacatgttggtggtttggaacagagtgtggatccaagagaacccgtggatggaggacaagacccccgtggagtcatgggaagaggtcccttacttgggtaagcgggaggaccagtggtgcgggagtctgatcggcttgaccagccgggcgacctgggccaagaacatccagaccgcaataaaccaggtacgcagcctgatcggtaacgaaggatacaccgactacatgcccagcatgaagcggttccgccgcgaagaggaagaggccggcgtgctgtggtga

SEQ ID NO: 25112 - RNA, 9876 nt, synthetic construct
  misc_feature 1..9876: note = derived and/or modified CDS sequence (opt11) from DENV-2__KC294210__SS-prME
  source 1..9876: mol_type = other RNA
accgcgggcgtgatagtcatgttaatacccaccgcgatggcgtttcatctcaccactcggaatggggagccccacatgatagtgggtcgtcaggagaagggcaagtccctgttgttcaagaccgaggacggggttaacatgtgcacactaatggcaatcgatttaggggagctgtgcgaggacaccataacatataagtgccccctcctgcgccagaacgagccggaggacatcgactgctggtgcaacagcactagcacgtgggttacgtatgggacctgcaccacaacgggtgagcaccggcgcgagaagaggtcggtggcattggtgccccacgtggggatgggcctcgagacacgcaccgagacctggatgagcagcgagggggcctggaagcacgttcagagaatagaaacgtggatcttgcgccatccgggcttcaccatcatggccgccattctggcctacaccattgggacaacgcattttcagcgggcgctcatcttcatcctgcttaccgccgtggcgccgagcatgacaatgcgctgcatcggaatcagcaatcgtgatttcgtcgaaggcgtttcaggcggctcctgggtggatatcgtcctcgaacacgggtcatgcgtcaccacgatggccaagaacaaaccgacgttggacttcgagctgataaagacagaggccaagcagcccgccaccctgcgcaaatactgcattgaggccaaacttacgaacacaacaaccgagtcccggtgccccactcaaggagaaccctccctgaacgaggagcaggacaagcgattcatctgcaagcactccatggtggacaggggctgggggaatggctgcggtttattcggcaaaggcgggatcgtgacctgtgcgatgttcacgtgcaagaagaacatggaggggaagatcgtccaacccgaaaacctggagtacactatcgtgatcactccccattcaggggaggagcacgctgttggaaatgataccgggaaacacggcaaagaaatcaagatcaccccgcaatccagcaccaccgaggctgaactgacgggctacggcaccgtaatgatggagtccagcccccgcaccggcctcgacttcaatgagatggtgctgcttcaaatggaggacaaggcttggctcgtccaccggcagtggttcttagacctgcccctaccctggctcccgggtgcagacacccaagggtccaactggatccagaaggagacgctggtaaccttcaagaacccgcacgcgaagaagcaggacgtggtcgtgttgggatcacaggagggtgctatgcataccgccctgaccggggccacggagatacagatgagcagcggcaatctcctgtttaccgggcacctgaagtgccgcctgcggatggacaagctccagctgaaggggatgagctactcgatgtgcaccgggaagtttaagatcgtcaaggaaatcgccgagacccaacacggcacaatcgtgatccgcgttcagtacgaaggggacggcagcccatgtaagataccattcgagatcaccgacctggagaagcggcacgtcctcgggcggctaatcaccgtgaacccgatcgtgaccgagaaggattcgcccgtcaacatcgaggctgagccacccttcggcgacagctacatcatagtgggggttgagccgggccagctaaagctcaactggtttaagaagggctccagcattggccagatgttcgagacgacgatgaggggcgccaagaggatggcaatactgggggacaccgcctgggacttcggctccctcggcggggttttcacgagcatcgggaaggccctccaccaggtgttcggggcgatctatggcgctgctttttccggggtgtcatggacgatgaagatcctgatcggcgtcatcatcacatggattgggatgaactccaggtcgacttcgttgagtgtatcactggtgctcgtaggtgtggtgaccctgtacctgggcgccatggtccaggcggacagcggctgcatcgtgagctggaagaacaaggagctgaaatgcggctcgggaatatttattacggataacgtgcatacttggacggagcaatacaagttccagcccgagagcccctcaaagctggccagcgccattcagaaggcacacgaagaaggcatctgtgggatccgctccgtcacccgccttgagaatctgatgtggaagcagataacacccgagctgaaccacattttgagcgagaacgaggtgaagctcaccatcatgactggcgatatcaaggggatcatgcaagccggcaagcggtccctccgccctcagcccaccgagctgaaatatagctggaagacgtggggaaaggcgaagatgctctccaccgagagccataaccagacctttcttattgacgggcccgaaactgccgagtgtccgaacacgaatagagcttggaactcattagaggtggaggactacggcttcggggttttcactacgaacatctggctcaagctccgggagaagcaggatgtattctgcgactcaaagctgatgtccgccgccatcaaagacaatcgggcggttcacgccgacatgggctattggatcgaaagcgccctcaatgatacgtggaagatggagaaggcctcctttatcgaagtcaagagttgccactggcctaagtcccacaccctgtggagcaacggcgtgctggagtccgagatgatcatccctaagaacttcgccggtcccgtgagccaacacaactaccgcccgggctaccatacgcaaaccgcggggccctggcatttgggcaaacttgagatggacttcgacttttgcgagggcaccaccgtcgtcgtgaccgaagattgtggcaaccggggaccgagcttgcgtacgaccacagccagtgggaagctcattaccgagtggtgctgccggagctgcaccctgccaccgctgcgctaccggggcgaggacgggtgctggtacggtatggaaattcgccccctaaaggagaaagaagagaacctggttaacagcctagtaaccgccgggcacggccagatcgacaacttctcactcggtgtgctggggatggcccttttcctcgaggagatgcttcggaccagagtcggtacgaagcacgcgatactgctcgtggccctgtccttcgtgaccctgatcaccgggaacatgtcattccgggacctcggcagggtgatggtgatggtgggggccactatgacggacgacatcggcatgggcgttacctacctggccctactcgcagcgttcaaggtacgtcccaccttcgcggccggcctgctactccggaagctgacctccaaggaactaatgatggcgacaattgggattgcgttgctgagccaatccaccctacccgagaccatcctcgagctgaccgacgcccttgcattaggcatgatggcgctgaagatcgtgcgcaacatggagaagtaccagcttgccgtaactattatggccatcagctgcgtgcccaatgcggttatactccagaacgcctggaaggtatcctgcacgatccttgccgccgtgagcgttagtccgctgctgctcacctcgtcccagcagaaggcggactggatcccacttgcgctcacaatcaagggattgaatcccacggccatctttttgacaaccctctctcggacttctaagaaacgcagctggccgctgaacgaggccatcatggccgttggtatggtgtccattttagcctcctcgctcctgaaaaacgatatccccatgacggggccgctggtggctggcgggctcctgaccgtgtgctacgttctgacggggcgttccgccgacctcgagctggagagggccgccgacgtcaagtgggaggaccaggcggagatcagcgggtcctcacccatcctgagcattaccattagcgaggacggctctatgagcatcaaaaatgaggaggaggagcagacgctcaccatcctgatccggacaggtctgctcgtcatctccggggtgtttccggtctcaattcccatcacagccgcagcctggtacctttgggaggtaaagaaacagcgcgccggtgtactgtgggacgtccccagcccgccacccgtgggaaaggcggaactcgaggacggggcctaccggatcaagcagcgcgggatcctgggctatagccagattggcgccggtgtctacaaggagggaaccttccatacgatgtggcacgtcacacgcggggccgtgctcatgcaccgcggcaagcggatcgagccctcctgggccgacgtcaaaaaggacttgattagttatggcggcggctggaagctggaaggggaatggaaggaaggcgaggaggtccaggtgctggcgctggagcccgggaagaacccgcgcgccgtgcagactaagcccggcatctttaaaactaacaccggaacaattggcgctgtcagcctggacttcagccccggcacctccgggtcccccatcgtagaccggaaagggaaagtggtcgggttgtacggaaatggagtggttacgcgctcaggtgcttacgtcagcgcaatcgcccagaccgagaaatccatcgaggacaaccccgagatcgaggacgacatcttccggaagaagcgacttaccatcatggatctccatcccggggcggggaagaccaagcggtacctgcccgccatcgttcgcgaggcaattaagcggggactgcggactctcatcctcgccccgacgcgcgtggtcgccgccgagatggaagaggccctacgggggcttcctattcggtaccagacccccgctatccgggcggaacacaccggtcgtgagattgttgacctgatgtgtcacgccaccttcacaatgcggttactttcccccgtgcgcgtcccgaactacaacctgataatcatggacgaggcccacttcaccgaccccgccagcattgccgcgcggggctacatctccacccgtgtggagatgggggaggccgccggaatctttatgaccgccacgccgcccgggtcaagggatcctttcccccagtccaacgcgcccatcatggacgaggaacgcgagataccagagcggagctggaactccggccacgaatgggtgacagactttaaggggaaaacagtatggttcgtgccgagcatcaaggccggcaacgatatcgccgcctgcctgcggaaaaacggcaagaaagtgatacagctcagcaggaaaacttttgacagcgagtacgttaagacgcgtgcaaatgactgggactttgtggtgactaccgacatatccgagatgggcgctaatttcaaggctgagcgggtcatcgacccccgtcggtgcatgaagcccgtaatccttaccgatggcgaggagcgcgtgatcctggcggggcccatgccggtcacgcacagctccgcggcccagcggcggggccgaataggacgcaatcccaaaaatgaaaacgaccagtacatctatatgggcgagcccctcgagaacgacgaggactgtgcacactggaaagaggcaaagatgctgctcgacaacatcaacacccccgagggcatcatcccctcgatgttcgagcccgagcgtgagaaagtagacgccatcgatggggagtaccgactacggggtgaagcccgcaagacctttgtcgacctgatgcgccggggagatctgcccgtctggctcgcgtacaaggtcgcagcggaaggcatcaactacgccgatcgaaagtggtgctttgatgggatcaagaacaatcagatcctggaggagaacgttgaggtcgagatctggaccaaggagggcgagcgaaagaagctgaagccgcgctggctcgacgcgaggatatactccgaccccctggcgctgaaggagttcaaggagttcgccgccggacgcaaaagccttacgctgaacctgatcaccgagatggggagactccctaccttcatgacccagaaggcacgcaatgccctggacaatctcgcggtgctccacacggccgaggtgggcggtaaagcctacacccacgcactatccgagctgcccgagacactcgagaccctgctactcctgacgctcctagcagcagtcacaggcgggatctttctgtttctaatgtctggtaagggcatcgggaagatgacactcggcatgtgctgcatcattactgcctcgattctgctgtggtacgcccagatccagccgcactggatcgccgccagcatcatcctcgagttcttcctgatagtgctactcattccagagccggagaagcaacggacaccccaggacaaccagttaacgtatgtcgtcatcgcgatcctgaccgtggtcgctgccacaatggccaacgaaatgggcttcctcgaaaagaccaagaaggatctgggtttcgggagcatcacgacccaggaatccgagtccaatatcctagacatcgacctccgcccggcctctgcttggacgctttacgctgtggccaccacgttcgtaacacccatgctgcggcacagcattgagaacagtagcgtgaatgtgtccctcaccgcaatcgcgaaccaagccaccgtgctgatggggttaggaaaggggtggcccttgagcaaaatggacatcggcgttccactgctggccatcggttgctactcccaggtgaatccaattactctcaccgccgccctgctgctcctggtggcacactacgctatcatcggtcccgggctgcaggccaaagccacccgcgaggcgcagaagcgggcggcggctggcatcatgaagaaccccaccgtcgacggcatcacggtgatcgacctagagcccatcccctacgacccgaagttcgagaagcagctggggcaggttatgttgctcatcctgtgcgtcacgcaagtgctgatgatgcgcaccacttgggccctctgcgaggccctgacgctggcgaccggccccatctccaccctctgggaaggcaaccccggccggttctggaacacgacgatagccgtgtcgatggccaatatcttccgcggcagctacttggcaggggcgggcctcctattcagtataatgaagaacaccaccaacacccgccggggcaccggcaatgtcggagaaaccctgggggaaaaatggaaatctcgcctgaacgcactcggcaaatccgagtttcagatctacaaaaagagtggtatacaggaggttgatcggactctggccaaggagggcatcaaacgcggggagacggatcaccacgcggtgagtcggggcagcgcaaagttacggtggttcgtcgagcggaacatggtgacgccggagggcaaggtagtcgacctcggatgcggcagagggggctggagctactactgcgggggtctgaagaacgtgcgggaggtcaagggcctgacaaagggtgggcccgggcacgaggagcccatccccatgagcacctacggctggaatctcgttcgcctccagagcggggtggacgtcttctttactccacccgagaagtgcgacaccctgctctgcgacatcggcgagtccagcccgaaccccacgatcgaggcaggccggaccttacgcgtcctgaaccttgtcgagaactggcttaacaacaatacacagttctgcataaaggtgttgaacccgtacatgccgtccgtcatcgagaagatggaaactctgcaacgtaaatacgggggagcactggtccgcaatcccctgtctcgcaactccactcacgagatgtactgggtcagcaacgcgaccggcaatatcgtgtcgagcgtcaatatgatatcgcgcatgctgattaaccggtttaccatgaaacacaagaaggcgacctacgaaccggacgttgacttgggatcagggacgcgcaacattggcatcgagtccgagattcccaacctggacatcgtcggcaagcggatcgaaaagatcaagcaggagcacgagaccagttggcactatgaccaggaccacccctacaaaacgtgggcgtaccacgggtcctatgagactaaacaaactggaagtgcgtcaagcatggtgaacggggtggtgagactgcttaccaagccctgggacgtggtgcccatggtcacccagatggccatgaccgatacgacacccttcggccagcagcgcgtgttcaaggagaaggtggacacccggacccaggagcccaaggagggtacaaagaagctgatgaaaattactgcagaatggctgtggaaggagctcgggaaggagaagacgcctcgtatgtgcacccgggaagagttcacgcggaaggtccggtccaatgccgctctcggcgcggtgttcaccgacgagaacaagtggaaatcggcccgcgaggcagtggaggacgggcggttctgggagctggtcgacagagagcgcaacctccatctggagggtaaatgcgagacctgcgtgtacaatatgatggggaaaagggagaaaaagttgggcgagttcggcaaggccaagggttcccgagctatttggtacatgtggctcggggcccgctttctggagtttgaggccttggggtttctcaacgaggaccattggttcagccggggcaacagcctatccggggtcgagggcgaaggcctgcaccgcctcggctacatcctgcgcgaagttggcaaaaaggaagggggagccatgtacgccgacgacactgcgggatgggacacgcgcatcaccctggaagacctaaagaacgaggaaatggtgactaaccatatgaagggagagcacaagaagctcgccgaagccatcttcaagttaacctaccagaacaaggtcgtccgggtgcagcgcccgacgcctcgaggcaccgtgatggacatcattagccgtaaagaccaacgggggtctggccaggtggggacctacggtttaaatacgtttacgaacatggaggcccagcttattcgccagatggagggcgaaggaatttttaaatcaatacagcacttaaccgcaacggaggagatcgcggtgcagaactggctcgtccgcgtaggtcgggaacgcctgtctcggatggcgatcagtggcgacgactgtgtcgtgaagccgatcgacgacagattcgcgtccgccctgaccgctctcaacgacatgggcaaggtgcggaaggacatacaacagtgggagcccagccgggggtggaacgactggacccaggtgccgttttgttcccaccacttccacgagctggtgatgaaggacggtagagtactggtggtcccctgccgaaaccaggacgagctcataggacgggcccgtatcagccagggggccggctggtccctgaaggagacagcctgtctgggaaagagctatgcccagatgtggaccctcatgtattttcaccggcgcgacctacggctggccgcgaacgccatctgctccgcggtgcccagccactgggtgcccaccagccggaccacgtggagcatccatgccaaacacgagtggatgaccaccgaggacatgctagtggtttggaaccgggtgtggatccaggaaaacccttggatggaggacaagacccccgtcgagtcctgggaggaggtgccatacctgggaaagcgcgaggatcagtggtgcgggagcttaatcggcctcacgagcagagcgacctgggccaagaacatccaaaccgccatcaaccaggtgcgaagtctcatcggcaacgagggttataccgactacatgcccagtatgaagagattccgccgcgaggaggaagaggccggcgttttgtggtga

SEQ ID NO: 25113 - RNA, 9876 nt, synthetic construct
  misc_feature 1..9876: note = derived and/or modified CDS sequence (opt11) from DENV-2__KC294215__SS-prME
  source 1..9876: mol_type = other RNA
accgcaggcgtgatagtcatgctgatcccgacggccatggcgttccacctcacgacccgcaacggggagccccacatgatcgttggccggcaggagaaggggaagtctctgcttttcaagaccgaggacggcgtgaacatgtgcaccctcatggccatcgacctgggtgagctgtgcgaggacaccatcacctacaaatgccccctcctccgccagaatgaacccgaggatattgactgctggtgcaacagcaccagcacctgggtcacctacgggacctgcaccaccacgggcgagcatagacgcgagaagcggtccgtggccctggtgccccacgtcgggatgggcctcgagacccgtacggagacctggatgagctccgagggggcctggaagcacgtgcagaggatcgagacatggatcctgcgccacccagggttcacaatcatggccgcgattctggcttacaccatcgggaccacgcacttccagcgggctctcatcttcatcctgctgaccgccgtggcgcccagcatgacgatgcgctgcattgggatctccaatcgggacttcgtcgagggcgtgagcggcggctcctgggtggacatcgtcctcgaacacggtagctgcgtgaccacgatggccaagaacaagcctaccctggacttcgagctgatcaagaccgaggccaagcagcccgctaccctccgcaagtactgcatcgaggcgaagctgacgaacacaaccaccgagtcccggtgcccaacgcagggcgagcccagcctgaatgaggagcaggataagcgctttatttgtaaacactccatggtggaccgggggtggggcaacggctgcgggctgttcggcaagggtggaatcgtgacctgcgcgatgttcacgtgcaagaagaacatggagggcaagatcgttcagcccgagaacctggagtacaccatagtgatcaccccgcacagcggggaggagcacgccgtcggcaacgacaccgggaagcacggcaaagagatcaagatcaccccgcaatcgagcaccaccgaggcagagctgacgggatatggtaccgtgaccatggagtgcagcccccggaccggcctcgacttcaacgagatggtgctcctgcagatggaggacaaagcctggctcgtccaccgccagtggttcctggacctgcccctaccctggctgcctggggccgatacgcagggtagcaactggatccagaaggagactcttgtgaccttcaagaacccccatgccaagaagcaagatgtggtagtgctcggctcccaagagggcgccatgcacaccgcgctgacgggggccaccgagattcagatgtcgagcggcaacctcctgttcaccggccacctgaagtgccgcctgcgtatggacaagttacaactgaaggggatgtcctacagcatgtgcaccggcaagttcaagatcgtcaaggagattgccgagacgcagcacgggaccatcgtgatccgtgtgcagtacgagggcgacggctccccctgcaagattccctttgagatcaccgatctggagaagcggcacgtgttaggaagactgatcaccgtgaacccgatcgtgacagagaaggacagtcctgtcaacatcgaagccgagccgccctttggcgactcctacatcatagtaggcgtggagcctggccagctgaagctcaactggttcaagaagggatcctcaataggccagatgttcgagaccaccatgcgcggcgcgaagcgcatggcaatccttggcgatactgcctgggacttcggctctctcggcggggtcttcacgtccattgggaaagccctccaccaggtgttcggggcgatctatggcgccgccttcagcggggtctcctggaccatgaagatcctgattggcgtcataatcacctggatcgggatgaacagccgctccactagcctgtctgttagcctggtgctcgttggcgtcgtgacgttatatctgggggccatggtccaggcagacagtggctgcatcgtgtcatggaagaataaggagctcaagtgcggctccggcatcttcatcaccgataatgtgcacacctggaccgagcaatacaagtttcagcccgagtcgccgagcaagcttgcctccgccatccagaaggcgcacgaggagggcatctgcgggatccggagcgtcacaaggctggagaacctcatgtggaagcaaatcacaccggagctaaaccacatcctgagcgagaacgaggtgaagctaaccatcatgaccggagatatcaaggggatcatgcaggcaggcaagcggagcttacgcccacagcccacggagctgaagtacagctggaagacctggggtaaggcaaagatgctcagcaccgagtcccacaatcagaccttcttgatagatggtcctgagacggccgaatgcccgaataccaaccgcgcatggaacagtctggaggtggaggactatggcttcggcgtcttcaccaccaacatctggctcaagctgcgcgagaagcaggacgtgttctgcgactccaagctgatgagcgccgcaatcaaggacaaccgagcagttcacgcggacatggggtattggattgagtctgccctcaacgacacctggaagatggagaaggccagctttatcgaagtcaagtcctgccactggcccaagagccacacgctgtggtccaacggcgtgctggagagcgagatgatcatccccaagaacttcgccggccccgtgtcccaacacaactaccgtccgggataccacacccagaccgcggggccttggcacctcggcaagctggagatggactttgacttctgtgaggggaccacggtcgtggtgaccgaggactgcggcaaccggggccccagcttacgtaccaccacggccagcggtaaactcatcaccgagtggtgctgccgatcttgcactctgcccccgctgcgttacagaggtgaggacgggtgctggtacggcatggagatccgccccttgaaggagaaagaggagaacctggtcaacagcctggtaaccgccgggcacggccagattgacaacttctccctcggcgtcttggggatggccctgttcctcgaggagatgctgagaactcgcgtcggcaccaagcatgcgattctgctagtggccctgagcttcgtaaccctgatcaccgggaacatgtccttcagggacctcggccgcgtcatggtgatggtgggggccacgatgactgacgacatcggcatgggcgtcacttacctagcgttgctcgcggcattcaaggtgcggcccaccttcgcggccgggctgctcctcaggaaactgacgagcaaggagttgatgatggccaccatcggcatcgccctcctgtcccagagcaccctgcccgagaccattcttgagctcacggacgcgttagccctcgggatgatggctctgaagatagtgcgcaacatggaaaagtaccagctagccgtcaccattatggcgatctcctgcgtgccgaacgcggtgattctccaaaatgcctggaaggtctcatgcaccatcctggcggcggtgtccgtgagccccctgctcttgacctccagccaacagaaggcggactggatccccctcgccttgacgatcaagggcctgaaccccaccgccatattcctgaccaccctctcacgaacgagcaagaagcgctcgtggccgctgaacgaggccatcatggccgtcggcatggtgagcatcttggcttccagcctcctgaagaacgacataccaatgaccgggccactggtcgccggcgggctgctgaccgtgtgctacgtgctgaccggccggagcgccgacctcgagttagagcgcgcggctgacgtcaagtgggaagatcaggcggagatctccgggagctcccccatcctgagcatcacgatctccgaggacggctccatgtccataaagaacgaagaggaggagcagaccttgaccatcctgatccggaccggactgctcgtgatcagcggggtattcccggtctccatccctatcaccgccgccgcgtggtacttatgggaggtgaagaagcagcgcgccggcgtgctgtgggatgtgcccagcccgccacccgtggggaaggcggaactcgaggatggcgcctatcggatcaagcagcgcggcatactgggctactcacagataggcgccggagtttacaaggagggcacattccacaccatgtggcatgtcacacgtggggccgtgctgatgcaccgaggtaagcggattgagccaagctgggccgacgtcaagaaagaccttatctcctacgggggcggctggaagttagagggggagtggaaggaaggcgaggaggtccaagtactggcactcgaacccgggaaaaaccccagggccgtgcagacgaagccaggtatcttcaagacgaacactggaaccatcggcgccgttagcctggactttagccccggaacctctggcagtcccatcgtggaccgcaaaggcaaggtggtcgggctgtacggcaacggcgtggtgacaaggagcggagcctacgtctccgcgatagcccagaccgagaagtccatcgaggacaaccctgagatcgaggacgacatctttcggaagaagcgcctcaccatcatggacctgcacccaggagccgggaagaccaagcggtacctacccgcaattgtgcgcgaggccatcaagcggggcctgcgcacgctcatactggcgccgacccgcgtggtcgccgccgaaatggaggaggccctgcgtggactccccatcaggtatcagacccccgccatccgcgcggagcacaccggccgcgagatcgtggacctgatgtgccacgccactttcaccatgcggctgctgagccctgtacgcgtgcctaactacaacctgatcatcatggatgaggcccacttcaccgaccccgcctccatcgccgcgagaggctacatcagcacccgcgtagagatgggggaggccgccgggatctttatgaccgcaacgccgcccgggtccagagaccccttcccccagtcaaatgcgcccatcatggacgaggagcgcgagataccggagcggtcctggaattccggtcacgagtgggtgaccgacttcaaagggaagaccgtctggtttgtgccctccatcaaggctggcaacgacattgccgcctgtctgaggaagaacggcaagaaggtgatccagctctcccggaaaacgttcgactcggaatacgtcaagaccagggccaacgactgggacttcgtggtgaccacagacatcagcgagatgggggccaacttcaaggccgagcgggtcattgatccccgccggtgcatgaagcccgtgatcctgacggacggcgaggaacgcgtcatcctggccgggcccatgccggtgacccattcaagcgccgcccagcggcgcggccgcatcgggcggaaccccaagaacgagaacgaccagtacatctacatgggcgagcccctcgagaacgacgaggactgcgcgcactggaaggaagccaagatgctgctggacaatattaacacccccgagggcattatcccgtccatgttcgagcccgagcgtgagaaggtggatgccatcgacggggagtatagactgcgcggcgaagctcggaagacgttcgtggacctgatgcgccgcggggacctgccagtgtggctcgcgtacaaggtggcggcagagggtatcaactacgccgaccgtaagtggtgtttcgacggtatcaagaacaaccagatcctggaggagaatgttgaagtcgagatctggacgaaggagggcgagcggaagaaactgaagccgcgttggctcgacgcccggatctacagcgaccccctggcgctgaaggagtttaaggaatttgccgccggcagaaagtccctcaccctgaatttgataaccgagatggggagactccccaccttcatgacgcaaaaagcccgcaacgcccttgacaacctggcggtgctccacaccgccgaggtgggggggaaggcctacacccatgcgctgagcgagctgccagagaccttagagacgctgctgctcctgaccctgctggccgcggtcaccggaggcatcttcctgttcctaatgtccggtaagggaatcgggaagatgactctcgggatgtgctgcatcatcaccgccagcatcctgctgtggtacgcacagatccagcctcactggatcgcggccagtattatcctggaattcttcctgatcgtgctgttaatccccgagcccgagaagcagagaacgccccaggataaccagctgacgtacgtcgtgatcgcgatcctgaccgtagtcgcagccaccatggctaatgagatggggttcctcgagaagacaaagaaggatctgggcttcgggagcatcaccacgcaggagtccgaatccaacatcttagacatcgacctccgccctgccagcgcgtggacattatacgcagtggccacgactttcgtgacccccatgctgcggcattccatcgagaattcctccgtcaatgtgagcctcactgccatcgcaaaccaggccacggtgctgatgggtctaggcaagggctggcccttgtccaagatggatatcggcgtccctttattagccatcgggtgctacagccaggttaacccgatcacccttaccgccgccctgctgctcctcgtggcgcactatgccatcatcggtcccggcctgcaggcgaaggcgacccgcgaggcccaaaagcgggccgcagccgggatcatgaagaaccccacggtcgacggcatcaccgtgatcgacttggaacccattccgtatgaccctaagttcgagaagcagctggggcaggtcatgctgttgattctgtgcgtcacccaggtactgatgatgcgcaccacgtgggctctctgcgaggccctgacacttgcgaccggccccatctccacactctgggaaggcaacccaggccggttctggaacacaaccatcgcagtaagcatggccaacatcttccgcggctcctacctggcaggagcgggactcctgttctcaatcatgaagaacaccaccaacacgcgccgggggaccggtaacgtcggggagaccttgggggaaaagtggaagtcccgattgaatgcactcggcaagagcgaattccagatctacaaaaagtccgggatccaggaagtagaccggaccctggcaaaggaggggatcaaacgcggggagacggaccatcacgctgtaagccggggttccgccaagttgcgctggttcgtcgagcggaatatggtgacaccggaaggaaaggtggtcgacctcggctgcggccgcgggggctggtcgtactattgcgggggcctgaagaatgtgcgggaggtaaagggcttgacgaagggcgggcccgggcacgaagagcccatccccatgtcgacctacggctggaatctcgttaggcttcagagcggggtggacgtgttcttcaccccacccgagaagtgtgacaccctgctatgtgacatcggtgagtcatcccccaaccccaccatcgaggcaggccgtaccctgcgcgtcctgaatttggtggagaactggctaaacaacaacacccagttctgtatcaaggtcctgaacccgtacatgccaagcgtaatagagaagatggagacgctccagcggaagtacggtggcgccctggtgcgcaatcccctgagccggaacagcacccacgagatgtactgggtgtctaacgccaccgggaatatcgtcagctccgtgaacatgatctcgcgcatgctgatcaaccgcttcacgatgaagcacaagaaggccacgtacgagccggacgttgacctcggctccggcacccgtaatatcggaattgagagcgaaatacccaacttagacatcgtcggcaagcggatcgagaagataaagcaggaacacgagacctcctggcactacgaccaagatcacccctacaagacctgggcctaccacgggagctatgagacgaaacagacaggctccgcgagctccatggttaacggggtggtacgcctgctgacaaagccctgggacgtggtaccgatggtcacccagatggccatgaccgacaccaccccgtttgggcagcagagggtgttcaaggagaaagttgacacccgaacgcaggagccgaaggagggcactaagaagctgatgaagatcaccgccaagtggctgtggaaagaactcgggaaggagaaaacgccccggatgtgcactcgggaagaattcacccgcaaggtgcggagcaacgccgccctgggcgcggtatttaccgacgagaacaagtggaagtcagccagggaagcagtggaggacgggaggttctgggagttagtcgaccgagagcggaacctccacctggagggcaagtgcgagacctgcgtatacaacatgatggggaagcgcgagaagaagctgggtgagttcggtaaggccaaaggctcaagggcgatctggtacatgtggttaggcgcccgcttcttagaattcgaggccttgggattcctcaacgaggaccactggttttcccggggcaactccctgagcggagtcgagggcgagggactacaccgcctcgggtacatcctgcgggaggtcggcaagaaagagggcggcgccatgtatgctgacgacacggcggggtgggacacccgcataaccctggaggacttaaagaacgaggagatggtcaccaatcacatgaagggggagcacaagaagctggcggaggccatcttcaagctgacgtaccagaataaggtcgtgcgggtgcaacgcccgacgccccggggcacagtcatggacatcatctccaggaaggatcagcgggggagcggacaggtggggacatacggcttgaacacattcaccaacatggaggcccagctgatccgtcagatggaaggcgagggcatctttaaaagcatacagcacctgaccgcaacagaggagatcgcggtgcagaactggctcgcccgcgtcggccgggagcgccttagtcggatggcaattagtggggatgactgtgtcgtgaagcccatcgacgaccgcttcgccagtgccctgacggcgttgaacgacatgggcaaggtcaggaaggacatacagcagtgggagccctctagagggtggaacgactggacacaggtgccgttttgcagccaccactttcacgagctggtgatgaaggatggccgggtactggtggtgccgtgccgcaaccaggacgaactcatcggtagggcccgcatcagtcagggggccggctggagcctgaaggagaccgcctgcctggggaagtcctacgcacaaatgtggacccttatgtattttcaccggcgcgacctgcggctggcggccaatgcgatctgcagcgccgtcccctcccactgggtgcccaccagccgcacgacctggagcattcacgcgaaacacgagtggatgacgacagaggatatgttagtggtctggaaccgggtgtggatccaggagaacccctggatggaggacaagacgcccgtggagagctgggaggaggtcccctacctgggcaagcgagaggaccagtggtgtgggagtctgatcggcctcaccagccgggccacgtgggccaagaacatccagactgccattaatcaagtgcgctctctgatcggtaacgagggatacacggactacatgccctccatgaagcggttccgacgagaggaggaggaggccggcgttctgtggtga

SEQ ID NO: 25114 - RNA, 9876 nt, synthetic construct
  misc_feature 1..9876: note = derived and/or modified CDS sequence (opt11) from DENV-2__KC294216__SS-prME
  source 1..9876: mol_type = other RNA
accgctggggtgatcattatgcttatccccaccgcaatggcgttccacctaaccacccgcaacggggagcctcacatgattgtgggccggcaggagaaggggaagtccctgctgttcaagaccgaggacggcgtgaacatgtgtaccttgatggcgatcgacctgggcgaactttgcgaggacaccatcacctataaatgtcctctactgcgccaaaacgagccagaggacatagactgctggtgtaatagcacctctacctgggtaacctacgggacctgtacgaccacgggggaacaccggagggagaagcggtccgtcgccctggtgccccacgttggcatgggcctcgagacccgaaccgagacctggatgagctcagaaggagcctggaagcatgtacagcggatcgagacctggatcctgcgtcacccgggcttcgccatcatggccgccatccttgcctacaccattgggaccacgcactttcagcgggcattgattttcatcctgttaacggcggtggcaccaagcatgaccatgcgctgcatcggtatcagcaaccgggacttcgtagaaggcgtgagcggaggctcctgggtggacattgtactcgagcacgggagctgcgtcacaactatggccaagaacaagcccacgctggatttagaactcatcaagaccgaggccaaacagccggccaccctgcggaagtattgcatagaagcgaagctgacgaacacaaccaccgaatcccggtgtccgacgcagggggagcctagtctcaacgaagaacaagacaaacgattcatctgcaaacacagcatggtggacaggggctgggggaacggctgtgggctgttcggcaagggcgggatcgtgacgtgcgcaatgttcacgtgtaagaagaacatggaagggaaagttgtgcttcccgagaacttagaatacactatagtaatcactcctcactcaggggaggaacatgccgtaggcaacgatactgggaaacacggagaggagatcaagatcacaccccaatccagcatcacggaggccgaactgaccggatatggcactgtgactatggagtgctcgccccggaccggcctggatttcaacgagatggtgttactgcagatggaggaaaaggcctggctggtgcaccggcagtggttcctagacttacccttgccttggctacccggggcagacacccagggtagcaactggatccaaaaagaaaccctggtgacgtttaagaacccccacgcgaagaagcaggatgtggtcgtactggggtcccaggagggagccatgcacaccgccctgacaggggccaccgagatacagatgagctcaggaaatctgctgtttacgggtcacctcaagtgcaggcttcggatggataaactgcagctcaaagggatgtcttacagcatgtgtaccgggaagttcaagatcgtgaaggagattgcggagactcagcacgggaccatcgtaatccgcgtgcagtacgaaggagacggctccccgtgcaagatccccttcgaaatcatggaccttgaaaagcggcacgtcttggggcgcctcatcacagtgaatccgattgttaccgagaaggacagccccgtcaatatagaggcagagccgcccttcggtgactcctacattatcataggagtcgagccaggtcagctgaagctaaattggttcaagaagggctcctccatcggtcaaatgttcgagaccaccatgcgcggcgccaagcggatggccatcctcggagataccgcctgggacttcggttctctcgggggagtgttcacaagtatcgggaaggcactccaccaggtctttggagccatctacggcgctgcattctccggggtgtcctggactatgaagatcctgatcggtgtgatcatcacatggatcggcatgaatagccgcagtacctcattatccgtctcactggtactggtgggcgtcgtaaccctataccttggggcaatggtgcaggcagactccggatgtgtcgtgtcgtggaaaaacaaggagctgaagtgcggctccgggatctttattaccgacaacgtgcacacttggacagagcagtataaattccagcctgagtccccgtccaagctcgcctccgcgatccagaaggctcacgaggaaggcatctgcgggatccggagcgtcacccgtctggagaacttgatgtggaagcagattacccccgaattgaaccacatcctgtccgagaacgaggttaagctgaccatcatgacaggcgacatcaagggaatcatgcaggcgggcaagcggtctctccgtcctcagcctaccgagcttaagtactcgtggaagacctggggcaaggccaagatgctaagcaccgaatcccacaaccagaccttcttaattgatgggcctgagacggcagagtgcccgaataccaaccgcgcttggaacagcctggaagtggaggactacggattcggagtcttcaccactaatatctggctgaagctccgtgagaagcaagacgtgttctgcgactccaaactgatgagcgccgctataaaggacaaccgggctgtgcacgccgacatgggctactggatagagtccgcgctgaacgacacctggaagatggagaaggccagctttatcgaggtcaaatcatgtcactggcccaagagccacaccctgtggtccaacggcgtacttgagagcgagatgatcatacccaagaatttcgctggcccggtgagccagcacaattaccggccgggctaccacacccaaactgccggtccgtggcatctgggcaaacttgaaatggacttcgacttctgcgaagggactaccgtcgtggtaactgaagactgcggtaatcggggacccagcctgaggaccaccaccgccagcgggaagctgataaccgagtggtgctgccgttcctgcacacttccacctctgcgctacagaggcgaggacgggtgctggtacggcatggagatccgccccttaaaggagaaagaggagaatctcgtgaacagtctggtcacggccggacacggacaaattgacaacttctccctgggggttctcgggatggcgctgtttctggaggagatgttacggacgcgcgttggcaccaagcacgccatcctcttagtggccgtgagcttcttaaccttgatcacagggaacatgagcttccgggatctggggcgagtgatggtaatggtaggcgttgctatgaccgacgacattggcatgggagtgacttacctcgccttattggcagccttcaaggtgcggcccacttttgccgccggactcctgctgcgaaagttaacgagcaaggagctgatgatggcaacaataggcatcaccctattatctcagagcaccacgcccgaaaccatcctggagttaactgacgcgctcgcgctgggaatgatggtcctgaaaatcgtgaggaacatggaaaagtaccagctcgcagtaaccatcatgacgatttcctgcgttccaaatgccatgattctgataaatgcctggaaggtgagctgtaccatcctggccgtggtgtccgtgtcacctctgctgctgacctcctcacagcagaaaacggactggatacctctcgcgctgacaatcaagggcctgaaccctaccgccatctttctcacaaccctctcccggacgagcaagaaacgctcatggccgctgaacgaggccgtaatggcagtgggcatggtgtcgatcctcgcctcaagcctgctcaaaaatgacattcccatgaccggtcccctagtcgccgggggtctgctgactgtttgttacgtgctgaccggccggagcgctgatctggagctggagcgggcagccgacgtaaaatgggaagatcaagccgagataagcgggtcgagtcccattctcagcatcacgatatccgaggacggctcaatgagtattaaaaatgaggaggaggagcaaaccctgaccatattaatccggaccggcctcctggtgataagcggggtgttcccggtctccattcccattaccgccgctgcctggtacctatgggaggtgcgcaagcagcgggctggcgtgctctgggacgtcccaagcccgccgccagtggagaaggctgaattggaagatggggcctatagaataaaacagcgcggcatactggggtactcccagataggcgccggggtgtacaaagagggcacgttccataccatgtggcacgtcacccgcggggcggtccttatgcatcgggggaagcgcatcgaacccagctgggcagacgtgaagaaggacttaatctcttatggcggtggatggaagctggaaggcgagtggaaggagggggaggaggtccaagtgctagccttagagcccggcaaaaatccccgggccgtgcagactaagcccgggctgttcaagacaaatacaggtaccataggcgccgtcagcttggacttctccccgggcactagcgggagcccgatcgtggaccgcaaaggcaaggtcgtaggtctgtatgggaacggagttgtgacccggtctggtgcgtacgtttccgcgatcgcgcagaccgagaagtccatcgaagacaaccccgagatcgaagacgacatcttccgcaagaaacggctgacgatcatggaccttcaccccggggcaggcaagaccaagcgctacctcccggccatcgtgcgggaggcgatcaaacgcggacttcgaactctgatcttggccccaacccgggtagtagctgccgagatggaagaggccctgagaggcctacccatccggtatcagacgcccgcgatcagggccgagcacaccgggagggagatcgttgatttaatgtgccacgcaacgttcacaatgcgcctgctgagccctgtgagggtaccaaattacaacctcatcatcatggacgaggcacacttcaccgaccccgcctcaatcgcggcccgcggatacatcagcacgcgcgttgagatgggcgaggccgccgggatctttatgacggccactccgcccggctctcgcgacccgttcccacaaagcaacgcgcccataatggacgaggagcgggagatccccgagcgctcctggaacagcgggcacgagtgggttaccgacttcaagggcaaaaccgtatggttcgtgccctcgatcaaggctgggaacgacatcgccgcttgcctccggaagaatggcaagaaggtgatccagctgagccgcaagaccttcgattctgagtacgtaaagacccgggctaacgactgggacttcgtggtgacaaccgatatctcggagatgggcgccaatttccgcgccgaacgggtcatcgaccctcgtcggtgcatgaagcccgtgatcctcacagatggggaggagagagtgatcctggccggacccatgcccgtcacccacagcagcgcagcgcagagacgcgggcgcgtaggccgcaaccctaagaacgagaacgaccagtacatatatatgggcgagcccttggagaacgatgaggactgcgcacactggaaggaggccaagatgctcctggataacataaacacccccgagggcatcatcccgtccatgtttgagcccgagcgcgagaaggtggacgccatagatggggagtatagactgcgcggggaggctcgcaaaacctttgttgatctcatgcgcagaggggacctgcctgtgtggctagcgtacagggtagcggccgagggtattaactacgccgatcgtcgctggtgctttgatggtatcaagaataaccagatcctcgaagaaaatgtggaggtggagatctggacgaaggagggggagcggaagaagctgaagccccgctggcttgacgcccgcatctacagcgaccccttggcgctgaaggaatttaaggaatttgccgccgggcgcaaatcgctaacgctgaatctcatcaccgagatgggccggctgcccaccttcatgactcagaaggccaggaacgcgctagacaatctggccgtactgcacaccgctgaagctgggggaagggcctacaatcacgcgctcagcgagctgcccgaaacgctggagaccttgctgctgctcacgctgctcgcaaccgtcacagggggcatattcctctttctcatgtcgggcaaggggatcggcaagatgactctgggaatgtgttgcatcatcaccgcaagcattctactatggtacgcccagattcaaccccactggatagccgcgtcaataatcctggagtttttcctaatagtgctgcttatccccgaacctgagaagcagcgcacgccccaggataaccagctcacgtatgtcgtgatagccatcctgacggtggtcgccgccaccatggccaatgagatggggtttctggagaagacaaagagagacctcgggcttggctcgatcactacacaggagtctgagtcaaacatcctggacatagacctccgccccgctagcgcctggaccttgtatgccgttgctacgacattcgtgacccccatgctgagacattctatcgaaaactccagcgtcaacgttagcctcaccgccattgcgaatcaggccactgtgctgatggggctgggaaaaggttggcccctttccaaaatggatatcggggttccccttttagccataggctgttacagtcaggtgaacccgatcacgctcaccgccgcgttactgctcctggtggcccactacgccatcatcgggcctggactgcaagccaaggccacccgggaggcacagaagcgcgccgctgccggcatcatgaagaacccgacggtagacggtatcacggtaatcgacctcgagccaatcccgtacgaccccaagttcgagaagcagctgggacaggtcatgctgcttatcctgtgtgtcacccaggtgctcatgatgcggaccacgtgggcactctgcgaggcgctgaccttggcaaccggcccaatcagcaccttgtgggaaggaaacccagggcgcttttggaatacgacgatcgcagtgagcatggccaacatattccgggggtcgtatctggcgggcgcggggctcctgttctccatcatgaagaacaccaccaacacgcgccggggcacagggaacatcggcgagaccctgggagagaagtggaagtcaagactaaacgccctcgggaagtcagagttccaaatctacaagcggagcggaatacaggaggtagaccgcaccctggccaaggaggggatcaaacgtggcgagacggaccaccacgccgtgagccggggctctgccaagctgcggtggttcgtagagcgcaacatggtcaccccagaaggcaaagttgtagacctcggctgcgggcggggcgggtggagctactattgtggcggccttaagaacgtaagagaggtaaagggcctgaccaagggaggccccggacacgaggagcctatacctatgtccacctacgggtggaacctcgtgcggctgcagtctggtgtcgacgtcttcttcacaccgcccgaaaagtgcgataccctgctatgcgatatcggggaaagctctcccaacccaaccatagaggccggccgtaccctgcgggtgctgaatctggtcgagaactggctgaacaacaacacccagttctgcatcaaagttctgaatccgtacatgccaagcgtcatcgaaaagatggagacgttgcagaggaagtatggcggggccttagtgcgcaaccctctatcccggaacagcacccatgagatgtactgggtgtcgaacgccaccggcaatatcgtgagctccgtgaacatgatctctcgaatgctgattaatcgattcaccatgaagcacaagaaggccacgtacgagccagacgtagacctcggatcgggtaccagaaacatcgggatcgagtctgagatacccaacctggcgatcatcggcaaacggatcgagaagatcaaacaggagcacgagacgtcctggcactacgaccaagaccacccctacaagacctgggcttaccacggcagttacgagacaaagcagactggaagtgcctcgtccatggtaaacggggtcgtgcgcctgctcacaaagccctgggacgttgtccccatggtaacacaaatggccatgactgacacaacccctttcggtcaacaacgggtttttaaggagaaagtcgataccagaacccaggagccgaaagaaggcaccaagaaactgatgcggatcaccgccgagtggctgtggaaggagctcggcaagaaaaagacgccgcgcatgtgcacgcgggaagagttcaccaggaaggtgcggagcaacgcggcattgggggccatcttcaccgacgagaataagtggaaatccgcccgcgaagccgtggaggacagccgtttctgggaacttgtcgatcgcgagcggaacctccacctggaaggcaaatgcgagacctgcgtttataatatgatggggaagcgtgagaagaagctgggcgagttcgggaaggcgaagggctccagagccatctggtacatgtggctcggtgcccggttcttggagtttgaagctcttgggttcctcaatgaggatcactggttttcacgtggcaacagcctctctggtgtcgagggagaagggctgcacagactcggatatatccttcgcgacgtgagcaagaaggagggcggggcgatgtacgccgacgatacggccggctgggacacccggattacgctcgaggacctcaaaaatgaggagatggtgacgaaccacatgaagggcgaacataagaagttagccgaggccgtctttaagctgacttaccaaaataaggtggtgagggtccagcggccgacaccccgcggcaccgtgatggacataatatcgcggcgcgatcaacgtggcagcggtcaggtgggtacctatgggctcaacactttcacaaatatggaggcgcaactgatcaggcaaatggagggcgaggggatcttcaagagtatacagcacttaaccgccaccgaggagattgcagtccagaactggctggcaagggtgggccgggagcggctgagtcgcatggccataagcggagacgattgcgtggtcaagcccctcgatgaccggtttgcgtccgcactcacggcgctaaacgacatggggaaggtgcgcaaggacatacaacagtgggagccttctcgcggatggaatgactggacccaagtgcctttctgcagccaccactttcatgagctggtaatgaaggatgggcgcgtgttggtcgtgccctgccgcaatcaagatgagctgatcggtcgagcacggatctcccaaggagcaggctggagcctgaaggagacggcctgcctcggaaagtcctacgcccagatgtggacgcttatgtacttccaccgtagggatctgcggctagcagcaaacgccatatgcagcgcggtgccctcccactgggtgccaaccagccgcacaacctggtccatacacgccaagcacgagtggatgacaactgaagacatgctggcagtatggaaccgcgtgtggatacaggaaaacccatggatggaggataaaacgcccgtagagagctgggaggaggtaccctacctcgggaagcgcgaggatcagtggtgcggcagcctcatcgggctaacctccagagccacctgggcaaagaacatccaaactgccataaaccaagttagatccctgatcgggaatgaggagtacacggactacatgccctccatgaagcggttccggcgcgaagaagaagaggcgggggttttgtggtga

SEQ ID NO: 25115 - RNA, 9876 nt, synthetic construct
  misc_feature 1..9876: note = derived and/or modified CDS sequence (opt11) from DENV-2__KC294218__SS-prME
  source 1..9876: mol_type = other RNA
accgccggcgtgatcgtcatgctgatccccaccgcaatggcgttccacctcacgacccgcaacggcgaaccccacatgatcgttggacggcaggagaaagggaagtccctgctgttcaagaccgaggatggtgtgaacatgtgcacactcatggccatcgatttgggggagctctgcgaagacacaatcacgtacaagtgcccattgctgcgccaaaacgaaccggaggacatcgattgctggtgcaacagcaccagcacctgggtaacatatgggacctgcaccaccacgggggagcatcgacgcgagaagcggtccgtggccctggtgccacacgtcgggatgggcctcgagaccagaacggagacatggatgagcagcgagggtgcatggaagcacgtccagcgtatcgagacctggattctgagacacccgggcttcaccattatggccgcaatacttgcctacaccatcgggactactcactttcaacgggccctcattctgatcctgctcaccgcagttgcgcctagcatgactatgcgatgcatcggcatatccaaccgggattttgtcgagggtgtgtcgggcggctcctgggtggacatcgtcctggagcacgggtcttgcgtgaccacgatggccaaaaataagcccaccttagacttcgagctcataaagaccgaggcgaagcaacccgcaaccttgcggaagtactgtatcgaagccaagctgacgaacaccaccaccgagtcaaggtgtccgacgcagggcgagccctcactcaacgaagagcaagacaaacgcttcatctgcaagcactccatggtggaccgggggtgggggaacggttgcggtctgttcgggaagggagggatcgtgacctgtgccatgttcacatgcaagaagaacatggagggaaagattgtgcaacctgagaacctcgagtataccatcgtgatcacgccacacagcggtgaggagcacgccgtgggcaatgataccggaaagcacggcaaagaaatcaagatcaccccgcagagcagcaccaccgaagctgagctcacggggtatggcaccgtgacaatggagtgtagtccccggacaggcctggacttcaatgaaatggtgctgctccaaatggaggataaggcctggctggttcaccggcagtggttcctggacctacccctgccctggctgccgggggcagacacgcagggcagtaactggatccagaaggagacacttgtgacattcaagaacccacatgctaaaaagcaggatgtagtcgtgttagggtctcaggagggggccatgcacaccgccctgacgggggcaaccgaaatccagatgagctctggtaacctgttgtttaccggccacctgaagtgccgcctccggatggacaagcttcaactgaaggggatgtcctactccatgtgcaccggcaaattcaagatcgtcaaagagatcgccgagacccaacacggtacaatcgtgattcgcgtccagtacgaaggcgatggctccccatgcaagatccccttcgaaatcaccgacctcgagaagcggcacgttctggggcgactcatcaccgttaatccgatcgtgacagagaaagactccccggtcaacatcgaggcagagccgcccttcggagactcttacatcatcgtgggagttgagccgggccaattaaagctgaactggttcaagaaggggagctccatcggccaaatgttcgaaaccactatgcgcggagccaagcggatggccatcctgggggacaccgcctgggacttcggttccctcgggggagtcttcacgtctatcggaaaggcactgcaccaggtgtttggcgcaatctacggcgctgccttcagcggcgtctcctggaccatgaagatattaatcggcgtcatcattacctggatcggtatgaacagtcgctcgacctcactgtccgtgagccttgtgctagtcggagtggtgaccctgtacctcggggccatggtacaggcggacagcggctgtatcgtgagctggaagaacaaggagctgaaatgcggctcaggtattttcatcactgacaacgttcatacatggacagagcagtacaagttccagcccgagtcccccagcaagctcgccagcgcaatccagaaagcgcacgaggaggggatctgcgggatccggagcgtcacgagactcgagaacctgatgtggaagcagatcacccctgagctcaaccacatactgtccgagaacgaggtgaagctaaccatcatgaccggggacattaagggaatcatgcaggctggcaagcgcagcctgaggcctcagcccaccgagctcaagtactcctggaagacctggggcaaggcgaagatgctgagcaccgaaagccacaatcagaccttcttaatcgatggaccggagaccgccgaatgcccgaataccaaccgggcctggaatagcttagaggtggaggactacggcttcggggtcttcaccaccaacatctggctgaaactgcgcgagaagcaggacgtgttctgcgatagtaagctcatgagcgccgccatcaaggacaaccgggctgtgcacgccgacatgggctactggatcgaatccgctctgaatgatacctggaagatggagaaggccagcttcatagaggtcaaatcctgccactggcccaagagccacacgctgtggtccaatggagtcctcgagagcgagatgatcatcccaaaaaactttgccgggccagtgtcccagcacaactacaggccgggctaccacacccagaccgcggggccctggcatctgggcaagctcgagatggacttcgacttctgcgaggggaccacggtcgttgtgaccgaggactgtggtaaccggggcccctcactccgcacaaccaccgcaagtgggaagctgatcacggagtggtgctgccggtcctgcacgctacctccgctccggtaccggggcgaggacggctgctggtacggcatggaaatcaggcccctaaaggagaaggaggagaatctggtgaacagcctggtcaccgccgggcatggccaaatcgacaacttctccctgggagttctgggtatggccctcttcctggaggagatgctgcggacgcgagtcggcactaagcacgcaatcctccttgtggccctgagcttcgtgacccttataaccgggaacatgtccttccgggacctcggccgcgtaatggttatggtgggcgccacaatgaccgacgacatcggcatgggcgtcacctacctggccctgctggccgcgttcaaggtgcgcccaacttttgccgcagggctcctgctgcggaagctgaccagcaaggaacttatgatggccacgatcgggatcgccctgctgtcccagagcaccctgccggagaccatcctggagctgacagacgcgctcgccctgggcatgatggccctgaagatcgtgcgcaacatggaaaaataccagctcgccgtcaccatcatggcgatctcctgcgtgccgaacgcggtgatcctgcaaaacgcgtggaaggtcagctgcaccatcttggcggccgtgtccgtaagccccctcctcctgacttcgtcccagcagaaggcggattggatccctctcgccctgactatcaagggcctcaaccccaccgctatattcctcactaccctgtcccggacaagcaaaaagcgctcctggcctctgaacgaagccataatggctgtgggcatggtgagcatcctcgcgtccagcctgctaaagaatgacatcccaatgaccgggccactcgtcgcaggcgggctgctgaccgtgtgctacgtgctcaccggccgcagcgccgacctggagctggagcgtgccgccgatgtcaagtgggaggatcaggcggaaatctccgggagcagtcccatcctcagcatcacgatctccgaggatggcagcatgtccattaagaatgaggaagaggagcaaacgttaaccatcctgatcaggaccggcctcctggtgatcagcggagtattcccggtctccatccccataaccgccgctgcctggtacttgtgggaggttaagaagcagcgtgccggagtgctctgggacgtccccagccccccgcctgtgggcaaggcggagctggaggacggcgcgtaccggatcaagcaacgcgggatcttgggctactcacagattggcgcgggggtatacaaggagggcacgttccataccatgtggcacgtcacccgcggggccgtcctcatgcaccgcggcaagcggatcgagcccagctgggccgatgtaaaaaaggacctcatctcttacgggggcggctggaagctggagggggagtggaaggaaggagaggaggtccaggtgctcgcactggagcccggtaagaacccacgagccgtgcagaccaagcccggcattttcaagacgaacaccggtaccatcggcgctgtaagcctggacttttcacccggaaccagcgggtccccgatcgtggaccggaagggcaaggtggtcgggctctacggcaacggcgttgtgacacgcagcggtgcctacgtctccgcgatcgctcagaccgagaagtccattgaggacaacccagagatcgaagacgacatcttccggaagaagcgtctgactatcatggatctgcatcccggcgctgggaagaccaagcggtacctccctgccatcgtgcgagaggcgatcaagcggggactccgcacgttaatcctggcgccgacccgcgtggtcgccgcggagatggaggaggccctacggggcctgcccatccgctaccagactcccgccatccgggcggaacatacgggccgtgagatcgtggacctgatgtgccatgccacgttcacgatgcggctcctgagtcccgtgcgcgtacccaactacaacctgatcatcatggacgaggcccactttactgaccccgcctccatcgccgcgagaggatacatcagcactcgcgttgagatgggggaggccgccggcatcttcatgacggccactccgcccgggtcccgggacccctttccccagtcgaacgcacccatcatggacgaggagcgagaaatccccgagcggtcctggaacagcggccacgagtgggtgaccgacttcaagggtaaaacagtctggttcgtcccgtccataaaagcgggcaacgacatcgccgcttgcctccgcaagaacggaaagaaagtgatccagttgtctcggaagacgtttgacagtgagtacgtgaagactcgcgcaaacgactgggacttcgtggtgacaaccgacattagcgaaatgggtgcgaacttcaaggccgaaagagtaatagacccccgccggtgcatgaagcccgtgatactgacggatggcgaggagcgcgttatcctcgccgggcccatgccggtcacccactccagcgccgcccaacggcgcggccgcatcgggaggaacccaaagaacgagaacgaccagtacatctacatgggggagcccctggaaaacgatgaggactgcgcgcactggaaagaagccaagatgctgctcgacaacatcaacacccccgagggcatcatcccgtccatgtttgagcccgagcgcgagaaggttgacgccatagacggggagtaccggctgcgcggcgaggcacggaagacattcgtggacctgatgcgccgtggggacctaccggtctggctcgcctacaaagttgcggccgaggggatcaactatgccgaccgtaagtggtgcttcgacggaatcaagaacaaccagatcctcgaagagaacgtggaggtggaaatctggacgaaggagggcgagcggaagaaactcaagccgcgttggctggacgccagaatctactctgaccccctggcgctcaaggagttcaaggagttcgccgccggccgcaaatccctgaccctaaacctcattacagagatgggccgccttcccaccttcatgacccagaaggcgcgcaacgctctggacaacctcgcggtgctgcacaccgccgaggtaggcggcaaagcctacacccacgccctgagcgagctccccgagaccctcgagacgttactcctgctgacactcctggccgcggtcaccggcggtatcttcctgttcctcatgtccgggaagggcatcgggaagatgacgctgggcatgtgctgcatcattacggccagcatcctgctctggtacgcgcagatccagccgcactggatcgcagcgtccatcattttagagttcttcctgatcgtgctcctgatccccgagcccgagaagcagagaacgccgcaggataaccagctgacctacgtcgtgatcgcgatccttaccgtggtcgccgccaccatggccaacgaaatggggttcctggagaagacgaagaaggacctgggctttggcagtataaccacccaggaaagtgagtccaatatcttggacatcgaccttcggccggccagcgcatggacactgtacgccgtggccacgacgtttgtgacccctatgttgagacactctatcgagaattcgagcgtcaacgtgagcctcaccgctatcgcgaaccaggccaccgtcttaatggggctcggcaaggggtggcctctgtccaagatggacatcggcgtccccttgctggctatcgggtgctacagccaagtgaaccccatcaccctcaccgccgccctgttactgctggtggcgcactacgcaatcatcggtcctggcctccaagcaaaggcaacccgagaggcccaaaagcgtgcggcggccgggatcatgaagaacccgacggtcgatggcatcaccgttatcgacttggagcccatcccgtatgaccccaaattcgagaagcagttaggccaggttatgctcttaatcctgtgcgttacccaggtactcatgatgcgcaccacgtgggccctgtgcgaggccttgaccttagcgaccggtccaatctccaccttatgggaaggcaaccccggcagattctggaacacgaccatcgccgtgagcatggcaaacatcttccgcggcagctatctggcaggggcgggactccttttcagcattatgaaaaacaccaccaacacgcgccgggggactggaaacgttggcgagaccctgggggaaaagtggaagtcccgcctcaacgccctgggcaagagcgagtttcagatctataagaagagtgggatccaggaggtggaccggaccttagccaaggaaggcatcaagcgcggggagactgaccaccacgcagtttctcggggctccgccaagctccgctggttcgtcgagcggaacatggtcaccccagaagggaaggtcgtcgacttaggttgcgggcgcggagggtggagctactattgcgggggcttgaagaacgtgcgggaggtgaagggcctcaccaagggcgggcccgggcacgaggaacctatccccatgtctacctacggctggaacttagtacgcctgcagagcggggtggatgtgtttttcacccctcccgaaaagtgcgacaccctcctgtgcgacatcggcgagagctcccccaacccaaccattgaagcgggtcgcaccctgagggtcctcaacctggtggaaaattggcttaacaacaacacccagttttgcatcaaggtactcaacccttacatgccaagcgtcatcgaaaagatggagacgctgcagcggaagtacgggggcgctctggtgagaaaccctttatcccggaactccacccacgagatgtactgggtatccaacgctaccgggaacatcgtcagctctgtgaatatgatcagccgcatgctcatcaaccggttcaccatgaagcacaagaaggcgacgtatgagccagacgtagatctaggctccggtacccgcaacattggcatcgagagtgagatcccgaacttggacattgtcggcaagagaatcgaaaagatcaagcaggagcatgagactagttggcactacgaccaagaccatccctacaagacctgggcctaccacgggagctacgagactaagcagaccggctccgcgagctccatggtgaacggggtggtcaggctccttaccaagccttgggacgtggtgccgatggtgacacagatggccatgacggacaccacgcccttcggccaacagcgcgtgttcaaagagaaggtggacacccggacgcaggagcccaaagagggcaccaagaagttgatgaagattaccgccgaatggctttggaaggagctggggaaagagaagacgccacggatgtgtacgcgagaggaattcacccgcaaggtccggagtaacgccgccctgggcgcggtgttcaccgatgagaacaagtggaagtccgcccgcgaggccgtggaggacgggcgcttctgggagctcgtcgaccgtgagcggaatctgcacctggaggggaagtgtgagacctgcgtgtataacatgatgggtaagagagaaaagaagctaggcgaattcggcaaggccaaggggagccgggcgatctggtacatgtggttgggcgcccgcttcctggagttcgaagccctcgggttcctgaacgaggaccactggttcagtcgggggaacagcctcagcggggtcgaaggcgagggcctccaccgcctgggatacatactgcgggaagtcggcaagaaggagggcggagcaatgtacgcggacgacacggcggggtgggacactcgcatcaccctcgaggacctcaagaatgaggagatggtgaccaaccacatgaaaggcgagcacaagaagctggccgaggccatcttcaagctcacgtaccaaaataaggtggtaagagtgcagcgcccgacgcctaggggcaccgtcatggacatcatctcccgcaaggaccagcgggggagcggccaggttgggacgtacggactaaacacgttcaccaacatggaagcccagctgatacgacagatggagggcgaggggatcttcaagtccattcagcacctcactgctaccgaggaaatcgcggtgcaaaactggctggcccgcgtcggccgggaacgccttagccggatggccatcagtggggatgactgcgtagtcaaaccaatcgacgaccgctttgccagcgcgctcacggctcttaacgacatgggaaaggtccggaaggacatccagcaatgggagccctcacgcgggtggaatgactggacacaagtaccgttctgcagccaccattttcacgagctggtgatgaaagacggccgggtccttgtggtgccctgccgcaaccaagacgagctgatcggccgggctcgcatcagccagggggccggctggagcttaaaggagactgcctgcctcgggaagagctacgcccagatgtggaccctgatgtattttcaccggcgcgacttacgcctagcggctaacgccatctgcagtgccgtcccttcccattgggtgcccaccagccgcacgacctggtccatacacgcgaaacacgaatggatgaccaccgaggatatgttagtggtctggaaccgggtgtggatccaggagaacccctggatggaagataagacgccagtcgagagctgggaggaagtcccctacctgggcaagcgcgaggaccagtggtgcggatcgctgatcggcctgaccagccgggccacctgggccaagaatatccagaccgccataaaccaggtgagaagcctgatcggcaacgagggctacacggactacatgccgtctatgaagcggttccgcagagaagaggaggaggccggagtgctttggtaa

SEQ ID NO: 25116 - RNA, 9876 nt, synthetic construct
  misc_feature 1..9876: note = derived and/or modified CDS sequence (opt11) from DENV-2__KC294220__SS-prME
  source 1..9876: mol_type = other RNA
accgccggcgtgatagtcatgctgatccctacggccatggccttccacctcaccacgcgcaacggggaacctcacatgatcgttggccggcaggagaagggcaagtccctgttattcaagacggaggacggcgtgaacatgtgcaccctcatggccatcgacctgggggagctgtgcgaggacaccatcacgtacaagtgtcccctgctgcgtcagaacgagcccgaggatatcgactgctggtgcaattccacctcaacatgggtcacgtacgggacttgcaccactacgggcgagcatcggcgcgagaagcggtccgtggccctggtgccccacgtcgggatgggcttggaaacgcgcaccgagacctggatgagctccgagggggcctggaagcacgttcagcggatcgagacctggatcctccgccacccgggcttcaccatcatggccgcgatcttagcctacaccatcgggaccacgcacttccagcgggccctcatcttcatactgctgaccgccgtggcgcccagcatgacgatgcgctgcatcggcatctccaaccgggacttcgtcgagggcgtgagcggaggctcctgggtggacatcgtgctcgagcacgggagctgcgtgacgacgatggctaagaacaagcccaccctggacttcgagctgatcaaaaccgaggccaaacaaccggccacccttcgcaagtactgtattgaagccaagctgacgaacaccaccaccgaatcccgatgcccgacgcagggcgaacccagcctgaatgaggagcaagacaaacgcttcatctgcaagcactccatggtggaccgagggtgggggaacggctgcggcttatttggcaagggcggcatcgtgacctgcgcgatgttcacgtgcaagaagaacatggaggggaagatcgtgcagcccgagaacctggagtacaccatcgtaatcacgcctcacagcggagaggagcatgccgtcggcaacgacaccgggaagcacgggaaggagatcaagatcaccccgcagtcgagcactaccgaggccgaactgacggggtacggcactgtgaccatggagtgcagccccaggaccggcctcgacttcaatgagatggtgttactgcaaatggaggacaaggcctggcttgtccaccgacagtggttcttggacctgcccctcccttggctgccgggggccgacacgcagggcagcaactggatccagaaagagaccttggtgaccttcaaaaacccccacgccaagaagcaggacgtagttgtattggggtcccaggagggcgccatgcacaccgccttgacgggagccaccgagatccagatgagcagcggcaacctcctgtttaccggccaccttaagtgccgcctacggatggacaagctccagctgaagggtatgtcttactctatgtgcactggcaagttcaagatcgtcaaggagatcgccgaaacacagcacgggaccattgttatccgcgtgcagtacgagggcgacggttcgccctgcaaaatccctttcgagatcaccgacctggagaaacggcatgtcctcgggcgcctgatcaccgtaaacccgatcgtgacggagaaggacagtccggtcaacatcgaggcggaaccgccctttggagactcctacatcatcgtgggggtggagccgggccaactgaaactcaattggttcaagaaggggagtagtatagggcaaatgttcgagaccaccatgcgcggcgcgaagcgaatggcgatactgggggacaccgcgtgggacttcggcagcttaggcggggtcttcacgtccatcggtaaagccctccaccaggtgttcggggcgatctacggcgctgccttcagcggggtgtcctggaccatgaagatcctcatcggggtcatcatcacctggatcgggatgaactcccgctctaccagcctgtccgtgagcttagttctcgtcggcgtggtgacgctgtacctgggggccatggtccaggcggattccggctgcatcgtcagctggaagaacaaggaactcaaatgtggttccggcatcttcatcaccgacaacgtccatacctggaccgagcaatacaagttccagcccgaatctccctctaagctggcttcagccatacagaaagcccacgaggagggcatctgcggtatccggagcgtcacgcgcctggagaacctcatgtggaagcagatcacacccgagttaaaccacatcctgtccgagaacgaggtgaagctcactataatgaccggcgacatcaaggggatcatgcaggccggcaagcgcagcctccgaccacagcccacggagctgaagtactcctggaagacctggggcaaggcaaagatgctcagtaccgagtcacacaatcagaccttcctgatcgacgggcccgagacggcagagtgcccgaacaccaaccgggcatggaactcgctagaggtggaagactacggattcggggtcttcaccaccaacatctggctcaaactgcgcgagaagcaggatgtgttttgcgactccaaactgatgagcgccgccatcaaggacaaccgggcggtgcatgccgacatgggctattggatcgagtccgcgctcaacgatacctggaaaatggagaaggccagcttcatcgaggtcaagtcctgccactggcccaagagccacacgctgtggtccaatggcgttctggagagcgagatgatcatccctaaaaacttcgccgggcccgtgtcccagcacaactaccgcccgggctaccacacgcagaccgctggaccttggcacctgggcaagctggagatggacttcgatttctgcgaggggaccacagtcgtggtgaccgaggactgcggaaaccgaggccccagcttacgcaccacaacggccagcgggaagctcatcaccgaatggtgctgcagatcttgcaccttgcccccgctgcgctacagaggggaagacggttgctggtacggaatggagatccgcccgctcaaggagaaggaggaaaacctggtcaacagcctggtgacggccgggcacggccaaattgacaacttctcactcggcgtgctggggatggccctcttcctcgaggagatgctgcggacgagagtcggtaccaaacacgcgatcctgctcgtggccctgtctttcgtgaccctgataaccgggaacatgtccttccgggacctcggccgggtaatggttatggtcggggccacgatgaccgatgacatcggcatgggcgttacctacctggccctgctcgccgcattcaaggtacgccccacctttgccgccgggctgctgctccggaagctgacgtccaaggagttaatgatggcgaccatcggcatcgcccttctgtcccagtctaccctgccagagacgatcctcgaactgacggacgccctggccctcgggatgatggctctgaagatcgtacgcaacatggagaagtaccagctggctgtcacgataatggccatctcctgcgtgcccaacgcagtgattctccagaatgcgtggaaggtaagttgcaccatcttggccgccgtgtccgtgagccctctgctcctgacctctagccaacagaaggccgattggatccccctggccctcaccatcaagggcctgaatcccaccgcgatcttcttgaccacactctcccggacgtctaagaagcgctcttggccgctgaacgaagccatcatggctgttggcatggtaagcatcctggcgtccagcttgttgaagaacgatatacccatgaccgggccgctggtcgccggaggactcttgacggtgtgttacgtgctgaccggtcgttctgcggacctcgagctggagcgcgccgccgacgtcaaatgggaggaccaggcggagatctccgggagctcccccattttgagcatcactatctccgaggatggaagcatgtccatcaagaacgaggaggaggagcagaccctcaccatcctgataagaacgggcctgctcgtgattagcggggtattcccggtctccattcctatcaccgcagccgcctggtacctgtgggaggtgaagaagcagcgcgccggtgtgctgtgggacgtcccctctccgccgccagtagggaaggcggagctcgaggatggagcctaccggataaagcagcgcgggattttaggctactcgcagataggggccggggtgtacaaggagggcaccttccacacaatgtggcatgtcaccagaggggcagtgctgatgcaccgcggcaagcggatcgaacccagctgggctgacgtcaagaaggacctcatatcgtacgggggcggctggaagctggagggggagtggaaggaaggcgaggaggtccaggtgttggcgctcgagcccgggaagaaccccagagccgtgcagaccaagccaggcatcttcaagacgaacaccgggaccatcggcgcggtcagcctggacttctcccccggcactagcgggtctcctattgtagaccggaaggggaaggtcgtcgggctgtacgggaacggtgtagtgacgaggagcggggcctacgtctccgcgatcgcccagaccgaaaagtcgatcgaggacaaccccgagattgaggacgatatcttccggaagaagcgcctcaccattatggatctacaccccggcgccgggaagactaagcggtacctgcccgccatcgtgagagaggccatcaagcggggcctgcgtacgctcatcctggcgccgacccgtgtcgtcgccgccgagatggaggaggccttgcgaggtctccccatccgctaccagacccccgccatccgggcggagcacaccggccgcgagatagtggacctgatgtgccacgccacgttcaccatgcggctactaagccccgtgcgtgtcccaaactacaacctcatcataatggacgaggcccactttaccgaccccgcaagtatcgccgcgcggggttacatctccacccgcgtggagatgggggaggccgccggcattttcatgacggccacgccgcctgggagccgggacccgttcccacagagtaacgcgcccattatggatgaggagcgcgagatccccgaacgttcctggaacagcggccacgagtgggtaaccgacttcaaggggaagaccgtctggtttgtgccgtcaatcaaggccgggaacgacatagccgcctgcctgcgcaagaacggcaagaaagtcatccaacttagccggaagacgttcgactccgagtacgtcaagactcgggccaacgattgggacttcgtagtgaccaccgacatctccgaaatgggggccaatttcaaagccgagcgggtcatcgacccacgccggtgcatgaaacccgtgatcctgacggacggggaggagcgggtgatcctggctgggcccatgccggtcacccactccagcgccgcgcagcgccgcggccgcatagggcggaaccccaagaacgagaacgatcagtacatctacatgggggagcccctggagaacgacgaggactgcgcgcactggaaggaggccaaaatgttgctggacaatatcaatacacccgagggtatcataccatcaatgttcgaacccgagagggagaaggtagacgccatcgacggggagtatcggctccgcggcgaggcccggaagaccttcgttgacctgatgcgccgcggtgacttgccagtctggctcgcttacaaagtggccgccgagggcataaactacgctgatcggaaatggtgcttcgacggtataaagaacaaccagatacttgaggagaacgtagaggtggagatctggacgaaggagggcgaacggaagaagctgaagccgagatggctcgatgcccgcatctactcagaccccctggccctgaaggagttcaaagagttcgcagccgggcgcaagtccctcacactgaacctgatcaccgagatggggcggctccccaccttcatgacgcaaaaggcgcgcaacgctcttgacaacttagcggtgctccacactgccgaggtaggcgggaaggcctacacccacgccctgagcgagttgcccgagaccctcgagacgctgctgcttctgaccctgctcgccgcggtcaccggaggcatcttcctgttcctgatgtctgggaagggcatcgggaaaatgaccctcggcatgtgctgcatcatcaccgccagcatcctgttatggtatgcccagatccagcctcattggatcgctgcctccataatcctcgagttcttcctgatcgtactgctcatccccgagcccgagaagcagcggactccccaagacaatcagctgacctacgtcgtcatcgcgattctgacagtggtcgccgcaacgatggccaacgagatggggttcctcgagaagacgaagaaggacctggggttcggcagcatcaccacccaggagtctgaatccaacattctggacatcgaccttcgtccggccagcgcgtggaccctgtacgccgtggcaacgacattcgtgacccccatgctgcggcactccatcgagaacagctccgtcaacgtgagcctcacggccatcgcaaaccaggcgacggtgctgatggggctgggtaaggggtggcccctctccaagatggatatcggggtccccctgttggctatcgggtgttactcgcaagtgaacccgatcaccctcacggccgcccttctgttgctggtggcgcactacgcaatcatcgggcccggcctgcaggcaaaggccacccgcgaggcccaaaagcgggcggccgcggggatcatgaagaatcccacagtcgacggaatcaccgtgatcgatctcgagcccatcccgtacgaccccaagttcgagaagcagctcgggcaggtcatgctgctcatcctgtgcgtcacccaggtattgatgatgcgcacgacgtgggccttatgtgaggccctgaccctcgcgaccggccccatctccacgctctgggagggtaaccccggccggttctggaacacaaccatcgccgtgagcatggccaacatctttcgcggctcctacctggccggggcgggcctcctattcagtatcatgaagaacaccacaaacacgcgccgggggaccggcaacgtcggcgagacgcttggagagaagtggaagtcccgccttaacgccctcggcaaaagcgagttccagatttacaagaagtcaggaatccaggaggtggaccggaccctggccaaggaaggtatcaagcgcggggaaacagaccaccacgccgtgagccggggctccgctaagctgcgctggttcgtcgaacggaatatggtgacgccagagggcaaggtggttgatctcggatgcggccgcgggggctggagctattattgcggtggcctgaagaacgtgcgggaggtgaaaggcctgaccaagggcggccccgggcacgaggaaccaatccccatgagcacatacggctggaacctcgtccgcctgcagagcggggtggatgtattcttcacgccgcccgaaatgtgcgacactctgctgtgcgacattggcgagagctcccccaatcccaccatcgaggcggggcggaccctgcgcgtactaaacctcgtagagaactggctgaacaacaacacgcagttctgtatcaaggtgttgaacccgtatatgccgtccgtcatcgaaaagatggagacgctccagcggaagtacgggggcgcgctcgtgcgcaaccccctgtcccggaacagcacccacgagatgtactgggtgtccaacgccaccggcaacatcgtaagctccgtcaatatgatcagccgcatgcttatcaatcgtttcaccatgaagcacaagaaggccacgtacgagcctgacgtcgacttggggtcgggtacgcgcaacattggaatcgagagcgagatccccaacctggacatagtcggcaagcgcatcgagaagatcaagcaggagcacgagacctcctggcactacgaccaggaccacccctataagacctgggcctaccacgggagctacgagacgaagcagaccggctccgcgagctccatggtgaacggggtagtaaggcttctcaccaagccctgggatgtggtgcctatggtgacccagatggccatgacggacactacccccttcggccagcagagagtattcaaggagaaggtggatacccggacgcaagagcccaaggaaggcaccaagaaactgatgaaaattacagccgagtggctgtggaaggagttgggaaaggagaagacgccccgaatgtgcacccgcgaagagttcacccgcaaggtacggagcaacgccgcccttggcgcggtgttcaccgacgagaacaagtggaagtctgcccgcgaggccgtggaggacgggcggttctgggagctggtcgaccgcgagcggaacctccacctggagggtaagtgcgagacctgcgtgtacaacatgatggggaagcgcgagaagaagctgggcgagttcggcaaggccaagggtagccgggcaatctggtatatgtggctcggcgcccggttcctggagttcgaggccctgggcttcctcaatgaggaccactggttctcccggggcaactccttgagcggggtcgagggcgaaggcctgcaccgcctcgggtacatcttacgggaggtgggcaagaaggagggcggcgccatgtatgccgacgacacggccgggtgggacacccgcatcaccctggaggacctgaagaacgaggagatggtcaccaaccacatgaagggcgaacacaagaagctggccgaagcgatcttcaaactgacataccagaacaaggtcgtgagagtgcagagaccaacgcctcgcggcaccgttatggacatcatatcccgtaaggaccagcgggggagcggacaggtggggacctacgggctcaacacgttcaccaatatggaggcccagctgatccgccaaatggagggtgaggggatctttaagtcaatccagcatctgaccgccacggaggagatcgcggtgcaaaattggctcgcccgcgtaggccgggagcgcttgagccgtatggccatctccggggacgactgcgtcgtcaagcccatcgacgaccgtttcgccagcgccctgacggcgctcaacgacatgggcaaagtccggaaagatatccagcagtgggagccctcccgcggatggaacgattggacccaggtgccgttctgcagccaccacttccacgagttggtgatgaaggacgggcgtgtcctggtagtgccctgccgcaatcaggacgaactcatcggccgggctcgcatttctcagggggcgggctggagcctgaaggagaccgcatgcctcgggaagtcctacgcccagatgtggaccctcatgtacttccaccgcagagacctgcggctggcggccaatgccatctgctccgctgtcccttcacattgggtgcccacctcgcgcacgacctggtcaatacacgcgaagcacgagtggatgaccacagaggacatgctcgttgtctggaaccgggtgtggatccaagagaacccgtggatggaggacaagacgccagtggagagctgggaggaggtcccctacctgggcaagcgagaggaccagtggtgcggctccctgatcggcctcacgagtagagctacttgggccaagaacattcagaccgccatcaaccaggtgcgcagcttaatcggtaacgagggttacactgactacatgccatccatgaagcgattccgcagagaggaggaggaggcaggcgtgctgtggtga

SEQ ID NO: 25117 - RNA, 9876 nt, synthetic construct
  misc_feature 1..9876: note = derived and/or modified CDS sequence (opt11) from DENV-2__KC294221__SS-prME
  source 1..9876: mol_type = other RNA
accgccggggtgatcgtcatgctgatccctaccgctatggcgtttcacctcacgacccggaatggtgaaccgcacatgatcgtgggccggcaggaaaaaggcaaatccctgttgtttaagaccgaggacggcgtaaacatgtgcaccttgatggccatcgacttaggggaactgtgcgaagacaccatcacctataagtgccctctcttgcgccaaaacgagcccgaggacatcgactgctggtgtaactcgacgtcgacctgggtcacttacgggacatgtacgacaacgggggagcatcggcgagagaagcggagcgtggccctggttccccacgttgggatgggcctcgagacccggactgaaacctggatgagctcagaaggggcctggaagcacgtacagcgtatagagacttggatcctgcgtcatccgggcttcacaatcatggccgcgattctggcctataccatcggaacaacgcacttccagcgggccctcatcttcatcctgctgaccgccgtggcgccatcgatgaccatgcgatgcataggcatcagtaaccgggacttcgttgagggcgtgagcgggggcagctgggtggacatcgtcctggagcacgggagctgcgtgaccacgatggccaagaacaagccaaccctggacttcgaattgatcaagacagaggctaaacagcctgccaccctccgcaaatactgcatcgaggcgaagctgacgaacaccacgactgaaagccggtgccctacgcagggcgagccctcgctgaacgaggaacaggacaagcgcttcatctgcaagcacagcatggtggatcggggctggggtaacggctgcgggttatttggcaagggtggcatcgtgacctgcgcgatgttcacgtgcaagaagaacatggagggcaagatagtgcagcccgaaaacctggagtacaccatcgtgataacgcctcactcaggagaggagcacgcagtcggcaacgacaccgggaagaggggcaaggagatcaagatcaccccgcagtccagcaccaccgaagccgagctgacggggtacggcaccgtgacgatggagtgcagcccacgaaccggcctcgactttaacgaaatggtgctgctgcagatggaggataaggcctggctcgtgcaccgccagtggtttctggacctgcccctcccctggctgccgggggccgacacgcagggcagcaattggatccagaaggagaccctggtaaccttcaagaaccctcacgctaagaagcaagacgtggtggtgttggggtcccaagaaggcgccatgcacaccgcgctgacgggagccaccgagattcagatgtcgagcggcaacttgctgttcacaggccacctgaagtgccggctgcgcatggacaaactccagctaaaagggatgtcctatagcatgtgcactggtaaattcaagatagtcaaggagattgccgagacgcagcacgggaccatcgtgatccgagtgcaatacgagggcgatggctccccctgcaaaatccccttcgagatcaccgacctagagaagcgccacgtcttgggacgccttatcacagtgaaccctatagtaacggagaaggactctcctgtcaacatcgaggcggagccgcccttcggggactcctacattattgtgggggtggagccgggacagctaaagctcaactggttcaagaaggggagctccatcggccagatgtttgagaccaccatgaggggcgccaagcgcatggccatcctgggtgacaccgcctgggacttcggatcgctaggaggggtcttcacatccatcgggaaggctctccaccaggttttcggagcgatttacggagccgccttctccggggtgtcctggactatgaagatcctcataggcgtcatcatcacctggatcgggatgaacagcagatcgaccagtctgtccgtaagcctagtgctcgtgggcgtggtgacgctctacctaggggccatggtccaggcggactccggctgtatcgtcagctggaaaaataaggagctcaagtgcggcagtggcatctttatcaccgataacgtgcacacctggaccgagcaatacaagttccagcccgagtcaccctccaagctggcatccgctatccagaaggcccacgaagaggggatctgtgggattcggagcgttacgcggctggagaacctcatgtggaaacaaatcacccccgagctgaaccacatcctgtccgaaaatgaggtgaagctcacgatcatgaccggcgacatcaagggaattatgcaggccggcaagcgcagcctgcggccacagcccacagagctgaagtacagctggaagacctggggaaaggcgaagatgctgtctactgagtcccacaaccagaccttcctgatcgatgggcccgagactgccgagtgcccgaacaccaaccgcgcctggaactctctggaggtggaggattatggattcggggtcttctccactaacatatggctcaagctccgggagaagcaagacgtgttctgcgatagcaaactgatgtccgccgccatcaaggacaaccgcgcggtgcacgcggacatgggttactggatcgagagcgccctcaacgatacctggaagatggagaaagcctcgttcatagaagtaaagagctgccactggcctaagagccacaccctgtggagcaacggcgtgcttgagtccgagatgatcatccccaagaacttcgccgggcccgtgtcgcaacataactaccggccgggataccacactcaaacggccgggccctggcatttgggaaaacttgagatggacttcgacttctgcgagggtacgaccgtcgtggtgacggaggactgcggcaaccgcggcccctcactgcgaaccaccaccgcctccgggaaactcatcacggagtggtgctgccgctcctgcaccctgcctcccttaaggtatcgcggcgaggatggatgttggtatggcatggagatccggccgcttaaggagaaggaggaaaatctggtcaactcattggtcaccgcagggcacggccagatagacaatttttcattgggcgtgctggggatggctttgtttttggaggagatgctgcgcacacgggtcggaacgaagcatgcgatactgctcgtggcactgtccttcgtgaccttaataaccggtaacatgtcattccgcgatctcggccgtgtaatggtgatggtgggggcgaccatgacggacgatatcggcatgggcgtcacgtacctggccttactcgccgcgttcaaggtgcggccgaccttcgccgcgggactgctgctacgcaagctgacctccaaggagctgatgatggccaccattgggatcgcactcctgagccaaagtaccctgccagagaccatcctagagctgaccgacgcactggctctcggtatgatggctctgaaaattgtccggaacatggagaaatatcagctggccgtcacgatcatggctatctcctgcgttccgaacgcggtaatcctccagaacgcctggaaggtctcttgcacgatcttggccgcagtgagcgttagccccttattattgacttcctcccaacagaaggcggattggattcccctggctctcaccataaagggcctgaacccgacggccatcttcctgaccactctctcccgcacgtcgaagaagcggagctggccgctgaacgaggccatcatggccgtgggcatggtgtcaatcctggcgtcgagtcttctgaagaacgacatacccatgacggggcccctggtcgccggcgggctcttgaccgtgtgctacgtccttaccggcagatccgccgacctcgaactggaacgggccgccgacgttaagtgggaggaccaagccgaaatctccggttccagtcctatcctctccattaccattagcgaggacggatccatgagcatcaaaaacgaggaggaggagcaaacgctcacaatcctgatcaggacggggttgctcgtgattagcggcgtgttcccggtgagcattccgatcaccgcagccgcctggtacctgtgggaggtgaaaaagcagcgggcgggggtgctgtgggatgtacccagcccgccgcccgttggtaaggcggagctcgaggacggcgcctatcgcatcaagcaacgggggatcctgggatactcgcagataggcgccggcgtgtacaaggagggcaccttccatactatgtggcacgtcacccgcggtgccgtgctgatgcaccgtggcaagaggatcgagccctcctgggccgacgtgaagaaggacctcatcagctacggcggagggtggaagctggagggggagtggaaagagggcgaggaggtccaggtgctagcgctcgagcccgggaagaacccccgggccgtgcagaccaagcccggcattttcaaaactaacacggggaccatcggcgccgtctccctggacttttcgcccggcacctccgggagccccatcgtggaccgcaagggaaaggtggtcgggctgtacggcaacggtgtggtgacacggtcgggggcttacgtctctgcaatcgcccagacggaaaagtcgattgaggacaatcccgagatcgaggacgacatcttccgcaagaaacggctcactatcatggacttacacccgggcgccgggaaaacgaagcgctacctgcccgcgatagtgcgagaagccatcaagagaggtctgcgcaccctcatcctggcgccgacgagggtggtcgcggccgagatggaagaggccctgcgcgggctccccatccggtaccagacccccgcaatccgggcagaacacactggacgggagatcgtggacctgatgtgccacgccacgttcacaatgcgcctgctcagccctgtgcgggtaccgaactacaacctgattatcatggacgaggcccacttcaccgaccccgccagcatcgccgcgaggggctacatctccaccagagtggagatgggggaagcagcgggcatcttcatgaccgcaacaccgccagggtcgcgcgaccccttcccccagtccaatgcgcccatcatggacgaggaacgggagatcccggagcgctcatggaactccggtcacgagtgggtgactgacttcaaagggaagaccgtctggtttgtgccgtcgatcaaggccggcaacgatatcgcggcctgcctacgaaagaacggcaagaaagtgatccagctctcccgcaagaccttcgatagcgagtacgtcaagacgcgggcaaacgactgggacttcgtggtcaccacagacatctccgagatgggagcgaacttcaaagcagagagagttatcgacccccggcgctgcatgaagccagttatcctgaccgacggtgaggaacgagtgatcctggctgggcccatgcctgtcacacacagctccgctgcacagcgacgcggccggataggtcgcaaccccaagaacgagaacgaccagtacatctacatgggcgagcccctagagaatgacgaggattgcgcgcattggaaggaggccaagatgctcctggataatatcaacacacccgagggcatcatcccgtcaatgttcgagcccgaacgggagaaggtggacgccatcgatggggagtatcgcctccgcggcgaggcccgcaagaccttcgtagacctgatgcggcgcggggacctgcctgtctggctggcctacaaggtcgcggcggagggcattaactacgcagaccggaagtggtgctttgacgggatcaagaacaatcaaatcttagaggaaaacgtagaggtcgagatttggaccaaggaaggcgaacgcaagaagttgaagccgcggtggctcgacgcccgcatctactccgaccccctggccctgaaggagttcaaggagttcgcagcgggccggaagtcccttactctgaacttgatcaccgagatggggcgcctccccaccttcatgacccaaaaggctcggaatgccctggacaacctggcggtgctccacacggccgaagtaggagggaaggcgtacacgcacgccttatccgagttgcccgagaccttggagacccttttgctcctgacgcttctcgccgcggtcaccggcggcatcttcctgttcctgatgtcagggaaaggcatcggaaaaatgaccctcggcatgtgttgcattatcaccgcctccatcctgctgtggtacgcgcaaatccagccgcattggatcgccgccagcatcatactagagtttttcctgattgtcctgctcattcccgaacccgagaagcagcgaacgccacaggataaccagctgacgtacgtcgtgatagcaatccttactgtggtcgccgccaccatggccaacgagatggggtttctcgagaagaccaagaaagacctgggcttcggatctataacgacccaggaatccgagtccaacatcctggatatagacctccggccggcctccgcgtggaccctgtatgccgtggcaactactttcgttacccccatgctgcgccacagcattgagaactccagcgtcaacgtgtccctcaccgccatagcgaaccaagccaccgtgctgatggggctgggaaagggttggccgctcagcaagatggacataggcgtccccctgttagctatcggatgttactcccaggtgaacccaataacgctcacagccgccctgttgctactggtagcgcactatgccatcatcggccccgggttacaagccaaggcgactcgtgaggcgcagaaacgtgcggcggccgggatcatgaagaatcccaccgtcgacggcatcacggttattgacctcgagcctatcccgtacgacccaaagttcgagaagcagctggggcaggtaatgctgctcatcctgtgcgtgacacaggtgctgatgatgcggaccacctgggccctatgcgaggccttaacgctggctaccggcccaatcagcaccctatgggaaggtaaccccggccgcttctggaataccacgatagctgtgtccatggccaacatcttccgcggaagctacctggccggggcgggcctccttttctccatcatgaaaaacactacgaacacccgtcgcgggacaggcaacgtaggcgagaccctcggggagaagtggaaatcccggctgaacgcgctcgggaaatcggagttccagatctacaagaagtctggcatccaggaggtggacagaaccctggccaaagagggcatcaagcgcggggaaaccgatcaccacgccgtttcccgcggcagcgcaaagctgcggtggtttgtcgagcgcaatatggtgactccggagggcaaggtggtcgatctcggatgcggcaggggcgggtggtcttattactgcggcgggctgaagaacgtcagagaggtgaagggattgactaagggcggcccaggtcacgaggagcccattcccatgtcaacctacggctggaacctcgtacgcctgcagagcggcgtggacgtgttcttcaccccgcccgagaagtgcgacaccctgctctgcgatatcggcgagtccagccccaacccgaccatcgaggccggccgcaccctgagagtcttgaacctcgtggagaactggttgaacaataacacccagttctgcatcaaggtactgaacccgtacatgccgtccgtcatcgagaagatggagacactacagcgaaagtacgggggcgccctggtaaggaaccctctgagccgcaactccacgcacgaaatgtactgggtgagcaacgcaaccggcaacatagtctccagcgttaacatgatctcccggatgctgatcaaccgcttcaccatgaagcacaagaaggctacctatgaacctgacgtagacctcggcagcggcacgcggaatataggaatcgagtccgagatccccaacttagacattgtcggcaagagaatcgagaagattaagcaggagcacgagacctcctggcattacgaccaggaccacccctataagacgtgggcctatcacgggtcctacgagaccaagcaaacgggtagcgcgtcaagtatggtaaacggggtggtccgcctgcttaccaagccctgggacgtggtgcctatggtcactcaaatggccatgaccgacaccacccccttcggccagcaaagggtgttcaaagagaaggtggacacccgcacccaggagcctaaggagggcacgaagaaactaatgaagataaccgccgagtggttatggaaagagctcggtaaggagaagacgccccgcatgtgcaccagggaggagttcacgcggaaggtccgctcaaatgcagccctgggcgccgtgttcactgacgagaacaaatggaagtccgcccgcgaggctgtggaggacggacgcttttgggagctggtcgaccgggagcgaaatttacacttagagggcaagtgcgaaacctgcgtctacaacatgatggggaagcgtgagaagaaacttggcgagttcggcaaggctaaggggtcccgcgcgatctggtacatgtggctcggcgcccggttcctggagttcgaggccctggggttcctcaacgaggaccactggttcagccgcggaaacagcctgtccggggtagagggggagggtctgcaccgactcgggtacatcctcagagaggtaggcaagaaggagggcggcgccatgtacgcggatgacaccgcagggtgggatacgcggatcaccctggaggacctcaaaaacgaggagatggtcaccaaccacatgaagggagagcacaagaagctagccgaggccatcttcaaactgacctaccagaacaaggttgtgcgcgtgcagcgcccgacgccccgcgggacggttatggacatcatcagccgaaaggatcagcgcgggtccggccaggttgggacttacggcctcaacacgttcacgaatatggaggcccagctgatcaggcagatggaaggcgaagggatcttcaagagcatccagcacctgaccgccaccgaggagatagcggtacagaattggttagcccgggttggccgcgagcgactgtctcgcatggccatcagcggggacgactgcgtggtgaaacccattgatgacagattcgcctccgccctcaccgcgctcaacgacatgggtaaagtcaggaaagacatccaacagtgggagcccagccgtgggtggaacgactggacccaggtgccgttctgttcccaccacttccacgagctggtaatgaaggacggccgcgttttggtggtcccatgtcggaaccaggatgagctcatcggccgtgcccggatcagccagggggctggctggagcctgaaagagaccgcgtgtctgggcaagtcctacgcccagatgtggacactcatgtacttccaccgccgtgacctgcggctggcggccaatgccatctgctccgccgtcccaagccattgggtacccacctcccggaccacgtggtctatccacgcgaagcacgagtggatgaccacggaggacatgctcgtggtgtggaatcgtgtttggatccaggagaatccgtggatggaggacaagacccccgtggagagttgggaggaggtcccctatctgggcaagcgtgaggatcagtggtgcggtagtctgatcggcctcactagccgcgcgacttgggccaagaacatccagacagccatcaaccaggttcggtccctgatcggcaacgaggggtacacagattacatgcccagcatgaagcgcttccgccgggaggaggaagaagcgggagtgctgtggtaa

SEQ ID NO: 25118 - RNA, 9876 nt, synthetic construct
  misc_feature 1..9876: note = derived and/or modified CDS sequence (opt11) from DENV-2__KC294223__SS-prME
  source 1..9876: mol_type = other RNA
acagccggtgtgatcgtcatgctgatccccaccgccatggcattccacttgaccacccgaaacggagagccccacatgatcgtgggtcgccaagagaaagggaagtcactgctctttaagactgaagacggggtcaacatgtgcaccttaatggctatcgacttaggggagttatgcgaagacactatcacctataaatgccccttgctgaggcaaaacgagcccgaggatatagactgctggtgcaactcaacaagcacatgggtgacctacgggacctgcaccaccacgggtgaacatcggcgcgagaaacgcagcgtggccttggtgccccacgtcgggatggggctcgagacgcgaaccgagacatggatgtcgtcggagggggcctggaaacacgtgcagcgcatcgagacatggatcctgcgccacccggggtttaccatcatggccgcgatcttggcgtacaccatcgggaccacccactttcagcgggccctcatattcatcttattgaccgcagtggcgccgagcatgacaatgaggtgtataggcatctcgaaccgggacttcgtcgagggggtgagcgggggtagctgggttgacatcgttttggaacacggttcctgcgtgaccacgatggccaagaacaaacccacacttgattttgaattgatcaaaaccgaagccaaacagcccgccaccctccgcaagtactgcatagaagccaagttgaccaatacaacaaccgagtcccggtgcccgacacagggcgagccctctctaaatgaggagcaggacaagcgctttatctgtaagcacagcatggtggaccgtggatgggggaacggctgcgggctttttggcaagggcggaatcgttacgtgcgctatgttcacctgtaagaagaatatggagggtaagattgttcagccagaaaacttagaatacaccatcgtgatcacgcctcactctggtgaggagcacgcagtcggcaacgataccggtaagcatggcaaggagataaaaatcacaccacaatcaagcaccaccgaggcggagctcacgggttacggtacggttacaatggagtgtagcccccggaccggcctagactttaacgagatggtactgcttcagatggaagataaagcctggctcgtacatcggcagtggttcctggacctgcccctaccttggctgcctggggccgacacacaaggctcgaactggatccagaaagaaacattagtcacctttaaaaacccgcacgctaagaagcaggatgtggtcgtgttagggtcccaagaaggcgcgatgcacacggcactgacgggggctacggaaatccagatgtcctcaggcaacctactgttcacaggccatctcaagtgtcgccttcggatggacaagctgcaactgaaggggatgtcgtactcgatgtgcaccggtaagttcaaaattgtcaaggagatcgcagagacgcaacatgggacaattgttatccgggtccagtatgagggcgacggctcaccctgtaagatccccttcgagattacggacctggaaaagcgccatgtcctcgggcgcctgatcaccgttaaccctatcgttaccgaaaaggacagtcctgtaaacatcgaagcggagccgccgttcggcgatagctacatcatcgtgggggtggagcccggtcaactgaaacttaactggtttaagaaggggtcctccattggacagatgtttgagaccaccatgcgcggcgccaagaggatggccatcctgggggacacagcctgggacttcggcagcctcggcggagtattcacatccatcgggaaagcgttacaccaagtgttcggtgcaatttacggtgctgccttcagcggggtgagttggacaatgaagattttgatcggagtgatcatcacctggatcggaatgaacagccgctccacctcactgtcagtgagcctggtactggtgggcgttgttacgctgtacctgggggctatggtccaggctgactccggctgtatagtgtcgtggaagaacaaggagctgaaatgtggtagcgggatcttcatcactgacaacgtgcatacgtggacggagcagtacaaattccaacccgagagtcccagcaaacttgcctccgccatacagaaggcccacgaggaaggcatctgtgggattcgctccgtgacgcgactggagaacttgatgtggaagcaaatcacaccggagctgaaccacattctgtccgagaatgaggtgaaacttaccatcatgacaggcgacattaagggcatcatgcaggctggaaagaggagcttacgcccgcagcccacggagctgaagtactcctggaagacctgggggaaggcgaagatgctcagcaccgagtcccacaaccagaccttcctcatagacggccccgaaacagctgaatgcccgaacaccaaccgggcttggaacagccttgaggtcgaagactatgggttcggagtgttcaccaccaatatctggttaaagttacgcgagaagcaggacgtcttctgtgattccaaactgatgagtgccgcaattaaggataatcgggcagtacatgccgacatgggctactggatcgaatctgcccttaacgacacttggaaaatggagaaagcgtcattcatagaggtcaagtcgtgtcactggcccaaaagtcacacgctatggagcaacggggtgctagagtctgagatgatcatccccaagaatttcgcggggccggtgagccagcacaactaccgcccgggataccacacacagaccgcagggccttggcacctgggcaaattggagatggactttgacttttgtgaaggtaccactgtggtcgtgaccgaggattgcggcaaccggggtccttctctgcgcacgacgacggcctccgggaaacttattaccgaatggtgctgccgtagttgcaccctgcccccactgcgataccggggcgaggatgggtgttggtacggtatggagatcaggcccctcaaggagaaagaggagaacctggtcaatagcctggtgaccgccgggcacggccagatcgacaatttttcgctcggcgtactgggaatggcccttttcttggaggagatgctacgaacgcgtgttgggaccaagcacgcaatcctgctcgttgccctgagcttcgtgaccctgatcaccgggaatatgtcctttcgagaccttggtcgcgtgatggtcatggtgggggcgacgatgaccgatgacatcggtatgggggtcacctacctagcacttctcgcagcgttcaaggtgcgtccaactttcgcagccggcctgttactccggaagctgaccagtaaggaactaatgatggccaccatcggcattgccttgctctcccagagcactctgcccgaaaccatcctcgagctcacggatgcactcgcgctaggtatgatggccctgaagatcgtgcgcaacatggagaaataccagctggcagtcaccatcatggccataagttgcgtcccgaacgcggtcatcttgcaaaatgcgtggaaggtcagctgcaccatcctcgcggctgtgtcagtcagcccgctgctcttgacatcctcgcaacagaaggcggactggattcccttagcactcacgataaagggactcaatccgactgccatattcttgacgactctctcacgaacctcgaagaagcgctcctggccgctgaacgaggccatcatggcggtcggcatggtgtccatcctggcctccagcctcttaaagaacgacatcccaatgacgggtcccctggtcgccggcgggctcctcactgtgtgttacgtcctcaccggcagatcagctgacctcgagctggagcgcgcggccgatgtcaaatgggaggaccaggcggaaatatccgggagctcccccattctcagcataacgataagtgaggatggctcaatgtccatcaagaatgaggaggaagaacaaactctcaccatcctaataaggacaggtctactggttatcagcggggtgttccccgtctccatccccatcaccgccgccgcctggtatctgtgggaggtgaaaaagcaacgcgcgggcgtcctttgggacgtccctagccctccgcctgtgggcaaagcggaattggaggacggcgcttaccggatcaagcaacgcgggatcctgggctactcccagattggggccggggtgtacaaagaaggtaccttccataccatgtggcatgtcaccaggggcgccgttctgatgcaccgcggcaagcggattgagccttcctgggcggacgtaaagaaggacctcatctcctatgggggcggctggaaattggaaggcgagtggaaggagggtgaagaagtacaggtgctcgctctcgagccggggaaaaacccacgtgctgttcagacgaagcccggtatattcaagactaacaccggcaccatcggagctgtcagtctggacttctccccgggcaccagcgggtcccccatcgtggaccgtaaaggtaaagttgtcgggctttacggcaacggtgtggttacgcgcagcggtgcctacgtgtccgcgatcgcccaaaccgagaagagtattgaggacaaccccgagatagaagatgacatcttccggaagaaacgcctcacgatcatggacctgcaccctggagccggcaagaccaagcggtatctgccagccatagtgcgcgaggctataaagcggggcctgcgcacgctcatcctcgcaccgacccgggtggtggccgcagagatggaggaggccttgcggggactccctattcgctaccagacgcccgcgatccgggcagaacacaccggccgcgagatcgtggatctaatgtgccacgccacgttcacgatgcggctcctaagcccagtgcgcgtcccgaactacaacctgatcattatggatgaagcccacttcacggaccccgcatccatcgccgcaagggggtacatctcgacgcgggtggagatgggggaagcggccggcatcttcatgacggccactccgccggggtccagggaccccttcccccagtcgaacgcacccatcatggacgaagaacgcgagatcccagagcggtcctggaactcaggacacgaatgggtaaccgacttcaagggtaagaccgtctggttcgtgccttccattaaggccggcaatgacatagcagcgtgcttacgcaagaacggcaagaaggtgatccagctcagccggaagacgttcgatagcgaatacgtaaagacgagagctaacgactgggactttgtggtcaccaccgacatctctgagatgggagccaacttcaaggccgagagagtaatcgacccgcgccgctgcatgaagcccgttatcctgacggacggggaggaacgggtgattctggccggcccaatgccagtcacgcacagtagcgccgcccagaggcgcggtcgaatcgggcggaaccccaagaacgagaatgatcagtacatctacatgggcgaacctctcgaaaacgatgaagactgcgcgcattggaaggaagcgaagatgcttttggataacatcaatacacccgagggaatcatcccatcgatgtttgaacccgaaagggagaaggtagatgccattgacggggagtaccgactccgcggagaagccagaaagaccttcgtggacctgatgcgcagaggggaccttccggtctggctagcctacaaggtcgcagctgaaggtatcaactacgcagacaggaagtggtgcttcgacgggatcaagaacaatcagattctcgaggagaacgtagaggtagagatctggacgaaggagggcgagcggaagaaactgaagcccaggtggttagacgcccggatttacagcgaccctttagctcttaaagagttcaaggagttcgccgcaggccgcaagtccttgaccctaaatcttattaccgagatgggcagactacccactttcatgacgcagaaggcccgtaacgccctcgacaatctcgccgttctccataccgccgaagtgggcggcaaggcctacactcacgccctcagcgagctcccagaaaccttagagacactgctgctcctaactcttctagccgcggttaccggcggaatcttcctgttcctcatgagtgggaagggcatagggaagatgaccttgggcatgtgttgcattataactgcgtcgatacttctatggtatgcccagatccaaccacactggatcgcggcctccatcatcctggagttctttctgatcgtgctgttaatccctgagcccgaaaagcagaggacgccacaggataaccagctgacctacgtcgttatcgctatcttaaccgtggttgccgctaccatggctaacgagatggggttcctcgagaaaacgaagaaagatctgggattcggaagcataacgactcaagagtcggaatccaacatcctggacatcgacctccggccggcgagcgcgtggaccctctacgctgtggccactaccttcgtgacccccatgctgcgtcactctatcgaaaacagcagcgtcaacgtgagcctgaccgcaatagcgaatcaagcgacggtgctcatgggattaggaaagggttggcccctgtctaagatggacataggtgtgccactcctggctatcggctgctactctcaagtgaatccgataacgctcaccgccgctctgctgcttctcgtggcgcactacgcgattataggaccgggcctgcaagcaaaggctacccgagaggcccagaagagagctgccgccggtatcatgaaaaaccccaccgtcgatggtatcaccgtcatagacctcgagccaattccgtacgatcccaagttcgaaaagcagctaggccaggtgatgctattgattctctgcgtaactcaggtgctgatgatgaggacgacgtgggccctctgcgaggccttaacccttgcgaccggacccatcagtaccctctgggaggggaaccccggccggttctggaatacgaccatagcggtatccatggccaatatcttccgcggctcctacctggctggagcgggcttgctgttcagcattatgaagaacacgaccaacactcgcagggggaccggcaacgtcggtgaaacactgggggaaaagtggaagtcccgactgaatgctctgggcaagagcgagttccagatctataagaagtcggggatccaagaggtggaccgcaccctggctaaggaaggcattaagagaggggagacggaccaccacgcggtcagtagggggtccgcgaagttaagatggttcgtcgaacgcaacatggtaactccggagggtaaagttgtagatctcggctgcggcagagggggatggagctactattgtggcggcctgaagaacgtgagagaggttaagggtctaacaaaagggggaccaggccacgaggagcctatcccaatgtccacctacggctggaacctggtgcgcctgcagtccggagtggacgtattctttaccccacctgagaagtgcgacaccctgctctgtgacatcggcgagtcatcgcctaaccccacaatcgaggcgggccggactctgcgcgtgctaaatttggtggaaaactggctgaataacaacactcagttctgtatcaaggtgctgaacccgtatatgcccagcgtcatcgagaagatggaaacactccagagaaagtacggcggggctctggttaggaacccgctttcccgaaatagcacccacgaaatgtattgggtgtctaatgccaccggaaacatcgtctcttctgtcaacatgatcagccgcatgctgatcaaccggtttaccatgaagcacaagaaggccacatatgagccggacgtagacctcggaagtgggacacgcaatataggcattgagagcgagattcccaatctagatatcgtcggcaagcgaatcgagaaaatcaaacaggaacacgagacttcctggcactacgatcaggaccacccttataagacctgggcctatcatggctcgtacgagacgaagcagaccggctccgcgagttccatggtgaacggggtggtccgactactcaccaagccgtgggatgtcgtgcccatggtcacccaaatggctatgacggataccactcccttcggacagcaacgggtgttcaaggagaaggttgatacccggacgcaagagccgaaagaggggaccaagaagttaatgaagatcacagccgagtggctgtggaaagagctcgggaaggagaagaccccaagaatgtgtacaagagaggagttcaccagaaaggtccgatctaacgccgccttaggcgcggtattcacggacgagaacaagtggaaaagcgccagggaggccgtggaagacggaaggttctgggaacttgtagatcgtgagcggaacctacacctggagggcaagtgcgagacctgcgtatacaacatgatgggtaagcgagagaaaaagttaggcgaatttggcaaggccaaagggagtcgggcgatctggtacatgtggctaggcgccaggttcctagagttcgaggccctggggttcctaaacgaagaccactggttctcccggggtaattcgctcagcggggttgagggcgaaggccttcacaggctcggatacattctgcgagaggtgggcaagaaggagggtggcgcaatgtatgccgacgatacggctgggtgggacacccgcataaccctagaggacctcaaaaatgaggagatggtgacgaaccatatgaagggcgagcacaagaaacttgccgaggccatcttcaaactgacgtatcagaataaggttgtgcgggtgcaacggcctactccgcggggtaccgtgatggacatcatatcccgtaaagaccagcggggaagcggccaggtaggaacatacggcctcaacacgttcactaacatggaggcacaacttatccgccagatggagggcgaagggatcttcaagtccatccagcacctgaccgccaccgaagagatagctgtacaaaactggctcgcacgcgtcggtcgggagcgcctgagccgtatggccattagtggggatgactgcgtggtgaaacccatcgacgacagattcgcttctgccttgacggcgctcaacgacatgggaaaggttcgaaaggacatacaacagtgggaaccctcccgcgggtggaacgattggacccaagtgccgttctgcagccatcacttccacgagctggtgatgaaagacggccgggttttagtggtgccatgccgcaaccaagacgagctcatcggtcgcgccagaatctcccagggggcaggctggagcctaaaggagactgcgtgcttagggaagagttatgcccagatgtggacactaatgtactttcaccgccgcgacttgagactagccgctaacgccatatgcagcgccgtaccatcacactgggtgccgacctctagaacaacctggtccatccacgcgaagcacgagtggatgaccaccgaggacatgctggtggtctggaaccgcgtctggatccaggagaacccgtggatggaggacaagacgcccgtggagagctgggaggaagttccgtacctgggcaaaagggaagaccagtggtgtgggtccctcatcggcctcaccagcagagccacctgggccaagaacatccaaacagccattaaccaggtgaggagcctgatcggtaacgaggggtacactgactatatgccgagcatgaagcggttcaggcgcgaggaagaggaggccggcgtgctgtggtga

SEQ ID NO: 25119 - RNA, 9876 nt, synthetic construct
  misc_feature 1..9876: note = derived and/or modified CDS sequence (opt11) from DENV-2__FJ906959__SS-prME
  source 1..9876: mol_type = other RNA
accgccggcatgatcatcatgctgattcccactgtgatggccttccacctcaccacccgaaacggggagcctcacatgatcgtcagccggcaggagaagggcaagtcgctcctgttcaagaccgaagacggtgtcaacatgtgcaccctcatggcgatggacctgggcgagctgtgcgaggacaccatcacctacaagtgcccattcttgaagcaaaacgagcccgaggacatagactgctggtgcaacagcacctccacctgggtgacgtatgggacctgcaccaccacgggcgagcaccgccgggagaaacgcagcgtcgccctcgtcccccacgtgggcatggggctggaaacgaggaccgaaacctggatgtcgtcagagggcgcttggaagcacgcccagcggattgagacttggatcctccggcacccggggttcaccatcatggccgcgatcctcgcgtacaccatcggcaccactcacttccaacgcgccctgatattcattctcctgaccgccgtcgctccctccatgaccatgcggtgcattgggattagcaatcgagacttcgtggagggagtatccggcgggtcatgggtcgacatcgtgctggagcacggctcctgcgtgacaacgatggccaaaaacaagcccaccctcgattttgagctgatcaagaccgaagccaagcaacccgccacactgcggaagtactgcatcgaggccaaactcacaaatacgaccaccgactcgcgctgcccgacccagggtgagccctccctgaacgaggagcaggacaagcggttcgtctgtaagcacagcatggtggaccggggctggggcaacggttgcggcttgttcggtaagggggggattgttacctgcgcgatgttcacgtgtaagaaaaacatgaagggcaaggtcgtgcagcccgagaacctcgagtacaccattgtaatcacgccccattccggcgaggagcacgccgtcgggaacgacaccggcaagcatgggaaggaaataaaaatcaccccgcagagctccatcaccgaggccgagcttaccggctacgggacggtgaccatggagtgcagcccccgtaccggcctggacttcaacgagatggtcttactgcaaatggaaaacaaggcttggctggtccaccgccagtggtttctcgacctgcccctgccctggttgccgggcgccgacactcagggatctaactggatccagaaggagacgctggtgaccttcaagaacccccacgcgaagaagcaagacgtcgtggtgcttggaagccaggagggggccatgcacacggccctcaccggtgccacggagatccagatgagctcggggaacttgctgttcaccggccatctcaagtgccggctgcgcatggacaagctgcagctcaagggcatgagctactccatgtgcaccgggaagttcaaggtcgtgaaagagatcgccgagacccagcacggcactatcgtgatccgggtccagtatgagggagatggcagcccctgcaagatccccttcgagatcatggacctcgagaagcgccacgtcctgggccggctgatcaccgttaacccgatcgtcaccgagaaggattcccccgtgaatattgaagcggagccgcccttcggggacagctatatcatcattggcgtggagcccgggcaactgaagctgaactggttcaaaaagggatccagcatcgggcagatgatcgagaccacgatgcgtggcgccaaacgcatggccatactcggagacacggcgtgggacttcggatccctcgggggtgtcttcacctctataggcaaggccctgcaccaggtgttcggggccatttacggcgccgctttctccggcgtaagctggatcatgaagatcctgatcggggtcattattacctggataggcatgaactcccggagcacgtccctgagcgtgtcgctagtgctggtaggggtggtgaccctgtaccttggagtcatggtacaggccgatagcgggtgcgtggtcagctggaagaacaaggagttaaagtgcggcagcggcatcttcatcaccgacaacgtccacacctggacggagcaatacaagttccagcccgaaagtccctcgaagctggcatcggctatccagaaggcccacgaggaggggatctgcggaatccgctccgtgacccgcctggagaacctgatgtggaagcagatcacccccgagctaaaccacattctgagcgagaacgaggtaaagttaacaatcatgacgggggacattaagggcatcatgcaggccgggaagagatccctccaaccccagcccacagagctgaagtacagctggaagacctggggcaaggccaagatgctctccaccgagagtcacaaccagacgttcttgatcgacggccccgagactgcagagtgtccgaacaccaaccgggcctggaactccctggaagtagaggattacggctttggcgtgttcaccacaaacatctggctgaagttacgcgagaagcaagacgtattctgcgacagcaagctgatgtccgccgccatcaaagacaaccgggccgttcacgcggacatggggtactggatcgaatcggccctcaatgacacctggaagatcgaaaaagcctccttcatcgaggtgaaaagctgccactggcccaaatcccacaccctctggagtaacggtgtgctggagtccgagatgatcatcccaaaaaactttgccggccccgtgagccagcacaactaccgccccgggtatcacacccagacggcaggcccttggcacctgggtaagctcgagatggacttcgacttctgcgaggggacgacggtcgtcgttaccgaggactgcgggaaccggggcccaagcctgcgtaccacgaccgcttccggcaagctaatcaccgagtggtgctgccggagctgcaccttgccgcccctgaggtatcgcggggaggatggctgctggtacgggatggagatccgcccgctgaaagaaaaggaagagaacctcgtgaactccctggtcacggccggccacgggcagatagacaacttcagcctgggcgtgctcggcatggcgctgttcctggaggagatgttacggacgcgtgtggggaccaagcacgctatcctgctggtggcggtaagcttcgttaccttaatcacaggcaacatgagcttccgggacctggggagagtgatggtaatggtgggcgccaccatgaccgacgatatcgggatgggtgtcacgtatctggccctcctcgcagccttcaaagtgcggcccacgtttgctgccggcctcctcctgcgcaaactcacgtccaaagagctcatgatgaccaccatcgggatcgtcctgctgagccagtcaacgatccccgagaccatcctcgagctgacagatgccttggccctgggcatgatggtcctgaaaatggtgcgcaagatggagaagtaccaactggccgtgaccatcatggcgatcctgtgcgtgcctaatgccgtgatcctgcagaacgcatggaaggtcagctgcacgatcttagccgtcgtgtcagtcagccccctcttcttgacctccagccaacagaaagccgactggatccccttggcgctcaccataaaggggctaaaccccaccgccatctttctgacaaccctatcccggaccaataagaagcgtagctggccgctgaacgaggcaatcatggccgtgggcatggtgtccatactggcgagctccctcctcaaaaacgacatccccatgaccggtcccctggtcgccgggggcctcttaacagtgtgctacgtgttgaccgggcggagtgccgatctcgagctggagcgcgccgccgacgtcaagtgggaggaccaagcggagatcagcggctccagccccatcctgtccataactatcagcgaggacgggtccatgagtatcaagaacgaggaggaagagcagaccctgacgatcctgatcaggaccggcctgcttgtgatcagcggcctgttccccgtgagcatccccatcaccgccgccgcctggtacttgtgggaggtcaagaagcagcgcgccggggtgctctgggacgtgcccagcccgcctccggtcggcaaggcagagctggaggacggagcgtaccggatcaagcagaagggcatcctggggtacagccagatcggtgcgggtgtgtacaaggaggggaccttccacacgatgtggcacgtaacgcgcggcgccgtcctaatgcacaaagggaagcgaatcgaaccatcctgggccgacgtgaagaaggacctgatcagctacggcggggggtggaaactggagggcgagtggaaggaaggagaggaggtgcaggtcctcgcgctggagcccggaaagaacccccgcgctgtgcagaccaagcccgggctattcaagaccaatgccgggacgatcggggcggtgtcgctcgacttcagccccggcacatccggcagccccatcatagacaagaaggggaaggtcgtgggcctgtacggcaacggcgtggtcacccgctccggcgcttacgtcagcgcgatcgcccagaccgagaagtccatcgaggacaaccccgagatcgaggacgacatcttccgcaagcggaagctgacaatcatggatctccaccccggggccggaaaaacgaagcggtatctgcccgccatcgtgcgggaggcgatcaagcgcgggttgcggaccctgatcttggccccgacccgtgtcgtggccgcagagatggaagaggccctgcggggcctgcccatccgctaccagacccccgcgatccgtgccgagcatacggggagggagattgtagacctcatgtgccacgcgaccttcaccatgcgcctgcttagtcccgtccgggtaccgaactacaacctcatcatcatggacgaggcccacttcaccgacccagcctccatcgcagcccgtggctacatctcgacgcgtgtagaaatgggcgaggccgctgggatcttcatgaccgctactccgcccggcagccgcgacccgtttccacagagcaacgcgcccatcatggacgaggagcgggagatccccgagcgtagctggtccagcgggcacgagtgggtaacagactttaagggcaaaacggtctggttcgtgccgtccattaaggccggcaacgacattgcggcctgcctgcggaaaaacggcaagaaggtcatccagctgagccgcaaaactttcgactccgaatatgtgaagacccggaccaacgactgggacttcgtggtcaccacggacattagcgaaatgggcgcgaacttcaaggccgagcgtgtgatcgacccccggcgttgtatgaagcctgtgatcctcacggatggtgaggagcgggtcatcctcgccggtcccatgccggtcacccactccagcgccgcgcagcgccgggggcgcatcggccggaaccccaagaacgagaacgaccagtacatctacatgggggagccgctcgagaacgacgaggactgcgcacactggaaggaggccaagatgctcctggacaacatcaacacgcccgagggcatcatcccgtccatgttcgagcccgagcgcgagaaggtggacgcaatcgacggcgagtaccggctgcgcggagaagcccgcaagacttttgtagacttgatgcggcgcggggacctgcccgtctggcttgcgtatcgggtggcggcagagggcatcaactacgccgaccgcaggtggtgcttcgacggcatcaagaacaatcagatcctcgaggagaacgtcgaagtggagatttggaccaaggagggggagcgcaagaagctgaaaccgcggtggctggacgcccgcatctactcggaccccctagccctgaaggagttcaaggagttcgcggcaggccggaagtccctgaccttgaacctgatcaccgaaatgggccgcctccccactttcatgacccaaaaggctcgggatgccttagacaacctggcggtcctgcacaccgccgaggctgggggccgcgcttacaaccacgccctgagcgagctacctgagacactggagaccctcttgctgctcaccctgctggcgaccgtcacaggagggatcttcctctttctgatgtccggccgtggtatagggaagatgaccctggggatgtgctgtatcatcactgccagcattctcctgtggtatgcacagatccagccccactggatcgccgcttccatcatcctggagttcttcctcatcgtgctgctgattcccgagcccgagaagcagcgcacgccccaggataaccagctgacctacgtcgtgatcgcgatcttaacggtcgtagctgccaccatggctaacgagatgggcttcctcgagaagaccaagaaagacctcgggcttggcagcatcaccacacagcagccggagagcaacatactagacatcgacctccggcccgcctccgcgtggaccctctacgctgtcgccaccaccttcgtgacgcccatgctacgccacagcatagagaactccagcgttaatgtttccctcacggcgatagccaaccaggcgaccgtgctgatgggcctggggaagggctggcccctcagcaagatggatatcggcgtcccgctgctggctatcggttgctactcccaggtgaatcctatcaccctcacggccgcgctattcctgctcgtggcccactacgcgataatcgggccaggcctgcaagccaaggccacacgggaggcccagaagcgggcggctgccggcatcatgaagaatcctaccgtcgacggtatcacagtcatcgacctggaccccatcccctacgaccccaagtttgagaaacagctcggccaggtgatgctgctggttctgtgcgtgactcaggtgttaatgatgcggaccacctgggctctgtgcgaagccctcaccctggcgactgggccaataagcaccctgtgggaaggcaacccggggcgcttctggaataccaccatcgccgtctccatggcaaacattttccgcggtagctacctagccggtgctgggctgctgttctccatcatgaagaacacgaccaacacccgcagaggcacggggaacattggggagactctcggcgagaaatggaagagccgactgaacgcgttgggcaagagcgagttccagatctacaagaaatccgggattcaggaggtggaccgcacactcgccaaggaggggatcaagcggggagagaccgaccatcacgccgtatcccgcgggagcgctaaactgcggtggttcgtcgagcgtaacatggtgacgcccgagggcaaggttgtcgacctggggtgcgggcggggggggtggtcttactactgcggcgggttgaagaacgtccgcgaggtgaaaggcctgacgaaaggcggtcccggccacgaggagcccattccaatgagtacctacgggtggaacctggtccggctccagtccggggtggacgtgttcttcacgccacccgagaagtgcgacaccctgctgtgcgatatcggagagagcagcccaaaccctacggtcgaggcgggccgcaccctccgggtgttgaacctggtggagaactggctcaacaacaatacccagttctgtatcaaggtgctaaatccgtacatgcccagtgtgatcgagaaaatggaagcgctgcagcgcaagtacggtggggcactcgtccgcaatccgctgtcacgcaactccacccatgaaatgtactgggtcagcaacgcctccggcaacattgtgagctccgtgaacatgatctcccggatgctgatcaaccgctttaccatgcggcacaaaaaggccacgtacgagccagacgtcgacctgggatccggcacccgcaacatagggatcgagagtgagatacccaacctcgacatcataggcaagcggatagagaagatcaagcaggagcacgagacctcctggcactacgaccaggatcatccctacaagacctgggcctaccacggcagctacgaaacgaaacagaccgggtccgcgagctccatggtgaacggagtggtccgcctgctgaccaagccgtgggatgtggtgcccatggtcacccagatggccatgacggacactacgcccttcgggcagcagcgcgtgttcaaggagaaggtagacacccgtactcaggagccaaaggaaggtactaagaagctcatgaagatcaccgccgagtggctctggaaggaacttggcaagaagaagacacctcgcatgtgcacgcgggaagagtttacccgcaaggtccgttcgaacgctgcgctcggggccatattcacagatgagaacaagtggaagtccgcccgcgaggctgttgaggacagcaggttctgggagctggtggacaaggagcgcaatctgcacctcgaaggcaagtgcgagacgtgcgtgtataacatgatgggcaaacgtgagaagaaactgggcgagttcgggaaggccaagggttcccgcgccatctggtacatgtggctgggcgcccggttcctcgagttcgaggccctggggttcctgaacgaggaccattggttcagccgcgagaacagcctctccggtgtggaaggagaaggtctacataagctgggctacatcctccgagacgtcagcaagaaggagggaggcgccatgtacgcggacgacacggcggggtgggacacccgcataaccctggaggatctgaagaacgaggagatggtgaccaaccacatggagggcgagcataagaagcttgccgaggccatctttaagcttacgtaccagaacaaggtggtgcgggtgcagcgccccacgccccgggggaccgtgatggacatcatttctcgccgtgaccagcgcggcagcgggcaagtcggaacctacggactgaacacctttaccaatatggaggcccagctcatccggcagatggagggggagggcgtctttaaatccatccagcacctgactgtgaccgaggagatcgcggtccagaactggttggcccgcgtggggcgcgagcggctcagccgaatggcaatttccggcgatgactgtgtggtcaagcctctggacgaccggtttgccagcgccctgacggcgctcaacgacatgggcaaggtgcgaaaggacatccagcaatgggagccttcccgggggtggaacgactggacgcaagtgcccttctgcagccaccacttccacgagctgatcatgaaggacggcagggtcttagtcgtgccatgccggaaccaggacgagctcatagggcgcgcccgcatctcccaaggcgccggctggagcctgcgcgaaaccgcctgcctaggcaagtcctacgctcagatgtggtcgctgatgtacttccaccggagagacctgcgtctggcggctaacgccatctgctcagccgtccccagccactgggtgcctacttccagaaccacgtggagcatccacgctaagcacgagtggatgaccaccgaggacatgctcaccgtgtggaaccgggtctggatacaggaaaacccgtggatggaagacaagacgcccgtggagagttgggaggagatcccatacctgggaaaacgggaagaccagtggtgcgggtccctgatcgggttgaccagccgggcgacctgggccaagaacatccagaccgccatcaaccaggtgcgctccctgatagggaacgaagaatacaccgactacatgccgagcatgaaacggttccgccgcgaggaagaggaagccggcgtcctgtggtag

SEQ ID NO: 25120 - RNA, 9876 nt, synthetic construct
  misc_feature 1..9876: note = derived and/or modified CDS sequence (opt11) from DENV-2__KF360005__SS-prME
  source 1..9876: mol_type = other RNA
accgccggggtgatcatcatgcgaatccccactgccatggcttttcacttgacgacccgaaacggggagccccacatgatagtgagcaagcaggagaagggcaagtccctcctcttcaagactgaggacggggtgaacatgtgcaccctcatggcgatggacctcggcgagctgtgcgaggataccatcacctataactgtcccttactccggcagaacgagcccgaagacatcgactgctggtgcaacagcacctccacctgggtcacttacgggacctgcaccgccaccggcgagcaccggagggagaagcggagcgtagccctggtgccccatgtcggcatgggcctggaaacccgcaccgagacctggatgtccagcgagggcgcgtggaagcacgcgcagaggatcgagacctggattctccggcatcccggtttcaccataatggctgccatcctggcctacaccatcgggaccacctacttccagcgggtgcttatatttattttactgacggcggtggcaccctcgatgacaatgaggtgcatcgggataagcaaccgggacttcgtggagggcgtctccggtgggagctgggtcgacatcgtactggagcacggctcctgtgtcaccaccatggctaagaacaagcccacgctcgacttcgagcttattaaaaccgaagccaagcagcccgcaaccctgcgcaagtactgtatcgaggcgaagctcaccaacacgaccaccgcctcccggtgcccgacacagggggaaccttccctgaacgaggagcaggacaagcgcttcgtgtgcaagcacagcatggtgggccggggctggggcgacggctgcggactgttcggcaagggcgggatagtcacgtgcgctatgttcacgtgcaagaaaaacatggagggtaagatcgttcagcccgagaacctcgagtacaccatcgttgtcacgccacattccggggaggagaacgccgtgggcaatgacacggggaagcacggcaaggagatcaaggtgaccccgcagtcctctatcaccgaggccgagctaaccgggtacggtactgtcacgatggagtgctcaccccgcaccggattagatttcaacgagatggtgctcctccagatggagaacaaggcgtggctggtgcaccggcagtggttcctcgacctgcccctgccctggctcccgggggccgacatccagggctccaattggatccagaaagagacgttggtcacctttaagaacccccacgcgaagaaacaggacgtggtcgtgctggggagtcaggagggcgcactccacacggccctgactggggcgaccgagatccagatgtcatctggcaacctgctgttcaccggccacctgaagtgtcgcttacggatggataaactccagctgaagggaatgtcgtactccatgtgcacgggcaagttcaaggtggtcaaggaaatcgcggagacccagcacggaaccatcgtcgtgcgcatccagtacgagggagacggcagcccctgtaagattccctttgagattatggacctggaaaaacggcacgtcctcgggagactgatcaccgtgaaccccatcgtgacggaaaaggactcaccagtaaacatcgaggctgagccgccttttggggacagttacattatcattggggtagagccgggccaactgaaactctcctggtttaagaagggttcgtcaatcggacagatgttcgagaccactatgcgcggcgccaagcggatggcgatattaggggacaccgcgtgggattttggctctctcggtggggtttttacgtccatagggaaggctcttcatcaggtgtttggggccatctacggcgccgcgttcagcggagtgagctggaccatgaagatcctgatcggagtggtcatcacctggatcgggatgaactcgcgctccaccagcctgtccgtgagcctggtgctcgtcggcgttgtgacactgtacttgggggtcatggtgcaggccgattccggctgtgtagtcagctggcggaataaggagttgaagtgtggaagcggaatcttcatcaccgataacgtgcacacatggactgagcagtataagttccaacccgagtcccccagcaagctggcctccgccatccagaaggcccacgaggagggcatctgcgggatccgcagcgtgacccggctggagaacctcatgtggaagcagatcactccggagctaaaccatatcctctccgagaatgaggtcaagttaagcatcatgaccggcgacatcaagggaatcatgcaggcgggcaagcgctccctacggccgcagcccaccgagcttaagtactcctggaagacgtggggcaaggcaaagatgctctccaccgagccacacaaccagaccttcctgatcgacgggcccgagaccgcagaatgtcctaacaccaacagggcatggaacagcctggaggtggaggactacggctttggggtgttcacaaccaatatctggctcaagctgaaagagcggcaggacgtcttctgcgactccaagctgatgagcgccgcgattaaggacaaccgcgcagttcacgccgacatgggctactggatagagtcggcactcaacgacacctggaagatcgagaaggccagctttatcgaggtgaagtcctgccactggcccaaaagccacacgttatggtccaacggcgtgctagagagcgagatgatcatccccaagaacttcgcaggccccgttagccagcacaattacagacccgggtaccatacccagaccgccgggccctggcacctcggcaaactggagatggatttcgacttctgcgaagggaccaccgtggtcgtgacggaggactgcggcaatcgcggtccctccctgagaaccactaccgccagcgggaagctgatcacagagtggtgctgccgctcctgcaccctacctccattacggtatcgcggcgaggacgggtgctggtacggaatggaaatccggcctctcaaagagaaggaggagaatctggtgaacagcctcgtaaccgccgggcatggccagatagacaacttctccttaggcgtgctggggatggcgctgtttctcgaggagatgctgcgcacccgggtggggacgaagcacgccgtgctgctcgtggccgtgagcttcatgaccctgataacaggtaacatgtcgttccgggacctgggacgggtcatggtgatggtaggggctgccatgaccgacgacatcggcatgggagtgacgtacctcgctcttctggccgcctttaaggtccggcccaccttcgccgccgggctcctgctgcgcaaactcacaagcaaggagctgatgatgacaacgatcggaatcgtgctgctatcccaaagtacgacccccgaaaccatcctcgagttaacggatgcgctagccctggggatgatgatcctgaagatcgtccggaacatggaaaagtaccaattggccgtgaccattatggccatcctgtgcgtcccgaacgccgtgatactgcagaatgcgtggaaggtgtcgtgcactatcctcgcggccgtgtctgtgtcgcccttgctgctcaccagtagtcagcagaaagccgactggatccccctggccctgacgatcaagggcctcaaccccaccgccattttcctcactaccctgagccgcacgaataagaagcggagctggcccctcaacgaggccatcatggcagtgggcatggtcagcatcctggcatctagcctactgaagaatgacatccccatgaccgggcccctcgttgctggagggctgctcacagtatgttacgtcctgaccggccgcagcgctgatctggagctcgaaagggctgccgacgtgaggtgggaggaccaggcggaggtgtccggtagcagcccgattctgagcattacgatctccgaggatggcagcatgtccataaagaacgaggaggaggaacagaccctgaccatcctcatccggactggcctgctggtaatcagcggcctcttccccgtgtctatcccaattactgcagcggcatggtacctgtgggaggtaaagaagcagcgggccggagtactgtctgccgtgcccagtccgcctcccgtcgggaaggcggagctcgaggacggcgcgtaccggatcaagcagaagggcatcctgggttacagtcagatcggggctggggtatacaaagaaggaacgttccacaccatgtggcacgtgaccagaggtgccgtgctgatgcacaagggcaaaagaatcgagccgtcctgggccgatgtcagaaaggacctaatcagctacggagggggccgtaagttggaaggcgagtggaaagagggcgaagaggtccaggtgctggctctcgagcccggcaagaacccccgcgccgtgcagaccaagccgggcctgttcaaaacaaacaccgggaccattggggccgtttcccttgacttctcacccggcgcatccgggagccccattgtggataagaagggcaaggttgttgggctctatggcaacggcgtggttacgcggtccgggacgtacgtcagcgcgatcgcccaaaccgagaaatccatcgaggataaccccgagatcgaagacgacatctttagaaagaaacggctgaccataatggacctgcaccccggagcagggaaaaccaagcgttaccttccggccatcgtgcgggaggccattaaacggggcctccgcacgctgatcctggcgcccacccgggttgtggccgctgagatggaggaagccctccgcgggctacccatcagataccagaccccagccattcgtgcggagcacaccggccgcgagatcgtagatttgatgtgccacgcaactttcactatgcgcctcctatccccggtccgggtgccaaactacaacctgataatcatggacgaggcgcatttcaccgaccccgcctcaatcgccgcgagaggctatatctctacccgggtagagatgggggaggctgccggcatctttatgacggccacgcctcccgggtcaagagaccccttcccccagtccaacgcgcccatcatggacgaggaacgggagatccccgagcgaagctggaattccgggcatgagtgggtcacggacttcaagggaaagaccgtgtggtttgtgcccagcatcaaggcaggcaacgatattgccgcctgcctccgaaagaacggcaagaaggtcatccaactgtccaggaagacgttcgacagcgaatacatcaagacccggacaaatgactgggacttcgtggtgaccacggatatttctgagatgggcgcaaacttcaaagccgagcgcgtcatcgacccacgacggtgtatgaaacccgtgatcctgaccgacggcgaagaacgggttatcctcgccgggccgatgccagtcactcatagctcggccgctcagcgccgcggccggatcgggcgcaaccccaaaaacgagaacgaccaatacatctacatgggcgagcccctggagaacgacgaggactgcgcccactggaaggaggcgaagatgctgctggacaacataaacaccccggaggggatcatcccctcgatgttcgaacccgagcgagagaaggtagacgccatagacggggagtacaggctgcggggcgaggcgcgcaagactttcgtggacctgatgcggcgcggggacctccccgtctggctcgcctaccgggtggccgcggagggcattaactacgccgaccgacggtggtgcttcgacggtatcaagaacaatcagatcctggaggagaacgtcgaggtggagatctggaccaaggagggcgagcgcaagaagctcaagccccggtggctagacgctagaatttactccgaccccctggccctaaaagaatttaaagaattcgcagcaggccgaaaaagtttgaccctgaacctcatcacagagatgggccgcctgcccacgttcatgacccagaaggcccgaaacgccctggacaacctagccgtgctacacaccgcggaggccgggggtcgcgcctacaatcacgccctgtccgagctcccggagactctggagacgctgctcctgctgactctcctggccaccgtcaccgggggcatcttcctgttcctgatgagcggtaagggcattggtaaaatgaccttgggcatgtgctgcatcatcaccgcttctattctgctctggtacgcccagatccagccccactggatcgccgcatctatcatcttggagttcttcctgatcgtgctcctgatccccgagccagagaagcagcggacacctcaggacaaccagctcacttatgtggtcatcgccatcctcaccgtggtggcggccacgatggccaatgagatggggttcctggagaagaccaagaaggacttcggcctgggcagcattgccacccaacagcccgagagcaacatcctcgacatcgacctgcgccccgccagcgcgtggaccctgtacgccgtcgccacgaccttcatcacacccatgttgcggcacagcatcgagaactcatccgtgaacgtgagcctgaccgcaatcgcaaaccaggccacggtcctgatgggcctcggaaaggggtggccgctgagtaagatggacatcggcgtgccgttgctcgccatagggtgctatagccaggtgaaccccatcaccctgaccgccgccctgttgctgctcgtcgcccattatgccatcattggcccgggcctccaggcaaaggccacgcgcgaagcccaaaagcgcgcggccgccgggatcatgaagaacccgacggccgacggcatcaccgtcatcgacctggatcctatcccctatgatcccaagttcgagaaacagctgggccaggtcatgctcctcgtactgtgtgtgacccaggtcctcatgatgcggactacatgggccttatgcgaggcgctgaccctcgccaccggtcctatctccaccttgtgggaggggagcccaggcagattctggaatacgacaatcgccgtctccatggccaacatcttccggggctcctacttggcgggggctggcctcttgttctccataatgaagaataccaccaacacgcgacgggggaccggcaataccggtgagacactgggtgaaaagtggaagaaccgcttaaacagcttgggcaagagcgagttccaaatctacaagcggtcagggatccaggaggtggaccgcacgctggccaaggagggcatcaagaggggtgagaccgaccaccacgccgtatcccgcggcagcgccaagctccggtggtttgtggaacgcaacctggtgaccccagagggcaaggtggtcgacctgggatgcggccgcggcgggtggtcctactactgcggcgggctcaagaacgtccgcgaggtgcgggggctgacgaagggtgggcccggccacgaggagccgatccccatgtcaacgtacggctggaacctggtccgcctccagagcggagtggacgtatttttcactccgcccgagaagtgcgacaccctgctttgcgacatcggcgagtccagcccgaaccccaccgtcgaggcgggccggacgctgcgtgtgctgaatcttgtggagaactggctcaacaacaacacccagttctgtatcaaggtccttaacccctacatgccgtccgttattgaaaagatggagactctccagcgaaagtatggcggggctctggtgcgtaaccccctcagccgcaactccacccacgagatgtactgggtctccaacgcatccgggaacatcgtttcttctgtgaacatgatcagccggatgctgatcaaccgcttcacgatgcggcacaagaaggccacgtacgagcccgacgtcgacctgggctccgggacccgcaacatcggcatcgagagcgagactccgaacctcgacataatcgggaagcgtatcgagaagatcaagcaggagcacgaaacgtcctggcattacgaccaagaccacccgtacaagacgtgggcctaccacggcagctacgagaccaagcaaaccggatccgcgagctccgtggtcaacggtgtcgtgcgccttcttacgaagccgtgggatgtaatccctatggtcacgcaaatggccatgaccgataccacccccttcggccagcaaagagtgttcaaggagaaggttgacacgagaacccaagagccgaaggaaggcacaaagaagctcatgaagatcaccgccgaatggctgtggaaggagctggggaagaagaaaacgccccggatgtgcacccgagaagaattcgcccggaaggtgcgcagcaatgccgccctcggcgccatcttcaccgatgagaataagtggaagtccgcccgggaggccgttgaggacagccgcttttgggagcttgtggacaaggagcggaatctgcacctcgagggaaagtgtgagacctgcgtgtacaacatgatggggaagcgcgagaagaaaataggggagttcggcaaggccaagggcagccgagctgtgtggtacatgtggctaggggcccgcttcctggagttcgaagcactcggcttcctgaacgaggaccactggttctcccgggagaactctctgtccggggtggagggagagggactgcacaagctgggctacatcctgcgggaagtgagcaagaaggagggcggggccatgtacgcggacgacacggccggttgggacacccgcatcaccctcgaggacttgaagaatgaggagatggtgaccaaccacatggagggcgaacacaagaagctggcagaggccatcttcaagttaacataccagaacaaggtcgtgcgcgtacagcgccccacgccaaggggcaccgtcatggacatcatctcccgccgggaccagcgcagctctggccaggtgggcacctacggcttaaacacgttcaccaacatgggggcccagctgatccggcaaatggagggcgagggggttttcaaaggcatccagcacctgaccgcaactgaggaggtggccgtgcaagactggctagcccgcgtgggtcgggagcgccttagccgtatggcaatctccggggacgactgcgtcgttaagcccctcgacgaccgcttcgcaagcgcgctcacggcgctgaatgatatgggcaaggtgcggaaggatatccagcagtgggagccttcccgcggctggaacgactggactcaggtcccattctgcagccaccacttccacgagctaattatgaaggacggtcgggttctggtggtcccgtgtcgcaaccaggatgagctgattggtcgggccaggatctcacaaggcgctgggtggtccctccgggaaacagcctgcctgggaaagtcctacgctcagatgtggtctctgatgtacttccaccgccggggccttcgcctggccgccaatgccatctgctccgcggtccccagccactgggtgcctaccagccgcaccacctggagtattcacgcgaggcatgagtggatgaccacggaagacatgttaaccgtctggaaccgcgtgtggatccaggaaaatccatggatggaggacaagacgcccgtcgagagctgggaggagattccgtacctcgggaagcggggcgaccagtggtgcgggtccctgatcggccttaccagccgcgccacctgggccaggaatatccagaccgccattaaccgcgtccgatcccttatcgggagtgaggggtacacggactacatgccctccatgaagcggttccgacgcgaggaggacgaggccggcgtgttatggtga

SEQ ID NO: 25121 - RNA, 9876 nt, synthetic construct
  misc_feature 1..9876: note = derived and/or modified CDS sequence (opt11) from DENV-2__KJ010185__SS-prME
  source 1..9876: mol_type = other RNA
acggcgggcgtgatcatcatgctgatccccaccgccatggcgttccacttgaccacccgcaatggggagccccacatgatcgtcagcaagcaggagaagggcaagtccctgctgttcaaaaccgaggatggtgtgaacatgtgcaccctgatggccatggacttaggcgaactctgcgaggacacaatcacctacaactgtcctctgctgcggcagaacgaacccgaggacatcgactgttggtgtaacgccacctccacctgggtgacgtacgggacctgcaccgccaccggggagcatcgccgggagaagcgctccgtcgccctggtgccacacgtgggtatgggcctcgagacccggaccgagacctggatgtcctcagagggagcttggaagcacgcccaaaggattgagacctggatcctgcgccacccaggtttcacgatcatggctgccatcctggcgtacaccatcggcaccacctatttccaacgcgtcctcatcttcatcctgctaaccgccgtggccccctcaatgacaatgcggtgcattggaatatccaaccgagacttcgtggagggcgtcagtgggggctcctgggtggatatcgtcctcgagcacggcagttgcgtcaccacgatggccaagaataagcccacgctggacttcgaactaattaagaccgaggccaagcaacctgctacactacggaagtattgcatcgaggcgaaactgaccaacacgaccaccgcgtcccgctgccccacacagggggaacccagcctgaatgaggaacaagacaaacgcttcgtgtgtaagcactccatggtggaccgcggctggggcaacggatgcggcctcttcgggaagggcggcatcgtcacgtgtgccatgttcacatgcaagaaaaacatggagggcaagattgtgcaacccgagaatctggagtacacgatcgtagtaaccccgcatagcggggaggagaacgccgtggggaacgacacgggtaagcacgggaaggagatcaaggtgacaccccagtccagcatcaccgaggcggagctgaccggctacgggacagtaactatggagtgttcgccccggaccggcctcgacttcaacgagatggtgctactgcagatggagaataaggcctggcttgtgcaccgccagtggtttctggacctgcctcttccctggctgcccggcgccgacattcaggggagcaattggatccaaaaggagaccctggtcacctttaagaacccccacgccaagaagcaggacgtagtcgtgttgggctcccaggagggagcgatgcacaccgcgctgactggagctaccgagatacagatgagctctgggaaccccctcttcactggccacctgaaatgccggttacgcatggacaagctgcagctaaaaggcatgagttacagcatgtgtacagggaagttcaaggtggtcaaagagattgccgaaacacagcatggcaccatcgtggttcggatccagtacgagggagacggttccccctgcaagattccttttgagattatggatctggagaagcgccacgtgctgggccggctcatcaccgtcaatcccatcgtcactgagaaagacagccccgtaaacatcgaggccgagccacctttcggtgactcctacataatcattggcgtggagccaggacagctgaagctcagctggttcaaaaagggttcctctatcgggcaaatgtttgagaccactatgcgcggtgccaagcgcatggcgatactcggagacaccgcctgggattttggatcactaggaggggtgttcacgtcaatcggcaaggcccttcatcaggtcttcggggccatctacggtgcggccttttccggggtgagctggaccatgaagatccttatcggtgtggtcataacatggatcggcatgaacagcagaagcacatccctgagcgtatcgctggtattagtaggggtggtgactctctacctaggcgtcatggtgcaggcggacagcgggtgcgtggtctcctggaagaacaaggagctcaagtgcggcagcgggattttcttcacagacaacgtccacacctggaccgagcagtacaagttccaacccgagtccccgtccaagttggccagcgccatccagaaagctcacgaagaggggatctgcgggattcgctccatcactcggctggacaacctgatgtggaagcagattaccccggagctcaaccatatcctgtcggagaatgaagtgaaactgtccatcatgacgggggacatcaagggcatcatgcaggccgggaagcgcagcttgcggccccaacctaccgagctcaagtactcctggaagacgtggggcaaggccaagatgctgtcgacggagccccataaccagacattcctaatcgacggccccgagaccgcccagtgccccaacacgaaccgtgcctggaactccctggaggtagaggactacgggttcggcgtgttcaccaccaacatctggctgaagctcaaggaacggcaggacgtcttctgtgactccaagctgatgtccgcggccatcaaagacaatcgcgccgtacacgcagacatggggtactggattgaaagtgcgctgaacgacacctggaagatcgagaaagcgtccttcatcgaagttaaaagctgccactggcctaaatcccatacgttatggtcgaacggagtattagaatccgaaatgattatcccgaagaacttcgccggccccgtgagccagcacaactaccggccggggtaccacacccagaccgccggcccctggcacctggggaagctcgagatggacttcgacttctgtgaaggcacaaccgtggtggtcacggaggactgcgggaaccgcggcccgagcttacggaccacaactgcatcgggtaagttgataacggagtggtgctgccgctcctgcacactgccgccgctccggtatagaggggaagacggctgctggtacgggatggagatcagaccactgaaggagaaggaggagaacctcgtgaactccctggtgacggcgggtcacggccagattgacaatttctctttgggtgtccttgggatggcccttttcctggaggagatgctccgcacccgggtgggtacgaagcacgccgtgctgctggtcgccgtctccttcatgaccctaattacgggtaatatgagctttcgcgatcttgggcgggtcatggtgatggtaggagcagcgatgacggacgatatcggcatgggcgtcacttatctggcgttactcgccgcgtttaaagtgcgcccgaccttcgctgcgggtctgctcctgcgcaagctaacctccaaggagctcatgatgactacgatcgggatcgtgttactaagccagtccaccactccagagacaatcttggagctgactgacgccctggccctcggcatgatgatactgaaaatcgtgcggaacatggagaagtaccagctggccgtcacaatcatggccattctctgcgtgcccaacgcggtcattctacagaatgcttggaaagtttcctgcaccatattggccgccgtgtccgttagccccctcctgttgacctccagccagcaaaaggccgattggatccccctcgccctgacgattaagggattaaaccccacagccatctttctcaccacgttatcgcgcactaacaagaaacggagctggccgcttaacgaggcaattatggccgtgggcatggtgtccatcctagcgtcttccctgctaaagaacgacatccccatgaccggccccctcgtcgccgggggcctgctgaccgtttgctacgtgctgaccggtcgcagcgccgaccttgagttagagagagccgccgatgtcagatgggaggaccaggctgagataagcgggtccagcccaattctctcaatcacgatcagcgaggacgggtcgatgagcataaagaatgaggaggaagaacagacccttaccatcttgattcggaccggcctcctggtgatctctgggttattccccgttagcatacccatcacagcggccgcatggtacctctgggaggtcaagaaacagcgggcgggtgtgctatgggacgtaccatcccctccgcccgtcggcaaggccgagctggaagatggagcctatcggatcaagcagaagggcatcctcgggtacagccagattggcgccggtgtatacaaggagggtaccttccacaccatgtggcacgtgactagaggcgccgtcctgatgcataagggaaaacggatcgagcccagctgggcagatgttcgcaaggacctgatcagttatggagggggctggaagctcgagggcgagtggaaggagggggaggaggtgcaagttctggcgctggagcccggcaagaacccccgggcagtgcagacgaagcccgggctgttcaagacgaacactggcaccatcggggccgtgtccctcgacttcagccccggtacatccggctctcccatcgtcgacaagaagggtaaggtggtgggcctgtacgggaacggggtcgtgacgcgctccggaacctacgtgtcagcaatcgcgcagacggaaaaatccatcgaggacaaccccgagatagaggatgatatcttccggaagaagcgcctaaccatcatggacttgcatcctggggcaggcaagaccaaacggtacctgccagccatcgtccgcgaagccatcaaacgcggactgcgcacactgatactcgcccccacccgggttgtggcggccgagatggaggaggcgctgcgtggcctccccattagatatcagacccctgcaatccgggccgagcatacggggcgcgagattgtcgaccttatgtgccacgcgaccttcaccatgcggctgttatctcctgtgcgagtgcccaattacaatctgataatcatggacgaagcccacttcacagaccccgcatctatagcggccagggggtacatcagcacgcgcgtcgagatgggagaggcggcggggatcttcatgactgctacaccgcccggcagccgggaccccttcccccagtccaacgccccgataatggacgaagaacgcgagatcccagaaaggagctggaactccgggcatgagtgggttaccgactttaagggcaagacggtgtggtttgttcccagcatcaaggcggggaatgacatagctgcatgcctgagaaagaacggcaagaaggtgatccagctctcccggaaaacttttgactctgagtacatcaaaacccgcaccaacgactgggactttgtcgtcacgacagacatctccgagatgggagccaacttcaaggctgagcgcgtgatcgacccacgccggtgtatgaagcctgtgatactcacagacggagaggagcgcgtcatcctggcgggccccatgcccgtgacccactcaagtgcagctcaaaggagagggcggatcggccgcaaccctaagaacgagaacgaccagtacatatatatgggcgagccgctcgagaacgacgaggactgcgcccactggaaggaagccaagatgctgctggacaacattaatacccccgagggcatcatcccgtccatgttcgagccggaacgcgagaaagtggacgcgatcgacggcgagtaccggctcagaggggaagcgcggaagaccttcgtggatctaatgcgtcgaggagacctgcccgtgtggcttgcttaccgcgtggccgcagaggggatcaactacgcggaccggcgatggtgttttgacgggataaagaacaaccaaatcctggaagagaacgtagaagtggaaatctggaccaaggagggagagcggaagaaactgaaacccaggtggctcgacgcccggatctactcagacccccttgccctgaaggagttcaaggagtttgccgccggtcgtaagtcacttaccttaaacctgataacggagatgggccgactcccgacgttcatgacccagaaggccaggaacgcgttggataatcttgcagtcctccacaccgcggaggccggcgggcgggcctataaccacgcattgtccgaactgccggagacactagaaaccctactgctactgacactgctcgccaccgtaacgggcggcattttcctgtttctgatgtcagggaaggggatcggtaagatgaccctgggcatgtgctgcatcatcacggcctccatcctactgtggtacgcccagatccaaccccactggatcgccgccagcataatcctcgagttcttcctgatcgtactgttaatcccagagccggaaaagcaacgcacaccccaggacaaccaacttacctatgtcgtgattgcaatcctgactgtggtggctgcgaccatggccaacgaaatggggttcttagagaagaccaagaaggacttcgggttgggctcaatcgctacccagcagcccgaaagcaacatactggatatcgatctcaggccggcgagcgcctggacgctctacgcggtggccaccaccttcatcaccccgatgttacggcacagcatcgagaacagctctgtgaacgtcagcctcacggccatcgccaaccaggccaccgtcctgatgggcctggggaagggctggcccttgtccaagatggacataggggtcccactgcttgccatcggatgctacagtcaagttaaccccatcaccctcactgccgctctgcttctcctggtggcccactacgcgatcatagggccgggcctgcaggctaaggcaagccgggaggcccaaaagagagccgcggccggcataatgaagaatcccacggtggacgggatcacagtcatagacctcgaccccatcccctacgacccaaaattcgagaagcaactgggtcaggtgatgctgctcatcctgtgcgtgacccaggttctgatgatgcgtacaacatgggccttgtgtgaagccctgaccctggccaccgggcccattagcacgctctgggagggcaaccccgggcgcttctggaacacgaccattgcggtatccatggccaacatctttcgcggctcttacttagccggcgcaggtcttctgttttccatcatgaagaacaccaccaacacccggcgcggcacggggaacaccggagagaccctgggcgagaaatggaagaatcgggtgtcactgctgggaaagtccgagttccagatttataaaagaagcggtatacaggaggtcgaccgtacgctggcgaaggaggggatcaagcgcggggagacagatcaccacgccgtcagccgaggcagcgccaagctgcgctggttcgtggagcgcaacctcgtcacgcccgaaggcaaggtggtggatctgggctgcggtcgcggcgggtggtcttactactgcggcgggctgaagaacgtccgggaggttaagggcctcaccaagggcgggccgggccacgaggaacccatcccaatgtcgacgtatgggtggaacctagtgcgcctgctcaccggcgcagacgtattcttcacgccccctgagaagtgcgacaccctactgtgcgatatcggggaatcgagcccgaacccaactgtggaagccggccggaccctccgcgtgctgaatctggtcgaaaactggttgaacaacaacacccagttctgtatcaaggtactgaacccttacatgcccagcgtaatcgagaagatggagacccttcagcggaagtacggcggggcgctggtccgaaaccctctcagtcggaacagcacgcatgaaatgtactgggtgtccaacgcgtccgggaatattgtgtcaagtgtcaacatgatcagtcgcatgctgatcaataggttcacgatgaggcataagaaggccacttacgaccccgatgttgacctggggagcggcacccgcaatatcgggatcgagtccgagaccccaaacctcgacattatcggcaagcggatcgagaagataaagcaggaacatgagacgagccgccactacgatcaggaccacccctacaagacctgggcttaccacggctcatacgagaccaagcaaactgggtcagcctcgagcacagtgaatggcgttgtgcggctgctgaccaagccctgggacgtaatccctatggtcacccagatggcgatgaccgatacgaccccgttcggccagcagcgcgtgtttaaggagaaggtagacactcgcacgcaagagcccaaggagggcacgaagaaacttatgaaaatcactgccgagtggctgtggaaggagctgggtaaaaagaagacgccccgtatgtgcacccgagaagagttcgctcgcaaggtccggtccaacgccgccctcggggccatcttcacagacgagaacaaatggaagtccgcacgtgaagcagtcgaggattcacggttctgggaattggtggacaaggagcggaatctgcacctcgagggcaagtgcgagacctgcgtctacaacatgatggggaagcgggagaaaaagattggcgagttcgggaaagcgaagggaagccgcgcaatctggtacatgtggctgggcgcgagattcctggagttcgaggctctcgggtttctgaatgaggaccactggttcagcagggagaacagcctcagcggcgtggaaggcgagggacttcacaagctggggtacatactgagggaggtatccaagaaggagggcggcgctatgtacgccgacgacaccgctggctgggacacccgcatcacccttgaagacctgaagaacgaggagatggtcactaatcacatggagggcgagcacaagaagctcgcagaggccatctttaagctcacctaccaaaacaaggtggtccgggtgcagcgccccacccctcgggggactgttatggacatcatcagccgccgcgatcaacggggttccgtccaggtggggacttacggcctaggcactttcacaaacatgggcgcccagctgatccgccaaatggagggcgagggggtgttcaaggggatccagcatctgacagccacagaggaagtggcagtgcaggactggctggcgcgcgtcggtcgggagcggttatcgcgcatggccatctccggggatgattgcgtcgtcaagcctctggacgaccggttcgcatccgctctcaccgcgctgaacgacatgggaaaagtgcgcaaggatatacagcaatgggagccgtcccgcggttggaacgactggacccaggtccccttctgctctcaccactttcacgagctcatcatgaaggacggccgagtgttggttgttccgtgccggaaccaggatgaactgatcgggagggcccgaatctcccagggcgccggctggtcactcagggagacggcctgtctggggaaatcgtatgctcaaatgtggagcctgatgtactttcaccgacgcgacctccgtttagcggcgaacgccatttgctccgccgtgcccagccactgggtgccaacttcccgcaccacatggtcgatccacgcgggccacgaatggatgaccacggaggacatgctgaccgtctggaaccgggtatggatccaggagaacccgtggatggaggacaaaaccccggtggagtcctgggaggagattccctacctggggaaacgcgaggatcaatggtgtggcagcctgatcggtctgaccagccgcgcaacgtgggcccggaacatccaaaccgccatcaaccaggtcagaagtctcatcggcagcgaggaatacacggattacatgccctccatgaagcggttcggccgcgaggaggaggaagccggcgtgctgtggtga

SEQ ID NO: 25122 - RNA, 9876 nt, synthetic construct
  misc_feature 1..9876: note = derived and/or modified CDS sequence (opt11) from DENV-2__KJ010186__SS-prME
  source 1..9876: mol_type = other RNA
accgcaggcgtgatcatcatgctgatccccaccgccatggcgttccacctcaccacccgcaatggtgagccgcacatgatagtctccaagcaggagaaaggcaagtccctactgttcaagactgaggatggcgtgaacatgtgcactctcatggccatggacctaggcgagctgtgcgaggacacgatcacctacaattgccccctcctgcggcaaaacgaacccgaggacatcgactgctggtgcaacgccaccagcacctgggtgacttacgggacctgcaccgccaccggcgagcaccgccgggagaagcgcagcgtcgccctggtgccacacgtgggcatgggtctcgagacccgaaccgagacctggatgagctccgagggcgcgtggaagcacgcccagcggatcgagacctggatcctgcggcaccccgggttcaccatcatggccgccatcttagcgtacaccatcggtaccacctacttccagcgcgtcctcatattcatcctgctgacagcggtggcccctagcatgaccatgaggtgcattgggatctccaaccgagacttcgtggagggggtcagtggtgggtcctgggttgacatcgttcttgagcacggcagctgcgtcacgaccatggccaaaaataaacccacgctggacttcgagctaatcaagaccgaggcaaagcagcccgccacgctccggaagtactgcatcgaggcgaggctaactaacacgaccaccgcctcccggtgcccgacccaaggcgagcccagcctcaacgaggagcaggacaaaagattcgtgtgcaagcattctatggtggacagaggctggggtaacgggtgcggcctcttcgggaagggcgggatcgtgacgtgcgccatgttcacgtgtaaaaagaacatggagggtaagatagtgcagcccgagaaccttgagtataccatcgtggtaacgccccactcgggcgaggagaacgccgtgggaaacgacacgggtaagcacggtaaggaaattaaggtgaccccgcagtccagcatcaccgaggcggagctaaccgggtacgggacggtaacgatggagtgcagcccccggactggcctcgacttcaacgaaatggtgctgctgcagatggagaacaaggcgtggctcgtccaccggcagtggttcctcgatctgcccctcccctggctgccgggtgccgacatccaggggagcaactggatccagaaagagaccctagtcaccttcaagaagccccacgccaaaaagcaggatgtggtcgtactaggctcccaggagggggcaatgcacacggcgttgactggagcgaccgaaatccagatgagcagcgggaacctcttgttcaccggccacctgaagtgtcgactgcggatggacaagctccaactgaagggcatgtcatactcgatgtgcaccggtaagttcaaggtggtcaaagagatcgccgagacccagcacggcaccatcgtcgtgcgcgtccagtacgagggggacggctccccgtgcaaaatccccttcgagatcatggacctggaaaagcggcatgtgctcggccgtctgatcactgtgaatccgatcgttacggagaaggacagcccagtgaacatcgaggccgaaccacccttcggggactcctatatcatcatcggcgtggagccgggacagctgaagctcagctggtttaagaagggctcctccattgggcagatgttcgagaccaccatgaggggagccaagcggatggcgatcctgggcgatacggcctgggacttcggctccctgggtggggtcttcacgagcatcggcaaagccctccaccaggtgttcggggctatctacggcgcggcattctccggcgtcagctggaccatgaagatcctgatcggggtagttatcacctggatcggcatgaactcccgctcgacttccctaagcgtgtcactggtcttagtgggtgtggtcaccctgtacctgggcgtgatggtacaggccgacagcgggtgcgtcgtttcctggaagaatacggccctcaagtgcggctcagggatttttatcaccgacaacgtgcacacgtggacggagcagtacaagttccaacccgagtccccatccaagctggctagcgcgatacagaaggcccacgaggagggcatctgcggcatccggtccgtcacacgtcttgagaacctcatgtggaagcagatcacccccgagctgaaccatattctgagcgagaacgaagtgaagctctctatcatgaccggggacatcaagggcatattacaggccgggaagcggagcctgcgcccgcaacccacggagttgaagtactcttggaagacctggggcaaggcgaagatgctgtctaccgagtcgcacaaccagaccttccttatcgacggcccagagacggccgagtgtccgaacacaaatcgggcatggaactctctcgaagtggaggactacggtttcggggtcttcaccacaaacatctggttgaagctgaaggagcgccaagatgttttctgcgactccaagctcatgagcgctgccatcaaggacaaccgggcggtgcatgccgacatggggtactggatcgagagcgcgctaaacgacacgtggaagatcgagaaggccagcttcatagaagtcaaatcctgccattggcccaaaagccacaccctgtggtccaacggagtgctcgagagcgagatgatcatacccaagaactttgccggcccggtgtcgcagcacaactaccgccctgggtaccacacccagacggcgggcccctggcacctggggaaactggagatggactttgacttctgtgagggcactacagtcgtggtcaccgaggactgcgggaaccggggcccctccctccgtaccaccacggcgagcggtaagctgatcaccgagtggtgctgccggtcctgcaccctaccgcccctacgctacagaggggaagatggatgctggtatgggatggaaatccgtcccctgaaagagaaggaggagaacctggttaacagcctggtcacggcaggccatgggcagatcgacaacttttccctgggcgtgctgggcatggcactcttcctggaggagatgctgcggacgcgcgtcgggaccaagcacgccgtgctcctggtggccgtctcgttcatgaccctgattaccggcaacatgtctttcagggacctcgggagagtgatggtcatggtaggcgcggcaatgacggacgacattgggatgggcgtgacctacctggcgctcctcgcggccttcaaggtacgccccaccttcgcggccggcctacttctccggaagctgacgagtaaggaactaatgatgaccacgatcggtatcgtcctcctatcccaaagcactacgcccgagacgatcttagagctcacggatgccctagctttgggcatgatgatcctcaagatcgtgcgcaacatggaaaagtaccagctcgccgttaccatcatggcgatcctgtgcgtgccgaacgcggttatcctccagaacgcctggaaggtctcctgcactatactggcagcggtgagcgttagccccctgctgcttacgagctcccagcagaaggccgactggatcccactagccctcaccatcaaggggctgaaccccaccgccatcttcctgaccaccctcagccggactaacaagaagcgctcctggccgctgaacgaggccataatggcggtcggcatggtttccatcttagcctccagccttctgaagaatgacatcccaatgaccggccctcttgtggctggcgggctcctgaccgtttgctacgtgctgacggggcgcagcgcggacctcgaactcgagcgagcggcggacgtacggtgggaggaccaagcagagatctccgggagttcccccatactgagcatcaccatttccgaggacgggagcatgtccatcaagaacgaggaggaggagcagaccctcaccatcctgatccgcacggggctgctcgtcatcagcgggctgttcccggtgtcgatccccatcaccgccgccgcctggtacctctgggaggtgaaaaagcagcgagcgggtgtcttatgggacgtgcgcagctacccgccagtgggaaaggccgagctggaggacggggcataccggatcaagcagaaagggatcctggggtactcccagatcggcgccggggtctacaaggaggggaccttccataccatgtggcacgtgacccgcggagctgtgctcatgcacaaagggaagcggatcgaacctagctgggcagacgtccgtaaggatctaatctcctacggcggcggctggaagctggagggcgagtggaaggagggcgaggaggttcaggtgcttgctctggagcccggcaagaaccctcgggccgtccagacgaagccgggcctgttcaaaaccaatacggggactatcggggccgtgagtcttgacttctcccccggcacgagcggcagccccatcgtggacaagaaagggaaggtcgtgggcctgtacggcaacggagtggtcacccgcagcggcacgtacgtatctgcgattgcccagaccgagaagtcgatcgaagacaaccccgagatcgaggacgacatctttaggaagaagcgcctgacgatcatggacctgcaccccggtgccggcaagaccaagcggtacctcccggctatcgttagagaggccataaagcgggggctgcgcaccctgatcctcgcgccgacccgcgttgtggccgccgagatggaagaggcactgcggggcctgcccatccgctaccagacgccggctatccgggcggagcacaccgggcgcgagatcgtggacttaatgtgccatgcaaccttcaccatgcggctgctgtcacccgtccgcgtcccgaactacaacctcatcataatggacgaggctcacttcaccgaccccgcctccatcgcggcgcggggctacatcagcacacgcgtggagatgggcgaggccgccgggatcttcatgaccgccaccccgcccggctcccgggaccccttcccccagagcaacgcgccaataatggacgaggagcgggagatcccggagaggtcctggaacagcgggcacgagtgggttacggacttcaagggcaagaccgtgtggttcgtgcccagtatcaaggccggcaacgacatcgccgcgtgcctgagaaagaacggcaagaaggttatccagctgagccggaagacctttgactccgagtacatcaagacccgtacgaatgactgggacttcgtggtgaccaccgacataagcgagatgggcgccaacttcaaggctgagcgtgtcatcgacccccggcggtgcatgaagccggtaattttgaccgacggggaggagcgcgtgattctagcaggcccgatgcccgtcacgcactccagcgccgcccagcggcgcgggaggatcggccggaaccctaagaatgaaaatgaccagtacatctacatgggggagccgctagagaacgacgaggactgtgcacattggaaggaggcgaagatgctcctggacaatatcaacactcccgagggcatcattccatccatgttcgagcccgagcgcgagaaggtagatgcgatcgacggggagtaccggctgcgaggggaggccagaaagaccttcgtcgacctcatgcgccgcggcgacctgccggtctggctggcctaccgcgtggctgcggaggggatcaattacgccgacagacgctggtgcttcgatggcatcaagaacaaccagatcctcgaggagaacgtcgaggtggagatctggaccaaggagggggagcggaagaagctgaagccacgctggttagacgcccggatctacagcgaccccctcgcactgaaagagttcaaggagttcgcggccggccgcaagtccctcacgctaaatctgataaccgagatgggccggctgcctaccttcatgacacagaaggcccgcaacgccctcgataacctggcagtgctgcatacggcagaggcagggggccgggcctataaccacgctctcagcgagcttcccgaaaccctggagaccctcctgctgcttaccctgcttgccacggtcaccgggggcatcttcctcttcctcatgagcggcaagggaatcggcaagatgaccttagggatgtgctgcataatcactgcgagcatcctcctgtggtacgcccaaatccagccccactggatcgccgcgtccatcatcctggagttctttctcatcgtgctgctgatccccgagccggagaagcagcgcacgccccaggacaaccagctcacgtacgtggtcatcgccatcctgacggtggttgcggccaccatggcgaatgagatgggcttcctggagaagaccaagaaggacttcgggctcggctcaatcgccactcagcagccggaaagtaacatcctggatatcgacctgcggcctgcctccgcatggaccctctacgctgttgccacaacctttatcacgccgatgctgcgccatagcatagagaactccagcgtgaacgtctccctgaccgccatcgcgaaccaggccaccgtccttatgggtctggggaaaggctggcccctgagcaagatggatattggggtgcccctcttggccataggctgctactcccaggtgaacccaatcacgctgactgccgcactgctactgttagtggcgcactacgccatcatcggtccggggctgcaggccaaggcaactcgagaggcccagaagcgcgcggccgcaggcatcatgaagaaccccaccgtcgacgggatcaccgtgatcgatctggatcccatcccctacgaccctaaattcgagaagcagctcggccaagtgatgctgctagtgctctgcgtgactcaggtcctaatgatgcgcaccacctgggccctgtgcgaggccctcaccctggcgacagggcccatcagcaccctgtgggagggcaaccctgggcggttctggaacaccaccatcgccgtgagtatggccaacatcttccgcggctcttacctcgccggcgctgggctactcttctccatcatgaagaacacgaccaacacacggcgcggcacggggaacacgggtgagaccctcggggagaagtggaagaacagactgaactcgctggggaagagtgagttccagatttataagcgctcgggcatccaggaggttgaccggaccctcgccaaggaagggatcaagcgcggagagaccgaccaccacgccgtctcccgggggtctgccaagctgcgctggttcgttgagcggaacctggttacgcccgagggcaaagtcgtggacctcggctgcggtcgaggcgggtggtcgtattactgcggcgggctgaagaatgtgagggaggtcaagggcctgaccaagggcgggcctgggcacgaggaaccgatccccatgtcgacttacggctggaacctcgtgcgcctgcagtcaggtgtggacgtcttcttcacgccgcccgagaagtgcgacacgctgctctgtgacatcggggagagcagccccaaccctaccgtggaggcaggccggaccctgcgcgtgctgaacctagttgagaactggctgaacaacaacactcagttctgcatcaaggttctgaacccctacatgccgtccgtgatcgaaaagatggagaccctgcagcggaaatacggaggggcgctggtcagaaaccccctgagccggaactcgacgcacgaaatgtattgggtaagcaacgcgtccgggaacattgtgagctccgtcaacatgatcagcagaatgctgatcaaccgcttcaccatgcgtcacaagaaggccacctacgagcccgacgtcgacctcgggtccggcaccagaaacatcgggatcgagagcgagacgccgaatctggacatcatcggcaagcggattgagaagattaagcaagagcatgaaacgtcctggcactatgaccaagaccacccctataagacctgggcctaccacggcagctacgagacaaaacagacgggtagcgcctcttccatggtgaacggtgtcgtgaggcttctcaccaagccctgggacgtgatccccatggtcacccagatggcgatgaccgacacgacaccgttcgggcagcagcgggtgttcaaggagaaagttgatacccgcacccaggagcccaaggagggcacgaagaagctgatgaagatcacagccgagtggctgtggaaggagctcggcaaaaagaaaacaccccggatgtgcacccgcgaggagttcgcgcggaaggtcagaagtaacgccgccctgggggcaatctttactgacgagaacaagtggaagtccgcccgggaggccgtggaagacagccgcttctgggagctggtcgacaaggagcgtaacctccatctagagggcaagtgtgagacctgcgtgtacaatatgatgggcaagcgcgaaaagaagattggcgagtttgggaaggccaaaggctcccgcgcgatctggtacatgtggctgggcgcccgattcctcgagttcgaagccctggggtttctgaacgaggaccactggttcagccgggagaacagcctctcaggcgtggagggggaaggcctgcacaagctgggctacatcctccgcgaggtctctaagaaagaaggaggggccatgtacgccgatgacacagcggggtgggacactcggataacgctggaagacctgaagaacgaggagatggtgaccaaccacatggagggcgagcacaagaagctcgccgaggcgatcttcaagctgacctaccagaataaagttgtccgagtgcagcggcccactccgcgggggactgtgatggacatcatctccagacgggatcaacgaggcagcggccaggtgggcacctacggactgaacactttcaccaacatgggagcccagttgatccgacagatggagggcgagggggtgttcaagggaatacaacatctgactgctaccgaggaagtagcggtacaggactggctcgcccgcgtgggcagagagcgcctctccagaatggccatcagcggggacgactgcgtggtgaagcccctagacgaccgtttcgccaacgccctcaccgcgctcaacgacatgggcaaggtgcgtaaggatatccagcaatgggaaccatcacgcgggtggaacgactggacccaggtgccattctgcagccaccatttccacgagttgatcatgaaggacggccgggtcctggtagtgccctgccgcaaccaggacgagctcatcgggagagcccgcatctcccagggtgccggctggagcctgcgggaaacggcctgcctgggaaagagctacgcccagatgtggagcctcatgtacttccaccgccgggacctgcgcctcgcggccaatgccatctgctccgccgtgccaagccattgggttcccacatcccggaccacatggagcatccacgcgcgccacgagtggatgaccacggaggacatgctcaccgtttggaacagggtctggatccaggagaacccctggatggaggataagaccccggtggaaagctgggaggagatcccttacctgggcaagcgggaagaccagtggtgcgggagcctgatcggactcaccagccgagccacgtgggcccggaacatccagaccgcgatcaaccaggtgcgctccctgatcggcagcgaagagtacaccgactacatgccgtccatgaagcgtttccgccgggaggaggaggaggccggcgtcctgtggtaa

SEQ ID NO: 25123 - RNA, 9876 nt, synthetic construct
  misc_feature 1..9876: note = derived and/or modified CDS sequence (opt11) from DENV-2__KF955364__SS-prME
  source 1..9876: mol_type = other RNA
accgccggggtgataatcatgctgatccccaccgccatggccttccacctcaccacccggaacggcgagccgcatatgatcgtcgggcgccaagagaaggggaagtccctcctgttcaaaaccgaggacggcgttaacatgtgcaccctgatggctatcgacctgggggagctgtgcgaggacacgatcacctacaagtgccctttactgcgccagaatgagcccgaagacatcgattgctggtgcaacagcaccagcacctgggtgacctacgggacctgtacaaccacgggcgagcatcggcgcgagaagcggagtgtcgccctggtgccccacgtagggatggggttagaaactcgcaccgaaacctggatgtcgagcgagggggcctggaagcacgttcagcggatcgagacatggatcctgcgccacccgggcttcaccatcatggccgcgatcctggcatacacgatcgggaccacgcacttccaacgggccctcatcttcatcctgttaaccgccgtggcgccctctatgacaatgcggtgcatagggatcagcaaccgggacttcgtggaaggcgttagcgggggctcctgggttgacatcgtgctcgagcacgggagctgcgtcaccacgatggccaagaacaagcccaccctggacttcgagctgatcaagaccgaggcaaagcaacccgccaccctccgcaagtactgcatcgaggccaagctgacgaacaccaccaccgagtcccgttgcccgactcagggcgaacccagcctgaacgaggagcaggacaaacggttcatctgcaaacacagtatggtggaccgtggctgggggaacggctgcggcctcttcggcaagggtggtattgttacctgcgcgatgtttacgtgcaagaagaacatggagggcaaagtcgtactgccagagaacctcgagtacaccatcgtaattacgccccacagcggggaggaacacgctgtcggcaacgacaccgggaagcacggcaaggaaattaagatcaccccgcaatccagcatcaccgaagccgaactcaccggttacggcacggtgaccatggagtgcagcccacggactggcctggacttcaacgagatggtgttactgcagatggaggacaaggcctggttggtccaccgtcagtggttcctggacttacccctcccctggctgccgggagccgacacccagggcagtaactggatccagaaggagacgctagttacgttcaagaacccccacgctaagaagcaagacgtggtcgtgctggggtcacaggagggcgccatgcacacagccctgaccggggccacggagatccagatgagcagcggcaacctcttattcaccggccatctgaagtgccgcctgcggatggacaagctacaactcaaggggatgtcctacagcatgtgcaccggcaagttcaagatcgtcaaagagatcgccgagacccagcacgggaccatcgtgatccgcgtacagtacgagggcgacggttccccctgcaagatcccctttgagataatggatctcgagaagcggcatgtgctggggagactgatcaccgtgaacccgattgtgaccgagaaagacagccccgtcaacatcgaggcggagccacccttcggtgactcctatattatcatcggggtggagcctggtcagctcaagctgaactggttcaagaaggggagctctataggccaaatgtttgaaactacgatgcgaggggccaagcggatggcaatcctgggggacacagcctgggacttcggcagtctagggggcgttttcacgtccatcgggaaagccctgcatcaggtctttggcgcgatctacggggcagccttcagcggggtttcctggaccatgaagatcctgatcggcgtgatcatcacgtggatagggatgaacagccgcagtaccagcctctccgtcagtctcgtgttagtgggcgtagtgaccctgtacctcggggtgatggtccaggccgacaccggttgcgttgtgtcatggaagaacaaggaacttaaatgcggtagcggtatcttcattacggacaatgtgcatacctggaccgagcaatacaagtttcagccggagagtccctcaaagctagcgagcgcgatccagaaagctcatgaagaaggcatctgcgggattcggtccgtcacacgactcgagaacctgatgtggaagcagattacgcccgagctgaaccacatccttagcgagaacggcgtgaagctgaccatcatgactggggacatcaagggcattatgcaggccggcaagcggtccctgcgcccgcagccgaccgagctcaagtacagctggaagacgtgggggaaggccaagatgctgtccactgagagccacaaccagacgttcctgatcgacggccctgaaacggcggagtgcccgaacacgaaccgggcttggaactccctcgaagttgaggactacgggttcggtgtgttcagcaccaatatctggctgaagctgcgcgagaagcaggacgtgctatgcgactccaaactgatgagcgcggccatcaaggacaatcgagccgtccacgcggacatgggctactggatcgagtccgccctgaacgacacctggaagatggaaaaagcgagcttcatagagatcaaatcctgccactggcctaagtcccacactctctggtccaacggcgtgctggagtcggagatgatcatccccaagaattttgcaggccccgtatcccaacacaattaccgcccggggtaccatacccaaacggcaggcccctggcacctgggtaaacttgaaatggacttcgacttctgcgagggcactaccgtcgtggtgaccgaggactgcggcaatcgggggcccagtctgcgcacgaccaccgcgagcggcaagctgatcacggagtggtgctgccggtcctgcacgttgccgcccctgaggtaccgcggggaagacggctgctggtacgggatggaaatccggccactgaaggagaaagaggagaatctcgtcaacagcctggtgaccgccggccacggacagatcgataacttctcattgggagtgctagggatggcgctgttcctagaggaaatgcttcgaacgcgcgtcgggacgaagtatgccatcctgttagtggccgtgtcatttgtcacgctcatcaccggaaacatgtctttccgggacctggggcgcgtgatggtgatggtcggcgctactatgacagacgacataggcatgggtgtgacgtatctggccctcctggccgccttcaaggtgcgccctacttttgcggccggcctgctcctacgtaagctgaccagcaaagagctcatgatggcgacgatagggatcgccctcctgtcccagagcacgattcccgaaactatactagagctcactgacgccctggcgctcggcatgatggtcctaaagatcgtgcgcaacatggagaagtaccagctggccgtgaccatcatggccatcagttgtgtccctaacgcggtgatccttcaaaacgcctggaaggtgagctgcacaatcctggcggcggtctccgtgagccccctgctcctgacctcgagccagcagaaggccgactggattccgctggcattaaccattaagggcctcaacccgaccgcgatttttctgactaccctctcccggacaagcaagaagaggtcctggccgctgaacgaggcggtcatggccgtggggatggtgagcatccttgcatccagcctcctgaagaacgacatacccatgaccggtcccctggtcgccgggggactccttacggtgtgctacgtactgaccgggcggtcggcggacctggagctggagagggccgccgacgtgaagtgggaggaccaagccgagatctccggaagctcgcccatcctgtccatcaccatctccgaggacggcagcatgtccatcaaaaacgaggaagaggaacacaccctcaccatcctgatccggaccgggctgctcgtgatcagcggcgtgttcccggtctccattcccatcaccgccgcggcctggtacctgtgggaggtgaagaagcagcgtgccggggtgctttgggacgtccctagtccgccgcctgtgggcaaggccgagctggaggacggagcctaccgaatcaagcagcgcggcatcttcggctactcccagatcggcgcgggggtgtacaaggaggggactttccacaccatgtggcacgtcacgagaggggccgttctgatgcaccgggggaagcggatcgagcccagctgggccgatgtgaagaaggacctgatctcatacgggggcgggtggaaactcgagggcgaatggaaggaaggtgaggaggtccaggtattggccctggagccaggcaagaacccccgcgccgtgcagacaaagcccggcctcttcaagaccaataccggcacgattggcgcggtcagcctggatttctcccccggaaccagtgggtcccccatcgtcgaccggaagggaaaggtcgtgggcctttatggtaacggggtggtgacccgaagcggcgcgtacgtatccgccatcgcccagaccgagaagtccatcgaggataaccccgaaatcgaggatgacatcttccggaagaagcgcctcaccatcatggacctgcaccccggagcgggcaaaaccaagcgttacctgcccgccatcgttcgcgaggccattaagcgggggctgcgcacactaatcctggcgccgaccagagtggtcgccgccgaaatggaggaggccctgcggggcctcccaatccgctaccagacccccgccatccgggccgagcatacagggcgcgagattgtggacctgatgtgtcacgccaccttcactatgcggctgctgagcccggtacgcgttccgaactacaacctgattatcatggacgaggcgcactttacggaccctgcttccatagccgcacgggggtacatcagcacccgcgtggagatgggcgaagccgccgggatcttcatgaccgcaacaccgccgggctcccgggacccgttcccgcagagcaatgcccccatcatggacgaggaaagggagatccccgagcggtcctggaacagcgggcacgagtgggtgacggactttaagggcaagacggtttggttcgtgccttctattaaggccggcaacgacatcgcggcctgcttgaggaagaacgggaagaaggtgatccagttgagccggaaaaccttcgactccgagtacgttaagacacgcgccaacgactgggatttcgtggtgacgaccgatattagcgagatgggtgccaacttccgggccgagcgcgtgatagacccccggcgatgtatgaaacccgtcatcctcaccgatggtgaggaacgggtgatcctggcgggccccatgccggtaacccactcctcggcagcccaacgacgcgggcgtatcggccgtaaccccaagaacgagaatgatcagtacatatacatgggcgagcccctcgagaacgacgaagactgcgcccactggaaggaggccaagatgctgctggacaacatcaacacgcccgagggaatcatcccgtccatgttcgagccggagcgggagaaggtggacgccatagacggcgagtaccgcctccgtggcgaggccagaaagaccttcgtggacctgatgcggcgcggcgacctccccgtctggctagcctaccgtgtggccgccgaggggatcaactacgctgaccgtcggtggtgcttcgacggcattaagaacaaccagatcctcgaagagaacgtggaggtcgagatctggacaaaggagggtgagcgcaagaagctaaagccgcggtggttggacgcccgcatctacagcgaccccctggccctgaaggagtttaaggagttcgccgcggggaggaaatccctcaccctgaacttgataacggagatgggcagactcccgactttcatgacgcagaaggctcgggacgccctggacaacttggccgtgctacacaccgccgaggtcggtggacgagcgtacaaccacgccctgtcagagctgcccgaaaccctcgagaccctgctgttactgaccctgctcgccaccgtgacagggggtattttcctgttcctgatgtccggcaagggaatcggcaagatgaccctcggaatgtgctgcatcatcaccgccagcatcttactgtggtacgcccagatccagccgcactggatcgcggcctccatcatcctcgagttcttcttaattgttctgctcatccccgagccagagaaacagcgcactccacaggacaaccaactgacttacgtcgtgatcgcgatcctgacggtggtcgcggccaccatggcgaacgaaatgggcttcttagaaaagaccaagaaggacttgggcctggggagcatcactacgcaggaaagcgagtccaacatcctcgacatcgacctccgcccggcaagcgcctggaccctgtatgcggtggccaccaccttcgtgacgcccatgctccggcactccatcgagaatagctccgtgaacgtcagcctgaccgctatcgcgaaccaagccaccgtgctgatgggcctcgggcgcggctggcccctcagtaaaatggacatcggggtccccctgctcgccatcggctgctacagccaggtgaacccgatcacactgacggcggccctgctcctgctggttgcccactatgctataataggccccggtctccaagccaaagcgacccgcgaggctcagaagaggaccgccgccggcatcatgaagaatcccaccgtcgacgggatcacggtgatcgacctggagcccatcccgtatgatccaaagttcgagaagcaactgggccaggtgatgctgctggtcctgtgtgttacccaggtgctgatgatgcgcaccacctgggccctgtgcgaggcactgacgctcgcgactgggcccatctccaccctgtgggagggtaaccccggccggttttggaacaccacgattgctgtttcaatggcgaacatcttccgcggatcctacctggccggcgcggggctcctgttcagcatcatgaagaacaccaccaatacccggcgcggcacggggaacataggggaaaccctcggcgagaagtggaagtcccgactcaacgctctgggcaagagcgagttccaaatatacaagaagtccggcatccaggaggtggaccgaaccctggccaaagaggggatcaagcggggtgagaccgaccaccacgcagttagcagagggagtgcgaagctccggtggttcgtcgaaagaaacatggttacgccggaggggaaggtggtcgatctgggctgcgggcgtggcgggtggtcgtattactgcggcggcctgaagaacgtgagagaggtgaaggggctcactaaaggagggcccggccacgaggagcccatccccatgagcacatacgggtggaatctggtacggctacagagcggtgtggacgtattctttacgccgcccgagaagtgcgatacgctcttgtgcgacattggagagtcatcccccaaccccaccatcgaagccgggcgcaccctgcgcgtcctcaacctggtggagaactggttaaataacaatacccagttctgcgtgaaagtactcaacccgtacatgccctcggtaatcgagaagatggagaccctgcagcgcaagtacggcggtgcactcgtgcggaatcccctctcccgcaactcaacgcacgagatgtactgggtctccaacgccaccggcaacatcgtgagctcagtgaacatgatcagcaggatgctcatcaaccggttcaccatgaagcacaagaaggccacctacgagccggacgtcgacctggggtccggcacgcgcaacatcggaatcgagaatgagattcccaacctggacatcatcgggaagcggatcgagaagatcaagcaggagcatgaaaccagctggcactacgaccaggaccatccctacaagacttgggcataccacggctcctacgagacaaagcagacggggagcgccagcagcatggtgaacggcgtggtcaaattgttaaccaagccctgggatgtggtgccgatggtcacccagatggccatgaccgacacgacccctttcggccaacagcgcgtgttcaaggaaaaggtggacacccgtacccaggaacccaaggaggggacgaagaagctgatgcgcatcactgccgagtggttatggaaagagctgggcaagaagaagacgccccggatgtgcacccgcgaggagttcactaggaaggtccgctccaacgccgcgctgggggcgatattcaccgacgagaacaaatggaagtccgctcgggaggccgtggaagacagtcgcttctgggagctcgtcgacagggagcgcaacctgcatctggagggcaagtgtgagacatgcgtatacaacatgatggggaagcgggagaagaaactcggcgagttcggcaaggctaaggggagccgcgcgatctggtacatgtggctgggcgcccggttcttggaatttgaagccttagggtttctgaacgaggatcactggttctctcgcggtaacagcctgagcggggtcgagggcgagggcctccacaagctggggtacattctgcgggatgtgtcaaagaaggaaggaggggccatgtatgcggacgacaccgccggttgggacacgcgcatcaccctcgaagacttaaagaatgaggagatggtgaccaaccacatgaagggggagcataaaaagctggccgaggccatattcaagctcacgtaccaaaacaaggtggtacgtgtacagcgcccgacgcctcgcggtaccgtgatggatatcattagccggaaggaccagcgcggatccgggcaggtcggcacctacgggttgaacacgttcacgaatatggaggcccagttgatccggcagatggagggcgagggcatcttcaagagcatacagcgcctaaccgtgactgaggaaatcgctgttcagaactggctcgcacgagtcgggcgcgagcggctgtccagaatggccatttcaggcgacgactgcgtcgtgaagcccctcgacgatcggtttgcgtccgccctgaccgcgcttaacgacatggggaaggtccgcaaggacatccagcagtgggagccaagccggggctggaacgactggacccaggtgcctttctgctcgcaccacttccatgagctcgtgatgaaggacgggcgcgtcctggttgtgccctgccggaaccaggacgagttaatcggccgcgcaaggatcagccagggcgccggatggtccctcaaggagacagcctgcctgggcaagagctacgcacagatgtggacccttatgtattttcaccgccgggacctacgcctggcggccaacgccatctgctcggccgttcccagccactgggtgcccacctcccggaccacctggagcatccacgccaagcatgaatggatgaccactgaggacatgctcgcggtgtggaaccgggtctggatccaagagaacccttggatggaggacaagacccctgtggagtcttgggaggaggtgccctatttagggaagcgcgaggaccagtggtgcggaagcctgatcgggctgacgagccgggccacctgggcaaagaacatccagaccgccataaatcaggtcagatccttaatcggtaacgaggagtacacagactatatgccctctatgaagcggttccgcaaggaggaagaagaggctggcgtgctgtggtga

SEQ ID NO: 25124 - RNA, 9876 nt, synthetic construct
  misc_feature 1..9876: note = derived and/or modified CDS sequence (opt11) from DENV-2__KF955372__SS-prME
  source 1..9876: mol_type = other RNA
acagcaggcgtgatcatcatgttgatccccacagccatggccttccatctcaccacccgcaacggggagccccacatgatcgttggccgtcaggagaaggggaagtccctactgttcaagaccgaggacggcgtcaatatgtgcaccctcatggccatcgacctgggggagctgtgcgaagacaccatcacctacaaatgccccctcctgcggcagaatgagccagaggacatagactgctggtgcaacagcacctcgacctgggtgacctacgggacctgcaccaccactggcgagcaccggcgagagaagcggtccgtcgcactggtgcctcatgtggggatgggtctcgagacccgcacagagacgtggatgagcagcgagggggcctggaagcacgtccagcggatcgagacctggatactgcgccaccccggcttcaccatcatggcggcgatactggcatataccatcggtaccacgcacttccagcgggcattgattttcatcctgctgactgccgttgcgcctagcatgactatgcgctgcatcggcatctccaaccgggacttcgtggagggggtcagcggcggcagttgggtggacatcgtgctcgagcacgggtcttgcgtcacaactatggccaaaaacaagcccacactagacttcgagctgatcaagacagaggccaaacagcccgccaccctccgcaagtactgcatcgaggccaagctgacgaacaccaccaccgagtcccgatgcccgacgcagggcgagccctcgttgaacgaagagcaggacaagcgcttcatctgcaaacactccatggttgaccggggctgggggaacggctgtggccttttcggcaagggcggtattgtgacctgcgcgatgttcacgtgcaagaagaacatggagggcaaggttgtactgccagagaacttagagtacaccatcgtgatcacgccccacagcggggaggagtacgccgttggcaacgacacggggaagcacgggaaggagatcaagattaccccgcagtccagcataaccgaggccgagctcacggggtacggaactgtgaccatggagtgcagcccccggacagggctggacttcaacgagatggttcttctccagatggaggacaaggcctggctggtccacagacagtggttcctggatttacctctgccttggctgccgggggccgacacccagggcagcaactggatccaaaaggagacgctcgtgaccttcaagaacccccacgccaaaaaacaagacgtggtcgtgctgggcagtcaagagggcgccatgcacaccgcgctgaccggggccactgaaatccagatgagcagcggcaacctcttattcaccggccacctgaaatgtcgcctccggatggacaaattgcagctgaaggggatgtcctacagcatgtgcaccggcaaattcaagatcgtgaaagagatcgccgagacccagcacggcacgatcgtgatacgcgtgcaatacgagggggacggctccccctgcaagatccccttcgagatcatggacctcgagaagcggcacgtcctggggcgcctgatcaccgtgaacccgatcgtgacggagaaggacagcccggtgaacgtggaggcggagcctccgttcggagactcatacatcatcatcggggtggagccgggccagctcaagctgaactggttcaagaaggggagctccataggccaaatgtttgagaccaccatgcgcggagccaagcggatggccatcctgggggacactgcgtgggacttcggctcgctcggaggcgtcttcactagtataggaaaggccctgcaccaggtgtttggcgccatctacggcgctgccttcagcggggtgtcctggaccatgaagatcctgatcggcgtcatcatcacgtggatcgggatgaacagcagatccaccagcctgtccgtgagcctcgttttggtcggcgtggtgaccttatacctaggcgtcatggtgcaggccgatagtggctgcgtagtgagctggaagaataaggagctgaagtgcggctccgggatcttcatcacggacaacgtgcacacctggaccgagcagtacaagtttcaaccggagagccccagcaagttggcgtccgccatccagaaggcccacgaggagggcatatgtggaatacggtcagtgacccggctcgagaacctgatgtggaaacagatcacccccgagctgaaccacattctctccgagaacgaagtcaagctgacgatcatgacaggcgatatcaaggggatcatgcaggccgggaaaagaagcctgcgcccgcagcccaccgagctcaagtactcctggaagacctggggcaaggctaaaatgctgagcacggagtcccataaccagaccttcctgatcgacgggcccgagaccgcggagtgtccgaacaccaatcgggcctggaatagcctcgaggtggaggactacggcttcggggtgttttccacgaacatatggctgaagctgcgcgagaagcaggacgtcttttgcgacagcaagctcatgtccgcagcgatcaaagacaaccgggccgtgcacgcggacatgggctactggatcgagagtgccctgaatgacacctggaagatggagaaagccagtttcatcgaggtcaagagctgccattggcccaagtcccacacactgtggtctaacggggtgctcgagtccgagatgatcatccctaagaacttcgccgggcccgtgagccagcacaattaccgccccggctaccacacccaaaccgctgggccctggcaccttgggaagctggagatggacttcgacttctgcgaagggacgaccgtggtcgtgaccgaggactgcggcaaccggggcccaagcctgaggaccacgacagcgtccggcaagctgatcaccgaatggtgctgccggtcctgcaccctgcccccgctccgctaccgaggcgaggacgggtgctggtatggaatggagatccgccccctaaaagagaaggaggagaacttagttaactccctcgtcacggcggggcacggccaaatcgacaacttcagtctgggcgtgctggggatggccctgttccttgaggagatgctgcggacccgcgtgggaaccaagcacgccatcctactggtcgcagtgtctttcgtgacactgatcacggggaacatgagcttcagggacctcggcagggtgatggttatggtgggggccacgatgaccgacgacatcggcatgggcgtcacttaccttgccctgctcgccgccttcaaagtgcgcccgacgttcgcggccgggctgctgttacggaagctgacctcgaaggaactgatgatggccactatcggcatagctctcctgagccagtcgaccatccccgagacgatcctggaactcacagacgccctggcgctggggatgatggttctcaagatcgtccgcaacatggaaaagtaccagctggccgtgaccatcatggccatcagctgtgtgccgaacgccgtcatcctgcaaaacgcgtggaaggtctcctgcaccatcctcgcggccgtaagcgtgagccccctgctgctcacgagctcccagcagaaggctgactggatccccctggcactgaccatcaagggcttgaaccccaccgctattttcctgactacgctgagccgcacctccaagaagcggagctggccacttaacgaggccgttatggccgtcggcatggtgtcgatcctggcctctagcctgctcaagaacgacatccccatgaccgggccccttgttgctggagggctgctaaccgtttgctacgtcctcacgggacggtccgcggacctggagctcgagagagccgcagacgtgaagtgggaggaccaggccgaaatctccgggtcctcacccatcctgtccatcaccatcagcgaggatggctccatgagcatcaagaacgaagaagaggagcaaaccttaaccatcctcatccggactggcctactggtaatctccggagtgttcccggtgagcatcccgattacggccgcagcctggtacctctgggaggtcaaaaagcagcgcgcgggcgtgctgtgggacgtgccctctccaccgcccgtagggaaggctgagctggaggacggcgcctaccggatcaaacagcgcgggatcttcggctattcccagatcggcgcgggggtgtacaaggaaggcaccttccacaccatgtggcacgtgacccgtggggcagttctcatgcaccgcggcaagcggatagaaccctcctgggccgacgtgaagaaggatctgatcagctacgggggtggttggaagctggagggggaatggaaggagggagaggaggtgcaggtgctcgccctggagccgggcaaaaacccacgcgccgtgcagacgaagcccggcctgtttaagaccaacaccgggactattggcgcggtctccctcgacttctcgcccggcacctccgggagccccatcgtcgatcggaagggaaaggtcgtggggctgtacggcaacggcgtcgtcacccgctccggggcctacgtgagcgccatcgcacagactgagaagtccatcgaggacaacccagagatcgaggacgatatctttcggaagaagcgcctgaccattatggatctccaccccggcgcggggaagacgaagcggtacctgcccgccatcgttcgcgaggccatcaagcggggtctgcgcacccttatcctcgccccgacccgcgtagtggccgctgaaatggaggaggccctgcgcgggctgccaatccgctaccagacccccgccatccgggccgagcacacgggcagggagatcgtcgacctcatgtgccacgcgaccttcaccatgcgactgctgtcccctgtccgcgtgcccaactataacctcatcatcatggacgaggcgcacttcacagatcccgctagcacagccgcgcggggctacatctccacgcgcgtcgagatgggggaggccgcgggaatcttcatgacagccacgccgcccgggagccgggacccgttcccccaatccaacgccccgattatggacgaggagcgggagattcccgagcgcagctggaactccggtcacgaatgggtgaccgatttcaagggaaaaaccgtgtggttcgtcccgagcatcaaggctggcaacgacatcgccgcctgcctgaggaaaaacggtaagaaggtgatccagctgtccagaaagaccttcgatagcgagtacgtcaagaccagggccaatgactgggacttcgtcgtgacgaccgacatctccgagatgggggccaacttccgggccgaacgcgtgatcgacccccggcgctgcatgaagccagttatcctcacggacggtgaggagcgggtgatactggcggggcccatgccagtgacccactcgagcgcggcccaacgccgcggccggatcggacgcaaccccaagaacgagaacgaccagtacatctacatgggcgagcccctggagaacgacgaggactgcgcccactggaaggaagccaagatgctcctggacaacatcaacacgcccgagggcatcattccgagcatgttcgagccggagcgggaaaaggtcgacgcgatcgatggggagtaccgcctccggggcgaagcacgcaagacgttcgtcgacctcatgcggcgcggggaccttccggtgtggctggcctaccgggtcgccgcggagggcatcaattacgcagaccgccggtggtgcttcgacgggatcaagaacaaccagatcctcgaggagaacgtggaggtcgagatatggaccaaggagggcgagcgcaagaagctgaagccgcggtggttggatgcccgcatctactcagaccctttggctctgaaggagttcaaagagttcgctgcgggccgcaagtccttaaccctcaacctgattacggagatggggcgactgcccacctttatgacccagaaggcccgggatgcgctcgacaacctggccgtgctgcacaccgccgaggtgggcgggcgagcgtacaaccacgccctctccgagttacccgagaccctggaaaccttgctcctgctcactctgctggccaccgtcactggcggaatcttcttgtttctgatgagcgggaagggcatcgggaagatgaccctcggcatgtgctgtatcatcaccgcctccatcctcctatggtacgcccagatccagccgcattggatcgcggccagcatcatcttagagttctttctcatcgttctgctgattcccgagccagagaagcaacggaccccccaagacaaccagctcacctacgtagttatcgccatcctgacggttgtggccgccaccatggcgaacgagatggggttcctagaaaagaccaagaaggacctcggcctggggagcatcacaactcaggagtccgagtcaaacattcttgacatcgacctccgccccgcctccgcctggaccctgtacgccgtcgccacaaccttcgtgacgcccatgctgcggcacagcatcgagaactcttcggttaacgtatccctaaccgcgatagcgaaccaggccaccgtgctgatgggtctgggccgcgggtggcccctcagcaagatggacatcggcgtgcccctgctggcaatagggtgctactcgcaagtcaaccccattaccctgactgcggcccttcttctcttggtggcccactatgccataataggccctggcctgcaagcgaaggcgacccgggaggcccagaagcgggccgcggccgggatcatgaaaaaccccaccgtggacggtatcaccgtaatcgacctcgagcccatcccttacgacccaaagtttgagaagcaactgggccaggtgatgctgctagtgctgtgcgtcacccaggtgttaatgatgaggacaacctgggcgttgtgcgaggccctgaccctggctacaggccccatcagcaccctctgggaggggaaccccggccggttctggaataccaccatcgccgtgagcatggctaacatcttcaggggcagctatctggcgggggccggcctcctattctccatcatgaagaacacgaccaatacccgacgggggaccggcaacatcggcgagacgctgggggagaagtggaagtcccggctgaacgccctcggcaagagtgaatttcaaatctacaagaagtccgggatccaggaggtcgaccgcactctagccaaggagggtatcaagcgcggggaaaccgatcatcacgcggtgtcgaggggcagcgccaagctgcggtggttcgtggagcgcaacatggtcaccccggagggcaaggtggtggacttggggtgcggcagaggcggctggtcatactactgtggcgggttgaagaacgtccgcgaagtgaagggactaacaaagggcggacccgggcacgaggagccaatccccatgagcacgtacggctggaacctcgtgcgtctacagagcggggtggatgtgttcttcaccccgcccgagaagtgcgataccctgctatgcgacataggcgagtccagccctaatcccacgatcgaggccggccgcaccctgcgcgtgttaaaccttgtcgagaactggctaaataataacacacagttctgcatcaaggttttgaacccatacatgcccagtgtgatcgagaagatggagaccctccagcggaagtacgggggagccctggtgcggaaccccctgtcgcgcaattccactcacgagatgtactgggtgagtaacgccacggggaacatagtatccagtgtcaacatgatctcccgcatgctgataaaccggttcaccatgaagcacaagaaggcaacctacgagccggacgtggacctcggcagcgggacccgcaacatcgggatcgagaacgagatccccaacctggacatcatcggcaagcggatcgagaaaatcaagcaggaacacgagacgtcctggcattacgaccaagaccacccctataagacctgggcatatcacgggagctacgaaaccaagcagaccgggtccgccagctccatggtgaacggggtcgttaggttattaacgaagccctgggacgtggtcccgatggttacccagatggccatgacggacaccacgcccttcggccagcaacgggtgttcaaggaaaaggtcgacacgcgcacccaggagccaaaggagggcaccaagaagctgatgcggatcacggccgagtggttatggaaggagctcgggaagaagaagacgccccggatgtgcaccagagaggagttcaccaggaaggtgcgttcgaacgcggccctgggagccattttcaccgacgagaacaaatggaagtccgcccgcgaggccgtcgaggattctcggttctgggagcttgtggaccgcgagcggaacctccacctggaaggcaagtgcgagacctgcgtgtacaacatgatgggcaagcgcgagaagaagctaggggagttcggcaaagcgaagggctcacgagcgatctggtacatgtggttgggggcacggtttctggagttcgaggccctgggcttcctaaacgaggaccactggttcagccgaggaaatagcctctccggcgtggagggagagggcctgcacaagttgggctatatccttcgcgacgtgtcaaagaaggagggcggtgcgatgtacgcggacgataccgctgggtgggacacccggatcacgctggaagacctgaagaacgaagaaatggttactaaccacatgaagggcgagcacaaaaagttggccgaggcgatcttcaagctgacctatcagaacaaagtcgtgcgcgtgcagcgcccgacgccccgggggacggtcatggacataatctccaggaaggaccagagaggcagcggccaggtagggacctacggcctcaacaccttcaccaacatggaggcgcagctgatcagacagatggagggggaggggatctttaagtccatccaacggctgacggttacagaggagatcgctgtccagaactggctcgctcgcgtgggccgggagcgtcttagccggatggccatatccggggacgactgcgtggtcaagcccctggacgatcgctttgccagcgcgctaaccgccctgaacgacatgggaaaggtgcgtaaggacatccaacaatgggagccatctcgcgggtggaacgactggacccaagtgccattctgtagtcaccacttccacgagctggttatgaaggatggtcgggtcctcgttgtgccctgccgcaaccaggacgagctgatcgggcgggccaggatctcccaaggcgccggttggagcttgaaggagacggcctgcttggggaaatcctacgcacaaatgtggaccctgatgtacttccaccgccgcgaccttcggctcgccgccaacgccatctgctccgcagtgccctcccactgggtgcccaccagccgcaccacctggagcatccacgcaaagcatgaatggatgaccaccgaggacatgctggccgtttggaaccgcgtgtggatccaagagaacccgtggatggaggacaagactcccgtggagtcttgggaggaggtcccctacctgggcaagcgagaggaccagtggtgcgggtctctcatcggcctgaccagtcgcgccacgtgggctaaaaatatacagaccgcaatcaaccaggttcggagtctaatagggaacgaggagtacaccgactatatgccctccatgaagcgcttccggaaggaggaggaggaggccggcgtgctctggtga

SEQ ID NO: 25125 - RNA, 9876 nt, synthetic construct
  misc_feature 1..9876: note = derived and/or modified CDS sequence (opt11) from DENV-2__KF955373__SS-prME
  source 1..9876: mol_type = other RNA
accgccggcgtgatcatcatgctgatcccaactgccatggcgttccacctcaccacgcgcaatggggaaccccatatgatcgtgggccgacaggaaaaagggaagagtctgctgttcaagaccgaggacggtgtgaacatgtgcaccttgatggccattgacttgggggaactgtgcgaggataccataacctacaaatgtcccctcctgcgacagaacgagcccgaggatattgactgctggtgcaacagcacctcgacctgggtaacctatgggacttgtaccaccacgggcgagcatcggcgtgagaaacggtcggtagccctcgtgccccacgtggggatgggcctcgagacgcgcaccgagacctggatgagctccgagggggcctggaagcacgtacagcggatcgaaacctggatcctgcgccacccgggcttcaccatcatggccgcgatcttagcctataccatcggcactacgcatttccagcgggctctcatcttcatcttactgacggccgttgcgccctctatgaccatgcgctgcatcggaatatccaaccgggacttcgtggagggcgtcagcgggggatcctgggtggacatcgtgctcgagcatgggtcctgcgtgaccacgatggccaagaacaagcctaccctggacttcgagctgatcaagacagaggccaaacagcccgccaccctcagaaaatattgcattgaggcaaaactgacgaacacaaccaccgagtccaggtgtcccacgcagggcgagcccagcctgaatgaggaacaagacaagagatttatctgtaaacactccatggtggaccggggctgggggaacgggtgtggactgtttggcaagggcgggatagtgacctgtgcaatgtttacgtgtaagaagaatatggagggcaaggtcgttctgcccgaaaacctggagtacaccattgtgatcacgcctcacagcggggaggagcacgccgtcggcaatgacaccgggaagcacggtaaagagatcaaaataacgccccagtccagcatcacagaggcggagctcaccggttacggcacggtgaccatggagtgctctcctcgtactggcttggacttcaatgagatggtgctgctccagatggaggacaaggcttggctcgtccatcggcaatggtttctcgacctccccctcccttggctgccgggggccgacacccagggctcaaactggatccagaaggagacgctcgtgaccttcaaaaacccccatgctaagaagcaggacgtggtcgtgctcggctcccaggaaggtgccatgcacaccgccctgaccggggccacggagatccagatgagtagcggcaaccttttgttcaccggccacctgaaatgcagattgaggatggacaaactgcaactgaaggggatgtcctactcaatgtgcaccggcaagttcaagatagtcaaggagatcgccgagacccagcacgggacgatcgtaatccgcgtacaatacgagggcgacggctccccatgcaagatccccttcgagatcatggacttagagaagcggcacgtcctggggagactaatcaccgtgaacccgatcgtgaccgaaaaggacagccccgtcaacatcgaagcggaaccgccattcggcgactcatacatcataataggggttgaaccgggtcagctcaagctgaactggttcaagaaggggagctccataggccagatgttcgagactacgatgcgcggcgccaaacggatggccatcctgggggacacggcttgggacttcggcagcctagggggcgtgttcacatcgatcgggaaagccctgcaccaagtcttcggcgcgatctacggcgcggccttcagcggggtgtcctggacgatgaagatcctgatcggcgtcatcatcacgtggatcggaatgaactcgcggtccaccagcctatcagtcagcctcgtgctagtgggcgtcgtgaccctttatctcggggtcatggtccaggcggactccggatgcgtggtgtcctggaagaacaaggagttaaaatgcggctccgggatatttatcaccgacaacgtccacacgtggaccgagcagtacaagtttcaacccgagagcccttcaaagctggcgtccgctatccagaaggcccacgaggagggcatatgcgggatccggtccgttacccgcctcgagaatctcatgtggaagcagatcacccccgagttgaaccatatactctccgagaacgaggtcaagctgacgatcatgaccggcgacattaaggggatcatgcaggccgggaagcggtctctgcgcccgcagcccaccgagttgaagtactcctggaagacctggggcaaagccaagatgctgtcaacggagtcccacaaccagaccttcctgatagacgggcccgaaaccgcggagtgcccgaacaccaaccgggcctggaacagcctcgaagtcgaggactatggcttcggtgtgttctccacgaacatctggctgaagctgcgggaaaaacaggatgttttctgcgacagcaagctcatgtccgccgccataaaggataaccgggccgttcacgcggatatgggctactggatcgagagcgccctgaacgatacctggaagatggagaaggcgtccttcatagaggtcaagagctgccactggcccaaatctcacaccctgtggagcaatggcgtgcttgaatccgagatgatcatccccaagaacttcgccggtcccgtgagccagcacaactaccgcccgggctaccacactcagacggccgggccctggcacctgggaaaattggagatggacttcgacttctgtgaggggactaccgtcgtggtcaccgaggactgcggtaatcgcggaccctctctaaggacaacgaccgcgagtggaaaattgatcaccgagtggtgctgccggtcctgcaccctacccccacttcgatacagaggcgaagacgggtgctggtacggcatggagatccgccccctgaaggagaaggaggagaacctggtgaactccctggtgaccgcggggcacggtcaaatcgacaacttttctctgggagttttagggatggccttgttcctggaggagatgctgaggacccgagtgggaacgaagcacgccatcctcctggtggctgtctcattcgtgaccctaatcacggggaacatgagcttccgggatttggggcgcgtcatggtcatggtgggggcgacaatgaccgacgatatcgggatgggagtgacctatctggccctgttagccgctttcaaggtccggccgacgttcgcagccggtctgttactccggaagctgacctccaaggagcttatgatggccaccatcggtatcgccctcctgagccagtccactatccctgagacgatcctggagctcaccgacgccctggcactggggatgatggtgctcaaaatcgtgaggaacatggaaaagtaccaactggccgtcaccattatggccatcagctgcgtgccgaacgccgtgatcctgcagaacgcgtggaaggtctcctgtacaatcttagcggccgtgtctgtcagccccctgctgctcacgagctcccagcagaaagccgactggatccccctggccctgaccatcaagggtctcaaccccacggcaatcttcctgaccaccctctcacggaccagtaagaagcgcagctggccgctcaacgaggccgtgatggccgtaggcatggtttccatcctcgccagcagcctgctcaagaacgacattccaatgaccggccccctggtggccggcgggctgctcaccgtttgttacgtcctgacgggccgctccgctgatctggaactggagcgcgctgccgatgtgaagtgggaggaccaggccgagatcagcgggtccagcccaatcctgtcaatcaccatctcggaagacggctcaatgagcatcaagaacgaggaagaggaacacaccctgaccatcctcattcggactggcctgctggtgatctccggagtctttccgctgagcattcctatcaccgccgcggcctggtacctatgggaggtgaagaagcagagagccggcgtgctttgggacgtgcccagcccgccgcccgtggggaaagccgagctcgaggacggcgcctaccgcatcaagcagcgcgggatattcggctacagccagatcggtgccggggtgtacaaggagggaaccttccacacaatgtggcacgtgactagaggggccgtgttaatgcaccgcggcaagcggatcgagccatcatgggcggacgtcaagaaagacctgatctcgtacgggggcggctggaaactcgagggcgagtggaaggagggcgaagaggtccaggttctggccctggagcccggtaaaaacccccgcgcagtgcagaccaagcctggcctcttcaagaccaacacggggactataggcgcggtatccctggatttcagccctggcacgtccggtagccccatcgtggaccggaagggcaaagtggtcggtctgtacggcaacggggtggtcacccgctctggggcctacgttagcgccatcgcccagaccgagaaaagcatcgaggataatccggaaattgaagacgacatcttccggaagaaacggttgactatcatggacctacaccccggcgcggggaagacgaagcggtacctacccgctatcgtacgcgaggccatcaagcggggcctgcgcaccctcattctagccccgacacgggtggtcgctgcggaaatggaggaggcactccgggggctccccattcgctatcagacccccgccatccgcgccgaacacacgggccgcgagatcgtggacctgatgtgtcatgctacctttactatgcggctgctctcccctgtgcgcgttccaaactataacttaatcatcatggacgaagctcacttcaccgaccccgcctccatcgcagccagaggctatatctccacgcgcgtggagatgggggaggccgccggcatcttcatgaccgccacgccgcctgggagccgggatcctttcccccagtccaacgcccccatcatggatgaggaacgcgagatacccgagcggagctggaactccggccacgagtgggttaccgacttcaagggcaagacggtttggttcgtgcctagcatcaaagccggcaacgacatcgcggcctgcctacgcaaaaacggtaagaaagtgatccagttgtcgcggaagactttcgactctgagtatgttaaaacccgcgctaacgactgggacttcgtggtcaccacggatatttccgagatgggtgccaacttccgggccgagagagtcatcgacccgagacgctgtatgaaacccgtgatcctgaccgacggggaggagcgggtgatcctggcgggccccatgccggtaacccatagctctgccgcccagcggcggggccggattggtcgcaacccgaagaacgaaaacgaccaatacatctacatgggcgagccgctcgagaacgacgaggactgcgctcactggaaagaggccaagatgcttctagacaatatcaatacccccgaggggatcatccctagcatgttcgaacccgaacgggagaaagtggacgccatcgacggggagtaccgcctccgtggcgaggcacgaaaaacgttcgtggacctgatgcggagaggggatctacccgtttggctggcctaccgggtggccgccgagggcatcaactacgcggaccgccggtggtgcttcgatgggatcaagaacaaccagatacttgaggagaacgtagaggtagagatctggacaaaggagggcgagaggaagaaacttaagccgcggtggctagacgcccgcatctattccgaccccctggccctgaaggagttcaaggagttcgccgcaggacggaagtccctgactctgaacctgatcaccgagatggggcgattacccacgttcatgacccagaaggctcgcgacgcactggacaacctggccgtgctccacaccgctgaggtaggcgggcgcgcgtacaaccacgccttatccgaactgcccgagaccctcgagactctgctgttactgaccctgctcgccacagtgaccggtggtatcttcctattccttatgagcgggaagggcatcggcaaaatgacgctcggtatgtgctgcatcataaccgcctccattctgctgtggtacgcccagattcagcctcactggatagcggccagcatcatcctcgagtttttcctaatcgtgctgctcatccccgaacccgagaaacagcggacaccccaggacaaccaacttacttatgtcgtgatagccatactgaccgtggtcgccgcgacgatggcgaacgagatggggttcttagagaagacaaagaaggacctgggcctgggcagcataaccacacaggaatccgagtcgaacatcttagatatcgatctcaggcctgcctccgcctggacgctgtacgccgtggccaccaccttcgtgacccccatgctgaggcatagcatcgagaacagctcggtcaacgtcagcctgactgcgatcgccaatcaggcgactgtgctgatggggcttggccggggttggcccctgagcaagatggatatcggcgtcccgctgctcgccatcgggtgctactcccaagtgaatcctattaccctgaccgctgccctgctcctgctggtggcccactacgcaatcataggacccggcctccaggccaaggcgactcgtgaagcccagaagcgtgccgcggccgggattatgaagaatcccaccgtcgacggcatcacggtgattgaccttgagccaattccgtacgaccctaagtttgagaagcagctgggccaggtgatgctcctggtgctttgcgtgacccaagtgctcatgatgcgcacgacctgggcgctatgtgaggccttgactctcgctaccggtcccataagcacactgtgggagggcaaccccggcagattctggaataccaccatcgccgtctccatggccaacatcttccgcgggagctacctagcgggggccgggttgctgttttccatcatgaagaacaccacgaacacgagacgcgggaccggaaacatcggcgagacactgggggagaagtggaagtcgaggctcaacgccctgggaaagtcagagttccaaatctacaaaaagtccgggatccaggaggtagatcgcacgctggccaaggagggaataaagcgaggggagaccgatcaccacgcggtgtccaggggaagcgccaagctccggtggttcgtcgagcgcaacatggtcaccccggagggcaaggtggtagacctggggtgcggtcgcggcggatggtcctactactgtggcgggctgaagaacgttcgcgaggtgaaggggcttaccaagggcgggcctgggcacgaggagcctatacccatgagcacatacggctggaacctggtccggttgcagtctggagtggacgtgttcttcaccccgcctgagaagtgtgataccctcctgtgcgatatcggcgaatccagcccgaaccccaccatcgaggctggccgtaccctgcgggtgctcaatctggtggagaactggctgaacaacaatacccagttctgcatcaaagtgctcaacccgtatatgccctccgtcatcgagaagatggaaaccctgcagcgcaagtacgggggtgccctggttcggaacccgctaagccgcaactccacccacgaaatgtactgggtgagcaacgccaccggaaacatcgtctcctcggtgaacatgatcagccgcatgctcatcaaccggttcacgatgaagcacaagaaggctacctacgaaccggacgtcgacctgggctcaggcaccagaaacatcggcattgagaacgagatcccgaatttggacatcatcggtaagcggattgagaaaataaagcaggagcatgagacctcctggcactacgaccaggaccatccatacaagacgtgggcgtaccatggctcatacgagaccaagcaaaccggctccgccagctctatggtcaacggggtggtgaagctcctgaccaaaccctgggacgtggtcccaatggtcacgcagatggccatgaccgacaccacccctttcggccagcagcgggtcttcaaagagaaagtggacacacggacccaagagcccaaggaaggcactaagaagctaatgcggatcaccgccgagtggctctggaaggagctgggcaagaaaaagacgccccgtatgtgcacccgcgaggagtttacccgtaaggtcagaagcaatgccgccctgggcgccatcttcaccgacgaaaacaagtggaagtccgcccgggaggccgtggaggacagcaggttctgggagttggtggaccgggagcgcaacctgcatctggaagggaagtgcgagacctgcgtctacaatatgatgggcaagcgggagaagaaactcggggagttcgggaaagcgaagggctcccgcgcaatctggtatatgtggcttggggcgcggttcctggagttcgaggccctcggctttctgaacgaggatcactggtttagccgcgggaacagcttatccggagtagagggagagggcctccacaaactcggctacatcctgcgggacgtgagcaagaaggaaggtggagcgatgtacgccgacgacaccgccgggtgggacacccgcattacactcgaggatctgaagaacgaggagatggtcacgaatcatatgaagggcgagcacaaaaagctggccgaggccatattcaagctcacttaccagaacaaggtggtacgggtacagcgaccgacccctagaggaaccgtgatggacatcatctccagaaaggatcagcgcggcagtggacaggtggggacttacggcctgaacacattcacaaatatggaggcgcagttgatacggcagatggagggtgaaggcattttcaagtccattcagcgcctcaccgtcacggaggagatcgctgtgcagaactggctggcccgggtgggccgggagagactgagccgcatggccatctccggcgacgactgtgtcgtcaagcccctcgacgaccgtttcgcgagcgcgctcacagctctgaacgacatgggcaaggttcgcaaggatattcagcagtgggagccaagccggggctggaatgactggacccaggtccccttctgtagccaccacttccacgagctcgtgatgaaagatggcagggtgctggtcgtaccttgccggaatcaggacgagctgatcggtcgcgcccggatcagccagggcgccggctggagcctcaaggaaaccgcctgcctgggtaagtcctacgcgcagatgtggacgctaatgtacttccataggcgggacctccgcctggccgccaacgccatttgtagcgctgtgccctcacactgggtccccacaagccggacgacatggtctatccacgcgaagcacgaatggatgactacggaggacatgctggccgtgtggaaccgggtgtggatccaagaaaacccgtggatggaggacaagaccccagtagagagctgggaggaggtgccctatctcggcaagcgggaggaccaatggtgcggcagcctaatcggcctgacctcaagggctacctgggccaagaacatccaaacggcgatcaaccaggttcgcagcctcatcggtaacgaggagtatacggactacatgcccagtatgaaacgattccgcaaagaggaggaggaggctggcgtcctctggtga

SEQ ID NO: 25126 - RNA, 9876 nt, synthetic construct
  misc_feature 1..9876: note = derived and/or modified CDS sequence (opt11) from DENV-2__GQ868600__SS-prME
  source 1..9876: mol_type = other RNA
accgcgggcatgatcatcatgctgatccccacggttatggcttttcacttaaccacccgcaatggtgaaccccacatgatagtgagtcggcaggaaaagggcaaaagcctcctgttcaaaacaaaagacggaactaatatgtgcaccctaatggcaatggacctgggcgagttgtgtgaggacaccatcacgtacaaatgtccctttctcaagcagaacgagcccgaggacatcgactgctggtgtaatagcacctccacgtgggtcacctatgggacctgcaccacgacgggcgagcaccgacgcgagaagcgatcggtggccctggtcccccacgttggcatggggctggagacacgaaccgaaacgtggatgtccagcgagggcgcctggaagcacgcccagcgcatagagacctggatactccggcaccccggcttcaccataatggcagccatactcgcatacaccatcggtacgacccacttccagcgcgtgctcatattcatactcctgaccgccatcgccccctccatgacaatgcggtgcatcgggataagcaaccgcgactttgtcgagggcgtgtccggcgggtcatgggtggacatcgtcctggagcacggctcgtgcgtgaccaccatggccaagaacaagccaaccctagacttcgagctgatcaagaccgaggccaagcagccagccaccctgcgcaagtactgcatcgaggctaaacttaccaacaccaccacggacagccgctgccccacacagggggagccaaccctcaacgaggagcaagacaagagattcgtgtgcaagcactccatggtggaccgcggctggggaaacgggtgcggcctgtttggaaagggcgggatcgtaacgtgcgcaatgttcacgtgcaagaaaaacatggaaggcaagatcgtacaacccgagaatcttgagtacacagtcgtgatcacgccacacagcggcgaagagcacgcggtgggtaacgacaccggtaagcacgggaaggaggtcaaaatcaccccgcagtccagcatcacagaggccgagttaaccggctacggaaccgttaccatggaatgctctccacggacaggcctggatttcaatgagatggttctcctgcagatggaggacaaggcctggctcgtccaccgccagtggttcctcgacctgcccctgccctggctcccgggggccgacacccagggaagcaactggatccaaaaggaaaccctggtgactttcaagaacccccatgctaagaagcaggatgtggtggtgctagggtcccaggagggggcgatgcacacagccctcaccggcgccactgagatccagatgagctcagggaacctactgtttaccggtcatctcaagtgccggttgcggatggacaaactgcagctcaagggcatgagctactcgatgtgcacggggaagtttaagatcgtaaaggagatcgccgagacccaacacgggaccatagtgatccgtgtgcagtacgagggggacgggtccccctgcaagatccccttcgaaataatggacctggaaaagaggcacgtcctgggcaggctcataaccgtgaatccgatagtgacggaaaaggactccccggttaacatagaggccgaaccgccctttggggacagctacataataatcggggtggaacccgggcagctgaagctggactggttcaagaagggtagctccatcggccaaatgtttgaaacaactatgcgcggcgccaaacgcatggcaatcctcggcgacaccgcctgggacttcgggagcctgggcggggtgtttacttccatcggcaaggccctgcaccaggtcttcggagccatctacggcgcggcgttcagcggcgtctcctggaccatgaagatcttaatcggggtgatcatcacgtggatcggcatgaacagtcggtcgaccagcctatccgttagcctggtgctggtggggattgtcaccttgtatctgggcgtgatggtgcaggctgactccgggtgcgtcgtgagttggaaaaacaaggagctgaagtgcggatccggaatctttgtaaccgacaacgtccatacctggaccgagcagtacaaatttcaacccgagagtccgtctaagctcgcgagcgcgatccagaaggcacacgaggagggtatctgcggcatcagatctgtgacgaggctggaaaacctgatgtggaagcagataacatccgaactcaaccatatcctgagcgagaacgaggtaaagctgaccattatgaccggggacatcaagggcataatgcaagtgggcaagcgctccctccggccccagccaactgagttacgctactcttggaagacctggggaaaagctaagatgctctccaccgagctccacaaccagacgttcctcatcgacggcccagaaacggctgaatgccccaacaccaacagagcatggaacagcttagaggtggaagactacgggtttggcgtgtttacgactaacatctggctccgcttgcgcgagaagcaggacgcgttctgcgactccaagctaatgagcgcggccatcaaagacaaccgggccgttcacgccgatatggggtactggatcgagtcggcgctcaacgacacatggaagatcgagaaggccagcttcatcgaagtaaaaagttgccactggcccaagtcgcacacgctgtggtcaaacggcgtgctagagtcagaaatggtcatacccaagaactttgccggccccgtttcccagcataacaaccggcccgggtaccacacccagaccgcaggtccgtggcacttaggtaagctggagatggactttgacttctgcgagggcaccacggtggtcgtgacagaggactgcgggaaccgcggccccagcctgagaactactacggcaagcggcaagctcatcacggagtggtgctgccgctcatgcactttaccgccgctgcggtaccgcggcgaagacggctgctggtacgggatggagatccggccgttgaaggagaaggaggagaatctggtaagctccctagtcaccgcggggcatggacagatcgacaatttctcattgggaatcctgggcatggctctgttcctcgaagagatgctgcgcacgcgcgtcgggaccaagcatgccatcctgttggtggccgtctctttcgtcaccctgatcaccggcaacatgtcttttagggatctggggcgcgtgatggtaatggtgggtgcgacgatgacagacgatatcgggatgggcgtaacctaccttgccctgctggcagccttcaaagtccggcccaccttcgcggccggcctcttgctgcgcaagctaacgtccaaggagctgatgatgaccaccatcggaatcgtgctgttgagccaatccagtatccccgaaacaatcctggagctgacggacgccctcgccctgggcatgatggttttgaagatggtccggaacatggagaaataccagctcgcagtgacgatcatggcaattctgtgcgtgcccaacgcggtcatcctgcagaacgcttggaaggtgagctgcaccatactcgcagtcgtgtccgtaagccctttgttgctcacatcctcgcagcagaaggccgactggatccctttagccctgacaatcaaggggctcaacccgaccgcgatcttcctgaccacgctcagccgcacgtcaaagaaacggtcgtggcccctcaacgaagcgatcatggccgtcggcatggtctcgatcttggcctcgagcctccttaaaaacgacataccaatgaccggcccactggtggcgggcggactgctcaccgtctgctacgtgcttaccgggcgttccgcagacctagaacttgaacgggccaccgacgtgaagtgggacgaccaggccgaaatctcgggttctagccctatcctgtccatcacaataagtgaggacggttcaatgagcatcaagaacgaggaggaagagcagaccctgacgatcctgatccgcactggcctgcttgttatcagtgggctcttccccgtgagcatcccgataaccgccgcggcgtggtatctgtgggaggtcaagaagcagagggccggggttctgtgggatgtaccgagcccgccgcccgttggcaaggccgagctagaagatggggcctatagaatcaagcagaaaggcatcttaggttactctcagatcggtgcgggcgtatataaggagggaaccttccacacgatgtggcacgtgacacggggcgccgtattgatgcacaagggaaagagaatcgagccctcctgggccgacgtcaagaaggacctcatctcatatggcggggggtggaagctggagggcgagtggaaggagggtgaggaggtacaggtgctggcactcgagcccggcaagaacccccgggccgtgcagacaaagcccggacttttccgcactaacacgggcactatcggggcggtatccctggatttcagccccggaacgtctggcagcccaatagtcgacaagaaagggaaggttgtcgggctctacgggaacggggtcgtcacgcggagcggagcctacgtgagtgccatcgcccagaccgaaaagtccattgaggacaacccggagatcgaggacgacatcttccgcaagcggcgcctaaccatcatggatctgcaccccggtgccggtaagaccaaacgatacctgcccgcgatcgtccgcgaggccatcaagcgggggctccgcacactgatcctggcgcccacgcgcgtcgttgcagcggagatggaggaggccctccggggcctgccgatcaggtaccagacgcccgccatccgggccgagcacacgggacgcgaaatcgtggatctcatgtgtcacgcaactttcaccatgcgactactgagccccatcagggtgccgaactataacctgatcatcatggacgaagcgcacttcaccgaccctgccagcatcgccgccagaggctacatttccacccgcgtggaaatgggagaagcggcggggatcttcatgaccgccacaccgcccggcagccgggacccattcccgcaatccaatgcccccatcatggacgaggagcgcgagatccccgagcgaagttggaacagtgggcacgaatgggtgaccgacttcaagggcaagacggtctggttcgtccccagcatcaagaccgggaacgacatcgccgcttgtctccgcaaaaacggcaagcgggtgatccaactgtcccgcaagacattcgatagtgagtacgttaagaccaggacgaacgactgggacttcgtggtgaccaccgacatcagtgagatgggcgcgaacttcaaggccgagcgagtcatcgacccgcggcgatgcatgaagcctgtgatcctgaccgacggtgaggaaagggtgattctcgccggccccatgcccgtcacgcacagctcggccgctcaacgccgcgggcggatcggacgcaaccctcggaacgagaatgaccagtatatctatatgggggagccgctggagaacgacgaggattgcgcccactggaaagaggccaagatgctgttggacaatataaacacgcccgagggtatcatccccagcatgtttgaaccagagcgcgaaaaggtcgacgccatagacggcgagtaccggttacgcggtgaggctcggaagaccttcgttgacctgatgcgccgtggggacctccccgtgtggctggcgtataaggtggccgccgagggcataaactacgccgacaggcggtggtgttttgacggcacacgcaataaccagatcctggaggagaatgtggaggttgagatctggacgaaggagggcgaacggaagaaactcaagcccaggtggctggatgcccgaatctactccgacccgctggcgctcaaggagttcaaagagttcgccgcggggcgcaagtcactgactctgaacctaattacagagatgggccggctgccaacatttatgacgcagaaggcgcgcgacgcgctggacaacctcgcggtgctgcatacagccgaggccggtggcaaagcgtataaccacgcgctgtccgaactccccgagactttggagacgctgctcctgctgacccttttggccacggtcaccgggggcatatttctgttcctcatgtccggcagagggattggcaagatgacactgggaatgtgctgcattatcaccgcgtccatcttactctggtacgcacagatccaaccccattggatcgccgcgagtatcatcctggagttttttctgatcgtgctcctgattccggagccagagaagcagaggacgccccaggacaaccagttaacctacgtaatcatcgccattctcaccgtggtggccgcaacgatggcgaacgagatgggcttcctggagaaaacgaagaaggacctggggctcggaaacatcgcgactcagcaacccgagagcaacatccttgacatcgacctgcggccagcatccgcctggacgctctacgccgtggcaaccacatttatcaccccaatgcttcgccatagcatcgagaactctagcgtgaatgtgtccctgaccgccatcgcaaatcaggcgaccgtacttatgggcctcgggaagggctggcccctgagcaagatggacattggggtcccgctcctggccatcggctgctatagtcaggtgaaccctatcacactaacagccgcgctcctgctgctcgtggcgcattacgccatcatcgggccgggcctccaggccaaggcgacccgagaggcccagaagcgggcagcagccggaatcatgaagaaccccaccgtggacgggatcacggtgatcgacctggacccaatcccctacgatcccaagttcgaaaagcagttgggccaggttatgttactggttctctgcgtgacccaggtgctgatgatgcgcaccacctgggcgctgtgtgaagccctcacgctggcgaccggacccgttagcaccctctgggagggaaacccaggtcgtttctggaacaccacaatcgccgtgagcatggccaacatcttccgcggcagctacctagctggcgccgggttgctgttctccattatgaagaataccacctctacccggcgcggcacgggcaacatcggcgaaacgctcggggaaaagtggaagagcaggctaaatgccctagggaagtccgagttccagatctacaagaagtccggcatccaggaggtggaccgcacccttgccaaggaagggatcaagcggggggagaccgaccaccacgccgtctcgcgcgggtccgcgaagctgcgctggttcgtcgaacgcaacctcgtgacgcccgaaggcaaggtagtggacttgggttgcgggcggggcgggtggagctactattgcggagggctgaaaaacgttcgtgaggtcaagggcctgacaaagggcggaccagggcatgaagagcctatccctatgtccacttacgggtggaacctcgtacggctgcagagcggggttgacgtcttctttgtgccgcctgagaagtgtgacactctgctctgcgacatcggggagagttcccccaatcccacagtggaggcgggccgcacgctgcgggtgctgaacctggtagagaactggcttaacaacaacacacaattctgtgttaaggtgctcaacccgtacatgcccagcgtgattgagcgtatggagaccctgcagcgaaagtacggcggggctttggtgcgcaaccccctgtcgaggaacagcacccacgagatgtactgggtctccaatgccagcggcaacatcgtgtctagcgtaaatatgatatcccggatgctgatcaaccgctttacgatgcggcataagaaggcgacctacgagccggacgtggatctcgggtccggcacacgcaacatcgggatagaatccgagacccccaacctagacattataggcaagcgcattgagaagataaagcaggaacacgagacgagctggcactacgaccaggaccatccatacaagacatgggcctaccacggctcttacgagaccaagcaaaccgggtcggcctccagcatggtgaatggcgtggtccgcctgctcacaaagccgtgggacgtagtgccgatggtcacccaaatggctatgaccgataccaccccctttgggcaacagcgggtatttaaggaaaaggtggacaccaggacccaggagcccaaggagggcacaaaaaagttgatgaagatcacggccgagtggctgtggaaggagctcggcaagaaaaagacgccgaggatgtgcaccagagaggaatttaccaaaaaggtcagatccaatgcagccttaggggccatcttcacggatgagaataagtggaagtccgcacgcgaagcagtggaggattcacggttttgggagctggtcgacaaggagcgcaacctccaccttgagggcaagtgcgagacgtgcgtatataacatgatgggcaagcgcgagaagaagctgggcgagttcggaaaggcgaagggcagccgggccatctggtacatgtggctcggagcccgtttccttgagttcgaggccctcggcttcctgaacgaggaccattggttcagcagagagaactccttgagcggcgtggagggggagggcctgcacaagctagggtacatcctacgggaggtcagtaagaaggaaggcggtgccatgtacgcggacgacaccgccgggtgggataccaggattacgatcgaggatctgaagaacgaggaaatgataaccaatcacatggccggagagcacaagaaactggccgaggcgatctttaaactgacctaccaaaacaaggtcgtgcgggtgcagagaccgactccccgcgggaccgtgatggatataatcagtcggcgcgaccagagaggatccggccaggtgggcacctacggactgaacaccttcaccaatatggaggcccaactcattcggcagatggagggtgaaggcatcttcaagagcatccagcacctgacggcctccgaggagatagcggtccaggactggctggtacgggtgggacgcgagaggctcagccgcatggccatctccggagacgattgcgtcgtaaagcccctggacgatagattcgcacgcgccctgaccgccctcaacgacatgggcaaggtacgtaaggacatccagcaatgggagccctcacgcggctggaatgactggacccaagtcccgttctgcagtcaccacttccacgaactgatcatgaaggacggacggaccttggtggttccatgccgcaaccaggacgaactgataggtcgtgcccgcatcagtcagggcgccgggtggtccctgcgggagaccgcgtgcctgggtaaaagctacgcccagatgtggagcctcatgtacttccatcgccgggacctgcgcctggccgccaatgcaatctgctccgcggtcccttcccactgggtgcccacgagccgaaccacatggagcatccacgcctcccatgagtggatgaccacggaggacatgctcaccgtgtggaacaaggtctggatactggagaacccatggatggaggacaagaccccagtggagagctgggaggagatcccctatctgggcaagcgggaggatcagtggtgtgggtccttgatcggcctgaccagccgcgccacgtgggcgaagaatatccaaaccgccatcaatcaagtgaggtcactgatcgggaacgaggagtacacagactacatgcccagcatgaaacgcttccggcgcgaagaggaggaggcgggtgtcctctggtga

SEQ ID NO: 25127 - RNA, 9876 nt, synthetic construct
  misc_feature 1..9876: note = derived and/or modified CDS sequence (opt11) from DENV-2__KF955359__SS-prME
  source 1..9876: mol_type = other RNA
accgccggggtgattatcatgttaatccccaccgccatggcgttccaccttaccacccgcaatggggaaccccacatgattgtgggccggcaggaaaaggggaagtccctgctgtttaagaccgaggacggcgtgaatatgtgcaccctcatggccatcgatctgggggagctgtgcgaggacaccatcacttacaagtgccccctcctgcgacagaacgagccagaggacatcgactgctggtgcaacagcacctcaacctgggtgacctacgggacctgcacgacaactggcgagcaccggcgtgagaagcggagcgtcgccctggtgcctcacgttggaatgggcctcgagacccgcaccgaaacctggatgagcagcgagggggcctggaagcacgtccagcggatcgagacgtggatcctgcgccacccgggcttcactaccatggccgcgatcctggcctacaccatcgggacgacccacttccagcgggccctcatctttatcctgctgaccgcggtagcccccagcatgaccatgcgctgcatcggcatttcaaaccgggactttgtggagggcgtcagcgggggctcctgggtggacatagtgctcgagcacgggagctgcgtaacgacgatggccaagaacaagcccaccttagacttcgagctcatcaagaccgaggccaagcagcccgccatcctcagaaagtactgtatcgaggccaaacttacgaacaccacgaccgaatcccggtgtccgactcagggcgagcccagcctgaacgaggaacaggacaagcgcttcatctgcaagcactccatggtggaccggggctggggtaacggctgcggtctattcggaaagggcgggatcgtgacctgcgcgatgttcacgtgcaagaagaacatggaaggcaaggtcgtgcttcccgagaacctggagtacaccattgtgatcacgccccactcaggggaggagcacgccgtgggcaacgacaccgggaagcacggtaaggagatcaaaatcacgccgcagtccagcatcaccgaggccgagctcaccgggtacggcacggttaccatggagtgcagcccccgtaccggcttagactttaacgagatggtgctgctccagatggaggacaaggcctggctggtccatcgtcagtggttcctcgacctccccctgccctggttaccgggggccgacacccagggcagcaactggatccagaaggagacgctagtgaccttcaagaacccccacgcgaaaaagcaggacgtggtcgtcctggggagccaggagggtgccatgcacaccgccctgaccggcgccacggagatccagatgagctctggcaatctcctgtttactgggcacctcaaatgccgcctacgtatggacaagctgcagctaaaggggatgtcctacagcatgtgcaccggcaagtttaagatcgttaaggagatcgccgagacccagcacgggacgatcgtgatccgcgtgcagtacgagggcgacggctccccctgcaagatccccttcgagatcatggaccttgagaagcggcacgtcctggggcgcctgatcacggtgaacccgatcgtgaccgagaaggacagccccgtcaacattgaagcggagccgcccttcggcgactcctacattattatcggggtggagcccggccagttaaagctgaactggttcaagaaggggagctctatcggccagatgttcgagaccacgatgcgtggcgccaagcggatggccatcctgggggacaccgcctgggattttggcagcctcgggggcgtgttcacctccatagggaaggccctgcaccaggtctttggcgccatctacggtgccgccttctccggggtgtcctggaccatgaagatcctgattggcgtgatcatcacgtggatcgggatgaacagccgctccaccagcctgtccgccagtctcgtcctcgttggtatagtgaccttatacctcggggtcatggtgcaggcggacaccggctgcgtggtctcctggaagaataaagagctgaagtgtggctctgggatcttcatcacagacaacgtacacacctggacggagcagtacaagtttcagccagagtcccccagcaaactggcctctgcaattcagaaggcacacgaagagggcatctgcggcatccggtccgtgacccgcctcgagaatctgatgtggaagcagattacccccgagctgaaccacatcctctcagagaacgaagtcaagctaacaatcatgaccggagacattaaggggatcatgcaggccggcaagcggtccctacggccgcagcccaccgagctcaagtacagctggaagacgtggggcaaggcgaagatgctgtccaccgagagccacaaccagaccttcctcatcgacgggcctgagaccgccgagtgcccgaacacgaaccgggcctggaactccctcgaggtggaggactacggcttcggggtgttcagcaccaacatctggctgaagctgcgcgagaaacaggacgttttctgtgattcaaaattgatgagcgccgctatcaaggacaaccgggcggtacacgccgatatgggctactggatcgagtctgccctgaacgacacctggaagatggagaaggccagcttcatcgagatcaagtcctgccactggcccaagagccacacactttggtctaacggagtgctcgagtctgagatgatcatccccaagaacttcgccgggcccgtttcacaacacaactaccggccgggctatcacacccagacggcggggccctggcacctgggcaagctggagatggacttcgacttctgcgaggggaccaccgtggtggtcacggaagactgcggcaaccggggccccagcctccgcacaaccacggccagcgggaagttaattacggaatggtgctgtcggtcctgcacgctaccacccctccgctaccggggcgaggacgggtgctggtatggcatggagatccgccccctgaaggagaaggaggagaacctggtgaacagcctggtgaccgccgggcatggacagatcgacaacttctccctgggcgtcctggggatggccctcttcctggaagagatgctgcggacacgcgtgggcaccaagcatgcgatcctcctggtggccgtcagctttgtcacgctgataaccggcaatatgtccttccgggacctcggcagagtgatggtcatggtgggcgccaccatgaccgatgacatcggcatgggcgtgacgtacctggccttgctcgctgcgttcaaggtccgccccacctttgccgccgggctgctactccgcaagctgaccagcaaggagctgatgatggccaccatcggcatcgccctcctgtcccaaagcacgatccccgagacgatcctggagctcaccgacgcactggccctgggcatgatggtgctcaagatcgttcgcaacatggagaagtatcagctggccgtcaccatcatggccatctcctgcgtgccgaacgccgtgatcctgcagaacgcttggaaggtcagctgcacgatcctcgccgccgtgtccgtgagccctctgctgcttacctccagccagcagaaggccgactggatccccctggctctgaccatcaagggcctcaaccccacagccatcttcctaacgaccctgtcccgaaccagcaaaaagcgcagctggccgctcaacgaggccgtcatggccgtgggcatggtcagcatcctggctagtagccttctcaagaacgacatccccatgaccgggccgttagtagcaggcgggctgttgacggtttgctacgtcctgaccggccggtcggccgacctcgagctcgagaaggccgccgacgtgaagtgggaggaccaggcggagattagcggcagctcccccatcctaagcatcaccataagtgaggacggcagcatgtccatcaagaacgaggaagaagaacacaccctgacgatcctcatacgcaccggcctgctggtgatcagcggggtcttcccggtgtccatcccgatcaccgcagccgcctggtacctgtgggaggtgaagaagcaacgggctggcgtgctgtgggacgtgcccagcccgccgcccgtggggaaggcagagctggaagacggcgcgtaccgcatcaagcagcgggggattttcggatactctcagatcggcgccggggtctacaaggagggcaccttccacactatgtggcacgtgacgcgcggggccgtgctcatgcaccgggggaagcgcatcgagccgagctgggccgacgtcaagaaggacctcatcagttatggcggcggctggaagctggaaggggagtggaaggaaggcgaggaggtccaggtgctcgctctggaacccgggaagaatccccgggcggtccagaccaaacccgggctattcaagactaacaccgggacgattggcgccgtgtcgctcgacttctcccccggaacgagcgggagccccatcgtggatcgcaagggcaaggtcgtggggctgtacggcaacggagtggtcacccgaagcggggcctacgtctccgcaatcgcgcagaccgagaagtccattgaggacaaccccgagatcgaagacgacatcttccgcaagaagcggctgacgatcatggacctccatcccggcgccgggaaaaccaagcgatacctgcccgccatcgtgcgggaggccatcaagaggggcctgcggacgctgatcctcgccccgacccgagtcgtggcggccgagatggaggaggcactgcgcggactccccattcgttaccagactcccgcgatccgcgccgagcacaccggacgggagatcgtggacctcatgtgccacgcgacgttcacgatgcgcctgctgagccccgtccgggtaccgaattacaacttaatcatcatggatgaggcccacttcacggaccccgcctccatcgccgccaggggctacatcagcacccgggtggagatgggtgaggcggccggcatcttcatgacggccactccacccgggtcccgcgacccgttcccccaaagcaacgcccccatcatggacgaggagcgggagatcccggagcgctcctggaactcaggccacgagtgggtaacggacttcaaggggaagaccgtttggtttgtgccttccattaaggcgggcaatgacattgccgcttgcctgcggaagaacggtaagaaggtcatccaactgagcaggaagacattcgattcggaatacgtgaagacccgggccaacgactgggatttcgtggtcacgaccgacatcagcgaaatgggcgccaacttccgcgcggagcgggtgatcgacccccgaaggtgcatgaagcccgtgatcctcaccgatggcgaggagcgcgtcatcctggccgggcccatgccggtgacccactccagcgccgcccagcgtcgcggccgcatcgggcggaaccccaaaaacgagaacgaccagtacatctatatgggcgagcccctggagaacgacgaggactgcgcccactggaaagaagcgaagatgctcctggataacatcaacacgcccgagggcatcatcccgtcaatgttcgagcccgagcgcgagaaggtggacgccatcgacggggagtaccggctgcgcggcgaggcccgaaagaccttcgtcgaccttatgagacgaggcgacctgcccgtgtggctagcctaccgcgtggccgcggagggcatcaactacgccgaccgtcgctggtgcttcgacgggatcaagaacaaccagatccttgaggagaacgtcgaggtggagatctggaccaaggaaggcgagcggaagaaacttaaaccgcgctggctggatgcacggatctacagcgaccccctcgccctgaaggagttcaaggagttcgcggccggcaggaagtctctgaccctcaacctgatcacggaaatggggcggctgccaaccttcatgacccaaaaggcgcgcgacgccctcgacaacctggccgttctccatacggcggaggtcggcgggcgggcatacaaccacgccctcagcgagctgcccgaaacgctggagaccctcctgttactgactctgctggccaccgtgacaggcggcatcttcctctttctgatgtcagggaagggcatcggaaagatgaccctgggcatgtgctgcatcataaccgccagcattctcttgtggtacgcgcagatccaaccgcactggatcgccgccagcatcatcttagagttcttcctaatcgtcctgctgatccccgaacccgaaaagcagcgcacgccccaggacaaccagttgacgtacgtagtgatcgccatcctcacggtcgtggccgccaccatggccaacgagatgggcttcctggagaagaccaagaaagatctcggcctgggcagtatcaccactcaggagagcgagagcaacatattggacatcgatctccggcctgccagcgcctggaccttatacgccgtggcgaccaccttcgtcacacccatgctgcgccactccatcgagaacagctccgtgaacgtgagcctgaccgccatcgccaaccaggcaaccgtcctgatgggtcttggccgcgggtggcccctctccaagatggacattggcgtgcccctgctggcgattgggtgttattcacaggtgaacccgatcaccctcacggccgccctactgctccttgtcgcacactatgccatcatcggccccggcctgcaggcgaaggccacccgcgaggcccagaagcgcaccgccgccgggatcatgaagaacccaaccgtggacggcatcacggtgatcgacctagagcccatcccgtatgatcctaagtttgagaagcagttagggcaggtcatgctgctcgtgttatgcgtgacccaggtgctgatgatgcggaccacctgggcgctctgcgaggccctgacgctggccaccggccccatttctaccctctgggagggaaatcccggccgcttctggaacacaacgatcgccgtgagcatggccaacatctttcggggctcctacctggcgggggccggccttctcttcagcatcatgaagaacaccacgaacacacgccgggggacgggaaacatcggggagaccctgggggagaagtggaaatcccgcctgaacgccctcggaaagagcgagttccagatctacaagaaatccggaatacaggaggtggaccggaccctggccaaagagggcatcaagcgcggggagacagatcaccacgcggtcagccggggctccgccaagctgcgctggttcgttgagcggaacatggtgacgccggagggcaaggtcgtagacctcgggtgcgggcgcgggggctggagctactactgcgggggtctgaagaacgtgcgggaagttaagggcctcaccaagggcgggcccgggcacgaggagcccatcccaatgtctacctacggctggaacctcgttcgcctgcagagcggagtggacgtcttcttcaccccgcccgagaagtgcgacacgctgctctgcgacatcggcgaaagttcccccaaccccaccatcgaggccggccggaccctgcgcgtgctgaacctcgtggagaactggctgaacaacaacacccagttctgcgtcaaggtgcttaacccgtacatgccgagcgtgatagagaagatggaaaccctccagcggaagtacgggggcgccctagtccgcaacccactgtcccggaacagcacgcacgagatgtactgggtgtcaaacgccaccgggaatatcgtgagctccgtaaacatgatctctaggatgttaataaaccgcttcaccatgaagcacaagaaggcgacctacgagccggacgtggacctcggctccgggacgcggaacatcggcatcgaaaacgagatccccaacctggacattatcggcaagcgcatcgagaagatcaagcaggagcacgagaccagctggcactatgaccaagaccacccctacaagacctgggcctatcacgggtcctacgagaccaagcagacaggaagcgcctccagcatggtgaacggggtcgtgaagctgctcacaaagccatgggacgtggtcccgatggtgacccaaatggccatgaccgacactaccccctttggccagcagcgggtgttcaaggagaaggtcgacacccgcacccaggagcccaaggagggcacgaagaagctgatgcggatcaccgcggagtggctgtggaaggagttggggaagaagaagacgccacgcatgtgcacccgggaggagtttacgcgcaaggtgcgttccaacgcggcgctgggcgccatcttcaccgacgagaacaagtggaagtcagctcgcgaggccgtggaggacagccggttctgggaactggtcgaccgcgagcgtaatctccacctggaggggaagtgcgagacctgcgtgtacaacatgatggggaagcgcgagaagaagctgggggagtttggcaaggcgaagggcagccgggccatctggtacatgtggttgggtgcacgcttcctggagttcgaggccctgggtttcctcaacgaagaccactggttttcccgggggaacagtctgagcggcgtcgaaggggagggtctacataagctcggctacatccttcgcgacgtcagtaagaaggaaggcggggcgatgtacgccgatgataccgctgggtgggacacacggataaccctcgaagacctcaagaacgaggagatggtcaccaaccacatgaagggcgagcacaagaagctggccgaggccatattcaagctgacctaccagaacaaggtcgttcgcgtgcagcggccgacgccgcgcgggaccgtcatggacattataagccgcaaggaccagagaggatccggccaggtgggtacctacggcctcaacaccttcacgaatatggaggcgcagctgatccgccagatggagggggagggcatcttcaaatcgattcagcggctgaccgtgaccgaggagatcgcagtccagaactggctcgcccgcgtggggcgggagcgcctgtcccggatggccattagcggtgacgactgtgtggtcaagcccctggacgaccgtttcgcctctgcgctcaccgcgctgaacgatatgggcaaggtgcggaaggacatccagcagtgggagcccagcaggggatggaacgactggacacaggtgccgttctgtagccatcacttccacgagctggttatgaaggacggccggatgctcgtggtgccctgccgcaaccaggacgagctcatcgggcgggcccgcatcagccagggggccggctggtccctgaaggaaaccgcctgcctcggaaagagttacgcgcagatgtggaccctgatgtatttccaccggcgcgatctgcggctcgccgcgaacgccatttgctccgccgtccctagccactgggtgcctacctctcgcaccacgtggagcatccacgcgaagcacgagtggatgaccaccgaggacatgctggccgtgtggaaccgggtctggatccaggagaacccgtggatggaggacaaaacccccgtggagtcctgggaggaggtgccctaccttggcaagcgcgaggaccagtggtgtgggtcgctcattggcctcaccagccgcgccacctgggccaagaacatccaaaccgcgatcaaccaagtccggagcctgatcgggaacgaggagtataccgactatatgccgagcatgaagcgcttcagaaaggaagaggaggaggccggcgtgctgtggtag

SEQ ID NO: 25128 - RNA, 9876 nt, synthetic construct
  misc_feature 1..9876: note = derived and/or modified CDS sequence (opt11) from DENV-2__KF955360__SS-prME
  source 1..9876: mol_type = other RNA
acagccggcgtgatcatcatgcttatcccgacagccatggcgttccatttgactacccgcaacggggaaccccacatgatcgtcggccggcaggagaaggggaagtccctgcttttcaagaccgaggacggcgtgaacatgtgcaccctcatggccatcgacctgggggaactgtgcgaggacaccattacgtacaagtgccccctacttcggcaaaatgagcccgaggatattgactgctggtgcaactccaccagcacctgggtgacatacggaacctgtgccaccaccggcgagcacagaagggagaagagatccgtagcattggtgccccacgtgggcatgggactcgagacccggaccgagacgtggatgagcagcgagggggcctggaagcacgttcagcggattgaaacctggatactgcgccacccgggatttaccatcatggcggccatcctggcctacaccatcgggaccacccatttccagcgggcactaattttcatcctgctgacagcggtggcccccagcatgaccatgcgctgcattggcatctccaaccgggactttgtggagggtgtctctgggggcagttgggtggacatagttctcgagcacgggtcatgcgtcaccaccatggccaaaaataagcccacgttggacttcgagctgatcaaaaccgaagcaaagcagcctgccactctccggaagtactgcatcgaggcgaagctgaccaatacgaccaccgagtcccggtgcccgacccagggcgagccatcgctgaacgaggagcaggacaaacgcttcatttgcaagcattccatggtcgaccgggggtggggcaatggctgcgggctgttcggaaagggtgggatcgtaacttgtgctatgttcacatgcaaaaagaatatggagggaaaggtcgtgctgcccgagaacctggagtacaccatcgtgatcacgccccacagtggggaggagcacgccgtgggcaacgacacgggtaagcacggcaaggagataaagatcacgccgcagtccagcatcaccgaggccgagttaaccggatacgggaccgtgacgatggaatgcagcccccgtacgggcctggacttcaacgagatggtcttgctccaaatggaggacaaggcctggttggttcatcggcagtggtttctggacctccccctgccctggttgcccggtgcggacacacagggcagcaactggatccagaaggagactctcgtgacattcaagaacccccatgccaagaaacaggacgttgtcgtcctggggtcccaggagggggccatgcacaccgctctgaccggagccaccgagatccagatgtcaagtggcaatctcctgttcacgggccacctgaaatgtcgcctccggatggataaattgcagttaaaggggatgtcctacagcatgtgtaccggtaagttcaagatcgttaaggagatagcggagacccaacatgggaccatcgtcatacgggtgcaatacgagggcgacggctccccctgtaagatccccttcgagattatggacttggaaaagcgtcacgtattaggacgcctgatcacggtgaacccgatcgttaccgagaaggactctccagtgaacatcgaggcggagccacccttcggcgactcctacataatcatcggggtagagccgggacagttaaagcttaactggttcaagaaagggtcatccatcggccagatgttcgagaccacgatgcgcggcgccaagcggatggccatcttaggggacacggcctgggacttcgggagcctcggtggcgtgttcacgtccatcgggaaggcgctccatcaagtctttggcgccatttacggcgcggcgttcagcggggtttcctggacgatgaaaattctgatcggcgttatcatcacctggatcgggatgaacagccgcagtactagcttgtctgtcagcctcgtgctggtgggcgtcgtgaccctgtacctgggtgtgatggttcaagcggactccggatgtgtggtgtcttggaaaaataaggagctgaagtgtggctccggcatattcatcaccgacaacgtgcacacctggactgagcagtacaagttccagccagaaagcccgagcaaacttgcctccgccatccagaaagcacacgaagagggcatctgcggaatccggtctgtgacccgcttagagaatctcatgtggaaacagatcacccctgagctgaatcatatcctctctgagaacgaggtgaagctaacgataatgacgggggacatcaaggggatcatgcaggctggcaagcggtcgctgcgcccgcagcccacggagttaaagtactcgtggaagacctggggcaaggctaaaatgctgagcaccgagtcccataaccaaacattcctgatcgacgggcccgagaccgcagagtgcccgaacaccaatcgggcctggaacagccttgaagtcgaggattacggcttcggtgtattcagtaccaacatatggctcaagcttcgcgagaagcaagacgttttctgcgacagtaagctcatgagtgccgccattaaggacaaccgtgctgtccacgccgacatgggttactggatagaaagcgctcttaatgacacgtggaagatggagaaggcatccttcatcgagatcaagagttgtcactggcccaagagccacacgctgtggtctaatggtgtcctcgaatccgagatgattatccccaaaaacttcgcaggccccgtatcacagcacaactaccggcccggttaccacacccagaccgcggggccctggcacctgggcaagctggaaatggacttcgacttctgtgagggcaccactgtcgttgtgaccgaggactgcggcaaccgagggccgagcctccgcaccactactgcttccgggaaactcatcactgaatggtgctgccggagctgcaccctgcccccgctccggtacaggggcgaggacgggtgttggtacggcatggagataagacccctgaaggagaaggaggagaacttggtcaactccctcgttaccgccgggcacgggcagatcgacaacttcagcttgggcgtgctggggatggccctctttctggaagaaatgctgcggactcgcgtcggcaccaaacacgccatcctgctggtggccgtgtcttttgtcacgctgatcaccgggaacatgtctttccgggatctcggccgcgtgatggtaatggtaggtgccacgatgactgacgacatcgggatgggcgtgacatacctggccttgctggcggcgttcaaggtgagacccaccttcgctgccgggctgctgctcaggaagttaacgtccaaggagctgatgatggccacaatcggcatcgccctcctgagccagtccaccatacccgaaaccatcctggaactcacagatgcgctggcccttggtatgatggtcctaaagatcgttagaaatatggagaaataccagctggctgtaaccatcatggcgataagctgcgtcccaaacgccgtgatcttacagaatgcgtggaaggtgtcctgcacgatcctcgccgccgtctcagtgtctccccttcttctcaccagctcgcagcagaaggcggactggatccctcttgcgctgactatcaaaggcctcaaccccaccgctatcttcctgaccaccctaagcagaacgtctaagaagcgcagctggccactcaatgaagccgtaatggccgttggaatggtatccattctggcgtcaagccttctcaagaacgacatacccatgacagggcccctggtcgcgggagggctgcttaccgtgtgctacgtgctcaccggtcggtccgccgacctggaactagaaagggccgctgacgtcaagtgggaggaccaggccgagatctcaggttcctcgcctattctgtccataacgataagcgaggacggctccatgagcatcaagaacgaggaggaggagcacaccctaactatcctcatccggaccggcctgctggtaatttctggggttttcccggtcagcattcccattactgcggccgcctggtacctttgggaggtgaaaaagcagcgcgctggcgttctgtgggatgtccccagccctccgcccgttggtaaggctgagttggaggacggggcatacaggattaagcagcgcggcatcttcgggtacagccaaatcggcgccggggtgtacaaggagggcactttccacaccatgtggcatgtgacgcgcggggccgtgcttatgcatcgcggcaagagaatcgagccctcctgggccgacgtgaagaaggatctgatcagctacggtgggggatggaagctagagggggaatggaaagagggcgaggaggtccaggttctcgctctggagccagggaagaaccctcgcgctgtgcagaccaagcccggtttattcaagacgaacacggggacgatcggcgctgttagtctcgacttctctcccgggacgagcgggagccccatcgtggaccgtaagggcaaagtggtcgggctgtacggcaacggagtggtgacgcgctccggcgcctatgtcagcgccatcgctcaaaccgagaagtcaatcgaagataaccccgagatcgaggatgacatatttcggaagaagaggctgaccattatggacctccatccaggcgccggcaagacaaagcggtacctgcctgcaattgtccgcgaggccatcaagcgtggcctacgcacactcattttggcccccacacgcgtggtagcggccgagatggaggaggcactgcggggtcttcccataaggtaccagaccccggccatcagagcggagcacaccggcagggagatcgttgacctgatgtgccacgcaacctttaccatgcggctgctgagtccagtacgcgttccgaactacaacctcattataatggacgaggcgcatttcacggaccccgcctcgatcgctgcccgcgggtacatctccacacgcgtggagatgggcgaggcagccggcattttcatgacggccacgccgcccgggtccagggatccctttccccagtccaacgcccccatcatggacgaggagcgcgagatccccgagcgttcctggaattccggccacgagtgggtgaccgacttcaaggggaagacggtctggttcgtgcccagcatcaaggctggcaacgacatagccgcttgtctgcgcaagaacggcaagaaggtgatccagctgtccaggaagacgttcgactctgagtacgtaaagacccgcgccaatgactgggacttcgtggtgaccaccgacatcagtgagatgggtgccaacttccgggcggagcgtgtcatcgacccccggcgctgcatgaagcccgtcatcctgactgatggcgaagagcgcgtaatcctagccgggcctatgcccgtcacccacagttcggcggcccaacgccgcggccggatcggccgcaaccccaaaaacgaaaatgaccagtacatttacatgggcgagcccctggaaaacgatgaggattgtgcccactggaaagaggcaaagatgctcctggataacattaacacccccgaaggcatcatcccgtccatgttcgagcccgagagggagaaagtagacgccattgacggcgagtaccgcctacgtggagaggcccgaaagaccttcgtcgacctaatgcggcgcggggacctccctgtttggctggcctatcgggtggctgcggaaggtatcaattatgccgaccgacggtggtgctttgacgggatcaagaacaaccaaatcctcgaggagaacgtggaagttgaaatttggacgaaggagggggagcgcaagaagctgaagccgcggtggctggacgcccgcatctactccgaccctctagccctgaaagaattcaaggaattcgcggccggaaggaagtccctgacgctcaacttaataaccgagatgggcagactgcccactttcatgacgcagaaggcccgagacgccctggacaacctggcggtgttgcacaccgcggaagttggcgggcgagcatacaaccatgccctctccgagctgcccgagacgctggagaccctgctgctgctcactctgttagccacggtgacgggcggcatctttctattccttatgtcggggaagggcatcgggaagatgaccttaggcatgtgttgtataatcacagcttcaatacttctgtggtacgcgcaaatccagccgcactggatcgccgctagtatcatcctggaattcttcctcatcgtgctcctgatacccgagccggagaagcagagaacgccgcaggacaaccagctgacgtacgtcgtgatcgccattttaactgtggtcgcggcgaccatggccaacgagatgggattcctggagaagacaaagaaagatctcgggctgggcagcatcacgacccaagagtccgagtcgaacatcctggacatcgacctccgccctgcgtcggcctggaccctgtacgctgtggcgacgaccttcgtgacccccatgctgcggcacagtatagaaaactcctcggtgaacgtctccctcaccgctatcgccaaccaggcgacggtgttaatggggttgggtcgcgggtggcccctcagcaagatggatatcggagtccccctgctggcgatcggttgctactcccaggttaacccgatcaccttgaccgccgccctgctgctcttggtggcccactacgccataatcggacccggactacaagcgaaggccacccgcgaggcacaaaagcggacggccgctgggatcatgaagaaccccaccgttgacggcatcacggtaatcgacctcgagcccatcccgtacgatcccaagtttgagaagcagctaggccaagtgatgcttttagtcctgtgcgtgacccaggtgctgatgatgcgcacgacctgggcgctttgcgaggccctgaccctggccaccggccccatctccacgctctgggaggggaatcccgggcggttctggaacaccaccattgcagtctccatggcgaacatattccgcggctcatatctggcgggtgctggcctcctcttttcaattatgaagaataccactaacacccgtcgcgggaccggtaacatcggcgagactctgggcgagaagtggaaatcccgtctgaacgccctggggaagtccgagtttcagatatacaagaagagtgggattcaagaggtggaccgcacgctggccaaggaggggataaaacgcggggagaccgatcaccatgcggtgtcccgcggcagcgcaaagttgcggtggttcgtcgagcgcaacatggtgactcccgaaggcaaggtggtggacctggggtgcggccgcggcgggtggtcatattactgcggcgggctgaagaacgtgcgagaggttaagggtctgaccaaaggcgggcccgggcacgaagagccgatccccatgtccacttacggctggaacctcgtacggctgcaaagcggggtggacgtgttcttcactccgcccgaaaaatgtgatactctgctctgtgacatcggggagtcctcccccaaccccaccatcgaggccggaagaacactgcgggtcctgaacttggttgagaactggctgaacaataacacccagttttgcatcaaggtgctaaacccgtacatgccctccgtcatagagaagatggaaaccctccagcgaaaatatgggggcgccctcgtgaggaaccccctgagccgcaactccacccacgagatgtactgggtcagcaacgccactgggaacatagtctcatccgtgaacatgatatcccgcatgctgatcaatcggttcacgatgaagcataagaaggcgacgtacgagccggatgtggacctcggcagcgggacgcgcaatatagggatcgagaacgagatccccaacctggacatcattggaaagcggatcgagaaaataaagcaggagcatgaaacctcctggcactacgatcaggaccacccctacaagacgtgggcctaccacggcagctacgagaccaagcagaccggctcagctagcagtatggtcaacggagtggtgaagcttctcaccaaaccctgggatgtggtgcctatggtgacgcagatggccatgaccgacaccacccccttcggccagcagcgtgtcttcaaggagaaggtcgacacgcggacccaggaacccaaggagggaaccaaaaaattgatgagaataaccgccgagtggctgtggaaggagctcgggaagaagaagacaccccggatgtgcacgcgcgaggagttcacccggaaggtccgcagcaacgcggccttgggcgccatctttaccgacgagaacaagtggaagagtgctcgggaggctgtcgaggacagccgcttctgggagctggtcgaccgggaacgaaacctccatctggagggaaaatgtgagacgtgcgtttacaacatgatgggcaagagggagaagaaactgggtgagttcggcaaggcaaaaggttccagagccatatggtacatgtggctcggggctagattcttggagttcgaagccctaggattcttaaacgaagaccactggttctcgcgcggcaacagcctgtccggcgtggagggtgagggactgcacaagctcggctacatcctgcgggacgtgagcaagaaggagggcggggcgatgtacgccgacgacacggccgggtgggacacgcgcattaccttggaagacctcaagaacgaggagatggtcacgaaccacatgaagggcgagcacaagaagttagccgaggccatcttcaaactgacctaccagaacaaggtggtgcgcgtccagcgcccgacaccccggggtacagtgatggatatcatcagcagaaaggaccagcgcggcagcggccaggtgggcacttacggcctgaatacttttaccaacatggaggcgcaactgatacggcagatggagggggagggaatctttaagagcatccagcgactgaccgtgacggaggaaatagccgtgcaaaactggcttgcccgggtcggccgtgagcgtctaagcagaatggccatctccggggacgactgcgtggtgaagcctttggacgatcggttcgccagcgcgctcacagccctgaacgatatggggaaagtccggaaagacatccagcaatgggagccatcccggggctggaacgactggacacaagtcccgttttgcagccatcatttccacgagctagtcatgaaggacggccgtgtgttggtagtaccgtgccggaatcaggatgagttaatcgggcgcgcacgcatctcccagggtgccggctggagcttgaaggagacggcctgcctcggaaagtcctacgcgcagatgtggacgctgatgtacttccaccgccgcgatctgagactcgccgcaaacgcgatctgcagcgcggtgccctctcactgggtccccaccagccgtaccacctggtccattcatgcgaagcacgagtggatgacaaccgaggacatgctggccgtgtggaacagagtgtggatccaggagaacccgtggatggaggacaagacccccgtagagagctgggaggaggtgccctatctgggcaagcgagaggaccagtggtgtgggagcctcatcggcctgacgtccagagctacatgggctaagaatatccagacggcgatcaaccaagtgcgcagtctaatagggaacgaggagtacaccgattacatgccctccatgaagcggtttcgtaaggaggaggaagaagcaggcgtcctctggtga

SEQ ID NO: 25129 - RNA, 9876 nt, synthetic construct
  misc_feature 1..9876: note = derived and/or modified CDS sequence (opt11) from DENV-2__KF955363__SS-prME
  source 1..9876: mol_type = other RNA
accgctggcgtgatcatcatgctgatccccaccgccatggctttccacctaaccacccgcaacggggaaccccacatgatcgtgggcagacaggagaaggggaagtcactacttttcaagaccgaggatggcgtaaacatgtgcaccctcatggccatcgacctgggggagctgtgcgaggacaccattacctacaagtgcccactcctgcgacagaacgagcccgaggacatcgattgctggtgcaacagcacctctacatgggtgacctacgggacctgcaccactacgggcgagcaccggcgcgagaagcggagtgtcgctttggtgccgcacgtcggaatgggtctcgaaacccgtaccgagacatggatgtcttccgagggagcctggaagcatgtccagcggatcgagacatggatcctgcggcacccgggcttcaccatcatggccgccattctggcctacaccatcgggaccacgcacttccagcgggctctcatcttcatcctgctgaccgccgttgcgccgagcatgaccatgcgctgcatcggcatctccaaccgggacttcgtggagggcgttagcggtggctcctgggtggacatcgtgctcgaacacgggagttgcgtcaccacaatggccaagaataagccgaccctggacttcgagctgataaagaccgaggccaaacagcccgcgaccctccgcaaatactgtatcgaagccaagctgacgaataccaccacagagtcccggtgcccgacgcagggcgaacccagcctgaacgaggagcaggataagcgtttcctctgcaagcactccatggtggaccgcggctggggtaacggttgcgggctgttcggcaagggcgggattgtaacctgcgcgatgttcacgtgcaagaagaacatggaggggaaggtcgttcagcccgagaacttagagtacaccatcgtgatcacgccccacagcggggaggaacacgccgtcgggaacgacaccgggaagcacggtaaggagatcaagattaccccgcagtccagcatcaccgaggccgagctcactgggtacggcacggttaccatggagtgcagcccacggaccggcctggacttcaacgagatggtgctgctccagatggaggataaggcctggctcgtccatcggcaatggttcctggatctccccctgccgtggctgccgggggccgacacccaaggctcgaactggatacagaaggagacgctcgtgaccttcaagaacccccacgcgaagaagcaggacgtggtcgtgctaggatcccaggagggtgccatgcacaccgcccttacgggggctacggaaatccaaatgtcttccggcaatctcctgtttaccggacacctcaagtgccgcttgcggatggacaagctgcagctgaaaggtatgtcctactccatgtgcaccggcaagttcaaaatcgtcaaagagattgccgagacccagcacgggacgatcgtgatccgcgtacagtacgagggcgacggctccccttgcaaaatccccttcgaaattatggacctagaaaagcggcacgtcctggggcgccttatcacagtgaacccgatagtgaccgaaaaggatagccccgttaacatcgaagcagagccgcccttcggcgactcctatatcatcatcggggtggaaccgggccagctcaaactgaactggttcaagaagggaagctccatcggacagatgttcgagaccactatgcgcggcgccaagcggatggccattttaggcgacaccgcctgggacttcggcagcctcgggggcgtgtttaccagcattgggaaggccttacatcaggttttcggcgcgatctacggcgccgccttcagcggggtgtcctggacaatgaagatcctgatcggcgtgatcataacgtggatcgggatgaacagcagatccaccagcctgtccgttagcctcgtgctggtgggtgtcgttaccctgtacttaggggccatggtgcaggcagactctggctgcgtcgtgtcatggaagaacaaggagttgaagtgcggctccggtatcttcataaccgacaacgtgcacacgtggaccgagcagtacaagttccaacccgagagccccagcaagctggcgtccgccatccagaaggcccacgaggagggcatttgcgggatacggtctgtcacccgccttgagaacttaatgtggaagcaggttaccccggagcttaatcatatcttaagcgagaacgaggtgaagctgacgataatgaccggggacatcaagggtattatgcaggccggaaaacggagcctgcgcccgcagccaacagagctaaagtactcctggaagacatggggcaaggcgaagatgctgagcacggagtcccacaatcaaactttcctgattgacgggcccgagaccgccgagtgcccaaacaccaaccgggcctggaacagcttggaggtagaggactacggcttcggggtcttcacgacaaatatttggttaaagctgcgcgagaagcaggacgtgttctgcgacagtaagctcatgagcgctgccataaaggacaaccgggcggtccacgccgacatgggttactggatcgagtccgccctgaacgatacttggaagatggaaaaggccagcttcattgaggtgaagtcctgccactggcccaagtctcacaccctgtggagcaacggcgttctggagtccgagatgatcatccccaaaaacttcgccgggccagtctcccagcacaactaccgccctggttaccacacgcagacggccgggccctggcacttgggcaagttagagatggacttcgatttttgcgaagggaccaccgtcgtggtcaccgaggactgcggcaaccggggccccagcctccgcacgaccaccgccagcgggaagctgatcacagagtggtgctgccggtcctgtacgctgcctccgctcaggtaccggggcgaagatgggtgctggtacggcatggagatcaggcccctaaaggagaaggaggagaacctggtgaacagcctcgtgaccgccgggcacggacagatcgacaacttctccctgggcgtgctgggcatggccctatttctggaagagatgctgcggacccgcgtgggcaccaaacacgcgattctccttgtggccgtctcattcgtaacgctgatcaccgggaacatgtccttccgggacttaggccgcgtgatggtcatggtgggcgctaccatgaccgacgatatcgggatgggcgtcacgtatttagccctcctcgccgcgttcaaggtccgccccaccttcgctgctgggctgctgctgcgtaagctgactagcaaggaactgatgatggccaccataggcatcgccctattgtcccaaagcacgatccccgagactatcctggaactcaccgacgcgctggctctggggatgatggtgctcaagatagtgaggaacatggagaagtaccagctggctgtcaccatcatggccatcagttgcgtgccgaacgcggtgatcttacagaacgcttggaaggtcagctgcaccatcctcgccgccgtctccgtcagccctctgctgctcacctccagccagcagaaggccgactggatcccattagcgctcaccataaagggcctcaaccccacggccattttcctgacaaccctgtcccggaccagcaagaagcggtcctggccgttaaacgaagcaatcatggcagtgggaatggtttccatcctggcttccagccttctcaagaacgacatcccgatgaccgggcccctagtcgcgggcggtctgttaacggtctgctacgtgctgaccggccggagcgccgacctggagctcgaacgcgccgccgacgtcaagtgggaggaccaggcggagatatccggaagctcccccatcctgagcatcaccatctccgaagacggcagcatgtctataaaaaacgaggaagaggagcagaccctgaccatcctcatacggaccggcctattagtgatatcgggggtgttcccggtttccatccccataaccgcggctgcctggtacctctgggaggtgaagaagcagcgagccggggtactgtgggacgttcccagcccgccgcccgtggggaaagcagagctggaggacggtgcgtaccggatcaagcagagggggatcttgggctactcccagatcggcgcaggcgtatataaggagggcacttttcacactatgtggcacgtcacgaggggggccgtcctgatgcaccgcggcaagcggatagagcccagctgggccgacgtgaagaaggacctgatcagttatgggggcgggtggaaactcgagggggagtggaaggaaggcgaggaggtccaagtgctggccctggagcccgggaagaatcctcgcgcggtccagaccaagcccggcctctttaagaccaataccggtacgatcggcgccgtctcattagacttctcccccggcaccagcgggtcccccatcgtggaccggaagggcaaggtggtcgggctttatggcaacggcgtagtgacccgcagcggggcctacgtctccgccatcgcacaaaccgagaagtccattgaggataaccctgagatcgaggacgacattttccggaaaaagcgcctcaccatcatggacctgcaccccggcgctgggaagacaaagcggtacctgcccgcaatcgtgcgcgaggccatcaagcggggcctgcgcacgctcatcttggccccaacacgtgtggtcgcggcagagatggaggaggcgttacggggtctccccatccgctaccagacacccgccatccgagcggagcacaccggccgcgagatcgtggacctgatgtgccatgcgacgttcaccatgcggctactctcccccgtgcgcgttccgaactataacctgattatcatggacgaggcgcacttcacggaccccgcttccatcgccgcacggggctacattagtactcgcgttgagatgggggaggcggcaggcatcttcatgaccgccacgcccccaggctcccgggatccgtttccccagagcaacgccccgatcatggatgaagagagggagattcccgagcggtcctggaactcaggccacgaatgggtgacggatttcaaggggaagaccgtctggttcgtcccgtccatcaaggcgggcaacgacatcgcagcctgcctccgcaaaaacggcaagaaggtcattcagttaagccggaagaccttcgactccgagtacgtcaagacacgcgcgaacgactgggacttcgtggttacgaccgacatttcagaaatgggcgccaattttaaggcggagcgggtcatcgaccccagacgatgcatgaagcccgtgatcctgaccgacggcgaggagcgcgtgatcctggccgggcccatgccggtcactcactcgagcgccgcgcagcggcgcggccgcattgggcggaaccccaagaacgagaacgaccagtacatttacatgggggagcccctcgagaacgacgaggactgcgcccactggaaggaggcgaagatgctgctggacaacatcaacacccccgagggcatcattccgtccatgttcgagcccgagagggagaaggtggacgccatcgacggagagtaccggctccgaggcgaggcccggaagaccttcgtcgacctgatgcgccgcggggacctgcccgtctggctcgcctatcgagtggccgcggagggcatcaattacgccgaccggcgctggtgcttcgatggcatcaagaacaaccagattttggaggagaacgtggaggtcgaaatctggaccaaggagggcgaacggaaaaagctgaagcctcgctggctagacgcccggatctactcggaccccctggctctgaaggagtttaaggagttcgcagccggccgcaagtccctcaccctaaacctgataacggagatgggtcggctccctaccttcatgacacagaaagcacgcgacgccctggacaacctggccgttctccacaccgccgaggccggcgggaaggcctacaaccacgccctgagcgaactgcccgagacgctagagaccctgctgctcctgacgctgctcgccacggtcacgggcggaatatttctgttcctgatgagcggtaagggaatcgggaagatgaccctgggcatgtgctgcatcatcacagcaagcatcctgctgtggtatgcccagatccaaccgcattggatagccgccagtatcattctcgagttcttcctgatcgtgcttctcatccccgagccagagaagcagcggacgcctcaggacaaccagctgacctacgttgtcattgccattctgacggtggtcgcggccaccatggccaacgagatggggttcctcgaaaagaccaagaaggacctaggactgggcagcatcaccactcaagagagcgagtccaacatcctcgacatcgacctgcgcccggccagcgcctggaccctgtacgcggtcgccaccaccttcgtgacgcccatgcttcggcactccatcgagaattcatccgttaatgtcagtcttaccgccattgccaaccaggcgactgtgctaatggggctcggcaaggggtggccgctttccaagatggacatcggcgtgccgctgctcgccatcggatgctacagccaggtcaacccgattacgctcacggcagccctgctactgctggtggcacactacgcaatcatcggccccggcctccaggcaaaagcaactcgcgaggcccagaagcgagccgccgccgggatcatgaagaaccccaccgtggacggcatcacagtcatcgacctggagcccatcccgtacgaccccaagttcgagaagcagttgggccaggtgatgctcctgatcctgtgcgtgacgcaggtcctcatgatgcgcaccacctgggccctgtgcgaggctctgaccctcgcgacgggccccatctcaaccctctgggaggggaaccccgggcggttctggaacaccaccatcgcggtcagcatggccaacatcttccggggctcctatctggctggggccggcttactattcagcatcatgaaaaacacgacaaacactcgccggggcacgggcaacataggcgagacgctgggggagaagtggaagtcccgcctcaacgcgcttggcaagagcgagttccagatctacaagaagagtggtattcaggaggtggaccgtacactggccaaggagggcatcaagcgcggggagacagaccaccacgccgtcagccggggctctgccaagctacgctggttcgtggagcggaacatggtgaccccggagggaaaggttgtggacttggggtgcggccgagggggctggagctactactgcgggggcctgaagaacgtgcgggaggtcaagggcctcacgaagggcgggcccgggcacgaggagcctatacccatgtcaacctatggctggaacctagtgcggctacagagcggggtggacgtcttcttcaccccgcccgagaaatgcgacaccctcctttgcgacatcggcgagagcagccctaatcccacgatcgaagccggccggaccctgcgcgtgctcaatctggtggagaactggttgaacaacaacacccagttctgcataaaggtcctcaacccgtacatgcccagcgtgatcgagaagatggaaacgttacagcggaagtatgggggcgcgttagtgcgcaaccccctatccaggaacagcacacacgagatgtactgggtctccaatgccacggggaacatcgtgagctcagtgaacatgatcagccgcatgctcattaaccggttcaccatgaagcacaagaaggccacctatgagccggatgttgacctgggctccgggacgcgcaacatcggcatcgaatccgagatacccaatcttgacatcatcggcaagcgtatcgagaagatcaaacaagagcacgagacgtcatggcattacgaccaagaccacccctacaaaacctgggcctaccacgggagctacgagaccaagcagaccggctcagccagctccatggtgaatggggtggttcggctcctgacgaagccctgggacgtggtgcctatggtcactcagatggcgatgaccgacaccacgccatttggccagcagcgcgtcttcaaggagaaggtggacacacgaacccaagagccaaaggaggggacgaagaagctgatgaagatcacggctgagtggctctggaaggagctaggcaagaagaagacgccccgcatgtgcacccgggaagagttcacccgaaaggttcggtccaatgccgccctgggcgccatctttacggacgagaacaagtggaagtccgcgcgcgaggccgtcgaggacagccggttctgggagctcgtggaccgcgagcgcaacctgcacctggaggggaaatgcgagacgtgcgtctacaacatgatgggcaaacgtgagaagaagttgggggagttcggtaaggccaagggctcgcgggccatctggtacatgtggctgggcgcgcgtttcctggagttcgaagccctcggattcctcaatgaagaccactggttttctagggggaatagcctgtccggcgtggagggggagggcctccaccgcctggggtacattttgcgtgacgtctccaagaaggagggcggggcaatgtatgccgacgacaccgccgggtgggacacccgcataacgctcgaggacctgaagaacgaggagatggtgacgaaccacatgaagggcgagcacaagaagctggcagaggcgatcttcaagctcacttaccagaacaaggtggtccgggtgcagcgcccgacgccccgcgggacggtgatggacataatctcacgccgggaccagcgggggagcggccaggttggaacttatgggctgaacacctttaccaacatggaggcccagttaatccgccagatggaaggggagggaatcttcaaaagtatccaacacttgactgtgaccgaggagatcgccgttcagaattggctggccagagtaggccgcgaacggctgtcgcgcatggtgatctctggggacgactgcgtggtcaagcccctcgacgaccggttcgccagcgccctgaccgccctgaacgacatgggcaaggtgcgcaaagacatacagcaatgggagccctcccgggggtggaacgactggacccaagtaccgttctgtagccaccacttccacgaactcgtcatgaaggacggcagagtcctggtggtcccctgcaggaaccaggacgagcttatcgggcgcgcccggatctcccagggcgcaggctggagcctcaaggagaccgcgtgcctggggaagtcctacgcccaaatgtggaccctgatgtacttccaccggcgggatctccgcctcgccgcgaatgccatctgcagcgcggtgccgtcccactgggtgcccacatcccggacaacatggtccatccacgccaagcatgaatggatgacgacagaggatatgctggccgtttggaaccgcgtttggatccaggagaacccatggatggaggacaaaaccccggtggagtcatgggaggaggtcccctacctcggcaagagggaggaccaatggtgcgggagcctgattggcctgacatcccgcgccacgtgggcgaagaacatccagaccgccattaaccaagtcagatctctcatcggcaacgaggagtacaccgactatatgcccagtatgaagcggttccgccgggaggaagaggaagcgggcgtgctgtggtga

SEQ ID NO: 25130 - RNA, 9876 nt, synthetic construct
  misc_feature 1..9876: note = derived and/or modified CDS sequence (opt11) from DENV-2__EU726767__SS-prME
  source 1..9876: mol_type = other RNA
agcgcgggcatgatcatcatgcttatccccaccgtgatggccttccacctcaccacccgcaacggggaaccccacatgatcgtgtcccggcaggagaagggcaagtcgctgctgttcaagactgaggacggggttaacatgtgcaccctcatggcgatggacctaggcgagttatgcgaggacactatcacctacaagtgccccttgctccgccaaaacgagcccgaggacatcgactgctggtgcaattccactagcacctgggtaacctacgggacgtgcgccaccaccggcgagcaccggcgcgagaagcggtccgtggccctggttccccacgtaggcatggggctcgaaacccgcaccgagacctggatgagctccgagggcgcttggaagcacgcccagcggatcgaaacctggatcttacgccacccggggttcaccataatggcggcgatcctggcctacactatcgggaccacccatttccagcgggcgctcatcttcatactcttaaccgccgtcgcccccagcatgacgatgcgctgtatagggatatccaacagggactttgtggagggcgtttccggcggttcctgggtcgacatcgtgctcgagcacggcagctgtgtgaccaccatggccaagaacaagccaaccctggacttcgagctgatcaagacagaggccaagcagccggccaccctccgcaagtactgcatcgaggcgaagctcaccaacaccacgaccgagtcccggtgccccacccagggggagccgagcctaaaggaggaacaggacaagcgcttcgtttgcaagcactccatggtggaccggggctggggcaacggatgcggcctcttcgggaaagggggtatagtgacctgtgccatgttcacgtgcaagaagaacatggagggcaagatcgtccagcccgagaacctggagtacaccatcgtggtcacgccccactccggcgaggagcacgccgtcgggaatgacaccggaaagcacgggaaagaaatcaaggttacgccgcagtccagcatcaccgaggccgagctgaccggctacgggactgtaaccatggagtgcagccctagaacgggccttgacttcaacgagatggtcctgctgcagatggagaacaaggcatggctcgtacatcggcagtggttcttggatcttccactcccctggctgccgggcgcggacacacagggtagcaactggattcagaaggagaccttggtgaccttcaagaacccccatgccaagaagcaggatgtggtggtccttggcagccaggagggggccatgcatacggccctgactggcgccaccgaaattcagatgtcctccgggaacctcctctttaccggccacctgaagtgccgcctgcggatggacaaactccagttgaagggcatgagttactctatgtgcacagggaaattcaaggtggtgaaggaaatcgcagagactcagcacggcaccatcgtgatccgcgtgcaatacgagggcgacggctccccctgcaagatccccttcgaaatcatggatctggagaagcggtatgtgctcggccgcctgatcaccgtcaacccgatcgtgacggaaaaggatagccccgtgaacatcgaggcggagcctccattcggagactcctacatcatcataggtgtcgaaccggggcagttaaagctcaactggttcaaaaaggggtcgtccatcgggcaaatgttcgagaccaccatgcgcggtgccaagcgaatggccatcctgggagacactgcatgggacttcgggagcctgggcggtgtcttcacgtccattggcaaggcgctccaccaggtgttcggggccatctacggcgccgccttcagcggtgtatcctggaccatgaagatcctgatcggggtgatcatcacgtggatcgggatgaacagccgctccacctccctgtccgtcagcctggtcctcgtaggtatcgtgacactgtacctgggggtcatggtgcaggcggactccgggtgcgtggtctcttggaagaataaggagctcaagtgcgggtcgggcatcttcatcaccgacaacgtgcacacctggacggagcagtacaaattccagccagagtcccccagcaagttagcctccgccatacagaaggcacaggaggaggggatctgcggcatcagaagcgttacccgcctggagaacttgatgtggaagcagatcactccagagctgaaccacatcctggccgagaacgaagtcaagctcactatcatgacaggggacgtgaagggcatcatgcaggcgggcaaacggtcccttcgaccgcagcccacggagctgaagtacagctggaagacgtgggggaaagccaaaatgctctccaccgagagccacaaccagaccttcttgatcgacggccccgagacggccgagtgcccgaacaccaaccgggcctggaattccctggaggtggaagattacggtttcggcgtctttactaccaacatatggctcaagctgaaggagaagcaggacgccttctgcgacagcaagctaatgtccgcggccatcaaggacaaccgcgccgtgcacgccgatatggggtactggatcgagtctgccctcaacgacacgtggaagatcgaaaaggcgtccttcatcgaggttaagaactgccactggcctaagagccacaccttatggtccaatggcgtgctggagagcgaaatgatcatccccaagaatttagccggacccgtgtcccagcacaattatcggccggggtatcacacccagatcgccgggccctggcacctggggaagctggagatggatttcgacttctgcgaaggcaccacagtggtcgtaacggaagactgcgggaaccgaggccccagtcttcggaccaccaccgccagcggcaaactgatcaccgagtggtgttgcaggtcctgcaccctgccgccgctccggtaccgtggagaggacggctgctggtacggaatggagatcaggcccctgaaggagaaggaagagaacctggtgaatagcctcgtcacagcgggccacggccaggttgataacttttccttgggtgtcctgggcatggccctctttttggaggagatgctccgcaccagggtcggaacgaagcacgctatactcctggtggcagtaagcttcatgaccttgatcaccggcaacatgtccttcaaggacctcggtcgcgttgtggtgatggtgggcgccgcgatgaccgatgacattggtatgggcgtgacgtacctggccctgctcgccgctttcaaggtcaggcccaccttcgccgcgggcctgctgctccgcaagctgaccagtaaggagctgatgatgaccacgattgggatcgctctcctgtcccagtctaccatccccgagaccatcttggagctcactgacgcgctggcgctgggcatgatggtcctcaagatggtgagaaacatggagaagtaccagctggccgtgacaatcatggcgatcctatgcgtcccgaatgccgtgatactccaaaacgcctggaaggtctcctgcaccatattagccgtggttagcgtaagccccttgctactgacaagctcccagcaaaagaccgactggattcccctggccctcacaatcaaggggctgaatccgactgccatcttcctaaccaccctcagccggacgtccaagaagcgcagctggccgcttaacgaggccatcatggccgtagggatggtaagtatactggccagctctctgcttaaaaacgacatcccgatgaccggccctcttgtcgccggcgggctcctgaccgtgtgctacgtgctgaccgggcggagcgccgacctcgagctggaacgcgccacggacgtcaagtgggaggaccaagcggagatcagcggatccagccccattctttccataaccatctcagaggacgggtcgatgagcatcaagaacgaggaggaggagcaaaccctcaccatcctgatccggacgggcctgttagtgatctccggcttattcccggtgagcatcccaatcaccgccgcggcttggtacctgtgggaggtcaagaagcagcgagcaggggttctgtgggatgtgcccagcccgccacccatgggcaaagccgagcttgaggacggggcctaccgtatcaaacagaagggcatcctggggtactctcaaatcggcgcaggcgtctacaaagaagggaccttccacaccatgtggcacgtgacccgtggggccgtgctcatgcataagggcaaacggatcgagccctcctgggccgacgtcaagaaggacctgatcagctacggcggtggctggaagctggagggagagtggaaggaaggtgaggaggtccaggtgctcgccctggagcccggcaagaacccccgcgcagtccagacgaagcccggtctgttcaaaaccaacgcgggcacgataggtgccgtgtcgctcgactttagccccggtacaagcggcagccccatcatcgacaagaaggggaaagtggtcggtctgtacgggaacggtgtagtgacacgctccggggcctacgtcagcgccatcgcccagaccgagaagtcaatcgaggacaaccccgagatcgaagacgacatcttccgcaagcggcgtctgaccatcatggacctgcatcccggggccggcaaaaccaagcggtacctccccgccatagtccgcgaggccatcaagcgcgggctgagaacgctgatactcgcccctacacgggtggtcgctgccgagatggaggaagcgctccgcggcctgcccatccgttatcagaccccggccatccgcgccgaacatacaggccgcgagattgtggatctcatgtgccacgcgacgttcaccatgcggttgctgagtccagtgagggttccgaactacaaccttataatcatggacgaggcccacttcactgatcccgccagcatcgccgcgcggggctatatctctacccgagttgagatgggcgaggcggcgggaattttcatgacagccacgccgcccggtagccgggacccgttccctcagtccaacgcccccatcatcgacgaggagcgcgagattcccgagcggagctggaattcggggcacgagtgggtgacagactttaagggcaagaccgtctggttcgttccgagcatcaaggctgggaacgacattgctgcctgcctgcgcaagaacggcaagaaggtgattcagctgtcccggaagacgttcgacagcgagtacgtcaagacccggacgaacgactgggactttgtggtgacaaccgacatctccgaaatgggggcaaacttcaaggccgagcgggtaatagacccccgccggtgcatgaaaccagtgatcctcaccgacggtgaagagcgcgttatcctggcgggccccatgccggtcacccacagctccgccgcccagcggcgcggaaggatcgggcgcaaccccaagaacgaaaacgaccagtacatctacatgggggagcccctagagaatgacgaggactgcgcccactggaaggaagccaagatgctcttggacaacatcaacacccccgagggcatcattccgtcgatgttcgagcccgaacgggagaaggtggatgctatcgacggcgagtaccgcctgcgcggggaggcacggaagacatttgtggacctcatgcgccgaggcgacctgcccgtttggctcgcatacaaggtggccgccgaggggatcaactacgcggaccgacggtggtgcttcgacggcatcaagaataatcaaatcctcgaggagaacgtggaggtagagatctggaccaaggagggggagcgtaaaaagctgaagccgcggtggctagacgcgcgcatctacagtgatcccctcgctttgaaggagttcaaggaatttgccgccggccggaagtccctgactctcaatttgataaccgagatgggacgcctgcccacgttcatgacccaaaagacaagggacgcactcgacaaccttgccgtgctgcacaccgccgaggccggggggcgcgcgtacaaccacgcgctctccgagctgcccgagacgttagagaccctcctgctgctaaccctgctcgccactgtcacgggggggatcttcctcttcctgatgagcggccggggaatcggcaagatgaccctggggatgtgctgcatcatcaccgcctccatactcctgtggtacgcccaaatacaaccgcactggatcgcggccagcatcattttggagttcttcctcattgtgctactgatccccgagcccgaaaagcagcgcacgccccaggataaccagctcacctacgtggtcattgccatcctgactgtggtggccgccactatggcgaacgagatgggcttcctagagaaaacgaagaaggacctcggactaggctccatcgtcacccagcagccggagagcaatatcctggacatcgacctccggcccgccagcgcctggaccctgtacgctgtggccaccacctttgtcacccccatgctgcgccactccatcgagaacagcagtgtcaacgtgagcctcacggcgatagccaaccaagccaccgtgctgatgggcctcgggaagggctggcccctctccaagatggacataggcgtcccgctgctggccatcggctgttactcccaggtgaacccaatcaccctcaccgctgccttactgctcctggtcgcccactacgccattattgggcccggcctgcaggccaaggcgactcgggaggcccagaagcgcgcagccgccggcatcatgaagaacccgaccgttgacgggatcaccgtcatagacctagacccgatcccttacgaccctaagttcgagaagcagctgggccaagttatgctgctcgtcctctgcgtgacccaggtgctgatgatgcggacgacctgggcactctgcgaggccctgacgctggcaacagggcccatctccacgctctgggagggcaaccccgggcgcttctggaacaccaccatcgccgtcagcatggctaacattttccggggctcctacctggcgggcgccgggctcctgttcagcattatgaagaacaccacgaacacccggcgcgggactgggaacatcggcgagacgctgggcgagaagtggaagtcccggctgaacgccctagggaaatccgagttccagatctacaagaagtccgggatccaggaagtggaccgcaccctggccaaagaggggatcaagaggggcgagaccgaccaccacgcagtaagccgcgggagcgccaagctgcggtggtttgttgagcgcaacatggtgacccccgaaggcaaagtggtcgatctcggatgcgggcggggcgggtggagctactactgcggcggactgaagaatgttcgtgaggtgaagggcctgaccaagggcgggcctggccacgaggaacccatcccgatgtccacgtatgggtggaacctggtccggctgcagagtggcgtggacgtgttcttcatcccccccgagaaatgcgataccctgctctgcgacatcggggagtccagtcccaacccaaccgtcgaggcgggcaggactctgcgggttctgaacctcgtggagaactggctgaacaacaatacgcaattttgcatcaaggtcctgaacccttacatgccctccgtgattgagaaaatggaggccctgcagcgcaaatacggcggagccctcgtgcggaacccgctttcccgcaatagcacccatgagatgtactgggtcagcaacgcgagcggcaacatcgtatccagcgtgaacatgatctcccggatgctcatcaaccgcttcaccatgcgccataagaaggccacctacgagccggatgtagacctcgggagcggcacccgcaatatcgggatcgagtctgagatcccaaacctggacatcataggcaagcggatcgagaagatcaagcaggaacacgagacgagttggcactacgatcaggaccacccgtacaaaacctgggcctaccacggttcttacgagacaaagcagaccgggagtgcttccagcatggtgaacggcgtggtccgcctgctcaccaagccgtgggacgtgttacctactgtgacccagatggccatgaccgacacaacccccttcggccagcagcgcgtcttcaaggagaaggtggacacccggacccaggagcccaaggagggcacgaagaagctgatgaaaatcaccgccgagtggctctggaaggagctaggcaagaagaagaccccgcggatgtgcacccgggaggagtttacacgcaaggtgcggtcgaacgccgcgcttggggccgtcttcactgacgagaacaagtggaaatctgcccgagaggcggtggaagactcacggttctgggaactcgtcgataaggagagaagcctgcacttggagggcaaatgcgagacctgtgtgtataacatgatgggcaagagggaaaagaaacttggcgaattcgggaaggccaagggctcccgcgccatctggtacatgtggctgggagcccggttcttggagttcgaggcgctcgggttcctgaacgaggaccactggttcagccgagagaacagcctgtccggagtcgagggggagggactccacaagttggggtacattctgcgggatgtcagcaagaaggagggcggcgccatgtacgctgacgacaccgccgggtgggatactcgcatcaccctcgaggacctgaagaacgaggagatggtgaccaaccacatggagggcgagcacaagaagctggcggaggcgattttcaaactcacataccagaacaaggtggtccgggttcagcgccccacgccccgggggacggtgatggacatcatctcccgccgggaccagcgcggctcaggtcaggtcggaacctatggcctgaacaccttcacgaacatggaagctcagctgatccggcagatggagggggagggcgtgttcaagaacattcagcacttgacggtgaccgaggaaatcgccgttcagaactggctggctcgcgtgggtagagaacggctctcccggatggccatatctggtgatgattgcgtggtcaagcccctcgacgaccggttcgcgagtgctctgaccgctctgaatgacatgggtaagatccgcaaggatatccaacaatgggagccgagccgggggtggaacgattggacgcaggtacccttctgttcccaccacttccacgagctcatcatgaaggacggccgcgtgctggtcgtgccctgccggaaccaggacgagctgatcgggcgtgcccggatcagccagggcgccgggtggtccctccgcgagaccgcgtgcctgggcaagagctatgcgcagatgtggtccctgatgtacttccaccggcgcgacctccggctggccgccaacgccatctgtagcgcggtgccgtcccattgggtccccaccagccgcaccacttggtccatccacgccaagcatgagtggatgaccaccgaagatatgctgactgtgtggaaccgggtgtggatccaggagaacccctggatggaggacaagacgccggttgagagctgggaagagatcccctacttgggaaagcgcgaggaccaatggtgcgggagcctgatcggcctgacgtccagagccacttgggccaaaaacattcaggctgcaatcaaccaggtgcgcagcctgataggaaacgaggaatataccgactacatgccgtccatgaagcgcttccgccgcgaggaggaggaggccggtgtcctgtggtga

SEQ ID NO: 25131 - RNA, 9876 nt, synthetic construct
  misc_feature 1..9876: note = derived and/or modified CDS sequence (opt11) from DENV-2__EU687246__SS-prME
  source 1..9876: mol_type = other RNA
agtgcgggcatgatcatcatgctgatccccaccgtgatggcgttccatctcaccacccgaaatggggaaccccacatgatcgtgagcatccaggagaagggcaagtccctgctgttcaagaccgaggacggggtgaacatgtgcacgctcatggcgatggacctgggcgagctgtgcgaggacaccatcacctacaaatgccccctcctgcggcagaacgaacccgaagacatagactgctggtgcaacagcaccagcacctgggtgacgtacggtacctgcaccaccaccggcgagcaccgccgggaaaagcgctccgtggccctagtcccccacgtgggcatggggttggagacccggacagaaacctggatgtcatccgagggcgcctggaaacacgcccagcgcatcgagacgtggattctgcgtcacccggggttcacgataatggcagcgatcctggcttacaccattggtaccacccatttccagcgcgccttaatcttcatcctgctgacggccgtcgcgcccagcatgacgatgagatgcatcgggatctccaaccgcgacttcgtagagggcgtgagcggcgggtcctgggtcgatatcgtgctcgagcacggcagctgcgtgaccaccatggccaagaataagcccactctggatttcgagctgatcaagaccgaggccaagcagcccgccaccctccgaaagtactgcatcgaagccaagctgaccaacacgaccaccgagtcccgctgccccacccagggggagccgagcctgaaggaggagcaggataagcggttcgtctgcaagcactccatggtagaccgcggctggggcaacgggtgcggcctattcgggaagggcgggatcgtgacgtgcgcgatgttcacgtgcaagaagaacatggagggcaagatcgtccagccagagaacctggagtacaccatcgtagtgacgccccactctggcgaggagcacgccgtcgggaacgacacgggcaagcacgggaaggagattaaggttaccccacagtcctccatcaccgaggcggagctgacgggctatgggaccgtcacaatggagtgctccccccggaccggattagacttcaacgaaatggtcctgctgcagatggagaacaaggcctggctcgtgcatcggcagtggttcctggacctgcccctcccctggctgccgggggccgacacccaagggagcaactggatacagaaggaaaccctggtgacgtttaagaacccgcacgcgaagaaacaagatgtcgtggtcctcggcagccaggagggggcaatgcacaccgccctgaccggcgccaccgagatccagatgtccagcgggaacctcctgttcacgggccaccttaagtgccggcttagaatggacaagcttcagctgaagggcatgtcctacagcatgtgcaccgggaagttcaaggttgtaaaagagatcgccgagacccagcacggcaccatcgtcatccgtgtgcagtacgagggggacggctccccctgtaagatccccttcgagatcatggacctcgagaaacgctacgtgctcggccggctgatcacggtcaacccgatcgtgaccgagaaggacagccctgtgaacatcgaggcagagccgcccttcggtgactcgtacatcatcatcggggtcgagccggggcagctgaagctcaactggttcaagaaaggcagcagcatcgggcagatgttcgagaccaccatgcgcggtgccaagagaatggccatcctgggcgacactgcctgggatttcgggagcctgggaggggtgtttacctccatcggaaaggccctccatcaggtgttcggggcgatctacggggccgctttctcgggcgtctcctggaccatgaagatactaatcggggtgatcatcacctggatcggcatgaatagccgaagcactagcctgtccgtgagcctagtcctcgttgggattgtcaccctctacctgggcgtcatggtgcaggccgactccggctgcgtggtcagctggaagaacaaggagctcaagtgcgggagcggcatctttatcaccgacaacgtgcatacctggacggagcagtacaagttccagcccgagtccccctcaaagctggcatccgcgatccagaaggcccaggaggagggtatctgcggcatccgcagcgtaacccggctggagaaccttatgtggaagcagatcacgcccgagcttaaccatatcctggccgagaacgaggtcaaactcaccatcatgacgggggatattaagggcattatgcaggcggggaaacgatccctgcggccacagcccaccgaactcaaatactcgtggaagacctggggcaaggctaagatgctctcaaccgagtcgcacaaccagactttcctgatcgacggccccgagaccgccgagtgcccgaataccaacagggcctggaactccctggaggtcgaagactacgggttcggcgtgttcaccacgaatatctggctcaagctgaaggagaaacaggacgccttctgtgacagcaagttgatgagtgcggcgatcaaagacaaccgggccgtccacgcggacatggggtactggatagagagcgctctaaacgacacttggaaaatcgagaaggcctccttcatcgaggtgaagaactgccattggcccaagagccataccctgtggtccaacggcgtcctggagagcgagatgatcatccccaagaacctcgcgggccccgtctcccagcacaattaccgaccggggtaccacacccagatagccggcccatggcacttagggaagctggaaatggacttcgacttttgcgacggcaccacggtggtggtcaccgaggactgcgggaaccggggtcctagcctcaggaccactacggccagcggcaagctgatcaccgagtggtgctgccggtcctgcactctgcccccgctccgctacaggggggaagacggctgctggtacgggatggagatccgccccctgaaggagaaggaggagaacctggttaacagcctcgtgacagccggacacggtcaagtcgacaacttttccctgggcgtgctgggcatggccctcttcctggaggagatgctgcggacccgtgtggggaccaagcatgccatcctccttgtcgccctgtcgttcgtgaccttaatcaccggaaacatgtccttcaaggacctggggcgggtggtggtgatggtgggcgccacgatgaccgacgacatcgggatgggcgtcacctacctcgccctgctggcggccttcaaggtgcggcccaccttcgccgccgggctactcctgcggaaactgacgagcaaggaactcatgatgaccaccatcgggattgtgttgctgagtcagagcaacatcccagagacaatcctcgagctgacggacgccttggcgctcggcatgatggtactgaagatcgtgagagacatggagaagtaccagctggctgtgaccatcatggccatcctctgcgtgccgaacgcggtgatcctgcagaacgcatggaaggtctcctgcaccatcctggcggtggtcagcgtcagccccctcctgctgaccagcagtcagcaaaagacggactggatccccctcgcgctgaccatcaaggggctgaaccctaccgcaatcttcctcacgacgctaagtcgcaccaacaagaagcggagctggccgttgaacgaggccatcatggcggtggggatggttagcatcctcgcctccagcctcctgaagaacgacatccccatgaccggccccctcgtcgccggggggttactgaccgtctgctacgtgctcactgggcgctccgccgatctggagctggagcgagccaccgacgtcaaatgggaggatcaggcggagatctcaggctcctcccccatcctcagcatcaccatctccgaggacgggtccatgtccatcaagaacgaggaggaggagcagaccctgacgatcctgatccgcaccggcctcctggtgatcagcggcctgtttccggtgtccatccccatcaccgccgccgcctggtatctttgggaggtgaagaagcagcgggccggtgtgctgtgggacgtgccctccccgccgcccatgggcaaggcggaactggaggacggagcctaccgcatcaagcagaagggcatcctcgggtactctcaaatcggcgcaggcgtatacaaggaggggaccttccacacaatgtggcacgtgacgcggggagctgtcctgatgcacaaggggaagcgcatcgaacccagctgggccgacgtcaagaaggacctgatctcctacggcgggggctggaagctcgagggcgaatggaaggagggggaggaggtccaggtgctggcgctggaaccaggcaagaacccccgggccgtccagacgaagccaggcctcttcaagaccaacaccggtacgataggggccgtgtcactggacttctcacccggcacaagcggctcacctatcatagataagaaggggaaggtggtcggcctttacgggaacggtgtggtgacccgcagcggcgcctatgtctccgccatcgctcagaccgagaaatccatcgaggacaacccggacatcgaggacgacatcttcagaaagcgccggctgactatcatggacctccaccccggggccggcaagaccaaacgttacctgccggctatcgtgcgggaggccatcaagcgcgggctacggaccttaatcctggcgcctactcgcgtggtcgccgcagagatggaggaggccctgcggggcctcccaatccgctaccaaacgcccgccatccgggcggagcacaccgggcgcgagatcgtggatctgatgtgtcatgccaccttcaccatgcgcctgttgtcccccgtccgggtcccgaactacaacttgatcatcatggacgaggcacacttcacggatcccgccagcatcgccgcccggggctacatcagcacccgggtggagatgggcgaggctgccgggatcttcatgaccgctaccccgcccggctctcgcgacccgtttccccagtccaacgcccccattatcgacgaggagcgcgaaatccccgagcgctcctggaacagcgggcacgagtgggtgacggacttcaagggcaagaccgtctggttcgtgccgtccatcaaggcggggaacgacatcgccgcatgcctgcggaagaacggcaagaaggtgatacagctcagccgcaagaccttcgacagcgagtacatcaagacccggaccaacgactgggacttcgttgtgaccaccgacatcagcgagatgggcgccaacttcaaggcggagcgcgtgatcgacccccggaggtgcatgaagcccgtcatcctgaccgacggggaggagagggtgatcctggccggccccatgcctgtgacgcactccagcgccgcccagcgccgggggcgcatcgggaggaaccccaagaacgaaaacgatcagtatatctacatgggggagcccctcgagaacgacgaggactgcgcccactggaaggaggccaagatgctgttggacaatatcaacacccccgagggaatcatcccttccatgttcgaacccgagcgcgagaaggtggacgccatcgatggcgagtaccggctccgcggagaggcccgcaagaccttcgtggacctgatgcggcgcggcgaccttcccgtctggctcgcctacaaggtcgccgcggaggggatcaactacgccgaccggcgctggtgcttcgacggcatcaagaacaaccagatactggaggagaacgtggaggtggagatctggaccaaggagggggagcggaagaagctgaagccgcgttggctcgacgcccggatctacagcgaccccctggccctaaaggagttcaaggaattcgccgcaggcagaaagagtttaacactgaacctgatcaccgagatgggcagactccccacctttatgacgcagaagacgcgggacgccctcgacaacttagccgtcctccacacggccgaggccggagggcgggcctataaccacgccctgagcgagttgcccgagaccctcgagaccctgctgctcctgacgctgctcgccaccgtgaccggcgggatcttcctgttcctgatgtccgggcgcgggatcggcaagatgaccctcgggatgtgctgcatcataaccgccagcatattactgtggtacgcgcagatacagccgcactggatcgccgcctccatcatactggagttttttctgatcgtcctgcttattcccgaaccggagaagcagcgtacgcctcaagacaaccagctgacctacgtggtgatagccatactaaccgtcgtggcggcgaccatggccaacgagatgggcttcctcgagaagacgaagaaggacctaggtctgggaagcatcgccacccagcagccggagtccaacatcctcgacatcgacctgcgccccgccagcgcctggacgctgtacgcggtggcgaccacattcatcacccccatgctccggcacagcattgagaactcaagcgtcaacgtgtccctgaccgccatcgccaaccaggccaccgtgctgatgggcctcgggaaaggctggcccctatctaagatggacatcggggtccccctgctcgctatcggatgctactcccaggtgaaccccataacgctgactgccgccctattactgctgattgcccactacgctatcatcggtcccggcctccaagccaaggccacccgcgaggcccagaaacgggccgcggccgggatcatgaagaaccccaccgtggacgggatcacggtcatcgacctggacccgatcccctacgaccctaaattcgaaaagcaactgggccaggtgatgctcctggttttgtgcgtaacccaagttctcatgatgcgcaccacttgggccctgtgcgaggccctgacgctcgccaccgggcccatcagcaccctgtgggagggcaatccgggacggttctggaacaccacgatcgcggtgtccatggcaaacatcttccgcggcagctacctggccggcgccgggctcctgttctccatcatgaagaacaccaccaacacccggcgcggcaccgggaacatcggcgagaccctgggcgagaagtggaagtcccgccttaacgccctggggaagagcgagttccagatctacaagaagtccggcatccaggaagtcgaccggaccctggcgaaggaggggatcaagcgcggcgagaccgaccaccatgccgtgtcccgggggagcgccaagttaaggtggttcgtggagcggaacatggtcacgcccgagggcaaggtcgtggacctgggctgcgggcgcgggggatggtcctactactgcggcgggctgaagaacgtccgagaggtgaagggactcaccaagggcgggcctggccacgaggagcccatcccgatgagcacctacgggtggaacctggtgcgcctgcagtccggcgtcgacgtcttcttcatcccccccgagaagtgtgacaccctcctgtgcgacattggggagagctcccccaacccgacagtggaagccggccggaccctgcgggtcctcaacctggtggagaactggctgaacaacaatacccaattctgcatcaaggtgctgaacccatacatgcccagcgtaatcgagaaaatggagaccctccagcggaagtacggtggagcgctggtgcgcaacccgctaagccggaactccacacacgagatgtactgggtgagcaacgcctccggcaacatcgtcagttccgtgaacatgatcagccgcatgctcatcaaccggttcacgatgcgccacaagaaggccacctacgaacccgacgttgatttaggctccggcacccggaatattggaatcgagagcgagattcccaatttagacatcattggtaagcgcatagagaagatcaaacaggagcatgagacctcctggcactacgaccaggaccacccctacaagacgtgggcctaccatggaagctatgagaccaagcaaacggggtccgccagctccatggtgaacggcgtggtccggctcctgaccaagccttgggacgtcctgccaacggtgacacagatggcgatgacagacaccacgcccttcggtcaacagcgcgtgtttaaggagaaggtcgacacccgcacccaggagcccaaggagggcaccaagaagctcatgaagatcacggccgagtggctgtggaaggagctgggcaagaagaaaaccccgcggatgtgtacccgcgaggagttcacccggaaggtgcgcagcaacgccgccctcggggccatcttcacggacgagaacaagtggaagtccgcgcgggaggccgtagaggacagccgcttctgggaactggtcgacaaggagcgcaacctgcacctcgagggcaagtgcgagacctgcgtgtataacatgatggggaagcgcgagaaaaagctgggcgagttcggtaaggccaagggctcccgggccatctggtacatgtggctgggcgcacgcttcctcgagttcgaggcgttaggattcctgaacgaggaccactggttcagccgggagaactccctaagcggcgtggagggggagggcctgcacaagctagggtacatcctccgcgacgtcagcaagaaggagggcggcgctatgtacgccgacgacacagccgggtgggacacccggatcacgctggaggacctgaagaacgaggagatggtgaccaaccacatggaaggagagcacaagaagctcgcggaggccatattcaagctgacctaccaaaacaaagtcgtgcgcgtgcaaaggccgacgccccgtgggactgtcatggacattatttcccggcgcgatcaacggggcagcggccaggtggggacctacggcctgaatacctttaccaatatggaggcccagctaatccgtcagatggagggcgaaggcgtgttcaagaacatccagcacctgacggtcaccgaggagatcgccgttcagaactggcttgcccgggtgggtcgcgagcgcctctcccggatggcgatcagcggggacgactgcgtcgtgaagcccctggacgaccgctttgcctccgccctcactgccctcaacgacatgggtaagatccggaaggacatacagcagtgggagccgagccgcggatggaacgattggacccaggtgcccttctgctcgcaccacttccatgagctgatcatgaaggacggccgggtcctggtggtgccctgtcgcaaccaggacgagttaatcgggagggccagaatctcccagggcgcgggttggtccctgcgggagacggcctgcctcggcaagagttacgcccagatgtggtccctcatgtacttccatcgccgggaccttcgcctggccgccaacgctatttgcagcgccgtcccctcccactgggtgcctaccagtaggacaacctggtccatccacgccaagcacgagtggatgaccacggaagacatgctcaccgtatggaaccgagtctggattcaggaaaacccatggatggaggacaagaccccagtggagtcatgggaggagatcccctacctgggcaagcgggaggaccagtggtgcgggtccctgatcggcctcacctcccgcgccacgtgggcaaagaacattcaagcggccatcaaccaggtgcggagcctgatcggctccgaggagtacaccgactacatgccgagcatgaaacgcttccggcgcgaggaggaggaagccggcgtcctgtggtga

SEQ ID NO: 25132 - RNA, 9876 nt, synthetic construct
  misc_feature 1..9876: note = derived and/or modified CDS sequence (opt11) from DENV-2__FJ639828__SS-prME
  source 1..9876: mol_type = other RNA
agtgttggcatgatcatcatgctgatccccaccgtgatggcgtttcatctcacaacccgcaacggggaaccccacatgatcgtcagcatacaggagaagggcaagtcgctgttattcaaaactgaggacggggttaacatgtgtaccctcatggctatggatctgggcgagctttgcgaagataccatcacctacaaatgccccctcctgcggcagaacgagcccgaggacattgactgctggtgcaactccacctcaacatgggtcacctatggcacctgtaccacgaccggcgagcatagacgggagaagcgttccgtggcgttagtgccccacgtgggcatgggcctggagacccggaccgagacctggatgagctccgaaggcgcctggaaacacgcccaacgcatagagacttggatcctgagacaccccggcttcacgattatggccgctatcctcgcgtatactatcggcactacccactttcaaaggacgcttatcttcattttgctgacggccgttgccccctccatgaccatgcggtgtatcgggatctccaatcgagatttcgttgagggcgtcagcggcgggtcctgggtggatatcgtgcttgagcacggctcctgcgtcaccacgatggcgaagaacaagccgaccctagacttcgagctgatcaagaccgaggcgaagcagcccgcaaccctccgtaaatattgcatcgaggccaagttaacgaacaccaccaccgaatcccgctgccctactcagggggagcccagcctcaaggaggagcaagacaaacggttcgtgtgcaagcactccatggtggataggggctggggcaatgggtgtggcttattcgggaagggcgggatagtgacctgcgccatgttcacgtgcaaaaaaaacatggagggcaagatagtgcagcccgaaaatctggaatacaccatagtggttaccccgcatagcggcgaggagcacgccgtggggaacgacactggcaagcacggtaaggagatcaaggtaaccccgcagtcctccatcaccgaggcagagttaacaggctacgggaccgtcaccatggagtgcagccctcgcaccggcctagactttaacgagatggtgctgctgcagatggagaacaaggcttggctcgtgcaccgtcaatggttcctggacctgccgctcccatggctgcctggtgccgacactcaagggagcaactggatccagaaggagacgctagttaccttcaagaacccccacgccaagaaacaggacgtggtcgtgctgggcagccaggagggggccatgcacactgcgctgaccggagcgactgagatccagatgtccagcggtaacctcctgttcactggccatctgaagtgcaggttgcgcatggataagctccagctgaaggggatgtcctacagcatgtgcaccgggaagtttaaggtggttaaggaaattgccgaaacccagcacggcaccatcgtgatccgggttcagtacgaaggggacggctccccttgcaagataccgtttgaaataatggacctggaaaagcgctacgtcctcggccggttaataacggtcaacccaattgccaccgaaaaagacagccctgtgaacatagaggctgagccgcccttcggggattcgtacatcattataggcgtcgagccggggcagctgaagttgaattggttcaagaaaggaagctccatcgggcagatgtttgagactacgatgcgcggcgcgaagcgaatggcgatcctgggcgacaccgcctgggacttcggtagcctgggcggggttttcacgtccatcggcaaggcgctccaccaggtcttcggtgcgatttacggcgcggccttctcaggcgtctcctggactatgaagatcctgattggggtgatcattacgtggatcggcatgaacagcagaagtaccagcctgtcagtctcgcttgttctcgtgggagtagtcacactgtacctgggagtgatggtgcaggccgactcggggtgcgtggtgagctggaagaacaaggagctcaagtgcggcagcggcatcttcatcaccgacaatgttcacacgtggaccgagcagtacaagttccagccagagtccccctccaaactggcgtcagcgatccagaaagcccaggaggaggggatctgcggaatacgcagcgtcacccggctcgagaacctcatgtggaaacaaattacccccgagctgaaccacatactggccgagaacgaggtgaaactcacgatcatgaccggggacatcaaaggcataatgcaggccggaaagcgctccctgcggccgcaacccaccgagctgaagtacagctggaagacctggggcaaagccaagatgctctccacggagtctcataaccagaccttcttaatcgatggccctgaaaccgcggagtgcccgaacaccaaccgggcgtggaacagcctagaggtggaggactacggcttcggcgtcttcacgaccaacatatggctcaaattgaaggagaagcaagacgctttctgcgacagtaagctgatgagtgccgccatcaaagacaaccgcgcggttcacgccgacatggggtactggattgagagcgccttaaacgacacctggaaaatcgagaaggcctccttcatagaggtgaaaaattgtcattggccaaaaagccacacactgtggtcgaacggcgtcctggaaagcgagatgatcatccctaagaacttggcgggtcccgtgtcccaacacaattatcgcccggggtatcacacccagatcgcgggtccctggcatctggggaagttggagatggacttcgacttttgcgacggcacgaccgtggtggtgaccgaggactgcggcaaccgcggccccagcctacgaaccaccaccgctagcggcaagctgatcacagagtggtgctgccggtcttgtaccttgcccccgctccgttaccggggggaagatggctgctggtacgggatggaaatccgcccgttgaaggagaaggaggagaacctggttaactcgctcgtcacggcaggccacgggcaagtcgacaacttcagtttaggagtcctaggcatggccctctttttggaggagatgctgcggacccgcgtcggcacgaagcacgctattttactggtggccgtcagcttcgtcactctgatcacgggcaacatgtcattcaaagatctcggtcgtgttgtggtcatggtgggtgccactatgaccgatgacatcgggatgggcgtgacatacttagctctgttggccgcattcaaggtccgccccacgttcgccgccgggctgttcctgaggaagcttacgagtaaggagctgatgatgacgaccattgggatcgtactgttatcccaaagcacgctccccgagacaatcctggagctcacagacgccttggccctgggaatgatggtgttgaaaatggtaagagacatggagaaataccagttagcggtgacgatcatggcgatcctgtgtgtcccgaacgccgtaatactccaaaacgcctggaaggtgtcctgcacgatccttgcagtcgtaagcgtgagccccctactcctgaccagcagccagcagaagaccgactggatccccctggctctcacgatcaaggggttgaaccccacggccatcttcctgaccaccctctcacggaccaacaagaagcggtcctggccgctgaatgaagctatcatggccgtgggcatggtttccatcctggcgtcctccttgctgaaaaacgacatccccatgacgggtcccctagttgccgggggcctcctaaccgtctgctatgtgctgaccgggcgcagcgcggacttggagctcgagcgggccacggatgtgaagtgggaagaccaggccgagatcagcggctcctcacccatcttgtcaatcacgatctccgaggacgggagcatgagtatcaagaacgaagaagaggagcagaccctcaccatcctgatcagaaccgggctgctcgtaatctccggcctgttcccagtatccatccccataacggcggccgcctggtacctgtgggaagtgaagaaacagcgggctggggtgctctgggacgtgccgtccccgccgcccatgggcaaagccgagctggaggatggcgcataccgaatcaaacaaaggggcatcctggggtactcccagataggggccggcgtgtataaagaaggtacgttccataccatgtggcatgtcacccgaggcgccgtccttacccacaaggggaagcggatcgaaccctcctgggcagatgtgaaaaaggacctgatctcctatggaggaggctggaagctggagggcgagtggaaggaaggcgaggaggtccaagtactcgccctcgagcccggcaagaacccccgcgcggtccagacgaagcccgggctgttcaagaccaacaccgggaccatcggggcagtgagcctggacttctcccccggcacaagcggttctccaatcatcgacaagaagggaaaggtggtgggactttacgggaacggcgtggtcacccggagcggcgcgtacgtgtccgccatagcccagaccgagaagtccatcgaggataaccccgacatcgaagacgacatctttcgcaagagacgtctaaccataatggacctccacccgggggcgggaaagacgaagcgatacctccccgcaatcgttcgcgaagccatcaagcgcggcctacgcaccctgatcctagccccgacccgcgtagtggcggccgagatggaagaggccttgcgaggcttgccgatacggtatcagacccccgccattcgcgccgagcacacggggcgcgaaattgtggacctcatgtgccacgctaccttcaccatgcggctgctgtcccccgtgcgcgtaccgaactacaacctgatcattatggatgaggcccacttcacagaccccgcaagcatagccgccaggggttacatcagcacgcgggtcgagatgggcgaggctgccggcatcttcatgacggcgacgccgcccggctcgcgggacccgttccctcagagcaacgctcccattattgacgaggagcgcgagatcccggagcggtcgtggaacagcggacatgaatgggtcaccgacttcaagggcaagacggtgtggttcgtcccgtccattaaggccgggaacgatatcgcggcgtgcctgcgcaagaacggtaagaaagtcatccaactgagccggaagaccttcgattccgaatacgtgaagaccaggacaaacgactgggatttcgtcgtgacgactgacatatcagagatgggtgcgaatttcaaggccgagagagtaatcgacccccgtcgatgcatgaagcccgtgattctcactgacggggaggagagagtgatcctggcgggccccatgccggtgacccactctagcgccgcccagcgccgcggccggatcggccggaaccccaagaacgagaacgaccagtacatctatatgggggagcccctggagaacgacgaggactgcgcccactggaaggaggccaagatgttactcgacaacatcaacacgcccgagggcatcatcccgtccatgttcgagcccgagcgggagaaggttgacgcgatcgatggggagtaccgccttcgaggggaggcccggaagaccttcgtcgacctcatgcggcggggtgacctgccagtgtggttagcctacaaagtcgccgcagaggggattaactacgcagaccgccgatggtgcttcgacggcatcaagaacaatcagatcttggaagagaacgtcgaggttgagatctggacgaaagagggcgagcgcaagaagctgaaaccgcggtggctggacgcccgcatctacagcgacccccttgcccttaaagaattcaaggagttcgccgccggcagaaagtcccttactctcaaccttatcacggagatggggcgcctgcccacctttatgacccagaaaacacgggacgcgctcgacaacctggccgtactgcacacggcagaggccggaggtcgcgcctataaccatgccctctctgagctgccagagaccctcgagaccctcttgttactcactctgctcgccaccgtaaccggagggatcttcctcttcctaatgtcagggagaggaatcggcaagatgacgcttgggatgtgttgtatcgttaccgccagcatcctcttgtggtacgcccaaatccagccgcactggatagctgcttccatcatcttagagttcttcttgatcgttcttctgattccggaacccgagaaacagcggacccctcaggacaaccagctcacctacgtagtgatcgcgatactgaccgtggtggctgccacgatggcgaacgagatgggcttcctcgaaaagaccaagaaggacctcgggctgggcagcatcgccacgcagcagcctgagtccaacatcctcgacatagacctccggcccgccagcgcctggaccctgtacgctgtggcgactactttcgtgacaccaatgctacgccacagcatcgaaaattccagcgttaacgtctccctcacggccatcgcgaaccaggcaacagtgcttatgggactcggaaaggggtggcccctcagcaagatggacatcggggcaccactcctggcgatcggctgctattcccaagttaaccccatcacccttacggccgccctgctactcctggtcgcccactacgcaatcatcgggcccggcctgcaggcgaaggccacaagagaggcccagaagcgcgcggcggccggcattatgaagaaccccacagtggacgggatcactgttatcgacctcgatccgatcccctacgaccctaagttcgagaagcagctcggccaggtcatgctgttggtgctgtgcgtgacacaggtcctgatgatgcgtaccacctgggccctctgtgaagcgctgacccttgccacgggacccatcagcacactctgggagggcaacccggggcgcttctggaacacaaccatcgcggtctccatggccaacatcttccggggtagttatctggccggcgcggggttgctgttctcaatcatgaagaacaccaccaactccagacgcggcacgggcaacatcggcgagaccctgggcgaaaagtggaagtcccggctcaacgccctaggaaaaagcgagttccagatctacaagaagagtggcatccaggaggtggaccgcacgctggcgaaggaaggcatcaaacggggcgaaaccgatcaccacgccgtgtctcgggggtccgccaaactacggtggttcgtcgagagaaacatggtgacacccgagggcaaggttgtggacctcggctgcgggcgcggagggtggagctactactgcggcgggctgaagaacgtgcgcgaggttaagggcctaactaaaggggggccagggcacgaggaacccatcccgatgtccacgtacgggtggaacctcgtgcggcttcagagcggcgtagacgtcttctttataccgcccgagaagtgcgacacgctgctctgtgacatcggggagtcctctcccaacccaaccgtggaggctggcagaaccctgcgggtattaaacctcgtggagaactggctgaataacaacacgcagttctgcattaaggtgctgaatccctacatgcccagcgtaatagagaagatggagaccctgcagcgcaagtacggcggggcgctagtcaggaacccgctgtcccgcaatagcacccacgagatgtactgggtgagcaacgccagcggcaacatagtgtccagcgtgaatatgatctccagaatgctgatcaatcgtttcaccatgcgtcacaaaaaggcaacctacgagcccgacgtcgatctcgggagcggcacgcgcaacatagggatcgagtccgagatccccaatttagacataattggcaagcgcatagaaaagatcaagcaggagcatgagaccagttggcactatgaccaggaccacccgtataagacctgggcctatcatggctcctacgagactaaacagacggggagcgccagcagcatggtgaacggcgtcgtacgcctgctaacgaaaccgtgggacgttctgcccaccgtcacccagatggcgatgacggacaccacccccttcgggcaacaaagagtgtttaaggaaaaggtggatacccggacccaggagcccaaagagggcaccaagaagctgatgaagattaccgcagagtggctctggaaggagctaggcaagaagaaaaccccgcgaatgtgcactcgggaggagtttacccgcaaggtccggtccaacgccgccctgggggccattttcaccgacgagaacaagtggaagtctgcgcgcgaggcggtcgaggattctcggttctgggagctcgtcgacaaggagcgcaacctgcacctcgagggcaagtgcgagacttgcgtgtacaacatgatggggaaacgggagaagaagctaggggagttcggcaaagccaagggcagccgggccatatggtacatgtggctgggtgcacgatttctggagttcgaggcgctggggttcctgaacgaggatcactggttctccagggagaacagcctgagcggtgtggagggagagggactccaccggctggggtatatcctgcgcgatgtcagcaagaaagagggcggcgccatgtacgcagacgatacggccggatgggacacccgtattaccttagaggatctgaagaacgaggagatggtgactaaccacatggagggggaacacaagaagctggcggaggccatcttcaaactcacctaccaaaacaaggtggtccgcgtgcagcggcccacgccccgcgggaccgtaatggacatcatatcgcggcgggaccagcggggctccgggcaagtcggcacatatggcctaaataccttcaccaacatggaggcccaattgatccgccaaatggagggggaaggcgtcttcaagaacatccaacacttaaccgtcactgaagagattgcggtccagaactggctggcacgcgtcgggcgagaacgtctgagtcggatggcgatcagcggtgatgactgcgtagtcaagccgctcgacgacaggtttgccagcgccctcactgccctaaacgacatgggcaaaatccggaaggatatccagcaatgggagccgtctcgagggtggaatgattggacccaagtcccattctgcagccaccactttcacgaattgatcatgaaagatggccgggtgttagtcgtgccctgtcgcaaccaggacgagctgatcggccgagctcgcattagccaaggggcagggtggagtctcagggagactgcctgcctgggcaagtcctacgcacagatgtggtctcttatgtacttccaccgacgggatttacgcctggctgcaaacgccatttgctcagccgtaccctcgcactgggtaccgacgtcgcgaaccacgtggagcattcacgccaaacacgagtggatgaccaccgaggatatgctgacagtgtggaacagagtatggatccaggaaaacccctggatggaggacaaaacgcccgtcgagtcctgggaggaaatcccatacttaggcaagcgggaggaccagtggtgtgggagccttatcggcctgacaagcagagccacctgggctaaaaacatccaggcggcgatcaaccaggtgaggtccctcatcggcaacgaggagtacactgactacatgccgtctatgaagcgcttccggagggaggaggaagaggccggcgttctgtggtaa

SEQ ID NO: 25133 - RNA, 9876 nt, synthetic construct
  misc_feature 1..9876: note = derived and/or modified CDS sequence (opt11) from DENV-2__FJ639829__SS-prME
  source 1..9876: mol_type = other RNA
tctgtgggcatgatcatcatgctgatccccaccgtgatggcgttccacctcaccacccgcaacggggagcctcacatgatcgtgtcgatacaggagaagggcaagtctcttctgttcaagaccgaggacggggtgaacatgtgcacactcatggccatggacctgggcgagctgtgtgaagacacaatcacctataaatgtcccctcctgcggcagaacgagcccgaggacatcgactgctggtgcaactccaccagtacctgggtcacctatggaacgtgtaccaccaccggcgagcaccgccgggagaagcgcagcgtggcgctggtgccgcacgtcggaatggggctcgagacgaggactgagacctggatgtcgtccgaaggtgcgtggaagcatgcccagcgcatcgagacttggatcctgcggcacccggggttcacaatcatggccgccattctcgcgtacaccatcggcaccacccacttccagcggacgctcatcttcatcctgctgaccgctgtggccccaagcatgaccatgcggtgtatcgggatcagcaatagggacttcgtggagggcgtcagcggcgggtcctgggtggacatcgtgctcgagcacgggagctgcgtcaccacgatggccaagaataagcccaccctggacttcgagctaatcaagacggaggcgaagcagcccgccaccctccggaagtattgcatagaggccaagctgacgaacaccaccacggagagtcggtgccccacgcagggggaacccagcctgaaggaagaacaggacaagcgattcgtgtgcaagcactccatggtagaccgcggctggggcaacggttgcggcctcttcgggaagggcgggatcgtgacctgcgctatgttcacgtgcaaaaagaatatggagggaaagatcgtgcagcccgagaacctggagtacacaattgtggtcacgccccacagcggcgaggagcacgccgttgggaacgacaccggcaagcatgggaaggaaatcaaggtgaccccacaatccagcattaccgaggcggagcttaccggctatgggacggtcaccatggagtgctccccccggaccggcctggacttcaacgagatggtgctgctgcagatggagaacaaggcctggctcgtgcaccgccagtggttcttagacctgcccctcccatggttaccgggcgccgacacccaggggagcaactggatccagaaggaaacgctggtcacctttaagaacccccacgccaaaaagcaggacgtggtcgtgttgggcagccaggagggggccatgcacaccgcgctgaccggcgccacagagatccagatgtccagcggaaacctcctgttcaccggccacctgaagtgcagactgagaatggataagctccagctgaaaggcatgtcctacagcatgtgcaccgggaagttcaaagtggtcaaggagatcgccgaaacccagcacggcacgatcgtgatccgggtgcaatatgagggtgacggctccccctgcaagatccccttcgaaatcatggatctggagaagcgctatgtcctcggccgtctaatcaccgttaaccccatcgtcaccgaaaaggactcgcccgtcaacatcgaggccgaaccgcccttcggggactcctacataatcatcggcgtggagccgggacaattgaagctcaattggttcaagaagggcagctccatcggtcagatgttcgagaccactatgcgcggcgccaaacgcatggcaatcctgggcgacacagcctgggacttcgggagcctggggggtgtgttcacctccatcggcaaggccctccaccaggtctttggggccatctacggcgccgcgttctcgggcgtaagttggaccatgaaaatactgatcggggtgatcatcacgtggatcggcatgaactctcggtccactagcctgtccgtcagcctggtgctcgtgggggttgtcaccttgtacctgggcgtgatggtgcaagccgactccgggtgcgtggtgagctggaaaaacaaggagctcaagtgcggcagcggcatcttcatcaccgacaatgtccatacgtggactgagcagtacaaattccagcccgagagcccaagcaagctggcctccgctatccagaaggcgcaggaggaggggatctgcggtatccgaagcgtgacccggctagagaacctcatgtggaagcagatcacccccgagctgaatcacattctggccgagaacgaggttaagctcacgatcatgaccggggacatcaagggcatcatgcaggccgggaagcgatccctgcggccgcaacccaccgagctaaaatacagctggaaaacctgggggaaggccaaaatgctgtccacggagagccataaccaaacattcctgatcgacggcccagagactgccgagtgccctaacaccaacagagcgtggaattccctggaagttgaagactacgggtttggtgtcttcacgaccaacatttggctaaaactcaaggagaagcaggacgccttttgcgacagcaagttgatgtccgccgccatcaaggataaccgggctgtgcacgcggacatgggatattggatcgagtcggccctcaacgacacgtggaagatcgagaaggcctccttcatcgaggtgaaaaactgccattggcccaagagccacaccctgtggtccaacggcgtgctggagtcagagatgatcatccccaagaacctcgcaggccccgtgtcccagcataattaccgcccagggtaccacacccagatcgccggcccctggcatctggggaagctggaaatggacttcgacttctgtgacggcacgaccgtcgtggtgaccgaggactgcgggaaccgtggccccagcctccgcacgacgaccgccagcggcaagttaattaccgagtggtgctgtcggtcctgcaccctgcccccgcttcgctatcgcggggaggatggctgctggtacgggatggagatccggcccctgaaggagaaggaggagaacctggtcaactctctggtgacggcaggccacggacaggtcgacaacttcagcctgggagtactgggcatggccttgttcttggaagagatgctgcggaccagggtagggaccaaacacgcgatcctcctggtggcggtcagctttgtgactctgatcacgggcaatatgagtttcaaggacctcgggcgcgtggtcgtgatggtgggggccaccatgaccgacgacataggtatgggggtcacttatctggcccttctcgcagcctttaaggtcaggcccacattcgcggccggattgttcctgcggaaactcacctctaaggagctgatgatgaccaccataggaatagtgctgctctcccagagcacgatccccgagacaattctggagcttaccgatgccctcgcactgggcatgatggtgctgaagatggtgcgcgacatggagaagtaccagctcgcggtcaccatcatggcgatcctttgtgtgccgaacgccgtgatactgcagaacgcttggaaggtcagttgcacgatactcgccgtggtgagcgtaagccccctgctgttaaccagctcccagcagaagactgactggatccccctcgccctgaccatcaaggggctcaaccccacggcgatcttcctcaccaccctgagccgcactaataaaaaacggtcgtggccgctcaacgaagccatcatggcagttgggatggtgtcgatccttgcctccagtctgctcaagaacgacatccccatgaccggcccgctggtcgcgggcgggctactcaccgtctgctacgtactgactgggcgcagtgccgacctcgagctcgaaagggccaccgacgttaagtgggaggatcaggccgagatcagcgggagctcccctattctcagcatcacgatctccgaggacggcagcatgtccatcaagaatgaggaggaggagcagacccttaccatcttgatccgtacaggcctgctggtgatcagcggtctcttccctgtttccatccccatcacagcggccgcatggtatctgtgggaggtcaagaagcaacgggccggggtgctgtgggacgtgccctcaccgccgccgatgggcaaggccgaactcgaggacggggcctaccgcatcaaacagcgggggatcctgggatactcccagatcggcgcgggcgtctataaggaggggacgttccacaccatgtggcacgtgacccgcggcgccgtgctgacccacaaggggaagcggatcgagcccagctgggccgacgtgaaaaaagacctaatctcctacggaggtgggtggaagctggagggcgagtggaaagagggggaggaggtccaggtgctagccttggagcccggcaagaacccccgcgccgtccagacgaagcccgggttgttcaagacgaacaccggcaccatcggggcggtgagcctggacttttccccaggtacgagcgggtcccctatcatcgacaagaaggggaaggtggtcggcttgtacgggaacggcgtggtgacccggagtggcgcctacgtctccgccatagcccaaacggagaaatcgatcgaagacaaccccgacatcgaggacgatatcttccgcaagcggcggctgaccatcatggacctgcacccgggggccggcaagacgaagcggtacctgcccgcgattgtgagggaagctattaagcgtgggctccgcactcttatcctggcaccgacccgggtggtcgccgctgagatggaggaggcgctgcgcggtctgcccatacggtaccagacccccgccatccgcgcagaacatactgggcgcgagatcgtagatctgatgtgtcacgccaccttcaccatgcggctcctttcccccgtgcgcgttccgaattacaacctgattatcatggacgaggcgcacttcaccgaccccgcgagcatcgccgcccggggctacatcagcacgcgcgtagaaatgggcgaggccgcagggatttttatgaccgccaccccgcccggctcccgggaccctttcccccagagcaacgccccaatcatcgacgaagagcgcgaaatccccgagcgatcctggaacagcgggcacgagtgggtgacagacttcaagggcaagacggtctggttcgtgccgtccatcaaggccgggaacgacatagccgcgtgtctcaggaagaacggcaagaaggtgatccagctgtctcggaagaccttcgactccgaatacgtaaagaccaggaccaacgactgggacttcgttgtgacgaccgacatcagcgagatgggcgccaacttcaaggccgagcgggtcatcgacccccgccggtgcatgaagcccgtgatcctgacggatggagaggaacgcgtgatcctcgccggacccatgccggtcacccactccagcgcggcccagcggcggggccggatcggccgtaaccccaaaaacgagaacgaccagtacatctatatgggggagcccctagagaacgacgaggactgcgcccattggaaggaagccaaaatgcttctagacaacattaacacgccagagggcatcatcccgtccatgttcgagcccgaacgcgagaaagtggacgcaatcgacggcgaataccgtctgcgcggggaagcgcggaagaccttcgtggacctgatgcgccggggcgacttacccgtctggctggcctacaaagtggccgccgaggggatcaactacgccgatcgccggtggtgtttcgacggcatcaagaacaaccagatcctggaggaaaacgtcgaggtggagatctggacaaaggagggggagcgtaagaagctcaaaccgcggtggctggacgcgcgcatctacagcgatcctctcgccctcaaggagtttaaggagttcgctgccggccggaagtccctgaccctgaatcttatcacggagatgggccgccttcccacattcatgacccagaagacccgggacgcactggacaatctggcagtgctgcacacggctgaggcggggggtcgcgcttacaaccacgcgctgtctgagctccccgagacgctggagaccctgctcctgctgaccttgctggccacggtcaccggcggcatcttcctgttcctcatgtccggacgggggataggcaagatgacattgggaatgtgctgtatcgtgacggcctcaatcctgctctggtacgcccaaatccagccgcactggatcgccgcatcaatcatcctggagttcttcttaatcgtgttactgattcccgagcccgagaaacagcgcacgccccaggacaaccagctgacgtacgtcgtcatcgccatcctcaccgtggtcgccgccacaatggcgaacgagatgggcttcctggagaagaccaagaaagacctggggctcggcagcatcgctactcagcagcccgaatcaaacatcctggacatcgacctccggcccgccagcgcctggaccttatatgctgtggccaccacatttgtgacgcccatgctgcgccacagcatcgagaacagcagcgtcaacgtgtcgctgacggcgattgcaaatcaggccaccgttctgatgggcctgggtaagggctggcctctgagcaagatggacataggagccccgctcctggccatcggatgctacagccaggtaaaccccatcacactgacggcggctctcttactgttggttgcccactacgccatcatcggacccggactgcaagcgaaggccacccgggaggcccagaagcgcgccgccgcgggcatcatgaagaaccccaccgtagacggaataactgtcatcgatctggacccaattccttacgaccctaagttcgagaagcagctcggccaggtaatgttattggtgctttgtgtcacccaggtgctgatgatgcggaccacctgggccctgtgcgaggcactcaccctggcgacagggcccatcagtaccttgtgggaaggcaaccctgggcgcttttggaataccactatcgccgtatccatggctaacatcttccgggggagctacctcgcgggtgccgggctgctgttctccatcatgaagaacacgacgaacagtagacgcggtactgggaacatcggcgagaccctcggcgagaaatggaagtcccgactgaacgccctgggtaagagcgagttccagatctacaaaaaatccggcatccaagaggtcgaccgcacgctcgccaaagaagggatcaaaagaggggaaaccgaccaccatgcggtgagccgtgggagtgccaagctgcggtggttcgtggaacgcaacatggtcacccccgaagggaaggtggtagacctgggctgcgggcggggcgggtggagctactattgcggcgggctcaaaaacgtccgcgaggttaagggcctgaccaagggggggcctgggcacgaggagcccatcccgatgtccacgtacgggtggaacctggttcgactccaaagcggcgtcgacgtgtttttcatcccgcccgaaaagtgcgacacactcctgtgtgacattggggaatccagtcccaacccgaccgtagaggccggccgtaccttgcgggtcctgaacctggtggagaactggttgaacaacaacacccaattctgcatcaaggtattaaacccctacatgcccagcgtcatcgagaagatggagaccctgcagcgcaagtacggcggggcgctggtgcggaacccgctctcacgcaacagcacccacgagatgtactgggtgtccaatgcaagcggcaacatcgtctccagcgtgaacatgatctccagaatgctgatcaaccgtttcacgatgcggcacaagaaagcgacttacgagcccgacgtggacctggggtcgggcactcgcaacatcggcatcgagtccgagatccccaacctcgacataatcggcaagcggatcgagaagataaagcaggagcacgaaaccagctggcactacgaccaggaccacccgtacaagacgtgggcctatcacggctcctacgagaccaagcagacggggagcgcctccagcatggtcaatggagtggtgcgcctgctgaccaagccgtgggacgtcctccccaccgtgacccaaatggcaatgaccgacaccacccccttcgggcagcaacgcgtgttcaaggagaaggtcgacacgcggacgcaggaacccaaggagggcacaaagaagctgatgaagatcaccgcggaatggctgtggaaggagttgggcaagaagaagaccccgcgcatgtgcacgagagaggaattcacccgcaaggtgcggtccaacgccgctctgggggccatcttcaccgacgagaacaagtggaagtccgcccgtgaggcggtcgaggactcccgattctgggagctagtggacaaggagcgtaacctccacctggagggaaagtgcgagacctgtgtgtacaacatgatggggaaacgggagaagaagctgggcgagttcgggaaggcgaagggctcaagggcgatctggtacatgtggctcggcgcccggttcctggagtttgaggctctaggattcctcaacgaggaccactggttctctcgcgagaacagcctgagcggcgtcgagggggaagggctccaccggctcgggtacatactgcgtgacgtgtccaagaaggagggcggcgcaatgtacgccgacgacacagccgggtgggatacacgtataaccttggaggacctcaagaatgaggagatggtgaccaaccacatggagggagagcacaaaaagctagccgaggccatcttcaagctgacgtaccagaacaaagtcgttcgcgtgcaaaggcccacgccacgggggaccgtcatggacatcatcagccggcgggaccaaaggggctccggccaagtgggaacgtacggcctcaacacgtttaccaacatggaggcccagctgatccgccaaatggagggggagggcgtgttcaagaacatccagcacctgaccgtcaccgaagaaatcgccgtgcagaactggctcgcccgcgtggggcgggagcggctgagccgcatggctatatccggcgatgactgcgtcgtgaagcccctggacgaccgctttgcgagcgccctcacggccctgaacgacatgggcaagatccggaaggacatccagcagtgggagccctcccgcgggtggaacgattggacccaggtgcccttctgctctcaccatttccacgagctgatcatgaaggacggccgagtcctcgtggtgccctgccgcaaccaggacgagctgatcgggagagcccgcatctcccaaggagccggttggagcttacgggagaccgcgtgtctcggcaaatcctacgcccaaatgtggagcctaatgtacttccatcgccgggacctacgcctcgcggccaatgccatctgctcggccgtccccagccattgggtccctacctcccggaccacgtggagcatccacgccaagcatgaatggatgaccaccgaggacatgctgaccgtgtggaaccgcgtctggatccaggagaacccctggatggaggacaagacgcccgtcgagtcctgggaggagatcccctacctgggcaagagagaggatcagtggtgcgggagcctcatcggcctgacctctcgcgcgacctgggctaaaaacatccaggtggccatcaaccaggtccggtccctgatcgggaacgaggagtacaccgactatatgccgagcatgaagcgcttccgccgagaggaggaagaggcaggcgtgctctggtag

SEQ ID NO: 25134 - RNA, 9876 nt, synthetic construct
  misc_feature 1..9876: note = derived and/or modified CDS sequence (opt11) from DENV-2__FJ639831__SS-prME
  source 1..9876: mol_type = other RNA
agcgcgggcatgatcatcatgctaatcccgacagtgatggcattccacttgacgacccgcaatggagagccccacatgatcgtgtctatacaggagaagggcaagagcctgctgttcaagactgaggatggggtgaacatgtgcaccctcatggcgatggaccttggggaactgtgcgaagataccatcacctacaagtgccccctcctgcggcagaacgaacccgaggatatcgactgctggtgcaactccaccagcacctgggtgacgtacgggacgtgcaccaccaccggcgagcaccggagggagaagaggtcggtcgccctggtgccccacgtgggaatgggtctggagacccggaccgagacctggatgagcagcgagggcgcctggaagcacgcccaacgcatcgagacgtggatcctgcggcacccggggttcacgatcatggccgcgatcctggcctataccatcggcaccacccacttccaacgggccttaatcttcatcctgctgacggccgtcgcgcccagcatgaccatgcggtgcatcggtatctccaatcgtgacttcgtggagggcgtgagcggtggatcctgggttgatatcgtgctcgagcacggcagctgcgtgaccaccatggcgaagaacaagcccacgctggattttgaactgataaagaccgaggccaagcagcccgccactctccggaagtattgcatcgaggccaagctgaccaacacgaccaccgagtcccgctgccccactcagggggagccctcgctgaaggaggagcaggacaagcggttcgtttgcaagcattccatcgtggaccgcggctggggcaatggatgtggcctcttcgggaagggcggcattgtgacatgcgcgatgttcacgtgtaagaagaacatggaaggtaaaatcgtccagcccgagaatctggagtacaccatcgtggtgacgccccacagcggtgaggagcacgctgtcggtaatgatacgggcaagcacgggaaggagatcaaggtcacccctcagtccagcgtgacggaggctgagctgaccggctatgggaccgtcacgatggagtgcagccccagaaccggcctcgacttcaacgaaatggtactgctgcaaatggagaacaaggcctggcttgtacaccgccagtggttcctggacctgccccttccctggctgccgggcgccgatacccaggggtctaactggatccagaaggaaaccctggtcacgttcaagaacccccatgcgaagaagcaggacgtcgtagtgctcggaagccaggagggagccatgcataccgccctgaccggcgctactgagatccagatgagtagcggcaacttactgttcacgggccatctgaagtgccggctgagaatggacaagctacaactcaaggggatgtcctacagcatgtgcacagggaagttcaaggtggtcaaggagatcgccgaaacacagcatggcactatcgtgatccgggtacagtacgagggagacggctccccttgcaagattcccttcgagatcatggatctggagaagcgctatgtcttaggcagactcatcacggtgaatccgatcgtgacggagaaggacagccccgtaaacatcgaggcggagccgccgttcggggattcctacatcatcatcggcgtcgagccggggcagctaaaactcaactggttcaagaaggggagcagtatagggcagatgttcgagaccaccatgcgcggcgccaagcgcatggccatcctgggcgatacggcatgggacttcgggagcctaggcggggtgtttacctccatcggcaaggccctccaccaggtcttcggggcgatatacggcgccgccttcagtggcgtgtcttggaccatgaagatcctgatcggggtgatcatcacctggattgggatgaactcacggtctactagcctgtccgtctctctggtgctcgtgggaatcgttaccctgtacctgggcgtgatggtgcaggcagactccgggtgcgtagtcagctggaagaacaaggagctcaagtgcggcagcggcatattcatcaccgacaacgtgcacacgtggacggagcagtacaagttccaacccgagtcccccagcaaacttgcgtctgcgatccagaaggcccaggaggaagggatctgcggtatacgcagcgtcacccgactggagaacctcatgtggaagcagatcacgcccgaacttaaccacatcctggccgagaacgaggtgaaactcaccatcatgactggggacatcaaggggatcatgcaagccgggaaacgctctctgcggccacagcccacagagctgaagtactcatggaagacctggggcaaggcgaagatgttgtccacagagtcacataaccagacgttcctgatcgacggacccgagaccgccgagtgccccaacaccaacagggcctggaactccctggaagtggaagactacgggtttggcgtcttcaccacgaacatctggctcaagctgaaggagaaacaggacgcgttctgcgacagcaagctgatgtccgccgcgatcaaggacaatcgggccgtgcacgctgacatggggtactggatcgagagcgccctcaacgacacgtggaagatcgaaaaggcctccttcattgaggtgaagaactgccactggcccaagagccacactctgtggtccaatggcgtcttggagagcgagatgatcatccccaagaacttggcgggccccgtgtcgcagcacaactaccgcccggggtaccacacccagatcgccggcccctggcacctgggcaagctggagatggacttcgacttctgcgacggcaccacggtggtggtgaccgaggactgcgggaacagaggccccagcctccgcaccacaaccgccagcggcaaactgattaccgagtggtgctgccggtcctgcacactgcccccactccggtatcgcggggaggacgggtgttggtacgggatggagatacgccctctgaaggagaaggaggagaatttagtgaacagcctcgtcacagccggccacgggcagatcgacaacttctcccttggcgtgctgggcatggccctcttcctggaggaaatgctgcggacgcgcgtggggaccaagcacgccatcctcctggtcgccgtgagcttcgtaacactgattaccggcaacatgagtttcaaggacctcgggagggttgtcgtaatggtcggcgccacgatgactgacgacatcgggatgggcgtgacctacctggccctcctcgcggccttcaaagttcgccccaccttcgtcgccggcctactactacggaaattaacgagcaaggagcttatgatgaccacaatcgggatcgtgctcctgtcccagagcaccatccctgaaacgatcctggaactaactgatgccctggccctgggcatgatggtacttaaaatcgtccgcgacatggagaagtaccagctggcggttacaatcatggccatcctgtgtgtcccgaacgccgttatcctgcagaacgcctggaaagtttcctgtactatcctggccgtcgtgagcgtgagccccctgttgctgacgagctcccagcagaagaccgactggatccccctggcgctcaccatcaagggcctgaaccccaccgccatcttcttgacgaccctcagtcgcacgaataagaaacggtcctggccgttgaacgaggccataatggccgtgggcatggtaagcatcctcgcgagtagcctcctgaagaacgacatccccatgaccgggcccctggtggccggcggcttgctgacggtctgttacgtgctgaccggtcgctccgccgatctagagctggagcgggccacagacgtgaagtgggaggatcaggccgagatcagcggctcgtcccccatcctgagcatcaccatctccgaggacgggagcatgtccatcaagaacgaggaggaggagcagacgctcacaattctgatacgaaccggactgctcgtgataagcggcttgttccctgtgtccatccccatcaccgcggccgcctggtacctgtgggaggtcaagaagcagcgggctggggtcctctgggacgtaccctccccaccgcccatgggcaaggccgaactggaggacggggcgtaccgtatcaagcagaagggcgtgctggggtacagtcagattggagccggtgtctacaaggaggggaccttccacacaatgtggcacgtgacccggggcgccgtgctcatgcacaaggggaaaagaatcgaacccagctgggcagacgtcaagaaggacttaatctcctacggcgggggctggaagctggagggcgagtggaaggaaggggaggaggtccaggtgctcgctctcgagcccggaaagaacccccgggcggttcagaccaagcccgggctgttcaagacgaacacgggtaccatcggggccgtgagcctcgatttttcccccggcaccagcggctcccccatcatcgacaagaagggtaaggtagtcggactgtacgggaacggcgtggtaacgcgctcaggcgcatacgtctccgcaatcgcccagacggagaagtccatcgaggacaaccccgacatcgaggatgacatattccggaagcgccggctgaccattatggacctgcacccaggggcgggcaagacaaagcgctacctccccgccatcgtgcgggaggccataaagcgcgggctgcggaccctgatcctcgcccctacgcgcgtggtcgcggccgagatggaggaggcattacggggcctgcccatacgctatcagacgcccgccatccgggccgagcacaccgggagagaaatcgtggacctcatgtgccacgcgacctttacgatgcgcctgctgtccccagttcgggtcccgaactacaacctcatcatcatggacgaggcccacttcaccgaccctgcaagcattgctgcccgcggctacatcagcacccgggtggagatgggggaagcggccgggattttcatgaccgccacgccgcccggctcccgagacccgttcccgcaaagcaacgcccccatcatcgatgaggagcgagagatccccgagcgctcttggaatagcggacacgagtgggttaccgacttcaagggcaagacagtatggttcgttccatccatcaaagccggcaatgacatcgcggcctgccttcggaagaacggcaagaaggtgatccagctgtctcgcaagacctttgactccgagtacgtcaagacgcggaccaacgactgggacttcgtggtgaccaccgacattagcgagatgggcgccaacttcaaggccgagcgcgtcatcgaccccagacggtgcatgaaacctgtgatactcacggacggcgaggagcgggttatccttgctggccctatgccggtaactcactccagcgccgcccaacgccggggacgcatcggccggaatcctaagaacgagaacgaccagtacatctacatgggggagcccctggagaacgatgaggactgcgcccactggaaggaggcaaagatgctcctggacaacatcaacacccccgagggaatcatcccgtctatgttcgagcccgagcgcgaaaaggtagacgcaatcgatggcgagtatcggctgcgcggggaggcccgcaagacattcgtagacctgatgcgtcgaggcgacctacccgtctggctggcctataaggttgccgccgagggaattaactacgcagaccggcgctggtgcttcgacggcatcaagaacaaccagatcctcgaagagaatgtcgaggtggagatctggacgaaggagggggagcggaaaaagctgaaaccgcgctggctcgacgcccggatctacagcgaccccctcgccctgaaggagttcaaggagttcgccgccggccgcaagtcccttaccctcaacctgattaccgagatgggtcggctgcccaccttcatgacccaaaagacccgcgacgcactcgacaacctggccgtgctgcacactgccgaggccgggggccgggcctacaaccacgcactcagcgaactgcccgaaaccctggagacactcctgctgttgaccctgctggccaccgtaaccggaggcatcttcctattccttatgtccggaagagggatcggcaagatgaccctgggcatgtgctgtattattactgcctctatacttctgtggtacgcgcaaatccagcctcactggatcgctgcctccatcatcctggagttctttctcatcgtgctgctgatccccgaaccagaaaagcagcgcacgccgcaggataaccagctcacctacgtggtcatcgccatcctgaccgtcgtggccgcgacgatggcgaacgaaatgggattcctggagaagaccaagaaggacctcgggctgggcagcataaccacccagcagccggaatccaacatactggacatcgaccttcgtcccgcgagcgcctggacgctttatgccgtggcgaccaccttcgtcacccccatgctgcggcacagtatcgagaactcctctgttaacgtctccctcacggcgatcgccaatcaggccaccgtgctgatgggcctaggcaagggctggccgctcagcaagatggacatcggggtgccgcttctggcaatcggctgctactcccaggtcaaccccatcacccttacggccgcgttactgctcctggttgcccactacgccatcatcgggccaggcttgcaggccaaggcgacgcgcgaagcccagaagcgggccgccgccggcattatgaagaaccccaccgtcgacggtatcaccgtcatcgacctcgaccctatcccgtacgaccccaagttcgaaaagcagctcggtcaggtgatgctgctcgtgctgtgcgtcacccaggtgctgatgatgcgcactacctgggccatgtgcgaggcactcactctggccaccgggcccatcagcacgctgtgggagggcaatccggggcgcttctggaacacaaccatcgccgtgtctatggccaacatcttccggggcagctacctggcgggtgccgggctgctgttcagtatcatgaagaacacaactaacacacggcgcggcaccggcaacatcggcgagaccctaggagagaagtggaagtcccgactgaacgccctggggaaatccgagttccagatctacaaaaagtccggaatccaggaagtcgaccgaacgctagcaaaggaggggatcaagcgaggcgagaccgaccaccatgccgtttcccgggggagcgcgaagctcaggtggtttgtcgagcggaacatggtcacccccgagggcaaagtggtggacctgggatgcgggcgtggcgggtggtcctactactgcggcgggctcaagaacgtccgagaggtgaaaggactgaccaagggagggcccggccacgaagaacccattccgatgagcacgtatgggtggaacttagtacgcctccaaagcggcgtcgacgtgttctttatcccgcccgagaagtgcgacaccctgctgtgcgatatcggcgagagctcccccaacccgaccgtggaggccggccgtaccctccgcgtcctgaacctggttgagaactggttaaacaacaacacccagttctgcataaaagtgctgaacccctacatgcccagcgtcatcgagaagatggagacgctgcagcggaaatacggcggggccctggtgcgcaacccattaagccgtaactccacccacgagatgtactgggtcagcaacgcctccggcaatatcgtcagctccgtaaatatgatcagccgcatgctgattaaccgtttcaccatgcgacacaagaaaaccacgtatgagcccgacgtggatctagggtccgggaccaggaacatcgggatcgagagcgaaatacccaatctcgacatcatcggcaagcgcatcgagaagatcaagcaggagcatgagacttcctggcactacgaccaggaccacccctacaaaacctgggcgtaccacggcagctacgagacgaagcaaaccgggtccgccagctccatggtgaacggtgtggtgcggctgctgaccaaaccatgggacgtcctccccaccgtgacgcagatggcaatgaccgacaccacccccttcgggcagcagcgcgtgtttaaggagaaggtcgacacgcgcacccaggagcccaaggagggtacaaagaagctgatgaaaattaccgccgagtggctgtggaaggagctcggcaagaaaaagacgccgcggatgtgcacccgcgaggagttcacccggaaggtgcgcagcaacgcggcgctgggagccatcttcaccgacgaaaacaagtggaagtctgcccgggaggccgtcgaggactcccgcttctgggaactggtggataaggagcggaagctccacctggagggaaagtgcgaaacatgcgtgtacaatatgatggggaagcgagagaagaagctgggcgagttcgggaaagccaagggctcacgggccatctggtacatgtggctgggggcccgcttcctggagttcgaggccctggggttcctcaacgaggaccactggttctcacgcgagaactccctgagtggcgtcgaaggggagggcttacacaagctcgggtacatcctgcgcgatgtgagcaagaaggaagggggcgccatgtatgccgacgacacagccgggtgggacacgcggatcacgctggaggacctcaagaacgaggagatggtgacgaaccacatggaaggcgaacacaagaagctggcagaagccatattcaagctgacctatcagaacaaggtcgtgcgcgtacaacgtcccacgccccgggggaccgtcatggacatcatctcccggcgcgaccaacgaggcagcggccaggtgggtacgtatggcctcaacaccttcaccaacatggaagcccagcttatccgccagatggagggggagggcgtgttcaagaacattcagcatctgaccgttaccgaggagattgctgtgcagaactggctcgcccgggtggggcgcgagcgcctgtcccggatggccatctctggcgacgactgcgtcgtgaagccactagacgaccgtttcgcttccgccctcactgcgctgaacgatatgggcaagatacggaaggacatccagcagtgggagccgagccgcggatggaatgactggacgcaggttcccttctgctcccatcacttccacgaactgatcatgaaggatggccgagtgctcgtggtgccctgccgcaaccaggacgagctgatcggtagggcccggatcagtcagggcgccgggtggtccctgcgggaaacggcttgcctaggcaagtcgtacgcacagatgtggtccctcatctacttccaccgccgggacctgcgcctcgccgccaacgccatctgctctgccgtcccctcccactgggtgccgacgagccggacgacgtggtcgatccacgccaagcatgagtggatgaccacagaagacatgctgactgtatggaaccgggtctggattcaggagaacccctggatggaggataagacacccgtcgaaagttgggaggagatcccctacctggggaagcgggaggatcagtggtgtggatcccttataggcctgaccagccgcgctacgtgggccaagaacatccagaccgctatcaaccaggtgcggagcctgatcgggaacgaggagtacaccgactacatgccatccatgaagcgtttccggcgcgaggaggaggaggccggcgtgctctggtga

SEQ ID NO: 25135 - RNA, 9876 nt, synthetic construct
  misc_feature 1..9876: note = derived and/or modified CDS sequence (opt11) from DENV-2__FJ639832__SS-prME
  source 1..9876: mol_type = other RNA
agcgccggcatgatcataatgctgatcccaacagtgatggcgttccacttaacaacccgtaatggagagcctcacatgattgtcgggattcaggaaaaggggaagtctttactgttcaaaacagaggacggtgtgaatatgtgcacactcatggcaatggacctaggggagctgtgcgaagacaccatcacctacaagtgtcccctcttgagacaaaacgaacccgaggacatagattgctggtgcaacagtaccagcacctgggtgacctatgggacctgcaccaccactggggaacaccgccgagagaaacgaagcgtggccctagtcccccacgtaggaatgggccttgagacccggactgagacatggatgtccagcgaaggagcctggaaacacgcccaacgtattgagacgtggatcctgcggcacccggggttcacgatcatggccgcaatcctagcgtacacaatcggcacaacccacttccagcgggtcttaattttcatactgttgacggccgtcgccccgtccatgaccatgcggtgcatcgggatctccaatagggactttgtggagggcgtctccggaggcagctgggttgacatcgtgttagagcatgggtcctgcgtcaccacgatggctaagaataagcccacgctagacttcgaacttatcaaaaccgaagctaagcagcccgccaccttacggaagtattgcatcgaagcgaagcttaccaatacgaccacggagagccgctgtcccacccagggcgagccttctctaaaggaagagcaggacaagagattcgtgtgcaagcacagcatggtggaccgaggctggggcaacggctgcggcctgttcgggaagggaggtattgtaacctgtgctatgtttacgtgtaagaagaacatggaaggcaaaatagtgcagcccgagaacctcgagtacaccatcgtggtcacgccacactcgggtgaggagcacgctgtgggcaatgacacggggaagcatggcaaggaaatcaaggtgactccccagagctcgatcaccgaggccgaattgacgggttacggcaccgtcacaatggagtgcagccctcggactgggctcgatttcaatgagatggtgttgctgcagatggagaacaaggcctggttagtgcaccgccagtggttccttgacctgccgctaccatggttaccaggagcagataagcaggagtctaattggattcagaaagagaccctagtgaccttcaagaaccctcacgccaaaaagcaggacgtcgtcgttctcggaagtcaggagggcgcaatgcatactgccctgaccggcgccactgagatccagatgagctcagggaacctcctttttaccggtcatctgaagtgcagactccgcatggacaaactccagctgaagggaatgagctactccatgtgcacagggaaatttaaggtggtcaaggagatcgctgagacccagcacggcaccatcgtgatcagagttcagtatgagggggatggcagtccatgcaagatccccttcgaaataatggacctggaaaagaggtacgtcctcggccggttgatcacagtgaacccaatcgtgacggagaaggacagcccggtgaacatcgaggcggagccgccgttcggggacagctatatcatcatcggcgtggaaccagggcagctaaagctaaactggtttaaaaagggctcgagcatcggtcaaatgttcgagaccaccatgcgtggcgcaaaacgcatggccatcctgggcgacaccgcctgggacttcgggtccctgggcggtgtgttcacgagcataggcaaagccctacaccaagtttttggcgctatctacggtgcggctttctccggcgtgtcgtggaccatgaagatccttatcggcgtgatcatcacctggatcggcatgaactcgcgtagcacctcccttagcgtctcactggtccttgtgggtatagttacactgtacctaggcgtgatggtgcaggcggatagtgggtgtgtcgtgtcctggaaaaacaaggagctaaagtgtggcagcggcatcttcatcaccgacaacgtgcacacctggacggaacagtataaattccagcccgagagcccctcaaagctcgcgtcggcaatccaaaaggctcaggaggaggggatatgcggcatacggtccgttacgcgcctggagaacctcatgtggaagcaaatcacgcccgagctcaaccacatcctggccgagaacgaggtgaaactaaccatcatgaccggggacatcaagggaattatgcaggccgggaagagatccctgcggcctcaacccaccgaattaaagtatagttggaagacctggggcaaggccaagatgctgagcaccgaatcttacaaccagacatttctcatagacggtcccgagacggctgagtgccctaacacgaaccgcgcctggaattccctggaagtagaggactatggctttggagtgttcaccaccaacatatggttgaagttaaaggagaagcaggacgccttctgcgattccaagctgatgagcgcggcgatcaaggacaaccgggccgtgcatgccgatatggggtactggatcgagtcggccttgaacgacacatggaaaatcgagaaagccagcttcatcgaagttaagaactgtcactggcctaagtctcacacgctgtggtccaacggtgtgctggaaagcgagatgataatccccaagaacctcgccggcccagtaagccagcacaactatcgcccggggtaccacacgcagatcgcggggccgtggcatctggggaagttggagatggatttcgacttctgtgacgggacaaccgtgatcgtcacggaggactgtggcaatcggggcccgtctctccgtactaccaccgcttcaggaaagctgataacggagtggtgttgccggagttgcaccttaccgccgctacgttaccgcggggaagacggctgctggtatgggatggagattcgccccctgaaggagaaggaggagaacctagtgaacagtctcgttaccgccggccacgggcaggtcgacaacttcagcctgggcgtgctgggcatggccctcttcctcgaggagatgctgcgtacccgcgttggaacgaaacacgccatcctcctggtcgccgtgtcctttgtgacgttaatcactggcaacatgtcattcaaggacttagggagagtcgtggtgatggtcggcgcgactatggcagacgacatcgggatgggtgtaacatacttggcccttctcgcagccttcaaagtgcgccccacgtttgcagccggtctgctgctccggaagttgacctccaaggaattgatgatgaccacgatcgggatcgtactactctcgcaatctaccattccagaaaccgtgttggaactcaccgacgcactggcgctgggaatgatggtgctcaaaatagttcgcaacatggagaagtaccaactggccgtgactatcatggccattctatgcgtgccgaacgccgtgatcctccagaatgcatggaaggtcagctgtacaatactggctgtcgtgtccgtttcccccctgctcctgacctccagccagcagaagaccgactggatacctctggccctgacgatcaaggggttaaacccgaccgccatttttttgaccaccctgtccaggacgaacaagaagcggtcgtggcccctgaatgaagccatcatggccgtcggcatggtctccatcctggccagctcgctcttgaagaatgacatacccatgacgggccccctggtggccgggggccttctgaccgtctgttatgtgctgactgggcgtagtgcagacctcgagcttgaacgggccacggacgtgaaatgggaggaccaggccgagatctccggtagcagccccatcctgtccatcactataagcgaggacgggtccatgagcatcaaaaacgaagaggaggagcaaactctgaccattttgatccgcaccggattgttagtcattagtggcctatttcctatcagcatccccattaccgccgctgcctggtacctctgggaagtgaaaaaacagcgggcgggggttctctgggacgtgccctccccgcctccgatgggcaaggcggagctggaagacggggcctaccgcatcaaacaaaaaggcatcctggggtattcacagataggggctggcgtgtacaaggaggggaccttccataccatgtggcacgtgacccggggagcagtcctcatgcataagggcaagcgcatcgagccctcgtgggccgacgtgaagaaggaccttattagttacggcgggggctggaagctggagggcgaatggaaagagggggaagaggtgcaagtactggctctggaacctggcaagaatccccgggcagtgcagacgaagccagggctgttcaaaacgaacaccggcaccattggggctgtgagcttggacttttctcccggcacatccggcagccccataatagataagaaaggcaaggtcgtgggcctgtatgggaacggagtggttacacgttccggcgcctacgtgagcgccatcgcacagaccgagaagagcatcgaggataaccccgaaatcgaggatgatatcttcagaaagagacgtctgaccatcatggacttgcatcccggtgctggaaaaacgaagcgttacttacccgccatcgtcagggaggccatcaagcgcggcctacggaccctgatcctcgcaccgacacgagtcgtggctgccgagatggaggaagccctccgtggtctgccgattcgctaccagacccccgccatacgggcagagcacacggggcgcgagatagtggacctcatgtgccacgccaccttcaccatgcgtctgttgagcccggttcgggtgccaaactacaacttaataatcatggatgaggcccattttaccgaccccgcgtctatagccgcccgcggctatatctccacgcgggtggagatgggcgaagccgctgggatcttcatgaccgctacaccccccggtagccgggaccccttcccgcagtccaacgctcccattatcgacgaagagcgggaaatacccgagcgctcgtggaactcagggcacgaatgggtaacagactttaaaggcaaaaccgtgtggttcgtgcctagcatcaaggctggcaatgacatcgccgcctgccttagaaaaaatggcaaaaaagtcattcagctgtcccggaaaacattcgactcagagtatgtgaagacccggactaacgattgggacttcgtggttacgacggacatctcggagatgggggcaaacttcaaggcggaacgggtaattgacccccgccgctgcatgaagcccgtgatcctcactgacggtgaagagagggtaattctggcgggacccatgccagtcacccatagctcagccgcccagaggcgcggacggatcggccggaatccgaagaacgagaacgaccagtacatatacatgggggagccccttgagaatgatgaggactgcgcccactggaaagaggccaagatgctgctggacaatataaacacgcctgagggcatcatcccgagtatgtttgagcccgagcgagagaaagtggacgccatagacggcgagtaccggctgcgcggggaggcccggaagacgttcgttgacctcatgaggagaggcgacctgcctgtgtggctggcctacaaggtggccgctgagggtattaattacgccgaccgtcgctggtgcttcgacggtatcaagaacaaccagattctcgaggagaacgtcgaggttgaaatatggaccaaagagggggagcggaagaagctgaagcctcgctggctggacgcaagaatatattccgatcccctagctttgaaggaatttaaggaattcgccgcgggccgcaagtcactcacgttaaacctgatcacagagatgggccgactgcccaccttcatgacccaaaagacccgcgatgcactggacaacctcgccgtcctacacacagccgaagcgggcgggcgggcttataaccatgccctcagtgagctgcctgaaacgttagagacgctcttgctgctcaccctgcttgccaccgtgaccggggggatttttttgttcctcatgagtggccgtgggatcgggaagatgacccttgggatgtgttgtatcattaccgcctccatcctgctgtggtatgcgcagatacagccacattggatcgccgccagcataatccttgaattcttcctcatcgtactgctgatccccgaacccgagaagcagaggactcctcaggacaaccaactaacgtacgtggttattgctattcttaccgtggtggcggcgaccatggccaacgaaatggggttcctggagaagaccaagaaggacctggggctgggctccatcgcaacgcagcagccggagagcaatatcctggacatagaccttcgaccggcctcagcctggactctgtacgctgtcgccacgacattcgtaacccccatgctgcggcacagcattgagaatagctctgtcaatgtgtcactcaccgcaatcgctaatcaagccacagtgcttatgggactggggaagggctggcccctaagtaaaatggatatcggggtcccgctcctggcgatcggctgctacagccaggtgaaccccatcaccctgacagctgcccttctgctcctggtcgcgcactatgcgatcatagggcctgggctgcaggccaaggccacccgcgaggcgcagaagcgggccgccgctggaatcatgaagaatccaaccgtcgacggcataaccgtgatcgaccttgacccgatcccctacgacccaaagttcgagaagcagctagggcaagttatgctgctgattctgtgtgtcactcaagtgctgatgatgcgtacgacctgggccctctgtgaggccctaaccctggcaacggggcccatatctacgctctgggagggcaaccctggccgcttctggaacacaaccatcgcggtttctatggccaatatcttccgcgggtcatacctggccggcgctgggcttctattcagtataatgaagaacacgaccaatacccggaggggcacggggaacatcggggaaactttaggcgaaaaatggaagagcagactgaacgcactagggaagtccgagttccaaatttacaaaaagtccggcatccaagaggtcgaccggaccctggcgaaagaggggatcaagcggggcgaaaccgaccaccatgcggtatcccgtggttcggcaaagctgcgctggtttgtggagcggaacatggttacccccgagggcaaagttgtggatcttggttgtggtagaggcgggtggtcctactactgcgggggtctgaagaatgtccgggaggtaaaggggctgactaaaggcgggcccggtcacgaggaaccaatacctatgagtacttacgggtggaatctcgtgcgtctgcagagcggcgtggacgtattcttcatcccccccgagaagtgcgacacccttctctgtgacattggggagtctagccccaacccgactgtggaagccggtcgcacgctgcgcgtccttaacctcgtggagaactggctgaataacaatacccagttctgcataaaagtgttgaacccctatatgcctagtgtcatagagaaaatggaggcgcttcagcggaagtacggtggggcactcgtgaggaatcctctcagcaggaacagcacacacgagatgtattgggtttccaacgcgagcggcaacattgtatctagcgtgaacatgatcagtcgaatgctgatcaaccgctttacaatgcgacacaagaaagccacttacgaacccgacgtggacctaggaagcggaacgcgaaacattggcatcgagagcgaagtccccaacctggacatcataggcaaacgcatcgaaaaaataaagcaggagcacgagacaagttggcactacgatcaggaccacccctacaagacctgggcctatcacggcagttacgagactaaacagacggggtcggcttcaagcatggtgaacggcgtggtccggctgctcaccaaaccgtgggacgtgctgcccaccgttacccagatggccatgacggacaccacccccttcgggcagcaacgggttttcaaggagaaggtagacacccgcacacaggagcctaaagagggcacgaagaagctgatgaagatcaccgcagagtggttatggaaggagctggggaagaaaaagacgccacggatgtgcacgagagaggagttcacgcggaaagtccgctctaacgctgccctcggggcgatcttcaccgacgagaacaagtggaagtcagctcgcgaggccgtggaggacagccgattctgggagcttgtggacaaagagcgcaatctgcacctggaggggaagtgtgagacatgcgtctacaacatgatggggaagcgcgaaaagaaattgggcgagttcgggaaggcgaaaggctcccgggccatctggtacatgtggctcggcgcgcgctttctagagttcgaggcgctaggtttcctaaacgaggaccactggttctcccgggagaactccctgtccggcgtggagggggaaggcctccacaagttagggtacatactccgggacgtgagcaagaaagagggtggggccatgtacgccgatgatacggctggatgggacacaaggatcacgttggaggacctaaagaacgaggagatggtcacgaatcacatggaaggggagcataaaaaactggccgaggccatcttcaagctcacgtaccagaacaaggtagtgcgcgtccagcggccgacgccccgggggacagtgatggacatcattagccgccgagaccaacgtggctccggacaggtggggacctacgggctgaatacgtttactaacatggaagcgcagctgatccgccaaatggagggggagggagtcttcaaaaacatccaacatttaactgtcacagaggaagtggccgtccagaactggctcgcccgggtggggcgcgaaaggctgtctcgaatggccatctccggggacgactgtgtggtcaagccactcgacgaccgcttcgccaacgccttgaccgcgctgaacgacatgggcaagataaggaaggacatccaacagtgggagcctagcaagggctggaatgactggactcaggtcccattttgcagccatcacttccacgagctcataatgaaagatggccgagtgttagtcgtgccctgccggaaccaggacgagctgatcgggcgcgcgcggattagccagggcgcaggttggtccttgcgtgaaacagcttgtctgggcaagagctacgcccagatgtggtctctaatgtacttccacagacgcgacctcagactagcagccaacgctatatgctcagccgtgccgagccactgggtgccgaccagccgcacgacctggtcaatacacgccaagcatgaatggatgacgacagaggacatgctgaccgtatggaaccgagtgtggatcagagagaacccctggatggaggacaaaacgcctgtggagagctgggaggaaataccctaccttgggaagcgggaggaccagtggtgcggtagcctgatagggctaacgagccgcgcaacctgggctaaaaacatccaggcggccatcaaccaggtgcgatccctcattgggaacgaggagtacaccgattacatgccgagcatgaagcggttccggcgcgaggaggaggaagccggcgttctgtggtga

SEQ ID NO: 25136 - RNA, 9876 nt, synthetic construct
  misc_feature 1..9876: note = derived and/or modified CDS sequence (opt11) from DENV-2__FJ687434__SS-prME
  source 1..9876: mol_type = other RNA
agcgtgggcatgataataatgttaatacccaccgtcatggccttccatttaaccacccgcaatggggagccccacatgatcgtctccatccaggagaagggcaagagcctgcttttcaagaccgaggacggcgtgaacatgtgcaccctcatggccatggacctgggcgaactgtgcgaggacaccatcacctacaagtgccccctcctgcgtcagaacgaacccgaggacatcgactgctggtgtaactccaccagcacctgggtcacctacgggacgtgcaccaccaccggcgagcaccgaagagaaaagcgctccgtggcgctggtccctcacgtcggtatggggctagaaacgaggaccgagacctggatgagctccgaaggcgcctggaagcacgcccagcgcatagagacctggatcctacgccacccggggttcacgatcatggctgccatcttagcgtacaccatcggcaccacccacttccagcgcacgctcatcttcatcctgctgaccgccgtcgcccccagcatgaccatgcggtgcatcgggatctccaaccgcgacttcgtggagggcgttagcggcgggtcctgggtggatatcgtcctcgaacacggcagctgcgtgaccacgatggccaagaacaagcccaccctggacttcgagctgatcaagacagaggcgaaacagcccgccaccctccggaaatactgcatagaggcccgtctgacgaacaccaccaccgagtcccgttgccccacgcagggggagcccagtcttaaggaggagcaggacaagcgcttcgtgtgcaagcacagcatggtcgaccgggggtggggcaacgggtgcggcctcttcgggaagggcgggattgtgacctgcgccatgttcacctgtaagaagaacatggagggcaagatcgtccagcccgagaacctggagtacaccatcgtggtcacgccccacagcggcgaggagcatgccgtcgggaacgacaccggcaaacacgggaaggagatcaaggtgaccccgcagagtagcatcaccgaggcagagctgaccggctacggaacggtcaccatggaatgcagcccaagaaccagcctggatttcaatgagatggtgctcctgcagatggagaataaggcctggctcgtgcatcggcagtggttcctggacctgcccctcccctggctgccaggcgccgacacccagggcagcaactggattcagaaggagacgctggtcacattcaagaacccccacgccaagaagcaggacgtcgtcgtcctcgggtcccaggagggcgccatgcacaccgcgctgacgggggccacggagatccagatgagctccggcaaccttctgtttaccgggcacctaaagtgccgccttcggatggacaagctccaactgaagggcatgtcatactccatgtgcaccggcaagttcaaggtggtaaaggagatcgccgaaacgcagcacgggacgatcgtgatccgcgtccagtacgagggcgacggaagcccctgtaagatccccttcgagatcatggacttagagaagcggtatgtcctcggccgcctaatcaccgtgaacccgattgtgacggagaaggactcccctgtcaacatcgaggccgagccgcccttcggcgacagctacatcatcatcggggtggagccgggccagctgaagctcaactggtttaaaaaggggagcagcatcggccagatgttcgagaccacgatgcgcggggcgaagagaatggcgatcctgggcgacaccgcctgggacttcgggtccctcggcggggtgtttaccagcatcggcaaggccctccatcaggtcttcggtgcgatctacggggccgctttctccggcgtaagctggaccatgaagatcctgatcggcgtgatcatcacctggatcggaatgaactcccgcagcacctctctgtctgtctcgctggtgctcgtgggcgtcgtgaccctgtatctgggggtgatggtccaggccgacagcggctgcgtagtgagctggaagaacaaggagctcaagtgcgggagtggcatattcatcacagacaacgtccacacatggacggagcagtacaagttccagcctgagagcccctccaagctggcctctgccattcagaaggcgcaggaggagggtatctgcgggatccggtccgtgacccgcttggagaacctcatgtggaagcagatcacccccgaactgaaccacatcttggccgagaacgaggtgaagctcacgatcatgacgggcgacatcaaggggatcatgcaagccggcaagcggagcctgcgcccgcagcccaccgagctgaagtactcgtggaagacctggggaaaggccaaaatgctcagcacggagtcccacaaccagaccttcctgattgacggccccgagaccgccgaatgcccgaacaccaaccgggcgtggaacagcttagaggtcgaggactacggcttcggcgtgttcacgaccaacatctggctgaagttgaaggagaagcaggacgcgttctgcgactccaagctgatgagcgccgccatcaaggacaaccgcgccgtgcacgctgatatgggatactggatcgagtccgcccttaacgacacgtggaagatcgagaaggctagcttcatcgaggtgaagaactgtcactggccgaagtcccacaccctttggtcaaacggggtgctggagtccgagatgattatccccaagaacctcgccggccctgtgagccagcacaactaccggcccggctaccacacccagatcgccgggccctggcacctgggcaagctagagatggacttcgacttctgcgatgggacgaccgtcgtggtgaccgaggactgcggcaaccgtgggccctccctgcggaccacgaccgcgtccgggaagctgataacagagtggtgctgccgcagctgcaccctgcccccgctccgttaccggggcgaggacgggtgctggtacggcatggagatccggcccctgaaggagaaagaggagaacttagtcaactccctcgtgacagccgggcacggccaggtcgacaacttcagcctgggggtcctgggcatggccctcttcttggaggagatgctgcgcacccgggtggggaccaagcacgccatcctcctggtggcggtgtcattcgtgaccctgatcacggggaacatgagcttcaaggacctcggccgggtggtcgttatggtcggggccactatgacggacgacatcggcatgggtgtcacctacctggccctgctcgccgctttcaaggtgcggcccacgttcgcggcgggactgctgctccgcaagctaacctccaaggagctgatgatgaccaccatcgggatcgtgttactgagccagtccacgatcccagaaaccatcctggagctcaccgacgcattagcactggggatgatggtcctcaagatggtgcgcgacatggagaagtaccagctggccgtcaccatcatggcgatcctgtgcgtgcccaacgccgtgatcctccagaacgcctggaaggtcagctgcacgatcctggccgtggtgtccgtcagccccctcctcctgacctcctcccagcagaagacagactggatacccctggccctaacgatcaagggtctgaatcccacggctatctttctgaccaccctctccagaacaaacaaaaagcgcagctggccgttaaacgaggcgatcatggcggtggggatggtgtcgatccttgccagctccctcttgaagaacgatatcccaatgacgggtcccctggtcgcgggcgggctcctgaccgtatgctacgtgctaaccggccggagcgcggacctcgagctagagcgcgccactgacgtcaagtgggaggatcaggcggagatcagcggatccagccccatcctctcaatcactatctccgaggacggctccatgagcatcaagaacgaggaggaggagcagaccctcaccattctgatccggactgggctgttggtgatcagtggtctgttcccggtgagcatacccatcaccgctgcagcctggtacctgtgggaagtcaagaagcagagggccggcgttctctgggacgtgcccagcccaccgcccatggggaaggccgagctagaagacggtgcctaccggatcaagcagcgcgggatcctgggctacagccaaattggggcaggtgtctacaaggagggcacgttccataccatgtggcatgtaaccagaggggctgtgctcatgcacaagggcaagcgcatcgagccgtcctgggccgacgtcaagaaggacctgatcagctacgggggtgggtggaagctggagggcgagtggaaggagggcgaggaggttcaggtgctcgccctggagcccggcaaaaacccccgggccgtgcaaaccaagccaggcctgttcaagacgaacaccgggaccatcggcgcggtctctctcgacttcagcccggggacctccggcagccccatcattgacaagaagggcaaggttgtcgggctgtatggcaacggagtggtgacgcgctccggcgcctacgttagcgcaatcgcccagaccgagaagagcatagaggacaaccccgacatcgaggacgacatattccggaagcgccggctgaccataatggacctgcaccccggcgccggcaagaccaagcgctacctgcccgcgatcgtgcgggaggccatcaagcgcggcctgcggacgctgatcctcgccccgacccgcgtggtggcagcggagatggaggaggccctgcgggggctgcccatcaggtaccaaacccccgccatccgggccgagcacaccggccgggagatcgtagacctcatgtgccacgccacgttcaccatgcgcctgctgagcccagttcgggtcccgaactacaacctcatcatcatggacgaggcgcatttcacggaccccgccagcatcgccgcccgcgggtacatctccacacgggtggaaatgggcgaggccgcggggatcttcatgacggccacgccgcccgggagccgcgacccgttcccccagtcgaacgcccccatcatagatgaagagcgggagatccccgagcgcagctggaactccggtcacgagtgggttaccgacttcaagggtaagaccgtttggtttgtgccgagcattaaggcaggcaacgacatagccgcgtgcctgcgtaagaacgggaagaaggtcatccagctgtcccgcaagacgttcgactctgagtatgtcaagacccggaccaacgactgggatttcgtggtgaccacggacatctccgagatgggcgccaacttcaaggccgaaagagtcatcgaccccagacgctgcatgaagcccgtgatcctcaccgacggcgaggagagggtgatactggccgggcccatgcctgttacccacagctcggcggcccagcgccggggcaggatcgggaggaaccccaagaacgagaacgaccagtacatctacatgggtgagcccctggagaacgacgaagactgcgcccactggaaggaggccaagatgctcctggacaacatcaacacacccgaggggatcatcccgagcatgttcgagcccgagagggagaaagtcgatgccatcgacggcgagtaccgcctgcggggcgaggcgcgcaagacgttcgtagacctcatgcgacgaggggatttgcctgtctggctggcctacaaggtggcggccgagggcatcaactatgcagaccggcgctggtgcttcgatgggattaagaacaaccagatcttagaggagaacgtcgaggtcgaaatctggaccaaggagggagagaggaagaagctgaagccgcgctggctcgacgcgcggatctactccgatcccctcgccctgaaggagtttaaggagttcgccgccgggcgcaagagcctgaccctcaacctgatcaccgagatgggccgactgcccacgttcatgacccagaagacacgtgacgccctcgacaacctggcggtactgcacaccgccgaggccggcgggcgggcctataaccatgcgctctccgagctgcccgagacacttgagaccctcctgctgctcaccctgctggccaccgtcaccggcggtatcttcctcttcctgatgagcggccgcggcatcgggaagatgacgctgggcatgtgctgtatcgtaaccgcatccatcctcctgtggtatgcccagatccagccgcactggatagccgcgtcaattatcctggagttcttcctcattgtgttattaatccccgagcccgagaagcagcggaccccccaggacaaccagttgacttacgtcgtgatcgccatcctgacggtggttgcggccaccatggcaaacgagatggggttcctggagaagaccaaaaaggacctcggtctaggctccatagccacccagcagccggagagcaacatcttggacatcgacctccgacccgccagcgcctggacgctatacgctgtggccaccactttcgtcaccccaatgctgcggcactccattgagaacagctccgtcaacgtgagcctcacggccattgccaatcaggccaccgtgctgatgggtctcggcaagggctggcccctcagcaagatggacatcggcgccccgctgctggccattgggtgctacagccaggtcaaccccatcaccctcacggccgccttgctgctcctagtggcccactacgccattatcggccccgggttgcaggccaaagcgacgcgagaagcccagaaacgggccgccgcgggcatcatgaagaaccccaccgtggacggcatcaccgtcatcgacctcgacccgatcccctacgaccccaagttcgagaaacagcttgggcaggccatgctgctcgtgctgtgcgtgacccaggtcctgatgatgcgcacgacctgggcactctgcgaggccctgaccctagccaccggacccatcagtacgctctgggaggggaacccgggccggttctggaacaccaccatcgcggtgagcatggctaacatcttccgcgggtcctacctggcgggcgccggcctcctgttcagcataatgaagaacaccaccaactctcgtcgggggaccggcaacatcggagagaccctgggcgagaaatggaagtcccgcctgaacgccctcggcaagtccgagttccagatctacaagaagtcagggatccaggaagtggaccggaccttggcgaaggagggcattaagcgcggggagacggaccaccacgccgtctcacggggaagcgcaaagttacgatggttcgtggagagaaacatggtgactcccgaggggaaggtcgtggacctcggttgcggccgcgggggctggtcctactactgcgggggccttaagaacgtgcgggaggtcaaaggtctgactaagggggggccggggcacgaggagcccatcccgatgagcacctacggctggaacctcgtgcgcctgcagagtggggtggacgtcttctttatcccccccgagaaatgcgacacgttactctgcgacatcggcgagagcagcccaaacccgaccgtggaggccgggcggaccctgcgcgtgctgaacctggtcgagaactggctgaacaacaacacacagttttgcatcaaggtactgaacccctacatgccctccgtgatcgagaaaatggagaccttgcagagaaagtacggtggagcgctcgtcagaaacccgctgagccggaactccacccacgagatgtactgggtgagcaatgcatccgggaacattgtgagctccgtcaacatgatctctcgcatgctgatcaaccggttcaccatgcgccacaagaaggcaacctacgagccggacgtagatctcggctccggtacccggaacatcggcatcgagagcgagatccccaacctggacattatcgggaagcggatcgagaagatcaagcaggagcacgaaacgtcctggcactacgaccaggaccatccctacaagacatgggcataccacggctcttacgagaccaagcagaccggctccgccagctccatggtgaacggggtcgtgcgcctgctcacgaagccgtgggacgttctgcccaccgtaacccagatggcgatgacagacaccacccccttcggccagcagcgggtgttcaaggagaaggtagacacccgcacccaggagcccaaggaggggactaagaagctgatgaaaatcaccgcggagtggctctggaaggagctgggcaagaagaagaccccgcgtatgtgcacccgcgaggagttcacgcggaaagtccgcagcaacgccgccctgggggcgatcttcacggacgagaacaagtggaagtccgcacgggaagctgtggaggacagccgcttctgggagctcgtagataaggagcgcaacctgcacttagaggggaagtgcgagacctgcgtgtacaacatgatggggaagcgcgagaagaagttgggggagttcggcaaggctaaggggtcccgggccatctggtacatgtggttaggcgctcgcttcctggaattcgaggcgctgggcttcctcaacgaggaccactggttcagccgggagaacagcctgtccggggtggaaggcgaagggctccacaagctgggctatatcctgcgcgatgtgagcaagaaggaaggcggggccatgtacgccgacgacaccgccgggtgggacactaggatcaccctcgaagatctgaagaacgaggagatggtgaccaaccacatggagggggagcataagaagctcgcggaggcgatcttcaagctcacctaccagaacaaggttgtacgcgtgcagcggcccaccccccgcggcaccgtgatggacatcatctcccggagggaccagcggggcagcggccaggtcgggacctacgggctgaacaccttcacgaacatggaggcccagctgatccgccagatggaaggggagggtgtattcaagaacatccagcacttgaccgtgactgaggagatcgccgtccaaaactggctggcacgcgtgggccgggagcgcctgtcccggatggcgatcagcggggacgactgcgtggtcaagcccctcgacgaccgcttcgcttccgccctgaccgccctgaacgatatggggaagatacgcaaggacatccaacagtgggagccgagccgcggctggaacgactggactcaggtgcccttctgctcgcatcatttccacgagttaatcatgaaggacgggcgggtgcttgtcgtaccctgtcgcaatcaggacgagctgatcggccgagcccggatcagccagggggcgggctggtccctccgggagaccgcctgtctggggaagtcgtacgcccagatgtggtccctgatgtactttcaccgccgcgacctccgcctggccgccaacgcaatctgcagcgccgtgccttcgcactgggtcccgaccagcagaaccacctggtccatccacgccaagcacgagtggatgacgaccgaggacatgctgaccgtgtggaatcgagtatggatccaggagaacccatggatggaggacaagacacccgtggagagttgggaggagatcccctacctcggcaagagggaggaccagtggtgcggctcgctgatcggcctgacgtcgcgcgccacctgggccaagaacatccaggcggccatcaaccaggttcggagcctcatcggcaatgaagagtacaccgactacatgccgtccatgaagcgctttcgacgggaggaggaggaagccggggtgctgtggtaa

SEQ ID NO: 25137 - RNA, 9876 nt, synthetic construct
  misc_feature 1..9876: note = derived and/or modified CDS sequence (opt11) from DENV-2__FJ687439__SS-prME
  source 1..9876: mol_type = other RNA
tcagccgggatgatcatcatgcttattcccaccgtgatggcctttcatcttaccacacgcaacggggagccccacatgatcgtaggcatacaggagaaaggcaagagcctgttattcaaaactgaggacggcgtgaacatgtgcaccctcatggcgatggatcttggtgagctgtgcgaggacaccatcacgtacaagtgccccctcctacgacagaacgaacccgaggacatcgactgctggtgcaacagcacatccacttgggtgacctacgggacctgcaccaccacgggcgagcaccgccgggagaagcgcagcgttgcccttgtgccccacgtggggatgggcttggagacccggaccgagacctggatgtccagcgagggggcctggaagcacgcccagcgcatcgagacctggatcctgcggcaccccggcttcacgattatggccgcgatcttagcttacaccatcgggaccacccatttccagcgcgccctcatcttcatcttgctgacggcggttgccccctccatgaccatgcggtgcatcggcatcagcaatcgcgatttcgtggagggcgtgtccgggggcagctgggttgacatcgtgctcgagcacggaagttgtgtgacaaccatggccaaaaataaacccacgttggacttcgaactgatcaaaaccgaggctaagcaacccgccactctccgaaagtactgcatcgaggccaagctcacaaacacgaccaccgagagccgctgccccacgcagggcgagcccagcctgaaggaggagcaggacaagagattcgtctgtaagcacagcatggtggaccgcggttgggggaatggctgcggactgttcggcaagggcgggatagtgacgtgcgcgatgttcacttgtaagaagaacatggagggaaagattgtgcagcccgagaacttggagtacaccattgtggtgacgccccactccggtgaggagcacgctgtcggcaacgacacggggaagcacgggaaggagatcaaggtgaccccgcagagctctatcaccgaggcggagctgacggggtacggcaccgtgacgatggagtgcagcccccggaccggcctcgacttcaacgagatggtcctgctgcagatggagaacaaggcatggctcgtgcaccgccagtggttcctggacctgcccctcccctggctcccgggggcggacaagcaagagtccaattggatccaaaaggagacgctggtcacatttaagaacccccatgcgaagaagcaggacgtcgtggtcctcgggagtcaggagggggctatgcacaccgccctgaccggtgcaactgagatccagatgagctccgggaatctcctgttcaccggccatctgaagtgccgtctgcgcatggacaagctccagctgaagggcatgagctactcaatgtgcactggaaagttcaaggttgtgaaggagatcgccgagacccagcacggcaccattgtcatccgggttcagtacgagggggatggcagcccctgcaagatccctttcgagatcatggatttagagaagcgctacgtgctcggccggctgatcaccgtaaatccgattgcgacagagaaggactcccccgtgaacatcgaggcagagccgcccttcggggacagctacatcatcatcggcgtggaaccaggccagctgaagctcaactggttcaagaagggttcatccatcggccaaatgttcgagaccaccatgcgtggggccaagcgcatggccatcctgggcgacacagcctgggacttcggatcacttggcggggtgttcacgagcatcggtaaggcgctccaccaggtgtttggggccatctacggggccgccttttccggcgtgagctggaccatgaaaatcctgataggggtcatcatcacctggatcggcatgaactcccgaagcacctctctgagcgtgtccctggtgctcgtcgggatcgtgacgctgtacttgggcgtaatggtacaggcggatagcggttgcgtggtgtcctggaagaataaggagctcaagtgcggctcgggtatctttatcaccgacaacgttcacacctggaccgaacagtacaagttccaaccagagagcccctccaagctggccagcgccattcagaaggcccaggaggaagggatctgtggtatacgctccgtgacgcggctggaaaacctcatgtggaagcagatcacccccgagctaaaccacatcctggccgagaacgaagtgaagctcaccatcatgacgggggacatcaagggcattatgcaagcggggaagcgctcgctgcgtccgcagcccactgaactgaagtacagttggaagacctggggcaaggccaaaatgctcagcaccgagtcctacaaccagaccttcctaatcgacggtcccgagacggccgagtgcccgaacaccaaccgcgcctggaactcgctggaggtcgaagactatgggttcggcgtgttcacgactaacatctggctcaagctgaaagaaaaacaggatgccttctgtgactcaaaactgatgtcggcggcaatcaaggacaaccgggcggtacacgccgacatggggtactggatcgagtcggccctcaatgacacgtggaaaatcgagaaggcgtctttcattgaggtgaagaactgccattggcccaagtcccacaccctatggagcaacggcgtgctggagtccgagatgatcatacccaagaatctcgccggccccgtgagccagcataactatcgtcctgggtaccacacgcagatcgccggcccatggcatctggggaagctggagatggacttcgacttctgcgacgggaccaccgtcatcgtgacggaggactgcgggaaccgaggcccctccttgcgcaccaccacggcgagcggcaagctcatcaccgagtggtgctgccggagctgcaccctccccccgctccgttaccgaggggaggacggttgctggtacgggatggagatccggcccctgaaggagaaggaggagaacctggtgaattccctcgtcacggcagggcacggacaggtggacaatttctctctgggggttctgggcatggcgctcttcctggaggaaatgctgcggacccgcgtcggtacgaagcatgccatcctactggtggccgtgtccttcgtcaccctgatcaccggcaacatgagctttaaagatttgggtcgggtggtggtcatggtgggtgccacaatggcggatgatatcgggatgggcgtgacatacctggctctactcgccgccttcaaggttcgcccgaccttcgccgcgggcctgttgctccggaagctgacctccaaggagctgatgatgaccaccatcggaatcgtgctcctgagccaaagcaccatccccgagaccatcctggagctcaccgacgccttagccctgggaatgatggtgctcaagatagtccgcaacatggaaaagtaccagctcgccgtaacgatcatggcaattctgtgcgtgccgaacgcggtcatcctccagaacgcatggaaagtcagctgcaccatcctggccgtcgtgtccgtgagccccctattgctgacctcgagccagcagaagactgactggatccccctggcgctcaccatcaaggggctgaacccgactgctatatttctgaccaccctctccaggacgaacaagaagcggagctggccgctgaatgaggctatcatggccgtcggcatggtgtctatactagcctcctccctcttgaagaatgacatacctatgaccggccccctggtggccgggggcctcctgaccgtctgctacgtgctgactgggcgctctgccgacctcgagctggagcgggcgacggacgtgaagtgggaggaccaggccgagatctccggtagcagccccattctatccatcacgataagcgaggacgggtccatgagcattaagaatgaggaggaggagcagaccctcaccatcctgatccgcaccggcctcctcgtcatctccggcctgttcccgataagcatccccatcacagccgcggcgtggtacctgtgggaagtgaagaaacagcgggccggggtcttgtgggacgtccccagtccaccgcccatgggcaaggccgagctggaggatggggcctaccgcatcaaacagaagggcatcctggggtacagccaaatcggcgcgggagtgtataaggagggcaccttccacaccatgtggcacgtgactcgcggcgccgtcttgatgcacaagggcaagcggatcgagccatcgtgggccgacgtgaaaaaggatctgatctcgtacggagggggctggaagctggagggcgagtggaaggagggggaggaggtgcaggtcctcgccctcgagccaggcaagaacccccgggccgttcagacgaaacccgggctgtttaagaccaacacgggcaccatcggggcagtgtccctagacttcagccccggcacgagtggcagcccgatcatcgacaagaaggggaaggtcgtaggactgtacgggaacggcgtggtcacccgctccggggcctatgtcagcgctatcgcccagacagagaagtccatcgaggataaccctgagatcgaggacgatatctttcgtaagcgcagacttacaatcatggacctacatccaggggccggcaagacgaagcgctatctccccgcgatcgtacgggaggcgatcaagcgcgggctgcggaccctgattctcgcgccgacccgcgtcgtggccgccgagatggaggaggcgctgcggggcctgcccatccggtaccagacacccgccatccgggctgagcacacggggcgcgagatcgtggatctgatgtgtcacgctacattcactatgcggctgctttcacccgtacgggtaccgaactacaacctcatcgtgatggatgaggcccacttcactgaccccgcgtccatcgccgcccgtggctacatcagcacccgggtcgagatgggcgaagcggctggtatctttatgaccgcgacgccgcccggcagcagagaccctttcccccagtccaacgcccccatcatcgacgaggagcgggagatccccgaacggtcgtggaacagcgggcacgaatgggttaccgatttcaagggcaaaacggtgtggtttgtgcctagcatcaaggcggggaatgacatcgccgcatgtttacggaaaaacggaaagaaggtaatccagctgtctcgcaagaccttcgactccgagtacgtgaagacccgtaccaacgactgggatttcgtcgtgacgacggacatctccgagatgggtgccaacttcaaggccgagcgcgtgatcgacccccggcgttgcatgaagcccgtgatactcacagacggggaggagcgggtgatcttggccggccccatgccggtgactcactcatccgccgcgcagaggcgcgggcgcatcggccggaatcccaagaatgagaacgatcagtatatctacatgggagagcccctggaaaacgacgaggactgcgcccattggaaggaggcgaaaatgctcctggacaatatcaacacgcccgagggcatcatcccgagtatgttcgagcccgagcgcgagaaggtcgacgcgatcgatggcgagtaccggctgagaggggaggcccgcaagaccttcgtggacctcatgcggcgcggcgacctgccggtgtggttagcgtacaaggtcgccgccgaggggatcaactacgccgaccggcgttggtgcttcgacggcataaagaacaaccagatacttgaagagaacgtggaagtggagatttggactaaggagggggagcggaagaagcttaaaccgcgctggttagacgcccgcatctactccgaccccctcgcgttaaaggagttcaaggagtttgccgcgggccgcaagagcctgaccctcaatctgatcacggagatgggccggttgcccacattcatgacccagaaaacccgagacgccctcgacaatctggcggttctgcacacggctgaggccggcggccgggcctacaaccacgccctctccgaactgcctgagaccctggagaccttgctgctcctcacccttctagcgacggttaccgggggcatcttcctcttcttgatgtccgggcgcgggatcggcaagatgacccttggaatgtgctgcatcatcaccgcctccatccttttgtggtacgcccagatccagccgcactggatcgcagcatccatcatcctggaattctttctaattgtcttattgatccccgagcccgagaagcagcggacaccccaggacaaccagctcacgtacgttgtgatcgcgatcctaacggtcgtggctgccacaatggccaatgaaatgggtttcctggagaagacgaagaaggacttagggctgggctcgatcgccacgcagcagccggagtccaacatcctggacatcgatctccgccccgcgtcggcctggaccttatacgccgtggccaccaccttcgtcacgccaatgctgcggcactccatcgagaattcctccgtgaacatcagcctcaccgcaatagccaaccaggccactgtgctaatgggcctggggaagggatggcccttatccaagatggacatcggcgtcccgctgctagcgatcggctgctacagccaggtgaaccccatcaccctcacggccgcgctgctgctgctggtggcccactacgccatcatcggtccgggcttgcaagctaaggccacccgcgaagcgcaaaagcgtgccgccgccggcatcatgaagaaccccaccgtggacggtatcaccgttatcgacctggacccaataccctatgaccctaagttcgagaagcaactgggccaggtgatgctgttaatcctgtgcgtcacccaagtgctcatgatgcggaccacctgggccctttgcgaggcgctgactttggccacagggcccatctccaccctctgggagggcaacccggggcggttttggaataccacgatcgccgtgagcatggccaacatctttcgaggctcctacctggccggcgctgggctcctgttcagcatcatgaaaaacacgacgaatacccggcgcggcaccggaaacatcggcgagacgttgggcgagaaatggaagtcccgcctcaacgccctggggaagtcggagttccagatctacaaaaagagcggcatccaggaggtcgatcggaccctggccaaggaggggatcaagagaggcgagaccgaccatcacgccgtgtctcgggggtccgcgaagttacgctggttcgtagagcgaaacatggtcacccccgagggcaaagtggtggacttaggatgcgggcgcggcgggtggtcgtactactgcggaggactgaaaaacgtccgagaggtgaaaggcttaacgaagggcggccccggccacgaggagcccatccctatgagtacgtacgggtggaacttagtgcggctgcagagcggcgtcgacgtgttcttcatcccgcccgagaagtgcgacacactgctctgcgacatcggggagtcaagcccaaatccgactgtggaggccggccggacgctgcgggtcctcaacctcgtggagaactggctgaacaacaacacacagttttgcatcaaggtgttaaacccctacatgccctccgtgatcgagaagatggaggccttacagcggaagtacggcggggcgctcgtccgcaaccctctgagccggaatagcacccacgaaatgtactgggtgtccaacgcgtccggcaatatcgtctcctctgttaacatgatctcgcgcatgctcatcaacagattcaccatgcgccacaagaaggcgacctacgagccggatgtggacttggggagcggcacgcggaacataggtatcgagtccgagatcccgaacctggacatcatcggcaagaggatcgaaaagatcaaacaagagcacgagaccagctggcactacgaccaggatcacccctacaagacgtgggcataccacggcagctatgagacgaagcagacggggtctgcatccagcatggtgaacggcgttgtacgactgctcaccaagccgtgggacgtcttaccaacggtgacccagatggccatgacggacacgacccccttcggtcagcaacgcgtgttcaaggagaaggttgacacccgcacccaggagcccaaggagggcactaagaagctgatgaaaatcacggccgagtggctgtggaaggagttaggcaagaagaagacaccaaggatgtgcacgcgcgaggagttcacccggaaggtgcgctccaacgcggccctgggggccatcttcaccgacgagaacaagtggaagtccgctagggaggctgtggaagactcacgtttctgggagctcgtcgacaaggagcggaacctgcacctagagggcaagtgcgagacctgcgtgtacaacatgatgggcaagcgcgagaagaagttgggcgagttcgggaaggcgaagggcagcagggccatctggtacatgtggcttggagccaggttcctagagtttgaggccctcgggttcctgaacgaggatcactggttttcccgagaaaactcgttatccggcgtggagggggaaggcctccacaagctggggtatatcctgcgcgacgtaagcaagaaggaaggcggcgcgatgtacgccgacgacacggccgggtgggacacccggataaccctcgaggatctgaagaacgaggagatggtgaccaatcacatggagggcgagcacaagaagctggccgaggcgatcttcaagttaacgtaccagaacaaagtcgtgcgcgttcagcgaccaactccccggggtaccgtgatggacataatcagccggcgcgatcagcggggctccggacaggtggggacctacggcctgaacaccttcaccaacatggaagcgcaactgatccgccagatggagggggagggcgtattcaagaacatccagcacctcaccgtcactgaggaggtggcggttcagaactggctagcccgggtcgggagagaacgcctgagccggatggccatctccggcgacgactgtgtggtgaagcctcttgacgaccgcttcgccaacgcgctgacggccctgaacgatatgggcaagattcggaaggacatccagcagtgggaaccaagcaaggggtggaacgactggacccaggtccccttttgcagtcaccacttccacgagctcatcatgaaagacggtcgcgtgctggtggtcccctgccgtaaccaggacgagctgatcgggcgcgcccggatcagtcaaggcgccggctggtccctccgcgagactgcctgcctgggcaagagctacgcgcaaatgtggtccctgatgtacttccatcggagagacctccggctggccgcaaacgccatctgctccgccgtgccctcccactgggtgccgacatcgcgcacgacttggagtatccatgcaaaacacgagtggatgaccaccgaggacatgctgacggtatggaatcgggtgtggatccgcgagaacccctggatggaggacaagacgcccgtggagagctgggaggagatcccctacttgggcaagcgggaggaccagtggtgcggttccctgatcggcctgaccagccgcgctacatgggccaagaacatccaagccgcgatcaaccaggtccggtccctcatcgggaacgaggagtacacagactacatgccgagcatgaagcgcttccggcgagaggaggaagaggccggcgtgctttggtag

SEQ ID NO: 25138 - RNA, 9876 nt, synthetic construct
  misc_feature 1..9876: note = derived and/or modified CDS sequence (opt11) from DENV-2__FJ687440__SS-prME
  source 1..9876: mol_type = other RNA
agcgccggcatgataatcatgctgatccccaccgtgatggccttccacctaaccacccgcaatggcgagcctcacatgatcgtcggcatccaggagaagggcaagtccctgctgttcaagaccgaggacggcgtgaacatgtgcacgttgatggcgatggatctgggggagctgtgtgaagacaccatcacctacaagtgcccactcctgcggcagaacgagcccgaggacatcgactgttggtgcaactccacttccacctggatcacgtacgggacctgcacgaccaccggcgaacaccgccgagagaagaggtcggtggccttagtcccacacgtggggatgggtttggagacccgcaccgaaacctggatgagttcagaaggggcttggaagcacgcccagcggatcgagacctggatcctccggcatccgggcttcactatcatggccgcgatcctggcctacaccattgggaccacccactttcagcgcgccttgatattcatcctgctcacggccgtcgcgccatccatgaccatgcggtgcatcggtatctcgaaccgcgacttcgtggagggtgtttccggagggagctgggtggacattgtcttagagcatggatcctgcgtcactaccatggccaaaaataagcccacgctggactttgagctcataaagaccgaggccaaacaaccggccaccctccgaaagtattgcatcgaggctaagctgacaaacacgaccaccgaaagccggtgccccacccagggcgaaccctccctcaaggaggagcaggacaagcggttcgtctgcaaacacagcatggtcgaccgcggctggggtaacggctgcggactctttggcaagggcgggatcgtgacgtgtgcgatgttcacttgcaaaaagaatatggaaggcaagattgtgcaacccgaaaacctagagtacaccatcgtggtgactccccactccggcgaggagcatgccgtgggtaacgatacagggaagcacggcaaagagataaaggtcaccccacaaagctccatcacggaggccgagctgactggttacggcactgtaacgatggagtgcagcccgcggaccggactcgacttcaacgagatggtactgttgcagatggaaaataaggcgtggctcgtccatcgccagtggttcctagacctgcccctcccatggctgcccggggccgacaagcaaggcagcaactggattcagaaggagacccttgtcaccttcaaaaatccccacgcgaaaaagcaggacgtggtcgtcctcggaagccaggagggggccatgcatacggccttgaccggtgccaccgagatccaaatgagctccggcaacctccttttcacaggacacctgaagtgccggctgcgcatggacaagctccagttgaaggggatgtcgtactccatgtgtacgggcaagttcaaggtcgttaaggagatcgccgagacccaacatgggaccatcgtgatacgggtccagtacgagggcgatggcagcccgtgcaagatcccatttgagatcatggacttggagaaacggtacgtcttagggcgcctgataaccgtgaacccgatcgtcacagagaaagactccccggttaacattgaggcagagccacccttcggcgacagctacatcatcatcggggtagagcccggccagctaaagctcaactggttcaagaagggatccagcatcggccagatgttcgagaccactatgcgcggagctaagcgcatggccattctgggggacaccgcctgggatttcggcagcctcggcggggtcttcacgagcatcggaaaggcactccatcaagtcttcggcgccatctacggggctgccttcagcggggtgagctggaccatgaaaatcctaatcggtgtaatcataacgtggatcggcatgaactcccggagcaccagcctgtcggtgtccctggtactcgtcggcatcgtgacgctgtatctgggagtgatggtccaggcagacagtggctgcgtggtctcttggaagaacaaggagctcaagtgcggcagcgggatcttcattacggataacgtgcacacctggacagagcagtacaagttccagcccgagtcgccctctaagctggcgtcagctattcagaaggcccaggaagagggtatctgcgggatccgctccgtgacgcgccttgaaaatctcatgtggaagcagatcacgcccgagttgaaccacatactcgctgagaacgaggtgaaactaaccatcatgacgggcgacataaaggggatcatgcaggctggcaagcgaagtttacggccccaaccgacggagttgaagtacagttggaagacctggggcaaggcgaagatgttgagcaccgaatcccacaatcaaaccttcctgatcgacggacccgaaacagccgagtgcccgaacaccaatcgggcgtggaactctctggaggtcgaagactacggctttggagtgttcactaccaacatatggctcaagctaaaggagaagcaagacgccttttgtgattccaagctgatgagcgccgccatcaaagacaaccgggccgttcacgccgacatgggctactggatcgagtccgccctcaacgacacgtggaagatcgagaaggcgtctttcatcgaagtgaagaattgccactggcccaagtcgcatacactgtggagcaacggcgtgctggagtcagagatgatcatcccgaagaacctcgcggggcccgtgtcccaacacaactaccgccccgggtaccacacccagatagcaggcccctggcacctgggcaaactggagatggactttgatttctgcgatggaaccaccgtcatagttacggaggactgcggcaaccggggcccctcccttaggaccaccaccgcctccgggaaactgattactgagtggtgctgccggagctgcaccctgcccccgctccgataccggggcgaggacgggtgctggtatggaatggagattcggcccttgaaggaaaaggaagagaacctggtaaattccctcgtcacggcagggcacggccaggtagataacttcagtctgggtgtactgggaatggccctgttcttagaggagatgttgcgtacacgggtcggaacgaagcatgccattttgctagtggctgtcagcttcgtaaccctgataaccggaaatatgagcttcaaggacctcggacgagtcgtggtaatggtgggcgccaccatgactgacgacatcggcatgggcgtcacctacttagcgctcttagcggcgtttaaggtccgtcctaccttcgcggcaggactgcttttacggaaacttacctccaaagagcttatgatgacaaccatcgggatcgtgctcctgagccagtccaccatccctgagaccatactggagctcactgacgccctcgccctgggcatgatggtgctcaaaatcgtccgcaacatggaaaaataccagttagctgtgacaataatggctatcctgtgcgtgccgaatgccgttattctgcaaaacgcatggaaggtgagctgcacaatcttggcggtagtgtccgtgtctcccctactactgacctcctcacagcagaagacggattggatccccttggccctgaccatcaagggcctgaatccgaccgctatctttctgacaacgttgtctcgcaccaacaagaagaggtcttggccgctgaacgaggccatcatggcggtgggaatggttagcattctcgccagcagtctcctgaagaacgacattcctatgaccgggcctctggtggcaggagggctcctaaccgtctgctacgttttgacgggccgcagcgctgacttggagctggagcgagccacggacgtgaagtgggaggaccaagcggagatctcgggtagcagccccatcctgtccatcacgatcagcgaggatgggtccatgagcattaaaaatgaggaggaggagcaaaccctcacgatcctaatccgcacaggtctgctagtgatctccgggctgttcccggtgagcataccgatcactgccgcagcttggtacctgtgggaggttaagaagcagagggccggcgtgctctgggacgtgccctcaccgccgcccatggggaaagcggagctagaggacggagcctatcgcatcaaacaaaaggggatcctgggctacagccagattggcgccggggtgtacaaggagggcacctttcacaccatgtggcacgtgacgcgtggggccgtgctcatgcacaaggggaagcgcatcgagccctcctgggccgacgtgaagaaggacttaatcagttacggtggagggtggaagctcgaaggtgagtggaaggagggagaggaggtccaggtgcttgcgctggagcccgggaagaacccgcgagccgtgcagaccaaacccggcctgttcaagacgaacaccgggacgatcggtgcagtctccctcgacttctcacctggaacatccgggtcaccaataatcgacaagaagggcaaggttgtgggcctgtacggaaacggcgtggtgaccaggtcaggggcctacgtatcagcgatcgcgcaaactgagaagagtatcgaggataaccccgaaatcgaggacgatattttccggaagagaaggctgacgataatggatctacaccccggcgcggggaaaaccaagcgctatctccccgccattgtccgggaagccatcaagcgcggcctgcgcactttaatcttggcgccgaccagggttgtggccgccgagatggaggaagccttacggggtctacccattcgctaccagaccccggccattcgggcggaacacaccgggcgcgagatcgtcgacctcatgtgccacgccacatttaccatgaggctgctgagccccgtccgggtgcccaactacaacctcatcatcatggacgaggcacacttcaccgatccagcctccatcgcagcgcgcggctatatctctacgcgggtcgaaatgggggaagctgccggcattttcatgacagccacgcctcccggtagccgcgatccgttccctcaatccaacgcccccatcattgacgaagaacgcgaaattcccgaaagatcatggaactccggccacgagtgggtaacggacttcacggggaaaactgtgtggttcgttccaagcatcaaggcgggcaatgacatcgccgcatgtctgcggaagaacgggaagaaggtgatccaactgtcacgcaagacgttcgactcagagtacgtcaaaacacggaccaacgactgggatttcgtagtaaccaccgacatctccgagatgggagccaacttcaaggcagagcgtgtgatcgacccccggcgctgtatgaagcctgtgatcctcacggatggcgaagaacgggttatactggccgggccaatgccggtgacccactcgtcagccgcgcagcgccggggccgcatcggtcgcaaccccaagaacgagaacgaccagtacatatacatgggcgagcccctggagaacgatgaagactgcgcccactggaaagaggcaaagatgttactggacaacatcaacacccctgagggcatcataccaagcatgttcgaaccagaacgcgagaaagtcgatgccatcgacggtgagtacagattgcgcggcgaggccaggaagaccttcgtggatctcatgcggcgaggggatctgcccgtgtggctggcatacaaggttgccgcggaaggcatcaactacgccgaccggcgctggtgcttcgatggtatcaagaacaaccagatcctcgaagagaacgtggaggtcgagatctggacgaaggagggggaacggaagaagctgaagcctcgctggctcgacgcccggatttattccgacccgctcgccctgaaggagttcaaggagttcgccgcggggcgcaagagtctgaccctcaatctgatcaccgaaatggggcgccttccgaccttcatgacgcagaagacccgggacgccctcgacaacctggcagtcctgcataccgcggaggcaggcgggcgggcctacaaccacgccctctcggagctccccgagacactggagacgctcctgctgctcaccctgctcgccaccgtaaccggcggtatctttctcttcttgatgagtggccgcggcattggcaagatgactctcggcatgtgttgcatcatcacggcgtccattttgctgtggtacgcgcaaatccaaccgcactggatcgccgccagtataattctcgaatttttcctcatcgttctcctgatacccgagcccgagaagcagcggacgccccaagacaaccagctcacctatgtggtgatcgccatcctgacggtcgtggccgccacaatggccaacgagatggggtttctggagaagacaaagaaggatctcggcctgggctccatagccacccaacagcccgagagcaatatcctcgacatcgacctccgcccagccagtgcctggacactgtacgcggtggccacgaccttcgtcacgccaatgctgaggcactcaatcgagaacagctccgtaaatgtgagcctcaccgcaatcgccaaccaagccacggtcctgatggggttgggtaaggggtggccattgtccaagatggacataggcgtgccgcttctggcgatcggttgttacagccaagtgaaccccatcacgctcacagccgctctgctactccttgtcgcgcactatgccatcatcggcccgggcctacaggccaaggccacccgcgaggcccagaagcgtgcggcggccgggatcatgaagaaccccacggtggacggtataactgtaatcgatctcgacccgatcccgtacgacccgaagttcgagaagcagctgggacaggtgatgctcttaatcctatgtgtaacacaggtgcttatgatgcgaaccacctgggccctatgcgaagcactgaccctggcgaccggccccatctccaccctctgggaggggaacccgggccggttttggaacaccaccatagcggtcagtatggctaacatcttccgaggctcctacttagctggggccggcctcctctttagcatcatgaaaaacaccacaaacactcggcgcgggaccggcaacatcggcgagacactgggagaaaagtggaaaagccgcctaaatgccttaggcaagagcgagttccagatctataagaagtccgggatccaagaggttgaccggaccctggcgaaagaaggcatcaaacgcggggagacggaccaccacgccgttagccggggctcggcgaagctgcgctggttcgttgagcggaatatggtgacccccgagggcaaggtggtcgacctcggctgtggcagaggtgggtggagctactactgcgggggcttaaagaatgtgcgggaggtaaagggcctgacgaagggtggacccgggcacgaggagccgattcctatgtcaacctacggttggaacctcgtccgcttacagagcggggtggacgtcttctttattccgccagagaagtgtgacacgctgctttgcgacatcggcgagtcctctcccaacccgaccgtcgaggccggacgcactctgcgcgtgctgaacctagttgagaactggctgaacaacaatacccagttctgcattaaggtcctgaacccctatatgccaagcgtaatcgagaagatggaggcgcttcagcgcaagtacgggggcgccctcgtgcggaatcctctgagtcggaacagcacccacgagatgtactgggtctccaacgcctcagggaacatcgtgagcagcgtgaacatgatcagtcgcatgctgatcaaccggtttacgatgcgccacaaaaaggccacttacgagcccgacgtcgacctcggcagcgggacacggaacataggcatcgagagtgagatacccaacctggacataattggcaagcgcatcgagaagatcaagcaagagcatgagacgtcttggcactacgaccaggaccacccctacaagacgtgggcctatcacggctcctacgagacgaagcagactgggagcgcatccagcatggtgaacggagtggtccggctgctcaccaagccgtgggatgttctgcctacggtgacccagatggccatgaccgacactacgcccttcggccaacagcgcgtgtttaaggagaaagtcgacacgcggactcaggagccgaaggagggcaccaagaagctaatgaaaattacggccgagtggctctggaaagagctggggaaaaagaagaccccgcggatgtgcacccgtgaggagtttacccggaaggtgcgctccaacgccgccctgggcgcaatattcacggacgagaacaagtggaagtcagcgcgggaggcggtcgaggattccaggttctgggagctagtggataaggagcggaatcttcatctggaggggaagtgcgagacctgcgtgtataacatgatgggtaagcgggagaagaagctcggggagttcggcaaggccaagggcagcagggcaatttggtacatgtggctgggggcacgcttcctggagtttgaggctctcggcttcctaaacgaagaccactggttctcccgggagaacagcctgagcggggttgagggagaaggtctgcacaaacttggctacatcctgcgcgatgtgagcaagaaggaaggcggggccatgtatgccgatgacacagcgggctgggacacccggatcacgctcgaagacctgaagaacgaggagatggtcaccaaccacatggagggggagcacaagaagctggcagaggctatctttaagctgacctaccagaataaggtggtacgcgtccagcgccccacgccacggggtaccgttatggacattatcagccggcgcgaccagcggggatcgggtcaggtgggcacgtacgggctgaacacgttcaccaacatggaggcgcagctgatccggcagatggaaggagagggggttttcaaaaacattcagcacctcacggccaccgaagagatcgcggtacagaattggttagctcgggtggggcgggagcgcctgagccggatggccatctctggcgatgactgcgtcgtaaagccgctcgacgacaggttcgccaatgccctaaccgcgctgaacgacatggggaagatacgtaaggatatacagcagtgggagccaagcaaaggctggaacgattggacccaggtgcccttctgctcccaccatttccacgagctgatcatgaaagacgggcgcgtgctggtggtgccctgccggaatcaggacgagctgatcggccgggcccgcatcagccagggagccggttggtccttgcgtgagacggcctgcttaggcaagagttacgctcagatgtggtctctgatgtatttccaccggagagacctcaggctggcggccaacgccatatgtagcgccgtaccgtcccactgggtgccaaccagccgcaccacctggtctattcacgccaagcacgagtggatgaccacggaggacatgttaaccgtgtggaacagagtctggataagggagaacccgtggatggaggataaaacccccgtggagtcgtgggaagaaatcccctacctcgggaaaagagaggatcagtggtgcggctccctgatcgggctgacctctcgcgccacgtgggccaagaacattcaggccgccatcaaccaggtgcggagtctcatcgggaacgaggaatacaccgactacatgccgagcatgaagcgcttccggcgagaggaggaggaggcgggggtcctgtggtga

SEQ ID NO: 25139 - RNA, 9876 nt, synthetic construct
  misc_feature 1..9876: note = derived and/or modified CDS sequence (opt11) from DENV-2__FJ687441__SS-prME
  source 1..9876: mol_type = other RNA
tcggccggcatgatcatcatgctgatcccgaccgtgatggccttccacctcaccacccgcaacggggagccccacatgattgtgggaatccaggagaaggggaaatccctactgttcaagaccgaggatggggtaaacatgtgcaccctcatggcgatggacctgggggagctgtgcgaagacacgattacatacaaatgtcccctcctgcggcagaacgagcctgaggacatcgactgctggtgcaacagcacctccacctggatcacctacgggacctgcaccaccaccggcgagcaccgacgggagaagcgcagcgtggcactggtcccccacgtgggtatgggcctcgaaacccggacagagacctggatgtccagcgagggggcctggaagcacgcccagcgcatcgagacctggatcctgcgccaccctggctttaccatcatggccgcgatcctggcgtacaccatcgggaccacacacttccagcgcgcgctcatcttcatcctactgacggcagtggcaccctccatgaccatgcgctgcatcggtataagcaacagggacttcgtcgagggcgtcagcgggggcagctgggtggacatcgtcctcgagcacggatcctgcgttaccaccatggcaaagaacaagcccacactcgacttcgaactcatcaagaccgaagccaagcagcccgcaaccttaagaaaatactgcattgaggccaagctaaccaacacgaccaccgagagccgctgtcccacccagggcgagccctccttaaaggaagagcaggacaagcgcttcgtgtgcaagcacagcatggtcgaccgcggctgggggaacggctgcggactgttcggaaagggcgggatcgtgacctgcgcgatgttcacgtgcaagaagaacatggaggggaagatcgtacagcccgagaatctggagtacaccatcgtcgtgacgccccactccggagaggagcacgcagtgggtaacgatacggggaaacacggcaaggagatcaaggtcaccccgcagagctccatcaccgaggccgagctgacggggtacggcaccgtaacgatggagtgcagcccccgaaccggcctagacttcaacgagatggtgctgctgcaaatggaaaacaaagcctggctcgtacaccgccagtggttcttggacttgcccctcccctggctgccgggggccgacaagcagggttccaactggatccagaaggagaccctggtgaccttcaagaacccccacgccaagaagcaggacgtggtcgtgctcgggagccaggagggcgccatgcacacggccctgaccggggccaccgagattcagatgagctctggaaacctcttattcacgggccacctgaagtgccggctgcgcatggacaagttgcagctgaaggggatgagctactccatgtgcactggcaagttcaaggtcgtgaaggagatcgccgagactcagcacgggaccatcgtgatacgggtgcagtatgagggcgacggcagcccctgcaagatccccttcgagattatggacctggagaagagatacgtgctcgggcggctgattacagtgaacccgatcgtcacggagaaagactcccccgtaaacatcgaggcggagccgcccttcggcgacagctacatcataatcggggtggagccgggccagctgaagctcaactggtttaagaaaggctcctccattggccaaatgttcgagaccaccatgcgcggcgccaagagaatggcaatcctgggggacaccgcctgggatttcggctccctaggcggggtcttcacgtctattggtaaggctctccaccaggtgttcggcgcaatctacggcgccgccttctccggggtaagctggaccatgaagatcttgataggcgtcattatcacctggataggcatgaactcccggagcacctccctgagcgtgtccctggtgcttgtaggcatcgttacgctgtacctgggggtgatggtccaggccgacagcggatgcgtggtgtcctggaagaataaagagctcaaatgcggtagcgggattttcatcacagacaacgtccacacctggaccgagcagtacaagttccagcccgagagcccctccaagctggcgagcgccatccagaaggcccaggaggaaggcatttgcgggatccgctccgtgacgcggctggagaatctcatgtggaagcaaatcaccccggagctgaaccacatcctggccgagaacgaggtgaagttaaccatcatgaccggcgacatcaaggggatcatgcaggccggcaagcgctcactgcggccgcagcccacggagctgaagtactcctggaagacctggggcaaagcgaagatgctcagcaccgagtcccacaaccagaccttcctgatcgacgggccagagacggccgagtgcccgaacaccaaccgcgcctggaactccctggaggtcgaggactacggcttcggggtgttcaccactaacatctggctcaagctgaaggagaagcaagatgccttctgcgactccaagttaatgagcgccgcgattaaggacaatcgggccgtgcacgccgacatgggctactggatcgagtccgccctcaacgatacgtggaagatcgagaaggccagcttcatcgaggtcaagaactgccactggcccaagtcgcacaccctgtggagtaacggagtgctcgagtccgagatgatcatccccaagaacctcgcggggcccgtgagccagcacaactaccgcccaggctaccacacccagatcgccggtccatggcacctgggcaagctggagatggacttcgacttctgcgacgggaccacagtcatcgtgacggaggactgcggcaaccggggcccctccttgcgcaccaccaccgccagcgggaagctgataacggagtggtgctgtcggagctgcaccctacccccgctccgctaccggggcgaagacgggtgctggtacggcatggagatccgccccctgaaggagaaagaagaaaacttagtgaactccctcgttaccgccgggcacggccaggtggacaacttcagcctgggcgtgctggggatggcactgttcttggaggagatgctgcggacgcgcgtgggtacgaagcacgcaatactcctggtggccgtgtccttcgttaccctcatcaccgggaacatgagtttcaaggacctcggcagggtcgtggtcatggtgggtgccacaatgacggacgacatcggcatgggcgtgacctacctagccctgcttgcggctttcaaggttcgccccacattcgccgccgggctgctgcttcggaagctgaccagcaaggaattaatgatgacgaccatcggcatcgtcctcctgagccagtccaccatccctgagaccatcctggagctcacggacgccctggcgcttgggatgatggtgctcaagatcgtccgcaacatggagaagtaccagctggccgtgaccatcatggccatcctgtgcgttccgaatgcagttatcctccagaacgcctggaaggtgagctgcaccatactggcggtcgtgtccgtgagccccctgctcctgacctccagtcagcagaagacggactggatccccctggccctcaccatcaagggcctgaatcccaccgccatcttcctgaccacgctctccaggacaaacaagaagcggagctggcccctgaacgaggccatcatggcggtcggcatggtgtccattctagccagctccctcctcaaaaacgacatacccatgactgggcccctcgtggccggcggcctcttaaccgtgtgctacgtcctgacgggccgcagcgccgacctcgagctggagagagctaccgatgtgaagtgggaggaccaggcggagatctccgggagcagccccatcctgtccatcaccatctctgaggatggctccatgagcatcaagaacgaggaagaagagcagactctcacgatcttgatccgcaccgggctgctagtcatctccgggctgttcccggtgagcatccccatcaccgccgccgcttggtacctgtgggaggtcaagaaacaacgggccggcgtcctatgggatgtgccatctccgccgcccatggggaaggcggagctggaagacggcgcctaccgcatcaagcaaaaggggatcctgggctacagccagatcggcgccggggtgtacaaggaaggcaccttccatacaatgtggcacgtcacgcgcggggcagtgcttatgcacaagggcaagcgcatcgagccctcttgggccgacgtgaagaaggacctcatctcatacggggggggttggaagctggagggcgagtggaaggagggcgaggaggtccaggtgctcgcactggaacccgggaagaaccccagagccgtgcagactaagcccggcctgttcaagacaaacaccgggacgatcggcgccgtctcactcgacttctcgcccggcacctccgggagcccaatcatcgacaagaaagggaaggtggtggggctgtacggcaacggcgtcgtgacccgttccggggcttacgtaagcgccatcgcgcagaccgagaagtcgatcgaggacaaccccgagatcgaggacgacatcttccggaagcgccggctgacgatcatggacctgcaccccggagccgggaagaccaagcgctacctccccgccatcgtccgggaggccatcaagcgcggattgcggaccctgatcctcgctccgacccgcgtggtggccgccgagatggaggaggccctccggggactgcccatccgataccaaacccccgccatccgggcggagcacaccggccgcgagatagtcgaccttatgtgccacgccaccttcacaatgcgcctgctgagccccgtcagagtgccgaactacaacctcattatcatggatgaggcgcatttcactgaccccgcttccatcgccgcgcgcggctacatcagcacccgggtcgagatgggggaggccgccggcatcttcatgaccgcgacgccgcccgggagccgcgatccgttcccgcagtccaacgcccccatcatcgacgaggaaagggagatccccgagcgctcctggaactccggccacgagtgggtgacggatttcaagggtaagacagtgtggttcgtcccgtcgatcaaggcgggcaatgacattgcagcctgcctccggaaaaacggcaagaaggtgatccagctgtccaggaagaccttcgacagcgagtacgtgaagacccggacgaacgactgggacttcgtcgtaaccaccgacatctcggagatgggggccaacttcaaggcagagcgggtcatcgatccccggcggtgcatgaagcccgtcatcctcaccgacggcgaagagcgcgtgatcctggccgggcccatgccggtgacccacagctcggccgcccagcgacggggtcgcatcgggcggaaccccaagaacgaaaacgaccagtacatttacatgggagaacccctggaaaacgacgaggactgcgcgcactggaaggaggcgaagatgctcctggacaacatcaacacgcccgagggtatcatccctagcatgtttgagcccgagcgcgagaaggtcgacgcaattgacggggaataccggctgcgtggcgaggcgcgcaagaccttcgtggacctcatgcgacgcggggacctccccgtgtggctcgcctataaagttgccgcggaggggataaactacgccgaccgacgctggtgcttcgacggaatcaagaataaccagatcctcgaagaaaacgtggaagtggagatctggacgaaggagggagagcggaagaagctgaagccgcgctggctggacgcacggatctactccgaccccttagccctgaaggaattcaaagagttcgccgcgggccgcaaatcactgacgctcaatctgatcactgagatggggcggctcccaaccttcatgacccagaagacgcgggacgccctcgataatctggccgtactgcacaccgccgaggcgggggggcgggcctacaatcacgccctctccgagctgccggaaaccctggagaccctcctgctgttgacgctgctggccaccgtgaccgggggcatcttcctcttcctaatgagcggtcgcggcatcggtaagatgaccctgggcatgtgctgcattatcacggcgtccattctcctctggtacgcacagatccagccgcactggatcgccgccagcataattcttgagttcttcctcatcgttctgctgatcccagagcccgagaagcagcggacgccccaagacaaccagctcacctacgtggtgatcgccatcctgacagtcgtggccgcgaccatggccaacgagatgggctttttggagaagacgaagaaggacctcggcctgggctccatcgccacccagcagccggagagcaacatcctggacatcgacctccgccccgcctccgcgtggaccttgtacgcggtggccaccacgttcgtaacccccatgcttcggcactcgatcgagaatagctccgtgaatgtgagcctcaccgcaatcgccaaccaggccactgtgctgatggggctgggcaagggctggcccctctccaagatggacatcggcgtgccgctgttggcgatcgggtgctacagccaagtaaaccccattacgctcaccgcagccctgctgctcctggtcgcccactacgcgataatcggccccggcctgcaggccaaggccacccgggaggcccagaaacgggccgcggcggggatcatgaaaaaccccacggtggatggcatcacggtgatcgacctcgacccaattccctacgaccccaagttcgagaagcagctggggcaggttatgctgctcatcctgtgtgtgacccaggtgctgatgatgcgcaccacctgggccctatgcgaggcactgacgctggccaccggccccatctccaccttgtgggaggggaacccgggtcggttttggaacactacgattgcggtaagcatggccaacatcttccggggctcctacctggccggcgccggcctcctcttcagcatcatgaagaacacaaccaacacccgtcgcgggacgggaaacataggcgagaccctgggggagaagtggaagtccaggctgaacgccctcggcaagagcgagttccagatctacaagaagagcggcattcaggaggtggaccggaccctggcgaaggagggcattaagcgcggggagaccgaccaccacgccgtgagccggggcagtgccaagctacgctggttcgtcgagcggaacatggtgacgcccgagggcaaggtggtcgacctcgggtgcggcagggggggctggagctactactgcgggggcctgaagaacgtgcgagaggtgaagggcctgaccaagggcggccccgggcacgaggagcccatcccgatgtccacctatggctggaacctcgtgcgcctgcagagcggggtggacgttttcttcatcccgcccgagaagtgcgacaccctgctctgcgacataggcgagtccagccccaacccgacggtcgaggcgggccggaccctgcgcgtgctgaacctcgtggagaactggctgaacaataacacccagttctgcatcaaggtcctgaacccctacatgccctccgtgatcgagaagatggaggcgctgcagcggaagtacgggggcgccttagtgcgcaacccgttgagccggaacagtacccacgagatgtactgggtttcaaatgctagcgggaacatcgtgtctagcgtgaacatgatctcccgcatgctgattaacaggtttaccatgcgccacaagaaggcaacgtacgaaccggacgtcgacctcggcagcgggacccgaaacattgggatcgagtccgaaatccccaacctggatattatcggcaagcgcattgagaagataaagcaggagcacgagacctcgtggcattacgatcaggatcacccgtacaagacctgggcctatcacgggtcctacgagacgaagcagaccggtagtgcgtccagcatggtgaacggggttgtccggctgctgaccaagccgtgggacgtgctgcccacagttacgcagatggccatgaccgacaccacaccattcggtcagcagcgcgtcttcaaggagaaggtggacacgcgcacccaggagcccaaggagggcacgaaaaagctgatgaagataacagcagaatggctatggaaggagctggggaagaagaaaaccccgcggatgtgcacccgcgaggagttcactagaaaagtgcgctccaacgccgccctgggcgcgatcttcacagacgagaacaagtggaagtccgctcgggaggccgtcgaggactcccgcttttgggagctcgtggataaggagagaaacctgcacctggaggggaagtgcgagacgtgcgtctacaacatgatgggcaagcgcgaaaagaaactcggggagttcggcaaggccaaagggagccgtgccatctggtacatgtggctgggggcgcgcttcctcgagttcgaggctctcggcttccttaacgaagaccactggttctcccgggaaaacagcctttccggggtcgagggcgaagggctgcacaaactgggctatatcctgcgcgacgtgagcaagaaggagggcggggccatgtatgccgatgacaccgcgggttgggacacccggatcaccttagaggatctgaagaacgaggagatggtcacgaaccacatggagggggagcacaagaaactggccgaggccatcttcaagctcacctaccagaataaggtggtgcgtgtccagcggcccacgccccggggcacggtgatggacatcatcagccggcgcgaccagcgggggtccggccaggtgggcacgtacggactgaacaccttcactaatatggaggcacaactgatccgccagatggaaggcgagggggtcttcaaaaacatccagcacctcaccgccacggaggagatcgcggtgcagaactggctggcccgggtgggccgcgagcgcttaagccggatggccatatccggcgacgactgcgtcgtgaagcccctggacgaccgtttcgccaacgccctgaccgctctgaacgacatggggaagatccggaaggacatccagcagtgggagccgagcaaaggatggaacgactggacccaggtgcccttttgctcccaccatttccacgagcttatcatgaaggacgggcgcgtcctggtggtgccctgccggaaccaggacgaactgatcggccgcgcgcggatcagccagggggcgggctggtccctcagagagaccgcctgtctgggaaagtcctacgcccagatgtggtcactgatgtacttccaccggagggatctccggctggcggccaacgccatctgcagcgccgtcccctcccactgggtgccgaccagtcgcaccacctggtccatccacgccaaacacgagtggatgactactgaggatatgctgacggtgtggaaccgggtctggatacgtgagaacccctggatggaggacaaaaccccggtcgagagctgggaggagataccctacctcggcaagagggaggaccagtggtgcggctccctgatcggactgacctcgcgagcgacctgggccaagaatatccaggcagccataaaccaggttaggtccctcatcggcaacgaggagtacacggactatatgccgagcatgaagcgctttcggcgcgaggaggaagaagcgggggtcctttggtga

SEQ ID NO: 25140 - RNA, 9876 nt, synthetic construct
  misc_feature 1..9876: note = derived and/or modified CDS sequence (opt11) from DENV-2__FJ687445__SS-prME
  source 1..9876: mol_type = other RNA
agtgtcggcatgataatcatgctgatccccaccgttatggccttccacctcaccacgcgcaacggggagccccacatgatcgtgagcatccaggagaaaggcaaaagcctgctgttcaagaccgaagacggggtgaacatgtgtaccctgatggccatggacctgggcgagttatgcgaggataccatcacctacaagtgccccctcctgcggcaaaacgagcccgaagacatcgactgctggtgcaactccacaagtacctgggtcacctacggtacgtgcaccaccaccggggagcaccgccgtgagaagaggtcagtggcgctggtgccccacgtcggcatggggctggagacacggaccgagacttggatgagctctgagggcgcctggaagcatgctcagcgcatcgagacttggatcctgcgtcacccggggttcacgatcatggccgccatcctggcgtataccatcggcaccacccactttcagcgcacgctgatcttcatcctactgaccgccgtggcccccagcatgaccatgcggtgcatcgggatctccaaccgcgacttcgtggagggcgtctcaggcgggtcctgggttgacatcgtcctcgagcacggcagctgcgtcaccaccatggccaagaacaagcccaccctggacttcgagctgatcaaaaccgaggccaagcagcccgctaccctgcggaagtactgcatcgaggccaagctcacgaacaccaccaccgagtcccgctgccccacccagggggagcccagcctgaaggaggagcaagacaaacggttcgtgtgcaagcactccatggttgaccgcggctggggcaatgggtgcggcctgttcgggaagggtgggatagtgacctgcgccatgtttacgtgcaagaagaacatggagggcaaaatcgtgcagcccgagaatctggagtacaccatcgtggttacgccccacagcggggaggagcacgctgtcgggaacgacacgggcaagcatgggaaggagatcaaggtgaccccgcagtcatcaatcaccgaggctgagctcaccggctatgggaccgtcaccatggagtgcagcccccggaccggcctcgacttcaacgagatggtgctgctgcagatggagaacaaagcttggctcgtgcaccgccagtggttcctggacttacccctcccctggctgccgggcgccgacacccagggaagcaactggatccagaaggagacgctggtcaccttcaagaacccccacgccaagaagcaagacgtggtcgtgctcggcagccaggagggggccatgcataccgcgctgaccggcgccacggagatccagatgtccagcgggaacctcctgttcaccggccacctgaagtgccggctacgcatggacaaactccagctgaagggcatgagctatagtatgtgcaccgggaagttcaaggttgtcaaggagatcgcggagacccagcacggcacgatcgtgatccgggtgcagtacgagggtgacggttccccctgcaagatacccttcgagatcatggacctagagaagcgctatgtcctcggccggctcatcactgtgaacccgatcgtgaccgagaaggacagccccgtaaacatcgaggccgagccgcccttcggagattcctatattatcatcggtgtggagccggggcagctgaagctcaactggttcaagaagggcagctctatcgggcagatgttcgagacgacgatgcgcggcgccaagcgcatggcgatcctgggcgacaccgcatgggacttcgggtccctcggcggggtgtttacatccataggcaaagctctccaccaggtattcggggccatctacggcgccgcgttctccggcgtgagttggaccatgaagatcctgattggagtgatcatcacgtggataggcatgaacagccggtccaccagcctgtccgtcagcctggtgctagtgggggtcgtgaccctgtacctgggcgtgatggtccaggccgactccggttgcgtggtgagctggaaaaacaaggagctgaagtgcggcagcggcatcttcatcaccgacaacgtccacacgtggaccgagcagtacaagttccagcccgagtctcccagcaagctggcctccgccatccagaaggcccaggaggaggggatctgcggcatacgcagcgtgaccaggctggagaacctcatgtggaagcagatcacccctgagctcaaccacatcctggcagagaacgaggtcaaacttacgatcatgaccggcgacatcaagggcatcatgcaagccgggaagcgctccctgcggccgcagcccaccgagctaaaatacagctggaagacctggggcaaggctaagatgctctccacagagtctcacaaccagaccttcctgatcgatggcccggagacggccgagtgcccgaataccaatcgcgcatggaactccctggaagtcgaagactacggtttcggtgtgttcactaccaacatctggctcaagctgaaagagaagcaggacgccttctgcgactcaaagctgatgtccgccgccatcaaggacaaccgggcggtccacgcggacatgggttactggatcgagagtgccctaaacgacacctggaagatagagaaggcctccttcatcgaggtaaagaactgccactggcccaagagccacaccctgtggtcgaacggcgtcctggagagcgagatgatcatccccaagaacctcgccggccccgtgtcccagcacaactacaggccggggtatcacacccagatcgctggcccctggcaccttggtaagctggagatggacttcgacttctgcgatggaaccaccgttgtggtgactgaggactgtggaaaccggggccccagcctccgcaccacgaccgcaagcgggaagctgatcaccgagtggtgctgccggtcctgcaccctgccgccgttacgctaccgcggtgaggatggctgctggtacgggatggagatccgccccctgaaggagaaggaggagaatctggtcaacagcctcgtgacggccggccacggtcaggtagacaacttctccctgggcgtcctgggcatggccctcttcctggaggagatgctgcggactcgcgtgggcaccaagcatgcgatcctcttggtggcggtcagcttcgtgaccctgatcacaggcaacatgtccttcaaggacctcgggcgggtggtcgtaatggtgggggccactatgaccgacgacattggtatgggcgtcacctacctggccctgctcgccgcctttaaggtgcgccccacgtttgcggccggcctgtttctgcggaagctcacgagcaaggagctgatgatgaccaccatcgggatcgtccttttatcccagagcacgatccccgagaccatcctggagttgaccgacgccctcgccctgggtatgatggtcctgaagatggtgcgcgacatggagaagtaccagctcgccgtcaccatcatggcgatactgtgcgtgcccaatgccgtgatactacagaacgcctggaaggtatcctgcacgatcctcgccgtggtgtccgtcagccccctgcttctcacctcttcccagcagaagaccgactggatccccctggccctgacgatcaaggggctcaaccccacggcgatcttcctgaccaccctgagccgcaccaacaagaagcggtcctggccgcttaacgaagccatcatggccgtgggcatggtgagcatcctggcatccagcctgctcaagaatgatatcccaatgacgggcccgctggtcgccggcgggctgctcaccgtgtgctacgttctgaccgggcgctccgccgaccttgagctcgagcgggccaccgacgtcaagtgggaggatcaggccgagatcagcgggagctcccccatactgtcgatcactatctccgaggacgggagcatgtccatcaagaacgaggaagaggagcagaccttgaccatcctcatccgcaccggcctgctggttatcagtggcctcttcccggtttccatccctatcaccgccgcggcgtggtacctttgggaggtcaagaagcagcgggccggggtgctgtgggatgtgccgtccccgccgcccatgggcaaagccgagctcgaggacggggcctatcgcatcaagcagcggggcatcctggggtatagccagataggcgcgggtgtctataaggagggtacgttccacaccatgtggcacgtgactcggggcgcagtgctgacccacaaggggaagcggatagagcccagctgggccgacgtcaaaaaagacctcatctcctacggcgggggctggaaactggagggcgagtggaaggagggggaggaggtccaagtgctggccctagagcccgggaagaacccccgcgccgtgcagacgaaacccgggctattcaagaccaacaccggcaccatcggggcggtgagcctggacttctccccaggcacaagcggctcccccatcatcgacaagaaagggaaggtggtcggcctctacgggaacggcgtggtgaccagaagcggcgcctacgtctccgccatcgctcagaccgagaagagtatcgaggataatcccgacatcgaggacgacatcttcagaaagcgtcgcctgaccatcatggacctgcatcccggggccggcaaaacgaagcgttacctgcctgcgatcgtgcgtgaggccatcaagcgggggctccgcacactgatcttggccccgaccagggtggtcgcggcggagatggaggaggcgcttcgcggtctgcccatccgctaccagacccccgccatccgcgccgagcacacgggacgcgagatcgtggacctgatgtgccatgccacctttactatgcggctcctgtcccccgtacgcgtcccgaattacaacctgatcatcatggatgaggcgcacttcaccgaccccgccagcatagcggcccggggatacatcagcacgcgcgtagagatgggtgaggctgcggggatctttatgaccgccacgccgcccggctcccgggacccatttccccagagcaacgcccccatcatcgacgaagagcgggagatacccgagcgctcctggaacagcgggcatgagtgggtcaccgacttcaagggcaagacggtctggttcgttccgtcgatcaaggccgggaacgacattgcagcgtgtctccgcaagaacggcaagaaggtgatccagctgagccggaaaaccttcgattccgaatacgtcaagacccgcaccaatgactgggacttcgtggtgaccaccgatatcagcgagatgggcgccaatttcaaggccgagcgagtgatcgacccccgccggtgcatgaagcccgtgatccttaccgacggtgaggagcgcgtgatcctcgccgggccaatgccagtcacccactccagtgcggcacagcggcgcgggaggatcggccgcaaccctaagaacgaaaatgaccagtacatatacatgggggagcctctggaaaacgacgaggactgcgcccactggaaggaggccaagatgctgctcgataatatcaatacgcccgagggcatcatcccgagtatgttcgagccagagcgggagaaggtggacgccatcgacggggagtaccgcctgaggggtgaggcgcggaagaccttcgtggacctgatgcgcaggggcgatctccccgtctggctggcctacaaggtggccgccgaggggattaactacgccgaccgcagatggtgcttcgatggcatcaagaacaaccagatcctggaggaaaacgttgaggtggagatctggaccaaggagggggagcgcaaaaagctcaagccgcggtggctggacgcgcgcatctactcggatcccctggccctcaaggagttcaaggaattcgccgccggccggaagtccctgaccctgaacctcatcacggagatgggccggctgcccacatttatgacccagaagacccgggacgccctggacaacctcgcggtgctgcacactgccgaggccggaggccgcgcctacaaccatgcgctgagcgaactccccgagaccctggagacccttctcctgctgaccctcctggccaccgtcaccgggggcatcttcctgttcctcatgtccggccgggggatcggaaagatgaccttagggatgtgctgcatcgttaccgcaagcatcctgctctggtacgcccagatccagccgcactggatcgccgcgtccatcatcctggagttcttcctgatcgtgctcttgatccccgagcccgagaagcagcgcactccccaggacaaccagctgacgtacgtcgtgatcgccatcctgaccgtggtcgccgccaccatggccaacgaaatgggcttcctggagaaaaccaagaaggacctggggctcggctcaatcgcgacgcagcagccggagtctaacattctggacatcgacctgcggcccgccagcgcctggaccctctacgccgtggccaccaccttcgtgacacccatgctacgccactccatcgaaaactccagcgtcaacgtgtccctgaccgcgatagccaaccaggccaccgtgctcatgggcctagggaagggctggcccctgagcaagatggacatcggggccccgctcctggccatcggctgctactcccaagtaaaccccattacactgacggcggccctcttgctgctagtggcgcactacgctatcataggtcccggtctgcaggcgaaagccacccgggaggcccagaaaagagccgcggcaggcatcatgaagaaccccaccgtggacgggatcactgtcatcgacctggacccgatcccccacgaccccaagtttgagaagcaacttggacaggtgatgctgctggtgctctgtgtcacgcaagtgctgatgatgagaaccacctgggccctgtgcgaggccctcaccctggccacgggccccatcagcaccctgtgggagggcaatccggggcgcttctggaacaccaccatcgctgtctcgatggcgaacatcttccggggaagctacctcgccggtgcagggctgctgttctccatcatgaagaacacgaccaacagccgccgcggaaccgggaacatcggcgaaaccctaggcgagaagtggaagtcccggctaaacgccctgggtaagagcgagtttcagatatacaagaagtccggcatccaggaggtcgacaggacgctcgcgaaggaggggatcaagagaggcgagaccgaccaccacgcggttagccgtgggtccgccaagttgcggtggttcgtggagcgcaacatggtcacccccgagggcaaggtggtggatctgggctgcgggcggggcgggtggagctactactgcggagggctcaaaaacgttcgcgaggtgaagggcttgaccaagggcgggcccggccacgaggagcccatcccgatgtccacgtacggatggaacctggtacggttgcagagcggcgtcgatgtgttcttcatcccgcccgagaagtgcgatacactgctgtgcgacatcggggagtccagccccaacccgaccgtggaggccggccgcaccctccgggtcctcaacctggtagagaactggctcaacaacaacacccagttctgtatcaaggtgttaaacccctacatgcccagcgtcatcgagaagatggaaacgctgcagagaaagtatggcggggccctggtgcggaacccgctctcccgcaacagtacccacgagatgtactgggtatccaacgcgagtggcaacatcgtctccagcgtgaacatgatctcccgcatgctaatcaatcgcttcaccatgcggcataaaaaggccacctacgagcccgacgtggatctggggagcggcacgcgcaacattggtatcgagtccgaaatccccaatctcgacatcatcgggaagagaattgagaagatcaagcaggagcacgagaccagctggcactacgaccaggaccacccatacaagacctgggcctaccacggcagttacgagacgaagcagacggggtcagcctcaagcatggtcaacggcgtggtgcgcctgctgaccaagccgtgggacgtcctccccaccgtgacccaaatggccatgactgataccacccccttcgggcagcagcgtgtgttcaaggagaaggtcgacacccggacgcaggagcccaaagagggcaccaagaagctgatgaagataaccgccgagtggctgtggaaggagctcggcaaaaagaagaccccgcgcatgtgcacgcgggaggagttcacccgcaaagtgcgttccaacgccgcgctgggagccatcttcaccgacgaaaacaagtggaagtccgcccgcgaggcggtcgaggactcgcggttctgggagctggtggacaaggagcgcaacctccacctggagggcaagtgcgagacctgcgtatacaacatgatggggaagcgggagaagaagctgggcgagttcgggaaggccaagggcagcagagccatctggtatatgtggttgggcgcccggttcctggagttcgaggcccttgggttcctcaacgaagaccactggttcagtcgcgagaacagcctgtctggcgtcgagggggagggcttgcaccgccttgggtacatcctgcgcgacgtgtccaagaaggagggcggcgcgatgtacgcagacgacacggccggttgggatacaaggataaccctggaggacctcaagaacgaggagatggtgaccaatcacatggagggcgagcacaagaagctggccgaggccatctttaagctgacgtaccaaaacaaggtcgtgcgcgtgcagcgccccacgccccgggggaccgtcatggacataatcagccggcgagaccagcggggctccggacaggtggggacatacggcctcaacaccttcacaaacatggaggcccagcttatccgccagatggagggggaaggagtattcaagaacatacagcacctgaccgttaccgaagagattgccgtgcagaactggctcgcccgcgtaggacgggaacgcctgtcccggatggccatctcgggcgacgactgcgtcgtgaaaccgctggatgaccgcttcgcgagcgccttgacggcccttaacgacatgggcaagatccggaaggacatccagcagtgggagccgtcacgcgggtggaacgactggacccaggtgcccttttgctcacaccacttccacgagctgatcatgaaggacggcagagttctcgtggtgccctgccgcaaccaggacgaactgatagggcgggcccgcatctcccaaggcgccggatggagcctgcgggagaccgcgtgcctcggaaagtcctacgcgcagatgtggagcctgatgtacttccaccgcagagatttgcgcctcgccgcaaacgccatctgttccgcggtcccgtcccactgggtgccgacctcccggacaacgtggagcatccacgccaagcacgagtggatgaccaccgaggacatgctgaccgtgtggaatcgtgtctggatccaggagaacccctggatggaggacaagacgcccgtagagtcctgggaggagataccctacctcggcaagcgggaagaccagtggtgcgggagcctcatcggtctgaccagccgcgccacctgggccaagaacatccaggtggccatcaaccaggtcaggtccctgatcgggaacgaggagtacaccgattacatgccgagcatgaagcgcttccgccgggaggaggaggaggcgggcgtcctctggtga

SEQ ID NO: 25141 - RNA, 9876 nt, synthetic construct
  misc_feature 1..9876: note = derived and/or modified CDS sequence (opt11) from DENV-2__FJ687447__SS-prME
  source 1..9876: mol_type = other RNA
tccgccggcatgataatcatgctgatccctacagtgatggccttccacctcaccacccggaacggagagccccatatgattgtcggcattcaggaaaagggaaagtctctgctattcaagaccgaggacggagtaaacatgtgcactctcatggcgatggacctgggggagctgtgtgaagacactatcacgtacaagtgccccctcctaagacaaaacgagcccgaggacatcgactgctggtgcaattcgaccagcacctgggtgacctacgggacctgcacgaccaccggcgaacacagacgggagaagcgatcagtcgccctggtgccccacgttggcatggggcttgaaacccggaccgaaacctggatgagcagcgagggggcctggaagcacgcccagcgcatagagacctggatcttacggcaccctgggttcaccatcatggcagcgatccttgcatacaccatcgggaccacccatttccagcgcgctcttatcttcatcctactaacggccgtggcaccatccatgactatgcggtgtataggcatcagcaaccgcgacttcgtggagggtgtgtccgggggtagctgggtcgatatcgtgctcgaacacgggtcgtgcgtgaccaccatggcgaagaacaagcccacgctggacttcgagctgattaagaccgaggccaagcaaccggctacccttcgtaagtattgcatcgaagcaaaactgaccaacaccactaccgagtcacgctgcccaacccagggcgagccctccttgaaggaagaacaggacaagcggttcgtttgcaaacacagcatggtggacagagggtgggggaacggctgcgggctgttcggcaaaggcgggatcgtcacgtgcgcgatgtttacctgcaagaaaaacatggagggtaagatcgtccaaccagagaacctggagtacaccatcgtggtaacgccgcactccggggaggagcacgccgtcggtaatgacacagggaagcacggcaaggagatcaaagtgacgccgcaatcttccattacagaggccgagcttactggatacggaaccgtcacaatggagtgcagcccccgtacctccctcgacttcaacgagatggtactgctgcagatggagaacaaggcctggttagttcaccgacagtggtttctggatttacccctaccgtggctgccgggcgccgataagcaggagagcaactggattcaaaaggaaactctcgtgaccttcaagaacccccatgcgaagaagcaggatgtcgtggtgcttgggtcccaagagggcgccatgcacaccgccctgaccggggcgacagagatacagatgtccagcgggaatctcctgttcaccgggcacctgaagtgccgactgcgcatggataaattacagctgaagggcatgtcctactcgatgtgcaccggcaagttcaaagttgtgaaggagatcgccgaaacacagcacgggaccatcgtgataagagtgcaatatgaaggcgacgggtccccctgcaagatcccctttgagatcatggacctggagaaacgctacgtgctaggtcgcctgatcaccgtcaatccgatagttaccgagaaggactccccggtgaatatcgaggcggagccgcctttcggcgactcctatatcataatcggcgtcgagccgggccagctgaaactcaattggttcaagaaggggagctccatcggacagatgttcgagaccaccatgcggggagcgaagcgcatggccatcttaggcgacaccgcgtgggacttcggcagcctcggtggggtgttcacgtccattgggaaggccctacaccaagtcttcggggcgatttacggggcagccttcagcggcgtatcgtggacaatgaagatcctgatcggcgtgatcataacatggatcgggatgaacagccgatccacctcactatccgtgtcattggttctcgtgggcatagtcaccttatacctaggtgtgatggtgcaggccgactccggctgcgtagtctcctggaagaacaaggagctcaaatgtggctctggcatcttcatcaccgacaacgtgcatacctggaccgagcagtacaaattccagcccgagtccccctcgaagctggcgtccgccatccagaaagcacaggaggaaggcatttgcgggattagatcggtgacccggctcgaaaacctcatgtggaagcagataacccccgagctcaaccacattctggccgagaatgaggtaaagctgacgatcatgaccggcgatatcaagggaatcatgcaggccggaaagcgctccctacggccacagcccacggaactgaagtactcctggaagacctggggaaaggctaagatgctcagtaccgagagctataaccagacgtttcttatcgacggccccgagacggccgagtgccccaacaccaaccgggcctggaactccctggaggttgaagactacggatttggggtctttaccaccaatatatggctcaagctgaaggagaagcaggatgccttctgcgatagcaagctgatgagcgccgcgattaaagacaaccgggcagtccacgcagacatgggctactggatcgaaagcgccctcaacgacacgtggaagatcgagaaggcctccttcatcgaggtgaagaactgtcattggccaaaaagccacacgctttggtccaatggggtgctggagagcgagatgataatacccaagaaccttgcgggccccgtctcgcagcacaactaccgcccgggctaccacacccagatcgccgggccctggcacttgggtaagctggagatggacttcgacttctgcgacggaaccacggtaatcgtgacggaggactgcggcaaccggggaccctctctcaggaccaccaccgccagcggcaagctgatcacggaatggtgctgccgctcctgcactctgccccctctccgctacaggggcgaggacgggtgttggtatggcatggaaatccgcccgctgaaggaaaaggaagagaatctggttaatagcttggttaccgccggccacggccaggtggataatttctctctcggtgtcctggggatggcgcttttcctggaggagatgctgcggacacgcgtaggaactaagcacgccatccttctggtggccgtctccttcgtgaccctaatcactgggaacatgtccttcaaagacctcgggcgggtagtagtgatggttggggccactatggcagatgatatcggaatgggagtcacgtacctggcgttgctcgccgcgtttaaggtgcgccccacattcgcagccggcctgttactccggaagctgaccagcaaggagctgatgatgaccactatcggcatcgtactcctgtcacagagtaccatcccagagaccatcttagagctcacagacgcgcttgccctgggtatgatggtcctcaaaatcgttcgcaatatggagaagtaccagttagccgtgacgatcatggctatcttgtgcgtccctaacgccgtgatcctgcaaaatgcgtggaaggtctcatgcacaatcttggccgtggtaagtgtcagtcccttgctcctgactagcagtcagcagaagacagactggatacccctggccctcacgattaagggcctgaaccccaccgccatctttctcacaacattaagccgcacgaataagaagcggtcctggccgctaaacgaggcgatcatggccgtggggatggtgagcatactggccagttcgctcctgaagaacgacatccccatgaccggccccctggtcgccggcggactattaaccgtatgctacgtgctgactggtcgctctgctgacctagagctggaacgggcgacggacgtcaaatgggaggatcaggccgagatctccgggtcgtcccccatcctgtcaatcaccatatccgaggacggcagcatgagcatcaaaaatgaggaagaggaacagacccttaccatcctgatccgcacagggctgctggtgattagcgggctgttcccaatctcaatacccatcaccgccgccgcttggtatctttgggaagtaaagaagcagcgggcgggcgtcttatgggacgtaccctctccgcctcccatcggcaaggccgagttggaggatggcgcctaccgaataaagcagaagggaatcttgggctacagtcagatcggggccggcgtttacaaggagggaacattccacaccatgtggcacgtcacccgcggggcggtgctcatgcacaaggggaagcgcattgagccctcgtgggccgacgtgaagaaggatctgatctcttatgggggcgggtggaaacttgaaggcgagtggaaggaaggcgaagaggtccaggtcctcgcactggagcccggaaagaatccccgggccgtgcagacgaaaccggggctattcaaaaccaacaccggtaccataggtgccgtcagcctggacttctccccgggtacgagcggttcccccatcatcgacaagaagggaaaggtagtggggctgtatggcaacggcgtcgtgacccgtagcggcgcctacgtgtccgcgatcgcccagacagaaaagtccatcgaggataacccagagatcgaggacgacatatttcggaagcgccgactgaccattatggacctgcatcccggagctgggaagacgaaacgctatctcccagccatcgtccgggaggcgataaagcgcggccttcggaccttgattcttgccccgacgcgcgtggtggctgccgagatggaggaggcgctgcgggggctgcccatccgataccagacccccgcgatacgggccgagcacaccggccgcgaaatcgtcgacctcatgtgtcacgctactttcaccatgcgcctgctttcccccgtacgagtgccgaattacaacctcattatcatggacgaagcccatttcacggatcccgccagcatcgcggccagggggtacatcagcacgcgggtcgagatgggcgaggccgccggcatcttcatgaccgcaacgccacccggttcccgcgaccccttcccccagagcaacgcgcctatcatcgacgaagagcgggagatacccgaacgctcctggaacagcggccacgagtgggtgaccgacttcaaggggaagaccgtgtggttcgtcccgtccattaaagccggcaacgacatagccgcctgtcttcggaagaacgggaagaaagttatacagctgagccgcaagaccttcgactctgagtacgtcaagacgcggactaatgactgggactttgtcgtgacgaccgatatctcggagatgggagcgaacttcaaggccgagcgcgtaattgacccgcggcgctgcatgaagcccgtcatcctgaccgacggcgaggagagggtgatcctcgcagggcccatgccggtgacccacagtagcgccgcccagcgccgggggcgcatcgggcgcaaccccaagaacgaaaacgaccagtacatctacatgggtgaaccccttgaaaacgacgaggactgcgcgcactggaaggaggccaagatgctcttggacaacatcaatacaccggagggtatcatcccgtccatgttcgagcccgagcgtgaaaaagtcgacgccatcgacggcgagtatcggctacgaggcgaagcacgcaagacgttcgttgacctcatgcgccgcggggaccttccggtgtggctggccttcaaggttgcggccgagggaataaactacgccgatcggcgctggtgcttcgacgggatcaagaataaccaaatcctcgaggagaatgtagaggtggagatctggaccaaggaaggcgaacggaagaagttgaagccgaggtggctagacgccaggatctacagcgaccccctggctctgaaggagttcaaggagttcgcggccgggcgcaagtcactgaccctcaacctgatcactgagatgggccgcctgcccaccttcatgacccaaaagacccgcgacgcgcttgataacctcgccgtcctgcatacggcggaagccggaggtcgggcctataaccatgccctcagcgaactcccggagacgctcgagaccttgttactgctcaccctgcttgccacagtgaccggaggaatcttcctcttcctgatgagtggacgcgggatcgggaagatgaccctgggaatgtgttgcatcattaccgccagcatcttgctgtggtacgcacagattcaacctcactggatcgccgcgtccatcatactggagttctttctcatcgtgctgctgatccccgaacccgagaagcagcggacgcctcaggacaaccaactcacttacgtggtgattgcaatcttaaccgtcgtcgcggccaccatggccaacgagatgggtttcctggaaaagaccaagaaggacttgggcctcggaagcattgccacgcaacagccggagtctaacatactcgatatcgacctccgtcccgctagcgcgtggacactatatgccgtggcaacgacctttgtcacgcctatgctgcggcacagcattgagaattcaagcgtgaacgtctccctgaccgctattgcaaaccaggcgactgtgctgatggggttaggcaagggatggccattaagcaagatggacatcggcgtcccgctgctggccatcgggtgctattcccaggtgaatcctatcaccctcacggctgcgctgctcctcctggtggcgcactacgccattatcggcccagggctgcaggccaaggcgacccgcgaggcccagaagcgggcggccgcaggcatcatgaagaaccctaccgttgacggcattaccgtgatagacttggatcccataccctatgatcccaagtttgagaagcagctggggcaagtcatgctgctaatactgtgcgtgacccaggtgctgatgatgcgcaccacctgggccttgtgcgaggccttaacattggcaaccggccccatcagcaccctctgggagggaaaccccggccggttctggaacactaccatcgccgtctccatggcgaacatttttagaggaagctacctggctggcgccggcctcctcttctcaatcatgaagaacacgactaacacccggcgcgggaccggcaacatcggggaaacactgggcgagaaatggaaatccaggctgaacgcactcggtaagtccgaattccaaatctacaagaagtccgggatccaggaagttgaccggacgctggccaaggaagggatcaaacgcggggagaccgaccatcacgccgtgtcccgtggcagcgccaagctgcgatggttcgtagagcggaacatggtgacaccggaggggaaagtggtagacctcggctgtggccgcgggggctggtcctactactgtgggggcctgaagaacgtgcgggaagtcaaaggacttaccaagggaggtcccgggcatgaggagccaataccaatgagcacctacggctggaacctcgtccgcctgcagtcgggggtggacgtattcttcatcccgcccgagaagtgcgataccctcctctgtgatatcggcgagagcagtcccaaccctactgtagaagcggggaggacgctgcgcgtgctgaacttagtggagaactggctaaacaacaacacccagttctgcatcaaggtcctgaacccatatatgcccagcgttatcgagaagatggaggccctgcagcggaagtacggtggcgccctcgtgcgcaacccgctgagcagaaactccactcacgagatgtattgggtctcgaacgcctccgggaacatcgtgagctcggtcaacatgattagccgcatgctgatcaaccgcttcaccatgcgccacaagaaggctacttacgagcccgacgttgacttaggttccgggacgcggaatatcgggatcgagtcagaaatccccaacctggacataatcgggaagcgcatcgagaagattaaacaagagcacgagacgtcctggcattacgatcaagatcacccctacaagacgtgggcgtaccacggtagttacgaaaccaagcagacgggcagtgcaagctccatggtgaacggggttgtccgtcttctcaccaagccgtgggacgttctgcccaccgtgacccaaatggccatgacggacaccacccccttcgggcagcagcgcgtcttcaaagagaaggtagacacccgaacgcaagagcccaaggaagggaccaagaagctgatgaagatcaccgctgagtggctctggaaggagctgggaaaaaagaagaccccgagaatgtgcacgcgcgaggagttcactaggaaggtgcgctcaaatgccgcattgggcgccatcttcaccgacgagaacaagtggaagtccgctagagaggcagtagaggacagccgtttctgggaattggtggacaaggagcggaacttacacctggagggaaagtgcgagacctgtgtttacaacatgatgggaaaacgcgagaagaagctcggggaattcggcaaggccaagggctcccgggcgatctggtacatgtggctgggcgccaggttcctagagttcgaggccctcggttttctgaacgaggaccattggttcagccgggagaactccctgtccggggtagagggcgaggggctccataagctgggatatatcctacgtgacgtgagtaagaaggagggcggcgccatgtacgccgacgacacggccgggtgggacacccggatcacccttgaagatctgaaaaatgaggagatggtcaccaaccacatggagggggagcacaagaagctggccgaggcaattttcaaactcacgtaccagaacaaggtggtacgagtccagagacctacgccccggggcaccgtcatggacattatttcccggcgtgaccagcgggggagtggccaggtggggacatacggcctgaacacgttcaccaacatggaagcccagctgatcagacagatggagggagagggggtctttaagaacattcagcacctcaccgtgaccgaggaggtggcggtccagaactggctggcccgggttggcagagaacgcctgtcgcggatggccatttctggggatgactgcgtcgtcaagcccctcgacgaccgcttcgcgaatgcgctgactgcgttgaacgacatgggcaagattcggaaggatatccagcaatgggagccctccaagggctggaacgactggacgcaggtgcccttctgctcacaccacttccatgagcttataatgaaggacgggcgtgtgctcgtcgtgccctgccggaaccaggatgagctcatcggtcgcgcaagaatctcccagggggcaggttggagtctcagagaaaccgcctgcctagggaaatcatacgcccagatgtggagcctcatgtacttccaccgccgcgacctccgcttggcggcgaacgccatctgttccgctgtgccaagccactgggtcccgacctcacgcacgacctggagcatccacgcgaagcacgagtggatgaccaccgaggacatgctgaccgtgtggaaccgggtgtggatccgcgagaacccctggatggaggacaagacacccgtcgagtcatgggaggagatcccgtacttgggcaagagagaggaccagtggtgtggcagcctgatcggtcttacctcccgcgcgacttgggcgaaaaacatccaggccgccatcaaccaggtacggagccttatagggaacgaggagtacacagactatatgccatccatgaagcgctttaggcgcgaggaagaggaggcaggggtgctgtggtaa

SEQ ID NO: 25142 - RNA, 9876 nt, synthetic construct
  misc_feature 1..9876: note = derived and/or modified CDS sequence (opt11) from DENV-2__FJ810411__SS-prME
  source 1..9876: mol_type = other RNA
agcgccggcatgatcatcatgctgatccccacggtgatggctttccacttaaccacccggaacggcgagccccacatgatcgttggcatccaggagaagggtaagtctctgctgttcaaaaccgaggacggcgttaatatgtgcaccttgatggcgatggacctgggtgagctgtgcgaagacaccatcacctacaagtgccccctcctgagacagaacgagccagaggacatcgactgctggtgcaatagcaccagcacctgggtaacttacgggacctgcaccacgaccggcgagcaccggcgggagaagcggtccgtcgccctggtgccccacgttggcatgggcctcgagacccggaccgagacgtggatgagctcggaaggcgcctggaaacacgcacagcgcatcgagacctggatcctgcggcatccgggcttcacgatcatggccgcgatcctggcgtacaccatagggacaacccatttccaacgcgcactcatcttcatcctcctgacggctgtcgcgccgtccatgacaatgcggtgcatcggcatctccaatcgcgacttcgtggagggggtgtctggggggtcctgggttgacatcgtgctcgagcatgggtcctgcgtaaccactatggccaagaacaaacccactctggatttcgagctgatcaagaccgaggcaaagcagcccgccaccctacggaagtactgcatcgaggccaagctgacgaacacgaccaccgagagcagatgccccacacaaggcgagccctcccttaaagaggaacaggataagcggtttgtctgcaagcactcaatggtggaccgcggctggggcaacggctgcgggctgtttggcaagggcggcatcgtcacgtgcgcgatgttcacgtgcaagaagaacatggagggtaagatagtccagcccgagaacctggagtacaccatcgtggtcactccgcactcgggggaagagcacgcagtcggcaacgacacaggaaagcatggcaaggaaatcaaggtgaccccgcagagctccatcaccgaggccgagctgacggggtacggcaccgtgaccatggagtgcagcccgcggaccagcctcgacttcaatgagatggttttgctgcagatggagaacaaagcctggctggtgcaccgccaatggttcctggatctgcctctcccctggctgccgggtgccgacaagcaggagagcaactggatccagaaggagaccctggtgaccttcaagaacccacacgccaagaaacaggacgttgtggtcctcggtagccaggagggcgccatgcacacggccttgaccggggccacggagatccagatgtccagcggcaacctcctgttcactggccacctgaagtgccggctgcgcatggataaactccagttaaagggcatgtcctactccatgtgcacggggaaatttaaggtggtgaaagagatcgccgagacccagcacggtaccattgtaatcagagtacagtacgagggcgacggtagcccatgcaagatacccttcgagatcatggacctggaaaaacgatacgtgctcggccggctgataaccgtcaacccgattgtgacggagaaagacagcccagtgaacatcgaggcggagcctccgtttggtgacagctacattatcatcggggtagagccgggacagctgaagctcaactggttcaagaaagggagcagtatcggccagatgttcgagaccaccatgcgaggtgccaaacgcatggccatcctgggggacactgcctgggactttggttctttaggcggagtgttcacgtccatcgggaaggccctccaccaggtgttcggggcgatctacggggccgcattcagcggcgtctcctggaccatgaaaatcctcatcggcgtaatcatcacctggatagggatgaatagcaggtccaccagcctgtccgtgtccctcgtcctcgtgggcatcgtcacgctgtacctgggggtgatggtgcaggcagactccggctgcgtggtcagctggaagaacaaagagctcaagtgcgggagcggcatcttcatcaccgacaatgtgcacacatggaccgagcagtacaagttccagccggagtccccctctaagctggcgtccgccatccagaaggcccaagaggagggcatctgcgggatccgctccgttacgaggctggagaacttaatgtggaagcagatcacgcccgagctgaaccatatcctggccgagaacgaggtcaagttaaccatcatgactggcgacatcaaggggatcatgcaggccgggaagcgttccctgcggccgcagcccacggagctaaagtacagctggaagacttgggggaaggcaaagatgttgtccacggagtcttacaaccagacctttctaattgatggccccgagacggcggagtgcccgaacaccaaccgcgcctggaactccctggaggtggaggactacggcttcggggtgttcaccaccaacatttggctcaaattaaaggagaagcaggatgctttctgcgacagcaagctgatgtccgccgcgatcaaggacaaccgagccgtccatgccgacatgggctactggatagagagcgcgctcaacgacacgtggaaaatcgagaaggcctcctttatagaggttaagaattgccactggccaaagagccacaccttatggtccaacggggtgctggagtctgagatgatcattcctaagaatctcgcgggccccgtttcccagcacaactatcgcccgggttaccacacccagatcgccggtccctggcacttaggcaagctggagatggacttcgacttctgcgacgggaccaccgtaatagtgacggaggactgcgggaaccgtgggccgagcctccgcaccaccacagcgagcggcaagctgatcacggagtggtgctgccggtcctgcactctgcccccgttacgctacagaggcgaggacgggtgttggtatggcatggagatcaggcccctgaaggagaaggaggagaaccttgttaactcgcttgtgacagccgggcacggccaggtggacaacttctctctcggggtcctgggtatggccctgttcctcgaagagatgctccggacccgcgtgggcacgaagcacgccattttattggtggccgtcagcttcgtgaccttgataacggggaacatgtcattcaaggatctcggccgtgtcgttgtgatggtgggggccaccatggcagatgacatcggcatgggcgtcacgtacttagcgctgctcgccgccttcaaagtgcgccccaccttcgccgccggcctgcttctccggaagctgactagcaaagagctgatgatgactacgatcggcatcgtgctgctgtcccagagcactatccctgaaacaatcctggagctcaccgacgccttggccctggggatgatggttctaaagatcgtgcgcaatatggagaagtaccaactggctgtgaccatcatggccattctgtgcgtcccgaacgccgtcatcctccaaaacgcgtggaaggtctcctgcacgatcctggccgtcgtgagcgtcagccccttactactgaccagcagtcagcagaagaccgattggatccccctggccctcacgatcaaaggcctgaaccccaccgccatcttcttaaccacactctcccgcacgaacaagaagcggtcctggccgctgaacgaagcgattatggccgtgggtatggtatcaatcctggcctccagcctcctgaagaacgatatacccatgaccggcccccttgtagccggcggcctcctgaccgtgtgctacgtgcttaccggcaggtccgccgacctcgagctggagcgggcaacggacgtcaagtgggaagaccaggccgaaatctctgggtcttcccccatcctatcgatcacgatctccgaggacggatccatgtccataaagaacgaggaggaggagcagaccctcaccatccttatccgcaccgggttgctcgtgatcagcggcctgtttccgatctccattcccataaccgccgccgcctggtacctatgggaggtcaaaaagcagcgggcgggcgtactctgggacgtgccgtccccacctcccatagggaaggccgagctggaggatggcgcttaccgcatcaagcagaaggggatcctgggctactcccagattggagccggcgtttacaaggaggggaccttccacaccatgtggcacgtcacccgcggggcggtgctcatgcacaagggcaagcgcatcgagccctcttgggcagacgtgaagaaggacctgatctcctacgggggcgggtggaagctggagggcgagtggaaggagggcgaggaagtccaggtgctcgccctagagcccggaaagaacccccgggccgtccagacgaaacccggcctgttcaagactaacaccgggaccatcggggctgtcagtcttgacttctcccccgggacgagcggcagcccgattatcgacaagaagggcaaggtggtggggttgtacgggaacggcgtcgtcacccgcagcggagcatacgtgtcagcaatcgcccagaccgagaaatccatcgaagacaaccccgagatcgaagatgacatcttccggaagcgcaggctgaccatcatggatctgcaccccggtgccggtaagacgaaacgctacctcccggcaatcgtccgggaagctattaagcgcggcctgaggacgctgatcctcgcaccgacccgcgtggtagccgccgagatggaggaggcactgcggggacttcccatccgctaccagacccccgcgataagggccgagcatacgggccgcgagattgtcgacctcatgtgccacgccaccttcaccatgcgcctgctgtcgcccgtgagagttcccaactacaacctcatcatcatggacgaggcccatttcaccgaccccgccagtatcgcggcccgcgggtacattagcacgcgtgtcgagatgggcgaggcagccggcatattcatgaccgccactccgcccggctcccgcgacccgttcccccagtctaacgcgcccattatagacgaagagagagagatccccgagcgatcctggaattctggtcacgagtgggtgaccgacttcaaggggaagacagtgtggttcgtcccgtccatcaaggccggcaacgacatcgccgcatgcctgcggaagaacgggaagaaagttatccagctgagtcgcaagacttttgatagcgagtacgtgaagacccgtaccaacgactgggacttcgtcgtgacgacggacatcagcgagatgggcgcgaacttcaaggccgagcgcgttatcgacccacggcgctgtatgaagcccgtcatccttaccgacggcgaggaacgggtgatcctggccgggccaatgccggtgacccacagtagcgccgcacaacgccggggccgcatcggacggaacccgaagaacgagaacgaccagtatatctacatgggcgaacctctggagaacgacgaggactgcgcgcactggaaagaggccaagatgctcctggataacataaacacgcccgaggggatcatcccgtcaatgttcgagcccgagcgcgagaaggtcgacgccatcgacggcgagtatcggctccgcggcgaggcccgcaagactttcgtcgacctcatgcgccgcggtgacctgcccgtgtggctggccttcaaggtcgcggccgagggcataaactacgccgaccggcgctggtgcttcgatgggattaaaaataaccagattctcgaggagaatgtcgaggttgaaatctggaccaaggagggcgagcggaagaagctgaagccgcgctggctggacgcacggatatacagtgaccccctagccctgaaggagttcaaagaatttgcggcaggccgtaagtctctgactctaaacctgataacagagatgggccggctgccaaccttcatgacccaaaagacccgcgacgcgctcgacaacttggccgtactgcatacggcggaggccggcggacgggcctacaaccacgcactcagcgagctgcccgagaccctggagacgttgcttctgctcacactgctggccacggtcaccggtgggatctttcttttcctaatgtccggccgcggtatcgggaagatgactctgggaatgtgctgcatcatcaccgcgtccattctcctgtggtacgcccaaatccagccgcattggatcgccgcctccatcatacttgagttcttcctcatcgttctgctaatccccgagccagaaaaacagcgcacgccacaggacaaccaactcacatacgttgtgatcgccatcctgacggtcgtggccgccaccatggccaacgagatggggttcctggagaagaccaagaaggacctcgggctggggtcgatcgccacgcagcagccggagtccaatatactggacatagacctccgccccgcatccgcgtggacgttatacgcggttgctaccaccttcgtgacgcccatgctgcgacactctatcgaaaactccagcgtgaacgtgtccctgaccgccatcgccaaccaggccaccgtcctgatgggcctcgggaaaggctggccgctcagcaaaatggatataggcgtcccgctgttagcaatcgggtgctactcccaggtgaaccccatcaccctcaccgccgccctgctgctcctcgtcgcgcactatgcaatcataggccccgggctgcaggcgaaggccacccgggaagcccaaaagcgggcggccgccggcattatgaagaaccccaccgttgacggcattaccgttatcgacctcgacccgatcccctacgaccccaagttcgagaagcagttagggcaggtgatgctgttgatcctttgcgtgactcaggtgctgatgatgcgcaccacgtgggccctctgcgaagctttgaccctggcgacgggccccatcagcaccctctgggaggggaacccgggccggttttggaataccacgatagccgtctccatggccaacatcttccgcggcagctaccttgccggcgccggcctcctgttctccatcatgaagaacacgaccaacacccggcgagggaccggcaacatcggggaaacgctgggcgagaaatggaagtcccgcctgaacgctctcggcaagtccgaattccagatttacaagaaatccggtattcaggaagtcgaccggacactggccaaggagggtatcaagagaggcgaaactgaccatcacgccgtctcccggggcagcgccaagctccgctggttcgtcgagcgtaacatggtcaccccggaggggaaggtggtcgacctcggctgcggccgcggtggctggtcctactactgcggtggcctgaagaatgtccgggaagtgaagggcttaacaaaaggaggcccagggcatgaggagcccatcccgatgagcacttacggatggaacctcgtccgcctacagtcgggggtcgacgtattcttcatcccgccggagaaatgtgacacacttctctgcgacattggtgaaagctctcccaacccgacggtcgaggccgggcggacgttacgcgtgctaaacctcgtggaaaactggctgaacaataacacccagttctgtatcaaggtactgaacccctacatgcccagcgttattgagaagatggaagccctgcagcggaagtacggcggcgcgctcgtgcgcaatccgcttagcagaaactccacccacgagatgtactgggtaagcaacgccagcggaaacatcgttagcagcgtaaacatgatcagccgtatgttgatcaaccgtttcacgatgaggcataaaaaggccacctatgagcccgacgtcgacctcggctccgggactcggaacatcggcattgagagcgaaatccccaacctggacataatagggaagcgcatagagaagatcaaacaggagcacgagacatcctggcattatgaccaggatcacccctataagacctgggcgtatcacggcagctatgagaccaagcagacgggcagtgccagctcaatggtgaacggggttgtacgtctactcaccaagccatgggacgtgctgcccactgtaacccagatggcaatgacggacaccacccctttcggccagcagcgcgtcttcaaagagaaggtggatactcgcactcaagagcccaaagaggggaccaagaaactgatgaagatcaccgccgagtggctctggaaggagctgggcaagaagaaaaccccgcggatgtgcacccgcgaagagttcaccaagaaggtgcggagcaacgccgcgctgggtgccattttcaccgacgagaacaaatggaagtccgcccgcgaggccgtcgaggatagccggttttgggagttagttgacaaagagcggaacctccacctcgaggggaagtgcgagacttgcgtctacaacatgatgggcaaacgggagaagaagctcggggagttcggcaaggccaaagggagccgcgcgatctggtacatgtggctgggcgcccgcttcctggagttcgaggccctgggcttcctgaacgaggaccactggtttagcagggagaattccctgtctggtgtcgaaggggaaggtttacacaaactgggctacatcttacgggacgtgagcaagaaagaaggcggcgctatgtacgcggatgacacggccggctgggacacccgcatcaccctcgaagacctgaaaaacgaggagatggttacgaatcacatggagggggagcacaagaagctagccgaggccatcttcaagctcacgtaccagaacaaggtcgttcgggtccaaagacccacgccccggggcactgtgatggatatcatctcacgcagggaccagcgcgggtctggtcaagtcgggacatatggcctaaatacgttcaccaacatggaggcccagctgatccggcagatggagggcgaaggagtcttcaagaatatacagcacctcaccgttaccgaggaggtagcggtccagaactggttagcccgggtgggccgggagcgattatctcgcatggcgatcagcggtgatgactgcgtggttaagcccctcgacgatcggttcgccaacgccctgaccgcgctgaacgacatgggcaaaatccgcaaggatatccagcagtgggaaccgtccaagggctggaatgactggacacaggtccccttctgcagccaccacttccacgagctcatcatgaaggacggtcgggtgctggtagtaccctgccgcaaccaggacgaactgattggccgtgctcgcatctcccagggggccggctggtctctccgggagaccgcctgcctggggaaatcctacgcacagatgtggagcctgatgtacttccaccgacgagacctccgactggcagcaaacgccatctgctccgccgtgccctcacattgggtccccacctcccggacgacctggagcatccacgccaagcacgagtggatgaccaccgaggatatgctgaccgtctggaaccgtgtgtggatccgggagaatccctggatggaggataagacgcccgtagagtcgtgggaggagataccttacctcgggaaacgcgaggaccagtggtgcggaagcctgatcgggctgacctcccgggcgacctgggcaaagaacatccaggccgccataaaccaggtgagatcgctcatcggcaacgaagagtataccgactacatgccatcgatgaagcggtttaggcgggaggaggaggaggctggggtactttggtga

SEQ ID NO: 25143 - RNA, 9876 nt, synthetic construct
  misc_feature 1..9876: note = derived and/or modified CDS sequence (opt11) from DENV-2__FJ744713__SS-prME
  source 1..9876: mol_type = other RNA
tccgccggtatgatcatcatgctgatacccaccgtaatggccttccaccttaccacccgcaacggggagccccatatgattgtcggtatacaggagaaaggcaagagcctgctgttcaaaaccgaggacggcgttaacatgtgcaccttgatggctatggacctgggggaactgtgcgaggataccatcacctataaatgtccacttttacggcagaacgagcccgaggacatcgactgctggtgcaacagcacctctacctgggtgacctacgggacgtgcactactaccggtgaacaccgccgggagaagcgctctgtcgcgctggtgccccacgtgggtatgggccttgagacgaggaccgaaacctggatgagcagcgagggggcttggaagcacgcccagcgtatcgaaacctggatcctgcggcacccgggcttcacgattatggcagcgatcctggcctacaccatcgggacgacccacttccagcgcgccctcatcttcatcctgctgacggcagtcgcgcccagcatgacgatgcgctgcatcggcatcagcaaccgcgacttcgtggagggggtatctgggggtagttgggtcgatatcgtgctcgagcacggctcttgcgtgaccaccatggcgaagaacaagcccaccctggacttcgagctaataaagaccgaagccaagcaaccagccaccctccgcaagtactgtatagaagccaagctgaccaacactaccaccgagagccgctgccccacccagggcgagccctccctcaaggaggagcaggacaagcggttcgtctgtaagcatagcatggtggaccgtggctgggggaacggctgcgggctattcgggaaaggtgggatcgttacgtgtgcgatgttcacgtgtaagaagaacatggagggcaagatcgtccagcccgagaacctggagtacaccatagtggtgacgccccactccggagaagagcacgccgtcggaaacgatacggggaagcacggcaaggagatcaaggtgacgccgcaaagctccataaccgaggccgagctgacgggttatggcacagtgactatggagtgcagcccccggacctccctagattttaacgagatggtcttgctgcagatggagaacaaagcctggctcgtgcaccgacagtggttcctggacctgcccctcccctggctcccgggcgccgacaaacaagagtccaactggatccaaaaagagaccctagtcaccttcaagaatccccacgcgaagaagcaagacgtagtggtcctcgggagccaagagggcgctatgcacacggcccttaccggggccaccgaaatccaaatgagcagcggcaacttgctgttcactgggcatctgaagtgccgactgagaatggacaagctgcaactgaaaggcatgtcgtacagcatgtgcacgggtaagttcaaggtggtaaaggagatcgccgagacccaacacgggaccattgtcattcgggtgcagtacgagggcgacgggtccccctgcaagatccccttcgagattatggacctcgagaaacgttacgtgctgggccggctgataaccgtcaatccgatcgtgacggaaaaggacagccccgtgaacattgaggctgagccccccttcggtgactcttacatcataatcggggtcgagcccggccagctgaaactcaactggtttaagaaggggagctcaatcgggcaaatgtttgagaccaccatgcgcggggccaaacgcatggccatcttgggcgacaccgcgtgggactttgggagcctaggcggggtttttacgtcgatcgggaaggcgctccatcaggtgtttggggcgatttacggggccgccttcagcggcgtgagttggactatgaagatcctgataggcgtgataatcacttggatcgggatgaacagccgtagcaccagcctgtccgtgagcctggtattagtcggtatcgtgacgctctacctaggggtcatggtgcaggccgattccggatgtgtggtatcgtggaagaacaaggagcttaaatgcgggagcgggatctttatcaccgacaacgtgcacacctggaccgagcagtacaagttccagcccgagtcccccagcaagttagcgagcgctatccagaaggcccaggaggaaggcatctgcggtatccgctcagtgactcggctcgagaacctcatgtggaagcagatcacacccgaactcaaccatatcctggcggagaacgaagtcaagctcactatcatgactggagacatcaagggcattatgcaggccggtaagcgctccctgcggccgcagcccacggagctgaagtactcatggaagacctgggggaaagctaaaatgctctccaccgaaagttacaaccagaccttcctgatcgacggccccgagacggccgagtgcccgaacaccaaccgcgcatggaactccctggaagtcgaggattacggcttcggggttttcacgaccaacatctggctcaagctgaaggagaagcaagacgctttttgcgattccaaactaatgtccgccgcaatcaaggacaaccgagccgtccacgcagacatgggatattggattgagagcgcccttaatgacacgtggaaaatagagaaggcgtcctttatcgaggtgaagaactgccactggcctaagagccacaccctctggtccaacggggtgcttgagagcgagatgattatccccaaaaaccttgcgggccctgtctcccaacacaactacagaccgggctaccacacgcaaatcgccggtccatggcacctgggcaagctggagatggacttcgacttctgcgacgggacaacggtgatcgttacagaagactgcggcaatcggggcccttctctccggacaaccaccgcctccggcaagctgatcacggagtggtgctgtcggtcctgcacactgcccccgctccgctatcggggcgaggacgggtgctggtacgggatggaaatccgccccctcaaggagaaggaggagaacctggtcaatagcttagtaaccgccgggcacggccaagtggataacttcagtttgggggtcctgggtatggccctgttcctggaggagatgctgaggacccgcgtcggcacgaagcatgccatcctactggtggccgtcagcttcgttaccctaatcaccggcaacatgtcgttcaaggacctcggtcgggtggttgtgatggtgggcgctaccatggccgatgatattggaatgggggtcacctacctcgccttgctagccgccttcaaagtgaggcccaccttcgccgcaggcctcctgctccggaagctgaccagcaaggagctgatgatgactacgataggcatcgtgcttctgtcgcagagcaccatccccgagaccatcctagagcttaccgacgcacttgccctggggatgatggtcctcaagatcgtgcgtaatatggagaagtaccagttagccgtgacgatcatggccattctgtgcgtcccgaatgctgtgatcctccaaaatgcttggaaggtgtcctgcaccatcctggccgtggtgagcgtaagccccctattactgactagctcacagcagaagaccgactggatacctctggcattgacgatcaaaggcctgaatcccaccgcgatcttccttacgaccctcagccgtacgaacaagaagcgatcctggccgctgaatgaggcaatcatggctgtggggatggtgtccattctggcgtcatcactcctgaagaacgacatcccgatgacgggccccctggtcgccggcggcctcctgactgtgtgctacgtcctaaccggccgcagtgctgacctcgagctggagcgggcgacggacgtcaaatgggaggaccaggccgagatcagcgggagctcccccatcctgtcaatcaccatctcagaagacggtagcatgtccatcaagaacgaggaagaggagcagattctcactatcctgatacgcaccggtctgttagtaataagtggcctgttccctatctccatccccataacggccgccgcatggtacctttgggaggtgaagaagcagagagcgggcgtgttgtgggacgtcccatcaccgccgcccattgggaaggccgagctggaggatggtgcgtaccgcatcaaacagaaggggatcctggggtactctcaaatcggtgccggcgtatacaaggaggggaccttccacaccatgtggcacgttacgcgcggcgcggtgctcatgcacaagggcaagcgcatagagcccagctgggcggacgtgaagaaggatctgatctcctatgggggcggatggaagctggaaggtgagtggaaagagggcgaggaggtacaggtgttagccctggagcctgggaagaatccgcgggccgttcagaccaaacccggcctgttcaaaacaaacaccgggaccataggcgccgtcagcctagacttctcccccggaactagcggtagccctattatcgacaagaagggcaaggtggtggggctgtacggcaacggcgttgtgacgcgcagcggagcctacgtttcagccatagcccagacggagaagtccatcgaggacaaccccgaaatcgaggatgacatcttcaggaaacgtcggctgaccatcatggacctccaccccggggccggcaagaccaagcgctaccttcccgcgatcgttcgggaggccatcaagcgcggtctgcggaccctcatcctcgcgccgacccgcgtggtggccgccgagatggaagaagccctgcggggtctgcccatccgctaccagacgcccgcgattcgggccgagcacaccggacgcgagatcgtcgacctcatgtgccacgccactttcacgatgcgcttactgtcccccgttcgggtgccgaactacaacctcataattatggacgaagcgcacttcaccgacccggccagcatcgcggcccgcgggtacattagcacccgggtagaaatgggcgaggccgctggaatcttcatgacggccacgccgcccggctcccgtgaccccttcccccagagcaacgcaccgatcatcgacgaggaacgggagatcccggagcgcagctggaacagcggccacgagtgggtcacagacttcaagggaaagaccgtgtggtttgttccgtccattaaggccgggaatgacatcgccgcctgcctgcggaagaacgggaagaaggtgatccagctgagccgcaagactttcgactccgagtacgtgaagacccggacgaacgactgggacttcgtcgtgaccacggacatcagcgaaatgggcgcgaacttcaaggccgaacgcgtaatcgatccacgccgctgcatgaaacccgtgatcctcaccgacggcgaagagagggttatcctagcgggacccatgcctgtgacccacagtagcgccgctcagcgccgggggcgcatcgggcggaacccgaagaacgaaaatgaccagtacatttacatgggtgaacccctcgagaacgacgaagactgcgcgcactggaaagaagcgaagatgctcctggacaatatcaacacccccgaggggatcatcccgtctatgttcgagcccgaaagagagaaggtcgatgcaatcgacggcgagtaccggctgcgaggcgaggcgcggaaaacattcgttgatctcatgcggcgcggggacctacccgtgtggctggccttcaaggtcgcggccgagggcatcaattatgctgaccggcgctggtgcttcgacgggattaagaacaaccagatcctcgaggagaatgtcgaagtcgagatctggactaaagagggcgaacggaagaagctgaagccccgctggttggacgcacggatctacagcgacccccttgcactgaaggagtttaaagagtttgcggccgggagaaaaagtctaaccttgaatctgataaccgagatgggccggctgcctaccttcatgacccaaaagacccgcgacgccctcgacaacctggccgtcctgcataccgcggaagccggcgggcgggcctacaatcacgccctctccgagctgcccgagactctggagacactcctgctgctcacgctgctggccaccgtgacgggcgggatcttcctctttctgatgtccggccgcggcatcgggaaaatgacgttggggatgtgttgcatcataactgccagcatcctcctctggtacgcccagatccagcctcactggatcgccgcctcgattatcctggagttcttcctcatcgtcctgctgatccccgagcccgagaagcaacggaccccccaggacaaccagctcacctacgtggtcatcgccatactcacggtcgtggcggctaccatggccaacgaaatggggttcctggagaagaccaagaaggacctaggtctcgggtccatcgccacccagcagccggagtccaacatcctggacatcgacctccggcccgcctccgcgtggacgctgtacgcagtggccacaacattcgtcacccccatgctgcggcacagcattgagaactctagcgtgaacgtgtccctcacggccatcgccaaccaggctaccgtcctgatggggctcggcaagggatggcccctaagcaagatggatatcggcgttccgctacttgccattggttgctattcccaagtcaacccgatcaccctaaccgccgccctgctgctgctggtcgcgcactacgccattatcggccccgggctacaggccaaggcaacgagggaggcccagaaacgggcggctgccggcatcatgaagaaccccacagttgacggaatcactgtgatcgatttggacccgatcccctatgaccccaagttcgagaagcagctggggcaggtcatgctcctcatactgtgcgtgacacaggtactgatgatgcgcacgacctgggcgctctgcgaggccctcaccctggcgaccgggcccatcagcacgctgtgggaggggaacccgggtagattctggaacaccaccatcgccgtctccatggccaatatcttccgcggcagctacttagccggcgccggcttgttgttctcgatcatgaagaacaccacgaacacccgtcgagggacaggcaacatcggggagaccctgggcgagaaatggaagtcccgcctgaacgcgctcgggaagtcggagtttcagatttacaagaagtccgggatccaggaggtggatcggaccctggccaaagagggcatcaaacgaggggagactgaccatcatgccgtgagccggggcagcgccaagctgcgctggtttgtagaaaggaacatggtgacccccgaggggaaggtggtcgacttaggctgcggccgcggcgggtggtcgtactactgcggtggactgaaaaacgtgcgggaggtgaaggggctgaccaagggcggccccgggcacgaggaaccaatcccgatgagcacgtacgggtggaatctcgtacgcctgcagtccggagtggacgtgttttttatcccgcccgagaagtgcgacacgcttctctgtgacattggggaatcttcccctaacccgaccgtcgaggcggggcggaccctgcgcgtgctgaacctcgtggagaattggctaaacaacaacacgcagttctgcatcaaggtcctcaacccttacatgccctctgtgattgagaagatggaagccttgcagcggaagtatggcggcgcactcgtccgcaacccgctgagccggaactccacccacgaaatgtactgggtctcgaacgcttccggaaatatcgtatcgtccgtgaatatgatctctagaatgcttatcaaccgattcaccatgcgccacaagaaggcaacgtacgagccggacgtcgacctcggctccgggacccggaacatcggcatagagtcagagatccccaacttggacatcatcgggaaaaggattgaaaagataaagcaggagcacgagacctcctggcactatgaccaggaccacccttacaagacctgggcgtaccacggcagctacgagaccaagcagaccggctccgctagctccatggtgaatggagtggtgcgactgctcacgaaaccatgggatgtgttacccaccgttacccagatggccatgacagacacgacgcccttcgggcagcagcgcgtcttcaaggagaaggttgacacgcgcacccaggaacctaaggagggcaccaaaaagctaatgaagatcaccgccgagtggctctggaaggaactgggcaagaagaagacaccaaggatgtgcacccgcgaggagttcacgcggaaagttcgcagcaatgccgcgctaggcgccatattcaccgacgagaacaaatggaagtccgcccgggaagccgtcgaggactcacgcttctgggagctcgtggacaaggagagaaacctgcacctagaggggaagtgcgagacctgcgtctacaacatgatggggaagcgcgagaagaagctaggggagttcggcaaggccaagggctcccgggcgatctggtacatgtggctgggcgcacgcttcctcgaattcgaggccctcggcttcctgaacgaggatcactggttcagccgggaaaactccctcagtggggtcgagggtgaagggcttcacaagctgggctacattctgcgagatgtgagcaagaaggagggcggcgccatgtacgcggatgacacggctggctgggacacgaggattaccctcgaggacctgaagaacgaagaaatggttaccaaccacatggagggggagcacaagaaactggcggaggctatattcaagctcacctatcaaaacaaagtggtgcgggtccagaggcccacaccccgcggcaccgtaatggacatcatttcccggcgcgaccagcggggctctggccaggtggggacctacggcctgaacaccttcacgaacatggaggcgcagctgatccggcagatggagggcgagggggtgtttaaaaacatacagcacctcactgtgactgaggaagtggcggttcaaaactggctggccagggtgggccgcgagcgcctgtcccggatggccatcagcggcgacgattgcgtggtcaaacccctcgacgaccgcttcgccaacgcccttaccgctctgaatgacatgggcaaaatccggaaggacatccagcaatgggagccgtccaagggctggaacgactggactcaggtgccgttctgcagccaccacttccacgagctcatcatgaaggacgggagagtgctggttgtgccctgtagaaaccaagacgagctgatcggccgagcccggatcagccagggggccggctggagcctccgcgaaacagcctgcctggggaagtcctacgcccagatgtggagcctgatgtacttccaccggcgcgacctccggctggcggccaacgccatctgcagcgccgtacccagccattgggttccgacctcccgcactacttggagcatacacgccaagcacgaatggatgacaaccgaagacatgttaaccgtgtggaatcgtgtttggatccgcgagaatccatggatggaggacaagacccccgtcgagtcctgggaggagatcccatacctcggcaagcgcgaggaccagtggtgcggttcactgatcgggctgacgtcccgcgctacctgggcaaagaacatccaggccgccatcaaccaagtgcggtctctcattggcaacgaggagtacaccgattacatgccgagcatgaagcgctttcggcgcgaggaggaggaagcgggggttttatggtga

SEQ ID NO: 25144 - RNA, 9876 nt, synthetic construct
  misc_feature 1..9876: note = derived and/or modified CDS sequence (opt11) from DENV-2__FJ744714__SS-prME
  source 1..9876: mol_type = other RNA
agcgccgggatgatcataatgctgatccccaccgtgatggccttccacctcaccacccgcaatggggagccccatatgatcgtagggattcaggaaaaggggaagagcctgctgttcaagaccgaagacggcgtgaacatgtgcactctcatggcgatggacctgggagagctgtgcgaggacaccatcacctacaaatgcccactcctgcggcagaacgaacctgaggacatcgattgctggtgcaatagcactagcacctgggtgacctacggcacttgcaccactactggcgagcatcggcgggagaaacggagcgtggcactggtgccccatgttgggatggggctggagacccggaccgagacttggatgtccagcgagggggcttggaagcacgcccaacgcatcgagacctggatcctgcgccacccgggcttcacgatcatggccgcaattctagcctacacaatcgggaccacccacttccagagggtcttaatcttcatcctgctaactgccgtggccccctccatgaccatgcgttgcataggcattagcaatcgcgacttcgtagagggcgtctccggcggcagctgggttgacatagtcttagagcacggctcttgcgtcaccaccatggcgaagaacaagcctacgctggacttcgagctaatcaagaccgaggctaaacagcccgccacccttcgcaagtactgtatcgaggccaagctgacaaacacgaccacggagtcacgctgccccacccagggggagccctcactgaaagaggagcaggacaaaaggttcgtgtgtaagcactccatggtagaccgcggctgggggaacggatgcggcctgttcggcaagggcgggatcgttacatgcgccatgttcacgtgtaagaagaacatggagggtaagatcgtgcagcccgagaacctggagtacaccattgtcgtcaccccacactccggagaagaacacgcggttggaaacgacacgggtaaacatggcaaggagatcaaggtaaccccgcaatcatccatcaccgaggctgaactgaccgggtacggcaccgtcacgatggagtgctcgccacgcacgggtcttgacttcaacgagatggtgctgttgcagatggaaaataaggcatggctcgtacaccgccagtggttcctggacctgcccctcccctggctgccgggggcggataagcaggagtccaactggatccagaaggagactctggtcacctttaagaaccctcatgccaagaaacaagacgtcgtcgtgctcggctcgcaggaaggggccatgcacacggccctgactggcgcaaccgagatccagatgagctccgggaacctcctgttcactggccatctgaagtgcaggctgcgcatggacaagttacagctgaaaggcatgtcctacagcatgtgtacaggaaaattcaaggtggtcaaggagatcgccgaaacccagcacggcaccatcgtgatcagggtgcagtacgagggcgacggcagcccctgcaagatcccctttgagatcatggacctggagaagcgctacgtccttggcaggctgatcaccgtgaatcctatcgtgacggagaaggactcccctgtcaacatcgaggccgaaccgccattcggagacagctatatcattatcggcgtggaaccgggccagctgaagctcaactggttcaagaagggatcctctatcggacagatgttcgagacaacgatgcgcggtgcgaagcgtatggccatcctgggagacaccgcgtgggacttcggtagcctgggcggggtgttcacgtcgatcgggaaggcgctccaccaagtatttggggcaatctacggagcggccttctctggggtgagctggaccatgaagatcctgatcggggtgattatcacctggatcggcatgaactcccggagcacctcgctgagcgtctccttagtgttagtgggaatcgtcacgttatatctgggtgtgatggtgcaggccgacagcgggtgcgtcgtttcctggaagaataaggagcttaagtgcggcagcggcatcttcatcactgacaacgtgcacacctggaccgagcaatacaagttccaacccgagagccccagcaagttagccagcgccatacagaaggctcaagaggaggggatctgcggcatccgctccgtaacgcggctggagaatcttatgtggaagcagattacccctgagctgaaccacatactggcagagaacgaggtgaagctgaccataatgaccggggacattaaaggtatcatgcaggccggaaagcgcagcttgcggccgcagccaacggagctgaagtactcctggaaaacctgggggaaggccaagatgctcagcaccgagtcctacaaccaaaccttcctgattgatggacccgaaacagcggagtgcccgaacacgaatagggcctggaatagcctggaggtggaggattatgggttcggggtattcaccaccaacatctggctcaagctaaaggagaagcaagacgccttctgtgactccaagctgatgagcgctgccatcaaggacaacagagcagtgcacgcagatatgggttactggatcgagtctgctctcaacgatacctggaaaatagagaaagccagcttcatcgaggtgaaaaactgccactggcccaaatcccatacattgtggagcaacggcgtcctggagtccgagatgatcatacctaagaatcttgccggccccgtgagccagcacaactaccgccccgggtaccacacccagatcgccgggccctggcacctggggaagctggagatggactttgatttctgcgatggcaccaccgttatcgttacagaggattgtgggaaccggggcccctccctcaggactactaccgcttcaggcaagctgatcacggaatggtgttgccgaagctgcaccttaccacccttacgttaccggggagaggatggatgttggtatggaatggagattcgccccctgaaggaaaaagaggagaacctggtgaactcccttgtgacagccggtcacggccaggtcgataacttcagcctgggggttctgggcatggccctctttctggaagagatgctacggacccgcgtggggacgaagcacgcgatcctactggtagctgtgagtttcgtgaccctgataaccggcaatatgagctttaaggatctaggtagagtagttgtgatggttggcgccaccatggccgacgacatcgggatgggcgtcacgtatcttgctctgctggccgcctttaaagtacgccccaccttcgctgccggccttctgcttcggaagctaacgagcaaggagttgatgatgactacaatagggatcgtcttgctctcccagtccaccatacccgagacggtactggagctcaccgatgccctggcactgggtatgatggtgctcaagatcgtcaggaacatggagaagtaccagctggccgtgacaatcatggccatcctgtgcgtccccaacgccgtgatcctccagaacgcctggaaggtgagctgcacaattttagccgtcgtatccgttagcccgctgctgctaacctcctcacagcaaaagacagactggatccccctggccctaacaatcaaaggactgaaccctaccgccatcttccttacgacactctcccgcacgaataagaagcgatcgtggccgctgaacgaggccataatggcggtcggcatggtgtccatcctggcaagctccttactgaagaacgacatcccgatgaccggccccctcgtggctgggggcttgctgaccgtctgctatgtcttaaccggacgctcagctgacctcgagctggagcgtgccacggacgtaaaatgggaagaccaggcggagatttccggcagcagccctatcctgtccataaccatcagcgaggacgggagcatgagcatcaagaacgaggaggaggaacagaccctcacgatactgatccgcacgggcctgctggtgatctccggcctgttcccgatcagcattcccattaccgctgccgcctggtacttatgggaggtgaaaaagcagcgggccggggtgctctgggacgtcccctcgccaccgcccatggggaaagctgaattagaggacggggcctaccgaatcaagcaaaaacggatactgggctatagtcagatcggcgccggcgtctacaaggagggcacctttcacaccatgtggcacgtgacccgcggagccgtcctcatgcacaagggcaagcgcatcgagccctcctgggcggatgtgaagaaggacctgatatcgtacgggggcgggtggaaactggagggagagtggaaggagggagaggaggtgcaggtccttgcgctggagcccgggaagaacccgcgcgcagtgcagacaaagcccggcctgttcaagactaacactgggaccatcggcgcggtgtccctcgacttcagccccgggacctcgggctcacccatcatcgacaagaagggcaaggtcgtggggctgtatggcaatggagtggtcacgcggtcgggtgcctatgtgagcgccatcgcgcagaccgagaaatcaatcgaagacaatcctgagatcgaggacgacatcttccgaaaacgccgcctgaccattatggacctgcatcccggcgcagggaagacaaaacggtacctccccgctattgtacgcgaggccattaagcggggcctccgcaccctgatcctggccccgacccgggtggtggccgccgagatggaggaggcactgcgcggcctgccaatccggtatcagactcccgccatcagagcggagcatacgggcagagagattgttgacctcatgtgccacgcgaccttcaccatgaggttgctaagccccgtccgcgtacctaattacaatctcattatcatggacgaggcccacttcaccgaccccgcctccattgccgcccgggggtacatcagcactcgcgtggagatgggcgaggccgccggcatattcatgaccgcgacgccgcccgggtcccgtgacccgttcccacagtccaacgcccccatcattgatgaggagagagaaatacccgaaaggagctggaactccggccacgaatgggtcacagacttcaaggggaagaccgtctggtttgtccctagcattaaggcgggaaacgacattgccgcatgcctgcgcaagaacggaaagaaggtcatccagctgtcacgcaagacattcgacagcgagtatgtcaagacccgcaccaacgactgggacttcgtggtaacgaccgacatttccgaaatgggcgcaaacttcaaggctgagcgtgtcatcgaccccagaaggtgcatgaagcccgtcatcctgaccgacggcgaggagcgcgttatcctggcagggccaatgccggtgacccactcctcagcagcccagcggcgcggtcgaattggccgcaaccccaagaacgagaacgaccaatacatatatatgggcgaaccccttgagaatgatgaggactgcgcccattggaaggaggctaagatgctcctcgataacatcaatactcccgaagggataataccttcgatgttcgagcccgagcgcgagaaggtggacgctatcgacggcgagtacaggctaaggggcgaggcgcgcaagacctttgtcgacctcatgaggcggggggacttaccagtgtggctggcctacaaggtggccgcagaggggatcaattacgccgatcgccggtggtgcttcgacgggatcaagaacaaccagatcctcgaggagaacgtagaggtggagatctggaccaaagagggcgagcgtaagaagttgaagccgcggtggctggacgcccgcatctactccgacccccttgcattgaaggagttcaaggagttcgccgcggggcggaagtccttaacccttaacctgattacggaaatggggcgcctgcccacctttatgacccagaagacgcgagacgccctagataacctggccgtcctgcatacggccgaggctggcgggcgagcatataaccacgcgttatccgagctgcccgagacactggaaacccttctgctgctcaccctgttagctacagtgaccggcgggatctttttgttcctgatgagcggccgagggataggtaagatgaccctgggcatgtgctgcatcatcaccgcctccattctcctgtggtatgcgcagatacaaccgcactggattgctgccagcatcatcctggagttcttcctcattgtgttgctgattcccgagcccgagaagcaacgcacgccccaagacaatcagcttacatacgtcgtgatagccatcctgaccgtggtggccgccaccatggctaacgagatggggttcttagagaagacgaagaaggacctcggcctggggagcatcgcgacacagcaaccggaaagcaacatcctggatatcgacctaagacccgcctccgcctggactttgtacgcggttgccaccaccttcgtgacgcccatgctgaggcactctatcgaaaacagctccgtcaacgtttcactcaccgctatcgccaaccaggccaccgtgttgatgggcctgggaaagggctggcccctcagcaagatggacattggcgtcccactgctggcgatcgggtgctatagccaggtgaatcccatcacattaactgcagccctgcttcttctcgtggcccactacgcgatcatcggccccggcctgcaggccaaggccaccagggaggcacaaaagagagccgcggcgggcatcatgaaaaacccaaccgtcgacggtatcacagttatcgatctcgaccccattccctacgatcccaagttcgagaagcagctgggtcaggtgatgctgctcatcttatgtgtcacccaggtgctcatgatgcggaccacctgggccctctgcgaggccctgaccctggccactggccccatctccacactgtgggaaggtaacccgggccgcttctggaacaccaccatagccgtgagcatggcgaacatcttccgggggtcatacctagccggagcaggcctcttattcagcattatgaagaacacgaccaacacccgccgcgggacaggcaatatcggggagacgctgggcgaaaagtggaaatcccggctgaacgccctagggaagagtgagtttcagatctacaaaaagtcagggatccaggaggtcgaccgcaccctagcgaaggagggcatcaagagaggggagaccgaccaccacgccgtgagccgcggcagcgccaagttgcggtggttcgtggagagaaatatggtcacccccgaggggaaggtggtggacctcggctgcggccgcggagggtggagctactactgcgggggcctgaagaacgtacgggaggtgaaaggtttgacgaaaggtggccctgggcacgaggagcccataccgatgtccacctacggctggaacttggtgcggctgcaatctggcgtcgacgtgttcttcatccccccggagaaatgcgacacgttactatgtgacatcggcgagtcgtcgcccaaccccactgttgaggccggacgcacgctgcgggtattaaatctcgtggagaactggctgaacaataacacacaattttgcataaaggtgctgaacccctacatgccctccgtcattgaaaagatggaggcgctgcaacgtaaatacgggggcgccctcgtgcgtaacccgctgagccgaaacagtacgcacgagatgtactgggtgagcaacgctagtgggaacattgtatccagcgtgaacatgatctcaagaatgcttataaaccgcttcaccatgcggcataagaaggcgacctacgagccagacgtagatctgggcagcgggacgcgcaacatcggcatcgagagtgaggtcccaaatctggacattatcgggaaacggatcgaaaagatcaagcaggaacacgagactagctggcactacgaccaagaccacccctacaagacctgggcttaccacggctcctacgagaccaagcaaacggggtcggcgtcaagcatggtcaacggggtagtccgcttactcactaaaccgtgggacgtgctacccacggtgacacagatggccatgacggacaccactccctttggccagcagcgggtcttcaaagagaaagtggacacccggacgcaggaacctaaggaggggaccaagaagttgatgaagatcacggccgagtggctttggaaggagctgggcaagaagaagacgccacgcatgtgtacgcgggaggagttcactcgcaaggtgcggtccaacgctgccctgggcgcgatcttcaccgacgagaacaagtggaagtccgcccgtgaggcggtagaggactctcggttctgggagctcgtggacaaggagcgcaaccttcacttagaggggaagtgcgaaacctgcgtctataatatgatgggaaagcgggaaaagaaactcggtgagttcgggaaagccaaagggtctcgcgctatctggtacatgtggttaggtgcgcggttcctcgagttcgaggccctcggcttcctgaacgaggatcactggtttagccgcgagaactccctgtccggggtggagggtgaggggctgcataagctgggctacatcttgcgtgacgtgtctaagaaggagggcggggcgatgtacgccgacgacacggctggctgggacacccgtataacgctagaggacctgaagaacgaggaaatggtgaccaaccacatggagggggagcataagaagctggccgaggccatttttaagctcacgtaccagaataaggtcgtacgggtccagcgccccacgccccgggggacggtgatggacatcattagccgccgggaccagcgcggatccggccaagttgggacctatggcctgaacacgttcacaaacatggaggcccaactgatccgtcagatggagggtgagggggtctttaaaaatatccagcacctcaccgtgaccgaggaggtggcggtccagaactggctcgcgagggtgggacgcgagcggctgagccgaatggccatctccggggatgattgcgttgtcaagcccttagacgaccggttcgcaaacgcgctgacggctctgaacgatatgggcaagatacgcaaggacatacagcagtgggagcctagcaagggctggaacgattggactcaagtgccgttctgttcgcaccactttcatgagctcatcatgaaggacgggcgggtgctggtcgtgccctgcagaaatcaggacgagttgatcggccgagcgcgcatttcccagggagctggatggtcccttcgggagactgcttgcctgggcaagagctacgcccaaatgtggtccctcatgtacttccaccgccgcgacttaagattagctgcgaacgccatctgctcggcggtccccagccactgggtgccgaccagccggactacctggtccatccacgccaagcatgagtggatgaccaccgaagacatgttaaccgtgtggaaccgtgtgtggatccgggagaatccctggatggaggacaaaactcccgtcgagtcttgggaggagatcccctacctcggaaagcgcgaggaccagtggtgcggctctctgatcgggctgaccagccgggccacttgggcgaagaacatccaggccgccatcaaccaggtccgctccctcataggcaatgaggagtacaccgactacatgccgtccatgaagcggttccgccgcgaagaggaggaggcaggcgtgctgtggtag

SEQ ID NO: 25145 - RNA, 9876 nt, synthetic construct
  misc_feature 1..9876: note = derived and/or modified CDS sequence (opt11) from DENV-2__FJ744716__SS-prME
  source 1..9876: mol_type = other RNA
tcggccgggatgattatcatgctgatccccaccgttatggcctttcacctcacaacacggaacggggagccccacatgatcgttgggattcaggaaaagggcaagagccttctgttcaaaaccgaggacggggtaaacatgtgtaccctcatggcgatggacctgggggagctgtgcgaggacaccatcacatacaagtgcccccttctgcggcagaacgagcccgaggacatcgactgttggtgtaacagtacctccacctgggtgacctacgggacttgcaccaccaccggtgagcaccgccgcgagaaacgctccgtcgccctggtgcctcacgtggggatgggcctggagaccagaactgagacatggatgtccagcgaaggggcctggaagcacgcccagcggatcgaaacatggatcctgcggcacccgggcttcaccatcatggcggcaattctagcgtacaccatcgggactacccacttccagcgcgtcctcatcttcatcctactgacggccgtagccccctccatgaccatgcggtgcattggcatcagtaacagagatttcgtggagggagtctccgggggatcctgggtggacattgtgctcgagcacggctcctgcgtcaccaccatggcgaagaacaagccgacactggacttcgaactgataaaaaccgaagcgaaacagcccgccacgctccggaagtactgtatcgaggctaagctgacaaacacgaccaccgaaagccgctgccccacccaaggcgaaccatccctgaaggaggagcaagacaagcggttcgtttgcaagcatagcatggtggaccgcggctgggggaatggctgcggccttttcggcaagggcgggatcgtcacgtgtgccatgttcacgtgcaaaaaaaacatggagggcaagatagtgcagcccgagaaccttgagtataccatcgtcgtcacgccccatagtggagaagagcacgcggtaggcaatgatacggggaagcacggcaaggaaatcaaggtgaccccgcagagctccataaccgaggccgagctaactggctacgggaccgtcaccatggagtgcagcccccggaccgggctcgacttcaacgaaatggtgctgctgcagatggagaataaggcctggctggtgcatcgccagtggttcctggacctgcccctgccctggctgccgggggccgacaaacaggagtccaactggattcagaaggagaccctagtcaccttcaagaacccccacgccaagaagcaggacgttgtggtgctcggcagccaggaaggggcgatgcatacggcgttgacaggcgccaccgagatccagatgagctccgggaacttactattcaccggccatctcaaatgccggcttcgcatggataaactccagctgaaggggatgtcttactccatgtgcacgggaaagttcaaggtggtcaaggagatagcggagacgcagcacggcactatcgtgataagagtacagtacgaaggggacggcagcccctgcaagatccccttcgagatcatggacctcgagaaacgctacgtcctcggccggctgataacggtgaacccgatcgtgacggagaaggactccccagtcaacatcgaggcggagccacccttcggggactcgtacatcatcatcggtgtggagcccgggcagctgaagttgaactggttcaagaaggggtccagcatcggtcagatgttcgagaccaccatgcgcggcgcgaagcggatggccattctgggtgacaccgcctgggactttgggtcactgggtggggtattcacgagcatcggtaaggccttacaccaggtctttggggccatctacggcgcggcattttccggcgtaagctggaccatgaagatcctaattggggtgataatcacctggatcggcatgaactccagatcaacctccctgtctgtctccctggtgctagtggggattgtcacgctgtacttaggtgtcatggttcaagccgacagcggctgcgtggtgagttggaaaaacaaagagctgaagtgcgggagcggcatctttatcaccgacaacgtgcacacctggaccgagcaatacaagttccagcccgagagcccctccaagctggccagcgccattcagaaggcacaagaggaggggatctgcggcatccgctccgtcacgcggctagagaatttgatgtggaagcaaatcactcccgagctcaaccatattctggcagagaacgaagtgaagctcacaatcatgactggagatataaagggcatcatgcaggccgggaaacgctccttacggccccaaccgacggagctgaagtactcctggaaaacctggggcaaggccaagatgctcagcaccgaatcctacaaccagaccttcctgatcgacggtcctgagacggcggagtgtccgaacaccaaccgagcctggaactcactggaggtggaggactacgggttcggggtcttcacaaccaacatatggctcaagttaaaagagaagcaagacgctttttgcgactccaagttaatgagcgccgctatcaaggacaaccgggcggtgcacgccgacatgggttattggatagagtccgccctcaacgacacgtggaaaatcgagaaggccagcttcatcgaagtgaagaattgccactggcctaagagtcacaccctttggagcaacggcgtcctggaaagtgagatgatcatccccaagaacttagccggacccgtgagtcagcacaactaccgcccggggtatcacacccagatagcgggcccctggcacctggggaagctggagatggacttcgacttctgtgacggtacaactgtaatagtcaccgaggactgcgggaaccggggtccctccctgagaacgaccaccgccagcggcaagctgatcacggagtggtgctgccggtcatgcacactgccccccctcagatatcgcggcgaggacggttgctggtacgggatggaaatccgcccactgaaagagaaggaggaaaacctggtgaactcactcgtaaccgcaggtcacggacaggtcgacaatttcagtctgggcgtgctgggcatggccctcttcctggaggagatgcttcggactcgcgtggggacgaagcacgcgatcttgctggtcgccgtgtcatttgtcaccctgatcaccggaaacatgagcttcaaggatctcggtcgggtcgtcgtgatggtgggcgccaccatggccgacgacatcgggatgggcgtgacgtacctggccctgctcgctgcgttcaaagtgaggcccaccttcgccgcagggctgctgctgaggaagctgacctcgaaggaactgatgatgaccacaatcgggatcgtcctcctgtcacagtccacaatccctgagacggtgctggagctcaccgacgccctggcgctgggcatgatggtgctcaagattgtccgcaacatggagaagtaccaactggccgtcacgatcatggcgatcttgtgcgtcccgaacgccgtgatcctccagaacgcctggaaggtgagctgcaccattctggcggtcgtatccgtgagccccttactcctgacctcaagccaacagaagacggactggattcccctggccctcacgatcaaggggcttaaccccaccgctatcttcctgaccaccctatcccgcaccaacaagaagcggtcttggccgctgaatgaggccatcatggcggtcggcatggtgagtatccttgcaagctccctcctgaagaacgacatccccatgaccggccccctggtggctgggggcctcctgacggtctgctacgtgctgaccgggcgcagcgccgacttagagctggagcgggccactgatgtgaagtgggaggaccaggcggagattagcggcagcagccctatcctgtccatcaccatctctgaggacgggtccatgagcataaagaacgaggaggaggagcagaccctcacaattctgatacgcacgggccttctcgtcatctccggcctgttcccgatcagcatccctatcaccgccgccgcctggtacctgtgggaggtgaagaagcagcgggccggggtgctatgggatgtccccagcccgccgcccatgggcaaggcggagcttgaggacggagcctatcgcatcaagcaaaagaggatcctgggctacagccagatcggggccggcgtgtataaggagggcacctttcataccatgtggcacgtgacccgaggggccgtcctcatgcacaagggcaagcggatcgagccgtcctgggctgacgttaagaaagacctgatttcatatggcggcgggtggaagctggagggcgagtggaaggaaggggaggaggttcaggtcctcgctctggagcccggaaagaaccctagagccgtgcagacaaaacctggcctttttaagaccaacaccgggaccatcggcgccgtgtcgcttgacttctcccccgggacgtctggcagccctatcatcgacaagaagggcaaagtcgtgggcctgtacggcaatggggtagtcacccggtccggcgcgtacgtaagcgccatcgcgcagactgagaaatccatcgaggacaaccccgagatcgaggacgacatttttcgcaagcggcgcctgaccatcatggacctgcacccaggagccgggaagacgaaacggtacttgcccgccatcgtacgcgaagccatcaagcgtggtctgcgcactctgatcctcgcaccaacccgagtcgtggcagccgagatggaagaggccctacgaggactgcccattaggtatcagacccccgccatacgcgcggagcacacgggccgcgagatcgtggacctcatgtgccacgccacatttaccatgcggctgctctctcccgtcagggtgccgaactacaacctcataatcatggatgaggctcacttcaccgaccccgccagcatcgccgcgcgggggtatatctcgacacgcgtggaaatgggtgaggcggccggcatattcatgaccgccactccgcccgggagccgggatccgttcccccagagtaacgcccccatcatcgacgaagagcgcgagatccccgagcggagctggaacagtggccacgagtgggtcaccgacttcaagggaaagacggtttggttcgtacccagcatcaaagctggcaacgacatcgccgcctgcttacgcaaaaacggcaagaaggtcatacaactgtccaggaagaccttcgacagcgaatatgtgaaaaccagaactaacgactgggatttcgtggtcacgaccgacatctccgagatgggagccaacttcaaggccgaacgggtgatcgacccccgccggtgtatgaagcccgtgatactcaccgacggagaggagcgcgtaatcctggccgggccaatgccggtaacccactctagtgccgcacagagacgcggccgaattgggcgcaaccccaagaacgagaacgaccagtatatctacatgggggagcctctagaaaacgacgaggactgtgcgcactggaaggaagcgaagatgctcttggacaacataaatacgcccgagggaatcatccccagcatgttcgagcccgagcgggaaaaggtcgacgccatcgacggagagtaccgcctgcgcggcgaagcgcggaagaccttcgtcgacctaatgcgccgcggggatctgcccgtgtggctggcgtacaaggtggccgcagagggcatcaactacgcagaccgccggtggtgctttgacgggatcaagaacaatcagatcctcgaagagaacgtcgaagttgagatttggaccaaggagggcgagcgcaagaagttaaagccgcggtggctggacgcccgaatctactccgaccccctcgccctcaaggagtttaaggagtttgcggcggggcggaagtccctgaccctcaacttgatcacggagatgggccgcctccctaccttcatgacccagaagacccgggatgccctcgacaatttagccgtcttgcgcacggccgaggcgggcgggcgggcatataaccacgccctttcggagctgcccgagactctggagaccctcctgctgctcaccttgctggccacggttactggcgggatctttctttttctgatgagcggtcgcggtataggaaagatgacgctcggtatgtgctgcatcatcaccgcctcgatcctcctgtggtacgcgcaaatccagccgcactggattgccgccagtatcatcctagaattcttcctcatcgtgctgctgataccagagcccgagaagcagcggacgccccaggacaaccagctcacgtatgtcgtgattgctattctgactgtagtcgccgcgaccatggcaaacgagatggggtttctggagaagaccaagaaggacctcggactggggtccatcgctactcagcaaccggagtcaaacatcctggacatcgacctccgccctgcctcagcctggaccctgtacgcagtggctacaaccttcgtgacgcccatgttaagacacagcatcgagaatagctccgtaaatgtaagcctcactgccatcgcgaaccaggccacggtgctgatgggactgggcaaggggtggcccttgtccaagatggacatcggcgtaccgttgctagcgatcgggtgctacagccaggtaaaccccatcaccctcacggccgccctgctgctactagtggctcactacgcgatcatcggccccggactgcaggccaaagccacacgcgaggcccagaagcgggcagcagctggcattatgaagaaccccaccgtcgacggcatcacagtgatcgatctggaccccatcccgtatgaccccaagtttgagaagcagctgggccaggtgatgctgctcatcctgtgcgtcacgcaggtgctgatgatgcggaccacctgggccctctgcgaggccctcaccctggccacgggccccatctccaccctctgggaaggaaacccgggccgcttctggaacactacgatagccgtgagcatggccaacatctttcgggggagttacctggccggcgccggcctcctcttctctatcatgaagaacacgaccaacacacgacgggggaccggcaacatcggggaaacgctgggcgaaaagtggaagtcccgcctgaacgccctcggaaagagcgagttccagatttacaagaagtcggggatccaggaggtcgaccggactcttgcgaaagagggaatcaaacgcggggaaaccgaccaccacgccgtaagccggggctccgccaagctgagatggttcgtggagaggaacatggtcacccccgagggcaaggtcgtggacctgggctgtggtcgcgggggctggagttactattgcggtggtctgaagaacgtccgggaggtaaaggggctgacgaagggcggccccgggcacgaggaacccataccgatgtccacctacggttggaacctcgtgcgccttcagagcggggttgacgtgttcttcatcccgcccgaaaagtgtgacaccctgctttgcgatatcggtgagtccagccccaatcctaccgtggaggcagggcggacgctgcgcgtcctgaacctcgtggagaactggctgaataataacacccagttttgcataaaggtgttaaacccctacatgccctccgtcatcgagaagatggaggctctgcagcggaagtatggtggcgccctcgtgcgcaacccgctgagcagaaattctacccacgagatgtactgggtgagcaacgccagcgggaacatcgtaagtagcgtgaacatgatatcccgcatgctgatcaaccggttcaccatgcgccacaagaaggcgacctacgaaccagacgtggatctcggatccgggactcggaacatcggcatcgagtccgaggtccccaacctggacatcatcggcaagcgcatcgagaaaattaaacaggagcacgagaccagttggcactacgaccaggaccacccctacaagacttgggcctaccacggctcctacgagaccaagcagacgggcagcgcttccagcatggtgaacggggtggtccgcctactcaccaaaccgtgggacgtccttcccaccgtgacccagatggccatgacggacaccacccctttcgggcaacagcgggtcttcaaggagaaggtggacacccgcacgcaggagcccaaagaggggacaaagaagctaatgaagatcaccgctgagtggctatggaaggagctgggcaagaagaagaccccgcggatgtgcacgcgagaagagttcaccagaaaggtccgaagtaacgcagccctaggagcgattttcaccgacgagaataagtggaagtccgcacgggaggccgttgaggactcgagattctgggagctcgtggataaggaacggaacctgcatctggaggggaaatgcgagacctgtgtctacaacatgatgggtaagcgagagaaaaagctaggtgagttcgggaaggccaaggggagccgggccatctggtacatgtggcttggtgcgaggtttctagagtttgaagccctcggcttcctgaacgaggaccattggttctctcgggagaacagcttatccggagtggagggagagggtctacacaagttgggctacatcctacgggacgtgagcaagaaggagggcggggccatgtacgccgatgacaccgcgggctgggacaccaggataaccctagaagacctgaagaacgaggagatggtcactaaccacatggagggggagcacaaaaagctggcggaggccatcttcaagctcacgtaccagaacaaggtggtgagagtccaacggcccacgccccgaggcaccgtaatggacatcatcagccggcgtgaccaacgggggagcgggcaggttggaacctatggcctgaacacgttcaccaacatggaggcgcagctgattcgccaaatggagggcgagggtgtcttcaagaacatccagcacctcaccgttaccgaagaggtggccgtccagaactggctggcgcgcgtgggccgcgagcgcctgagccggatggccatttccggggatgactgcgtggtcaaacccttggacgaccgcttcgccaacgcattaacggccctgaacgacatgggcaaaatccggaaagacatccagcagtgggaaccgagcaagggctggaacgattggactcaggtccccttctgctcccaccacttccacgagctgatcatgaaggacgggcgcgtcctggtcgtgccctgccggaaccaggacgagttaatcggccgtgcgcggattagccaaggggccggctggtccctgcgagagactgcctgcctgggtaagagctacgctcaaatgtggtccctcatgtatttccaccggcgcgacctccggctggcagcgaacgccatctgcagcgctgtgcccagccactgggtccctacctcacgcacgacgtggtccatccatgccaagcacgagtggatgaccaccgaggacatgcttaccgtgtggaaccgggtctggatccgtgagaacccctggatggaggacaagacgcccgtcgagagttgggaggagatcccgtacctgggcaagcgggaggatcagtggtgtggctccttgatcgggctgacctcccgggccacctgggcgaagaacatacaggcagccataaatcaagtccggtccctcattggcaacgaagagtacaccgactacatgccgagcatgaaacgcttccgtcgggaagaggaggaggccggggtgctctggtga

SEQ ID NO: 25146 - RNA, 9876 nt, synthetic construct
  misc_feature 1..9876: note = derived and/or modified CDS sequence (opt11) from DENV-2__FJ744718__SS-prME
  source 1..9876: mol_type = other RNA
agcgcgggcatgattatcatgcttatccccaccgtaatggccttccacctcactacccgcaacggggagccccacatgatagtgggtatccaggagaaggggaagtccctgctattcaagacggaggacggcgtgaacatgtgtaccctcatggcgatggacctgggggagctgtgcgaggacaccatcacctacaagtgccccctgctgcggcagaacgagccagaggacatcgactgctggtgtaacagcacaagcacgtgggtgacctacgggacatgcaccaccaccggcgaacatcgccgggaaaagagaagcgtcgcccttgtgccccacgtgggcatgggcctcgagacccgaacagagacgtggatgtcgtctgagggggcctggaagcacgcccaacgcatagagacctggatcctgcggcacccgggcttcacgatcatggcagcgatactggcctacaccatcggcacgacgcacttccagcgcgtcctcatattcatcctgctgacggccgtcgcaccctcaatgacaatgcggtgcatcgggatatcaaaccgcgatttcgttgagggcgtatccgggggcagctgggtggacatcgtgctcgagcatggcagttgcgtcaccaccatggcaaagaacaaacccacgctagacttcgagctgattaagaccgaggccaagcagcctgccacgctccggaagtactgcatcgaggcaaagctgaccaacacgaccaccgaatcccgctgccccacccagggcgaacccagtctgaaggaagagcaggacaagcggtttgtgtgcaagcactcaatggtggataggggctgggggaatggctgcggcctgttcggaaagggcgggattgtcacttgcgccatgttcacgtgtaagaaaaacatggagggtaagatcgtgcagcccgaaaatctcgaatacaccatcgtggtaacgccacattccggtgaggagcacgcggtgggtaacgacacggggaagcacggcaaagagatcaaggtgaccccacaaagctccattaccgaggccgagctgacaggatacggcacggtcacgatggagtgcagccctcggaccggcctcgacttcaatgagatggtgctgttacaaatggagaacaaggcatggctcgtgcacaggcagtggttcctggacctgcccctcccctggctgccaggagccgacaagcaggaatccaactggatacagaaggagaccctggtaaccttcaagaacccacacgccaagaagcaagacgtcgtcgtgctcggaagccaggagggtgccatgcacacggcgctgaccggcgccactgagatccaaatgagctccgggaacctactcttcaccgggcacctgaagtgccggctgcgcatggacaagctccagctcaaaggcatgagctactctatgtgcacggggaagttcaaagtagtgaaggagatagccgagacccaacacggcacgattgtgatccgggtgcagtacgagggggacggcagcccctgtaagatcccattcgaaatcatggacctggagaagcgctacgtcctgggccggctgatcaccgttaaccctatcgtgacggagaaggactcccccgtcaacatcgaggcagagcccccgttcggagatagctacattataatcggagtggagccggggcaactgaagctcaactggttcaaaaaggggtccagcattgggcagatgttcgaaacgactatgaggggcgcgaagcgcatggccatcctaggcgacaccgcctgggatttcggctccctgggcggggtgttcacgtcgatcggcaaagcccttcaccaggtcttcggggcgatctacggggctgccttctccggggtgagctggaccatgaagatcctgatcggggtgatcatcacgtggatcggcatgaactccaggtccacttccctaagcgtctccctggtgttagtggggatcgtcacactctatctaggagtgatggtgcaggccgacagcgggtgcgtcgtgtcttggaagaacaaggagctcaagtgcggcagcgggatcttcatcacagacaatgtgcacacctggaccgagcagtacaagttccagcccgagtcaccatctaagctggccagcgcgattcaaaaggcccaggaggaggggatctgtggaatacgctccgtcacgcggctggagaaccttatgtggaaacagatcaccccggaactgaatcacatcctggccgagaacgaggtgaagcttaccattatgaccggggacatcaagggcatcatgcaggcggggaaacgctccctgcggccgcaacccacggagctgaagtactcctggaagacttggggcaaggccaagatgctcagcaccgagtcatacaaccagacattcttgatcgacggccccgaaacagcggagtgcccgaacaccaaccgcgcctggaacagcctggaagtcgaggactacggattcggagtcttcaccaccaacatttggctcaagttaaaggagaagcaagacgccttctgcgattccaaattaatgagcgcggccatcaaggacaatcgggcggtgcacgccgacatggggtactggatcgagtccgccttgaacgacacatggaagatcgagaaagcctcgttcatcgaagtgaagaactgccactggcccaaatcccacactctgtggagcaatggcgtcctggaatccgagatgatcatacccaagaacctcgcgggccccgtgagccagcacaactatcgcccggggtaccacacccagatagcgggcccctggcacctggggaagcttgagatggactttgacttctgcgacggcaccaccgtgatcgtcacggaggactgcggtaaccgcggcccatccttgcgcacgaccaccgcgtctggcaaactgattacggagtggtgctgtcggagctgcaccctgcccccgctccgctaccgtggggaggacggctgttggtacggaatggagatccgccctctgaaggaaaaagaggaaaatctggttaactccctcgtgacagccggccacgggcaggtagacaacttcagtctcggggtgctgggcatggctctcttccttgaagagatgttgcggacaagagtgggaacgaagcacgccatcctcctggtagccgtgtcgttcgtgacccttatcaccggcaacatgtcattcaaggatctcgggcgagtcgtggttatggttggcgccaccatggcggacgatatcggcatgggcgtgacatacctagccctgttagcggcgttcaaagtgcgccccaccttcgccgcaggcctgctgctccggaagctgacctctaaggaactgatgatgaccaccatcgggatagtcttactgagccagagtaccatccccgagaccgtgctggagctcaccgacgcgcttgctttaggcatgatggtcctcaaaatagtacgcaacatggagaagtaccaactcgccgtgacgatcatggccatcctgtgcgtcccgaatgccgtaatcctccagaacgcctggaaggtgtcttgtaccatcctggcggttgtgtccgtgagccccctgcttctgacgtcttctcagcagaagacggactggatccccctggccctcacgataaaggggctgaatcccaccgccatcttcctgactaccctctcccgtacgaataagaagcggagctggcctctgaacgaggccattatggcagtcggaatggtgtccatcctagcctcgtccttgctgaagaacgacatcccgatgaccggccctctggtggccgggggcctcctgaccgtctgctacgtgctgaccgggcgcagcgccgacctagaactggagcgggcaacggacgtgaaatgggaggaccaggcggagatctcaggcagcagccccatcctgagtatcaccatcagcgaagacggatccatgagcatcaagaatgaggaggaagagcaaaccctcaccatcctgatccgcacggggctgctcgtcatctctggtctgttcccgatcagtatcccgatcaccgccgccgcttggtacctctgggaggtgaagaagcagcgtgcgggggtgctctgggacgtgcccagcccgcctcccatgggcaaggcggagctggaagacggggcctaccgcatcaagcagaaaggcatcctggggtacagccagatcggagccggggtgtacaaggaggggaccttccacaccatgtggcacgtgacccgaggggccgtccttatgcacaagggcaagcgtatcgagccctcctgggccgacgtgaaaaaggacctgatctcctacggcgggggttggaaacttgagggcgagtggaaggagggcgaggaagtgcaggtcctcgcactggagcccggcaaaaatcccagggctgtgcagacgaagcccggcctgttcaagaccaataccggcacgatcggcgccgtcagcttagactttagccccggcacgtccggcagccctatcatcgacaaaaaggggaaggtcgtcggcctgtacgggaacggcgtggtcacccgctccggcgcctatgtgagcgccatcgcgcagacagagaagtccattgaggacaaccccgagatcgaggatgatatcttccggaagcgccggctgaccataatggacctgcacccaggggccggtaaaacaaaacggtacctccccgccatcgttcgggaagccatcaagcgcggcctgcggaccctgatcctagcgcccaccagggtcgtggcggccgagatggaggaagccttgcggggtttacccatccgctaccagaccccagccatccgggcggagcacaccgggcgcgagatcgtggaccttatgtgccacgccaccttcacaatgcgcctgctgagccccgttcgggtaccgaactataatctcatcatcatggacgaagcccacttcaccgaccccgcctccattgccgcacggggctacattagcacgcgggtggagatgggcgaggctgccgggatattcatgaccgccaccccgccaggaagccgtgacccgttcccccagtccaacgcccccatcatagacgaggagagggagatccccgagcgctcgtggaattcagggcacgagtgggtaacagactttaagggcaagacggtgtggttcgtgccgtcaatcaaagcggggaacgatatcgccgcctgcctgcgaaagaacggcaagaaggtcatccaactgtcccgcaagaccttcgacagcgagtatgtgaagacccggaccaacgactgggacttcgtagttactaccgatatctccgagatgggcgccaacttcaaggcagagcgagtgatcgacccccgtcgctgcatgaagcccgtgattctcaccgacggggaggagcgtgtgatccttgccggcccaatgccggtgacccacagcagcgccgcccagcgccgggggcgaatcggacggaatcccaagaacgagaatgaccaatacatatatatgggggagcccctggagaacgacgaggactgcgcccattggaaggaggcgaagatgttactagacaacatcaatacgccagagggcatcataccgtcaatgttcgagccggagcgggagaaggtagatgcaatcgacggcgagtaccggctgcgcggggaggcccgaaagaccttcgtcgacctcatgcggcggggggacctgccggtatggctggcatacaaagtggctgcggaagggataaactatgccgaccgtcgatggtgctttgacggcataaagaacaaccaaatactcgaggagaacgtcgaggtcgagatctggactaaggagggagaacggaagaaattaaagccgaggtggctggatgcccgtatctactctgatcccctagccctgaaggagttcaaggagttcgccgccggtcgcaagagcctgaccctcaacttaatcacggagatgggccgcctgcccaccttcatgacccagaagacgcgcgacgccctcgataacctggccgttctgcacacggctgaggcaggcgggcgggcctataatcacgccctctccgaactgcccgagacgctggagaccctcctgctgttgactctgctggctacggtgactgggggcattttcctcttcctgatgtcgggccgaggaatcggcaagatgaccctaggcatgtgctgcatcataaccgcgtccatcctcctgtggtacgcgcagatccagccgcactggatagccgcaagcataatcctggagttcttcttaatcgtgctgctgattcccgagcccgaaaaacagcggacgccccaagataaccagctcacgtatgtcgtgatagccatcctgacagtggtcgcagcgaccatggccaacgagatgggcttcctagagaagaccaaaaaagacctagggctgggttccattgccacgcaacagcccgagagcaacatcttagacatagatctccgacccgcctccgcctggaccttatacgctgtggccacaaccttcgttacccccatgctgcggcactcgatcgagaactcgtccgtcaacgttagcctcaccgccatcgcaaatcaggccaccgtgcttatgggcctggggaagggctggcccttaagtaagatggacatcggggtcccgctgctggctatcggctgctacagccaggtgaaccccatcacactcacggccgccctgctgttgctagtcgcccactacgcgatcatcgggcccggcttgcaagccaaggccacccgagaggcacaaaagcgcgcagccgccggtataatgaagaaccccactgttgatggcataaccgtgatcgacctcgatccgattccctacgaccccaagttcgaaaaacagttaggccaggttatgctgctcatcctgtgcgtcacccaggtgctgatgatgcgtaccacctgggccctctgcgaagccctgaccctggccactgggcccatctccacactctgggagggatctccagggcggttttggaacaccaccatcgcggtgtccatggccaacatcttccgcggtagctacctggcaggagccgggctactcttctccattatgaagaacacaaccaacacgcgtaggggcaccgggaatatcggcgagacgctgggtgagaagtggaaatcccgcctgaacgccctggggaagtccgagttccaaatctacaaaaaatccggcatccaggaagtcgaccggaccctagcgaaggaggggatcaagcgaggagagaccgaccaccacgctgtgtccagagggagcgctaagctccggtggttcgtggagcggaacatggtcacccccgaggggaaggtggtggacctaggctgcgggcgcggcgggtggtcatactactgcggcgggctgaagaacgtccgggaggtgaaaggcctaactaagggcggacccggccatgaagagcccatcccgatgagcacctacgggtggaacctcgtgcgcctgcagtccggcgtcgatgtcttctttatcccgcccgagaagtgcgacaccctgctttgcgacatcggagagtcatcccccaacccgacggtggaggctggccggacgctgcgcgttctgaacctcgttgaaaattggttaaacaataacacccagttctgtatcaaggtcctgaacccttacatgcccagtgtgatcgagaagatggaggcgctgcagcggaagtacggaggggccctcgtgcgcaaccccctgtctcggaactccacccacgagatgtactgggtatcaaatgcctctggcaacatcgtctcctccgtgaacatgataagccgaatgctgatcaaccgcttcaccatgcgccataagaaggccacctacgagccagacgtggacctcgggtccggcacgcggaacatcgggatcgagagcgaggtgccgaacctggacatcatcggtaagcggatcgagaagatcaagcaggagcacgagacatcctggcactacgaccaggaccacccttacaagacatgggcctaccacgggagctacgagaccaagcagactggctccgcaagctcgatggttaacggtgtggtcagactgctcaccaagccgtgggacgtactgcccaccgtgacccagatggccatgacggacaccacaccctttgggcagcagagggtcttcaaggagaaggtggacacacgcacgcaggagcccaaggagggcaccaagaagctgatgaagattacggccgagtggctctggaaggagttgggcaagaagaagaccccgcggatgtgcacgcgcgaggagttcacccggaaggtacgctctaacgcagccctgggggcgatattcaccgatgagaacaagtggaagtccgcccgggaagccgtagaggactcgcggttctgggagctcgtagataaggagcggaacctgcacctcgagggcaagtgcgaaacctgcgtctacaacatgatgggtaagcgcgagaaaaagctcggcgagttcgggaaggccaagggctcccgggcaatctggtatatgtggctgggagcacgcttcctggagtttgaggcattaggcttcctcaatgaggaccactggttcagcagagagaactccctcagcggtgtggagggggagggcctccacaagctggggtacattctgcgcgatgtgagcaagaaggagggcggcgctatgtacgccgatgatacggccggatgggacacccggattacacttgaggacctcaagaacgaggagatggttaccaaccatatggagggcgagcacaagaagctggcggaggccattttcaagcttacgtaccagaacaaggtggtgcgcgtacagcgacccacgccgcgggggacggtaatggacataatctccaggcgcgaccaacggggctcaggccaggttgggacctacggattaaacacgttcaccaacatggaggcccagctaatccgccaaatggagggagagggcgtctttaaaaacatccagcatctcacggtcacggaggaggttgccgttcagaactggctggcaagggtggggcgagagagactgtcccgaatggcaattagcggcgacgactgcgtggtcaagcccctcgacgaccgcttcgcaaacgccctgacggccctgaacgacatgggcaagatcaggaaagacatacagcaatgggaaccgtccaagggatggaacgactggacacaggtgcccttttgtagccaccatttccacgagctcattatgaaggatggccgcgtgctggtcgtgccctgccggaaccaggacgagctgatagggcgcgcccggatctcccagggcgccgggtggagcctccgtgaaaccgcctgcctgggcaagtcctacgcccagatgtggtcactgatgtattttcaccggcgcgacctccggctggctgcgaacgccatctgctcagcggtgccttcacactgggtcccgacttcgcgcacgacctggagcatccacgccaagcatgagtggatgaccacagaggacatgctcacagtctggaacagagtctggataagggagaacccatggatggaggacaaaacgccggtcgagtcatgggaagagatcccatacctcggcaagagagaggaccagtggtgtggaagcctgatcggcctgacctcccgcgccacctgggcgaaaaacatccaggccgccatcaaccaggtgcgcagcttaatcggcaacgaggagtataccgattacatgccgagcatgaagcgcttccggcgcgaggaggaggaggccggcgttctgtggtaa

SEQ ID NO: 25147 - RNA, 9876 nt, synthetic construct
  misc_feature 1..9876: note = derived and/or modified CDS sequence (opt11) from DENV-2__FJ744722__SS-prME
  source 1..9876: mol_type = other RNA
tcggtgggaatgatcatcatgctcatacccaccgttatggcgttccatctgaccacccgcaacggggaaccccacatgatcgtgagcatccaggaaaaaggtaaaagcctacttttcaagaccgaagacggggtcaacatgtgcacactcatggccatggacctgggcgaactgtgcgaggacactatcacctacaagtgccccctccttcggcagaatgagcccgaggacatagactgctggtgcaacagcacctctacctgggtaacctacggaacttgtaccaccaccggcgagcaccgccgggagaaacgctccgtagctttagtgccacacgtcggaatgggcctcgagactcggactgagacgtggatgtccagcgagggtgcctggaagcacgcccagcgcatcgagacgtggatccttcggcaccctgggtttaccatcatggccgccatactggcgtacactattggcaccacccacttccagaggactttaatcttcatcttgctcaccgccgtggctcctagtatgaccatgcgatgcatcggcatctccaaccgcgacttcgttgaaggtgtatccggcggaagttgggtggacatcgtgctcgaacacggctcatgcgtcaccacgatggccaagaacaagcccacgctggacttcgagctgataaaaactgaggcgaagcaacccgccacgctacgcaagtattgcatcgaggccaagctgacaaacaccaccaccgaatcccgctgtcccacgcagggtgaacccaacctgaaagaggagcaggacaagcggttcgtgtgcaagcacagcatggtggaccgcggctggggcaatggatgcggcctcttcgggaagggcgggattgttacgtgtgcgatgttcacgtgcaagaagaacatggagggcaagatcgtgcagcccgagaacttagagtatacgatcgtggtcacgccccactctggtgaggagcacgccgttgggaacgatacaggcaagcatggcaaggagatcaaagtcacccctcagagcagtattaccgaggcggagctgaccggctatggaacggtcaccatggagtgcagcccccgaactggcctcgacttcaatgaaatggtgctgctccagatggagaacaaagcctggctcgttcaccgccaatggttccttgatctgccgctaccctggctgccgggcgcagatacccagggctccaactggatccaaaaggaaacgctggtcacctttaagaacccgcacgccaagaaacaggacgtggtggtgctaggcagccaggagggggccatgcacaccgctcttaccggcgcgacggagatccagatgagctccggtaacctcctgttcaccggtcacctgaaatgccggctgcgcatggacaagctccagctgaagggcatgtcctactccatgtgtaccggaaagtttaaggtggtcaaggaaatcgccgaaacgcagcacggcacgatcgtgatccgtgtgcagtacgagggagacggctccccttgcaagattcccttcgagatcatggacttagagaagcgctacgtcctaggccggttgatcaccgtgaacccgatcgtaaccgaaaaggactcccctgttaacatcgaggcggagccgcccttcggggatagctacatcatcatcggcgtagagccggggcaactgaagttgaactggttcaagaaaggctccagcatagggcaaatgttcgagaccacaatgcgcggcgcaaagcgcatggcaatcctgggcgacaccgcctgggactttgggtccctgggtggcgttttcaccagcatcggcaaggccttacatcaagtcttcggtgccatctacggcgccgccttctccggcgttagttggacgatgaagatcctgatcggggtgatcatcacgtggataggcatgaactctcggagcacttccttatctgtctctctggtactcgtgggagttgtgacactgtacttaggcgtgatggtacaagccgacagcgggtgcgtggtgtcctggaagaacaaggagcttaagtgcggcagcggcatctttatcaccgataacgtccacacgtggaccgagcagtataaattccaacccgagagcccttccaagctggcgagcgcaattcagaaagcgcaggaggaaggtatctgtggcattcgctccgtgacccgcttagagaacctcatgtggaagcagatcaccccggagctgaatcacattctagccgagaacgaggtgaagctcacgatcatgaccggggacataaagggcatcatgcaggccgggaagcgcagcttacgcccgcaacccaccgaactgaagtattcctggaagacctggggcaaagccaagatgctcagcaccgaatcccacaatcagaccttcttaatcgacggtcccgagactgccgagtgcccaaacacgaaccgcgcatggaatagcttagaggtcgaggactacgggttcggcgtgttcactaccaacatctggctcaagctgaaggagaagcaggatgccttctgcgacagtaagctgatgtctgccgctatcaaggacaacagggccgtgcatgcggacatggggtactggatagagtccgccctcaatgacacctggaagatcgagaaggcctccttcattgaggtcaagaactgtcactggcccaagtcccataccctatggtctaacggcgtgctggagagcgagatgattatccccaagaacctcgcaggccccgtgagccaacacaactatcgcccggggtaccatacccagatcgccggcccatggcaccttgggaagctggagatggatttcgacttctgcgacggcacgaccgtcgtggtaaccgaggattgtgggaaccgcggcccctccctccggactacaaccgcatcaggcaagctgatcaccgaatggtgttgccggagctgcactctgcccccgctccgataccgcggggaagacggctgttggtacgggatggagatccgccccctgaaagaaaaggaggagaatctggtcaactccctcgttacggccggccatggacaggtggacaacttcagcctcggcgtcctgggcatggctctctttctggaggagatgctgcggacccgcgtagggaccaagcacgccatactcctggtggcggtttctttcgtgaccctaatcaccggcaatatgagcttcaaggacttgggccgagtggtcgtgatggtgggggccaccatgactgacgatatcgggatgggcgtcacctacctggccctgctagccgccttcaaagtgcgccccacgttcgcggccggccttttccttcggaagctaacctcgaaggagctgatgatgacgaccatagggatcgttctcctcagccagtccactatccccgagaccattttagagcttaccgacgccctcgccctgggcatgatggtgctgaagatggtgcgcgacatggagaagtatcagctagcggtcactatcatggcgatcctttgtgttccgaacgccgtgatcctccagaacgcctggaaggtaagctgcacgatcttggcggtggtctccgtctcgcccctgttattgacctccagccagcagaagaccgattggatccccctggccctgaccatcaaagggttgaaccccacggcgatcttccttaccaccctgtcccgcaccaacaagaagagatcatggccgctcaacgaggccattatggccgtgggcatggtctccatcctggcctcgagtctcttgaagaacgacatccccatgacgggccccctggtcgccgggggcctgctcactgtgtgctacgtgctgaccgggcgcagcgcagatctggaactcgaacgggccacagacgtcaagtgggaggaccaagccgaaatttccggcagctcaccaatactatctatcacgattagcgaggacgggtcgatgagcatcaagaacgaggaggaggagcagaccctgactattttaatccgcaccggtctgctggtgatttccggcctcttccccgtgtccatacccataactgctgcggcctggtatctatgggaggtcaaaaagcagcgggctggcgtgctgtgggatgtgccgagcccgccgccaatgggcaaggccgaactcgaggacggggcctaccgcatcaagcaacgcggcatcctgggttacagtcagatcggcgcgggcgtctacaaggagggcacgtttcacaccatgtggcacgtaacccgaggcgccgtgctgactcacaagggcaagcggatagagcccagctgggccgacgtcaaaaaggaccttatatcttacggcggcggctggaaattggagggcgagtggaaggagggggaggaagtccaggtgctggccctcgagcccggcaaaaacccccgcgccgtccaaacgaaacccgggttatttaagactaacaccggaaccatcggggcggtgagcctggacttcagtccgggtacgtccggctcgcccatcatcgataagaaagggaaggtggtgggcctctacggcaacggcgttgtgacccggtctggcgcctacgtcagcgccatagctcaaaccgagaagagtatcgaagacaaccccgacatcgaggacgacatctttcgcaagcggcgcctgaccatcatggacctccaccccggggccggcaagactaaacggtacctgcccgcaatagtgcgcgaagccatcaagcggggactcaggactctgatcctggccccgacgcgggttgtcgccgcggaaatggaggaggccctccgcggcttacccatacggtaccagacccccgcgatccgcgccgagcacacagggcgagaaattgtggacctgatgtgtcatgctacattcaccatgcgtctcctgagccccgtgcgcgttccgaactacaacctgataatcatggacgaggcgcacttcaccgaccccgcctccatcgccgcccgtggctacatcagcacgcgcgtggagatgggcgaagccgcagggatcttcatgacagcgactccgcccggcagccgggaccctttcccccagtccaacgcacccatcatcgatgaggagcgcgagatccccgagcggagctggaactccgggcacgagtgggtgacggacttcaagggcaagacggtttggttcgtcccttccatcaaggccgggaacgacatcgccgcgtgcctccgcaagaatggcaagaaagtgatccagctgtcccgcaagaccttcgacagtgagtacgtcaaaacacgcaccaacgactgggacttcgtggtcacgaccgacatttccgagatgggagctaacttcaaggccgagcgggttatcgacccccgccgctgcatgaagcccgtgatactgaccgacggggaggaacgcgttatcctcgccggccccatgccggtcacccacagctccgcggcccaacggcgggggaggatcggcaggaacccgaagaacgaaaacgaccagtacatctatatgggggagcctctagagaacgacgaggactgcgcccactggaaggaggccaagatgctgctcgacaacatcaacacaccagagggcataatcccgagcatgttcgagccggagcgggaaaaggtggatgccatcgacggggaataccgcctgcgcggggaggctcggaagaccttcgtggacctgatgcgccggggcgacctccccgtctggttagcctacaaggtggccgcagaggggataaactacgccgatagaaggtggtgtttcgacggcatcaagaacaaccagatcctggaggaaaacgtcgaggtggaaatatggactaaggagggggagcgcaaaaagctcaagccacggtggttagacgcgcggatctactccgaccccctggctctcaaggagttcaaagagttcgccgccggtcggaaatccctgactttgaacctcatcaccgagatgggcaggctgccgactttcatgacccagaagacccgggacgctctggacaatctcgcggtgctgcacacggccgaggctgggggccgcgcctacaatcacgcgttgtccgagctccccgagaccctggagaccctcctccttctgaccctccttgcgacggtcaccgggggcatcttcctgttcttaatgagtggacgcgggattggcaagatgaccctagggatgtgctgcatcgtgaccgcctccatcctgctctggtatgctcagattcagccgcattggatcgcggcgtctatcatactggagttcttcttaatcgtgcttctgatccccgaaccagagaagcagcgcacgccacaagacaaccagttgacgtacgtggtgatcgccatccttaccgtggtcgcagccaccatggccaacgaaatgggcttcctggagaagaccaagaaggatctggggttaggctccatcgcgacgcagcagccggagtcaaacatactcgatatcgacttgcggcccgcctccgcctggaccctctacgccgtggcgacaacttttgtgacgcccatgcttcgccattccatcgagaacagctccgtaaacgtgagcctaaccgcgatcgccaaccaggctaccgtgctcatggggctggggaagggctggcccctgtccaagatggatatcggagccccgctcctggccatcggctgctactcccaggtcaaccccatcaccctaactgcggcacttctgctgctcgtcgcgcactatgccatcatcgggcccggcctgcaagcgaaagccacacgggaggctcagaaacgcgccgccgcgggcatcatgaagaaccccaccgttgacgggatcaccgtcatcgacctggacccgatcccgtacgacccaaagtttgagaagcagttgggccaggtgatgcttctggtgttgtgcgtaacccaggtgttgatgatgcggaccacctgggccctgtgcgaggccctcacacttgccactggtcccatcagcacgctctgggagggcaacccggggcgcttctggaacaccaccatagcggtgagcatggcgaacatcttccgtggcagctacctcgccggcgctgggctgctgttcagcatcatgaagaacacgaccaactcccgcaggggcaccgggaacatcggcgagaccttaggcgagaagtggaagtcccggttgaacgccctggggaagtccgagtttcagatctacaagaagtcaggcatccaggaggtcgaccgcacactcgccaaggaggggatcaagcggggcgagacagaccaccacgcggtatctcgcgggtcagccaaactccggtggttcgtggagcggaatatggtcactcccgagggcaaagtggtggacctagggtgcgggcggggcggctggtcctactactgtggtggcttgaagaatgtccgcgaggtgaagggcctgaccaagggcgggcccggccacgaggaacccataccgatgagcacgtatggttggaacctggtgcggctccagtccggcgtcgacgtgttctttatcccgccggaaaaatgtgacactctgctgtgcgacatcggggaatcttcccccaatccgaccgtggaggccggccgcacgctccgcgtcctgaacctcgtggagaactggctcaacaacaacacccagttctgcatcaaggttctgaatccatacatgcccagcgtcatcgagaagatggagacgctacagcgcaagtacggcggggccctggtgcgaaaccccctaagccgcaattcaacccacgagatgtactgggtgtctaacgcgtcgggcaacatcgtcagctcggtgaatatgatcagccggatgttaatcaatcggttcaccatgcggcacaagaaggccacctacgagcccgatgtggacttagggtccggcacgagaaatattgggatcgagagcgagatacccaatctagacataatcgggaagaggatcgagaaaatcaagcaggagcacgaaacctcctggcattatgaccaggatcatccctacaagacctgggcctaccacggcagctacgagacgaagcagacaggttccgccagctccatggtcaacggcgtggtgcgcctcctgaccaaaccgtgggacgtcctccccacggtgacgcagatggccatgacggacaccacccccttcggtcaacagcgcgtgttcaaggagaaggtcgacaccaggacgcaggagcccaaagaaggcacgaagaagctgatgaagatcaccgcggagtggctgtggaaggagctaggcaagaagaaaaccccgcgcatgtgtactagggaggagttcaccaggaaggtgcggagcaacgccgccctgggcgcgatcttcaccgacgagaacaagtggaaaagcgcccgagaagcggtcgaggacagccgcttctgggagctggtggacaaggaacgcaacctccacctggagggcaagtgcgagacctgcgtttacaacatgatgggcaagcgggagaagaaactcggcgagttcgggaaagcaaaggggtccagagcgatttggtacatgtggctcggtgcccgcttccttgagttcgaggccctggggttcttaaacgaggaccactggttttctcgtgagaactccttaagcggcgtcgagggggagggcctgcaccggctagggtacatcctgagagacgtgagcaagaaggagggcggggcgatgtacgccgatgacacggctgggtgggatacccggataaccctggaggacctcaaaaacgaagagatggtaaccaaccacatggagggcgagcacaagaagctggctgaggcgatattcaaacttacataccagaacaaggtagtgcgcgtgcagcggccaacaccgcggggcaccgtcatggacatcatctcccggcgggaccagcggggaagcggccaggtgggtacctacggtctcaacacgtttactaatatggaggcccagctgatccgtcagatggagggggagggcgtgtttaagaacatccagcacttaaccgtaactgaggagatcgccgtgcaaaattggctcgcccgcgtagggagggagcgcctgtcccggatggccatcagcggcgacgactgcgtggtgaagcctcttgacgatcgcttcgcgtcggccctcacggccctgaacgacatgggcaagatacggaaggacatccagcagtgggaaccgagtcgcgggtggaacgactggactcaggtacctttctgctcccaccacttccacgagctgatcatgaaagatggtcgggtcttggtggtgccctgccgcaaccaggatgagctcatagggcgggcacgcatcagccagggtgccgggtggtccctgcgggagacggcgtgcctaggaaagagttacgcccagatgtggtccctgatgtatttccaccgccgagacctgcgcctcgcggcaaacgccatctgcagcgcggtcccatcccactgggtgccgacaagccggacaacgtggtcgatccacgcaaagcacgagtggatgacaaccgaggacatgctgaccgtgtggaaccgcgtctggatccaggaaaacccgtggatggaggataagacgccagtggagtcctgggaggagattccttatctcggcaagcgggaggatcagtggtgcggtagtttaattggcctgaccagccgcgcaacctgggccaagaacatccaagtggccattaaccaagtccggagcctgatcgggaacgaggagtacaccgactacatgccgtccatgaagcgtttccgccgggaagaggaggaagcgggtgtgctatggtga

SEQ ID NO: 25148 - RNA, 9876 nt, synthetic construct
  misc_feature 1..9876: note = derived and/or modified CDS sequence (opt11) from DENV-2__FJ744723__SS-prME
  source 1..9876: mol_type = other RNA
agcgtcggcatgattataatgctgatccccaccgtcatggcgttccacctcaccacccgcaacggtgagccccacatgatcgtgtcgattcaggagaagggcaaaagtctgttgttcaaaacagaggacggggtcaacatgtgcacactcatggccatggatctgggcgagctgtgcgaggacacaatcacttacaagtgccccctactgcggcagaatgagcccgaggacatcgactgctggtgcaactcaaccagcacctgggtcacgtacgggacgtgcaccacgaccggtgagcaccgcagggagaagcgctccgtggccctggttccccacgtcggcatggggctcgaaacgcggaccgagacctggatgagctccgagggtgcctggaagcacgcccagcgcatcgagacctggatcctgcggcacccggggttcacgatcatggccgcaattctggcatacacgatcggcacaactcacttccagcgtacgttaatcttcatccttctcaccgctgtggcgcccagcatgactatgcggtgtataggaatctcgaaccgggacttcgtggagggcgtctccggggggtcctgggtcgacattgtacttgagcacggatcttgcgtcaccacgatggccaagaacaaaccaaccctggacttcgagctgatcaagaccgaggcgaaacagcccgcaactctccggaagtactgcatcgaggccaagctgacgaacaccacgaccgagtcccgctgcccaacgcaaggtgagcccagtctgaaggaggagcaggacaagcggttcgtgtgtaagcactccatggtggaccgcggctggggaaacgggtgtggcctcttcggtaagggtggtatagtgacctgtgccatgttcacgtgcaaaaaaaacatggagggcaagatcgtgcagcccgaaaacctagagtataccatcgtggtcacgccacacagcggcgaagagcacgccgtgggcaatgacacagggaaacacggcaaggagattaaggtaaccccgcagtccagcatcacggaggcagaactgaccggctatgggacggtcaccatggagtgctcgccccggaccggcctcgacttcaacgagatggtgctgctgcaaatggagaacaaggcctggctcgtccatcgccagtggttcctcgacttgcccctgccctggctgccgggcgcggacacccaggggagcaactggattcaaaaggaaacgctggtcacattcaaaaacccccacgctaagaagcaggacgtggtggtgctcggaagccaggagggggctatgcacaccgcgctgaccggagccacggagatccagatgtctagcgggaacctcttgtttacaggccacctgaaatgccgactgcgcatggacaagctgcagttaaagggcatgtcctacagcatgtgcaccgggaagttcaaggttgttaaggagatcgccgagacccagcacggcaccattgtaatccgggtgcagtacgagggggatggctccccctgcaagatccccttcgagatcatggacctggagaagcgatacgtactgggcagattaatcactgtgaatccgatcgtgaccgaaaaggacagccccgtgaacatcgaggccgaaccccccttcggggactcctatattatcatcggcgtggagccggggcagctgaagctaaactggtttaagaagggaagcagtatcgggcagatgttcgagaccaccatgagaggcgccaagagaatggcgatcctgggcgacacggcctgggactttggcagcttgggcggagtgttcacctcaatcggcaaggccttacaccaagtcttcggggccatctacggcgccgcgttctccggcgtgtcctggacgatgaagatactgataggggtaataatcacgtggatcggcatgaacagccgttccaccagcctgagcgtctcgctggtgctcgtcggggtcgtgaccctgtacctgggtgtgatggtccaggctgatagtgggtgcgttgtgagctggaagaacaaggagctgaagtgcggctcgggaatcttcatcaccgacaacgtccacacgtggaccgagcagtacaagttccagcccgaatccccgtcaaaactggcctccgcaatacagaaagcacaggaagaggggatctgtggcatccgcagcgtcacccggttagagaacctcatgtggaagcagattacccccgagcttaatcacatcctggccgagaacgaggtgaagttgacgatcatgaccggggacatcaagggcataatgcaggccgggaaacgctccctgaggcctcagcccaccgagctgaaatatagctggaagacttggggcaaagccaaaatgctctctaccgaaagccacaaccaaaccttcctgatagatggccccgaaactgccgaatgccctaacaccaaccgtgcgtggaattccctggaagtcgaggattacgggttcggcgtgtttacgaccaacatctggctcaaactgaaggagaaacaggatgccttctgcgacagcaagctgatgtccgccgcgatcaaagacaacagggccgtccacgccgatatggggtactggatcgaatcagccctcaacgacacctggaagatcgagaaggcctccttcattgaggttaaaaactgccactggcccaagagccacaccctgtggtccaacggagtgctggagagcgagatgattattccaaagaacctcgcgggccccgtctcgcaacacaactaccgcccggggtaccacactcagatcgctggcccctggcacctgggaaagctggaaatggactttgatttctgtgatggcacgaccgtcgtggtgaccgaggactgtgggaaccggggtccaagcctccgcacaacgaccgcaagcggcaagctgatcacagagtggtgttgccggtcctgcaccctaccaccgctccgataccgtggggaggacggctgctggtacggaatggagatcagacccctgaaggaaaaggaagaaaacctggtcaatagcctcgtgacggccggccacgggcaagtagacaacttctcactgggcgtcctaggcatggccctgttcctggaggagatgctgcggacccgcgtggggacgaagcacgccatcctcctggtggcggtgtcgttcgttaccttaatcaccggcaacatgagcttcaaggacctcggccgggtggtcgttatggtgggcgcgaccatgaccgatgatattggtatgggcgtcacgtacctggccctgctagccgccttcaaggtgcgccccacgttcgcggctggcctgtttctccggaagctcacctccaaggagctgatgatgaccaccatagggatcgtgctgttatcccagagcacaatacccgagaccatcctggaactgaccgacgcacttgccctgggaatgatggtcttaaagatggtgcgcgatatggagaagtaccagctcgcggtcacaatcatggcaatcctttgcgtgcccaatgccgtgatattacagaacgcgtggaaggtgagttgcacgattctcgccgtggtgagcgtcagccccctgcttttaacctcatcccagcaaaagaccgactggatacccttagccttgacaatcaaaggtctcaacccaacggcgatctttctgaccacactgagccgcactaacaagaagcggtcctggcccctaaatgaggccattatggccgtaggcatggtgagcatcctggcatcttccctgcttaaaaacgacatccccatgacgggaccactggtcgccggcggactgctcaccgtgtgttatgtgttaaccgggcgctccgccgacctggagctcgagcgagccactgacgtcaagtgggaggatcaggcagagatctcggggtcttcccccattctgtcgattacgatatctgaggacgggagcatgtccatcaagaacgaggaggaggagcagacgctgacaattttaatccgcactggcctgctggtaatcagcggcctctttccggtgtccatacccatcacagccgcggcatggtacctgtgggaggtgaagaagcagcgggccggggtgctgtgggatgtcccctcgccgccgcccatgggcaaggccgagctcgaggacggtgcataccgaatcaagcagaggggcatcctagggtactcgcagattggcgcgggcgtgtacaaggaggggacgttccacaccatgtggcacgtgacccgcggcgccgtgctgacgcacaaggggaagcggatcgagcccagctgggccgatgtgaaaaaagatctcatctcctatggcgggggctggaaactggagggtgaatggaaggagggggaggaggtccaggtactggcgctcgagcccgggaagaacccacgcgcagtccagactaagcccgggctgttcaagaccaacaccggcaccattggggcggtgagtctggacttctcccctggcacgagcgggtcccccatcatcgataagaaggggaaagtggtcggcctgtacgggaacggagtggtgaccaggagcggggcctacgtctccgccatagcacaaaccgagaagtccatcgaagacaacccagatatcgaggacgacatcttccgcaagcggcgcttgaccatcatggacttacaccccggggccggtaagacgaagcggtacctgcccgcaatagttcgcgaagccatcaagcgcgggctccgtacgcttatcctggccccgacccgggtcgttgccgccgagatggaagaggccctccgcggcctccccatccggtaccagacccccgccatccgcgccgagcacaccgggcgcgagatcgttgacttaatgtgccatgccacattcaccatgcgattactgtcgcccgtgcgcgtcccgaactataacttaataatcatggacgaggcgcatttcacggaccccgccagcatcgccgcccggggttatatcagcacgcgagtggagatgggcgaggccgccgggattttcatgaccgccacgccgccagggtcccgggacccgttcccccagagcaacgcccccataatcgacgaggagcgcgagatcccggagcggtcgtggaacagcgggcacgagtgggtgaccgactttaaggggaaaacggtgtggttcgtaccaagtatcaaggccggcaacgacatcgccgcgtgtctccgcaagaacggcaagaaagtgatacaactaagccgcaagaccttcgactccgagtacgtcaaaacccgcacaaacgactgggacttcgtggtgacaaccgatatcagcgagatgggtgccaacttcaaggccgagcgggtcatcgacccccgcaggtgcatgaagccggtaatccttacggacggggaggagcgcgtgatcctcgccggccccatgccggtcactcacagtagcgcagcgcagcggagagggcgcataggccgcaacccaaagaacgagaatgatcagtatatttatatgggagaaccgcttgagaacgacgaggactgcgcccactggaaggaggcgaagatgctgctcgacaacatcaacacaccggagggcatcatcccgtccatgttcgagcccgagagggagaaggttgacgccatcgacggcgagtaccgtctccgcggtgaggcgcggaagaccttcgtcgacctgatgcgccggggagacctcccagtctggctagcgtacaaggttgcggccgaggggatcaactatgccgacagacggtggtgcttcgatggcatcaagaacaatcagatactagaggagaacgtcgaggtggagatatggaccaaagagggggagaggaagaagctaaaaccccggtggctggacgcgcgcatctatagcgatcctctagcgttaaaggagtttaaagagttcgccgcaggtcggaagtctctgaccctaaacctcatcacggaaatgggacgcctgcccaccttcatgacccagaagacccgggacgccctcgataatctcgcagttctgcacacggccgaggcggggggccgcgcctacaaccacgcactgagcgagctccccgagacgctggaaaccctgctgctgctgaccctcctggctaccgtcacggggggcattttcctttttctcatgtccggcagggggatcggcaagatgaccctggggatgtgttgcatcgtgaccgctagcatcctactctggtacgcccaaatccagccacactggatcgccgcgtccatcatcttggagttcttcctgatcgtgctcctgattcccgagcccgagaaacagcgcacgccccaggacaaccagctgacctacgttgtgatcgctatcctcacagtggtcgctgccaccatggcgaacgagatgggctttctggagaaaaccaagaaggacctggggctcggcagcatcgccacgcagcagccggagtccaacatcctagacatcgacctgcgaccggcctcagcgtggacgctctacgccgtggccaccaccttcgtcacgcccatgctgcgccactcaattgagaactcaagcgtcaacgtgtccctgaccgcgattgccaaccaggccacagtgctcatgggccttgggaaaggctggcccttgagcaaaatggacatcggggccccgctcctggccatcgggtgctactctcaggtcaatcccatcaccctgactgcggcgctcctgttgttagtggcccactacgccatcattgggcccggcttacaggcgaaggccacacgggaggcccagaagagggctgcggcggggatcatgaaaaaccccaccgtggacgggataaccgttatagacctggacccgatcccctatgaccctaagtttgagaagcagctgggccaggtgatgctgctggtgctctgcgtcacccaggtgctgatgatgcggaccacctgggccctgtgcgaggcactcaccctggccacggggcccatcagcactctatgggagggcaacccggggcgcttctggaacacgaccatcgccgtctctatggcgaatatattccggggcagctacctcgctggcgctggcctgttgttttccatcatgaagaacactaccaactcgcgccgggggaccgggaatatcggtgagaccctcggcgagaagtggaagtcccgcctgaatgctctcggcaagagcgagtttcagatctataagaagtccggtatacaggaggtggaccgaacgctcgccaaggaggggatcaaacgtggcgagactgaccaccacgcggtgagtcgcgggtccgccaaactacgctggtttgtggagcgcaacatggtcacccccgagggtaaggttgtggacctgggctgcggtaggggcgggtggtcttactactgcggcgggttgaagaacgtcagagaggtgaaaggtttaaccaagggtgggccaggccacgaagagcctatccctatgtccacgtacgggtggaacctagtccgcctccagtcaggcgtcgacgtgttcttcataccgcccgagaaatgcgacaccctgctgtgtgatatcggtgagtctagccccaacccgaccgtggaggccggccgcaccctccgggtcctgaatttagttgagaactggctcaacaacaacacccagttctgtattaaggtgttgaacccatacatgccttctgtcatcgagaaaatggagacgctgcagcgcaagtacggcggtgccctggtgaggaaccctctctcccgcaactctacgcacgagatgtattgggtgtccaacgcaagcggcaacatcgtctccagcgtgaacatgatctccagaatgcttatcaaccgcttcaccatgcggcacaagaaagccacctatgagcccgatgtggacctggggagcggaacgcgcaacattgggatcgagtccgaaattcccaatctcgacatcatcggcaagcggattgagaagatcaagcaggagcacgagactagctggcactacgaccaggaccacccctacaagacctgggcctatcacggctcctacgagaccaagcagacggggagcgcctccagcatggttaacggcgtagttcgcctcctgaccaaaccgtgggacgtcttgcccacggttacacaaatggccatgacggacaccacccccttcgggcaacaacgcgtgttcaaggagaaggttgataccaggactcaggagcccaaggagggcacgaagaagctgatgaagattaccgcggagtggctgtggaaggagctcggcaagaagaagactccccgcatgtgcacgcgggaggagttcactcgcaaagtgcggtccaacgccgccctgggcgccatcttcaccgatgagaataagtggaaatccgccagggaggcggtcgaggactcccgcttctgggaactggtggacaaggagcggaatctccacctggagggcaagtgcgagacttgcgtgtacaacatgatgggaaagcgggagaagaagctgggcgagttcgggaaagccaagggcagccgggccatctggtacatgtggctcggggcccgcttcctggagttcgaggcccttgggttcttaaacgaggaccactggttcagccgcgaaaactcactaagcggtgtagagggagaaggtctgcaccggctcggatatatccttcgcgatgtgtccaagaaagagggcggcgcgatgtacgcggacgacacggctgggtgggacaccagaatcaccctggaggatttgaagaacgaggagatggtgaccaaccacatggagggcgagcacaagaaactggccgaggccatctttaagctgacgtatcaaaacaaagtcgtgagagtacaacgacccacgccccgcgggaccgtaatggatataatcagccggcgcgatcagcgaggcagcggtcaggtggggacctacggacttaacacattcaccaatatggaagcgcagttaatccgccaaatggaaggagagggcgtgttcaaaaacatccagcacctcaccgtcaccgaggagacggcggtgcagaactggctcgcccgcgtggggcgggaacgcctcagcagaatggccatctccggcgacgactgcgtcgtcaagcccctggatgacagattcgcgagcgccctcaccgccctgaacgacatgggcaaaattcggaaggacatccaacagtgggagccgagccgcgggtggaacgactggacccaagtgcccttctgcagccaccacttccacgagctgataatgaaggacgggagggtactcgtggtgccctgccgcaaccaggacgaactgatcgggagagcccgcatctcccagggcgccggttggagcctgcgggaaaccgcttgcctaggaaaatcctacgcccagatgtggagtctcatgtacttccacagacgggacctgcgcctcgccgccaacgccatctgctccgcagtccccagccactgggtgccgacgtcccgcacgacctggtccatccatgcgaagcacgagtggatgaccactgaggacatgcttacggtgtggaacagagtctggatccaagagaacccctggatggaggataagacccccgtggagtcttgggaagagatcccctacctgggcaagcgggaggaccagtggtgcgggagcctaatcggcctgactagccgcgcgacttgggccaagaatatccaggtagccatcaatcaggtacggtccctaattggtaacgaggaatacacagactacatgccgagcatgaagcgcttccgccgggaggaggaggaagcgggcgtgctctggtga

SEQ ID NO: 25149 - RNA, 9876 nt, synthetic construct
  misc_feature 1..9876: note = derived and/or modified CDS sequence (opt11) from DENV-2__FJ744724__SS-prME
  source 1..9876: mol_type = other RNA
tcagcagggatgatcatcatgctcattcccaccgtgatggcattccatcttaccacgaggaacggcgagccgcacatgatcgtcggcattcaggagaaagggaagtccctgctgttcaagacagaggacggtgtgaacatgtgcactttaatggcaatggacctgggggagctgtgtgaggacaccataacctacaaatgccccctcctgcggcagaacgaacccgaggacattgactgctggtgcaactcgacctctacttgggtcacttacgggacttgtacaacgaccggggagcataggcgggagaagcgctccgttgctctggtgcctcacgtggggatggggctcgagacgcgcactgaaacgtggatgtcaagcgaaggtgcatggaagcacgcccagcgaatcgagacctggatcctgcgccatccgggtttcactattatggccgctatcttggcctacacaatcgggacaacccacttccagcgcgtactgatcttcatactgctgacggccgtggctccctccatgaccatgcggtgcatcgggatatcgaaccgcgacttcgttgagggcgtttccgggggctcgtgggtagatattgtcctcgaacacgggtcctgtgttaccacgatggcgaaaaacaagcccacgctggacttcgaactgatcaaaaccgaagccaagcaacccgcaaccctccggaagtactgcatcgaagcgaagctgaccaacacgaccaccgagagccgatgcccaacacagggagagccgtccctgaaagaggagcaggacaagcggttcgtgtgcaagcactccatcgtagatcgaggctggggcaacggctgcggcctgttcggcaaaggtggtatcgtcacgtgtgccatgttcacatgcaagaaaaacatggaaggcaagatcgtccagcccgaaaacctggagtacaccatcgtggttacgccccactccggtgaggaacacgcggtgggcaacgacacagggaaacatggcaaggagatcaaagtgacaccgcagagctccgtcaccgaagccgagctgaccgggtacggcactgtcacgatggaatgcagcccccggaccggcctggatttcaatgagatggttctgctgcaaatggagaacaaagcctggctcgtccaccgccagtggttcctagacctgcccttaccttggctgcctggggctgataagcaggagtccaactggatccagaaggagaccctagtgaccttcaagaaccctcacgccaagaaacaggatgtcgtggttctaggcagccaggaaggggccatgcacacggccctcaccggtgccaccgagatccagatgagctccggcaacttgctattcaccgggcatctgaagtgcaggctgcgcatggacaagctacaattgaagggcatgagctactccatgtgcaccgggaaattcaaggtcgtgaaggaaattgccgaaacccaacacggcaccatcgttatccgggtccagtacgagggggacggcagcccctgcaagatcccctttgaaatcatggatctggagaagcgctatgttctcggacggctgatcaccgtgaaccctatcgtcaccgaaaaggactcccctgtgaacatcgaagccgaaccaccctttggggacagctacataataattggggtagagccggggcagctaaagctcaactggttcaagaagggatcaagcatcgggcaaatgttcgagaccacgatgcgcggcgcgaagcgcatggccatcctcggggacaccgcctgggacttcgggtccctgggcggtgttttcacgagcatcgggaaggcccttcaccaggtgtttggtgccatctatggcgcggccttctccggcgtgagctggaccatgaaaatcctgatcggggtcattatcacctggatcggcatgaactcccgcagcacctccctgagcgtatccctagtgctagtcgggatcgtcacactgtatttgggagtaatggtccaggctgatagcggttgcgtggtgtcatggaagaacaaggagctaaaatgtggtagcggcatcttcataaccgataacgtccacacctggaccgaacagtataagttccagcccgagagcccttccaagctggccagcgctatccagaaagcccaggaggaggggatctgcggcatccgatccgtgacacggctggagaacttgatgtggaaacagattacccccgagctgaaccacatcctggccgagaacgaagtgaagctcaccatcatgactggggacatcaaaggtattatgcaagcggggaaaagaagcctacggccacagcccacagaactgaaatactcctggaagacctgggggaaagccaagatgctcagcaccgagtcatataaccagactttcttgatagatggccccgaaacggcggagtgcccgaataccaacagggcctggaacagcctggaggtagaagactacggcttcggcgtcttcacaaccaacatttggctcaagctgaaggagaagcaagacgcgttctgcgactctaagctcatgagcgccgccatcaaggacaaccgagcagtgcacgccgacatgggttactggattgagtccgccctaaacgacacgtggaagattgagaaggccagcttcatcgaggtcaagaactgccactggcccaagtcccataccctctggagcaacggggtgctggagagtgaaatgatcatccccaagaacctcgcaggtcccgtgagtcagcacaactacagaccggggtaccatacccagatagctggcccgtggcatctgggtaagctcgaaatggacttcgacttttgcgacggaaccacggtggtcgttacggaggactgcgggaatcggggcccaagtctaaggaccactacagccagcggcaaactgataacagagtggtgctgccggagctgcacgcttccaccgctccgctaccgcggggaggacggctgctggtatggcatggaaatccgccccctgaaggagaaagaggaaaacctggtcaattccctcgttacggcaggccacgggcaaattgacaacttcagcctaggcgtgctgggcatggcactcttccttgaagagatgctgcggacccgcgtggggacaaaacacgctattttgttggtggccgtctcattcgtcactctgatcaccggtaacatgtccttcaaggacctcgggcgggtggtggtcatggtgggtgccactatggcagacgacatcgggatgggagtcacgtacctggcccttctcgcagcttttaaggtacgccccaccttcgccgcgggcttgctgctcaggaagttaacctccaaggagctgatgatgaccacgatcgggatagtgctcctgtctcagtccaccatcccagagaccgttcttgagttgaccgacgccctggcgctgggcatgatggttctgaagatcgttcgcgacatggaaaagtaccaacttgccgtcacgatcatggcaatcctttgcgtccctaacgctgtgatcctccaaaacgcttggaaggtaagctgcaccatcctggcggtggtgtccgtaagcccccttcttctgacatccagccagcagaagaccgactggatcccgctggccctcacgataaaggggctgaaccccaccgccatcttcctcaccaccctctcccgcacgaacaaaaagcggagctggccgctcaacgaggctatcatggcggtgggcatggtgtccatccttgccagctccctcctcaaaaatgacatcccaatgaccggccccttggtcgcgggagggctgctgacagtgtgttacgtgctgacagggcgttctgcagacttggagttagagcgggccactgacgtcaaatgggaggaccaggcagagatctctggcagcagccccatcctgtccatcaccatcagcgaagacgggtcaatgagcattaagaacgaggaggaagaacagactcttaccatcctgattcgcacgggtttacttgtgatcagtggcctgtttccgataagcatcccaatcaccgcagccgcgtggtacctttgggaagtgaagaaacagcgggccggggtcctctgggatgtccccagcccgccgcccatgggaaaggcggaactggaggacggggcctacagaattaagcagaagggaatcctcggctacagccagattggagccggcgtgtacaaggaggggacgtttcacactatgtggcacgtcacccggggcgccgtgttgatgcacaaggggaagaggatcgagccctcctgggccgacgtgaaaaaggacctgatcagctacggagggggctggaagctggaaggcgagtggaaggagggcgaggaagtccaggtgctcgctctcgagcctggcaagaaccctcgggccgttcagacgaagcccggtctattcaagaccaacaccggaaccatcggggccgtttccctcgacttctcgcccggcacgtccggttctcccatcatcgacaagaaggggaaggtggtcgggctatacgggaacggcgtagtcaccagaagcggtgcctacgtgtctgccattgcgcagacggagaagtcaatcgaggacaaccccgagatcgaagacgacatattccggaagcgccggctgaccatcatggaccttcatcccggggctggcaaaacgaaacgctacctcccagccatcgtccgggaggcgatcaaaaggggtcttcggaccctgatcctcgcacctacaagagtagtggccgccgagatggaggaggccctaaggggcctgccaatccgctaccagactcctgccatccgggctgagcacacggggcgggagatagtggacctcatgtgccatgctacctttaccatgcgcctgctgagtcccgtgcgggtgcccaactacaacttgatcatcatggacgaggcacatttcacagaccctgcctccatcgccgcgcgcgggtacatctcgacgcgggtagagatgggcgaggccgccgggattttcatgacagccacgccacccggcagccgagacccattcccacagtctaacgcccccatcatcgatgaggagcgggagatccccgaaaggtcgtggaactcgggtcacgagtgggtgaccgatttcaaggggaagacagtttggtttgtcccgagcatcaaggcagggaacgacatcgccgcatgcctacggaagaacgggaaaaaggtcatccaactatcacgaaagacgttcgacagtgagtatgtgaagaccaggaccaatgactgggactttgtcgtgactacggatatctccgagatgggcgccaactttaaggcggagcgcgtgatcgacccgcggcgctgtatgaagcccgtaatcttgaccgacggggaagaaagagtcattctggcaggccccatgccggtaacacactcatccgccgcccagagacgggggcgcatcggccggaaccccaaaaatgagaacgaccagtatatttacatgggggagcctctagagaacgacgaggactgcgcacactggaaggaggcaaagatgttgttggacaatataaacacgcccgaaggcatcatcccgagcatgttcgagcccgagcgcgagaaggtggatgctatcgacggtgagtaccgattaagaggtgaggcgcggaagaccttcgtggacctcatgcgccgcggcgatttgcccgtgtggctcgcctacaaagttgccgcggaggggatcaactacgctgatcggcgatggtgcttcgacggcatcaaaaacaaccagatactcgaggagaacgtggaggtcgagatttggactaaagagggggagcgaaagaagctcaagccgcgctggctggacgcccggatttactccgaccccctcgctcttaaggagttcaaggagttcgccgcaggacgtaagagcttaactctcaacctgattacggagatgggcaggttacccacgttcatgacgcagaaaacacgcgatgcgcttgacaatctggctgtgctgcacaccgccgaagccggcgggagggcctacaaccacgccctctccgagttaccggagaccctagaaacactcctactgctcacgctgcttgctacggttaccgggggcatcttcctcttcctcatgagcggccgcgggattggcaagatgacgctgggaatgtgctgcatcataaccgcctcaatactcctgtggtacgcgcagatccaaccgcattggattgcagcgagcataatcctggagttcttccttatcgtccttttgatacccgagcccgagaagcagcggactccccaagataaccagttgacatatgtagtgattgccattctgaccgttgtggccgcgaccatggctaacgagatgggcttcctggaaaagaccaagaaggacctcgggctggggagcatcgccacgcagcagccggaaagcaacatcctggacattgacttacgcccagcctctgcctggaccttgtatgctgtggccaccaccttcgttacacccatgctgcggcactcaatcgagaactcatccgtgaacgtaagcctaacggcgatcgcgaaccaagccaccgtactcatgggcctgggtaagggctggcccctcagtaagatggacatcggggttccgctgctggcgattggctgctactcacaggtgaaccccatcaccctcacggccgcccttttgttgctggtggcacactatgcgatcatcgggcccggtctgcaggcaaaggccacccgtgaggcccagaagcgagctgcggcggggatcatgaaaaaccccacggttgatgggatcaccgtcatcgatcttgacccgattccctacgaccccaagtttgagaagcaactggggcaggtcatgctcctcattctctgcgtgacccaggtgctgatgatgcgcacgacctgggcactctgcgaggcgctgaccctggccacgggtcccatttccaccctctgggaaggcaacccgggccggttctggaacaccaccatcgctgtcagcatggccaatatcttccgcggctcctatctggcgggcgccgggctcctcttctccatcatgaagaacacaaccaacacacggcggggaaccggtaacattggcgagacactcggtgagaagtggaagtccagactgaacgcgctaggaaaatccgagttccagatctacaagaaatccggcatccaggaagttgaccgcaccctggcgaaggagggtataaagcgcggcgaaacggaccaccacgccgtgagccgggggtccgcaaagctgcgttggttcgtggaacgaaacatggtgacccccgaaggtaaggttgtcgacctcggatgcggtcgcggtggatggtcctactattgcggcggcctgaagaacgtacgggaggtgaaaggcctcactaagggcgggcccggccacgaggaacccataccgatgtcaacgtacgggtggaatctcgtccgactacagagcggcgtcgacgtgttcttcatcccaccagaaaagtgcgacacgctgctctgcgacatcggggagagctctcccaacccgaccgtcgaggcaggacgcaccctgcgagtgttgaatctggtggagaactggttaaacaacaacacccagttttgcatcaaggtcctgaacccctacatgccgagtgtcatcgagaagatggaggcgttacagcgaaagtacgggggcgccctcgtgcgaaaccctctaagccgcaactcgactcacgagatgtattgggtcagcaatgcctccggcaacatcgtctcttctgtgaacatgatatcccgcatgttaatcaaccggttcaccatgcgccacaagaaggcgacctacgagcccgacgtcgatctcgggagcggcacgcggaacatcggaatcgagtctgaggtgcccaacttagacatcatcggcaagcgcatagaaaagatcaaacaggagcatgagacaagctggcactacgaccaggaccacccatacaagacctgggcctaccacggttcctacgagacaaagcagacggggagcgcgtcgagcatggtgaacggggtcgtgcggctgctcacgaagccgtgggatgttctgcccaccgtcacccagatggctatgactgatacgacccccttcggtcagcagcgcgtgttcaaagaaaaggtagacaccaggacgcaggaaccaaaggagggcaccaagaagctgatgaagataaccgccgagtggctatggaaggagttggggaagaagaagacacctcggatgtgcacgagggaagagtttacccgtaaggtgcgctccaatgctgcgttaggcgcgatattcaccgacgagaacaaatggaagtccgctcgggaagctgtggaggactcccggttttgggagttggtcgataaggagcgtaacctgcatctggaaggaaagtgtgagacctgcgtgtataatatgatgggcaagcgcgagaagaagttgggggaatttgggaaggccaagggtagccgggccatctggtacatgtggctgggagcgagattcctggagttcgaggcactcgggttcctgaacgaggaccactggttctcccgggagaactcactcagtggcgtggagggtgaagggctccacaaacttgggtacattctgcgcgacgtaagcaaaaaggaaggcggcgccatgtacgctgacgacacggctgggtgggatactcggatcaccctcgaggacctgaaaaacgaggagatggtgactaatcacatggagggcgaacacaagaagctagccgaggcgatcttcaagctcacataccagaacaaggtcgtcagagtgcaaaggcccacgccccggggcaccgtgatggacattatcagccggagagaccagcggggttctgggcaagtcggaacctacggtttgaacacatttacaaatatggaggcccaactgatccgtcagatggagggggagggcgtgttcaaaaacatccaacacctcacggtaaccgaggaagtcgccgtccagaactggctggcgcgggtggggagggaacgcctgagccggatggccatttccggtgacgactgcgtggtgaagcccttagacgatcgcttcgcaaacgctctgacggctctaaacgacatgggcaaaatccggaaagacatccaacaatgggagccaagcaaagggtggaacgactggacacaggttccattttgctcccatcactttcacgagctcatcatgaaggacgggcgggtgttagtggtgccctgccggaaccaggacgagctgattgggagagcacggatatcacaaggcgcggggtggagtctcagagagacggcctgcctgggcaaaagctacgctcagatgtggtccctgatgtacttccaccgccgcgacctcagactggctgcgaacgccatctgctccgccgtccccagccactgggtgccaaccagtcgcacgacatggtccatccatgccaagcacgaatggatgaccacagaagatatgctgaccgtttggaaccgggtctggatccgcgagaatccgtggatggaagacaagacgccggtggaaagctgggaggagatcccctacctcggcaagcgcgaggaccagtggtgtgggtccctaatcggactgacaagccgcgccacctgggcgaagaatatccagaccgccatcaaccaggtgcgttccttaatcggtaatgaggagtatacagactatatgcctagcatgaaacgtttccggcgcgaggaggaggaggccggcgtcctgtggtga

SEQ ID NO: 25150 - RNA, 9876 nt, synthetic construct
  misc_feature 1..9876: note = derived and/or modified CDS sequence (opt11) from DENV-2__FJ906957__SS-prME
  source 1..9876: mol_type = other RNA
agcgcgggcatgatcatcatgctgatccctacggtgatggccttccacctcaccacccggaacggggagccgcacatgatcgttagcatacaggaaaagggcaagtctcttctgttcaagactgaggatggtgtgaacatgtgtaccctcatggcgatggacctgggcgaactgtgcgaggacaccatcacctacaagtgccccttactgcgccaaaacgaacctgaggacatcgactgttggtgcaacagtacgagcacctgggtaacctacggaacctgcacaaccaccggggagcaccgtcgggaaaagcggtccgtggccttagtgccccacgtgggcatgggcctcgaaacccggaccgagacctggatgagctcggagggcgcgtggaagcacgctcagcgaatcgagacttggatccttcggcacccgggattcacgatcatggcagcgatacttgcctacaccatcggaaccacccatttccagcgcgccctcattttcatccttctgacggcggtcgcgccatccatgaccatgagatgcatcgggatctctaatcgcgacttcgtggagggtgtgtcgggcggatcctgggtagacatcgtgctcgagcatggaagctgcgtgaccaccatggccaagaacaaacccacactcgactttgagctgatcaaaacagaggctaagcagcccgccacactgcgcaagtactgcatcgaggccaaactgaccaacacgaccactgagagtcgctgcccaactcaaggggagcccagcctgaaggaggaacaggacaagaggttcgtctgcaagcactcaatggtggaccgcgggtggggcaacgggtgcggcctctttggcaagggtggcatcgttacttgcgcgatgttcacgtgtaagaagaatatggagggcaagattgtccagccggaaaacttggagtacaccatcgtagtaacgccccacagcggcgaggaacacgcagtcgggaacgacacgggcaagcacgggaaggagattaaagttacgccgcagtccagcattaccgaggccgagctgacaggctacgggaccgtgacgatggagtgcagcccccggaccggactcgacttcaacgagatggtgttgctgcagatggagaataaagcctggctcgtgcaccgccagtggttcttggacctccccctcccctggctgccgggtgcagataaacaggggagcaactggatccagaaggaaaccctggtgaccttcaagaacccccatgcgaaaaagcaggacgtcgtagtcctcggcagccaggagggagcaatgcatacggccctgaccggcgccaccgaaattcagatgtcctcgggaaaccttttattcacaggccacctgaagtgccggctgcgcatggataagctgcagctgaagggtatgtcctatagcatgtgcacggggaaattcaaagtggtgaaggagatcgccgagacccaacacggtaccatcgtcattcgagttcaatacgagggggacggctccccatgcaagattccgtttgagataatggacctagaaaagcgctacgtgctcggccggctgatcaccgtaaatccgatcgtcacggaaaaggacagtcccgtgaacatcgaggctgagccacctttcggagactcctacatcatcatcggcgtagaaccggggcagctgaagctgaactggttcaaaaagggatcttccatcgggcaaatgtttgagacaacaatgcgtggggccaaaagaatggccatacttggagacaccgcctgggacttcggaagcctaggaggggtctttacctccatcggaaaggcactccaccaggttttcggggcgatctacggcgccgccttcagcggcgtgagctggaccatgaagatcctgatcggggtgatcatcacttggatcggcatgaactcacggagtaccagcctttctgttagtctggttctcgtggggatcgtgacattatacttaggcgtaatggtgcaggcagacagtggttgcgtagtctcttggaagaacaaggagttgaagtgcggcagcggcatattcataaccgacaatgttcatacctggaccgagcagtacaagttccagcccgagtcgccctccaaactggcgtccgccatccagaaggcacaagaggagggcatctgcggcatacgcagcgtaacgagacttgagaatctgatgtggaaacagatcacccccgaactgaatcacatcctggccgagaacgaagtcaagttgaccatcatgaccggggacatcaagggcatcatgcaggccggcaagcggtctctgcggccacagcccactgagctgaagtactcgtggaagacctggggcaaggcgaagatgctctccactgaaagccacaaccagaccttcttgatcgatggtcccgagacggccgagtgtccgaacaccaatcgcgcttggaactcattagaagtggaggattacgggttcggcgtgttcaccaccaacatctggctcaagctgaaggagaagcaggatgccttctgcgactccaagctgatgtccgccgcgatcaaggacaaccgggcagtccacgctgacatgggttactggatcgagagcgccctcaacgacacctggaaaatcgagaaagcatcctttatcgaggtgaaaaactgtcactggcccaagtcacacacactctggtccaacggcgtattagagagtgagatgatcattcccaagaacttggcggggccagtctcccaacataactaccgcccagggtaccacacccagatcgccggcccctggcacctcgggaagctcgaaatggacttcgatttctgcgacggcaccaccgtggtggtcactgaggactgcggtaaccggggacccagcctccgcaccaccacagctagcggcaagttgatcacggagtggtgctgtaggtcctgcaccctgcccccattaaggtaccgcggggaggacggctgctggtacggaatggagattagacccctaaaagagaaggaggagaatctggtcaacagtctcgtgactgccggccatgggcaagtcgataatttctcccttggcgtgctcggaatggccctgttcctggaggagatgttgcgaaccagagtgggcaccaagcacgctatcctcctggtcgccgccagcttcgtaaccctgatcacggggaacatgagtttcaaggacctcgggagagtggttgtgatggtgggcgccacgatgacggacgacatcgggatgggcgtcacttacttggcgctgttggccgcgtttaaggtacgccccaccttcgccgccggcctgctcctccgtaagctgaccagcaaagagttgatgatgacgaccatcggtatcgtgctcctgtcccagtctaccatacccgagaccatcctggagctgacggacgcgctggccctgggcatgatggtcctcaagatcgtgcgcaacatggaaaagtaccagctggccgtgaccatcatggctatcctgtgcgtccccaacgcggtgatcctccagaacgcgtggaaagtcagctgcaccattctggccgtggttagcgtcagccctctgttactgacttcgtcccagcaaaagactgattggatccccctagctttgaccatcaagggactcaaccccaccgctattttcctgaccacgctcagccggacaaacaagaagcgcagttggccgctgaacgaagcgatcatggccgtgggcatggtctccatcctggcatctagcctcctgaagaacgacattcccatgaccggtccccttgttgccgggggcttgctgaccgtgtgctacgtgctgacggggcgcagcgccgacctagagctggagcgtgcgaccgatgtcaagtgggaggaccaagccgagatatccggctcgtcccccatcctttccatcaccatttccgaggacgggagcatgagtatcaaaaacgaggaggaggagcagaccctcacgatcctgatccgcacgggcctgctcgtgatcagcggcttattccctgtgtccatccccatcaccgcggccgcttggtacttatgggaagtgaagaagcagcgggcgggggtactctgggacgtgccctccccgccgcccatggggaaggccgagctggaggacggtgcctaccgcatcaaacagaaaggcatcctggggtattcccagatcggcgccggcgtctataaggaggggaccttccacaccatgtggcacgtgacgcgcggcgctgtgctcatgcacaaagggaagcgaatcgagccctcctgggcggacgtcaaaaaggacctgatctcctacggtgggggctggaagctggagggagagtggaaagagggggaagaagtacaggtgctcgccctagagcccgggaaaaacccacgggctgtccagaccaaacccggtcttttcaagacgaacaccggcactattggggccgtcagtcttgacttctcgcccggcaccagcggctcgcccatcatcgataagaagggtaaggtggtcggcttatacgggaacggcgttgtgacccgcagcggcgcttacgtcagcgcgatcgcccagaccgagaagtccatcgaggacaatcccgagatcgaggacgacatcttccggaagaggcggctgacgataatggaccttcaccccggagccggaaagaccaagcgatacttacccgccatcgtgcgggaagcgatcaagagagggctgcgtaccttaatcctcgccccgacccgcgttgttgccgccgagatggaggaagccctccggggcctccccataaggtaccagacgcccgctatacgagccgaacacaccggtcgcgagatcgtcgatctcatgtgtcacgccaccttcaccatgcgcctgctgagccccgtacgggtccccaactacaacctcatcattatggacgaggcacacttcactgaccccgccagcatagcggcacgtgggtacatcagcacgcgggtagagatgggcgaggcggccgggatctttatgaccgccacgccgcctggctctcgcgacccgttcccccaatccaacgcccccatcatagatgaggagcgggaaatccccgagcgcagttggaactcggggcacgagtgggtgacggacttcaagggcaagaccgtctggttcgtgccgtccatcaaggccgggaatgacatcgcagcctgcctacggaaaaacggcaagaaggtgatccagctaagccgcaagacctttgacagtgagtacgtcaagacccggacgaacgattgggacttcgtggtgacaaccgatattagcgagatgggtgccaacttcaaggccgagagggtcatcgacccccgtcgctgcatgaagcccgtgatcctcacagacggggaggagagagtaatcttggccggccccatgccggtcactcattccagcgccgcccagcgccgcgggcgcataggcagaaatcccaagaatgagaatgaccagtacatctacatgggggagcccctggaaaacgacgaagactgcgcgcactggaaggaggccaagatgctcctggacaacatcaacacgccagagggtattatcccgagtatgttcgagccggagcgagagaaggtcgacgctattgacggcgagtatcggctgcgcggggaagcccgcaaaaccttcgttgacctcatgcggcgtggcgacctgccggtatggcttgcctacaaagtggcagccgagggtatcaactacgcagatcgtcgatggtgtttcgacggcataaagaacaaccagatcctcgaggagaacgtggaggtagagatctggaccaaggagggtgaacggaagaagttaaagccacgctggctggatgctcggatctacagcgatccccttgccctgaaggagttcaaagagttcgcagctggcagaaaatcccttactcttaacttgattaccgagatgggtcggctacccacctttatgacgcagaagacgcgcgacgccctcgacaatctggccgtgctgcacaccgcggaggcgggagggcgagcgtacaaccacgccctcagcgagctgccagagaccctggagaccttgctactgttaacgctgctggcaactgtcacaggtgggatcttcctctttctgatgtccgggcgggggatcggcaaaatgactctgggaatgtgctgcatcatcacggcgtcgatcctcctgtggtacgcccaaatccagccgcactggatcgccgccagtataatccttgaatttttcctcatcgtactgcttatccctgagcccgagaagcagcggacgccccaggacaaccagctgacctacgtggtgatcgccatactgacggtggtggcagccaccatggccaacgaaatgggattcctggagaagacgaagaaagacctggggctgggctcaatcgccacccagcagccggagagtaacatccttgacatcgacctccgccctgctagtgcgtggaccctctacgccgtcgcaaccacatttgtaacccccatgctgcggcactcgatcgaaaactcctcagtcaatgtgtcactcaccgccatagcaaaccaggcgacagtactgatgggcctgggtaagggctggccactaagcaagatggatatcggggtaccgttgctggccatcggctgctactcgcaagtcaatcccatcacgctcaccgccgcgctactgcttcttgtcgcgcactacgccatcatcggtcccggcctacaggccaaggccacacgcgaggcccagaaaagagcggccgccggaataatgaaaaacccgaccgtggacgggatcacggtaatcgacctcgacccgatcccttacgacccgaagttcgagaagcagcttggccaggttatgctgctcatcctgtgcgtgacacaggtgctcatgatgcgtacgacctgggccttgtgtgaggccctgacgttagcgacggggcccatcagcaccctctgggagggcaaccctgggcggttttggaacactacgatcgctgtttccatggcaaacatcttccggggaagctacctggccggcgctgggctcttgttctccatcatgaagaacaccaccaacacccgccgcggcacgggtaacattggcgagacccttggcgagaaatggaaaagcagactgaacgccctcgggaaatccgagttccagatatataagaagtccggcatccaagaagtagaccgcaccctggcaaaagaggggatcaagcgcggcgagaccgaccatcacgcggtctcccgggggagcgccaaactacgatggttcgtcgagcggaatatggtgaccccggagggcaaggtagtggacctcggctgcgggcgcgggggctggtcctactattgcggaggtctgaagaacgtgcgcgaggtgaagggcctgactaaaggagggcccggccacgaggagcccatcccgatgagcacctacgggtggaacctggtgcggctgcagtccggcgtcgacgtcttctttatcccgcccgagaagtgcgataccctgctctgcgacatcggggaatcttcgccgaatcccacggtggaagccggccggaccctccgagtcctgaacctcgtcgagaattggcttaataacaacacgcagttttgcatcaaagtgctgaacccttacatgcccagcgtcatcgagaagatggaggccctgcaacggaagtacggcggggccctcgtccggaacccgctgtccagaaattccacccatgagatgtactgggtaagcaacgcttccgggaatatcgtcagttccgtcaacatgatctcccgcatgctgattaaccggttcacaatgcgccacaagaaagcaacgtacgagcccgacgtcgacctagggtctggaacccgcaacatcggtatcgaaagcgagatccccaatttggacattatcgggaaacgtatcgagaaaatcaaacaggagcacgagacctcctggcactatgaccaagaccacccctacaagacctgggcttaccacggcagctacgagacgaagcaaacggggtccgcgtctagcatggtgaacggagtcgtacggcttctcacaaagccgtgggacgtcctgcccacagtaacacagatggccatgaccgacaccacccccttcggtcagcagagagtgttcaaagaaaaggtggacacgcgcacccaggagcccaaggaggggaccaaaaagctaatgaaaatcaccgccgagtggctctggaaggaactgggtaaaaagaagacgcctcggatgtgcacccgcgaggagttcacccgtaaggttcgcagtaacgccgcgctgggagccatcttcaccgacgagaacaagtggaagtccgcgcgggaggccgtggaggacagccggttctgggagctcgtcgacaaggaacggaacctgcatctggagggcaagtgcgagacgtgcgtctacaacatgatggggaagcgcgaaaagaaattaggcgagttcgggaaggccaagggctcccgggcgatctggtacatgtggctgggagcacgctttctggagtttgaggccctcggctttttgaacgaagatcattggttctctcgggagaactccctgtcaggcgtggaaggggagggcttacataagttagggtatattctcagagatgtcagcaaaaaggagggcggtgcgatgtacgccgacgacaccgcagggtgggacacaagaatcaccctcgaggacctgaagaacgaagagatggtgaccaaccacatggagggcgaacataagaagctggccgaggccatcttcaagctcacgtaccagaacaaggtggtccgcgtgcagcgaccaacgccccgtggaaccgtcatggatatcatcagtcggagagaccagagaggctcagggcaggtcgggacgtatggactgaacactttcaccaacatggaggctcagctgatccgccaaatggagggggagggagtattcaagaacatccagcacctcaccgttacggaggagattgcagtccagaactggttagcccgggttgggcgcgagaggctgtcgcgcatggccatctcaggtgacgactgcgtagtcaagccgttagacgaccgctttgccaacgccctgaccgcgctgaatgacatgggcaagatacggaaggatatccagcagtgggagccgtccaaaggttggaacgactggacccaagtcccattttgctcgcatcatttccatgagctcattatgaaagacggacgcgtgctggtcgtaccctgccggaaccaagatgagttaatagggcgcgcccgaatatcccagggcgccggatggagcctgcgcgagactgcctgccttggcaagtcctatgcccagatgtggagcctgatgtactttcaccggcgggacctccgcctggcggcgaatgcgatctgctcagctgtacccagccactgggtcccaacgtccaggaccacctggtcgatccacgccaagcacgagtggatgacgacagaggacatgctgacggtgtggaaccgagtgtggatccaagaaaacccctggatggaggacaagacccccgtcgagtcctgggaggagatcccctatctcggcaagcgcgaagatcagtggtgcggcagcctgatcggcctaacgtcccgtgcgacctgggccaagaacatccaggctgccatcaaccaggtgcgcagcctcatcgggaacgaagaatacacggattacatgccgagcatgaagcgattccggcgggaagaggaagaggccggtgttctgtggtga

SEQ ID NO: 25151 - RNA, 9876 nt, synthetic construct
  misc_feature 1..9876: note = derived and/or modified CDS sequence (opt11) from DENV-2__FJ906958__SS-prME
  source 1..9876: mol_type = other RNA
agcgtggggatgattatcatgttaatccccacagtgatggcattccacctcacgacccggaacggggaaccccacatgatcgttagcatacaagaaaagggtaagagcctactcttcaaaaccgaagacggggttaacatgtgcaccctcatggccatggatctcggggagctgtgcgaggacaccatcacttacaagtgccccctcctccggcagaacgaaccggaagacatagactgctggtgtaactccaccagcacttgggtgacatacgggacctgcaccacgaccggtgaacaccgccgggagaaaaggagtgtggcgttggtgccgcacgtcgggatggggttagagacacgcaccgagacctggatgagctccgagggtgcttggaagcacgcgcagcgcattgaaacttggatcctgcggcacccaggttttacgataatggccgccatactggcgtacaccatcggaaccacccacttccagcgcgccctcatcttcatcctgctgacagccgtcgccccctccatgacgatgcggtgcatcggtatctccaaccgcgatttcgtcgagggcgtgagcggcgggagctgggtggatatcgtgctcgagcacggcagctgcgtgaccacaatggcgaagaacaagcctacgttggatttcgagctgatcaaaacagaggcaaagcagcccgccaccctcagaaagtattgcatcgaggccaagctgaccaacactaccaccgagtcccgctgccccacgcagggggagcccagcctgaaggaggagcaagacaagcgatttgtgtgcaagcactccatggtggaccgtggatgggggaatgggtgcggcctgttcgggaagggcggcattgtcacctgtgcaatgttcacgtgtaagaaaaacatggaaggcaagatagtgcagcctgagaacctggagtacaccatcgtggtcacgccccactctggcgaggagcacgctgtggggaacgacacggggaaacacggtaaggagatcaaggtgacacctcagtccagcatcacggaggctgaactgaccgggtacggcaccgtgacgatggagtgtagcccccggaccggcctcgacttcaacgagatggtgctcctgcagatggagaacaaggcatggctagtgcaccgccagtggttcctagacttgcccttaccctggctgcctggcgccgacacgcagggatcgaactggatccagaaggaaaccctggttacgttcaagaaccctcacgccaagaaacaggacgtcgtggtgctcggctcacaagagggcgcgatgcacacagcgttgacaggcgccaccgagatccagatgtccagtgggaaccttctattcactgggcacttgaagtgtcggctgcgcatggataaattgcagctgaagggcatgtcgtatagcatgtgtaccgggaagttcaaggtggtcaaggaaatcgcagagacccagcacggtacgatcgtgatccgggtgcagtacgagggtgacggcagcccgtgcaaggtccccttcgagataatggacctggagaaacgctacgtgctcggccgactgataaccgtgaacccggtggtcaccgagaaagacagccccgtgaacatcgaggctgagccgccctttggcgactcctatattattatcggcgtggagccagggcagctgaagctgaactggtttaagaagggctcgtcaatcgggcaaatgttcgaaaccaccatgcgcggcgccaagcggatggccatcctaggcgacacggcctgggacttcgggagtttaggtggggtgttcacctccataggaaaggccctccaccaggtcttcggtgctatttacggcgcggccttcagcggcgtctcctggaccatgaagatcctgataggagtgataataacctggataggcatgaactcccgcagcacgagcctgagtgtgagcctggtccttgtcgggatcgtgacattatacctgggagttatggtgcaagcagacagtggatgcgtggtctcctggaagaacaaggagctgaaatgcggatccggcatctttataaccgataacgtgcacacttggaccgagcagtacaagtttcaacccgagtccccctccaaactcgcctcggccattcagaaggcacaggaagagggaatctgcggtatccgctcggttaccaggctggaaaacttaatgtggaagcagatcaccccggagctgaaccacatcctggcagagaatgaggtgaagttaacaataatgacgggggacatcaagggcatcatgcaggcggggaagcgctccctgcggccccaacccaccgagctgaagtatagttggaaaacttggggtaaggccaagatgttgtctacggagagccacaaccagacgttcctaatcgacggaccggaaacagcggagtgtccgaataccaaccgtgcctggaactccctggaggtagaagactatgggttcggcgtattcaccacaaacatttggttgaagttaaaggagaagcaggacgctttttgcgacagcaaattgatgtctgccgccgtcaaggacaatcgggctgtgcacgcagacatggggtactggatcgagagcgcactaaacgacacctggaagatcgagaaggcctccttcatcgaagttaagaattgccactggccaaagagccacactttgtggtccaacggagtactggagagcgagatgatcattccgaagaacctcgccggcccagtttcacagcacaactaccgtcccgggtaccacacccagatagcgggtccctggcacctggggaagctagaaatggactttgatttctgcgacggcaccacggtggtcgtgactgaggactgcgggaatagaggcccgtcgctccgcaccacaacggcatccggcaagctgatcaccgagtggtgctgtcggagctgcactttgcccccgctgcgctaccgcggggaagacgggtgctggtatgggatggagatccgtcccctcaaggagaaagaggagaacctggtaaattcactcgtcaccgccggccaaggccaagtggacaacttttccctcggtgtgctgggcatggcgttattcctggaggagatgctccggacgcgtgtcgggacgaagcacgcgatcctcctcgtggccgtgtcgtttgtaacacttatcaccggcaacatgtccttcaaggacctcgggcgggtcgtagtaatggtgggcgctacaatgaccgacgacattggtatgggcgtcacctatctggccctgctcgcggcgttcaaggtgcgacccacctttgcagccggccttctcctgcgtaaactcacgagtaaggagttgatgatgaccaccatcgggattgtgttgctgtcgcagagtaccatacccgaaacgattctggagctaaccgacgctctggccctgggcatgatggtcctgaaaatcgtgagggatatggagaagtatcaactcgcggtaaccattatggcgatcctgtgcgtcccaaacgcggtgattctccaaaacgcctggaaggtgtcgtgcaccatactggcggtcgtcagtgtgagcccactcctcctgactagctcccagcagaagaccgactggattcccctggcgcttaccatcaaggggcttaatcctaccgccattttcctgacaacgctcagtcgcaccaataagaaacggtcgtggccgctgaacgaggctattatggctgtcggcatggtgtcgatcttagcctcttctctcctgaagaatgatatccccatgaccggcccgctagtggccgggggtttactgacggtatgttacgtgctaaccgggcgctccgccgatctcgagctggagcgcgctacagacgtgaagtgggaggaccaagccgagatcagcggctcatcccccatcctgagcataacaatctccgaggatggaagtatgtccattaagaacgaggaagaggagcaaacgttgactatcttaatccgcaccggcctactcgtcatcagcggcctgtttccggtgtccatccccatcaccgcggcggcctggtacctgtgggaggtgaaaaagcaacgtgccggggtgctctgggacgtgccttcaccgccgcccatggggaaagcggagttagaggatggcgcatatcgcatcaagcagaaaggcatcttaggctacagtcaaatcggcgccggcgtgtacaaggagggcaccttccacacgatgtggcacgtcacccggggcgcggtgctcatgcacaaggggaaacgaatcgaaccctcctgggcggatgtaaagaaggacctgatctcctacggcgggggctggaagttggagggagagtggaaggagggggaggaagtccaggtactcgcgttggagccaggcaagaacccccgtgcggtgcagaccaagcccggactcttcaagaccaacacggggacgataggggccgtcagcctagatttctcccctggcaccagcggatcccccatcatcgataagaaggggaaggtggtgggactatacgggaacggcgtcgtgacccgcagcggtgcttacgtctctgccatcgcccagacggagaaatcaatcgaggacaaccccgacatcgaagatgacatattccggaagcgcagactgactatcatggacctgcaccccggggcgggcaagaccaaacgctacctcccggccatcgtgcgggaggcgatcaagcgtgggttacggaccctgatcttggcgccgactcgcgtggttgctgccgagatggaggaggccctccggggcctacccatccgctaccaaaccccggcaatccgggcggagcacacgggccgcgagatagtcgacttgatgtgtcatgcgactttcacgatgcggctgctgtcccccgtgcgggtgccgaactacaacctcattatcatggacgaggcccacttcaccgaccccgccagcatagccgcccgcggctacatcagcacccgggtcgagatgggagaggccgccgggatcttcatgaccgccacaccgcccggtagtcgagatccgttcccccagagcaatgcccccatcatcgacgaggagcgggagatacccgagcgctcctggaactcgggacacgagtgggtaacggatttcaagggcaagaccgtatggttcgttccgtccattaaagccggaaacgacatcgcagcctgccttcgcaaaaacggcaagaaggtcatccagctgagccgtaagaccttcgattcggagtatgcaaaaactcggacgaacgactgggatttcgtggtcacgacggatatcagcgagatgggcgcgaacttcaaggcggagcgcgtaatagatcccaggcgctgcatgaagcccgtaatcctcacggacggggaggaacgggtcatcttggctgggcccatgcccgttacccattccagcgctgcccagcgccgggggaggatcgggcggaaccccaagaacgagaacgaccagtacatatatatgggggaacccctggaaaatgacgaggactgcgctcattggaaggaggcaaagatgctgctggacaacataaacaccccagagggcatcattcccagcatgttcgagccggagagggagaaggtggacgccatagatggggaataccggctgcgcggggaggcgaggaaaacgttcgtcgatctcatgcggcgcggcgacctacccgtatggttggcctacaaggtggctgctgaggggatcaactacgcggatcggcgatggtgctttgatggcatcaaaaacaaccagatccttgaagagaacgtggaagtggagatctggacgaaggagggggagcggaagaaattaaagccgcgttggctggacgcccggatatacagcgaccccctagccctgaaggagttcaaggagttcgccgcaggccgcaagtccctgacgctcaacttaattacagagatgggccggctgcccaccttcatgactcagaaaacgcgcgacgccttggacaacctagcagtcctgcacacagccgaggccggaggacgggcctacaaccacgccctcagcgagctacctgagactttagagaccctcttgctgctgaccctgctggcgacggttaccggagggatatttctgttcctgatgtccggccgcggcatcggaaagatgaccctcgggatgtgctgtatcgtgacagccagcatattgctctggtacgcgcagatccaaccacattggattgcggcctcaataattctggagttctttctcatcgtccttcttatacccgaacccgaaaagcaacggacgcctcaggacaaccaactcacctacgtggtgatcgccatcctaaccgtcgttgcagcgactatggccaatgaaatgggcttcctggagaaaactaaaaaggacctaggattgggcagcatcgccacccagcagccggagtctaacatcttagatatcgacctccgtccggcctctgcctggactttatatgcggtagccactaccttcgtcaccccaatgttgcggcacagcatcgaaaattctagcgtgaacgtctccctcaccgctatcgccaaccaggccacggtactgatggggttgggtaagggctggcccctctcgaaaatggatatcggggttcctctgcttgcgataggctgctactcccaggtgaaccccatcaccttaactgctgccctgctgctgctcgtagcacactacgcaatcatcggaccggggttacaagcaaaagccacccgggaggcgcagaagagggccgccgcgggcataatgaagaaccccacagtcgatggaatcaccgtgatcgacctcgacccgattccatacgaccccaagttcgaaaaacagctgggccaagtcatgcttctcgtgctctgtgtgacccaagtcttaatgatgcgcaccacgtgggccttatgcgaggctctgaccctggcaacgggccccatctcgacattgtgggagggcaacccagggcggttctggaacacgacgatcgcggtgtccatggccaacatcttccgtggatcttacctggccggcgccgggctcttattctccatcatgaagaacacgaccaacacgcggcgcggcaccgggaatatcggagagacccttggcgaaaaatggaagtcccgtctgaacgccctcgggaagtccgagttccagatctacaagaagtccgggatccaggaggtggaccggacacttgcgaaagagggtatcaagcgtggcgaaacagaccaccacgcggtctcccgggggagcgcaaagctgcgttggttcgtggagcggaacatggtgacccccgagggcaaggtcgtggacctcggatgtgggcgcggtgggtggtcctactactgcggcggactcaagaatgtcagggaggtgaaggggctaacgaagggcgggcccggccacgaggagcccatcccgatgagcacctacgggtggaacctcgtgcggctgcagtctggtgtggacgtcttcttcatcccgcccgagaaatgcgacactctgctctgcgacatcggcgagtcttcaccgaatccgacagttgaggctggccggaccctgcgcgtgcttaacttggtagaaaactggctgaacaacaatacacaattctgtattaaggtcttaaacccctacatgcctagcgtgatcgagaaaatggagaccctgcagcggaagtacggcggggcgctcgtccgcaaccctctgtcccggaactccacgcacgagatgtactgggtgagtaacgcctctggcaacatcgtatcttccgtcaatatgatcagccgcatgctgataaaccgtttcaccatgaggcacaaaaaggcgacgtacgagccggacgtggaccttggctcaggtacccggaacattgggatcgagagcgaaatcccaaacttggacataataggcaagcgcatcgagaaaataaagcaggaacacgagacgtcctggcattacgaccaggaccacccctacaaaacctgggcctaccacgggagctacgaaaccaagcaaaccggctccgcaagcagtatggtaaacggcgtcgtgaggctgctcacgaagccctgggatgtgctgcccaccgtcacccaaatggcgatgaccgacacgacccccttcggccagcagcgcgtgttcaaggagaaagtcgacacacgtacacaggaacccaaggagggaacgaagaagctgatgaagataacggccgagtggctatggaaggaactgggaaagaagaagacaccgcggatgtgtacgcgcgaggagttcacgcggaaagtacgcagtaacgctgccctgggggccatctttaccgacgagaacaagtggaagtccgcacgggaggccgtggaagatagccgcttctgggagctcgtcgacaaagaacgaaacctgcacctggagggcaagtgtgaaacgtgcgtgtacaatatgatgggcaaacgcgaaaagaagttgggcgagttcgggaaggccaagggctcccgagctatctggtacatgtggctgggcgcccggttcctggagtttgaggcgctcgggtttctgaacgaggaccattggttcagccgggagaactccttgagcggcgtggagggggagggcctccacaaactcgggtatatattgcgcgacgtcagcaaaaaggagggcggcgctatgtatgctgacgacaccgccgggtgggacacgcgaatcaccctggaggacttaaagaacgaggagatggtgaccaaccatatggagggagagcataaacgcctggccgaggcaatcttcaagctaacataccagaacaaagttgtccgggtgcaaaggcccacaccacggggaaccgtcatggatatcatctccaggagagaccaaaggggcagcgggcaagtgggcacttacggcttgaacacctttacgaacatggaagcgcagctcatccggcagatggagggggaaggcgtgttcaagaacattcagcacttaacagtgacagaggagattgccgtccaaaactggctagcacgcgtggggcgtgagagactcagccgtatggcgatcagcggcgacgactgcgtggttaagccgctcgacgaccgtttcgcctccgccctgactgccttaaatgacatggggaagatccgcaaggacatccagcagtgggagcctagccgggggtggaacgactggacgcaggtcccgttctgctcgcaccatttccacgagctcataatgaaggatggccgcgtgctggtcgttccctgtcggaaccaggacgaactaatagggcgggcccgaatcagccaaggtgcggggtggtccttacgtgaaacagcgtgcctgggcaagagctatgcccagatgtggagcctaatgtatttccatcggcgcgacctccggctggccgctaacgcgatctgctcggccgtgccctcccattgggtcccgaccagcaggactacctggagcatccacgccaaacacgagtggatgacaacagaggacatgctgaccgtatggaaccgggtgtggatacaggaaaatccgtggatggaggacaagaccccagtcgaatcatgggaggagatcccgtacctcggcaaacgagaggaccagtggtgcgggtccttaatcgggctgaccagcagggcaacttgggccaagaatatacaggcggccatcaatcaggtgaggtctctcattggcaatgaggaatacaccgactacatgccgtccatgaaacggttcaggcgcgaggaggaggaggctggtgtgctgtggtga

SEQ ID NO: 25152 - RNA, 9876 nt, synthetic construct
  misc_feature 1..9876: note = derived and/or modified CDS sequence (opt11) from DENV-2__FJ898452__SS-prME
  source 1..9876: mol_type = other RNA
tcggccggcatgatcatcatgctgatccccacggtgatggccttccatctcaccacccgcaatggggaaccccacatgattgtcggcattcaggaaaaagggaaatcccttctgttcaaaaccgaagacggtgtaaacatgtgtaccctcatggcgatggacctgggagagctctgcgaggatacgataacctacaaatgtcccctcctgcgtcaaaacgagcctgaggacattgactgctggtgcaacagcactagcacctgggttacctacggtacctgtacgaccaccggcgagcaccgccgggagaaacgcagcgtagcccttgttccccatgtgggcatgggcttggaaacccgcactgagacctggatgtcctctgagggggcctggaaacatgcccaacgcatcgagacgtggatcttgcggcacccgggattcaccattatggcagcgatcctggcctacactatcggtacgacccactttcagagggtcttgatatttatactgctgacggctgtcgccccgtccatgaccatgcgctgtatcggtatctcgaaccgcgacttcgtggagggtgtcagcgggggcagctgggtcgacatcgtcctcgagcacgggtcctgcgtcacgaccatggcgaaaaacaagcccaccctcgactttgagctgatcaaaactgaagcgaaacagcctgccaccctgcggaagtactgcatcgaggcaaagctgactaacacgacgaccgagagccgctgccccacacagggagagccctcgctgaaggaagaacaggacaagcggttcgtgtgcaagcattcgatggttgaccgcggctgggggaacggctgtgggttgttcggcaagggcgggattgtgacgtgcgcaatgttcacgtgtaagaaaaacatggaggggaagatcgtgcagccagagaacttagaatatacgatagtggttacgccccactccggtgaggagcatgcagtgggaaacgacaccgggaagcatggcaaggaaatcaaggtgacgccgcagagcagcattacggaggccgaactgacgggttacggcacggtcacgatggagtgctctcctcggaccggcttggacttcaacgagatggtcctgctgcagatggagaacaaagcctggctcgtgcatcggcagtggtttctggacctgcccttaccctggttaccgggggcggacaagcaggagtccaattggatccagaaggagaccctggtcaccttcaaaaaccctcacgccaagaaacaggacgtggtggtgctcggaagccaggagggggcgatgcacacggctctgacgggagccacggagatccaaatgagcagcggcaacctcctgtttaccgggcacctgaagtgccggttgcggatggacaagctccagctgaaggggatgagctactccatgtgcaccggtaaatttaaggtggtcaaggagatcgcagagacccagcacggcaccatcgtaatccgggtgcaatacgagggggatgggagtccctgcaagattcccttcgagatcatggatctggagaagcgttacgttctgggccggctcatcaccgtgaacccgatcgtgacggaaaaagactcccccgtcaacatagaggccgagccgcccttcggggattcgtacatcatcataggcgttgagccgggacagctgaagttaaattggtttaagaagggatcctccatcgggcagatgttcgagaccaccatgcgcggcgcgaagcgcatggccatccttggagataccgcctgggattttgggtccctaggcggggtgttcacttcaatcggcaaggctctccaccaggtgttcggtgccatttacggcgcggccttttccggtgtgtcgtggaccatgaagatcttaatcggggtaatcatcacctggatcggcatgaactcccggtcgacaagtctctccgtatctttggtgctcgtggggatcgtcacgctgtacctgggtgtgatggtgcaggccgatagcggatgcgtagtgtcgtggaagaacaaagagctcaagtgcggcagcggaatattcataaccgacaacgttcatacctggactgagcagtacaaattccaacccgaaagtcctagtaagctggccagcgcaattcagaaagctcaagaggaggggatctgcggcatcagatcagtcacacggctggaaaacttgatgtggaagcagatcacacccgagctgaaccatatcctggcggaaaacgaggtgaagctaaccattatgacaggggacatcaaaggaatcatgcaggccgggaagcgctcgttgcgccctcagcctacggaactcaagtactcctggaagacctggggcaaggccaaaatgctctcgacggagtcctacaatcagaccttcctgatagatggccccgagaccgcggaatgcccgaacaccaaccgagcatggaactccctggaggtggaggactacgggttcggcgtcttcaccacgaacatctggctcaagttgaaggagaagcaggacgccttctgcgattccaagctgatgagcgccgccataaaagacaaccgagctgttcacgccgacatgggttactggatagagtccgcgctcaacgacacgtggaaaatcgaaaaggccagttttatcgaggtgaagaactgtcattggcccaagtcccacaccctttggagcaatggagtcctggagagcgagatgattatccccaagaacctcgcaggccccgtaagccagcataattatcggcccgggtaccacacccaaatcgcgggcccctggcacctggggaaacttgaaatggacttcgatttctgcgacggtaccaccgttatcgtcacggaggactgcgggaatagaggcccttccttaaggacaactaccgccagcgggaaactgatcactgagtggtgctgtcggtcctgcaccttaccgccgctccgctaccgcggcgaagatggctgctggtacgggatggaaatcaggcccctcaaggagaaggaagagaacctggtgaactccctggtgaccgccggccacggccaggtcgacaacttctcactgggggttctgggcatggccctgttcttggaagagatgctgcgaacgcgggtgggcaccaagcacgcgatcctcctcgtcgccgtgtccttcgtaacgcttatcaccggcaacatgagcttcaaggacctaggacgggtggtggtgatggtcggtgccaccatggccgatgacatcgggatgggcgttacgtatttagccctgttggcggccttcaaggtgcggcctacctttgccgccggcctgctattgcggaagctgacctccaaggagttgatgatgaccacgatcgggatcgtgctgctgagccagtccacaattcctgagaccgtgctggagctcactgacgccttggcgcttggcatgatggtgcttaagatcgtcagaaacatggagaagtaccaattggctgttacgatcatggcaatcctgtgcgtcccgaacgccgttatattacagaacgcttggaaggtaagttgcaccatccttgcggtcgtttccgtctcaccactgctcctaacgagtagccaacaaaagacggactggatcccccttgcactcacaatcaaagggctgaaccctacagcaatattcctgacgacgctatcccgcacgaacaagaagcgaagctggcctctaaacgaggccatcatggcggtcggcatggtgtccatattagcctcgtccctcctaaagaacgacataccgatgacaggtcccctggttgctgggggcttgttaaccgtttgctacgtgctgacaggaaggtctgccgaccttgaattagagagagccaccgacgtgaagtgggaggaccaggctgagatatcgggttccagccccatcctgtccattaccataagcgaggacggatctatgagcatcaaaaacgaagaagaggagcagaccctaacaatcctgatcagaaccgggctcctggttataagtggactgttcccgatcagcatccccatcaccgccgccgcctggtacctgtgggaggtgaagaagcaacgggcaggggtactctgggatgtccccagccctccgcccatgggaaaggcggaactggaggacggggcctacaggattaaacaaaagggcatactgggatacagtcagatcggtgccggcgtctacaaggaggggaccttccacaccatgtggcacgtgactcgcggcgccgtcctaatgcacaaaggcaagcggatcgagccctcctgggcagatgtgaagaaggacctgatcagctatggcgggggctggaaacttgagggcgagtggaaggagggggaagaggtgcaggtcttggcgctggagccgggaaagaatccccgggcagtacagacgaaacccgggctgttcaagaccaacacaggaacgatcggggccgtttcactcgacttttcaccgggcacgagcggctcacccattattgataagaaggggaaggtcgtggggctgtacgggaacggtgttgtcacacgcagcggggcttacgtgagcgcgatagcccagaccgaaaagagtatcgaggacaaccccgaaatcgaagacgatattttccggaagcgtcggctgaccatcatggacctgcaccccggggccgggaagacaaaacgctacctacccgccatcgtgagggaagccatcaaacgcgggctgaggactctgatcctcgcgcccaccagggtcgtggccgccgagatggaggaggcccttcggggattacccatcagataccagaccccggccatccgcgcggagcacactggacgcgagatcgtggacttgatgtgccacgccacgtttaccatgcgcctgctgtcacccgtccgggtgccaaactacaacttgataatcatggacgaagcgcatttcaccgaccccgcctccatcgcagcgcgcggctacatcagcacgcgggtggagatgggcgaggccgccgggattttcatgaccgccacgccaccaggcagccgagacccattcccgcagtccaatgctccgattatcgatgaggagcgcgagataccagagagaagctggaactccgggcatgagtgggtaactgatttcaagggaaaaacggtgtggttcgtgcccagcataaaggcggggaatgatattgctgcctgtctgcgcaagaacggaaagaaagtcatccagctgagccgcaaaacgtttgatagcgagtacgtgaagacccgtaccaacgattgggattttgtggtcacgaccgatatctccgagatgggcgccaacttcaaggcggagcgcgtaatcgacccccggcgctgcatgaagccagtaatactcactgacggggaagaacgggtaattctggccggccccatgccggtgacccacagctcagctgctcagcgtcgggggcgcatagggcggaaccccaagaatgaaaacgaccaatacatctacatgggtgagccactggagaacgacgaggattgcgcccactggaaggaggcgaagatgttactggacaatatcaacactcccgaggggataataccgagcatgtttgagcctgagagagagaaggtggacgcaatcgacggcgagtatcggttgcgcggggaagctaggaagaccttcgtggacttgatgcggcgtggcgatcttcccgtgtggctggcctacaaggttgccgcggagggaatcaactatgccgaccggcgctggtgttttgacggtatcaagaacaaccagatcctcgaggagaacgtcgaggtggagatatggaccaaagaaggggagcggaagaaactgaagcctcgctggctggacgccaggatatacagtgacccccttgccttgaaggagttcaaggagttcgccgcaggccgcaagtctctgactctcaacctgataactgagatgggccggctgcccaccttcatgacccagaagacgagggacgctttagacaacctggccgtcctgcatacggctgaggccggcgggcgtgcctacaatcacgctctctccgaactgcccgagaccctggagaccctcctgttgctcacgctgctggccacggtgacagggggcatctttctgttcttgatgagcggtcgtgggatcggcaagatgaccctgggtatgtgctgcatcatcaccgcctcgatcctcctgtggtacgcgcagatccagccccattggatcgctgccagtatcatcctcgagttcttcctcatcgtgctgctaatcccagagcccgagaagcagcgaacacctcaggacaaccagttaacgtacgttgtgatcgccatcctgaccgtggtcgccgcgactatggccaatgaaatgggcttcctcgagaagaccaagaaagacttagggctaggctccatagccacgcagcaacccgaaagcaacatcctggatatcgacctcagacctgccagtgcctggaccctctacgcggtggcgacgactttcgtgacccctatgctgcggcatagtatcgagaatagttccgtcaatgtgagcttaaccgcgatcgccaatcaggccacggtactaatgggcctggggaaaggctggcccttatccaagatggacatcggtgtaccgctgctggcgatagggtgctatagccaggtgaacccaataaccttgacggccgccctgctgttactggttgcccactatgcaatcatcggcccgggactgcaggccaaggccacacgcgaggcccagaaacgggccgccgccggcatcatgaagaaccccaccgtcgatgggattaccgtgatagacctcgacccgatcccctacgacccaaagttcgagaagcagctgggccaagttatgttactcattctgtgcgtcactcaggtgctgatgatgaggactacctgggccttatgcgaggccttaacccttgccacggggcccatctccacactctgggagggcaacccggggcggttctggaatacaaccatcgccgtaagcatggccaatatatttcgcggctcctacctggccggtgcgggtttattgttctcaatcatgaagaacacgacaaatacccgtaggggcactggtaatatcggcgagacacttggagaaaaatggaagtcccgcctgaacgccttaggcaagtccgagttccaaatctacaagaaaagcggcatccaggaggtcgatcggacactggctaaagaagggatcaagcgcggcgagacagaccaccatgccgtgagccggggcagcgccaagctgcgttggttcgtcgagcgtaacatggtcacccccgaaggaaaagtagtggacctcggctgtgggcgcggagggtggtcctactactgtggagggttgaagaacgttagggaagtgaaaggcctaacgaagggagggcccggccacgaggagcccatacccatgtccacctacgggtggaacttggtaaggctacagagcggcgtcgacgtgttctttatcccgccagagaagtgcgatacgttactctgtgatatcggggagtccagtcccaaccccaccgtggaggctggccggacgctgcgcgtcctgaatctcgtggaaaactggcttaataacaacacccaattctgcatcaaagtgcttaacccctacatgcccagtgtcatcgagaagatggaggcactgcagaggaagtatggaggggctctcgttcggaacccactgtctcggaacagcacccacgagatgtactgggtgagtaacgctagcggcaacatcgtctccagtgtgaatatgatctcccgaatgctcatcaaccggtttaccatgcgccacaagaaagccacctacgagcccgacgtggatctcgggtctggcactcggaacatcgggatcgagtcggaaatccccaacctcgatatcatcggcaagcgcatcgagaaaatcaagcaggagcatgagaccagttggcactacgatcaggaccacccctacaaaacgtgggcctaccacggctcctacgagaccaagcagactggcagcgcctcctctatggtcaacggagtggtacggctcctaactaagccgtgggatgttctgcccacagtgacccagatggccatgacggacacgacccccttcggacagcagcgggtattcaaggagaaggtcgacacgcgcacgcaggagcccaaggagggcaccaagaagctgatgaagatcaccgccgagtggctctggaaggaactgggcaagaagaaaaccccgcggatgtgcacgcgcgaggagttcacccggaaggtgcgatccaacgccgccctgggggccatctttacggacgagaacaagtggaagtctgcccgggaggcagtcgaagactcacgattttgggagttggtcgacaaagagcggaatctgcacctggagggcaagtgtgagacctgcgtgtacaacatgatgggcaagcgcgaaaagaagctcggggagttcggaaaggccaaaggcagccgggccatctggtacatgtggcttggagcgcgcttcctggagttcgaggccctcggcttcctgaatgaggaccattggttcagtcgggagaatagtctgtcgggggtagaaggcgaaggcctccacaagctggggtacatactgagagacgtaagcaagaaggagggaggcgccatgtacgccgatgacacggcgggttgggacacccggatcactttggaggacctgaagaacgaagagatggtaaccaatcacatggaaggagagcataaaaagctggcggaggcaatcttcaaactcacttaccaaaacaaggtcgtgcgcgtccaacggcccacaccccggggtaccgtcatggatatcataagccgccgcgaccagcgcggctccggccaggtggggacatacggactgaacacgttcactaacatggaggcccaattaatccgtcagatggagggggagggggtgtttaagaacatacaacatctcaccgtcaccgaggaggtggcagtacagaactggctggcgcgggtcggacgcgagcgcctgagccggatggctatctccggcgacgattgcgtggtcaagccactcgacgacagattcgccaacgccctgacagccctgaatgacatgggtaagatccggaaagatatccaacagtgggaaccgagcaaagggtggaacgactggacccaggtacccttctgctcccaccacttccacgaactcatcatgaaggacggacgcgtgctggttgttccctgccggaatcaggatgagctgatcgggcgcgcgcgtataagccagggagccggttggtccctccgcgagacagcctgcctcggcaagagctatgcccagatgtggagcctgatgtatttccaccggcgcgacctccggctagccgcaaacgccatctgctcagctgtgccctcacactgggtgcctacaagccgcacaacttggagtatccacgcaaagcacgagtggatgactacagaggacatgctgactgtctggaaccgggtgtggatccgcgaaaatccctggatggaagacaaaactcccgtggagtcatgggaggagatcccatacttgggcaagcgggaagatcagtggtgcgggtccctgatagggctgacctctcgcgccacctgggcgaagaacatccaagccgccattaaccaggtgcgatcgctcatagggaacgaggagtacaccgattacatgccgagcatgaagcgctttcggagagaggaggaagaggcgggtgtgctgtggtga

SEQ ID NO: 25153 - RNA, 9876 nt, synthetic construct
  misc_feature 1..9876: note = derived and/or modified CDS sequence (opt11) from DENV-2__GQ868591__SS-prME
  source 1..9876: mol_type = other RNA
agtgcaggcatgatcattatgctaatccccacggttatggcattccacctgaccacccgtaacggggaaccccacatgatagtaagccgtcaagaaaaaggcaaaagccttctcttcaaaacggaagacggcgtcaatatgtgcaccctaatggccatggatctaggcgaactgtgcgaagacacaatcacgtacaaatgcccactactacgccaaaacgaacctgaagacatcgactgctggtgcaactctactagcacgtgggtaacatatggcacgtgcaccacgatgggagaacaccggcgagagaaaagaagtgtcgcactcgtcccacacgtaggcatgggcctagaaacgaggacagaaacgtggatgagcagtgaaggggcgtggaaacacgtccaaagaatcgagacgtggatattaagacaccccggatttacaatgatggcagcaatattagcctatacaataggtacaacgcacttccagcgggccctgatcttcatccttcttaccgcggtcacgcccagcatgacaatgcgttgtataggaatgtccaaccgcgatttcgtagagggagtgtctggcggctcctgggtagatatcgttctcgagcatgggtcatgcgtcaccacgatggccaaaaacaaaccgaccctcgacttcgaactgatcaaaaccgaggcaaaacaaccggccacgcttaggaaatactgcatcgaagcaaaacttacaaacaccaccacagagtcgaggtgcccaacacaaggcgaaccaagcctaaacgaagaacaagacaaaagattcgtatgtaagcatagtatggtagaccgcggatggggcaacggctgcggattgttcggcaaaggagggattgtcacctgtgccatgttccgatgtaaaaagaatatggaaggtaaagtcgtccaaccggaaaacctggaatacaccatcgttatcacgccacattccggggaagaacatgccgtaggaaacgacactggtaagcacgggaaggaaataaaaatcacaccccaatcgagtatcaccgaggcggaacttaccgggtatggcaccgtaacgatggagtgcagcccccgaacgggcctggacttcaacgagatggtattgctacaaatggaaaataaggcatggctagtgcaccgacaatggttcctcgacctacccctaccatggctgcctggagcagacacccaaggcagcaactggatacaaaaagagacactcgtcacctttaagaacccgcacgcgaagaaacaggacgttgtagtattaggttcccaagagggagcaatgcacaccgcactgactggcgcgacagagatacagatgagtagtggcaacctgctgtttaccggtcacctcaaatgccgcctccgaatggacaaactacaactcaaaggcatgtcgtacagcatgtgcacaggtaagttcaaggtagtgaaggaaatcgctgaaactcaacacggaaccatagttatccgggtacaatacgaaggagacggcagcccgtgtaagattcccttcgagatcatggacctagaaaagcgtcacgtgctgggcagattaataaccgtcaatccgatcgtaactgaaaaggatagcccggtgaacatagaggcggaacccccattcggagacagctacatcatcataggcgttgagcccggccagctaaaactcaattggttcaaaaagggatcgtcaataggacagatgtttgaaacaacgatgcgtggcgccaaacgaatggcaatcctcggcgacacagcttgggactttggcagcctgggtggagtgttcacaagcatcggcaaagcactgcatcaggtgtttggcgcgatctacggagccgctttttcgggcgtctcgtggacaatgaagatattaataggcgttataatcacgtggataggaatgaactcgcggagtaccagtttaagcgtcacacttgtactggtgggaatcgtgacactgtacttgggagtgatggtccaggccgactccggatgcgtcgtgtcctggaaaaacaaggaattaaaatgcggctccggtatcttcataacggacaacgtccacacatggacagaacagtacaaattccaaccagaaagccccagcaaactcgcatcagcaatccaaaaagcccacgaagaaggcatctgcgggatcagatccgtgactcggctagagaacctgatgtggaagcagattacgccggaattgaatcacatactaagtgaaaacgaagtcaaactcaccataatgacaggcgatatcaaaggcatcatgcaagccggaaagcgaagcctacggccacagcccacggagctcaaatacagctggaaaacatggggaaaagccaagatgctgagcacagagtctcacaaccaaacgtttttaatagacggaccggagactgcagagtgccctaataccaatcgggcctggaacagcctcgaggtcgaggattacggattcggagtattcacaacaaacatctggctaaagctaaaagaaaagcaggacgtcttttgcgacagcaaactaatgagcgcagccatcaaggacaacagggcggtccacgcggacatgggctactggatcgaatcagcattaaacgacacctggaagatagagaaggcatcattcatagaggtgaaaaactgccactggcccaaaagccacacgctatggtccaatggtgtgctcgaatcagaaatgatcatccccaaaaacctggcaggtccagtgagccagcacaactaccgaccgggctaccacacccaaataaccgggccctggcacctgggaaagctagagatggacttcgacttctgcgacggaacgacggtggtcgtgacagaagattgcggaaaccgagggcccagcttgcggacgaccactgcttcaggcaagttaattacggaatggtgttgccgcagctgcactttacccccattgagatatagaggcgaggatggctgctggtacggcatggaaataagacccttaaaagagaaagaggagaacctagtaaactcactcgttaccgccggacacggacaagtggacaatttcagtctcggagtcctcgggatggcactctttctggaggagatgttgcggaccagagtaggaaccaagcacgcaatactcctcgtagccgtcagctttgtaaccctcatcacgggcaatatgagcttccgcgatctagggcgtgtcatggtgatggtgggagcaacgatgaccgacgatataggcatgggagtaacgtacctcgcgctcctggccgcatttaaggtacgaccaacttttgccgcgggtcttctactcagaaaactcacttcaaaggaactgatgatgacaacaatcggaatcgtactactttcacagtccacgattcccgaaaccattctagaactaacagacgctcttgcactcggaatgatggtgttgaaaatggtacggaacatggagaagtaccaactagcagtaacgataatggccatactatgtgttccaaacgccgtcatcctacaaaatgcgtggaaagtgagctgtacaatcttagccgtggtaagtgtgagcccactattactcaccagcagccaacagaaaaccgattggatcccccttgcgttaacgataaaggggctaaaccccacggccatcttcctaaccaccctctcccggacgagtaagaaacgtagctggcccctaaacgaagccatcatggcagtggggatggtttcaatattagcctccagtctcctcaaaaacgatatcccaatgacggggcctttagttgctggcggcctccttacagtatgttatgtgctaaccgggcggtcggcggatctagagttggagcgagcagctgatgttaaatgggaagaccaagccgaaatatctggctcaagccctatcctttcaatcaccatatccgaagatggctccatgtcgatcaaaaacgaagaggaggaacaaaccctgactattctcatccggacagggctacttgtcatctccgggctgttcccagtgtcaatcccaatcacggctgccgcctggtatttatgggaagtcaagaaacagcgcgccggagtgctgtgggacgttccttcaccgccgccgatgggaaaagcagaactcgaagatggggcttacaggatcaagcaaaaaggtatactcggatactcccaaattggagcgggggtctataaggaaggcacattccacacaatgtggcacgtaacacgcggcgcggtgttaatgcacaaggggaagcggatagagccctcatgggctgacgttaaaaaggacctaattagttacgggggcggctggaaacttgagggtgaatggaaggaaggcgaagaagttcaagttcttgcactggaacccggcaaaaacccgcgagcagtacaaaccaagccaggactgttcaaaacaaacgcaggtacaatcggcgccgtatccttagacttctcacctgggaccagcggatcacccatcatcgacaagaaaggaaaagtggtaggactctacggaaatggcgtcgttacgaggagcggagcatacgtgagcgcgatagcacaaaccgaaaaatccatcgaggacaatccggaaatagaagacgatatcttcagaaaacgacggctaacgataatggacttacatccgggggccggaaaaacaaagagatacttaccagcgatcgtgcgcgaagccataaagagggggttacgaacactaatccttgcgccaacacgcgttgtagccgccgaaatggaagaggcactaaggggcctaccaataaggtaccagacgcctgccatacgggccgaacacacaggcagagaaatcgtggacctcatgtgtcacgcaactttcaccatgcggcttctaagtcccgttagagtaccaaactataacctcataataatggacgaggcgcatttcacggatcctgcgagtatcgccgcgagagggtatatatcaacacgagttgaaatgggcgaagcagccggcatattcatgaccgccacaccaccaggttcccgggacccatttcctcagagcaacgcaccgataatagatgaggaacgcgaaataccggaacggtcctggaactctgggcacgaatgggtgactgactttaagggtaaaaccgtatggttcgttccgagtatcaaagcgggcaacgacatagcggcatgtctacgtaagaacggaaagaaagtcatacaactaagtcgaaagacattcgatagcgagtacgtcaagacccgaacgaacgactgggactttgttgtaaccacggacataagcgagatgggagctaacttcaaagcggaacgagttatcgacccccgaaggtgcatgaaacctgtcatcttaacagatggggaggaacgtgtcatcctggccggacctatgccagtgacccatagcagcgcagcacagcgcaggggcagaatcggccgcaatccgaagaatgaaaatgatcagtacatctacatgggagagccactcgaaaacgacgaggactgcgcgcactggaaagaagcaaagatgctgctagacaatataaacacgccagaagggataataccgtccatgtttgaaccagagcgagaaaaggtcgatgcaatcgacggcgagtacaggctccgcggtgaggcacgtaagacgttcgtcgaccttatgcggcgcggagatttgcccgtatggctagcgtaccgcgtagccgctgaaggaatcaactacgcggaccgccgatggtgcttcgacggagtcaaaaataatcaaatcctagaagaaaatgtcgaagtcgagatctggactaaggaaggagagcggaagaaactcaagccgagatggttagacgcccgcatctactcagacccgctagcattaaaggagttcaaagagttcgctgcaggacgaaaatcgctcacattgaacctgatcacggaaatggggagactcccgacgttcatgacacaaaaagcccgggatgcgctggacaatctggccgtcctacacacagcagaagcgggcggacgagcctataatcacgcactctccgaactgccggagacattagaaaccctactgttgttaaccctactagctacagttacagggggcatctttttgtttttaatgagcgggagaggaatcggaaagatgacactaggtatgtgctgcatcatcacggcttccatcctactatggtacgcgcaaatccaaccacactggattgcagcaagcataattctcgagttcttcttgatcgtcctgctaatcccagaacccgaaaagcagcgcacgccccaagacaatcaactcacatacgttgtaatcgcaattctcaccgtagtggccgccacaatggctaacgaaatggggttcctagagaaaactaagaaggacttgggcttaggcagcatcgcaactcaacaacccgagtctaacatccttgacatcgacctacggccagccagcgcctggaccctgtatgccgtagcgactacattcgtcacaccgatgctgcggcacagcatcgaaaatagctcggtaaatgtctcgttgaccgcaatcgcgaatcaagccactgtattaatgggcctggggaaaggatggccactctcaaagatggatatcggcgtcccccttctggcaataggatgttacagccaggtcaatccaataacgctaacagcggcccttttcttgctcgtcgcccactacgcaattatagggcctggactacaagccaaagctacgcgggaagcgcaaaaacgagcagctgccggaatcatgaagaacccgacagtagacgggataactgtaatcgacctcgacccgataccttatgaccccaagttcgaaaaacaactcggccaggttatgctgctggtactatgcgtcacccaggtgctaatgatgaggacaacgtgggccctctgcgaggcccttacactcgccacagggccaatcagtaccctatgggaaggaaaccctggaaggttctggaataccaccatcgcggtctcaatggccaacatattccgtgggtcatatctagccggtgcaggcctccttttcagtataatgaaaaacacaacgaacacacgccggggaaccggaaacatcggagaaactcttggtgaaaagtggaaatcccgattaaacgcactaggaaaaagcgagttccaaatatacaagaaatccggtatacaggaagtagaccgaacactggccaaggaaggaataaaacgtggcgagaccgatcaccacgcggtatccagggggtccgcaaaactcagatggttcgtcgagcggaacatggtcacccccgaagggaaagttgtcgaccttggatgcggtcggggtggttggtcgtactactgtggcggccttaaaaacgtacgcgaagtgaaaggtctaaccaaaggaggcccgggacatgaagaaccaatccccatgagtacctacggctggaacctcgtgcgcctccagtcgggggtggacgtcttctttatacccccagaaaagtgcgacacgttgctctgtgatatcggagaatcgagccccaaccccacagtagaagcaggtcgcacgctccgtgtgctcaacctagtagagaactggctcaacaataacacacagttttgcatcaaggtcctcaacccttatatgccatcagtaatcgagaaaatggaggcactgcaacgaaagtacgggggagccctcgtgcgaaaccccctttcacgcaacagcacccatgaaatgtactgggtttcaaatgcctccggaaacatcgtgtcatctgtcaacatgatatcacgcatgctgataaaccgtttcacaatgcgttataagaaggccacctatgaaccggacgtagaccttggaagcggaacccggaatataggtatcgagagtgagatcccaaacttggatatcataggtaagcgaatcgagaagatcaaacaggaacacgaaacctcgtggcactacgaccaagaccacccctacaagacgtgggcctaccacggctcgtatgagacaaaacagacgggaagcgccagcagcatggtaaatggggtggtccgactattaaccaaaccctgggacgtagtgccaatggttacacagatggcgatgacagacacaacaccgttcggacaacagagagtgttcaaagagaaagtcgacacgagaacacaagagcctaaagaaggaactaagaaactcatgaagataaccgcagagtggctgtggaaggaactagggaaaaagaagacgccaagaatgtgtacaagagaagagttcacgcggaaggttcgaagcaacgccgccttgggagccatattcgccgatgaaaacaaatggaagtccgcgcgtgaggcggtcgaagattccagattctgggagttagtagataaggagcgaaacctacatctagagggcaaatgcgaaacttgcgtttacaacatgatggggaagcgcgagaagaaactaggggaatttgggaaagccaaaggcagccgagcaatctggtacatgtggcttggggcgagattcctagagttcgaagcactcggatttctaaatgaagatcattggttctcgagagagaactcactctcaggggtggaaggcgagggattacacaaattaggatatatcctccgcgacgtcagcaagaaagagggcggcgccatgtatgccgatgacacagcaggatgggatacacgaataaccttagaagacctcaaaaatgaggaaatggttacgaaccatatggaaggagagcacaagaaactcgcggaagcgatatttaaattgacctaccagaacaaagtcgtccgggtccaaagaccgacaccacggggaactgtaatggacataatcagccgccgcgatcagcgtggttcgggccaagtcggcacctacggactaaatacatttactaacatggaagcccaactcatacgacaaatggagggcgaaggcgtattcaagtcaatacaacatttaacaatcacggaagagatcgcagtccaaaactggctcgcccgcgtcggtagggaacgactaagccgcatggcaatttccggagatgactgtgtagtaaagccgctagatgaccggttcgccagcgcactgacggcattaaatgatatgggcaaaatacgaaaggacatacaacaatgggaaccatctagaggatggaacgactggacacaagtaccattctgcagccaccacttccacgaactcatcatgaaggacggaagggtactcgttgtgccctgtcggaaccaagacgaactcattggccgagcacggataagtcagggtgcgggctggagtctgcgtgaaaccgcgtgcctaggcaagagctacgcacaaatgtggagcctcatgtactttcacaggcgggacctacgactggccgcgaacgcaatatgcagcgccgtcccatcgcactgggtcccaacgagccgcacaacgtggtcaatccacgctaaacacgaatggatgacaacagaggatatgctcacagtatggaaccgagtttggatccaagaaaacccctggatggaggacaaaacacccgtagaatcttgggaggagatcccttacctaggcaagagagaagatcagtggtgcgggtcactgatcggcctgacgagtagagcaacttgggccaagaacatacaggccgcgatcaaccaggtacgaagtctgataggtaacgaagaatacacggactacatgccatcgatgaagcggttcagaagagaagaagaggaggcgggagtcctctggtga

SEQ ID NO: 25154 - RNA, 9876 nt, synthetic construct
  misc_feature 1..9876: note = derived and/or modified CDS sequence (opt11) from DENV-2__GQ868542__SS-prME
  source 1..9876: mol_type = other RNA
agcgcgggcatgatcatcatgctgatccccaccgtgatggcgttccacctcaccaccagaaacggggagccccatatgattgtcagcatccaggagaagggcaagagcctgctgttcaagacagaggacggggtgaacatgtgcaccctcatggcaatggacctgggcgagctgtgtgaggacacgatcacctacaagtgcccactcttgcggcagaacgagcccgaagacatcgactgctggtgcaactcaaccagcacctgggttacctatggtacgtgcacaaccaccggggagcaccgccgagagaagcgctccgtcgcgctggtgccccacgtgggcatggggctcgagacgcgcactgagacctggatgagcagcgagggcgcgtggaagcacgcccagcgcatcgaaacctggatactgcggcaccctgggttcactatcatggctgcgatcctggcctacaccatcggcaccactcactttcagcgcgccctcatcttcatcctcttaacggccgtcgcgcccagcatgaccatgcgttgcatcggtatctctaaccgcgacttcgtggagggcgtgtcaggcgggtcctgggtcgacatcgtgctcgaacacggttcatgcgtcaccaccatggctaaaaataaacccacgctagacttcgagctgatcaagaccgaggccaaacagcccgccacactacggaagtattgcatcgaggccaagctcaccaatacaaccaccgagtcccgctgcccaacgcagggggagcccagcctgaaagaggagcaggacaagcggttcgtctgcaagcactccatggtcgatcgcggctggggtaacgggtgcggcttattcggaaaaggcgggatcgtaacgtgcgcgatgttcacgtgcaagaaaaacatggagggcaagatcgtccagcccgagaacctagagtacaccatcgtggtgacgccccacagcggcgaggagcacgccgtcgggaatgacacggggaagcacgggaaggagatcaaggtgaccccgcaatccagcatcactgaggccgaactgaccggctacgggaccgtgacgatggagtgcagcccccggaccggcttagacttcaacgagatggtcctgctgcagatggagaacaaggcctggctcgttcaccgacagtggttcctagacctgcctctcccctggctgccgggcgccgacacccaggggagcaactggatccaaaaggagaccctggtaacgttcaagaacccccatgcgaagaagcaagacgttgtggtcttggggagccaggagggggccatgcacacagccctgaccggcgccactgagatccagatgtcctctgggaacctcctattcacgggacacctgaagtgccggctgcgaatggacaagctccagctgaagggaatgtcctatagcatgtgcaccgggaagttcaaggtggtgaaggagatcgccgagacccaacacggcaccatcgtcatccgggtgcagtacgagggggacggctcgccctgcaagatccccttcgagatcatggacctggagaagcggtacgttctgggccggctgataacggtcaacccgatcgtgaccgagaaggacagcccggtgaacatcgaggcggagccgcccttcggagattcctacatcatcatcggcgtcgagcctgggcagctgaagctcaactggttcaagaagggcagctccatcgggcaaatgttcgagactacgatgcgcggcgccaagaggatggcaatcctgggcgacacagcctgggacttcgggagcctgggcggggtgttcaccagtatcggcaaggccctccaccaggtgttcggggcgatctacggcgccgccttcagcggagtctcgtggacaatgaagatactgatcggcgtgatcatcacctggatcggcatgaacagcagatccacgagcctctccgtgagcctggtcctcgtaggaatcgtgaccctgtacctgggcgtcatggtccaggccgactccgggtgcgtggtcagctggaagaacaaggagttaaagtgcggcagcggcatcttcatcaccgacaacgtgcacacatggacggagcagtataagttccagcccgagtcgcccagcaaactggcgtcagcaatccagaaagcccaggaggaggggatctgcgggatacgcagcgtgacccggctagaaaacctcatgtggaagcagatcacccccgagctgaaccatatcctggccgagaacgaggtcaagctcactatcatgacgggggacatcaagggcataatgcaggctgggaagcgctccctgcggccgcagcccaccgagctgaagtacagctggaagacctggggcaaagcgaagatgctctccaccgagtcccacaaccagacgttcctgatcgatggacccgagacggccgagtgccccaacaccaaccgcgcctggaactccctggaagtggaggactacgggttcggcgtgttcacgacgaacatatggcttaagctgaaggagaagcaggacgccttctgcgacagcaagctgatgtccgctgcgatcaaggacaaccgggccgtccacgccgacatggggtactggatcgagagcgcattgaacgacacctggaagatcgagaaggcctccttcatcgaggtgaagaattgccactggcccaagagccacaccctatggtccaacggcgtgctggagagcgagatgatcatccccaaaaacctggcgggccccgtctcccagcacaactaccgtccgggataccacacccagatcgccggcccctggcacctggggaagcttgagatggacttcgacttctgcgacggcaccacggtggtggtaaccgaggactgcgggaaccggggtccgagcctgcgcaccaccacggctagcggcaaactaataacagagtggtgctgccggtcctgcaccctgcccccgctccgctaccgcggtgaagacggctgctggtacgggatggagatccgccccttgaaggagaaggaggaaaacctggtgaacagcctcgtgaccgccggccacggtcaggtcgacaacttctcactgggcgtgctgggcatggccttgttcctggaagagatgctgcggacgcgcgtggggaccaagcacgccatcctcctggtcgccgtgagcttcgtgaccctgatcaccggcaacatgtccttcaaggacctcgggagggtagtggtgatggtcggcgcgacgatgaccgatgacatcggaatgggcgtgacctacctggccctactcgcggccttcaaggtgcgccccacgttcgctgccggccttctgctccggaagctgacgtccaaagagctgatgatgaccaccatcgggatcgtcctgttatcacagagcaccatccctgagacgatactggagctcaccgacgccctggccctgggaatgatggtgctcaagatcgtacgcaacatggagaagtaccagctggccgtcactataatggccatcctgtgcgtgcctaacgctgtcatcctccagaacgcctggaaggtcagttgcaccatcctggcagtggtcagcgtgagccctctcctcctgacgagctcccagcagaagaccgactggatcccccttgccctcaccattaagggtctgaaccccacagccatcttcctgacgactttgagccgaaccaataagaagcggtcctggccgctgaacgaggccatcatggcggtgggcatggtctcgatcctggcctccagcctcctgaagaacgacatccccatgaccgggcccctggtggccgggggcctcctgacggtgtgctacgtcctcaccgggcgctccgccgacctcgagctggagcgggccacagacgtgaagtgggaagatcaggcggagatctcggggagctcccccatcctgagtatcacgatctccgaggacggctcaatgtccatcaagaacgaggaggaggagcagacgctcaccatcctaatccgcacaggcttgctcgtgatctctggcctgtttccggtctccatccccattaccgccgcagcctggtatttatgggaggtgaagaagcagcgggccggggtgctctgggacgtcccctccccgccgcccatgggcaaggcggagctggaggacggggcctaccgcatcaagcagaagggcatcctggggtacagccagattggcgccggagtgtataaggaggggaccttccacacgatgtggcacgtgacccggggcgccgtcctcatgcacaagggcaagcgcatcgagccaagctgggctgacgtgaagaaggacctgatctcctacggcgggggctggaagctggagggcgagtggaaggagggggaggaggtgcaggtactcgcgctggagccaggcaagaacccccgggccgtgcagaccaagcccggactttttaagaccaacacgggaaccatcggtgccgtgagcctcgacttctctcccggcactagcggctcccccatcatcgacaagaaagggaaggtcgtgggcctgtacgggaacggcgtggtcacccgcagcggcgcctacgtatccgccatcgcgcaaacggagaagtccatcgaggacaaccccgagatcgaggatgatatcttccggaagcgccgcctgaccatcatggacctgcaccccggggccggcaagaccaaacggtacctccccgccatcgttcgagaggccatcaagcgcgggctccggacactgatcctcgcgccaacgcgcgtcgtggccgcggagatggaggaggccctgcgggggctgcccatccgctatcagacccccgccatccgggcagagcacacggggcgcgagatcgtggacctcatgtgtcacgccaccttcacgatgcgcttgctgtcccccgtccgggtgccgaactacaacctaatcatcatggacgaggctcactttaccgaccctgccagcattgccgcgcgcggctacattagcacccgggtggagatgggcgaggctgccggtatatttatgaccgccaccccgcccggctcccgcgacccgttcccccagagcaacgcccccatcatcgacgaggagagagagatccccgagcgctcctggaatagcgggcacgagtgggtcactgacttcaagggcaagaccgtgtggttcgtgccgtccatcaaggcgggaaacgacatcgctgcctgtctacggaaaaacggcaagaaggtcattcagctgagccgcaaaaccttcgactccgagtacgtgaagacgcggaccaacgactgggacttcgtcgtcaccaccgacatcagcgaaatgggcgccaacttcaaggcggagcgcgtgatcgacccccggcggtgcatgaagcccgtgatcttgacggacggggaggagcgtgtgatcctggccgggcccatgccggtgacccactccagcgccgcccagcgacgggggcgcatcggccggaaccccaaaaacgaaaacgatcagtacatctacatgggggaacccttagagaacgacgaagattgcgcccactggaaagaggctaagatgttgctggacaacatcaatacccccgagggcatcatcccgtccatgttcgagcccgagcgcgagaaggtggacgccatcgatggcgagtaccggttacgcggggaggcccgcaaaaccttcgtcgacctcatgcggcgcggcgacctgcccgtgtggctggcatacaaggtggccgcggaggggatcaactacgccgaccggcgctggtgcttcgatggcatcaaaaacaaccagatactggaagagaacgtcgaggtggaaatatggacgaaggagggggagcggaagaagctgaagccgcgctggctggatgcccggatctacagcgatcccctcgccctgaaggaattcaaagagttcgccgcgggccgcaagtccctgaccctcaacctgatcaccgagatgggccggctgcccaccttcatgacgcagaagacccgtgacgccctcgacaatctggccgtccttcacaccgctgaggccggggggcgggcctacaatcacgccctcagtgagctgcccgagaccctggaaacgctcctgctgctcactctgcttgccaccgtgaccggcgggatcttcctcttcctgatgagtgggcgcgggatcggcaagatgaccctggggatgtgctgcatcatcacggccagcatcctcctgtggtacgcacagatccagccgcactggatcgccgcctccatcatcttggagttcttcctcatcgtgctgctgatccccgagcccgaaaagcaacggacgccccaggacaatcagctcacctatgtcgtgatcgccatactgactgtggtcgccgcgacgatggccaacgagatgggcttcctggagaagaccaagaaggatctcgggctgggcggcatcgccacccagcagccggagagcaacatactggatatcgacctccggcccgcctccgcctggactctgtacgcggtggcgacgaccttcgttacccccatgctgcggcacagcatcgagaatagttccgtcaacgtgagcttgaccgccatcgccaaccaggccacggtgctgatggggttaggcaaggggtggcccctgtccaagatggacatcggggtcccgctgctggcgatcgggtgctatagccaagtgaaccccatcactttgacggccgccctgctgctcctggtggcccactatgcgatcatcggcccgggcctgcaagctaaggccacccgcgaggcgcagaagcgtgctgcggccgggatcatgaagaatcccacggtcgacggcatcaccgtgatcgacctcgacccgatcccctacgaccccaagttcgagaagcaactgggtcaggtgatgctgctcgtgctgtgcgtgacacaggtgctgatgatgcgcactacgtgggccctatgcgaggctcttaccctggccaccgggcccatctccactctctgggagggcaaccccggccgcttctggaatacgaccatcgcggtcagcatggccaacatcttccggggcagctacctcgccggggccggcctcctcttcagcatcatgaagaacaccaccaacacgcggcgcggtaccggcaatatcggcgagaccctgggggagaagtggaagtcgcgcctgaacgccctcggtaagagcgagttccaaatctacaaaaagtccgggatacaagaggtagaccggaccctggcgaaggagggaatcaagcgcggggagacggaccatcacgccgtgtcccggggcagcgcaaagctgcgctggttcgtcgagcgaaacatggtgacaccggagggcaaggtggtcgacctcggctgcggccgcgggggctggtcttattactgcgggggcctgaagaacgtgcgggaggtaaagggcctaaccaagggcgggcccgggcacgaggaacccatcccgatgtccacctacggctggaacctcgtacgcttgcagagcggggtggacgtgttcttcatcccgcccgagaagtgcgacacgctgctctgcgacataggcgagtccagccccaacccgaccgtcgaggccgggcggaccctccgcgtgctgaacctcgtggagaactggctgaacaacaacacccagttctgcatcaaggtcctcaacccctacatgccttccgtgatcgagaagatggaggcgctacagcggaagtacgggggcgccctcgtaagaaaccccctgagccggaacagcacccacgagatgtactgggtctcaaacgcctcagggaacatcgtgagtagcgtgaacatgatctctcgcatgctgatcaaccggttcaccatgcgccacaagaaggccacctacgaacccgacgtagacctcggcagcgggacccggaacattggcatcgagtccgaagtgcccaacctggacatcatcggcaagcggattgagaaaatcaagcaggagcacgagaccagctggcactacgaccaggatcacccctacaagacgtgggcctaccacggatcctacgagaccaagcagaccggcagtgcgtccagcatggtgaacggggtcgtgagactgctcactaagccgtgggatgtcctgcccacggtcacccagatggccatgaccgatacaacgccctttggtcagcagcgcgtgttcaaggagaaggtggacacccgcacccaggagcccaaggaggggacaaagaaactaatgaagatcacggccgaatggctctggaaggagctggggaagaagaagaccccgcggatgtgcacccgcgaggagttcacccggaaggtacgctcaaacgccgccctgggcgcgattttcacggacgaaaacaagtggaagtccgcccgggaggcagtggaggactcccgcttttgggagcttgtagacaaggagcggaacctgcacctagaggggaagtgcgagacctgcgtgtacaacatgatgggcaagcgcgaaaaaaagctcggggagttcggcaaggctaagggcagccgagccatttggtatatgtggctgggggcgcgcttccttgagtttgaggccctcggcttcctgaacgaggaccactggttctcccgggagaacagcctgtccggggtggagggcgaggggctccacaagctgggctacatcctgcgcgacgtaagcaaaaaagagggcgggaccatgtacgcagacgacaccgccggatgggacacgcggatcaccctcgaagacctgaagaacgaggagatggtgacgaaccacatggagggggaacacaagaaactggcggaagccatatttaagctcacctaccagaacaaagtggtccgggtgcagcggcccactccgcgcggcaccgttatggacatcatctctcgacgcgatcaacggggctccggccaggttggtacctacgggcttaacaccttcacgaacatggaggcccagttaatccgccagatggaaggcgagggggtcttcaagaacatccaacacctcaccgtgaccgaggagatcgccgttcagaattggctggcccgggtgggccgcgagcgcctgagccggatggcgatctccggcgacgactgcgttgtcaagcccctcgacgaccgcttcgccagcgcccttaccgccctgaacgacatggggaagatccggaaggacatccagcagtgggaaccgtcccgcggctggaacgactggactcaggtgcccttctgcagccaccacttccacgagctcatcatgaaggacgggcgggtgctcgtcgtgccctgtcgcaatcaggacgagctgattggccgcgcacgcatttcccagggggcgggctggagcttacgggagaccgcctgtctgggcaagtcatatgcccaaatgtggagcctgatgtacttccatcgccgggacctgcgactggccgccaacgcgatctgtagcgccgtgcccagccactgggtcccgacgtcccggaccacctggagcatccacgccaagcacgagtggatgacgaccgaggacatgctgaccgtgtggaacagggtgtggatccaggagaacccgtggatggaggacaagacgcctgtagactcctgggaggagatcccctacctcgggaagcgtgaggaccagtggtgcggatctctgatcgggctgacgtcccgcgcgacctgggcgaagaacatccaggcggccatcaaccaggtacggagcctcatcggcaacgaagagtataccgactacatgccttccatgaagaggttccggcgcgaggaggaggaggccggcgtgctgtggtag

SEQ ID NO: 25155 - RNA, 9876 nt, synthetic construct
  misc_feature 1..9876: note = derived and/or modified CDS sequence (opt11) from DENV-2__GQ868544__SS-prME
  source 1..9876: mol_type = other RNA
tccgtgggcatgattatcatgctgatccccaccgtaatggccttccacctcacaacacggaacggggagcctcacatgatcgtgtcgatccaggagaaaggcaagtcgctgctgtttaagaccgaggacggggtgaacatgtgcaccttaatggccatggacctcggcgagctgtgcgaggacaccatcacctacaagtgccccctcctgcgacagaacgagcccgaggatattgactgctggtgcaacagcaccagtacgtgggtcacctacgggacgtgcactaccacgggcgagcaccgccgggagaagaggtccgtagcgcttgtgccccacgtcggcatggggctcgagactcgtaccgagacctggatgagctccgagggtgcctggaagcacgcccagcggattgagacctggatcctgcggcacccggggttcacgatcatggcggctatcttggcgtatacaataggcaccacccactttcaaagagccctcatcttcatcctgctgacggccgtggcccccagcatgaccatgcggtgcattgggatttccaaccgtgatttcgtggaaggggtcagcggcgggtcctgggtggacattgtgttagaacacggcagctgcgttaccaccatggctaagaacaagcccacgctggatttcgagttaatcaagaccgaggcaaagcagcctgccaccctccgtaagtactgcatcgaggccaagctgaccaacacgaccaccgagtcccgctgccccacccaaggggagccctcgctgaaggaggagcaggacaaacggttcgtttgcaagcactcaatggtggaccgaggatggggcaatgggtgcggcctcttcgggaaaggcgggatcgtaacgtgcgccatgttcacgtgcaagaagaacatggagggcaagatcgttcagcccgagaacctggagtacaccatcgtagtcacgccgcatagcggcgaggagcacgcggtggggaacgacaccggcaagcacggcaaggaaatcaaggtgaccccgcagtcttccatcaccgaggcggagctgacaggctacgggaccgtaacgatggagtgcagccccaggaccgggctcgacttcaacgagatggtgcttctgcagatggagaataaggcctggctcgtgcacagacaatggttcctggacctgcccctcccctggctgccgggcgccgacacccaggggagcaactggatccagaaggagaccctggtaaccttcaagaatccccacgccaagaagcaagacgtggtcgtgctcggcagccaggagggggcgatgcataccgcactgaccggcgccaccgagatccagatgtcaagcgggaacctcctgttcacgggccacctgaagtgccggctgcgaatggacaaacttcagctgaaaggcatgtcctacagcatgtgcacggggaagttcaaagtggtcaaggagatcgccgagacccaacatggcaccatcgtgatccgggtgcagtacgagggggacggcagtccctgcaaagtccctttcgagatcatggacctggagaagcgctacgtgctcggtcggctcatcactgtgaacccgatcgttaccgagaaggacagccccgtgaacatcgaggcggagccgcctttcggtgactcctacatcatcatcggcgtggagccgggccagctgaagctcaactggttcaagaagggcagctcgatcgggcagatgttcgagacaactatgcggggcgcgaagcgcatggccatacttggtgatacagcctgggactttgggagcctgggcggagtcttcacctctatcggcaaagccctccaccaggtatttggggccatctacggcgcagccttctctggcgtgtcctggaccatgaagatcttgatcggggtcatcatcacctggattggcatgaactcccggtcaacatctctaagtgtatcgctggtgctcgtcgggatcgtgaccctgtacctgggggtgatggtccaagccgactccgggtgcgtggtgagctggaagaataaggaattaaagtgcggcagcggcattttcatcaccgataacgtccacacctggaccgaacagtacaagttccagcccgagtctccgagcaagctggcctcagcgatccagaaggcacaggaggagggtatctgtggcatccgcagtgtcacccgactggagaacctcatgtggaaacagatcactcccgagctgaaccacatcctggccgaaaacgaggtgaagctcaccatcatgaccggggacatcaagggcatcatgcaggccgggaagcgctccctgagaccgcagcccaccgagctgaaatattcttggaagacctggggcaaggccaaaatgctctccaccgagagccacaaccaaaccttccttattgacggacccgaaaccgcggagtgccccaacaccaatcgcgcctggaactccctggaagtcgaggactacgggttcggcgtgttcaccacgaacatctggctcaagctgaaggagaagcaggacgccttctgcgacagcaagctcatgtccgccgccatcaaggacaaccgtgctgtccacgccgacatggggtactggatcgagagcgccctcaacgacacctggaagatcgagaaggcctcctttatcgaggtgaaaaactgccactggcccaagagccataccctctggtcaaacggagtgctggagtccgagatgatcattccaaagaacctcgccggtcccgtgtcccagcacaattaccgcccggggtaccacacccagatcgccggcccctggcacttggggaagctagagatggacttcgacttctgcgacggcaccacagtcgttgtgactgaggactgcgggaaccggggccccagcctccgcaccaccacggccagcggcaagttgataacagagtggtgctgccggtcctgcaccttgcccccgctccgctaccgcggggaggacggatgctggtacgggatggagatcaggcccctgaaggagaaggaggaaaacctggtcaacagtctcgtgaccgccgggcagggccagatcgacaacttttctctaggcgtcctgggcatggccctcttcctcgaagagatgctgcgcacgcgagtcgggaccaagcacgcaatactcctggtggccgtcagcttcgtaaccctgattaccggaaacatgtccttcaaggacctcgggcgtgtggttgtcatggtgggcgctaccatgaccgacgacatcggtatgggcgtaacctacctggccctgctagccgcattcaaggtccgccccaccttcgcggccggcttgctgctacggaagctgacgagcaaggagctgatgatgacaacgatagggatcgtgcttctgtcccagagtaccatccccgagacgatactggagctcaccgacgcactggctctaggcatgatggtgctcaaaatcgtccgcgacatggagaagtaccagctggccgtcaccatcatggccatcctgtgcgtcccaaacgccgtgatcctacagaatgcctggaaggtctcttgcaccatcctagccgtcgtgagtgtgagccccctgctcctgacgtcctcccagcagaagactgattggataccactggcgctcaccatcaagggactgaaccccaccgccatcttcctgacgacccttagccgcaccaacaagaaacggtcctggccgctcaacgaggccatcatggctgtcggcatggtgagcatacttgcgtcaagcctcctgaagaacgacatccccatgaccggccccctggtggccggaggcttgttgacggtatgctacgtgcttaccgggcgctccgccgacctcgagctggagcgggccaccgacgttaaatgggaggaccaggccgaaattagcggcagctcccccatcctgagcatcaccatctctgaagatgggagcatgtccatcaaaaacgaagaggaggaacaaaccctcaccatactgatcagaaccggcctgctcgtcatcagcggactgttcccggtgtccatcccaatcaccgcggccgcctggtacctgtgggaggtcaagaaacagcgggccggggttctctgggatgtgcccagcccgccacccatgggcaaggccgagctggaggacggggcgtaccgcattaaacagaagggtattctgggttattcccagatcggagcaggcgtgtacaaggaggggacattccatacgatgtggcacgtcacccggggagccgtgctcatgcacaaggggaagcgaatcgagcccagctgggcagacgtaaagaaggacctaatatcctacggcgggggctggaaacttgagggcgagtggaaggagggggaggaggtccaagtgttagccctggagcccggcaagaatccccgggccgtgcagacgaagcccgggctgttcaaaaccaacacaggcacgatcggggctgtcagcctcgacttctcccccggcaccagcggttcccccatcatcgacaagaaggggaaggtggtgggcctctacgggaacggcgtcgtgacccgcagcggcgcatatgtgtccgccatcgcccagacggagaaatccatcgaggacaacccggacatcgaggatgacatcttccggaaacgccggctgacgatcatggacctgcaccccggggcgggcaaaaccaagcgttacctgcccgccatcgtccgggaggctataaagcgcgggctacggaccctgatcctcgctcccacgcgcgtcgtggcggccgagatggaggaggccctgagaggcctccccatccggtaccagacccccgccatccgcgcggagcacacggggcgcgagatcgtagacctcatgtgccacgcgaccttcacgatgcgtttgctgtcccctgtgcgggtaccgaactacaacctaattataatggacgaggcccacttcaccgaccccgcctctattgcagcccgcggctacatcagcaccagggtcgagatgggcgaggcggccgggatcttcatgaccgccacgccacccggcagccgtgacccgttcccgcagagcaacgcccccatcatcgacgaagaacgggagatccccgagcgctcctggaacagcgggcacgaatgggtgaccgattttaaaggcaagaccgtgtggttcgtcccgtccatcaaggccggaaatgacatcgctgcctgtctgcggaagaacgggaagaaggtgatccagttgagccgaaagaccttcgattccgagtacgtgaagacgcggaccaacgactgggacttcgtcgtgacaactgatatcagcgagatgggcgccaacttcaaggctgagcgagtgatcgacccccggcgctgcatgaaacccgtcatcctcactgatggcgaggagcgcgtgatcctggcgggtcctatgccggtcacccactccagcgccgcccagcggcggggtcgcatcggccgcaatcccaagaacgagaacgatcagtacatctacatgggggagcccctggagaacgacgaggactgcgcccactggaaggaggccaagatgctccttgacaacatcaacaccccagagggcatcatcccatccatgttcgagcccgagcgcgaaaaggtcgacgccatcgacggcgagtaccggctgagaggggaagccagaaagacctttgtggacctgatgaggcgcggcgacttgcccgtgtggctggcctataaggtcgcagcagaggggatcaactatgcagaccggcgctggtgctttgacgggatcaaaaacaatcagatcctcgaggagaacgtcgaagtcgagatctggacgaaggagggcgagcggaagaagctgaagccgcgctggctggacgccaggatatacagcgaccccttagccctgaaggagttcaaggagttcgcagccggccgcaagtccctgaccctcaacctgatcactgagatgggccggctgcccaccttcatgacccagaagacccgcgacgccctcgacaacctcgccgtgctgcacaccgcggaggcgggaggccgagcgtacaatcacgccttgagcgagctgcccgagaccctggaaacgttgctattacttaccctgctggctaccgtgaccgggggcatcttcctctttctgatgtccggccgcgggatcggcaagatgaccctagggatgtgctgcatcgtcacggccagcatacttctgtggtacgcccagatccagcctcactggatcgcggcctctatcatactggagttcttcctcatagtgctgctgatacccgagcccgagaagcagcggacaccccaggacaaccaactcacctacgttgtcatcgccattctgaccgtggttgccgccacgatggcgaacgagatgggcttcctagagaagactaagaaggatctcggtctggggagcatagctacgcagcagccagaatcgaacatcttagacatcgacctccgccctgctagcgcctggaccctgtacgccgtcgcaacgaccttcgtgaccccgatgttgcggcactcgattgagaactccagcgtgaatgtctccctcacagctatcgccaaccaggccacggtgctgatgggtctgggaaagggctggcccctttccaagatggatatcggggtaccgctgctggccatcggctgctactcacaggtcaatcccatcaccctcaccgcggccctacttctccttgtggcacactacgccatcatcgggcccggcctgcaggctaaggccactcgggaggcgcagaagcgagccgccgccggcatcatgaagaatcccacggtggacgggatcaccgtcatcgacctcgacccgattccctacgacccgaagttcgagaagcagttaggccaggtgatgctgctcgtgctgtgtgtcacccaggtgctgatgatgcgcaccacgtgggccctttgcgaggccctcaccctggccaccggccccatcagcaccctctgggagggcaacccggggcggttctggaacacgaccatcgcagtgagcatggcgaatatctttcgcggcagctacttggccggggccgggctcctcttctccattatgaagaacaccaccaatacgcggcgcggaaccgggaacatcggcgaaacccttggcgaaaaatggaaaagccgcctgaacgccctcgggaagtccgagttccagatctacaagaaatccggcatccaggaggtagaccggaccctggccaaggaggggattaaacgcggcgagacggaccaccacgcggtgagtcgggggtcagccaagctgcgctggtttgtggagcggaacatggtcacccccgaagggaaggtggtggatctgggctgcgggcgaggtgggtggagttattactgcggagggttgaagaacgtccgggaggtaaaggggctgaccaaaggagggcccggccatgaggagcccatcccgatgtccacgtacgggtggaacctcgtgcgcctgcaatccggcgtggacgtgttcttcatccctccagagaagtgcgacacgctgctctgcgacatcggggaaagctcccccaacccgacggtggaggccggccggaccttacgcgtgctgaacctcgtcgagaactggctgaacaacaacactcagttttgcatcaaggtgctgaacccctacatgccctcggtcattgagaaaatggagaccctgcaacgcaagtacggaggcgcccttgtgcgcaacccgctgagccggaactccacgcacgaaatgtattgggtgagcaacgcgtcgggcaacatcgtcagctccgtgaacatgatcagccgcatgctgatcaaccgcttcacgatgaggcacaagaaggccacctacgagcccgacgtggacctcgggtccggcacccggaacattgggattgagagcgagatccccaacctggacatcatcggcaaacgcatcgagaaaattaagcaggagcacgagacgtcctggcactatgaccaggaccacccctataagacctgggcctaccacggctcttatgaaacaaagcagactgggtccgccagctcaatggtcaacggcgtggtgcgtcttctcaccaagccgtgggacgtacttcccaccgtcacccagatggccatgaccgacacgaccccattcgggcagcagcgagtgttcaaggagaaggtcgacaccagaacgcaggagcccaaggagggcacgaaaaagctgatgaagatcaccgcggagtggctctggaaggagctaggaaagaagaaaaccccgcggatgtgcacccgcgaggagttcacgcggaaggtaaggagcaacgcggccctgggggcaatcttcaccgatgagaacaagtggaagtccgcccgggaggcagtagaggacagccgcttctgggagctcgttgacaaggagcggaacctgcacctggaggggaagtgcgagacctgtgtgtataatatgatggggaagcgcgagaagaagttaggcgagttcgggaaggccaagggttccagagccatctggtacatgtggctgggcgctcggttcctggagttcgaggccctagggttcctgaacgaggaccattggttcagccgggagaactccctgagcggcgtggagggggagggtctctacaaacttggatacatcctgcgcgacgtgagcaagaaggagggcggcgcgatgtacgccgatgacaccgctgggtgggatacgcggatcaccctcgaggatttgaagaacgaggagatggttaccaaccatatggagggcgagcacaaaaagctggccgaggcgatattcaaacttacctaccagaacaaggtcgtgcgcgtgcagcggcccacgcccaggggtaccgtcatggacataatttcgcggcgcgaccaaagaggttctggccaagtggggacctatggcctgaacactttcacgaacatggaggcccaactgatacgtcagatggaaggcgagggtgtcttcaagaacatacaacacctcaccgtgaccgaggagatcgccgtccagaactggctggcgcgggtggggcgggagcgcctgtcccggatggccatcagcggagatgactgcgtcgtgaagcccctcgacgaccgcttcgcgtcagccttgaccgccctcaacgacatgggcaaaatccggaaagacatccagcaatgggagcctagccgcggttggaacgactggacccaggtgcccttctgctcccatcacttccacgagctaatcatgaaggacggccgggtcctggtggtgccctgccgcaaccaggatgagctgatcgggcgcgcacgtatcagccagggcgctgggtggtccctccgggagaccgcgtgtctgggcaagagctacgcccagatgtggtccctgatgtacttccaccgacgggacctccgtttggccgccaacgccatctgttccgctgtcccgtcccactgggtgccgaccagccggacgacatggtctatccacgccaagcacgagtggatgacgaccgaggacatgctgaccgtatggaaccgcgtctggatccaggaaaacccctggatggaggacaagaccccggtagagagctgggaggagatcccatacctcggtaagcgggaggaccaatggtgcgggtccctgatcggcctgacctcccgagccacctgggcaaagaacatccaggcagcgatcaaccaggttaggagcctcatcgggaacgaggaatacaccgactacatgccgtccatgaagcgattccggcgcgaggaagaagaagccggcgtcctgtggtga

SEQ ID NO: 25156 - RNA, 9876 nt, synthetic construct
  misc_feature 1..9876: note = derived and/or modified CDS sequence (opt11) from DENV-2__GQ868545__SS-prME
  source 1..9876: mol_type = other RNA
agcgcgggcatgatcatcatgctgatccccaccgttatggctttccatctcaccacccgcaacggcgaaccccacatgatcgtcagcatccaggagaagggcaagagcctgttgttcaagacagaggacggggtgaacatgtgtaccctcatggcgatggacctgggcgagctgtgcgaggacaccatcacctacaagtgccctctcctgagacagaacgagccagaagacatcgactgctggtgcaacagcacaagcacctgggtgacgtacgggacctgcaccacaaccggggagcaccgccgggagaagcgctccgtcgccctggtgccccacgtgggcatggggctcgagacccggaccgagacctggatgagctcggagggcgcctggaagcacgctcagcgcatcgagacctggattctgcgccacccggggttcacgatcatggccgccatcctggcctacacgatcggtacaacccacttccagcgcgccctcattttcatactgctgacggccgtagcgccctcaatgaccatgcggtgcatcgggatctccaaccgcgacttcgtggagggggttagcggcggttcctgggtcgacatcgtgttggagcacggcagctgcgtaaccaccatggccaagaacaagcccacgctcgacttcgagctgatcaagaccgaggccaagcaacccgccaccctccggaagtattgtatcgaggccaagctgaccaacacgaccaccgaatcccgctgccccacccagggggagcccagcctgaaggaggaacaggacaaacggttcgtctgcaagcactccatcgtggaccgcggctggggcaacgggtgcggcctcttcgggaaaggcgggatcgtgacgtgtgccatgttcacgtgcaaaaagaacatggagggcaagatcgttcagcccgagaatctggaatacaccatcgtggtgacgccccacagcggcgaggagcacgccgtcgggaacgacacgggcaagcacggcaaggagatcaaggtcactccgcagagcagcgtgaccgaggcagagctgaccggttacgggaccgtcacgatggagtgcagcccccgtaccgggctcgacttcaacgagatggtgctgctgcagatggaaaacaaggcttggctggtacaccgccagtggttcctggacctgcccctaccctggctgccgggcgccgacactcaggggagcaactggatccagaaggagaccctggttactttcaagaacccccacgctaagaagcaggatgtggtcgtgctcggcagccaggaaggggctatgcacaccgccctaaccggcgccaccgagatccagatgtccagcggtaacctcttgtttacgggccacctgaaatgccggctgcgcatggataagctgcagctcaaaggcatgagttatagcatgtgcaccgggaagttcaaggtggttaaggagatcgccgaaacccagcacggcacgatagtgatccgggtgcagtacgaaggggacggctccccctgcaagatacccttcgaaatcatggatctggagaagcgctacgttttaggcagactgattacggttaatccgatcgtgaccgagaaagacagtccagttaacatagaggcggagccgcccttcggggactcatacatcataataggcgtggaacctgggcagttgaagctcaactggttcaagaagggcagcagcatcgggcagatgttcgagaccaccatgcgcggagccaaacgtatggccatcctgggcgacacggcgtgggacttcgggagcctgggcggtgtgtttacgtcgatcggcaaagccctccatcaggtcttcggcgcgatttacggcgccgccttcagcggcgtgtcctggaccatgaagatcctgatcggggtgatcatcacctggataggcatgaacagccgatccacgagcctgtccgtcagcctggtgctcgtggggatcgtcaccctatacctgggcgtgatggtgcaggccgactcggggtgcgtcgtgagctggaagaacaaggagctcaagtgcggcagcggcatcttcatcactgacaatgtgcacacctggacggagcagtacaagttccagccggagtccccgagcaagttagcgtccgccatacagaaggcccaagaggaagggatctgtggcatccgcagcgtcacccggctggagaacttaatgtggaaacagatcacccccgaactgaaccacatattagccgagaacgaggtgaagctcaccatcatgacgggggatataaagggcataatgcaggccgggaagcgaagcctgcggccgcagcccaccgagctgaagtacagctggaagacctggggcaaggctaagatgctctccacagagagccacaaccagacgttcctgatagacgggcccgagaccgccgagtgcccaaacaccaaccgcgcgtggaattcgcttgaggtggaggactacgggttcggcgtattcacgacgaacatctggctcaaactgaaggaaaagcaggacgccttctgcgacagtaagctgatgtccgccgctatcaaagacaaccgggccgtgcacgccgacatggggtactggatcgaaagcgccctcaacgacacctggaaaatcgagaaggcctccttcattgaggtgaaaaattgccactggcctaagagccacaccctatggtccaacggggtgctggagagcgaaatgatcatccccaagaatctcgcaggtcctgtgagccagcacaactatcgcccagggtatcatacccagatagccggcccctggcaccttgggaagcttgagatggatttcgacttctgcgacggcaccacagttgtcgtgaccgaggactgcggcaaccggggtcctagcctccgcacaaccactgccagcggcaagctgatcaccgagtggtgctgccggtcatgcaccttgccaccgctccgctaccgcggggaggacggctgctggtacggcatggaaatacgccccctgaaggagaaggaggagaaccttgtgaacagcctcgtcaccgccggtcatgggcagatcgacaacttctccctgggcgtgttgggcatggccctctttctggaggaaatgctgcggacaagggtggggaccaagcacgccatcctcctggtcgccgtcagcttcgtgaccctgatcaccggcaacatgtccttcaaggacctcgggcgggtcgtcgtgatggtcggggccacgatgaccgacgacatcgggatgggcgtgacctatctggccctgctcgcggcgttcaaggtgcgccccaccctagcggcaggcttactcctgagaaagctgacgagcaaggagctcatgatgacgactatcgggattgtcctgctgtctcagagcaccattcccgagacgattctcgagctgaccgacgccctggcgctcggcatgatggtgttaaaaatagtgcgcgacatggagaagtaccagttggccgtaaccatcatggccacactctgcgtgccgaacgccgtcatcctgcagaacgcctggaaagtgagttgcacaatcctcgcggtggtcagcgtgagtcccttgctgctgaccagctcccagcaaaagacggactggatccccctcgccctgaccatcaaggggctgaatcccaccgccatattccttacgaccctgagccgcaccaataagaagcggtcttggccgttgaacgaggccatcatggctgtgggcatggtgagcatactcgcctccagcctgctcaagaacgacattcccatgacaggccccctcgtcgccgggggcctgctcacagtgtgctatgtattaaccgggcgatctgctgacctggaactggagcgggccaccgacgtgaagtgggaggaccaagcggagatcagcggcagctcccccatcctcagcattactatctctgaggatgggagcatgtccatcaagaacgaggaggaggagcagaccctcacgatcctgatccgaacagggctcctggtgatcagcggcctgtttccggtatccatccctatcaccgccgccgcctggtacttatgggaggtgaagaagcagcgggctggggtcctgtgggacgtccccagccccccgcccatgggcaaagcggaactggaagacggggcctaccgcatcaagcagaaaggcatcctcgggtattcccaaatcggcgcgggggtgtacaaggaggggacattccataccatgtggcacgtgaccagaggcgccgtcctgatgcacaagggtaagcgcatcgagcccagctgggccgacgtcaagaaggacctgatctcctacggcgggggctggaaactcgagggagagtggaaggagggggaggaagtgcaggtcctggcgctggagcccggcaagaacccacgggccgttcagaccaagcccggcctcttcaagacgaacactggcaccatcggggccgtgtcactggacttttctccgggaaccagcggctcgcccattatcgacaagaagggcaaggtggtgggcttatacgggaacggcgtggttacgcgcagcggtgcctatgtttccgcgatcgcgcagacggagaagtccatagaggacaaccccgacatcgaggacgacatcttccggaagcgccgcctgaccataatggacctccaccccggggcaggcaagaccaagcgctacctgcccgcaatcgtgcgagaggccatcaagcgcgggctgcgtacgcttatcttggcgccgacccgcgtagtggctgccgagatggaagaggccctgcggggcctccccattcgctaccagacccccgccatcagggctgagcacactgggcgcgagattgtggatctgatgtgccacgccacgttcaccatgcgcctgttgtcccccgtccgggtgccgaactacaacctgatcatcatggacgaagcccacttcaccgaccctgccagcatcgcagcgcgcggctacatcagcacccgggtggaaatgggcgaggctgcagggatcttcatgacggccacgccacccggctcccgcgatccgttcccccagagcaacgccccgatcatcgacgaggagcgggagattcccgaacgttcctggaactctgggcacgagtgggtcaccgacttcaagggcaagaccgtgtggttcgtgccgagtatcaaggctgggaacgacatagcggcctgccttcggaagaacggcaagaaggtcatacagctcagtcgcaagacgttcgactcagagtacgtgaagacccgcaccaatgactgggatttcgtggtcaccacggatatctcggagatgggagccaactttaaggcggagcgcgtgatcgacccccggcgctgcatgaagcctgttatactgactgatggggaggagcgggtcatcctggctggccccatgcctgtgacacatagtagcgccgcgcaacgccgggggcgcatcggccggaatcccaagaacgagaacgatcaatacatatacatgggggaaccccttgaaaatgacgaggactgcgcgcactggaaggaggcgaagatgctcctggacaacatcaacacacccgagggcatcattccgtccatgttcgaacccgaacgcgagaaagtggacgccatcgacggcgagtatcggctccgcggggaggcccgaaagactttcgtggacctgatgcggcgcggcgatctgcccgtgtggcttgcatacaaggtggccgcggaggggatcaactacgccgaccggcggtggtgcttcgacggtataaagaacaaccagatcctggaggaaaacgtcgaggtggaaatctggaccaaggagggagagagaaaaaagctgaagccgcgctggttggacgcacgaatctacagcgatcccctggcgctgaaggagttcaaggagttcgcagcgggtcgtaagtccctcaccctgaacctgattaccgagatgggtcggttacccacgttcatgacccagaagacacgtgacgcactggacaacttggccgtcctccacaccgccgaagccggcgggcgggcctataaccacgccctgagtgagcttcccgaaacgcttgagaccctgctgctcctaaccctacttgccacagtgacgggcggcatcttcttgttcctgatgtccgggcgcggcataggtaagatgacgctcgggatgtgttgcatcatcaccgcaagcatccttctgtggtatgcccagatacagccccactggatcgccgcaagcatcatcctcgagttcttcctgatcgtcctgctcatccccgaaccagaaaagcagcggacgccacaggacaaccagctgacgtatgtagtgatagccatcctgaccgtggtagccgcgaccatggccaatgaaatgggattcttagagaagaccaagaaggacctgggcctgggcagcatcgccacccaacagccggagtctaacatcttagacatcgacctgcggcccgcctctgcctggacactgtacgcggtggcaaccacattcgtgacccccatgctcagacattcaatcgagaactctagcgtcaacgtgtccctgacggcaatcgccaaccaggccaccgtgctgatgggcctcgggaagggatggccgctgtcgaagatggacatcggggtccctctgctcgcgatcggctgttactcccaagtgaaccccatcacacttaccgccgcccttctgctgctggtggcccattacgccatcatcgggcccgggctccaggccaaagccacgcgcgaggcccagaagcgggccgcggcgggcatcatgaagaaccccaccgtcgacgggatcaccgtgatcgacctggacccgatcccgtatgaccccaagttcgagaaacagttgggccaggtgatgctactagtattatgcgtgacccaggtgttgatgatgagaacgacctgggccctatgcgaggccctgacccttgccactgggcccatcagcaccctatgggagggtaacccggggcggttctggaacaccaccatcgcggtctccatggctaacatcttccgaggcagctacctggccggggccggactcctcttctcgatcatgaagaacaccacgaacactcgtcgcggcaccggtaacatcggcgagaccttgggcgagaagtggaagtcccgcctcaacgcgctggggaaatcagagttccagatctacaagaagtccggcatccaggaggtggaccggacgctggcgaaagaggggataaagcgcggagagactgaccatcacgcagtgtccaggggtagcgccaagctccgctggttcgtcgagcggaacatggtgacccccgagggcaaagtggtcgaccttggctgcgggcgcggagggtggtcctactactgcggcggactgaagaatgtgcgggaggttaagggcctcaccaagggcgggcccggccacgaggagcccatccctatgtccacgtacggttggaacctggtccgcctgcagtcgggcgtggacgttttttttattccgcccgaaaaatgcgacaccctcctgtgcgacatcggggagtcttcccccaaccccaccgtcgaagcgggccgaaccctgcgagtgctcaacctggtggagaactggctgaacaacaacacccagttctgtatcaaagtcctgaacccctacatgccgagcgtgatcgaaaagatggagacgctccagcggaagtacgggggcgcgctcgtgcgcaaccccctgagccggaactcgacccacgagatgtactgggtcagcaacgcctccggcaacatcgtgagctccgtgaatatgatctctcgtatgctcataaaccgcttcaccatgagacacaagaaggcaacctacgaacctgacgtcgacctggggtccggcacgcggaacatagggatcgagagcgagatccctaacctggacatcatcggcaagcgcatcgagaagatcaagcaggagcacgagacctcctggcactacgaccaggaccacccctataagacctgggcctaccacggcagttacgagaccaagcagacggggtccgcctctagcatggtgaatggcgtggtccggctcctgaccaaaccgtgggacgtgctgcccaccgttacccagatggcgatgacggacaccaccccatttggccagcagcgcgtcttcaaagagaaggtggacacccgcacgcaggaacccaaggagggcaccaaaaagctcatgaagatcaccgccgaatggttgtggaaggagctgggcaaaaagaagacgccgcggatgtgcacgcgcgaagagttcacccggaaggtgcgcagcaacgccgccctcggggccatcttcaccgacgagaacaagtggaagtccgcgcgggaggccgtcgaagacagccgcttctgggagctggtggacaaggagcggaagctgcacctcgaaggcaagtgcgagacctgcgtctacaacatgatggggaagcgcgagaagaagctaggcgaattcggtaaggccaaaggctcgcgggccatctggtacatgtggctgggtgcccgcttcctcgagtttgaggcactaggcttcctgaacgaggaccactggttctctcgggagaactcactcagcggcgtggagggggagggcttgcataagctgggttacatcttgagagacgttagcaagaaggaggggggcgctatgtacgccgacgacacggccgggtgggatacccggatcacactggaagacctgaagaacgaggaaatggtaaccaaccatatggagggcgagcacaagaagctcgcggaggcaatcttcaagcttacgtaccagaacaaggtcgtgcgcgtccagcggcccacgccacgcgggaccgtgatggacatcatctcccgccgtgatcaacggggcagcggccaggtgggcacttacgggttgaacacgtttaccaatatggaggcccagctcatacgccagatggagggcgagggcgtcttcaagaacatccagcacctgaccgtgaccgaggagatcgccgtgcagaattggctggccagagttgggcgcgagcgcctctcccggatggctatcagcggcgacgactgcgtggtcaagcctctggacgataggttcgcctccgccctcacggcattgaacgatatgggtaagatccggaaggacatccagcagtgggagccgagcaggggctggaacgattggacccaagtccccttttgctcccaccacttccatgagctgatcatgaaagacggacgggtactggtggtcccctgccgcaatcaggacgagctcatcgggcgcgcccgtatctctcagggcgcggggtggagcctgcgtgaaaccgcctgtcttggcaagagctacgctcagatgtggtccttgatgtacttccaccgacgggacctgcgcctggccgccaacgcgatctgcagtgcagttccctcacactgggtaccgaccagccggaccacgtggtccatccacgccaagcacgagtggatgacaaccgaggacatgctcaccgtttggaatcgcgtctggatccaagagaacccctggatggaggataaaacccccgtggagagctgggaggagatcccctacctgggcaagcgggaggaccaatggtgcggttccctcatcggcctcaccagccgcgccacctgggccaagaacatccaggcggccatcaaccaggttaggagcttgatagggaatgaggagtacaccgattatatgccgtctatgaagcgcttccggagagaggaggaggaggccggcgtgctgtggtga

SEQ ID NO: 25157 - RNA, 9876 nt, synthetic construct
  misc_feature 1..9876: note = derived and/or modified CDS sequence (opt11) from DENV-2__GQ868543__SS-prME
  source 1..9876: mol_type = other RNA
agcgccggcatgatcatcatgctgatccccaccgtgatggctttccatctcaccacgaggaacggggagccccacatgatcgtgggaatccaggagaaggggaaatccctgctattcaagaccgaggatggcgtgaacatgtgtaccctcatggcgatggatctgggtgaactgtgcgaggacacaatcacctacaagtgcccccttctgcggcagaatgaacccgaggacatcgactgctggtgcaattcgacctcgacctgggtaacctacgggacatgtaccacaaccggcgagcacaggcgggagaagcgcagcgtcgcgctggtgccacacgtgggcatgggcctcgagacccggaccgagacatggatgtcgagcgagggtgcttggaagcacgcccagcgtatcgagacctggattctgcgacatccgggctttacgatcatggcagcgatcctggcctacaccatcgggacgacccatttccagcgcgctctcatcttcatcctgcttacggctgtcgcgccctccatgaccatgcggtgcatcggcatcagcaaccgcgactttgtggagggggtatctggtggcagctgggtcgacatcgtactcgagcacgggtcctgcgtgaccaccatggccaaaaacaagcccacgctggacttcgagctgatcaagactgaggccaagcagccagccaccttgcggaagtactgcatcgaggccaaacttaccaacacgacaacggagagtcgctgccccacgcagggcgagccctcgctgaaggaggagcaggacaagcggttcgtctgcaagcactcgatggtggaccgtggctggggaaacggctgcgggctgttcggcaagggcggaatcgtgacatgcgcgatgttcacgtgcaagaaaaacatggagggcaaaatcgtccagcctgagaacctagagtacacgattgtggtgacgccccacagcggagaggagcacgcggtcggcaacgacacgggtaagcatggcaaggagatcaaggtgactccgcagagcagtatcacggaggccgaattgaccgggtacggcaccgtgaccatggaatgcagcccccggaccggactcgacttcaacgagatggtcctgctgcagatggagaacaaggcctggctagtgcaccgccagtggttcctggacctgcccctcccttggctgccgggggccgacaagcagggttccaattggatccagaaggagacactagtgaccttcaagaacccccacgcgaagaagcaggacgtcgtggtcctcgggtctcaggagggcgccatgcacacggccctgaccggtgccaccgagatccagatgagctccggcaacctcctgttcaccggccacctgaagtgccggctgcgaatggacaagctccagttaaaggggatgagctattccatgtgcacgggcaagttcaaggtggtgaaggagatcgcagagacccagcacggcaccatcgtcatccgtgtgcagtatgagggagacggcagcccctgcaagatcccgttcgagatcatggacctggagaagcgctacgtgctcgggcggttaatcaccgtcaatccgattgtgacggagaaggactccccagtcaatatagaggccgagccgcccttcggggactcgtatatcatcatcggggtcgaaccaggccagctgaagttgaactggttcaagaaggggagcagcatcgggcagatgttcgaaaccaccatgcgcggcgccaaacgcatggccatattgggggacaccgcctgggacttcggctccctcggcggtatgttcacgagcatcggtaaggcccttcaccaggtgttcggggcgatatatggggcagccttctccggggtatcctggaccatgaagatcctgatcggcgtcatcatcacctggatagggatgaactcgagatcaacgtccctgagcgtgtccctagtcttggtcggtatcgtgacgctgtacctgggggtgatggtccaggccgacagcggctgcgtggtgtcctggaagaacaaggagctcaagtgcggcagcgggatcttcatcaccgacaacgtgcatacctggaccgaacagtacaagtttcagccggagtccccctccaagttggcgagcgccatccagaaggcccaggaagagggtatctgcgggattcgctccgtgacgcggcttgaaaacctcatgtggaagcaaatcacccccgagctgaaccacatcttggcagagaacgaggtgaagctcaccatcatgaccggcgacatcaagggcattatgcaggccggcaagcgcagcctgaggcctcaacccacggagctgaaatactcctggaaaacttggggcaaggcgaagatgctctcgaccgagtcccacaaccagaccttcctgatcgatgggcccgagacggccgagtgccccaacaccaaccgcgcctggaacagcctggaggtcgaggactacgggttcggcgtgttcaccaccaatatctggctcaagctgaaagagaagcaggacgccttctgcgattccaagctgatgtctgccgcgatcaaggataaccgagccgtgcacgcagacatgggctactggatcgagtccgccctcaacgacacgtggaagatcgaaaaggcctccttcatcgaggtcaagaactgtcactggcccaaatcccacaccctgtggagcaatggcgtgctcgaatccgagatgatcatccccaaaaacctcgcggggcccgtgagccagcacaactacagaccgggctaccacacccagatcgccgggccctggcacctgggaaagctagagatggacttcgacttctgcgacggcaccaccgtcgtggtgacggaggactgcggcaaccggggcccgagcctccgaaccaccaccgccagcgggaagctaatcacggagtggtgctgccggtcctgcaccctgcccccgcttcgctacaggggagaggacgggtgctggtacggaatggagatccgccccctgaaggagaaggaggagaacttggtcaactccctcgtgaccgccgggcacggacaggtggacaacttcagcctgggcgtcctggggatggccctgttcctggaagagatgctgcggacccgagtgggcacgaagcatgccatcctccttgtggccgtgtccttcgtgaccctgatcaccggcaacatgtcgttcaaggacctcggaagagttgtagtgatggtcggagcgaccatgacggacgatatcggcatgggcgtcacttacctggccctgcttgccgcctttaaggtgcgccccacttttgccgctgggctgctgctccgaaagctgacttccaaggagctgatgatgacgaccatcggcatcgtgcttctgtcgcagtccaccatccccgagaccatcctggagctcacggacgccctggcgctggggatgatggtcctcaagatcgttcgcaacatggagaagtaccagctggcggtaaccatcatggccatactgtgcgtcccgaacgccgtgatcctacagaatgcatggaaggtcagctgcaccatccttgcggtggtgtccgtctctcccctgctcctgacctcctctcagcagaaaacggactggatccccctggcgctcacgatcaagggactgaacccgaccgccatcttcttaacaacgctctcccggaccaacaagaaacgcagctggcccctgaacgaggccatcatggcggtgggcatggtgagcatcctggccagctctctcctgaagaacgacatccccatgaccggtcccctggtagcaggcgggctcctcacagtgtgctacgtgctgacgggccgctctgccgacctcgagctggaacgggccaccgacgtcaagtgggaagaccaggcggaaatctccgggagcagccctatattaagcatcaccatcagcgaggacggctccatgagcatcaagaacgaagaggaggagcagaccctcacgatcctaatccgcaccggcctgctcgtgatcagtgggctattcccggttagcatccccatcaccgcagccgcctggtacctgtgggaggtcaagaagcaacgggccggcgtgctctgggacgtgcccagcccgccgcccatggggaaggcggaactggaagatggcgcctaccgaatcaagcagaaggggatcctgggctactctcagatcggtgccggggtgtacaaggagggcaccttccatactatgtggcacgtgacgcgcggggcggtgttaatgcataagggcaaaagaatcgagccctcatgggccgacgtcaagaaggatcttatcagttacgggggcggatggaagctggagggggagtggaaggagggcgaagaggtccaagtactcgccctggagcccgggaaaaacccccgggccgtccagacgaagcccggcctttttaagaccaataccgggacgataggcgctgtatcgctcgacttctcgcccggcacgagtgggagccccataattgacaaaaagggcaaggtggtcggcctatacggcaacggcgtggtgacccgcagtggtgcctatgtcagcgcgatcgcgcagaccgaaaaaagtattgaggacaaccccgagatcgaggacgatatcttcaggaagcgccggttgactattatggacctgcaccccggagcggggaagaccaagcgctacttgcccgccatagtgcgggaggccatcaagcgcggcttgagaactctgatcctcgcgccaacccgcgtggtcgccgccgagatggaggaggcactgcggggtctgcccatccgctaccagacgcccgccatccgggcggagcatactgggagggagatcgtagatctcatgtgccacgccaccttcaccatgcgcttattaagccccgtgcgcgtgcccaactacaacttaattatcatggacgaggcccactttacggaccccgcctccatcgccgcccgtgggtatatcagcacccgggtggagatgggagaggccgccggaattttcatgaccgctacgccccctgggagccgcgacccgttcccccagtccaacgcccccatcatagacgaggaacgagagatccccgagcgcagctggaactccggccacgagtgggtgacggactttaaggggaagactgtttggttcgtaccgagcatcaaggcaggcaatgacattgccgcctgcctccggaagaacggcaagaaggtgatccagctgtcccgcaagaccttcgacagcgagtacgtcaagactcgcacgaacgattgggactttgtggtgaccactgacatcagcgagatgggggccaacttcaaggcagagcgcgtcatcgacccacggcgctgtatgaaacccgtgatcctcaccgacggcgaggagagagtgatcctagccgggcccatgccggtcacgcacagctccgcagcccagcgccggggccgcataggccggaaccccaagaatgagaatgaccagtacatctatatgggcgaacccttggagaacgacgaggattgtgcgcactggaaagaagcgaagatgctcctggacaacatcaacacccccgaggggatcatcccgagcatgttcgagcccgagagagaaaaggtggatgccatcgacggggagtaccggttgcgcggtgaggccagaaagacctttgtggacctcatgaggcgcggggacctgcccgtatggctggcctataaggtggccgcggagggcatcaactacgccgaccggcgctggtgcttcgatgggatcaagaacaaccagatcctcgaggaaaacgtggaggtcgagatttggaccaaagagggcgagcggaagaagcttaagccgcgctggctagacgcacggatttactccgaccccctcgccctgaaggagtttaaggagtttgccgcaggccgcaagagtcttaccttgaacttaataacggagatggggagactgccgacctttatgacacagaagacgcgcgatgccctcgacaacctggccgtgctgcacaccgctgaagccggcggccgggcctacaaccatgccctctccgagctgcccgagaccctggagacactcctgctgcttacgctgctggccaccgtcactggcggcatcttcctcttcctgatgagcgggcgcggcatcgggaagatgacactgggcatgtgttgcatcattactgcctccatcctcctgtggtacgcgcagatccaaccccactggatcgccgccagcatcatcctggagttcttcctcatcgtgctgctcatccccgaacccgagaagcagcggacgccccaggacaaccagctcacctatgtggtcatagccatcctgacggtcgtggccgcgaccatggccaacgagatgggcttcctggagaagaccaaaaaggacctcggcctgggctccattgccacccagcagccggagagcaacatcttggacatcgatctgcgcccggcctccgcatggaccctgtacgcggtggccaccacgttcgtgacccccatgctgaggcacagtatcgagaactcatccgtgaacgtcagcctcactgccatcgccaatcaggcgaccgtcctgatggggcttggtaaaggctggccactctccaagatggacatcggggtgccgttgctggcgatcgggtgctacagccaagtaaacccaatcacgctcaccgccgccttactgctcctcgtggcccactacgctatcatcggccccggcctccaggccaaggccacacgcgaggcccagaaacgggccgcggccggtattatgaagaaccccaccgttgacggcatcaccgtcatcgacctcgacccgattccctacgaccccaagtttgagaagcagcttggccaggtcatgctgttaatactttgcgtgactcaggtcctgatgatgcgtaccacctgggccctctgtgaggccctgacgctggtgaccggccccatctcgactctctgggaggggaatccgggacgattctggaacacaaccatcgccgtgagcatggctaacatcttccgcggctcctacctggccggggccggcttgctctttagcatcatgaaaaacaccaccaacacccggcgcgggactggaaacatcggcgagacgctgggggagaagtggaagtcccgcctaaacgccttggggaagagcgagttccaaatatacaagaagtccggcatccaggaggtcgacagaacccttgccaaagaaggcatcaagcgcggggagaccgaccaccacgcggtgagccggggaagcgccaaactgcgctggttcgtggagcggaacatggtcacacccgaaggtaaggtggtagacctcgggtgcggccgcgggggatggagttactattgcgggggactgaagaacgtcagggaggtgaagggccttaccaagggcggccccgggcacgaggagcccatcccgatgtccacctacggctggaacctagtgcgcctgcagtctggggtcgacgtcttctttatcccgcccgagaagtgcgacaccctgctctgcgatatcggggagtccagccccaatccgacggtggaggccgggcggaccctccgcgtactgaacctcgtagagaattggctgaacaacaacacccagttttgcatcaaggtgcttaacccctatatgccctccgtgattgagaagatggaagccctgcaacggaagtacgggggggcgctcgtgcgcaatcccctaagccggaacagcacccacgagatgtactgggtgtccaatgcaagcgggaatatcgtatccagcgtaaacatgataagccgcatgctgataaaccggttcaccatgcgccacaagaaggccacgtatgaaccggacgtggacctaggaagcgggacccggaatatcggcatcgagagtgagattcccaacttagacatcatcggcaagcgcatcgagaagatcaagcaggagcacgaaaccagctggcactacgaccaggatcatccctacaagacctgggcctaccacggaagctatgagaccaagcaaaccggcagcgcctcctctatggtgaacggagtggtgcggctgctcacgaagccgtgggacgttttacccacggttacacagatggcgatgaccgacactacacccttcggccaacagcgcgtgttcaaggagaaggtagacacgcgcacccaagagcccaaggagggcaccaagaagttaatgaagatcaccgccgagtggctgtggaaggagttagggaagaagaagaccccgcggatgtgcacacgagaggagttcacccgcaaggttcgctccaacgccgccctcggcgccatcttcaccgacgagaacaagtggaagtccgcgcgtgaggccgtggaagactcccgcttctgggagctcgtggacaaggagcggaacttacacttagaggggaaatgtgagacgtgcgtgtacaacatgatgggaaagcgcgagaagaaactcggggaattcggaaaggctaaggggagccgggccatctggtacatgtggctgggggcccgcttcctggagttcgaggcactcggcttcctgaacgaggaccattggttctctcgggagaattcactgtccggggtcgagggcgaagggctccacaaactgggctacatcctgcgcgacgtgagcaaaaaggaaggcggggcgatgtacgccgacgacaccgccggctgggacacacggatcacgctcgaagacttgaagaacgaggagatggtgacgaaccacatggagggagagcataagaagctcgcggaggccatcttcaagctcacctaccagaacaaagtcgtgcgcgtgcagcggccgacgccgcggggcaccgtcatggacatcatcagtcggcgcgaccagcggggttccggccaagttggcacgtacgggctgaacacattcaccaatatggaggcgcagctgatacgccagatggaaggcgagggggtattcaagaatattcagcacctcaccgtcaccgaggaggtggccgtccagaattggttagccagagtcgggagagagcgactttcccggatggcaatctccggcgacgactgtgtggtgaagccactcgacgaccgcttcgcaaatgcattgaccgctcttaacgacatggggaagattcgtaaggacatccagcagtgggagccaagcaagggttggaacgactggacccaggtccctttctgctcccaccacttccacgagctaattatgaaggacggacgcgtgctggtggtcccgtgccggaaccaagacgagctgattggccgcgctcgtatctcacagggggctggctggtccttgcgcgagaccgcctgcctggggaaatcatacgcccagatgtggtccctgatgtatttccaccggcgggaccttcggctcgccgccaatgcaatctgcagcgccgtgccctctcactgggtcccaacgagccgcaccacctggtccatccacgccaagcacgagtggatgactaccgaggacatgctgacggtctggaatcgggtgtggattcaggagaacccctggatggaagacaagaccccagtggagagctgggaggagatcccgtacctcgggaagcgcgaagaccaatggtgcggctccctgatagggctgacctcacgggccacctgggcgaagaacatacaggcggccatcaaccaggtcaggtccctaatcggcaacgaggagtacacggattacatgccgagtatgaaaagatttcgccgggaggaggaggaggccggggtattatggtga

SEQ ID NO: 25158 - RNA, 9876 nt, synthetic construct
  misc_feature 1..9876: note = derived and/or modified CDS sequence (opt11) from DENV-2__EU482544__SS-prME
  source 1..9876: mol_type = other RNA
actgccggcgtgatcatcatgttaatccctacggtcatggcctttcacctcaccactagaaacggggagccccatatgatcgtgggtaggcaggagaagggtaagtccttactgttcaagaccgaagacggcgtgaacatgtgtaccctcatggcgatcgacttaggcgagctgtgcgaggacaccatcacctataagtgccccctactgcgccagaacgagcccgaggacatcgactgctggtgtaacagcaccagcacctgggtcacctacggaacctgtaccaccacgggcgaacacaggcgcgagaagagaagcgtggcgctggtaccccacgtcgggatgggcctcgagacccggaccgagacatggatgtcaagtgagggagcgtggaagcatgtgcagcggattgagacgtggatcctgcgccacccgggattcaccataatggcagcgattctggcgtacacgatcgggactactcactttcagcgggctcttatctttatcctgctgaccgccgtggcgccatcaatgaccatgcgctgcataggcatctccaatcgggacttcgtggagggtgtgagcgggggctcctgggttgacatcgtactagaacacgggagctgcgtgaccacgatggcgaaaaataagcccaccctggacttcgagttgatcaaaaccgaggccaagcaaccagccaccctgcgcaagtactgcatcgaggctaaactgacgaacaccactaccgagtcccgctgcccgacgcagggcgagccgagcctgaacgaggagcaggacaagcgcttcatctgcaagcactccatggtagaccggggctggggaaacggctgtggcctgttcggcaaaggcgggatcgtgacttgtgccatgttcacgtgtaagaagaatatggagggcaaggtggtgctgcccgagaacctggagtacacgatcgtcatcacgccgcacagcggggaggagcatgcggtcggcaacgacaccgggaagcatggcaaggagattaagatcaccccgcagtcaagcatcaccgaggctgagctcacagggtacggcacggtgaccatggagtgttcgccccggaccggcctggactttaacgagatggtcctgcttcagatggaagataaggcctggctggttcaccggcaatggttcctggacctccccctgccctggctgccgggtgccgacacccagggtagcaactggatccagaaggagacgctcgtgacctttaagaaccctcacgccaaaaagcaggacgtcgttgtcttggggtcgcaagagggcgcgatgcacaccgcgctcactggtgcaacggagatccagatgagcagcggcaacctgctgttcaccggccacctgaaatgccgcctccggatggacaagctgcagctgaaggggatgtcctacagcatgtgcacgggtaagtttaagattgtgaaggagatcgcagagacacaacacgggacgatcgtgatccgcgtccagtacgagggggacggctccccctgcaaaatcccgttcgaaataatggacctcgagaagagacacgtgctggggcgcttaatcaccgtgaacccgatcgtcactgaaaaagactctcccgtgaacattgaggccgagccgcccttcggcgactcctacatcatcatcggcgtggagccgggccagctcaagctgaactggttcaagaaagggtcatccatcggacagatgtttgagaccacgatgcgcggcgcgaagcgaatggcgatacttggggacaccgcctgggactttggcagccttgggggtgtcttcacctctatcgggaaggccttacaccaggtcttcggcgccatatatggggcggcgttctcgggggtgtcctggaccatgaagatattgatcggcgtcatcattacgtggatcggaatgaacagccggtcaaccagcttaagcgtgagcctcgtcctggtcggtgttgtgacgctgtacctcggtgtcatggtgcaagccgacaccggctgcgtggtgtcctggaagaacaaggaactgaagtgcggcagcgggatcttcatcacggacaacgttcacacctggacggagcagtacaagttccagcccgagtcccccagcaagttagcctctgcgatccagaaggcccacgaggagggcatatgcgggatccgctccgtgacgcgcctcgagaacctgatgtggaaacagatcacgcccgagctgaaccacatactcagcgagaacgaggtcaagctgaccataatgaccggcgacattaaggggattatgcaggccggcaagcggtcccttcgaccgcagcccacggagctcaagtacagctggaagacgtgggggaaggctaagatgctaagtaccgagagccacaaccaaacgtttctgatcgacggtcccgagaccgccgagtgcccgaatacgaaccgggcgtggaactccctcgaggtggaagactacggcttcggggtgttcagcacgaacatctggctgaagctgcgcgaaaagcaggacgtcttttgcgactccaagcttatgagcgccgccatcaaggacaaccgggccgttcatgcagacatgggttactggatcgagtccgcgctgaacgatacctggaagatggagaaggccagcttcatcgagatcaagagctgccactggcctaagagccacaccctgtggtccaatggcgtgctagagagcgaaatgataatacccaaaaacttcgccgggccggtctcgcagcacaactaccgcccgggctaccacacccagacggccggcccgtggcacctgggcaagctggagatggatttcgacttctgtgaggggactaccgtggtggtgaccgaagactgcggcaacaggggcccaagcctccgcacgaccaccgccagcgggaagctaatcaccgagtggtgctgccggtcttgtactcttcccccgctccgctatcggggcgaggatgggtgctggtacggcatggaaattcgccccctgaaggagaaagaggagaacctggtgaacagcttagtcaccgcggggcacgggcagatagataatttctccttaggagtccttggaatggccctcttccttgaggagatgctacggacccgcgtgggcaccaagcacgccatactactcgtggccgtcagcttcgtgacgctgataaccggtaacatgtcattccgggatctcggccgcgtcatggttatggtgggggcgaccatgaccgacgatataggcatgggcgtgacgtacctggccctgcttgccgctttcaaggtccgccccacttttgccgcggggttactgttgcggaagctgaccagcaaggagctgatgatggccacaatcggtatcgccctcctgtcccagtccacgatccccgagaccatattagagctcaccgatgccctggctctggggatgatggtcctcaagattgtgcgcaacatggagaagtatcagctggcggtcacaatcatggccatttcctgcgtgccgaacgctgtaatcctgcagaacgcctggaaagtgagctgtacgatactcgcagcggtctccgttagccccctgctgctcacctccagccagcagaaggccgactggatccccctggccctgaccatcaagggcctcaaccccactgccatattcctgacgaccctctcccggaccagcaaaaagcgctcctggccgctcaatgaggcggtgatggctgttggtatggtaagcatcctggcctccagcctgctcaagaatgacatcccaatgaccggccccctggtggctggcggtttgctcacggtgtgctacgtcctgaccggccgttccgccgacctagagttagaacgcgcggccgacgtgaagtgggaggaccaggccgagatctcggggagctcccccatcctgagcatcaccatctccgaggatgggtcaatgtccatcaagaacgaagaggaggaacataccctgacgatcctcatccggaccggcctgctcgtgatatctggggtcttcccggtgtccatacccatcacggccgccgcgtggtacctatgggaggtgaagaagcagcgcgctggcgtcctgtgggacgtgcccagcccgcctcccgtggggaaggccgaactagaggacggcgcctaccggatcaagcagcgcgggatcttcggctactcccagatcggtgccggggtctacaaggaggggaccttccacaccatgtggcatgtgacgcgtggggctgtgctcatgcaccgcggcaagcggatagagccctcttgggccgacgtcaagaaggacctgatctcctacgggggcggttggaagctggagggggagtggaaggagggcgaagaggtccaggtgctcgccctggaaccaggcaagaacccccgcgcggtccagaccaagcccggcctgttcaagaccaacaccggcacgattggcgccgtgagcttagatttctcccccggcacctccgggtcccccatcgtagatcggaagggcaaagtcgtggggctgtacggcaacggcgtggtcactcgtagcggggcatacgttagcgccatcgcccagaccgagaagtcaatcgaagacaaccccgagatcgaggacgacatattcagaaagaagcgcctgacgatcatggacctccacccgggcgccgggaagaccaagcggtacctgccagcgatcgtgcgcgaggctatcaagcggggcctccgcaccctgatcctcgcgccgacccgcgtagtggccgccgagatggaggaggcgctgcgggggctgcccatccgctaccagacgcccgccatccgggccgagcacaccggccgcgagatcgtggacctcatgtgccacgccaccttcaccatgcggctgctgagccccgtcagagtgccgaactacaacctcatcataatggacgaggcccacttcacggaccccgcgtcgatcgccgcccgaggctatatttctacccgcgtggagatgggggaagccgccggcatcttcatgaccgcgacgccgcccgggtcccgggacccattcccccagagcaacgcgcccatcatggacgaggagcgcgagatccccgaacggtcttggaacagcggccacgagtgggtcacggacttcaaggggaagaccgtgtggttcgtgccctccatcaaagccggcaatgacatcgccgcatgcctgcgcaagaatggcaagaaagtaatccagctgagccggaagacattcgactccgagtatgttaaaaccagagcaaacgactgggattttgtggtgacgacagacatcagcgagatgggtgccaacttccgggccgaacgcgtgattgatcccaggcgctgcatgaagcccgtgatcttaaccgacggcgaggagcgggtcatactggcagggcccatgccggtcacacactccagcgcggcccagcgccgaggccggatcgggcgcaatcccaaaaatgagaacgaccagtacatctacatgggcgagcccttggagaatgacgaggattgcgcccactggaaagaggccaagatgctcctggacaacatcaacacgcccgagggcattatcccgtccatgttcgagcccgagcgggagaaggtggacgccatcgatggagagtatagactgaggggcgaggcgcgcaagaccttcgtcgaccttatgcggaggggggaccttcccgtgtggctagcgtacagagtggccgctgagggcattaactacgccgaccgccggtggtgcttcgacgggattaagaacaaccagatcctcgaggagaatgtcgaggttgagatctggaccaaggagggagagcgcaagaagctgaaaccgcggtggctggacgcgcgcatatacagcgatcccctcgccctgaaggagttcaaggagttcgcggccggccgcaagtccttgaccctcaacctgatcacggagatggggcgcttaccgactttcatgacccagaaggcgcgggacgccctcgacaacctggccgtcttacataccgccgaggtgggcgggagagcctacaaccacgcgcttagcgagctgcccgagactctggagacactcctgctgctcacgctgctagccacggtgacgggcggcatctttctctttctgatgtcggggaagggaatcgggaagatgaccctgggcatgtgttgcatcataaccgcctcaattctactgtggtacgcgcaaatccagccgcactggatcgccgcgtcaatcatcctggagttcttccttatcgtcctgctgatccccgagcccgagaagcaacgtacgccacaggacaaccaactcacctacgtggtgatcgccatcctaacggtcgtggccgccaccatggccaacgagatgggattccttgaaaagactaagaaggatctcggactgggtagcatcaccacgcaagaaagcgagtccaacatactggacatcgatctccgcccggcgagcgcatggaccctttacgccgtggcgactaccttcgtaacgccaatgctgcggcactccatcgagaactctagtgtaaacgtgagcctcaccgcaatcgcgaaccaggccaccgtactaatggggctgggccgcgggtggcccctgtccaagatggatatcggtgtgcccctgctggccatcgggtgctatagccaggtgaatccgataaccctcacggccgcgttgctgctcttggtcgcccattacgccatcattggtccgggcctgcaggccaaggcaacccgcgaagcccagaaacgcaccgccgcggggatcatgaagaaccccaccgtggacggcatcactgtcatcgacctcgaaccaatcccgtacgaccccaagttcgagaagcagctgggtcaggtaatgctgctcgtgctgtgtgtgacccaggtcctgatgatgaggaccacctgggccctctgtgaggccctgacgctagcgaccggccccatcagtacactctgggaggggaacccgggccgcttctggaacaccaccatagcagtgagcatggccaacatcttccgcggctcctacctggcgggggccggcctccttttctctatcatgaagaacaccaccaacacccggcgcggcaccgggaacatcggggagacgctgggggagaaatggaagtccaggctgaacgctctcggcaagtcggagttccagatctataagaaatccgggatacaagaggtggatcgcaccctcgccaaggagggcatcaaacgcggggagacagaccaccacgccgtcagcagaggttccgccaaactgcgctggttcgttgagcggaatatggtgacgccggaggggaaagtcgtggacctcgggtgtggccgcggcgggtggagctactactgcggagggctgaagaacgtgcgcgaggtgaaggggctgaccaagggcgggcccggtcacgaggagcccatccccatgagcacctacggctggaacctcgtgcggctccagtccggggtggacgtcttcttcacgccaccagagaagtgcgatacgctgctctgcgacatcggcgagagcagccccaacccaaccatcgaagccggccgaaccctgcgcgtacttaacctcgtggagaattggctgaacaacaacacccaattttgcgtcaaggtgctgaacccgtacatgccctcggtgatcgagaagatggagaccctgcagcgcaaatacgggggagctctggtccgcaaccccctgagcaggaacagcacgcacgagatgtactgggtgtccaacgccaccgggaacatcgtgagctccgtcaacatgatcagccgcatgctgatcaaccggttcacaatgaagcacaagaaggccacgtacgagccggacgtggacctcggctctgggacccgtaacatcggcatcgaaaacgaaatacccaacttagacatcatcggcaagcggatcgagaagatcaagcaggagcatgagaccagctggcactacgaccaggaccacccctacaagacttgggcctaccacggatcatacgagaccaaacagacgggcagcgcgtcctcaatggtgaacggggtcgtcaagctgctcacaaaaccctgggacgtggtcccaatggtgacccagatggccatgacggacacgacccccttcggccagcagcgggtgttcaaggagaaggtcgacacccggacccaggagcccaaagaaggcacgaagaagctcatgagaatcacggccgagtggctatggaaggagcttgggaagaagaagacgccccggatgtgcacccgtgaggagttcacgcggaaggtaaggtccaacgcagccctgggtgctatcttcaccgacgagaataagtggaaatccgcccgggaggccgtcgaggattccaggttttgggaattggtggaccgggaacgcaacttacacctggaggggaagtgtgaaacgtgcgtgtataatatgatggggaagcgggaaaagaagctgggagagttcggcaaggcgaaaggcagcagggcaatctggtacatgtggctcggggcacggtttctggaattcgaggccctgggcttcctcaacgaggaccactggttctccagagggaactcgctgagcggcgtcgaaggagaaggcctccacaagctggggtacattctgcgggacgtgtccaagaaggaggggggggccatgtacgccgacgacaccgcggggtgggacacgcgcattaccctggaggacttaaagaacgaggagatggtcaccaaccacatgaagggcgagcacaagaagttggccgaggccatcttcaagctgacctaccagaataaggtcgtgcgggtgcagcgaccgacgccccgagggaccgtgatggacatcatcagccggaaggaccaacggggctccggccaagtcggtacctacggcctcaacacctttacgaacatggaggcccaactaatccggcagatggagggggagggcatcttcaagagcatccagcgtctgaccgtaaccgaggagatcgccgtccagaactggctcgcgcgagtgggccgcgagcggctgtcccgcatggccatcagcggcgacgattgcgtagtcaagcccctggatgaccggttcgcctccgccctcaccgccctgaacgacatgggaaaggtgcgaaaagacattcagcaatgggagcccagccgggggtggaacgactggacccaggtgccgttttgctctcaccatttccacgagttagtcatgaaagatggccgcgtgctagtggtcccctgccggaaccaggacgagctaatcgggcgcgcgaggatcagccagggcgcgggctggtctctgaaggagacagcctgcctcggcaaaagctacgcccagatgtggaccctgatgtacttccaccgcagagacctgcgcctggccgcgaacgctatctgctccgccgtcccctcgcactgggttcccacatcacggaccacgtggagcatccacgccaagcacgagtggatgacgacggaggacatgctggccgtctggaacagagtgtggatccaggagaacccgtggatggaggacaaaacccccgtggagagctgggaggaggtcccctacctgggcaagcgcgaggaccagtggtgcgggagcttgatcggcttgacgtcgcgggcgacctgggccaaaaacatccagaccgcgattaaccaggtacgcagcctgatcgggaacgaggagtacaccgactacatgcccagcatgaagcggttccgcaaggaggaggaggaggccggcgtgctctggtga

SEQ ID NO: 25159 - RNA, 9876 nt, synthetic construct
  misc_feature 1..9876: note = derived and/or modified CDS sequence (opt11) from DENV-2__EU482545__SS-prME
  source 1..9876: mol_type = other RNA
accgccggggtgattgtcatgctgatacccaccgccatggcgttccacctcacaacgcggaacggggaaccgcatatgatcgtgggccgacaagaaaaagggaagtccctgctattcaagacagaggacggcgtcaacatgtgcaccctcatggccatcgatctgggggagctgtgtgaggacaccataacctacaagtgtcccctcttacgccagaacgagcccgaggacatcgattgttggtgtaacagcaccagcacttgggtcacctacgggacctgcactaccacgggtgaacatcggcgcgaaaagcgctccgtggcgctggtgccccacgtcggcatgggcctcgaaacccggaccgagacctggatgagctccgagggggcctggaaacatgtccagcggatcgagacttggatcctgcgccaccccggcttcaccatcatggccgccatcctggcgtacaccattggcactacccactttcagcgtgccctcatcttcatcctgttaaccgccgtggcgcccagcatgacgatgcgctgtatagggatctccaaccgggatttcgtcgagggcgtgagcggcggcagctgggtcgacatcgtgctggaacacgggagctgcgtgaccacaatggccaagaataagcccacactggacttcgagctgatcaagaccgaagccaagcaacccgctaccctcagaaagtactgtatcgaggctaagctgacgaatacaaccaccgagtcccggtgcccaacgcaaggcgagcccagcctgaacgaggagcaggacaagcgtttcatctgcaagcatagtatggtagaccgaggctgggggaatggctgcgggctgttcggcaagggcggaattgtgacctgcgctatgttcacatgcaagaaaaatatggaaggcaaaatcgtgcagcccgaaaacctggagtacaccatcatgattacgcctcacagcggcgaagaacacgccgtgggcaacgacaccggaaagcacggtaaggaaatcaagatcaccccgcaaagttctatcaccgaggccgagctgaccgggtacggcacggtgaccatggagtgctcaccgagaacaggcctcgacttcaacgagatggtgctgctgcagatggaggacaaggcttggcttgtgcaccggcagtggttcctggacctccctctcccctggctaccgggagctgatacccaggggtcaaactggatccagaaggagaccctggtgaccttcaaaaacccccacgcgaagaagcaggacgtcgtggtcctcggatctcaagagggcgccatgcacaccgccctgacaggggccacggagatacagatgagcagcggcaacctccttttcaccggccacctgaagtgccgccttcggatggacaagctgcagctgaagggaatgtcctatagcatgtgtaccggcaaattcaagatcgtgaaagagatcgcagagacccagcacgggacgatcgtcattcgcgtgcagtacgagggagacggctccccttgcaagattcccttcgagataatggacctggagaagcggcacgtactcggccgcctgatcactgtcaacccgatcgtgactgagaaggacagccccgttaacatcgaagcagaaccgcccttcggcgactcttacatcatcatcggtgtcgagccgggccagctgaagctcaactggttcaagaaagggagcagtatcggccagatgttcgagacaacgatgcgcggcgccaagcggatggccatcctgggtgacaccgcatgggacttcggttcgttagggggcgtgttcacctcagttggaaaggccctccatcaggtcttcggcgcgatctatggtgcagcattcagcggggtgtcctggaccatgaaaatattgatcggcgtgatcattacgtggattgggatgaacagccgctcaacctcgctatcagtgagcctggtgctcgtgggcgtcgtgaccctgtatctgggagccatggtacaagctgactccggctgcgtcgtgagctggaagaacaaggagctcaaatgcggctctggaatcttcatcaccgacaatgtacatacgtggaccgagcagtacaagttccagcccgagagccccagtaagttggccagcgccatccagaaggcgcacgaggagggcatctgtggtatccgtagcgtcacccgcctggagaacctcatgtggaagcagatcacccccgagctaaaccacattttgtcagagaacgaggtgaaactcacgatcatgaccggtgacatcaagggaataatgcaggcgggcaaacggagcctccgcccgcagcctaccgagctgaaatattcctggaaaacctggggcaaggctaagatgttatccaccgagtcccataaccagaccttcctgatcgatgggcccgagaccgccgagtgtcccaacaccaaccgggcctggaatagcctggaggtggaggactacggctttggggtcttcactaccaacatctggctcaaactgcgcgagaagcaggacgtgttctgcgactcgaagctgatgagcgccgccattaaagacaaccgggccgtacacgccgacatgggctactggatagagtcggcgcttaacgatacgtggaaaatggagaaggccagctttatcgaggtcaagtcctgccactggcccaaatcgcacaccctgtggtccaatggcgtgctggagagcgagatgatcatacccaagaactttgccgggcccgtgtctcagcacaactaccgcccgggctaccacacgcagacggccggtccctggcacctcggcaagctggagatggacttcgacttttgcgaggggaccaccgtggttgtgaccgaggactgcggcaaccgtggccctagcctgcggacgacaaccgcctctgggaaacttatcaccgagtggtgctgtcggtcctgcacactgcccccgctgagatatcgtggggaggatgggtgctggtatggcatggagatccgtcccctcaaggagaaggaggagaatctagtcaatagtctggtgaccgccgggcatggtcagatcgacaacttctccctcggcgtgctggggatggccctatttctcgaggagatgctgcggacccgcgtgggcacaaagcacgctatcttgctcgtggctgttagcttcgtcacgctcatcaccgggaacatgtccttccgggatctcgggcgcgtaatggtgatggtcggcgcaacaatgacagacgacatcggcatgggagtgacgtacctcgcgctgctggccgcgtttaaggtccgccccacgtttgcagcgggtctattgttacgtaagctcacctcaaaggaactcatgatggccaccatcggcatcgctctgttgagtcagagcacgatccccgagaccattttggaactcaccgatgcgctcgctctaggtatgatggcactgaagatcgttaagaacatggagaagtaccagctggccgtgactattatggcaatctcctgcgtgccgaacgcggttattctgcagaacgcctggaaggtgagctgcacgatcctggccgcggtaagtgtaagtcctcttctgctcacctccagccaacaaaaagcggactggatccccctcgccctcaccatcaagggcctgaaccccaccgccatcttcctcactaccctgtcccgcaccagcaaaaagcggtcctggccgctcaatgaggccatcatggctgtgggcatggtgagcatattagcgtccagtctgctgaagaacgatatccccatgaccggacccctcgtagccggcgggctcctgacggtgtgttacgtcctcaccggccgaagcgccgacctggagcttgagcgggcggctgatgtgaagtgggaggaccaggcggagatcagcgggagctcccccatattaagcattaccatctccgaggacggtagcatgtcgatccgcaacgaggaagaggagcaaaccttgacgatcctgattcggaccggcttactggtcatatctggggtcttcccggtgtctatccctgtgaccgctgccgcttggtatctgtgggaggtcaagaagcaacgtgccggagtactctgggatgtgccatcgccgccacccgtcgggaaggcggagctggaggacggtgcataccggatcaagcagcgcgggatcctgggctactcgcagatcggcgccggggtgtacaaggagggtaccttccacaccatgtggcacgtgacaagaggtgcggtactgatgcaccgcggtaagcggatcgagcccagctgggcggatgtgaagaaagacctggtgtcatacgggggcgggtggaaactggaaggggagtggaaggagggggaggaggtccaggtactcgcgctggagcccgggaagaacccacgagcggtacagaccaagcccggcatcttcaagaccaacacggggacgattggcgccgtcagcctggacttttcccccggcacaagcgggagccccattgtggaccgcaagggcaaggtggtcggactatacggcaacggcgtggtgacccgttcgggggcttacgtcagtgccatcgctcagaccgagaagtccatcgaggacaaccccgagatcgaggacgatattttccggaaaaagagactgacgatcatggacctgcacccaggagcagggaagaccaaacggtacctacccgcaatcgtgcgagaggccatcaagaggggtctgagaacgctgatcctggcgcctacgcgcgtggtcgcggccgagatggaggaggccctgcggggactgcccatccgctaccaaacgcccgccattcgcgcggagcacactggccgagagatcgtggacctgatgtgccacgccaccttcaccatgcggctcctgagccctgtgcgcgtcccgaactacaacctgatcatcatggacgaggcccactttacggaccccgcctccatcgccgcgcgggggtacatatctacccgcgtggagatgggggaggccgcaggcatcttcatgaccgcgacgccgcccgggtcccgggacccgttcccccagtcgaacgcgccaataatggacgaggagcgggaaattccggagcgatcctggaactctggccacgagtgggtgacagacttcaagggcaagactgtctggttcgtgccgtccatcaaagctggaaacgacatcgccgcctgcctgcgcaagaacggcaagaaagtgatacagttgagcaggaagacatttgactcagagtacgtcaagaccagggctaacgactgggactttgtggtgacgaccgatatcagcgagatgggggcgaacttcaaggccgaacgagttattgatccacgccggtgcatgaagcccgtgatcctgacggacggcgaggagcgcgtcattctcgccggtcccatgccggtcacccactccagcgcggcccagcggcgcggccgcattgggcgtaaccccaagaacgagaacgaccagtacatctacatgggggagcccctagagaacgacgaagactgtgcgcactggaaagaggccaagatgctgcttgacaacatcaacacgcccgagggcatcatcccgtccatgttcgagcccgagcgcgagaaggtggacgctatagacggagagtatcgacttagaggcgaggcccgaaagaccttcgtcgacctgatgcgccgcggggatctccctgtctggctggcctacaaggtggccgcggagggcatcaactacgccgaccgacggtggtgcttcgacgggatcaagaataatcaaattctggaagaaaacgtagaggtcgagatctggacgaaagagggcgagcgcaagaagctcaagccgcggtggctggacgccagaatctacagcgacccccttgcgctcaaagagttcaaggagttcgccgccggccggaagtctctgaccctaaacctcatcactgaaatggggcgtctgcccaccttcatgacccagaaggcccgtaacgccctggacaatctcgcggtgttgcacaccgccgaggccggcgggaaggcctacaaccacgccttaagcgagctccccgagacgctggagacccttctactgctgaccctcctggcaaccgtcacgggcgggatcttcctgttcctcatgtccgggaaaggcatcgggaagatgactctgggcatgtgctgcattatcacggccagcatcctgctatggtatgctcagattcagccgcattggatagcagcttccataatcctggagtttttccttattgtgctcctgatcccagagcccgagaagcagcggacgcctcaagacaaccagctgacctacgtggtcatcgcgatcctcacggtggtcgccgccaccatggccaatgagatggggttcctggagaagaccaaaaaggaccttggcctcggctccatcaccacacaggagagcgagtccaacatactggatatcgacctgcggccggcttctgcgtggacactctacgcagtcgcgacgacctttgtgacgcctatgctgcgccactcaatcgaaaacagcagtgtgaacgtaagcctaactgccatagcaaaccaggccaccgtgctcatggggctgggaaaagggtggcccctgagcaaaatggacatcggcgttcccctcctggccatagggtgctacagccaggtcaacccaatcaccctgactgccgccctcctgctcctagtggcgcactatgcgatcataggccccggcctgcaggccaaggccactcgggaggcccagaaaagggcggcagcaggaatcatgaagaaccctaccgtggacggcatcaccgtcattgatctggagcctatcccgtacgaccctaaattcgaaaaacaattgggccaggtcatgctgctgatcttgtgcgtcacacaggtgttaatgatgcggaccacttgggccctgtgcgaggcccttaccctggcgacggggcccatctccaccctgtgggagggcaatcccggaagattctggaataccaccatcgccgtgagcatggccaacatattccgcggctcctacctcgcgggggcggggctgctgttcagtatcatgaaaaacacgacgaacacaaggagggggaccggcaacatcggcgagacgctcggggagaagtggaagtccagactgaacgcgctgggtaagagcgagttccaaatatacaagaaatcggggatccaggaggtggaccgcaccctcgccaaggaggggatcaagcgcggtgaaaccgaccaccacgccgtctctcgcggctccgccaagctgcggtggttcgtcgagagaaacatggtgacccccgagggcaaggtcgtagacctggggtgcggccgcgggggctggagctactactgcgggggcctcaagaacgtccgcgaggtcaagggcctcaccaagggtggccccgggcacgaagaacccatccccatgtccacatacggctggaacctggtgcgtctacagtccggggtggacgtgttctttaccccgcccgagaagtgcgacaccctactgtgcgacatcggcgaaagtagccccaaccccacgatcgaggcgggccgaaccctgcgggtgctaaacctggtggaaaactggctgaataacaacacccagttctgcatcaaggttctgaacccgtacatgccctcagtgatcgagaagatggagactctgcagcgcaagtacgggggcgccctcgtaagaaacccgctatcccgcaacagtacccatgaaatgtactgggtctcgaacgcaacggggaacatcgtgagctccgttaacatgatcagccggatgctgatcaaccgttttaccatgaagcacaagaaggccacgtacgagccggacgtcgatctgggcagcgggacccgaaacatcggcatcgagtcggagattcccaacttagacatcataggcaagcgcatagagaagatcaagcaggagcacgagacctcctggcactacgaccaggaccacccctataagacctgggcataccacggaagctacgagaccaagcagactggctcggcgagctccatggtgaacggggtggtccgtctgctgacgaagccctgggatgttgtgccaatggtcactcagatggccatgacagacaccacgccctttggtcaacagcgggtgttcaaggaaaaggtggatacgcggacccaggagcccaaggagggcaccaagaagctcatgaagatcacggccgagtggctgtggaaggagctcgggaagaagaagacaccccgcatgtgtactcgcgaagagttcactcggaaggtccgcagcaacgccgcactcggagcaatctttacggacgagaacaagtggaaatccgcccgtgaggccgttgaggacgggcgcttctgggagctggtggaccgggagcgaaacctgcacctcgagggcaagtgcgagacctgcgtctacaacatgatgggtaaacgggagaagaagctgggcgagttcggcaaagccaaggggagtagggcgatatggtatatgtggctcggcgcccggttcctggagttcgaagccctcggtttcctgaacgaagaccattggttctcgaggggcaacagcctcagcggggtggaaggcgagggtctgcaccggttagggtatatcctccgagatgtgtccaagaaggagggcggggccatgtacgccgacgataccgcgggctgggacactcgcatcacattagaggacctgaagaacgaggagatggtgaccaatcacatgaagggggaacacaagaaactcgccgaagccatttttaagctgacttaccagaacaaagtggtccgcgtacaacggcctacgccccggggcacggtgatggatatcattagccggcgcgaccagcgaggctccgggcaagtcggcacgtacgggctgaacaccttcaccaacatggaggcgcaactcatccggcagatggagggagagggcatcttcaagtccatacagcaccttactgtgaccgaggagatcgccgtgcagaactggctagcgcgcgtcgggcgggaacgcctctcacggatggcaatctctggcgacgactgcgtagtgaagcctatcgatgaccgcttcgcgtccgccctgaccgctctgaacgacatggggaaggtccggaaggacatccagcaatgggagcccagccgcggctggaacgactggactcaggtgccgttctgctcgcaccacttccacgagctcgtgatgaaggatgggcgggtcctggtggttccatgtcgcaaccaggacgagctgatagggagggcgcgcatcagccagggcgccggatggtccctcaaggaaaccgcctgcctgggtaagtcttatgcccagatgtggaccctgatgtacttccaccggcgcgatctccggctggccgccaacgccatatgctccgcagtccctagtcactgggtacccacctcccgcactacgtggagcatccacgccaagcacgagtggatgacgaccgaggatatgctggcagtgtggaaccgggtttggatccaagagaatccgtggatggaggacaagacccccgtcgagtcctgggaggaggtgccctacctcgggaagagagaggaccaatggtgcggcagcctgatcgggctgaccagccgggccacgtgggctaagaacatccagaccgcgatcaaccaggtacgctccctgattggtaacgaggagtacaccgactacatgccaagcatgaagcgctttcggcgggaggaggaggaggccggcgtgctgtggtga

SEQ ID NO: 25160 - RNA, 9876 nt, synthetic construct
  misc_feature 1..9876: note = derived and/or modified CDS sequence (opt11) from DENV-2__EU482546__SS-prME
  source 1..9876: mol_type = other RNA
actgccggtgtcatcgttatgctgatccccaccgtcatggcgttccaccttaccaccagaaacggagagccccatatgatcgtgggccgccaggagaaggggaagagtttgctgttcaagaccgaggacggcataaacatgtgcaccttgatggctatcgacctgggggagctgtgcgaggacaccataacctacaaatgccctctacttaagcaaaacgagcccgaggatatcgactgctggtgcaacagcaccagcacatgggtaacctacgggacctgcaccacgacgggcgagcaccgccgcgaaaagagatccgtcgccctcgtgccccatgtcgggatgggtctcgaaacccggaccgaaacctggatgagctctgagggggcctggaagcacgtgcaaaggatcgagacgtggatactgcggcacccggggttcaccataatggcggccatcctagcgtatacgatcggtactacgcactttcagcgcgccctcatcttcatcctgttgacagccgtagccccctcgatgaccatgcgatgcatcggaatctccaaccgcgactttgtggaaggggtgagcggcggctcttgggtcgatatcgtcctcgagcacggctcttgcgttaccacgatggcgaagaacaaacccactctggacttcgaactgatcaagaccgaagccaagcagccagccaccctccggaaatattgcatcgaggccaagctgacgaataccaccaccgagtccaggtgcccgacgcaaggcgagcccagcttaaatgaggaacaggacaagcggttcatctgcaagcattcaatggtggaccgtggctgggggaatggctgtgggctgttcggcaagggcgggatagtgacctgcgctatgttcacgtgcaagaaaaacatggagggcaaggtagtccagccagagaacctggagtacacaattgtcatcaccccccacagtggagaggagcatgcagtgggcaacgataccgggaagcacggcaaggaaatcaagatcaccccgcagtccagcattaccgaggccgagctgacagggtacggcacagtgaccatggaatgcagcccccggaccggcctcgacttcaacgagatggtcctattgcaaatggaggataaggcgtggctcgtacaccgacagtggttcctggatctgcccctcccctggctgcccggagccgacacccagggaagcaactggatccagaaagaaacgctggtgaccttcaagaaccctcacgctaagaagcaggacgtcgtggtcctcgggtcccaggagggcgcgatgcataccgccctgaccggagccacggagatccagatgtcgagtggcaacctcctgttcaccggtcacctgaagtgtcggctgcgtatggacaagctccagctgaaggggatgtcctactcaatgtgcactggtaaattcaagattgtgaaggaaatcgccgaaacgcagcacgggacgatagtcatccgggtacagtacgagggcgacggctccccatgtaagatcccattcgaaatcaccgatttggagaagaggcatgtactcggtcggctaatcaccgtgaacccgattgttaccgaaaaggactcccctgtgaacatcgaggccgaaccacctttcggcgactcctacatcatcatcggggtggagcctggccagcttaagcttaactggttcaagaagggtagctcgatcggccagatgttcgagacgaccatgcgcggcgcgaagagaatggccatcttaggcgacaccgcctgggattttgggagcctcggcggggtcttcacctccatcgggaaggctctccaccaggtgttcggggccatctatggcgcagccttcagcggagtgtcctggacgatgaagatcctgatcggcgtcattataacttggatcgggatgaatagtcggtccactagcctgtccgtgagcttggtgctcgtgggcgtggtaaccctgtacttgggggccatggttcaggcagactccggctgcgtggtttcatggaagaacaaggaactcaagtgcggctccgggatcttcatcacagacaacgtacatacctggaccgagcagtataagttccagcccgagagccccagcaaactggcctccgccatccaaaaagcgcacgaggaaggcatatgcggaatccgcagcgtgacccgactggagaacctcatgtggaagcagataacacccgagttaaaccacatcttgagcgagaacgaggtgaaattaactatcatgaccggcgacatcaaggggatcatgcaggccggcaagcgcagcctgcgtccacagcccacggagctgaagtactcctggaaaacgtggggtaaagccaagatgttaagcacggagtcccacaaccagaccttcctaatcgatggacccgagaccgcggagtgtccgaacacaaaccgcgcatggaactcgcttgaagtagaggactacggtttcggggtgtttaccaccaacatctggctaaaattacgggagaagcaggacgccttctgcgactccaagctgatgagcgccgccatcaaggacaaccgcgcggtgcacgccgacatgggatactggattgagtccgccctcaacgatacctggaagatggagaaggcctcgtttatcgaggtcaagtcctgccactggcccaaatcgcacaccctgtggtccaatggtgtgcttgaatccgagatgatcattcccaagaactttgccgggccggtgtcccagcacaaccaccggcctggctaccatacgcagaccgcggggccctggcatctcggcaagctggaaatggacttcgacttctgcgagggaacaaccgtcgttgtgaccgaggactgtggcaacagaggccccagcttacggacaacaaccgcttccgggaaactcatcactgagtggtgctgccgatcgtgtaccctgcccccgctgcggtaccgcggcgaggacggatgctggtatggcatggagatccggcccttgaaagagaaggaggagaacctggtcaacagtctcgtgaccgccgggcacggtcaaattgataatttctccctcggcgtgctggggatggccctgttcctcgaggagatgttgcgcacccgggtgggaacgaagcacgcgattctgctcgtggccgtgagcttcgtcaccctgattaccgggaacatgagtttccgtgacctgggacgagtgatggtcatggtcggggccaccatgaccgacgacatcggcatgggcgtcacctacctcgccctgctggccgccttcaaggtgcgacccaccttcgcagccgggctactgttaagaaaattgacttcaaaggagctgatgatggccaccatcgggatcgccctgctctcccagagcaccatccccgagacgatcctggagttaaccgacgcgttggctctggggatgatggtcctgaagatagtccggaacatggagaagtaccagctggcggtgaccatcatggccatctcctgcgtcccgaacgctgtgatcctgcagaacgcgtggaaggtaagctgcaccatactggcggcggtctccgtgagccccctcctgttaacctccagccagcaaaaggccgattggatccctctcgcgctgacaatcaagggtctaaaccccacggccatattcctcactaccctttcccgcacatctaagaagcgatcctggccgctgaacgaagccatcatggccgtcgggatggtcagcatcctcgcctccagcctgctgaagaacgacattcccatgacgggacccttggtggcgggcgggttactgacagtctgttacgtgctcaccggccggagcgccgacctggaactggagcgggccgcggacgtgaagtgggaagatcaagcagagatttccgggagcagtcccatcctctccatcaccatctctgaggatggctccatgtccatcaagaacgaggaggaggagcagacgcttaccatcctgatccgcactggactactcgtcattagcggggtgttccctgtgtccattcccatcacagccgccgcctggtacctctgggaggtcaagaagcagagagccggcgtgctctgggatgttcccagcccgccgcccgtcggtaaggccgaactggaggacggagcgtacaggatcaagcagcgggggttcctgggctattcccagataggagccggcgtgtacaaagagggaaccttccacacgatgtggcacgttacccgcggggccgtcctcatgcaccgcggcaagcgcatcgagcccagctgggccgacgtgaagaaagaccttatctcctacggcggcggctggaagctggagggggagtggaaggagggcgaggaagtgcaggtcctcgccttggagcctgggaagaacccgcgggcggtgcaaaccaagcccgggatcttcaaaacaaatacgggtaccataggcgccgtcagtctcgacttctccccaggcaccagcgggtcccccatcgtggaccgaaagggaaaggtggtggggctctacggcaacggcgtcgtgacccggagtggggcttacgtgtccgccatcgcgcagacggaaaagtccatcgaggataaccccgagatcgaggacgatatctttcgcaagaagcggctcaccatcatggacttacaccccggggctgggaagacgaagcgctacctccccgccattgtccgggaggccataaagcggggcctgcggaccctgatcctggccccgacgcgcgtggtcgccgcggagatggaggaggctctccgcgggctgcctatccggtatcagacccccgcaatccgcgccgagcataccggacgcgaaatagtggacctgatgtgccatgcaacattcacgatgcgactccttagccccgtgagagtgccgaactacaatctgattatcatggacgaggctcacttcaccgaccccgcatccatcgctgcacgcggctatatctcaacgcgggtcgagatgggggaggctgccggcatcttcatgactgccaccccgcccgggtcacgcgatccgtttcctcagagcaacgcacccatcatggacgaggagcgggagatcccagagcgctcctggaactccggccacgagtgggtgactgacttcaaggggaagacggtatggttcgttccgtccatcaaggcgggcaatgacatcgccgcctgcctccgtaagaacggcaagaaggtgatccagctctcgcgcaagaccttcgacagtgaatacgtgaagacgcgggcgaacgactgggacttcgtcgtgactaccgacatcagcgagatgggcgccaacttcaaagcagagagggtgatcgatccccggcgatgtatgaagcccgttatcctgacggatggcgaggagcgggtgatcctcgccgggcccatgccggttacacattcgtcagccgctcagcgccgggggcgcatcggccgtaaccccaagaacgagaacgaccagtacatctacatgggcgagccgctggagaacgacgaagactgtgcccattggaaggaggcgaagatgctgctagacaacattaacacacccgagggcatcatcccatccatgttcgagcccgagcgggagaaggtcgacgccatcgatggggaataccgcctgagaggcgaggccagaaagacctttgttgaccttatgagacgcggtgacctccccgtgtggctggcctacaaggttgcggctgaaggcatcaattacgcggaccggaaatggtgcttcgacgggatcaaaaacaaccagatactggaggagaatgtggaagtggagatctggaccaaggagggcgaacggaagaagctcaagccgcggtggctagatgcccgcatctactctgacccgctagcactcaaggaattcaaggagttcgcggccgggcggaagtccctgacgctgaacctgatcaccgagatggggcgcctgcccaccttcatgactcagaaggcccggaatgctctggacaacctcgccgtcctgcacacggcggaggccggcgggcgcgcctacaaccacgccctgagcgagctcccggagaccttagagacgctactactgctgacccttctggccactgtgaccggcggcattttcctgtttctcatgagcgggaagggaatcgggaagatgactctgggcatgtgctgtatcataaccgcttcgatcctcctctggtacgcccagatccagccgcactggatcgccgcctccatcatcctggagttctttctgatcgtcctcctgatacccgagcctgaaaaacagcggacgccccaagacaaccagctcacttacgtggtgatcgccatcctgacagttgtggcagcgaccatggcaaacgagatggggttcctagagaagacgaagaaggacctgggcttaggatccatcacgacccaagaaagcgagtctaacatcctggacatagacttgcgcccggccagcgcctggacactctacgcggttgccacgacatttgttacccccatgctgcggcattcaatcgagaacagctctgtgaacgtgagcctgaccgccatcgccaaccaggcgacagtcttaatgggactaggcaaggggtggcccctcagcaagatggacatcggcgtgccgctcctggccatcgggtgttactcccaggtgaaccccatcacacttaccgccgcgctcctactgctcgtcgcccactacgcgataatcggacccggcctccaggctaaggccactcgcgaggcccagaagagagccgcggccgggatcatgaagaaccccaccgtggacggcatcactgtgatcgacctggagccaatcccatatgaccccaagttcgagaagcagctcgggcaggtcatgctgctaatactttgcgtgacccaggtgcttatgatgcgcacgacctgggcactttgcgaggccctcaccttggccaccggccctataagtacactatgggaggggaacccaggccggttctggaacaccacgattgcggtcagtatggccaacatcttccgcggcagctacttggccggggccggcctcctgttcagcatcatgaagaacacaacaaacacccgccgggggacaggcaatatcggcgagaccctcggagagaagtggaagtcccgtttgaacgcgctgggaaagagcgagttccaaatatataaaaagtccggcatacaagaagtcgaccggaccctcgccaaggagggcatcaagcgcggtgaaaccgaccaccatgcagtcagccggggctctgccaaattacggtggttcgtcgaacggaacatggtaactcctgagggcaaggtggtcgacttagggtgcggtcgcgggggttggagctactactgcgggggactaaagaacgtgcgggaggtgaagggattgaccaaaggcggccccgggcatgaggagcccatccccatgtccacctacggctggaacctagtccgtctgcagagcggggtggacgtgttcttcaccccgcccgagaagtgcgatacgttactgtgcgacatcggcgagagctcccccaaccccacgatcgaggcaggccgtaccctccgcgtcctgaacctggtggagaattggctcaacaataacacgcagttctgcatcaaggtgctgaacccgtacatgccaagcgtaattgagaagatggaaacacttcagcgcaagtacgggggcgcgctcgtgcgcaatcccctttcccggaacagcactcacgagatgtactgggtatctaacgccaccgggaacattgtcagctccgtgaatatgatcagcagaatgttgatcaaccgtttcaccatgaagcacaagaaggctacctacgagccggacgtggacctgggctccggaactagaaacatcggcatcgaatccgaaatccctaacctcgacattattggtaaaagaatcgaaaagatcaagcaggagcacgagacatcgtggcactacgaccaggaccacccctacaagacctgggcctaccacgggtcgtacgagaccaagcagacgggcagtgccagctccatggtcaatggggtggtgcggctgctgaccaagccttgggacgtcgtgccgatggtgacccagatggcgatgactgacacgacgcccttcggccagcagcgcgtgttcaaggagaaggtggacacccggacccaggagcccaaagagggcacgaagaaattgatgaaaatcaccgccgaatggctgtggaaggagttagggaagaagaaaacgcctcgggtgtgcacccgcgaggagttcacgagaaaagtccggagcaatgccgccctcggcgcaatattcacggacgagaacaagtggaagagcgcacgagaggcagtggaggacggccggttctgggagttagtggaccgcgaacggaacctgcacctagagggcaagtgcgagacctgcgtctataacatgatgggtaagcgcgaaaagaagcttggcgaattcggcaaggccaagggttcgcgcgccatctggtacatgtggttgggcgcgcgcttcctcgagttcgaggccctggggttccttaacgaggaccactggttcagtagaggcaatagcctcagcggggtggaaggcgagggcctgcaccgcctggggtatatcctccgagacgtaggcaagaaagagggtggcgccatgtacgccgacgacacggcggggtgggacacgcgcataaccctggaggatctgaagaacgaggagatggtgacgaaccatatgaaaggagagcacaagaagctcgcagaggccatctttaagctgacctaccagaacaaggtggtccgggtgcagcgccctacgccgcggggcaccgtaatggacatcatctcccgccgggaccaacgcggatcgggacaggtcggcacctacgggctgaacactttcactaatatggaggcgcagcttatccgtcaaatggagggggaaggcatcttcaagtccattcaacacctgaccgccaccgaggagattgccgttcagaactggcttgctcgagtgggcagggagcggcttagccgcatggcgatctccggggacgactgcgtcgtgaagcccatcgacgaccgattcgccagcgccctgaccgccctgaacgacatgggtaaggtgcgcaaggatatccaacagtgggagccctcccgggggtggaacgattggacgcaggtcccgttctgctctcaccacttccacgagctggtgatgaaggacggccgtgtccttgtcgtgccatgccggaaccaggacgaactgataggccgggcgcggatctcccagggagcaggctggagcctcaaggagacggcatgcctggggaagtcctacgcgcagatgtggaccctgatgtacttccatcgccgggacctccgcctggctgcaaacgcaatctgcagcgccgtgccgtcccactgggtgcccacaagccggaccacgtggtccatccacgcgaagcacgagtggatgaccaccgaggatatgctggcggtctggaaccgcgtgtggattcaggagaacccatggatggaggacaagacccccgtcgagagctgggaagaggtgccctacttggggaagcgggaggaccaatggtgcggctccctgatcggccttaccagccgcgccacgtgggccaagaatatccagacggccatcagccaagttagatccctcatagggaacgaggagtacaccgactacatgccaagcatgaagcggttccgccgggaggaggaggaggccggcgtattgtggtga

SEQ ID NO: 25161 - RNA, 9876 nt, synthetic construct
  misc_feature 1..9876: note = derived and/or modified CDS sequence (opt11) from DENV-2__EU482550__SS-prME
  source 1..9876: mol_type = other RNA
accgccggtgtgatcatcatgctcatccccaccgccatggcgttccacctcaccacccgcaacggggagccccatatgatcgtgggtcggcaggagaaagggaagtccctgctgttcaagactgaggacggcgtgaacatgtgcacgctcatggccatcgacctgggtgagctgtgtgaagacacaatcacatacaagtgccccctcctccggcagaacgagcccgaggacatcgactgctggtgcaacagcacaagcacctgggtgacctacgggacctgtaccaccacgggggagcacaggcgcgagaagcgttccgtcgccctggtgccccacgttgggatgggtctcgagaccagaaccgagacctggatgagcagcgagggggcctggaagcacgtccaacgtatagagacctggatcctgcgccatccgggcttcaccatcatggccgcgatcctcgcctataccatcgggaccacccacttccagcgggcgctcatcttcatcctgctgaccgccgtggcgccaagcatgaccatgcgctgcatcggcatctctaaccgggacttcgtggagggggtgagcggaggctcctgggtagatattgtgctcgaacacgggtcttgtgtgaccacgatggccaagaacaagcccaccctggacttcgaactgatcaagacagaagccaagcagcccgcaaccctccgcaagtattgtattgaggccaagctgacgaacaccaccacagagtcccggtgcccgacgcaaggcgaacccagcctgaacgaggagcaagacaagcgcttcatctgcaagcactccatggtagaccgggggtggggtaatggctgtggcctcttcggcaagggcgggatcgtgacatgcgccatgtttacgtgcaagaagaacatggagggcaaggtggttctacccgagaacctggagtacaccatcgtaatcaccccacacagcggggaggagcatgccgtcggcaacgacaccgggaagcacggcaaggaaatcaagatcactccgcagtctagcatcaccgaggccgagctcacggggtacggcactgtgaccatggaatgctctccccggaccggtctcgacttcaatgagatggtgctgctccagatggaggacaaggcttggctggtccaccggcagtggttcctagacctcccactgccctggttaccgggtgccgacacccagggcagcaactggatccaaaaggagacgctcgtgaccttcaagaacccccacgcgaagaagcaggacgtggtcgtgctggggtcccaggagggtgccatgcacaccgccctgaccggggccacggagatccagatgagcagcggcaacctactgttcaccgggcatctgaagtgccggctccggatggacaagctgcagctgaaggggatgtcctacagcatgtgtaccggcaagttcaagatcgtcaaagagatcgccgaaacccagcacggaacgatcgtgatccgcgtgcagtacgaaggcgacggatcaccatgcaagatcccctttgagatcatggacctcgagaagcggtacgtcctcgggcgcctgataaccgttaaccctatcgtgaccgagaaagacagccccgtcaacatcgaggcggagccgcccttcggcgactcctacatcatcatcggagtggagccgggccagttaaagcttaactggtttaagaagggcagctccatcggccagatgttcgagaccacgatgcgcggcgccaagcggatggccatcctgggagacaccgcctgggacttcggcagccttgggggcgtgttcacctccatagggaaggccctgcatcaggtcttcggagcgatctacggcgccgcgtttagcggggtgtcctggaccatgaagatcctgatcggcgtcatcatcacatggatcggcatgaattcacgcagcaccagcctgtccgtttctctcgtgttagtcggcgtcgtgaccttgtacctcggggtgatggtccaagccgactccggctgcgtggtgagctggaaaaacaaggagctgaagtgtggctccggtatcttcatcaccgacaacgtccatacgtggaccgagcagtataagttccaacccgagagtccctctaagctggcgagtgccatccaaaaggcccacgaagagggtatttgcggtatccggagcgtgacccgcttggaaaacctgatgtggaagcagatcacgcccgagctgaaccacatcctcagtgaaaatgaagtgaaattgacgatcatgacgggcgacattaaagggattatgcaggccggcaagcggagcctgaggccgcaacccaccgagctgaagtactcctggaagacctgggggaaggccaagatgcttagcacggagagtcacaaccaaaccttcctgatcgacgggcccgaaaccgcggagtgccctaacaccaaccgggcctggaactcgctcgaagtggaggattacggcttcggggtgttctctacgaacatctggctcaagctccgcgaaaagcaggacgtgttctgcgacagtaagctcatgtccgccgccatcaaggataaccgggccgtacacgctgacatgggctactggatcgagagcgccttaaacgatacctggaagatggagaaggcctcattcatcgaagtcaagagctgccactggccgaagtcccacaccctctggagcaacggtgtgctcgagagcgagatgatcatacccaagaacttcgccgggcccgtcagtcagcacaactacagaccgggctatcacacccagaccgccgggccctggcacttaggtaagctagagatggacttcgacttctgtgaggggacgaccgtggtggtcaccgaagactgcggcaaccggggcccctccctccgcaccacgaccgcgtccgggaagctgatcaccgagtggtgttgccgtagctgcacactccccccgctccgctacaggggcgaggacgggtgctggtacggcatggagattcgccccctgaaggagaaggaggaaaatctggttaactccctggtgacggccgggcacggccagatcgacaacttcagcctgggagtcctgggtatggctctcttcctggaggagatgctgagaactcgcgtgggaaccaagcacgctattctcctggtagcggtcagtttcgtgaccctcatcacggggaatatgagcttccgggacttgggccgcgtgatggtcatggtgggggccaccatgaccgatgatattggcatgggcgtgacctacctggccttgctcgccgcgtttaaggtccgccccacgtttgcggccggcctgctgctccggaagttgacctcaaaggaattgatgatggccactatcggcatagcactcctcagccagagtaccatacccgaaacgatcctggagctcaccgacgccctggcgttagggatgatggtattaaagatcgtgcgcaacatggagaagtaccagcttgccgtcaccatcatggctatcctgtgcgtgccgaacgccgtgatcctacagaatgcctggaaggtcagctgcaccatactcgccgccgtgtctgtcagccccttactcctgacgtccagccaacagaaggcggactggatccccctggccctcaccatcaagggcctgaacccaaccgcgatcttcctaacaacactctcccggacctcaaagaagcgctcctggccgctgaacgaggccgttatggctgtgggcatggtctcaatactggcctccagcctccttaagaacgacattcccatgaccgggcccctggtggctggcgggctcctgacggtttgttatgtcctcacgggccggagcgcggacctcgagctggagcgcgcggccgacgtgaagtgggaggaccaggccgagatctccgggagctcccccatcctgagcataacgatctccgaagacgggagcatgtccataaagaatgaggaggaggagcagaccctcaccatcctgatacggacgggcctgctcgtgatcagcggggtcttcccggtgtccatccccatcaccgctgcggcttggtacctatgggaggtgaaaaagcagcgcgccggcgtcttatgggacgtgccctcgccgccgccggtggggaaagccgagctcgaggacggcgcctaccgtatcaaacaacgcgggatctttggttactcacagattggcgccggggtctacaaggagggcacctttcacaccatgtggcacgtgacccgcggggccgtgctgatgcatcgcggcaagaggatcgagcccagctgggccgacgtaaagaaggacttgatctcctacgggggcggctggaagctcgagggggagtggaaagagggcgaggaggtccaggtgctggccctggagcccgggaagaacccccgcgccgtgcagacgaagccgggtctcttcaagaccaacaccgggaccataggagccgtgagcctggacttctccccagggacgtctgggtcccccattgtggacaggaagggcaaggtcgtggggctgtatggcaacggcgtggtcacccgaagcggggcctacgtgtccgccatcgcccagacggagaagtccatcgaggacaaccccgagatcgaggatgacatattccggaagaagcgcctcaccatcatggacctgcacccaggcgcggggaaaacaaaacggtacctgcccgccatcgtacgcgaggccatcaagcggggactgcgcactctgattctggccccgacccgcgtggtggctgcggaaatggaagaggccctgcgggggttgcctatccgttaccagacccccgccatacgggcggagcacacgggccgcgagattgtggacctgatgtgccacgccacctttaccatgagactgctcagtcctgtgcgcgtgcccaactacaacctgatcattatggacgaggcgcacttcaccgaccccgcctccatcgccgcccggggatacatcagcacgcgcgtggagatgggggaggcggcgggcatttttatgaccgccacgccgcccgggtcccgggacccgtttccccagtctaacgcacccatcatggacgaggagcgcgaaatcccggagcggagttggaacagcggccatgagtgggtcaccgacttcaaggggaagacggtgtggtttgtgccttctatcaaggcgggaaacgacatcgcggcctgcctgcgtaagaacgggaagaaggtcatccagctctcgcgaaagacctttgactcggagtacgtgaagacccgggccaacgactgggacttcgtggtcacaacggatattagcgaaatgggggccaacttccgggcggagcgcgtgattgacccccggcgctgcatgaaacccgtgatcctgaccgacggcgaagagcgtgtcatcctggcggggcccatgcctgtgacccactccagcgccgcccagcgccgcggccggatcggtcggaacccaaagaacgaaaatgaccagtacatctacatgggcgagcccctcgagaacgacgaggactgcgcccactggaaggaggccaagatgttgctggacaatattaacacaccagagggcatcatcccgtccatgttcgagccggagcgggagaaggtggacgcgatcgatggggagtaccgcttacggggcgaggcccgcaagacgttcgtcgacctgatgaggcggggtgacctgcccgtgtggttggcctaccgagtggccgccgagggcatcaactacgcggaccgccggtggtgctttgatgggatcaagaacaaccagatcctggaggagaacgtcgaggtggaaatctggaccaaggagggggagcgcaagaagctgaagccgaggtggctcgatgcccgcatctacagtgatcccctggccttaaaagagttcaaggagttcgccgcaggtcgaaagtccttaaccctcaacctgattacggagatggggcgtttgcccacgttcatgacccagaaggcccgagacgccctggacaacctggcggtccttcacaccgccgaggttggcgggcgcgcgtacaaccacgccctgagcgagctcccggagactttggagacgctcctgctactgacccttctcgccacagtgaccggcggaatcttcctgttcctgatgtccggaaagggcatcgggaagatgaccctcggcatgtgctgcatcatcaccgcgagcatcctgctatggtacgcccaaattcagccacactggatcgccgcctcgatcatcctcgagttcttcctgatcgtcctactcatacccgaacccgagaaacagcggacgccccaggacaaccagctgacctacgtggtgatcgccatcctgaccgtcgtggccgcaacgatggcgaacgagatggggttcctcgagaagaccaagaaggatctgggcctgggcagcatcatcactcaggagagtgagtccaacatcctcgacatcgaccttcgcccggcctccgcctggactctgtacgccgttgccacgactttcgttacccccatgctccgtcatagtatcgagaactcttcggtgaacgtaagcctgaccgcgatagccaaccaagctacggtcctgatgggactcggccgcgggtggcccctgtccaagatggacatcggcgtgcccctactcgccattggatgctacagccaggttaacccgattaccctgacggcggccctcctactgctggtcgcccactacgcaatcatcggacccggtttacaggccaaggctacccgcgaggcccagaagcgggcagccgccggaatcatgaagaaccctacggttgacggcatcaccgtgatagatcttgagcctatcccgtatgaccccaagttcgagaagcagttgggccaggtcatgttgctagtcctgtgcgtgactcaggtcctcatgatgcgcaccacgtgggcgctgtgcgaagccctgaccctagcaaccggccccatctccaccctgtgggagggaaaccccggccggttctggaacacgaccatcgccgtgagcatggcgaacatattcagaggctcgtacctggcgggcgccggcctcctgttcagcatcatgaaaaataccaccaacacacgtcgcgggaccggcaatatcggcgaaaccctgggggagaaatggaagtcccggctcaacgccctcggcaagtcagagttccaaatctacaagaagtccgggatccaggaggtggaccgcaccctggccaaggagggcatcaagcgcggggaaacggatcaccacgccgtcagccgtggttccgccaagctccggtggttcgtggagaggaacatggtgaccccggaagggaaggtcgtagacctggggtgcggccgcggagggtggagctactactgcggcggcttgaagaacgtccgcgaggtcaaggggttaaccaaaggcgggcccgggcacgaggagcccatcccaatgtccacctacggctggaatctggtgagacttcagagcggggtggacgtcttcttcactccgcccgagaagtgcgacaccctcctgtgcgacatcggcgagagctcccccaaccccaccatcgaggccggccgcacactgcgtgtgctaaatctggtggagaactggctaaacaacaacacgcagttctgcattaaggtcctgaacccgtacatgcccagcgtgatcgagaagatggagaccctgcagcgcaagtatgggggagccctggtccggaaccctctgtcccgaaactctacccacgagatgtactgggtctccaacgccaccgggaacatcgtcagctccgtaaatatgattagccgcatgttgataaaccggttcaccatgaagcacaagaaggcaacgtacgagccggacgtcgacttaggctccgggacccgcaacatcgggatcgagaacgaaatccccaaccttgacatcataggcaagcggatcgagaaaatcaagcaggagcatgagaccagttggcactacgaccaggaccacccttacaagacctgggcctaccatgggtcctacgaaacgaagcagaccggctccgcctcctcaatggtgaacggggtggtcaagctcctgaccaagccctgggatgttgtgcctatggtcacccagatggccatgacagacaccacccccttcggccagcagcgcgtgttcaaagagaaggtagacacacggactcaggagcccaaggagggcaccaagaagctcatgcgcataaccgccgagtggctctggaaggagctggggaagaagaagacgccccgcatgtgcacgcgcgaggagttcacccggaaagtccgctccaatgccgcactgggtgccatcttcaccgacgagaacaagtggaagtccgcccgggaagccgttgaggacagccgcttctgggagctcgtcgaccgggagcgcaatctgcatctggaagggaagtgcgagacctgtgtgtacaatatgatgggcaagcgcgagaagaagctcggggaattcggaaaggcgaagggctctcgcgccatctggtacatgtggctaggggcccggtttctggagttcgaagctctcggtttcctgaacgaggaccactggttttcccgcggcaactcactgagcggcgtggagggggagggcctccacaagctgggatacatcttgcgggacgtaagtaagaaggagggcggcgcgatgtacgcggacgataccgccgggtgggacacccgaataacccttgaggatctgaagaatgaggagatggtgaccaaccacatgaagggcgagcacaagaagctggctgaggcaatcttcaagctcacataccagaacaaggtcgtccgggtgcaacgcccaacgccacgggggaccgtgatggacatcatcagccggaaggaccagcgcggctccggccaggttgggacctacggcttgaacacgtttaccaacatggaggcccagctgatccggcagatggagggggagggcatcttcaagagcatacaacacctcaccgtgacagaggagatcgccgtgcagaattggctggcccgcgtcggccgggaacgcctgtcccggatggccattagcggggacgactgcgtggtgaagcccctcgatgaccgctttgcgtccgcgctgacggcactgaatgacatgggcaaagtccggaaggacatccagcaatgggagcccagccgcgggtggaacgactggacccaggtgccgttttgcagtcaccatttccacgagctcgttatgaaggatggccgggtcctggtggtgccctgccgcagccaggatgagttaatcgggcgggcccgcatttcccagggcgccggctggagcctcaaggagaccgcctgcctggggaagtcctacgcgcagatgtggacgttaatgtatttccaccggcgcgacctcagactggctgccaacgcaatctgcagcgccgttccctcccactgggtgcccacgagccgcaccacctggtccatccacgcgaagcacgagtggatgactactgaggatatgctggctgtgtggaaccgggtctggatccaggagaacccgtggatggaagacaagacgctcgtggaaagctgggaagaggtgccctaccttggcaaacgcgaggaccagtggtgtgggagcctgatcggtctcacgtcccgggcgacatgggccaagaacatccagaccgcgattaaccaagtccggagcctgattgggaatgaggagtacacggactacatgccctccatgaagcgcttccggaaggaggaggaggaggccggcgtgctgtggtga

SEQ ID NO: 25162 - RNA, 9876 nt, synthetic construct
  misc_feature 1..9876: note = derived and/or modified CDS sequence (opt11) from DENV-2__EU482551__SS-prME
  source 1..9876: mol_type = other RNA
actgcgggagtgataataatgctaatcccgacggctatggcgttccacctaaccacacggaacggcgaaccacacatgatagtaggacggcaggaaaaagggaaaagcctactcttcaaaaccgaagacggcgtaaacatgtgtacgttgatggcaatagacctcggcgaactatgcgaagacacaatcacatacaaatgtcccttactccgccaaaatgaaccggaagatatagactgctggtgcaactccacaagcacatgggtaacatacgggacttgcacgaccacaggggaacacagaagagagaaaagatcggtagcactggtaccgcacgtcgggatggggctggaaacaagaacggaaacctggatgagctctgagggcgcgtggaaacacgtgcagcggatcgagacttggatcttacggcacccaggcttcaccacaatggcagcaatactcgcatacaccataggcaccactcatttccagcgggtactcatatttatcctactgacagccgtcgcgccgagtatgacgatgcgatgcatagggatctcaaatcgggactttgtagaaggtgtgtcaggtggcagctgggtagacattgtactagaacatgggtcgtgcgtgaccacaatggccaaaaacaaacccaccctagacttcgaactgatcaaaaccgaagcaaaacaaccggcgacattgcgaaaatactgtatcgaggcgaaactgactaacaccaccactgaaagcagatgccctacgcagggtgaaccgtcactaaacgaagaacaagataaaaggttcatttgcaaacacagcatggtcgaccgagggtggggaaatggatgcggccttttcggaaaaggaggaatagtcacgtgcgcgatgttcacttgtaaaaagaacatggaggggaaagtcgtcttgccagaaaatctggaatacaccatagtcataaccccgcatagcggggaggaacacgcagtgggaaacgacaccggcaaacacggtaaggaaataaaaataacaccacagtcatccataacagaagcggagcttacaggatacgggactgtcactatggagtgcagtccacgcactggtttagactttaacgaaatggtactgctccagatggaggacaaggcctggctggtccacaggcaatggttcttagacctcccgttaccctggttacccggtgcagacacccagggctctaactggatccagaaagaaacacttgtgacgtttaaaaacccacacgccaagaaacaggacgtagtcgtcctaggttctcaagagggagccatgcacaccgcgttaaccggcgctacagaaatccaaatgagctccgggaacctattattcacaggccacctgaagtgcaggctaaggatggacaagctacaattaaagggaatgagctattctatgtgcaccggcaagttcaaaatcgtgaaggaaattgcagaaacccaacatgggacgatcgtcatacgggtacaatacgagggggacgggtcaccctgcaagatccccttcgagataatggaccttgaaaagcggcacgtcttaggtcgcttaataacagtaaaccccatcgtgacagagaaggattcacctgtaaacatcgaagcggaaccaccctttggagatagctatatcataattggagtagagccaggtcaactcaagctcaactggttcaagaaaggaagcagcatcggccagatgttcgaaacaacgatgaggggcgcaaaaagaatggcgatattaggagataccgcttgggactttggctcgctagggggcgtgttcacatcgattggcaaagcactacaccaagtattcggggcgatatatggagccgcatttagcggagtaagctggacaatgaaaatactaataggggtgatcataacctggatcggtatgaactcgcgcagcaccagcctctctgtcagtctagtcttagtgggtatagtcacactctacctgggtgttatggtgcaagcggacaccggatgcgttgttagctggaaaaacaaggaactaaagtgtggcagtggcatattcatcactgataacgtgcacacttggaccgaacaatacaagttccaaccagaaagcccgtcaaagctagcatcggccatccagaaggcacacgaagagggtatatgcggtatacgaagcgtaactcgtctagagaacttgatgtggaaacaaatcacgccagagctcaaccacatcctatcggaaaacgaagtcaaacttacaataatgacaggggacattaagggcatcatgcaagccggcaaacgatctttgagaccacaaccgacggaattgaagtacagttggaaaacctggggaaaggcgaaaatgttaagcacggagagccacaatcaaaccttcctgatcgacgggccggagaccgcagaatgcccgaacactaatcgggcctggaacagtctggaagtagaggactacgggttcggcgtattcagtacaaacatatggttaaaactccgagaaaagcaggatgtattctgcgactccaaactcatgagcgcagcgattaaagataatcgagccgtacatgcagacatgggatactggattgaatccgccctgaacgatacatggaaaatggagaaagcctctttcatcgaaataaaaagctgccactggccgaagtcacacacactctggagcaacggggtcctcgaatccgaaatgatcatcccgaagaatttcgcgggaccggtctcgcagcataactaccgaccgggataccacacacagaccgctgggccatggcacctcggcaaactagaaatggacttcgatttttgcgaagggaccacggtggtagtcacagaagactgtggtaaccgaggaccctcgctgaggactaccacggctagtggcaaactaataacggaatggtgctgccgctcgtgcactctaccgcccctccggtatcgcggcgaagacgggtgttggtacggaatggagattcggccactaaaggaaaaggaggagaacctcgtcaacagtctcgtgaccgccggacacggacaaatcgacaatttctcactcggcgtattaggcatggcgctattcctagaagagatgctgcgaacccgggtgggaaccaagcatgcgatcctcctcgtcgcagtctcatttgtcacactcataacgggcaacatgagcttcagagacctcggacgggtcatggtaatggtaggcgcgactatgacagacgacattggaatgggggtgacctatctggctctcctcgccgcgttcaaggtccgcccaacattcgcggccgggctgctgctgcgcaaactaacgagcaaggaactaatgatggccaccatagggattgccttactcagccagtccaccatacccgagacaatacttgaactaaccgacgccctagcgctcggaatgatggtactcaaaatcgttcgtaatatggaaaagtaccaactagcggtcaccattatggccatatcctgcgttcccaatgccgtgatcctccaaaacgcctggaaggtctcctgtaccatcctagcggcagtgtcagtaagtcccctcctccttacgtccagccagcagaaagcagactggatcccactcgcactcacaataaagggcctgaacccaaccgcaatattcctgacgacgctgagccgaacatctaagaaacgctcgtggcccctaaacgaggcagtgatggcagttggcatggtcagtatcctagcgagcagtctattaaagaacgacatcccgatgaccgggccactcgtggctgggggcctcctgaccgtttgttacgtcttaacagggcgcagcgcggacctggaacttgagaaggcggcggacgtcaagtgggaagatcaagcagaaataagcgggagcagtcccatattaagcataacgatatctgaggacggctccatgagcataaagaacgaggaagaagaacatacactaaccatcctgatacgcacaggtctcctcgtaataagtggtgtgttcccggttagcattcccattacagcggcagcctggtacctctgggaagtcaagaaacagagggcgggggtcttatgggatgtcccaagtcccccacccgtaggaaaagccgaactggaggacggagcgtaccggatcaaacaacgagggatcttcggttatagccagataggagcaggcgtgtacaaagagggcacctttcacaccatgtggcacgtaacccgcggggccgtcctgatgcacagaggtaaacggatagaaccgagctgggccgacgtgaagaaagacctgataagctacggcggtggatggaaactagaaggcgaatggaaagaaggcgaagaagtacaggtgctcgcattagaaccaggcaaaaacccacgtgcggtccaaactaaacctggactgttcaaaactaacacaggcacaataggagcggtttcactcgacttttcacccggaactagcgggtcacctatagtcgaccggaagggaaaggtggtaggtctgtacgggaacggtgtagtcacacgcagtggggcctatgtctcagccatcgcacaaacggaaaaatccatagaagataacccagagatcgaggacgacatcttccggaagaagcggctgacgattatggacctacatcccggcgcaggcaaaaccaagcgatacctaccggcaatagtaagggaggctatcaagcggggactgcgaacactgatattggcaccaacacgggtggtcgcggcagagatggaggaggcactgcgcggtctaccaatacgctatcagacccccgcaatacgggcggaacacacagggagagaaatcgttgacctaatgtgccacgcaacgttcacaatgagattactaagcccagtacgagttccaaattacaacctaatcatcatggacgaagcgcacttcacggacccggcgagcattgcggcgcgcggatatatcagcacaagagtcgagatgggcgaggccgcaggcatattcatgacagccactccaccagggtcaagagacccctttccacagtcaaacgctccaattatggacgaagaaagagaaatacccgaacgctcttggaacagcggccacgaatgggtcactgacttcaaaggcaaaacagtctggttcgtaccttcgataaaggcgggaaacgacatcgccgcctgcctgcggaagaacggaaagaaagtcatccaactatcgcgcaaaacatttgatagcgaatatgttaaaacacgggcaaacgactgggacttcgtcgtgacaaccgacatcagcgaaatgggagcgaattttagggcggagagggtaatcgaccccaggcggtgtatgaaaccagtgatcttaacggacggcgaagaacgagtgatattagcaggccccatgcccgtaacccactcctcagctgctcagaggaggggccggataggcaggaatcccaaaaatgaaaatgaccagtacatctatatgggggagccacttgagaatgacgaagactgcgcacactggaaagaagccaaaatgctgctcgacaacatcaacactcccgaaggaataatcccctcaatgttcgaacccgaaagagaaaaagtcgacgccatagacggcgaatatcggctcaggggagaggcgcgaaaaacatttgtcgacctcatgcgcagaggagatttaccggtatggttagcgtaccgagtggcagccgagggtatcaactacgctgacaggaggtggtgctttgacggcatcaaaaataaccaaatattggaggaaaacgtcgaagtggaaatatggacgaaagagggggagaggaagaaactcaaaccacgctggttagacgcgcggatatattcggatccactcgcgcttaaagaatttaaagagttcgccgcagggaggaaaagtctgacgctaaacctaatcacagaaatgggccgcctaccaacgttcatgacccaaaaggccagagacgccctagacaacctcgctgttctccacacggccgaagttggaggcagagcgtacaaccatgcactaagcgaactgcccgagacattagaaacattactcttactgacgctccttgccacggtcaccgggggcattttcttgtttctaatgagcggcaaaggaatcgggaaaatgacgctaggcatgtgctgcattatcaccgcatctatcctactgtggtatgcgcaaatccaaccccactggatcgcagcctcaattatcctagagttctttttaatcgtgctgctcatcccagaaccggaaaaacaacggacgccacaagacaaccaactgacatacgtagtcatcgccatattaactgtggttgcggcaacaatggcaaacgaaatgggcttcctagagaaaacaaagaaggacctgggacttggaagcattacaacccaagaatctgaatccaacatacttgacatagacctccgacccgcctccgcctggaccttatatgccgtagcgactaccttcgtaacgccaatgctgcgtcattccatagagaatagcagtgtcaatgtaagcctcacggcgatagcaaaccaagcaacggtgctgatgggcctaggccgcggatggccgctcagcaaaatggacataggagtgccactcctagccatagggtgctacagccaagtaaacccaattaccctaactgctgctctcctactcctggttgctcactatgcgatcataggacccggacttcaagcaaaagcgacaagggaggcgcagaaacgcacagcagctgggataatgaaaaacccaacggtcgacggaataacagtaattgacctggaacccatcccctacgacccaaaattcgaaaaacaattaggacaagtaatgctgctagtattatgcgtgactcaggtactaatgatgagaacgacctgggcgctgtgcgaggcactaacccttgctacgggccccatcagcacactatgggaaggcaaccccggaagattctggaacaccaccatcgccgtctcaatggcaaacatctttcggggatcatacctggcgggcgccggtctattattttcaataatgaaaaatacaacaaacacgagaaggggcacaggaaatataggagagacgttgggtgagaaatggaaatctcgcctcaacgcgctcggaaaaagtgagttccagatatacaagaagtcagggatacaagaagtggatcgtacacttgccaaagaggggatcaagcgcggcgagacagaccatcacgccgtgagccggggatcggccaaattgcggtggttcgttgagagaaacatggtgacgccggagggaaaagtcgtcgacctaggatgcggaaggggcgggtggagttactactgtggagggctgaagaatgtccgcgaagtaaaaggtcttaccaaagggggtcctggccacgaggagccaatcccaatgagcacctacggctggaaccttgtgcgactgcaaagtggtgtggacgtatttttcactccccctgaaaagtgcgacacactgttatgtgacatcggagagtcctcaccgaatccaaccatcgaggcaggacgtacccttcgagtactcaaccttgtcgaaaactggctaaacaataacacacagttttgcgtcaaagttctaaacccgtacatgccatcggttattgagaaaatggagactctacaacggaaatatggaggtgcccttgtccggaaccccctgagtcgaaacagcactcacgaaatgtattgggtaagcaatgcgaccggaaatatagtctcgagcgtcaacatgatttcacgtatgctaataaaccgattcaccatgaagcacaagaaagcgacatacgaacccgatgtagacctcggaagcggcacacgaaatatcggtatcgaaaacgaaatacctaacctagacatcatcgggaagagaatcgagaagataaaacaggaacacgagactagctggcactacgaccaagatcacccttacaagacgtgggcgtaccatgggtcatacgagactaaacagacaggatctgcaagcagtatggtgaacggggtggtcaaactcctcacgaaaccatgggatgtggtacctatggtgacacagatggcgatgacggacacaacgcccttcggacagcaacgtgtcttcaaagagaaagtggatacccgcacacaggaacccaaagaggggacaaagaagctaatgcggataactgcagagtggttatggaaggagttaggcaagaagaaaacaccccgaatgtgcacgcgtgaggagttcacacgcaaggtgaggagtaacgccgctctgggcgccatattcacggacgagaacaagtggaaatcggcccgagaggccgtagaagactccagattctgggaacttgtggatcgggaacgaaacttacacctagaaggaaagtgcgagacgtgtgtctataatatgatggggaagcgtgagaagaaactaggcgagttcggcaaggccaaaggatcgcgtgcgatatggtacatgtggctcggcgcaagattcctagaatttgaggcactgggatttctaaacgaagatcactggttcagccgtggtaatagtctgtccggcgtggaaggagagggactccataaactgggatacatactgcgcgacgtctcaaagaaagaagggggagcaatgtatgccgacgacacggcgggttgggacacaagaatcacactcgaggacctcaaaaatgaggagatggtgacgaaccatatgaaaggagaacacaagaaactcgccgaagcaatattcaaactcacgtaccaaaacaaggtcgttagggtgcaacgacccacaccccgggggacagtaatggatatcatttcaaggaaagaccagcgaggaagcggccaggtagggacatatggactcaacactttcaccaatatggaagcgcaactaataaggcaaatggagggagaaggaatcttcaaaagcatccagcggctaacagtaacggaagaaattgcggtccagaactggctagcacgcgtaggaagggaacgactatccagaatggccatatcgggagacgattgcgttgtgaagcccctagacgataggttcgctagcgctttgacagcgctaaacgacatgggtaaggtgcgcaaagacatccaacaatgggaaccaagcagaggctggaacgactggacccaggttcccttttgctcacaccacttccacgagctagtaatgaaggacggtcgaatgctcgtagtaccttgccgtaatcaagacgagttaatcggaagggcacggatttctcaaggagcaggctggagtctgaaagagactgcgtgtctcgggaaaagctacgctcaaatgtggaccctcatgtactttcatcggcgcgacctgcgtttagccgcaaacgcaatctgcagtgcggtccccagccactgggtaccaaccagtagaacaacttggagcatccacgccaaacacgaatggatgacaacggaagacatgttggcagtatggaaccgggtctggatccaagaaaacccatggatggaagacaagacacccgtagaaagctgggaggaggtcccttatctgggcaagcgcgaagatcagtggtgcggttccttaatagggttaacaagtcgagccacgtgggcaaagaacatacaaacggcgataaaccaggtgcgcagcctgattggcaacgaagagtacacggattacatgccaagcatgaagcgatttaggaaagaagaggaagaagcaggggtcctatggtga

SEQ ID NO: 25163 - RNA, 9876 nt, synthetic construct
  misc_feature 1..9876: note = derived and/or modified CDS sequence (opt11) from DENV-2__EU482552__SS-prME
  source 1..9876: mol_type = other RNA
acggccggggtgataatcatgttaatccccaccgccatggcgttccaccttaccaccaggaacggggaaccccacatgattgtcggtcggcaggagaaagggaagtcactgctgtttaaaaccgaggacggcgtgaacatgtgcactctcatggccatcgacttgggcgagctgtgcgaggacaccatcacctataagtgccccctcttacggcagaacgagcccgaagacatcgactgctggtgcaacagtacgagcacttgggtgacctacggaacctgcaccactacgggcgaacaccgaagggaaaagcggtccgtcgctctcgtgccccacgttgggatgggcctcgagacccggaccgaaacctggatgagcagcgaaggtgcgtggaagcacgtccaacggatcgagacctggatcctgcgccacccgggcttcacgatcatggccgcgatattagcctacacaattgggaccactcatttccagcgggccctcatcttcatcctgctgaccgccgtcgcgcccagcatgaccatgcggtgcataggcatctccaaccgtgactttgttgagggcgtcagcggaggctcctgggtggacatcgtgctagagcatgggagctgcgtcactacgatggcgaagaacaagcccacgctggacttcgagttgatcaagaccgaagccaagcagcctgccaccttgcgcaagtactgcattgaggcgaagctgacaaacaccaccaccgagtcccggtgcccgacacaaggcgagcccagcctgaacgaagaacaggataagcgcttcatctgcaagcactccatggtggaccgaggctgggggaatggctgcgggctatttggcaaaggagggatcgtaacctgcgcaatgttcacgtgcaagaagaacatggagggcaaggtcgtgctgcccgagaacctggagtacaccatcgtgatcactccccacagcggggaggagcacgccgtaggcaacgacaccgggaagcatggcaaagagataaagattaccccgcaatcctccatcacggaggcggagctaaccgggtacggcaccgtgaccatggagtgtagcccccgtacagggctggacttcaacgagatggtgctgctccagatggaggacaaggcctggctggttcacagacagtggtttctggacctccccctcccctggctgccgggggctgacacacagggcagcaactggatccagaaggagacgctcgtgaccttcaaaaacccccacgcgaagaagcaggatgttgtcgtgctcgggagtcaagaaggggccatgcacaccgccctgaccggggctacggagatccagatgtcatcaggcaatctcctgttcaccggccatttaaaatgccgcttgcggatggacaagctgcagctgaaaggtatgagttactcgatgtgcaccggaaaattcaagatcgtcaaagagattgccgagacccagcacgggacgatcgtaatccgcgtccaatacgagggggacggctccccctgcaagatccccttcgagatcatggaccttgaaaagcggcacgtcctgggccgcctgataaccgtgaatccgatcgtgacggaaaaggacagccccgtcaacatcgaggcggagccgcccttcggcgactcctatatcatcatcggggtagagcccggacagctcaagctgaactggtttaagaaggggagctctataggacagatgttcgaaaccacgatgcgcggcgccaagcggatggccatcctgggggacaccgcctgggatttcggttcactcggtggcgtgttcacatccaccgggaaagccctgcatcaggtattcggggcgatctacggcgcggccttctctggggtatcctggacgatgaagatcctgatcggcgtcatcatcacttggatcgggatgaacagccgctccacctcactgagtgtgagcctggtgctcgtgggcgtcgtgaccctgtatttaggggttatggtacaggccgacacgggctgcgtggtgtcgtggaagaacaaggagctgaagtgtggctccgggatcttcatcacggacaacgtacacacctggactgagcagtataagttccagcccgagtccccctctaagctagcgtccgccatccaaaaggcccacgaggagggcatctgtggcatccggtccgtgacgcgcttagagaacctgatgtggaagcaaatcacccccgagctgaaccatatcctgagcgagaacgaagtaaagctgaccatcatgaccggcgacatcaaagggatcatgcaggccgggaaaaggtcactgcgcccgcaacccactgagctgaagtactcctggaagacatggggtaaagccaagatgctgagtacagagtcgcacaaccagaccttcctgattgacgggcccgagactgcggagtgccctaacaccaaccgtgcctggaactccctcgaggtcgaggactacggcttcggagtgttttccaccaacatctggctgaagctgcgcgagaagcaggacgtgttctgcgacagcaaactcatgagcgccgccataaaagacaacagagcggtccacgcagacatgggctactggatcgagtcagccctgaacgacacctggaagatggagaaggccagcttcatcgagatcaaatcctgccactggcccaagagccatacgctgtggtctaacggtgtgttggagtccgagatgattataccaaagaacttcgccgggcccgtatcccagcacaactaccggccgggctaccacacgcagacggccggaccgtggcatctgggcaagctcgagatggacttcgacttctgcgaggggacgaccgtcgtagtgacggaggactgtggcaaccgagggcccagcctccgcactaccaccgctagcgggaagctgatcacggagtggtgttgccggtcgtgcaccctaccccctctgcgttaccggggcgaggacggctgctggtacggcatggagatacggcccctgaaggagaaggaggagaacctggtcaactccctggtgacagccggatacggccaaatagacaacttcagccttggcgtgctaggtatggcgttgttcctggaggagatgctgaggacccgagtaggcaccaaacacgcgatcctcttagtggcggtgagcttcgtcactctgatcacggggaacatgtcattccgagacctcggcagggtgatggtgatggtcggggccaccatgacggacgacatcggcatgggcgtgacctacctcgccctgctcgccgccttcaaggtgagacccaccttcgccgcgggactgctgttgcggaagctgactagcaaggaactgatgatggccacaattggcatcgccctcctgagccagagcaccatccccgagaccatcctggagttaaccgatgcccttgcgctggggatgatggtgctcaagatcgtccgaaacatggagaagtaccagctggcagtgacgatcatggccatttcctgcgtcccgaacgctgtgatcctgcagaatgcctggaaggtgtcatgcaccatcctcgcggccgtatccgtgtcgccccttctgctcacctcctcgcagcaaaaggccgattggatcccactggccctgaccattaagggattaaaccccacggctatatttctgaccaccctgagccggaccagcaagaaacggtcctggcccctcaacgaagccataatggccgtcggcatggtcagcatcctagcctccagcttgctcaagaatgacatccccatgacggggcccctggttgccggcgggctgctcactgtttgctacgtgctgaccggccgcagcgccgacttagaactggaacgcgccgccgacgttaagtgggaggaccaggccgagatctccgggtcctccccaatcttaagcatcaccatctccgaggacggcagcatgtccatcaagaacgaggaggaggagcacacccttacaatcttaatccggaccggcctgctggtcatcagcggggtgttcccggtgagcatccccattacggccgcggcctggtatctctgggaggtcaagaaacaacgcgccggcgtgttatgggacgtgcccagcccgccacccgtagggaaagccgagctggaggacggcgcctaccggatcaagcagcgcgggatctttggatactcgcagattggtgcgggcgtgtacaaggagggcaccttccatacgatgtggcacgtgacccgcggggccgtcctcatgcaccgcgggaaacggatcgagccaagctgggcagacgtgaaaaaggacctaatatcctacggtggaggctggaagctggagggtgaatggaaggaaggtgaagaggtgcaggtcctcgccctggaacccgggaagaatccccgcgccgtacagaccaagccaggccttttcaagaccaacactgggacaattggcgccgtgagcctcgacttctcgcccggcaccagcgggtcccccatcgtcgaccgaaaaggcaaggtggtggggctctacggcaacggtgtcgttacccgcagcggggcctacgtgtccgcaatcgcccagacggagaaaagcattgaagataacccagagatcgaggacgacatctttcgcaaaaagcgcttgactataatggacctccaccccggcgctgggaagaccaagcggtacctgcccgccatcgttcgcgaggccatcaagcggggcctgcgcaccctgatcctcgcaccgactcgcgtggtcgccgcggagatggaggaggccctgcgggggctgcccatccgctaccagacccccgccatccgggccgaacacacaggtcgggagattgtcgacctcatgtgtcacgccaccttcacgatgcgactgctgagccccgtgcgcgtcccgaattacaacttgatcatcatggacgaggcgcacttcacggaccccgcctccatcgccgccaggggctacatcagtacccgcgtagaaatgggggaggcagcgggcatcttcatgaccgcgacaccgcctgggtcccgggacccgtttccacagagcaacgcccccattatggacgaggagcgcgaaatccccgaacggtcctggaacagcggccacgagtgggtgaccgacttcaaggggaagaccgtgtggttcgtgccatccatcaaggccggcaatgacatcgcggcatgcctgcgcaagaacggaaagaaggtgatccagctgagccgcaaaaccttcgactctgagtacgtgaagacgcgtgccaacgattgggacttcgtggttaccaccgacatcagcgagatgggagccaactttcgtgccgagcgcgttatcgacccgcggcgctgcatgaagccggtcatccttacggacggcgaggagcgggtgatcctagcggggcccatgccggtgacgcactccagcgctgcccagcgccgtggccggatcgggcggaacccaaagaatgagaacgaccagtatatctatatgggcgagcccttagagaacgacgaggactgcgcccactggaaggaggccaaaatgctcctggacaatatcaacaccccagagggcatcatcccctccatgttcgagcccgagcgggagaaggtcgatgcgatcgacggggaataccgcctacgcggcgaggccagaaagaccttcgtggacttgatgcgtagaggggacctccccgtgtggctcgcctaccgtgttgccgccgaagggatcaattatgcggaccgccggtggtgcttcgacgggatcaaaaacaaccagatcctcgaggagaacgtagaggtggagatatggaccaaggaaggtgaacgcaaaaagttaaagcccagatggctggacgcgcgcatctatagcgaccccctcgccttaaaggagttcaaggagttcgcagccggccgtaagtctttgacattaaacctaataaccgagatggggcgcctgcccacatttatgacgcagaaggcacgggacgcgctcgacaacctggccgtcttgcacacggccgaagtgggcgggcgcgcatacaatcacgcgctctctgagctgcccgagaccctggagaccctgttactgctaactctgctggccacggtcactggcggaatctttctattcctgatgtccgggaagggcatcggaaagatgaccctgggcatgtgctgtattattacggcctcgatcctgctgtggtacgcccagatacagccgcattggatagctgcctccatcatactggagttcttcctcatcgtgctgttaatccccgagccggagaagcaacggacgccccaggacaaccagctaacgtacgtggtcatcgccatcctgactgtggtggcagcaaccatggcgaacgagatgggattcctggagaagaccaagaaagatttaggcctgggctcaatcacgacacaggagagcgagagtaacatcctggatattgacttaagacctgcaagcgcctggacgttatacgccgtggctactacgtttgtgacccccatgctgagacactccatcgagaactcctccgtgaacgtcagcctcaccgctatcgccaaccaggccaccgtcctgatggggctgggccgcggttggcccctctccaaaatggacattggcgttcctctgctggccatcggatgctactcacaggtgaatccgatcacactcaccgcggctctgcttttgcttgtggcccactacgccatcatcggccccggccttcaggccaaggcgaccagagaggcacaaaagcggaccgcggccggcatcatgaaaaaccccacagtggacggcatcaccgtcatcgacctcgaacccatcccgtacgacccaaagttcgagaagcagctgggccaggtaatgcttctcgtgctttgcgtaactcaggtccttatgatgagaaccacgtgggccctctgcgaggcgctgaccttagccaccggacccatctcaaccctctgggaaggaaaccccggcaggttctggaacacgacgattgccgtcagcatggccaatatcttccgcggctcctacctggcaggggcaggtctcctcttcagcatcatgaagaataccaccaacacgcggagggggacgggcaatatcggcgagaccctgggggaaaagtggaagtccagattgaacgcacttgggaaaagcgagttccagatctacaagaaatccggtattcaggaagtcgaccgcactctagccaaggaggggatcaagcgcggagagacggaccaccacgccgtgagccgcggctccgcgaaactgcggtggttcgttgagcggaacatggtcaccccggaaggcaaagtggtagacctcgggtgcggccgcggcgggtggagctactattgcggcgggctgaagaacgttcgcgaagtgaagggactgacaaagggcggccccgggcacgaggagccgatccccatgtcgacctacggctggaacctggtgcggctgcagagcggagtcgacgtgttcttcacccctcccgagaagtgtgacaccctcttatgtgacatcggtgagagctcccccaatcccaccatcgaggccggccgcaccttgcgggtactgaacctcgtcgaaaactggctgaacaacaacacccagttctgcgtgaaggtgctgaatccgtatatgccctccgtcattgagaagatggagacgttgcagcgaaagtacgggggcgctctggtgcggaatcccctgtcccgcaactccacccatgagatgtactgggtgtccaacgccacggggaacatcgtcagctccgtgaacatgataagccgcatgctgatcaaccgcttcaccatgaagcataagaaagccacatatgagccggacgtggacctcggctccgggactcgcaacattggcatcgagaacgaaattcccaacctggacataatcgggaagcgcatcgagaagataaaacaagagcacgagaccagctggcattacgaccaggaccacccgtataagacctgggcgtaccacgggtcctacgagacgaagcagaccgggagcgcctccagtatggtcaacggggtggttaaacttctgacaaagccttgggacgtcgtgccgatggtgacccaaatggcgatgacggataccaccccctttggccagcagcgcgttttcaaggagaaggtggacacacgcacacaggagcccaaggaggggaccaagaagctgatgcgcatcactgccgagtggctatggaaagagctgggtaagaagaagacgccgcgtatgtgcacgcgcgaggagttcaccaggaaggtacgctccaacgccgcgctgggagccatcttcaccgatgagaacaagtggaaatccgcccgtgaggccgtcgaggactcccggttttgggaactggtggaccgggagcgcaacctccacctggaagggaagtgcgagacctgcgtttacaacatgatggggaaaagggagaaaaagctgggggagttcgggaaagccaagggcagccgcgcgatctggtacatgtggctcggggcccggtttctggagttcgaagccctgggcttcctcaacgaggaccactggttctcccgcgggaactccttgagcggcgtggagggggagggactgcacaagttaggctacatcttgcgggacgtgagcaagaaggagggcggggcgatgtacgcggacgacacggcgggctgggacacccgcatcaccctggaggacctcaagaacgaagaaatggttaccaatcacatgaagggagaacacaagaaacttgccgaggctatcttcaagttaacatatcagaataaggtggtgcgggtccagcgaccgacgccccggggaaccgtgatggacatcatcagtcggaaggatcagcgcggatctggccaggtggggacctacggtcttaacacgttcaccaacatggaggcacaactgatccggcaaatggagggggagggtatcttcaagagcattcaacggctgaccgtcactgaagaaatcgctgtgcaaaactggctcgcgcgtgtgggcagggagcgactgtcccgcatggccataagcggggatgactgcgtagtgaagcccctggacgaccggttcgcgagtgccctcaccgcgctgaacgacatgggcaaggtgcgaaaggacattcagcaatgggagcctagccggggctggaacgactggacccaggtcccattttgctcccaccatttccacgagctggtcatgaaggacggccgcgtgctcgtcgtgccctgccgtaaccaggatgagctgatcgggcgcgccaggatcagtcagggggcaggctggtcactgaaggagaccgcatgcttaggcaagagttacgcccagatgtggaccctgatgtacttccatcggcgggacctgcgtttggccgccaacgccatctgctccgccgtgcccagccattgggtgcccacttcccggacgacatggagcatccacgccaagcacgagtggatgaccaccgaggacatgctggcagtttggaaccgcgtgtggatccaggagaacccgtggatggaggacaagactcccgtggagtcctgggaagaggtaccatacttaggcaaacgcgaggatcagtggtgcgggagcctcatcggcctgacctccagggcgacgtgggccaagaacatccagaccgcaatcaaccaggtgcggtccttgatcgggaatgaggagtatacagactacatgcccagcatgaagcggttcaggaaggaggaggaggaggcgggtgtcctctggtga

SEQ ID NO: 25164 - RNA, 9876 nt, synthetic construct
  misc_feature 1..9876: note = derived and/or modified CDS sequence (opt11) from DENV-2__EU482554__SS-prME
  source 1..9876: mol_type = other RNA
accgcgggggtgataattatgcttataccgacggcaatggcattccacctaacgacccgtaatggagaaccacacatgatagtcggacgacaagaaaaaggaaaatcgctactcttcaaaactgaagacggagtaaacatgtgcaccctgatggcaatcgacctaggggaattgtgcgaagatactatcacatacaaatgtcccctgttaaggcagaacgaacccgaagacatcgactgctggtgtaattcgacctcgacgtgggtcacttatgggacgtgcacgacgaccggggaacaccggcgagaaaaacggtccgtagctctcgtccctcatgttgggatgggcttagaaactaggaccgaaacctggatgagcagcgaaggggcatggaaacacgtccagagaatagaaacgtggatcctccgccatccaggattcacgataatggcggcaatcctcgcttacacaataggaaccacgcactttcagagggcgctaatatttatactccttacggctgtggcccccagcatgaccatgcgctgcatcggcatcagcaaccgtgacttcgtcgaaggagtctctggagggtcatgggtcgacatagtcctggaacacggctcatgtgtaacgacaatggccaaaaacaaacccacgctagatttcgagctgattaaaaccgaagcaaaacaacctgccaccctcaggaaatactgcatagaggcgaaactaactaacaccacaactgagtcgcgatgcccaacccaaggagaaccgagcttaaacgaagaacaggacaagagattcatctgtaaacatagtatggtcgacaggggctggggcaacggatgcggcctcttcggcaagggcggcatagtcacctgtgcgatgttcacctgtaagaaaaatatggagggcacggtagtactaccagagaatctggagtacacaatcgtcatcacgcctcattccggcgaagaacatgccgtgggcaacgacaccggcaagcacgggaaagagatcaagataacaccacaaagctctataacagaagccgaactgacgggctatgggaccgtcacgatggaatgctctcccagaacggggctagacttcaacgaaatggtgctactacaaatggaagacaaggcgtggctcgtccaccgacaatggttcctagatctacctctaccatggctcccgggggctgacacacaaggcagcaattggattcaaaaggagacattagtaactttcaagaatccgcacgccaagaaacaggacgtcgtagtgctgggaagccaagaaggagcgatgcacaccgccctcacaggcgcaaccgagatccagatgtcaagcggaaacctcttattcactgggcatctgaaatgcagactacggatggataaattacagctgaagggtatgtcctattccatgtgtacaggtaaatttaaaatagtaaaagaaatcgcggaaacacagcacggcacaatagtcatccgagtacaatatgaaggtgacgggagcccatgcaaaatcccattcgagataatggacctcgagaaaaggtacgtactaggacgtctaatcaccgtaaatccgatagtgacagagaaagacagcccagtaaacattgaggcggaaccacccttcggggacagttacataataataggcgttgaaccgggacagctgaaactaaattggttcaagaaagggtcctccatcggccaaatgttcgagaccaccatgaggggagctaagcgaatggccatactcggcgataccgcttgggacttcgggagtctcggaggagtcttcaccagtatcggaaaggcactgcaccaggtcttcggggccatctatggagcagctttctcaggagtgtcttggacaatgaagatactcatcggagtcataatcacctggatcggcatgaacagtaggtccaccagcctctcggtcagcctcgtacttgtcggcgtcgtcacattatacctcggcgtcatggtccaagcggatagcggatgtgtagtgtcgtggaaaaacaaagaacttaagtgcgggtctggaatcttcatcacagacaacgtccacacctggactgagcaatacaagtttcagcctgaaagcccatccaaactcgcctcagcgatacagaaagcgcacgaggaaggcatttgcgggatacgcagcgtcacccgcctcgaaaatctaatgtggaaacagatcacaccagaattaaatcacatcctctcggaaaatgaagtaaagctgaccattatgaccggagacataaagggaatcatgcaggcggggaaaaggtcgttgcgcccacaaccaaccgagctcaagtactcgtggaaaacctgggggaaggcaaagatgttatcaacggaatcccacaaccagacctttctcatagacggccccgagacggccgaatgcccaaacacaaaccgagcatggaacagtttggaggtcgaagactatggttttggcgtcttctcaaccaacatctggcttaagctcagggagaaacaagacgtcttctgcgatagcaaactcatgtctgctgccatcaaggacaaccgcgctgttcacgctgatatggggtactggattgagtcagcgctaaacgacacgtggaagatggagaaagcatcattcatcgaagtcaagagttgccactggcccaaatcacatactctgtggtcaaacggcgtcctagagagtgagatgatcatccccaagaacttcgccggtccagtcagccaacacaattaccgccccggctatcacacacagaccgcaggaccatggcacctcgggaagctagaaatggacttcgacttctgtgagggcactaccgtcgtggtgacagaagactgtggaaacagaggaccttctttaagaacaaccacagcatcgggcaaattgatcaccgagtggtgctgccgaagctgcacactacctccattacgttaccgtggagaagacggatgctggtatgggatggaaattagaccattaaaggagaaagaagaaaacctcgttaacagtctcgtcacagccggccacggacaaatagacaacttctccctaggggtcctgggaatggccctattcctcgaagaaatgctccggacccgcgttggcacaaaacacgcaatcctcctggtagccgtttcgtttgtcaccctaataacaggaaacatgtccttccgagacctaggccgagtcatggtaatggttggtgccaccatgacagatgacatcgggatgggagtaacttacctggccttactagcagcctttaaggtgcgccccacattcgcagcggggctcctcctacggaaactgacatcaaaagagcttatgatggcaaccatagggatagcccttctgtcacaaagcacgatcccggagacgatattggaactcacagacgccctagcgctaggcatgatggtgctgaagatagtgaggaacatggaaaagtaccagctagcagtaacaataatggcgattctatgcgtccctaacgcggttatattgcaaaacgcatggaaggtaagctgcacgatattagccgccgtatccgttagtccactactgctaaccagctctcagcaaaaggcggactggatcccgctggccctaacaatcaaaggcttgaaccccacagcaatcttcttgactacactatccaggaccagcaagaaaagatcctggcccctaaatgaggccgtaatggcggtaggaatggtgagcatcctcgcttcatcccttctaaagaacgacatcccgatgactggaccgctggtcgctgggggtcttctaacagtatgctatgtccttacagggcggtccgcggacctcgaactagaaagagccgcagatgtaaaatgggaggatcaagccgagatcagtggtagcagccccatcctatcgatcaccataagcgaggacgggtccatgtccatcaagaatgaagaggaggaacaaacactgaccatactcatcagaacgggcctcctagtcataagcggcgtgttccctgtaagcatccccatcacagcagcagcctggtacctatgggaagttaagaaacaacgggcaggagtcctttgggacgtgcccagtccaccacccgtgggaaaagcagagttagaagacggcgcctacaggataaaacaaaggggcatatttggatattcgcagatcggggccggggtgtacaaagaggggacattccacacgatgtggcacgtgaccagaggagcagtccttatgcaccgtgggaaaagaatagagcccagctgggcagacgtaaagaaagatctcatctcatacgggggtgggtggaaactagaaggagagtggaaagaaggggaagaggtccaagtcctggccctcgaacccggcaaaaacccgagagccgttcagacgaagccaggtcttttcaagaccaacacgggaactatcggagctgtcagcctagattttagccccggtacaagtgggagccccatcgtcgaccggaaagggaaagtggtaggattatacgggaacggcgtcgtgacccgaagcggagcatacgtcagcgcgatcgcacaaaccgaaaagagtatagaagacaaccccgaaatcgaggatgatattttcagaaagaaaaggctgaccatcatggacttacaccccggagcgggtaaaactaaacgatacttgcctgcgatagtccgcgaagctataaagcgcggcctaagaacattgatcctagcacccacaagggtagtagcggcagagatggaggaggctctaaggggattgccgattcggtaccaaacaccagcaatccgcgccgagcacacaggccgggaaattgtagatctcatgtgccatgcaaccttcacaatgcgactcctatcccccgtcagagtcccaaactacaacttgataataatggacgaggcccacttcacagacccggcatcaatcgccgcccgaggctacatttcaacgcgtgtagagatgggcgaagctgctggcatatttatgacagcgacaccgcccgggtctcgagatcccttcccacaaagtaatgccccgataatggatgaagaacgagaaataccggagagaagttggaatagcgggcacgaatgggtcacagatttcaaaggcaagacggtatggttcgtgccctcaataaaggccggaaacgacatcgcggcatgccttagaaagaacgggaagaaagtaatacaactttcaagaaaaaccttcgacagtgaatacgtcaaaacgcgcgcaaacgactgggacttcgtcgtaacgacagacatatccgaaatgggcgcaaatttccgagctgagagagtaatcgacccccgccgctgtatgaaaccagtaatcctgactgacggggaggaacgcgtcattctcgccggcccgatgcctgttacccacagtagcgccgcccaaagacgaggaagaataggacgaaaccccaagaacgaaaatgaccagtatatctacatgggcgaaccactggagaacgacgaggactgtgcccattggaaggaagcgaaaatgctactagataacataaacacccccgaaggcatcataccaagcatgtttgaacctgaacgagagaaagtagacgcgatagacggcgaatatcgcctgcgtggcgaagcacgcaaaacattcgtggatctgatgcgtagaggagatttaccagtgtggctcgcgtaccgcgtggcggccgaaggaatcaactatgccgaccggagatggtgtttcgacggaatcaaaaacaaccaaatactagaggagaacgttgaagtggaaatatggaccaaagagggtgaaagaaagaaactcaagcccaggtggctggacgcaaggatctactcggacccgttagccctgaaagaatttaaagagtttgcagcgggaagaaagtcactcacattgaacctcatcaccgaaatgggccgcctacccacctttatgacacaaaaagctcgggacgctttggacaacctggcggtactacacacagcagaagtaggagggagagcatacaaccacgcactcagtgaactgccagaaacgttagagacactacttcttctcaccctacttgcgacagtgaccggcggtatattcttgtttctaatgagcggaaaggggataggcaagatgacactcggaatgtgctgcatcatcacagcctcgatactgctgtggtacgcacaaattcagcctcactggatagccgcatccatcatacttgagttctttctaatcgtactcctaataccggaacccgagaagcaacgtactccacaggataatcagttaacatacgtagtcatcgcgatactcacagtcgtagctgcgaccatggctaacgagatgggatttctcgagaaaaccaagaaagacctaggcctaggttccatcatcacacaagagtccgagagcaacattctcgacatcgacctgcgccccgcgagcgcctggactctgtacgccgtggcgacgacgtttgtcacgccgatgctccgacactcaatagagaatagcagcgtcaacgtaagcctaacagccatcgcgaaccaagcgacagtactgatgggactcggaaggggttggcccctttcaaaaatggatatcggggtaccgctcctcgcgattggttgctacagccaggtgaacccaatcacccttacagcagctctgctcctgctcgtggcgcactacgccatcataggcccagggctacaagcaaaggccacccgcgaggcacagaagcgggccgcggccggcattatgaaaaatccaacggtcgacggtattaccgtcattgacctcgaaccaatcccatacgatcccaagttcgaaaaacaactcggccaggtgatgctcctagtgctctgcgtcacacaagtgctaatgatgcggaccacatgggcgctttgcgaagccctaacattggcaacaggcccaataagcaccctatgggaaggcaaccctggacgattctggaataccaccatagcggtgagcatggcgaacatattccgaggatcctacctcgctggagccggcctgctattcagcataatgaagaacacaaccaacacacgtcggggaaccggcaacattggcgagacgctcggcgaaaaatggaagagtcgactaaatgcgctaggaaaatccgagttccagatttataaaaagtctggcatacaagaagtcgacaggaccctagcaaaagagggaatcaaacgcggggaaaccgaccaccacgcggtctcgagaggatcggcaaagctccgctggttcgtcgagcgaaacatggtgacaccagaaggaaaggtggtggacctcggctgcggacgcggagggtggagctattactgcggaggactcaaaaacgtgcgcgaagttaaaggcctcacaaagggaggccccggacatgaggaaccaataccgatgtctacatatggctggaatctagtccggctgcagagtggcgtggacgtattctttacacccccggaaaaatgcgataccctactatgtgacataggggaatcctcacccaatcccacaatcgaagcggggaggaccttaagagtcttaaacctcgtcgagaattggctcaacaacaacacccagttctgcattaaggtactaaacccttacatgccctcagtcattgaaaagatggagacactgcagaggaagtatggcggcgccctagttcgcaatccgctcagtagaaacagtacgcacgaaatgtactgggtgtccaacgccacagggaacatcgtgagctccgtgaatatgatatcccgtatgctaattaaccgcttcacgatgaaacacaagaaagctacgtatgagcccgacgtagacctgggttccggaacgaggaacataggaatagagaatgaaattccaaatttggacattatcggaaaaaggatagagaaaataaagcaagagcatgaaacaagttggcactatgaccaggatcacccctataagacttgggcctatcacggatcctacgaaacaaagcagactggaagtgcgtcttcgatggtgaacggcgtggtacggctcctgaccaaaccttgggacgtagtgcccatggtaacacagatggcgatgaccgatacgaccccgtttggacagcaacgcgtcttcaaagaaaaagtggacacaagaacgcaagagccaaaagaaggaacgaaaaagttgatgcgcatcacagcagaatggctatggaaggagttaggcaagaagaaaaccccacgaatgtgtacccgggaagagttcacgcgtaaagtgagatccaacgcagcactaggcgccatatttacggatgaaaacaaatggaaaagtgcccgcgaagccgtagaggatagcaggttctgggagctagtggaccgcgagcgtaatctgcacctcgaaggcaaatgcgagacgtgcgtatacaacatgatgggcaagcgagagaagaaactaggagagttcggtaaagcgaaggggtccagggcgatctggtacatgtggctaggggcgcgcttcctcgagttcgaagcactaggatttctgaatgaagaccactggtttagccgaggtaatagtctcagcggcgtagagggagaagggctgcataaacttggttacattctgcgagacgtatcgaagaaagaaggcggggcaatgtacgcggatgacacggctgggtgggatacacggataactctggaggacctcaagaacgaggaaatggtcacgaaccacatgaagggggaacacaagaaactagccgaagccatatttaagctgacataccagaacaaagttgtgagagttcagcgacccacgcctcgcgggaccgtaatggatataataagcaggaaggatcagagagggagcggacaggtaggcacctatggcctaaacaccttcacaaacatggaagcacagttaatacgacaaatggagggcgaaggaatattcaagtcaatacagcacttgactgtaacagaagaaattgccgtacagaactggctagccagggtcgggcgggaacggctgagccgcatggccatttcaggagacgattgcgtagtcaaaccactagacgatcgtttcgccagcgcactaacagcgctcaatgacatgggaaaggtgaggaaagacatccagcagtgggagcctagcaggggttggaacgactggacacaagtaccgttttgctcgcatcacttccacgaactcgtgatgaaagacgggcgcgttctcgttgtgccgtgcagaagtcaggacgaactaataggcagagcacggatctcgcagggggccggctggtccctaaaggaaactgcgtgccttggaaaaagctacgcacagatgtggaccctaatgtactttcatcgtagagacctccgactggcagcgaatgccatatgcagcgcagtcccgagccactgggtcccgacaagccgaacaacctggagtatccacgcgaagcacgaatggatgacaacggaggacatgttagccgtctggaatcgggtatggatacaggaaaacccctggatggaagacaaaacgctagtagaatcttgggaagaagtgccgtacctcggcaaacgcgaggaccaatggtgcggctcgctcattggactgacctcgcgggcaacgtgggcaaagaatatacaaaccgccatcaaccaggtgcgctctctcattggcaacgaggaatacacggactatatgcccagcatgaagcgattcaggaaggaagaagaagaagccggagttttatggtag

SEQ ID NO: 25165 - RNA, 9876 nt, synthetic construct
  misc_feature 1..9876: note = derived and/or modified CDS sequence (opt11) from DENV-2__EU482556__SS-prME
  source 1..9876: mol_type = other RNA
acggctggcgtgatcatcatgctaatccccaccgccatggcgttccacctgacgacccggaacggggagccccatatgatagtcggccgacaggagaaggggaagtccctgctgtttaagacggaagacggcgtgaacatgtgcaccctgatggccatcgacctgggggagctatgtgaggacaccatcacttacaagtgccccctcctgcgccagaacgagcccgaggacatcgactgctggtgcaatagcaccagcacctgggtgacttacgggacctgcaccaccacaggagagcaccggagagagaaacgatccgtcgctctggtcccccacgtgggcatgggcctcgagaccagaacggagacctggatgtctagtgagggggcctggaagcacgtacaacggatcgaaacgtggatcttgagacatcctggattcactatcatggccgcgatcctggcgtataccatcgggactacgcacttccagcgggccttaatcttcatcctgctgaccgccgtggcccccagcatgaccatgcgatgcatcggcatcagtaaccgggacttcgtagagggcgtcagcgggggctcctgggttgacatagtactcgagcacgggagctgcgtcaccaccatggccaagaacaaaccaaccctggacttcgagctgatcaagacagaggcgaaacagcctgctaccctccgcaaatactgtatcgaggcgaaactgacgaacaccaccaccgagtcgcgttgtcctactcagggcgagccctccctgaacgaagagcaggataagcgcttcatctgtaaacactctatggtggaccggggctgggggaacggctgcggtctcttcggcaaaggcgggatcgtgacctgcgcgatgtttacgtgcaagaagaacatggagggaaaggtcgttctgcccgagaacctagagtataccatcgtgattacgccccattccggggaagagcacgccgtcggtaacgacaccgggaagcacggcaaagaaatcaagataaccccgcagtccagcatcaccgaggccgagctcaccgggtacggcacggttaccatggagtgcagcccccgaaccggcctggtgagccacgagatggtcctgctccagatggaagacaaggcctggctggtgcaccgacaatggttcctggacctccccctgccctggctaccaggtgcagacacccaggggtccaactggatccagaaggagacgctcgtgaccttcaagaacccccacgcgaaaaagcaggatgtcgtggtcctggggagccaggagggcgccatgcacacagccctgaccggtgccacggagatccagatgagctccggaaacctactgttcaccggccacctgaagtgccgcctccggatggacaagctccagctcaagggtatgtcttactcgatgtgtactggcaagtttaaaatcgtgaaggagatcgctgaaacccagcacggaactatcgtaatccgcgtccagtacgagggcgacggtagcccctgcaaaataccattcgagatcatggacctcgagaagcggcatgtgttggggcgcctgatcaccgtgaaccccattgtgacggagaaggactcccctgtgaacatcgaggcggagccgcccttcggcgacagctatattatcataggagtcgagcctggccagcttaagctgaactggttcaagaaggggtccagcatcggacaaatgttcgagaccacgatgcgcggcgccaagcgtatggcggttctaggagatacagcatgggacttcggtagtctcgggggggtgttcaccagcattgggaaggccctgcaccaggtgtttggcgcgatttacggcgctgccttctccggggtgagctggaccatgaagatcctgattggcgtgatcataacttggatcggaatgaactcccgcagcacgtccctcagcgtgtccctagttctggtgggcgtggtgaccctgtacctcggggtgatggtgcaggccgacaccggctgtgttgtgtcatggaagaacaaggagttgaagtgtggatctgggatcttcatcacggataacgtgcacacgtggacggagcagtacaaatttcagcccgagagcccctctaagctggcttccgcaattcagaaggcccacgaagagggtatttgcggtatccggtcagtcacccgcctcgagaacctgatgtggaagcagataacgcccgagctgaaccacatcctctccgaaaatgaggtgaagctgaccatcatgacgggcgacatcaaggggatcatgcaggcgggcaagcggagcctgcgcccgcagcccaccgagctcaaatacagttggaagacgtggggcaaggctaaaatgctgagcaccgagtcccacaatcagactttcctgatcgatgggcccgagaccgcggagtgcccgaacacgaaccgggcctggaactcactcgaggtggaagactacggtttcggggtcttctccaccaacatctggttaaagctgcgggagaagcaggacgtattctgtgatagtaagctcatgtccgcagccatcaaagacaaccgtgccgtgcacgcggacatgggctattggatagagagcgccctgaatgacacttggaagatggagaaggcctccttcatcgagatcaagtcttgccactggcccaaatcgcacaccctatggagcaatggcgtcctcgagtctgaaatgatcatccccaagaatttcgccgggcccgtgagccagcacaactaccggccgggataccacacccagactgcagggccctggcacctgggcaagcttgagatggacttcgacttctgcgaagggacaaccgtggtcgtgaccgaggactgcggcaatcggggtcccagcctccgcacgaccaccgcaagcgggaagctgataaccgagtggtgttgccggtcgtgcacgctgcctccgctccggtatcggggggaggacggctgctggtatggcatggagatccgccccttaaaggagaaagaggagaaccttgtgaattccctcgttacagcagggcacggtcagatagacaacttcagcctcggcgtgctggggatggcactcttcctggaggagatgctccggacccgagtgggcaccaagcacgccatcctcctggtcgcggtgtccttcgtcacgctgataaccgggaacatgtcctttcgggacctcggccgcgtcatggtgatggtgggcgccaccatgaccgacgacatcggcatgggcgtcacgtatctggccctgctcgccgccttcaaggtgcgccccacattcgccgcaggtctgttactacggaagctgacgtccaaagagctgatgatggccactattggcatagcgctcctgagccagtccacgattcccgagaccatactcgaactcacagacgccctggcgctggggatgatggtgctcaaaatcgtccgcaacatggagaagtaccagctggctgtgaccatcatggccatcagctgcgtgccgaacgccgtcatcttgcagaacgcatggaaggtgtcctgcacgatcctcgcggccgtcagcgtgagccccctgctgctcacaagttcccagcagaaggccgactggattcccctagccctgacaatcaagggacttaaccccacggcgatcttcctgactaccctgagccggacctccaagaagcgcagctggccgttgaacgaggccgtgatggccgtcggcatggtgtccatcctggcaagcagcttactcaagaacgacattcccatgactgggcccctggtggccggcgggctgctcaccgtctgctatgtactgaccggtcggtcggcagacctggaactcgagcgcgccgcggatgtgaagtgggaggaccaagcagaaataagcgggtccagccccattctgtccatcaccatcagcgaggacggctccatgagcatcaaaaacgaagaagaagaacacacactgacgatcctcatccggacgggcctgttggtcatcagtggggtgttcccggttagcatccctatcaccgccgcggcgtggtatctctgggaggtcaaaaaacagcgggccggcgttctttgggatgtgccctcaccaccgcccgtcgggaaggccgagctggaggatggcgcctatcgcatcaagcagcgcggaattttcggctacagccagattggcgcaggggtatacaaggaaggcaccttccacacgatgtggcacgtgacgaggggggccgtacttatgcaccgcggcaagcggatcgagccgtcctgggcggatgtaaagaaggacctgatctcctacgggggcgggtggaagctggagggggagtggaaggagggcgaagaggtccaggtcttagcactcgaaccggggaagaaccccagagccgtgcaaaccaaacccggcctgtttaagactaataccggtacgatcggcgcggtttcgctcgacttcagccctggcaccagtggttcccccatcgtcgaccggaaaggaaaggtcgtggggctgtacggcaacggcgtcgttacacgatcgggggcctatgtgagcgccatcgcacagaccgagaagtccatcgaagacaaccccgagatcgaggacgacatctttcggaagaaacgccttacgatcatggacttacaccctggcgcgggaaagaccaaacgctacctgcccgcaatcgtacgcgaagccatcaagcggggcctgcgcaccctgatcctcgccccgaccagggtagtagccgcggagatggaggaggctcttcgggggcttcccattcgctatcagacgcccgccatccgggccgagcacactggccgcgagatcgtcgacctcatgtgccacgccaccttcacaatgcggctgttgtcccccgtacgcgtgccgaactacaacctcatcatcatggacgaggcgcatttcacggaccctgcctccatcgccgcccggggctacatctccacccgcgtcgagatgggggaggcggcgggcatattcatgaccgccacgccgcccgggtcccgtgacccgttcccccagtccaacgcccccatcatggacgaagagcgtgagattcccgagcgaagttggaattccggccacgaatgggtcacggacttcaagggcaagaccgtgtggttcgtcccgtccatcaaggccggtaacgacatcgcggcgtgcttgcgcaagaacggcaaaaaggttatacagctgtcccggaagactttcgacagcgagtacgtgaaaactcgcgccaacgattgggacttcgtcgtgacgaccgacatttccgagatgggggccaatttcagggccgagcgcgtgatcgaccctcggcgttgcatgaagccagtcattttaaccgatggcgaggagcgggtgatactggcggggcccatgccggtgacacatagctccgccgcacaacgccgaggccggatcggacgcaaccccaagaacgagaatgaccagtatatctacatgggcgagcctctggaaaacgacgaggactgcgcgcactggaaggaggccaaaatgctcctggacaacatcaacacgcccgagggcatcatccccagcatgttcgagcccgagcgggagaaggtcgacgcgatcgacggggagtacaggctgcggggcgaggcccgcaagacatttgtggacctcatgcggcgcggggacctgcccgtgtggctggcctatagagttgccgctgaaggaatcaactacgcggaccgccggtggtgctttgacggtatcaagaacaaccaaatcctcgaggagaatgtggaggtcgagatctggaccaaggaaggtgagcgcaagaagctgaagccgcggtggctggacgctcgcatctactcagaccccctcgcactgaaggaatttaaagagttcgcggcgggccgcaagtccctgaccctaaatctgattactgagatgggccgcctgccgacactcatgacccagaaggcccgggacgccctggacaatctagccgtgctccacaccgctgaggtaggtgggcgtgcgtacaaccacgccctgtccgagctgcccgagacgttagagacactgcttctcctgaccctgctcgccaccgtcacgggaggcatctttctgttcctgatgtcaggtaagggtatcggaaaaatgacattggggatgtgctgcatcatcactgcatccatcctcctgtggtacgcgcagatccagccgcactggatagcggctagcatcatactcgagttcttcttgatcgttctgctcatccccgagcctgagaagcaacggacgccccaggataaccagctgacctatgtggtcatcgcaatcttaacggtagttgcagccaccatggcgaacgagatgggcttcctcgagaagaccaaaaaggacctgggcctgggaagcattactacgcaagaatccgagagcaacatactcgacatcgacctgcgcccagcctccgcctggactctgtacgccgtggcgaccactttcgttacgcccatgctgcggcacagcatcgagaactccagcgtaaacgtgtccctgaccgcgatcgccaatcaggctaccgtgctgatggggctcggccgcgggtggcccctaagcaagatggacatcggtgtgcctctgctcgccatcgggtgctactcccaagtcaacccgataacactgactgctgccctgctcttactcgtcgcccactacgccatcatcggacctggcttacaggccaaggcgacccgcgaggctcagaagcggaccgccgccgggatcatgaagaatccgactgtggacggaataacggtcatcgacttggagcccattccttacgaccccaagttcgagaagcagttgggccaggtgatgctcctggtgctgtgtgtcacccaggtgttaatgatgcgcaccacctgggccctgtgcgaggcgctgacacttgcaaccggcccgatttcgaccctgtgggaggggaaccccggcagattctggaacaccacgatcgctgtgtcgatggcaaacatcttccgcggctcttaccttgcaggggcgggcctcctgttctccatcatgaagaacaccaccaacacccggcggggaacgggtaacatcggagagacactgggggagaagtggaagtcccgcctaaatgccctgggcaagtcagaattccaaatctacaagaagtccgggatccaggaggtcgaccgcacgctcgcgaaggagggaatcaagcgcggagaaaccgaccatcatgccgtgtcccgcggcagcgcgaaacttcggtggttcgtggagcgcaacatggtcacgccggagggcaaggtagtggatctggggtgtggccgcggcggctggtcctactactgcggagggctgaagaacgtccgcgaggtaaagggactcaccaaaggcggtcccgggcacgaggagcccatcccgatgtcaacctacggctggaacctggtgcggctgcaaagtggcgtcgacgtcttcttcaccccgcccgagaagtgtgatacgctgctgtgcgacattggcgagagtagccccaaccccaccatcgaagcgggtagaacactgagggtgctgaacctggtcgagaactggctgaacaacaacacccagttctgcgtgaaggtgctcaacccttacatgccttccgtcatcgaaaagatggagaccctgcagagaaagtacgggggcgccctggtgcggaaccccctgagccgcaactccacgcacgagatgtactgggtgagcaacgctaccgggaatatcgtcagttcagtaaacatgatctcccgcatgctcataaatcgtttcaccatgaagcataagaaagccacatacgaaccggacgtggacctgggcagcgggacgcggaacatcggcatcgaaaacgagatccccaacctggacatcatcggcaaacggatagagaagatcaagcaggaacacgagaccagttggcactacgatcaggaccacccatacaagacatgggcgtaccatgggagctacgaaactaaacagacgggctccgccagctccatggtcaacggggtggtgaagctcctgactaagccctgggacgttgtgccgatggttacccagatggctatgactgacacgaccccattcggccagcagcgcgtcttcaaagagaaggtggatacccgaactcaagagcccaaggagggcacgaagaagctaatgcgcatcaccgccgaatggctctggaaggagctggggaagaaaaagacgccgcggatgtgcacccgcgaagaattcactaggaaggtccggagcaacgccgcgctaggggccatattcacggacgagaacaagtggaagtccgcccgtgaggctgtggaagactcccgcttttgggagctcgtggaccgggagcgcaatttacacctggaaggaaagtgcgagacctgtgtctataacatgatgggcaagcgggagaaaaaactcggagagttcggaaaagctaagggctctcgcgcgatatggtacatgtggctgggcgctcggttcctggagttcgaggcattaggcttcctcaacgaggaccattggttttcacgtgggaacagcctgtccggcgtcgagggggagggccttcacaagctgggttatatcctgcgggacgtaagcaagaaagaggggggggctatgtacgcagacgataccgccgggtgggacacgcgcatcactctcgaagacctgaagaacgaggagatggtaactaaccacatgaaaggagagcacaagaagctagccgaggccatctttaagctcacctatcagaacaaggttgtccgcgtccagcggccaacgccccgcgggaccgtgatggacatcatcagccggaaggaccagcgcggcagcggtcaggtcgggacatacggcctgaacaccttcacgaatatggaagctcagctgatccggcaaatggagggggaaggcattttcaagtccatccagcgcttaaccgtgaccgaggaaatcgcggtacagaattggctggtgcgggtcggtcgcgagcggctgagccgcatggccgtgtcgggggacgattgcgtggttaagcccctcgacgaccggttcgccagcgccctaaccgccctgaacgacatgggtaaagtgcgcaaggacatccagcaatgggaaccctcccgagggtggaatgactggacgcaggtacccttctgcagccaccacttccatgagttagtcatgaaggacggccgcgttttggtggtcccgtgtcggaaccaggatgaactgatcgggcgggcgagaatctcccagggcgctggctggagccttaaggagaccgcctgcctggggaagtcctacgcccaaatgtggaccctgatgtacttccaccgccgggacctccggcttgctgcaaacgccatctgcagcgccgtaccctcccattgggttcccaccagtcggaccacgtggtccattcacgccaaacacgaatggatgaccaccgaagacatgctggcggtatggaaccgcgtgtggatccaggagaacccgtggatggaggacaaaacgcccgtggagagctgggaagaagtcccctacctgggcaagcgcgaggaccagtggtgcgggagcctaatcggtcttacttcccgcgcgacctgggcaaagaacatccagaccgccattaaccaggtgcgttcactcatcgggaacgaggagtatacagactacatgccctccatgaagagattccgcaaggaagaggaggaagccggtgtcttatggtga

SEQ ID NO: 25166 - RNA, 9876 nt, synthetic construct
  misc_feature 1..9876: note = derived and/or modified CDS sequence (opt11) from DENV-2__EU529693__SS-prME
  source 1..9876: mol_type = other RNA
actgccggggtgattattatgctgatccccaccgccatggcgtttcacctcaccacgcgaaacggggaaccccacatgatcgtaggccgccaggagaagggtaaatccctgctttttaagaccgaggacggtgtgaacatgtgcacgttaatggccatcgacctgggtgagctgtgtgaggacactatcacgtacaagtgccccctcctacggcagaacgagcccgaggacattgactgctggtgcaactcgacaagtacctgggtgacctacgggacctgcaccacaacgggcgagcacaggcgggagaagcgatccgtcgcccttgtgccccatgtgggcatgggcctcgagacccgcacagagacctggatgagcagcgagggtgcctggaagcacgtccagcggatcgagacctggatcctacgccacccgggcttcactactatggccgcgatcctggcttataccatcgggaccacccacttccagcgggcattgatcttcattctacttaccgccgtggctccaagcatgaccatgcgctgcatcggcatttccaaccgagacttcgtggagggcgtcagcgggggctcttgggtcgacattgttctggaacacgggagttgtgtgacgactatggccaagaataagcctaccttggattttgagcttattaagacggaggccaagcagccagccacgctccgaaagtactgtattgaggccaagctgaccaacacaacgacagagtcccggtgcccaacccagggggagcccagcctaaacgaggagcaggacaaacgtttcatctgcaagcactccatggttgaccggggttgggggaatggctgcggcctgttcggcaaaggcggcattgtgacctgcgcgatgtttacgtgcaagaagaacatggaggggaaggtggtgttacccgaaaacctggagtacacgatcgtaatcacgccccactctggggaggagcacgccgtcggaaacgacaccggcaaacatggtaaggaaatcaaaatcaccccgcaatccagcattaccgaggctgagctcacgggatacggcaccgtgaccatggagtgcagcccccggacgggcctggatttcaacgagatggtgctgctacaaatggaggacaaggcttggttagtgcaccgacaatggttcttagacttgcccctgccctggcttccgggggccgacacgcagggcagcaactggatccagaaagagaccctcgtgaccttcaagaacccccacgcgaaaaagcaggacgttgtcgtgcttggatcccaagagggagcgatgcacaccgccctgaccggggccaccgagatccagatgtctagcggaaacctcctgtttacggggcacctgaagtgccgccttcgaatggacaagctgcagctgaaggggatgtcctactctatgtgcaccggcaagttcaaaatagtcaaagagattgccgagacgcagcacgggaccatcgtcatcagagttcagtacgagggagatggttccccatgcaaaatccccttcgagatcatggacctagaaaaacggcacgtcctcgggcgcctaatcaccgtgaacccgatagtgacagagaaggactctcccgtcaacatagaggcggagccgccattcggcgactcgtacatcatcattggtgtcgagccaggccaactcaagctgaactggtttaagaaggggagctccatcggacaaatgttcgaaacgaccatgcgtggcgccaagagaatggctatcctgggggacacagcatgggactttgggtcgctcgggggcgttttcacttccatcgggaaggcacttcaccaggtcttcggcgccatatacggcgcagccttcagcggggtgagttggacgatgaaaatcctgatcggcgtgatcataacctggatcggcatgaactcacgctccaccagtctctccgtcagcctcgtgttggtcggtatcgtcaccctgtacctcggggtgatggtgcaggctgacacgggctgcgttgtaagctggaagaacaaggagcttaaatgcggcagcgggatattcatcaccgacaatgtccacacctggacagagcagtacaagttccagcccgagtcccctagcaaactggcgtccgccatacagaaagcccacgaagaaggaatctgcgggatccggagtgtgactaggcttgagaacctgatgtggaagcagatcaccccggagctgaaccacatcctcagcgagaacgaggtgaaactgaccattatgactggcgacatcaagggaataatgcaagccggtaagagatccttgcgccctcagcccacggagctcaagtacagctggaagacctggggcaaggccaagatgctgtccaccgagagccataaccagacctttctgatcgacgggcctgaaacggcggagtgccctaacactaaccgggcctggaactccttagaggtggaagactacggcttcggggttttcagtaccaacatctggcttaagttaagagagaagcaggacgttttctgcgactccaagctcatgagcgccgccataaaggataatcgggctgttcatgctgacatgggctactggatcgagtccgcgctgaacgatacctggaaaatggagaaggcgagcttcatcgagattaagtcctgccattggcccaagtcgcacaccctatggtctaacggcgtcttagaatctgagatgatcattcccaagaacttcgccggtcccgtatcccagcataactaccgtccgggataccacacacagaccgccgggccctggcacctggggaagctggagatggactttgacttctgtgaggggaccaccgtggttgtcacggaagactgtggtaaccggggccctagcctccgcacgaccaccgccagcggaaaactgatcacggaatggtgctgccggtcttgtaccctgccccctttgcggtacaggggcgaggacgggtgctggtacggcatggagatacgccccttaaaggagaaggaggagaatctggtgaacagcctcgtcacagccgggcacggccagatcgacaacttttccctgggcgtgctggggatggcccttttcctggaggagatgctgcggacgcgcgtaggcacgaagcacgcaatcctgctggtagcggttagcttcgtgaccctgatcaccgggaacatgtcctttagagacctcggtcgcgtcatggtgatggtgggtgctaccatgacggatgacatcggcatgggtgttacctatctagccctgttggcggccttcaaggtgcgcccgacgtttgcggccggactgctgctccggaaactgacgagcaaagagctgatgatggctactatcggtatcgcactactatcccagagtactatcccagagacgatcctagagctcacggacgcgctagcgttgggcatgatggtgctcaagatcgtgcgcaacatggagaagtatcagctggccgtgacgattatggccatctcctgcgtgccgaacgcagtcatccttcaaaacgcttggaaggtgagctgtaccatcctggcggcagtgtccgtctcgcccctgctgctgacatccagccagcaaaaggctgactggatcccactggcactgacaatcaagggtctcaaccccacggcgatcttcctgaccaccttgtcacgtacgtcgaagaagcgctcgtggccgctcaacgaggccgtgatggccgtcgggatggtgtccatcctggcttccagcttgctgaaaaatgacatccccatgacggggccgctagtggccggcggcctactgacagtctgctatgtgctgacgggccggagcgcggacctggagctcgagcgagccgccgatgttaagtgggaggaccaggcggagatcagtgggagctcgcccatcctgagcatcaccatctcagaggacggcagcatgtccatcaagaacgaggaggaggagcacacgctgacgatactcatccggaccggcttgctggtcatcagcggtgtgttccccgtgtccatccccatcaccgccgcggcctggtacctttgggaggtcaaaaagcagcgcgccggcgtcctctgggacgtgcccagcccgccgcccgtcggaaaggccgagctggaggacggcgcctaccggatcaagcagcgtgggatcttcggctactcccaaattggcgctggggtctacaaggaggggaccttccacacaatgtggcatgtgaccagaggagccgtcctcatgcaccgcggcaaacggattgagccaagctgggccgacgtcaagaaggaccttatctcctatgggggcggctggaagctcgagggcgagtggaaggagggcgaggaggtgcaagtactcgccctagagccaggtaagaacccgcgcgccgtgcagaccaagcccggactctttaagaccaataccgggaccatcggcgcggttagcctcgacttctcccccggaaccagcggatcccccatcgtcgaccggaagggcaaggttgtgggtctgtacggcaacggggtcgtgacccgcagcggtgcctacgtatcggcaatcgcccagacggaaaagtccattgaggacaaccctgagatagaggacgatattttccgtaagaagcgtctgacgattatggatctccaccccggtgcggggaagaccaaacggtacctgcccgccatagtgcgcgaagccatcaagcgggggctgcgcacgttgatactcgcgccgacgagagtggtggctgccgaaatggaagaggccctgcgggggctgcccatccgctatcaaacccccgccatccgtgccgaacacaccggccgggagatcgtcgatctaatgtgtcacgcaactttcaccatgcggttgctgagccccgtccgcgtgccgaactacaacctcattattatggacgaggcgcatttcacggaccccgcctccatcgccgcacgggggtacatctccacccgcgtcgaaatgggcgaggccgcgggtatcttcatgaccgccacgccgcccgggtcccgagacccgtttcctcagagcaatgcgcccatcatggatgaggagcgcgagattcccgagcggagttggaacagcggccacgagtgggtgacggactttaaggggaagaccgtgtggttcgtcccgtccataaaagcagggaacgacatcgcggcctgccttcgcaagaacggcaagaaggtgattcagctaagcagaaagaccttcgactctgaatacgtgaagacgagggccaacgactgggacttcgtcgtgaccactgacatctcagaaatgggagccaacttccgggccgaacgcgtgatcgacccccggcgctgtatgaagcccgtaatcctcaccgacggtgaggagagagtgatactggccgggcccatgcctgtgacgcattccagcgcagcccagcgccgcggccgaatcgggcgaaaccccaaaaacgagaacgatcagtacatttacatgggcgagccactagagaacgacgaggactgcgcccactggaaggaggcgaagatgctacttgacaatattaacactcccgagggtattatcccgtcgatgttcgagcctgagcgggagaaggtcgacgcgatcgacggggaataccgcctgcgtggcgaagcccgcaagacttttgtggacctgatgcggcgcggggacctgcccgtgtggctagcctaccgagtcgccgctgagggcataaactacgcggatcgccggtggtgctttgacgggatcaaaaacaaccaaatcctggaggagaacgtggaggtcgagatctggacaaaagagggtgagcgaaagaaactgaaaccgagatggttggacgcccggatctacagcgaccccctcgcgctgaaggagtttaaagagtttgcggctggccgtaaatccctaacgctcaacttgatcacagaaatggggagactgcccacctttatgacgcagaaggcccgggacgccctcgacaatctagccgtcctgcacaccgctgaagtgggcgggcgcgcttacaaccacgccctcagcgaactgcccgaaaccctggaaacactcttgcttttaaccctgctggccacggtcaccggcggcattttcctcttcctgatgtccgggaagggcatcgggaaaatgacactgggcatgtgctgcatcattacggccagtatcctcctgtggtacgcacagatacagccgcactggatcgcggccagcatcatcctggagttcttcctcattgtgctgctgatccccgagccagagaagcagcggacgccccaggacaaccagctcacgtacgtggtcatcgccatcttaaccgtggtggccgcgaccatggcgaacgaaatgggattcctggaaaagaccaagaaggaccttggcctgggcagcataacgacccaggagagcgagtccaatatactggacatcgacctacgacctgcgtcggcctggacgctgtatgccgtggccaccacgttcgtgactcccatgctgcgccactccatcgagaactcatccgtgaacgtttcacttaccgcgatagctaaccaggccaccgtgctcatggggctgggccgcgggtggccattgtccaaaatggacatcggcgtgcccctgctggccatcgggtgttacagccaggtcaacccgatcactcttaccgccgccttactgctcttagtggcccactatgcaatcatcggccccggcctccaggccaaggcgaccagagaggcccagaagcgcaccgccgccggaataatgaagaatcccacggttgacggcatcactgtgatcgacctagagcctattccgtacgaccccaaattcgagaagcaactgggccaggtgatgctgctcgtgctgtgcgtcacccaggtgttgatgatgagaaccacgtgggccctctgcgaggcgttaactctggccaccggcccgatcagcacactctgggaggggaaccccggccgtttctggaacactaccatcgcagtgagcatggcgaatatattccgcggcagttacctggccggggcgggcctcctgttcagcatcatgaagaacaccaccaacacgcggagggggaccggcaacatcggggagaccctaggagaaaagtggaagtcgcgactgaacgcactcggaaagagcgagttccaaatctacaagaaatcagggattcaagaggtcgaccggaccctcgcaaaagagggtattaagagaggggaaactgaccaccacgccgtgtcacgcggctccgcaaagctgcggtggttcgtggagcgcaatatggtcacgccagagggcaaggtggtggacctcgggtgcggccgcggcgggtggagctattactgtggcgggttgaagaatgtccgagaggtgaagggcctgaccaagggcggtcccgggcacgaggaacccatcccgatgtccacgtacggatggaatcttgtgcggctgcagagcggtgtggatgtcttcttcacgccgcccgaaaagtgtgacaccctgctatgcgacatcggcgagtcttcccccaatcccactatcgaagccggccggactctgcgggtgctgaacctagtcgagaactggctgaacaacaatacccagttttgcgtcaaggtgctcaacccgtacatgccaagcgttatcgagaagatggaaacgttgcagcgcaaatacgggggcgctctcgtgcggaatcctttatcccgcaactctactcatgaaatgtactgggtatcaaatgcaacagggaacatagtcagctctgttaacatgatcagccgcatgctgataaaccgcttcaccatgaagcacaagaaggcgacgtacgagccggacgtggacctcggcagcgggacgagaaacatcggtattgagaatgagatccctaacttggacatcatcggaaagcgaatcgaaaagataaagcaggagcacgagacgagctggcactacgaccaggaccacccgtataagacctgggcgtaccacggtagttacgagactaagcaaaccggttcggccagtagcatggtcaacggggtcgtgaaattactcaccaagccctgggacgtggtacctatggtgacccagatggccatgacggacaccacccccttcggccagcaacgcgtcttcaaggagaaggtggacactcggacgcaggagcccaaggagggtactaagaagctaatgcgcatcaccgccgagtggctgtggaaggagctcggaaagaagaaaacgcccaggatgtgcactcgcgaggagttcaccaggaaggtgcgttccaacgccgcgctgggagctatctttacagacgagaacaagtggaagtctgctcgggaagcggtcgaggactcgcgcttctgggagctggtggatcgtgagcgcaacctacatctggaggggaagtgcgagacctgcgtctacaatatgatgggcaagcgggagaagaagctgggagagttcggcaaggcaaagggcagccgcgcaatatggtacatgtggttaggggcccggttcctggagttcgaagcactgggcttcctcaatgaggaccactggttctcccgcggtaatagcctaagcggcgtggagggggagggtttacacaaactcggctatatcttacgggacgtgagtaagaaggagggcggggccatgtacgcggacgatacggcggggtgggacacccgcatcaccctggaggatctcaagaatgaggagatggtcaccaaccatatgaagggcgagcacaaaaagctggcggaagctatattcaagctgacttaccagaacaaggtggtgcgggtccagcgtccgactccacgggggacggtgatggacatcatcagccggaaggatcagcgcggttccggccaggtcgggacgtacggcctcaatacgttcaccaacatggaggcgcaactcatcaggcagatggaaggagaggggattttcaagagcattcaacgcctgacggtcactgaggagatcgcggtgcagaactggctcgcacgcgttggacgcgagcggctgtcccgtatggccatctcaggggacgactgcgtagtgaagcccctggacgaccggtttgccagcgccctcacggcgctgaacgacatgggcaaggtgcgcaaggacatacagcagtgggagccctcacgaggctggaacgattggactcaggtcccgttctgcagccaccacttccacgagctagtgatgaaggacggccgtatgcttgtagtcccgtgcaggaaccaggacgaattgatcgggcgcgcccgcattagccagggcgcaggctggtctctgaaggaaaccgcttgcttaggcaagtcctacgcccagatgtggaccttaatgtacttccatcgcagggatctacgtctcgcagccaacgccatctgctccgcggtgccgagccactgggtgcctacttcccggacgacgtggagcatccacgccaagcacgaatggatgacaacagaggatatgctggcagtctggaacagagtatggatacaggagaatccgtggatggaggacaagacacccgtggaatcctgggaggaggttccgtaccttggcaagcgcgaggaccaatggtgcgggagcctcatcggactcaccagccgggcaacttgggcgaaaaacatccagacggccatcaaccaggtccgatccctgatcgggaacgaagaatacacagattacatgcccagcatgaagagattcagaaaggaggaggaggaggctggtgtactctggtga

SEQ ID NO: 25167 - RNA, 9876 nt, synthetic construct
  misc_feature 1..9876: note = derived and/or modified CDS sequence (opt11) from DENV-2__EU482557__SS-prME
  source 1..9876: mol_type = other RNA
accgccggcgtgatcatcatgctgatcccaaccgccatggcgttccacctcaccacccgcaatggggagccccacatgattgtgggccggcaggagaagggcaagtccctcctgttcaagaccgaagacggcgtgaatatgtgcacccttatggccattgacctgggggagctgtgtgaggataccatcacctacaaatgcccccttctgcgtcagaacgaaccagaagacatcgactgctggtgcaatagcaccagcacctgggtgacctacgggacctgcaccaccaccggcgagcatcggagagagaagagatccgtcgcgcttgtgccccacgtgggtatgggtctcgagacccggactgagacatggatgagctcggagggggcatggaaacacgttcagcggattgaaacctggatcctgcgccaccccggcttcaccatcatggccgcgatcctcgcctacaccatcgggaccacccactttcagcgggccctaatcttcatcctgttaaccgccgtagcgcccagcatgactatgcgctgtattggcatctccaaccgagacttcgtggagggcgtcagcgggggctcctgggtagacatcgtgctcgagcatgggagctgcgtcacaacgatggccaagaataagcccaccctggacttcgaactgatcaagaccgaggccaagcagccggccacgttacgaaagtactgcatcgaggcaaagctgacgaatactaccaccgagtccaggtgcccgacccaaggcgagccgtctctgaatgaggagcaggacaagcgctttatatgcaagcactccatggtagacagaggctgggggaacggctgtggcctgttcggcaagggagggatcgtgacctgcgcaatgttcacatgcaagaaaaacatggagggcaaggtcgttctgcccgagaacctggagtacaccatcgtaattacgccacactctggcgaggagcacgccgtaggtaatgacacagggaagcacggcaaggagatcaagattaccccgcagtccagcatcacagaggcagagctcaccgggtacggcacggtaacaatggagtgcagtccacggaccgggcttgacttcaacgagatggttttgctccaaatggaggataaggcctggctggtccatcggcagtggttccttgacctcccactgccctggctgccgggggccgacacccagggcagcaattggatccagaaggaaacgcttgtgaccttcaagaatccccacgcgaagaaacaggacgtggttgttctggggtcgcaggaaggggcgatgcataccgccctgactggggccacggagatccagatgtcgtctggaaacctcctgttcaccggccacctgaagtgccgcctccggatggacaagctgcagctgaaggggatgagttacagcatgtgcaccggaaagttcaagatcgtcaaggaaattgcggagacccaacacggtacgatagtgatcagggtgcaatacgaaggcgatggctcaccctgcaagatccccttcgagatcatggacctcgagaaacggcatgtcctggggcgattgatcacggtgaaccctatagtcacggaaaaggacagcccagtcaatattgaggcagagcccccctttggcgactcatacatcatcatcggggtggaaccgggccagctcaagctgaactggtttaagaaggggagctcaatcggccagatgtttgagacgacgatgagaggcgccaaacggatggccatcctgggggacaccgcctgggacttcggcagcctcgggggcgtgtttacgtcgatcgggaaggccttacatcaggtcttcggcgcgatctatggcgccgccttcagcggggtgtcatggaccatgaagatcttgatcggcgttatcatcacgtggatagggatgaatagccgttccaccagcctgtccgtcagcctcgtgctggtcggcgttgtcaccctgtacctcggggttatggtccaggccgactccgggtgcgtggtgagctggaagaacaaggaactgaaatgcggctcggggatcttcatcaccgacaacgtccatacgtggaccgagcagtacaagttccagccagaaagccccagcaagctggcgtccgccatccaaaaggcccacgaggagggcatatgtgggatccggagcgtgacccgcctcgaaaacttaatgtggaagcaaatcaccccggagctgaaccacatcttatccgaaaatgaggtgaagttaacaatcatgaccggcgacatcaaggggattatgcaagccgggaagaggagcttacgcccgcagcctaccgaactcaaatactcctggaagacttggggcaaggccaagatgcttagcacggagtcccacaaccagactttcctgatcgacggtcccgagaccgcggaatgcccgaacactaaccgggcctggaatagcctcgaggtcgaggactacggattcggggtattcagtacgaacatctggctgaagctgcgagagaagcaggacgtgttctgcgacagcaagctcatgtccgccgccattaaggataaccgggctgtccacgcggacatgggatactggattgaaagcgcactcaacgacacttggaagatggagaaagcatccttcatcgaagtgaaaagttgccactggcccaagtctcacaccttatggtccaacggcgtgttggagtccgagatgatcatcccgaagaacttcgccgggcctgtgagccagcacaactaccgcccaggctaccacacccaaaccgccgggccctggcacctgggcaagctggaaatggacttcgacttctgcgaggggacgaccgtggtggttacggaggactgcggcaaccgtggcccaagcctccgaacaacaacagcgtccgggaagttgatcactgagtggtgctgcagaagctgcacactgcccccactccgctaccggggcgaggatgggtgctggtacgggatggagattcgccctctgaaggagaaggaggaaaacctggtgaactcgttagtgacggccgggcacggccagatcgataacttcagtctgggcgttctggggatggccctttttctcgaggaaatgctgcgaacccgcgttggcaccaaacacgctatcttactggtggcggtctcctttgtgactttaatcaccgggaacatgagcttccgggacctcggccgcgtgatggtcatggtgggcgccaccatgacggatgacattggcatgggtgtgacctatctggccctactcgccgccttcaaggtccgccccacgtttgcggcggggttattgctccgtaagctaacgtctaaggagctgatgatggccaccatcggcatcgccctcctatcccaatccaccatccccgagactatcctggagctcaccgacgccctggcgctgggcatgatggtactcaagatcgtgcgaaacatggagaagtaccagctggctgtcaccatcatggccatctcttgtgtaccgaacgcagtgatcctgcaaaacgcttggaaggtctcctgcacaatcctcgcggccgtgagcgtcagcccgctgctcctcacaagcagtcaacagaaagcggactggattcccctcgccctgaccataaagggcctcaacccgaccgcaatatttctgaccacgctgtcgcgaacctcaaagaaacgcagctggccgcttaacgaggcggtgatggccgtgggcatggtctccatcctggccagctcgctgctcaagaacgacatcccaatgacggggcccctggtagccggcggactgctcactgtgtgctacgtactgacgggccggtccgcggacctggagctcgagcgcgctgccgatgtgaagtgggaggaccaggccgagatcagcggatcctcccccatccttagtatcaccattagcgaggacggctccatgtcgataaaaaacgaagaggaagagcacacgctgacaatcttaatacgcactggtttacttgtgatttcgggggtcttccccgtgagcatcccgataaccgcagcggcatggtacctctgggaggttaagaagcagcgcgccggtgttctgtgggacgtgccctcgccgccgcccgtagggaaggccgagctggaggacggcgcctaccggatcaaacagcgcgggatcttcggctattcccaaatcggcgcgggcgtctacaaggagggcaccttccacaccatgtggcacgtgaccagaggggcggtgctcatgcaccgcggcaagcgcatcgaaccctcctgggcagacgttaagaaggacctgatctcatacgggggaggatggaagctggaaggggagtggaaggagggcgaagaggttcaggtgctcgcgctcgagccaggaaagaacccccgcgccgtgcagacaaagcccgggctgttcaagaccaacaccgggaccatcggcgcggtgtccctcgacttcagccccggtacatcagggagccccattgtcgaccggaagggcaaggtagtggggctctacggcaacggcgtggttacccgctccggcgcctacgtgtctgctatcgcccaaacggaaaaatcgatcgaggataacccggagatcgaggacgatatcttccgtaagaagcgcctgaccattatggacctccaccccggcgcgggtaagacgaaacggtacctgcccgctatcgtgcgcgaggccatcaagcgtggcctgcgcaccctgattctcgccccgacccgcgtcgtggccgcggagatggaggaggccctgcggggtctccctatccgctaccagacccccgccatcagagcagagcacacaggacgcgaaatcgtggacctcatgtgccacgcgacgttcaccatgcggctgttgtcccccgttcgcgtgccgaactacaacctcatcattatggatgaggcgcactttactgaccccgccagtatagctgcccggggctacatctccacgcgcgtcgagatgggggaagcagcgggaatcttcatgaccgccacaccgcccggttcgcgggacccgttcccccagtccaacgcccccatcatggacgaagagcgcgagatccccgagcggagctggaactctggacacgagtgggtcaccgactttaaggggaaaacggtgtggttcgtgccgagcatcaaggctggaaacgacatagccgcctgcctgcgcaaaaacggcaaaaaggtcatccagctgtctcggaaaacgttcgacagcgagtacgtgaagacccgcgcaaatgactgggatttcgtggtcacgacggacatctccgagatgggtgccaatttccgggccgaacgcgtgatcgaccctcggcgctgcatgaaacccgtaatcctgaccgacggcgaggagcgggtgattctggcggggccgatgccggtgacccacagctccgctgcccagaggagaggccggatcggtcgcaaccccaaaaacgagaacgatcagtacatctacatgggagagcccctggagaacgacgaggactgcgcccactggaaggaggcgaagatgctcctggacaacatcaatacccccgaggggatcatcccgagcatgtttgagccagagcgggagaaggtagacgcgatagatggggagtaccgcctgcgaggcgaggcccgcaaaacgtttgtcgatctcatgcggagaggggacctgccggtgtggcttgcctacagagtggcggccgagggcatcaactacgcggacagacggtggtgtttcgacggaatcaagaataaccagatcctagaggagaacgtcgaggtggaaatttggaccaaggagggggagcgcaagaagttgaagcctcgatggctggacgcccgcatctactccgaccccctcgccctgaaggagttcaaggagttcgccgcaggccgcaagtcgctgactctcaacctgatcacagagatgggtcgcctacccacgttcatgacccagaaagcccgggacgcgctcgacaacctggccgtcctgcataccgccgaggtaggcgggcgtgcttacaatcacgccctttcagaactacccgagaccctggagaccctcttactactcaccctgctggccacagtgacaggtggcatctttctcttcctgatgagcgggaaggggatagggaagatgacgctgggcatgtgctgcatcatcaccgcttctatcctcctgtggtacgctcagatccagccgcactggatcgcggccagcatcatactggagttcttcctgatcgtcctgttaatacccgagccggagaagcagcggacgccccaggacaaccaactcacctacgtggtcatcgccattctgaccgtcgtggccgcgacgatggcaaacgagatgggtttcttggagaagaccaagaaggacctcggcctgggctcaattaccacccaggagtccgaaagcaacattctggacattgacctacgcccggcttcagcctggactctgtacgccgtggccaccacctttgttacaccaatgctgcgacactccatcgagaactcctcagtgaacgtgtccctcacggccatcgccaaccaggcaaccgttttgatggggcttggccgtggatggcccctgagcaagatggacattggcgtcccgttgctggctatcggctgctactcccaggtcaacccgataaccctcaccgcggccttgctgcttctggtcgcccactatgcgatcatcggccccggcctccaggcaaaagcgacgcgtgaggcacagaagcgaaccgctgcagggatcatgaagaacccgaccgtggacggcatcaccgtgatagacctcgagcccattccgtacgaccctaagttcgagaaacaactgggtcaggtcatgcttctcgtgctctgcgtgacgcaggttctgatgatgagaaccacctgggccttatgcgaggcgctgaccctggccacgggccccattagcaccctctgggaggggaaccccggccggttctggaacactaccatagctgtgtctatggccaatatcttccgcggcagctacttggccggggcgggacttctattctccatcatgaagaacacgactaacacccggcgcgggaccggtaacattggcgagacgctgggggagaagtggaagtcacgtctaaacgccctcggcaaatccgagttccagatctacaagaagtccgggatacaagaggtggaccgcaccttagccaaggagggcataaagcgcggggagaccgaccaccatgccgtctcccgcggcagcgcgaaactgcgttggttcgtcgagcgtaacatggtgacaccggagggcaaagtcgtggacctcgggtgcggtcgcggcgggtggtcctactactgcggcggactcaagaacgtgcgcgaggtaaaggggctgacgaaagggggtcccggtcacgaggaacccatacccatgagcacctacggctggaacttggtgcggctgcagtccggagtggacgtcttcttcaccccgcccgagaagtgtgacacccttttatgcgacatcggcgagtcttctcccaaccccacgatcgaggccggcaggactcttcgggtgctgaatctcgtggagaattggctgaacaataacacccagttttgcatcaaagtcctgaacccgtacatgccctccgtgatcgagaagatggagaccctccagcgaaagtacgggggcgccctggtgcggaaccccttgagccgcaactccacccatgagatgtattgggtcagcaacgcgacgggtaacatagtatccagcgtgaacatgatttcccgcatgctgataaaccggttcaccatgaaacacaagaaggcgacatacgaaccggacgtcgacctaggcagtgggacacgcaatatcggcatcgagaacgagatccccaaccttgacatcatcggcaagcggatcgaaaagatcaagcaggagcacgagacgtcctggcattacgatcaggatcacccctacaagacatgggcgtatcacggcagctacgagacaaagcagaccggatccgcctcctccatggtgaacggggtggtaaagctactcacgaagccctgggacgtggtgccgatggttacccagatggccatgaccgacacgacccccttcgggcagcagcgggtgttcaaggagaaggtcgatacccggacccaggagcctaaggagggcaccaagaagttgatgcgcatcacggccgagtggctctggaaagaactcgggaagaaaaagactccccggatgtgcacccgggaggagttcacccggaaggttcgcagcaacgccgccttaggtgccatcttcacggacgagaacaagtggaaatccgcccgggaagccgtggaggactcgcgcttctgggagctagtcgatcgggagcggaacctccacctggaggggaagtgcgagacctgcgtgtacaacatgatgggtaagcgggagaagaaactcggtgagttcggcaaggccaagggctcccgcgccatctggtacatgtggctcggggcccggttcctggaattcgaggcactgggcttcctgaacgaggatcactggttcagccgcggaaatagcctgtccggcgtggagggggagggcctacacaagctcggctacatcctgcgtgacgtctccaagaaagaaggcggtgccatgtacgcggacgacacagcagggtgggacacccgcatcacgttagaggacctcaagaacgaggaaatggtgaccaaccatatgaagggtgagcacaagaagctggccgaggccatcttcaagctgacctaccagaacaaggtagtccgggtccagcgccccacgccgcgggggacggtgatggacattatctcacggaaggaccagcggggctccggccaggtcggaacgtacggcttaaacacgttcacgaacatggaggcccagctgatcaggcagatggagggggagggcattttcaaatccatccagaggttaaccgtgaccgaggaaatagcggtccagaattggctggcccgggtcggccgcgagcggctgtcacgcatggccatctccggggacgactgtgtggtcaagcccctggacgacaggtttgccagcgccttgacggcgctgaacgacatgggcaaggtccggaaagacattcaacaatgggagccgagccgtgggtggaatgactggacccaggtgccattctgctcacaccatttccacgaacttgtgatgaaggatggaagagtcctcgtggtcccctgccggaaccaggacgagctcatcggtcgcgcccgaatctcccaaggggccggctggtccctgaaggaaacggcctgcctggggaagtcctacgcccagatgtggacacttatgtacttccatcgccgggaccttcgcctcgcggccaacgccatctgttccgccgtcccctcccattgggtgcccaccagcaggacgacctggtccatccacgccaaacacgagtggatgacgacggaggacatgctggcggtgtggaacagagtgtggattcaggagaacccgtggatggaggacaaaacccccgtggagtcgtgggaggaggtgccctacctgggaaaaagagaagaccagtggtgcgggagccttatcggactgacctccagagccacttgggccaaaaacatccagacagctatcaaccaagtacgcagcttgattgggaacgaggaatatacggactacatgccctctatgaagcggttcagaaaggaggaggaggaggcgggcgtgttgtggtga

SEQ ID NO: 25168 - RNA, 9876 nt, synthetic construct
  misc_feature 1..9876: note = derived and/or modified CDS sequence (opt11) from DENV-2__EU482560__SS-prME
  source 1..9876: mol_type = other RNA
accgccggcgtcatcgttatgctcattccgaccgtcatggctttccacctcaccacccgtaacggtgaaccccacatgatcgtgggccggcaggagaaggggaagtccctgctgtttaagaccgaagacggtatcaatatgtgcaccctgatggctattgatctgggggaactgtgcgaggacaccatcacgtataagtgcccgcttttaaagcagaacgagccagaggacatagactgctggtgcaacagcacgagcacatgggttacctatgggacctgtacgaccaccggggagcacagacgggagaagcgcagcgtggccctggtgcctcacgtcggtatgggcctcgagaccagaaccgagacctggatgagcagcgagggggcatggaagcacgtgcagcgcatcgagacgtggattctgaggcatcccggttttaccatcatggccgccatcctggcgtacaccatcgggaccacgcacttccagcgcgccctcatcttcatactgctcaccgccgttgcaccgagcatgactatgcggtgcatcggcatctctaaccgcgactttgtcgaaggcgtgtccgggggctcctgggtggacatcgtgctcgaacacggcagctgcgtgactacgatggccaagaacaagcccaccctggacttcgaattaatcaagaccgaggccaagcagcctgccaccttgcggaaatactgcatcgaggccaaactgacgaacactaccaccgaaagccgctgcccgacgcagggcgaacccagcctgaatgaggaacaggacaagcggttcatctgcaagcactccatggtggacaggggctgggggaacgggtgcgggctatttggcaaaggcgggatcgtgacctgcgctatgttcacgtgcaagaagaatatggagggaaaggtagtgcagccggaaaaccttgagtacacgattgtgatcacgccccactctggggaggagcacgcggtaggcaatgacaccggaaagcacggcaaggagataaagattaccccgcagtccagcatcactgaggccgagctcaccgggtatggcactgtgaccatggaatgcagtccccgaaccggcctcgatttcaacgagatggtgctcctgcagatggaggacaaggcctggttagtgcaccgccagtggttcctggacctgccgctcccctggctgccgggggctgacacacagggcagcaactggattcagaaggagacccttgtgaccttcaagaacccccatgccaagaagcaagacgtcgtggtcctcgggtcccaggaaggcgcgatgcacaccgccctgaccggggcgacggagatccagatgagcagcggcaacttgctgttcaccggccacctgaagtgtcggctgcgcatggacaagcttcagttgaagggtatgtcgtacagcatgtgcaccggtaagtttaaaatcgttaaggagatcgcggagacccagcacgggacgatcgtcatcagggtgcagtacgagggcgacggctccccctgcaagatacccttcgagatcacagatttagagaagcgccacgttttggggcggctgattactgttaaccctatcgtcaccgagaaggacagccccgtgaatatcgaggccgaaccgccctttggcgactcgtacataattattggggtggagccgggccaactgaagctcaactggttcaagaagggctcatccattggccagatgttcgaaacgacaatgaggggcgcgaagcgtatggccatcctgggagacacggcttgggacttcggcagccttgggggcgtcttcacctccatcggcaaggctctccatcaggtgttcggggccatttacggcgcggctttctcgggggtgtcctggacgatgaagatcttaataggtgttatcataacttggattggcatgaacagccggtccaccagcctgtctgtgagtctcgtactcgtcggcgtggtcaccctttatctgggagccatggtgcaggccgacagcggatgtgtggtgagctggaagaataaggagctcaagtgcggctccggtatattcatcacggacaatgtgcacacctggaccgaacaatacaaattccagcccgagtcgcccagcaagctggcttccgccattcagaaggcccatgaggagggaatctgcgggatccgctccgtgacccggctagaaaatctcatgtggaagcaaatcacgcccgaactgaaccacatcctgtccgagaacgaggtaaagcttactataatgacaggcgacataaaggggatcatgcaagccggcaagcgcagcctgcggccgcagcccaccgaactgaagtactcctggaagacgtggggcaaggcgaagatgttaagcacagagtcgcacaaccaaaccttccttatcgacgggcccgagaccgcggagtgcccgaacacgaaccgggcatggaacagcctggaggtcgaggactacgggtttggggtttttaccacaaacatctggctcaaactgagggagaagcaagacgccttctgcgactccaagctgatgagtgccgcgatcaaggacaatcgcgctgtgcacgccgacatgggctactggatcgagtccgctctgaacgacacctggaagatggagaaagccagcttcatagaggtcaaatcctgccactggcccaagagccatacactatggtcgaacggcgttctggagagcgagatgattatccccaagaacttcgccgggcccgtgtcccagcataaccatcggccgggatatcacacgcagaccgcgggaccctggcacctcggtaagttagagatggacttcgatttctgcgagggtaccaccgtcgtggtgacagaggattgtggcaaccgtggcccctcactgcgcacgaccacagccagcgggaagttaatcacggagtggtgctgccgctcctgtaccctacccccgctacggtacagaggcgaggacggttgctggtacggtatggagattagacccttgaaggagaaagaggagaatctggtcaactcactggtgaccgccgggcacggccaaatcgacaatttctccctcggcgtcctgggaatggccctgttcctcgaggagatgctgcgcacccgggtcggtacgaagcacgcgatactgctcgtggcagtgagcctggtcaccctgatcactggaaatatgtcatttcgcgacctcggccgggtgatggtgatggttggagccaccatgacagacgacatcggcatgggcgttacctatctggcattgctcgccgcgttcaaagtgcgccccaccttcgccgccggactactgctccgcaagttgaccagcaaggagcttatgatggccaccatcggcattgccctcctgtcccagtctaccatccccgaaaccatccttgagctcacagatgcgctggcgctggggatgatggtcttaaaaattgtgcgcaacatggagaagtaccaactggccgtgacaattatggcaatctcctgcgtcccgaacgccgtaatcctgcagaacgcgtggaaggtgtcgtgcaccatccttgccgccgtctccgtgagccccctgcttttaacgtccagccagcaaaaagccgactggatcccgctggcgcttactatcaagggcttgaaccccacggccatcttcctgaccaccctgtcccgtacctccaagaagcggtcctggccgcttaacgaggctatcatggccgtgggtatggtcagcatcctggccagcagccttttgaaaaacgacatcccaatgacggggcccctggtggcgggggggctgctcaccgtctgctacgtgctgaccggccgcagcgcagacttggaactcgagcgggccgccgacgtgaagtgggaggaccaggcagagatatccgggagctcccccattctgagcatcaccatctccgaggacggcagcatgtccatcaagaacgaggaagaggagcagactttgaccatcctgatccgcaccggcctgctagtcatcagcggggttttcccggtgtccatccccatcaccgcggcggcctggtacctctgggaggtcaagaagcagcgggctggcgtgctgtgggatgtgcccagcccgccacccgtcgaaaaggccgagctagaagacggggcctaccgcataaagcagcggggcttcctcgggtacagtcagatcggcgccggcgtgtacaaggaagggacgttccacacgatgtggcacgttactcgcggagccgtcctgatgcaccgggggaagcgcatagaacccagctgggcagacgtgaaaaaggacctcatctcctatggagggggctggaagttagagggcgagtggaaggagggggaggaagtgcaggtgttggccctggagcccggcaagaatccccgggcggtgcagaccaagccggggatcttcaagaccaacacgggcaccattggggccgtgagcctcgacttctcccccggcaccagcggaagccccatcgtcgaccgcaaggggaaggttgtgggcctgtacgggaatggggtcgtcacccggagcggcgcctacgtatccgcgatcgcgcagaccgaaaagtccattgagaacaaccccgagatcgaagatgacattttccgcaagaagaggctgaccatcatggaccttcatcctggggccggcaagaccaaacgctatctgcctgccatcgttcgggaagctataaagcgcgggctgcggaccctgattctcgccccgacgcgcgtggtggcggccgaaatggaggaggcactgcgcggactgccgatccggtaccagacacccgccatccgcgccgagcacaccgggcgggaaatcgtcgacctcatgtgccacgctaccttcacaatgaggctactgtctcccgtgcgggtgcccaactacaacctcatcatcatggatgaggcccacttcaccgatcccgcgtctatcgcagcccgcggctacatcagcacccgggtcgagatgggcgaggcggcagggatcttcatgaccgccaccccgcccggctcgcgcgaccctttcccccagagcaacgcccccatcatggacgaggagcgggagatacccgagcgctcttggaacagtgggcacgagtgggtaaccgacttcaagggtaaaactgtgtggtttgtcccgtccatcaaggcgggcaacgacatcgccgcttgcctgcggaagaacggcaagaaggtgatccaactcagcaggaagaccttcgactctgagtacgttaagacgcgagccaacgactgggacttcgtcgtgaccactgacatctcagagatgggcgccaactttaaggccgaacgcgtgattgatcctcggaggtgcatgaagcccgtcatcttgacagacggggaggagcgggtgattctggcgggacccatgccagtcacgcactcgagcgccgcccagcgccgggggcgcatcggccgcaacccaaagaacgagaatgaccagtatatctacatgggggagcccctggagaatgacgaggattgcgcccactggaaagaggcgaaaatgttactggacaacatcaacaccccagagggaatcatcccgtccatgttcgaacccgaacgcgagaaagtcgacgcaatcgatggcgagtaccgcctacgcggggaggcccgcaagaccttcgtggacctcatgaggaggggcgacctgccagtgtggttagcctataaggtcgcagcagaggggattaactacgccgaccggaaatggtgcttcgatggcatcaagaacaaccaaatcctcgaggagaacgtagaggtggaaatctggactaaggagggggagcgcaagaagctcaaaccgcgatggttagacgccagaatctactcggaccccttggcgctaaaggagttcaaagagtttgcggccggccggaagtccctgacgctcaaccttattaccgagatggggcgactgcccacgttcatgacccagaaggcccgtaatgccctagacaacctggccgtcctgcacacggccgaggcaggaggtcgcgcctacaatcacgccctcagcgagttaccggagaccctggagaccttacttctgctcaccttgctggccacggttaccgggggcatcttcttgttcctcatgtccggcaaggggatcggaaaaatgactttgggaatgtgctgcataatcaccgcaagcatcctcctgtggtacgcccaaatccagccgcactggatcgccgcctccatcatcctcgagttcttcctcatcgtgctgctaatccccgaacctgagaagcaacggaccccccaggacaaccagctcacgtatgtggtgatagccatcctgaccgtcgtggcggctaccatggccaatgagatgggcttcctcgagaaaaccaagaaggacttgggtcttggcagcattacgacccaggagagtgagtccaacatcctggatatcgacctacgccctgccagcgcctggacgctgtatgctgtggccaccacgttcgtcacccctatgctgcgacactccatcgagaactcgtccgttaacgtgagcttaacagccatcgccaatcaggcgacggtcctgatgggcctggggaagggctggcccctcagcaaaatggacatcggggtgcccctgctggccattgggtgctacagccaggtcaacccgatcactctcaccgccgctctgctgctcctggtcgcccactacgctatcatcggcccgggcttgcaggccaaggccaccagagaagcacagaaacgggccgcggccggcatcatgaagaacccgacagtggacgggatcacggtaatcgacctcgaacccatcccttacgatcccaagttcgaaaagcagctgggccaggtcatgttactcatcctatgtgttacccaggtgctgatgatgcgcaccacatgggccctctgcgaagcactgacgctagcgaccggccctatctccaccctctgggaaggcaaccctgggcggttttggaacaccacgatcgcggtcagcatggccaacatcttcagaggctcctacctggccggggccgggctcttattcagcataatgaaaaatacgaccaatacccggcggggcacggggaatatcggagagacgctcggcgaaaagtggaagtcgcgccttaatgcgctcgggaagtctgagttccaaatatacaagaaatccggtatccaggaggtggaccggaccctggccaaggaaggtatcaaaagaggtgagaccgaccatcacgccgtctcacggggttctgcaaaattgcgatggttcgtcgagcggaatatggtcacgccggaaggcaaggttgtcgatctcggctgcgggcgtggcgggtggtcgtactattgtggcgggcttaagaacgtgcgggaggtgaagggcctgacgaagggcggccccggccatgaggagccaataccgatgtccacctacgggtggaatttggttagactgcagagcggcgtggacgtgttcttcactccgcctgaaaagtgcgacacgttactctgcgacatcggggagagctccccgaaccctacgatcgaggccgggcgtaccctacgcgtactgaacctcgtggagaactggctgaacaataacacccagttctgcatcaaggtgcttaacccgtatatgcccagcgtcatcgagaagatggagaccctccagcggaaatatgggggcgcgctggtcaggaaccccctgtcccggaacagcacgcacgaaatgtattgggtctccaatgccaccggtaacattgtcagcagtgtgaacatgataagccgaatgctgatcaaccggttcaccatgaagcacaaaaaggccacctacgagccggacgtagatctaggttccggcactaggaacatcggtattgaatctgagatccccaacctggacattattggcaagcggatcgagaagatcaagcaggagcacgagacctcctggcactacgaccaggatcacccctacaagacctgggcctaccacggctcgtacgagaccaagcaaacggggtccgccagcagtatggtcaacggcgttgtgcgcctgctcacaaagccttgggacgtcgtgccgatggttactcagatggcgatgaccgacaccacgcccttcggtcaacagcgcgtcttcaaggagaaggtggacacccggacccaggagcctaaagagggcaccaagaagctgatgaagattaccgccgagtggctgtggaaggagctcggcaagaagaagacccctcgggtgtgcacccgggaggaatttactagaaaggtccggagtaacgccgccttaggcgccatcttcacggacgagaacaagtggaagtccgcgcgcgaggccgtggaggatggccggttctgggagctggttgaccgcgaacggaacctccacctcgaggggaaatgtgagacgtgcgtctacaacatgatgggcaagcgagagaagaagttgggggagtttggcaaggcaaagggtagccgcgcaatctggtatatgtggctcggggcgcgttttctggagttcgaagccttgggcttcctcaatgaggatcactggttttctcgggggaactcgttgtccggagtggagggcgagggcttacatcgcctgggctacatcctgagagacgtgggcaagaaggagggcggggccatgtacgccgacgacaccgcgggctgggacacgagaatcaccctggaggacctcaagaacgaggagatggtgactaaccacatgaagggggagcacaaaaagctggcggaggccatattcaagctgacctaccagaacaaggtggtccgggtgcagcgcccgaccccgcgggggacagtcatggacatcatctcccgtcgggatcaacgtgggagcgggcaggtcggcacctacgggcttaacaccttcaccaacatggaggcgcaactgatccgccagatggagggcgagggcatcttcaagtccattcagcacctgaccgccactgaggagatcgccgtgcagaattggctcgcgcgggttggacgcgagcggcttagccgcatggccatatcgggcgacgactgcgtagtgaagcccatcgacgaccggttcgccagcgccctgactgccctcaacgatatgggcaaggtgcgcaaggacatccagcaatgggaaccctcgagaggctggaacgactggacgcaggttccgttctgcagccaccacttccacgagctggtgatgaaggatggccgcgtgttggtcgtgccctgccggaaccaggacgagctaatcggccgcgcgcgcatatcccagggcgcaggctggagcctgaaggagaccgcctgcttgggcaagtcctacgcacagatgtggaccttgatgtactttcatcggagagacctgaggctggcagcgaatgccatatgcagcgcggtgccctcccactgggtccccacatcacggaccacgtggtccatccacgcgaagcacgagtggatgactactgaagatatgctcgccgtgtggaatcgcgtgtggattcaagagaatccctggatggaggacaaaacccccgtagagagctgggaggaggtgccctacctgggtaagcgggaggaccaatggtgcggctccctaatcgggctgacgagccgcgctacctgggccaagaacatccagaccgctatcagccaggtgcggtcgctgatcggcaacgaggagtacaccgactacatgccgagcatgaagcgcttccgccgggaagaggaagaagctggagtcctgtggtga

SEQ ID NO: 25169 - RNA, 9876 nt, synthetic construct
  misc_feature 1..9876: note = derived and/or modified CDS sequence (opt11) from DENV-2__EU482561__SS-prME
  source 1..9876: mol_type = other RNA
accgccggcgtgatcatcatgctgatccccactgctatggcgttccacctcactacacggaatggcgagccccacatgatcgtgggccgtcaagagaaagggaagtccctgctgttcaaaacagaggacggggtaaatatgtgcaccctgatggcgattgacctgggggagctgtgcgaggacacaataacctacaaatgccccctcctgcgccagaatgagcccgaggacatagactgttggtgcaactcaacctcaacctgggtcacctacgggacctgtaccaccactggcgagcaccgccgagagaaacggtcggtcgccctggtgccccacgtggggatgggcctcgaaacccggaccgagacctggatgtcgagcgagggggcctggaagcacgtacagaggatcgagacctggatcctgcgccacccgggcttcacaattatggccgcgatactagcctacaccatcgggaccacgcacttccagcgggccctcatcttcatcctactgaccgcggtggcgcctagcatgacgatgcgctgcatcgggatctctaacagggacttcgtggagggcgttagcggcgggtcctgggttgatatcgtgctcgagcacgggtcttgcgtcacaacgatggccaagaacaagcccaccctggactttgagcttatcaagaccgaggccaaacagcccgctaccctcagaaagtactgcatcgaggccaagctgacgaacaccacgaccgagagccggtgtccgacgcagggggagcccagccttaatgaggagcaggacaagcgcttcgtctgtaagcacagcatggtcgaccggggctgggggaacggctgtggcctcttcggtaagggcggcatcgtaacctgcgcgatgtttacctgcaaaaagaacatggagggaaaggtcgtcctcccggaaaatcttgagtataccatcgttataacgccccactccggggaggagcacgctgtgggaaatgacaccgggaagcacggcaaggagatcaagattaccccgcagtccagcatcaccgaggccgagttaacggggtatggaacggttaccatggaatgcagcccccggaccggcctggatttcaacgagatggtactgctacagatggaggacaaagcctggctcgtgcatcggcagtggttcctggacctccctctgccctggctgccgggggccgacacacagggctcgaactggatccagaaggaaacgctggtcacctttaagaacccacacgcgaagaagcaggacgtcgtcgtcctggggtcccaggagggcgccatgcacacagcactgaccggcgccacggagatccaaatgagctcaggcaatttgctgttcaccggccacctgaagtgccgcctccgaatggataagctgcagctgaagggcatgtcctacagcatgtgcaccggtaaattcaagatcgtgaaggaaatagccgagacacagcacgggacgattgtgatccgagttcagtatgagggggacggctccccctgtaagattccctttgagatcatggacctcgagaaacggcatgtgctggggcggctgatcacagtgaacccgatcgtggcagagaaggacagccccgttaacatcgaggccgagccgcccttcggcgatagttacataatcattggggttgagccgggccagctcaagctgaactggttcaagaaggggagctccatcggccagatgttcgagacaaccatgcgaggcgccaagcggatggccatcctgggagacacggcctgggacttcggcagcctcggcggcgtcttcacctccatcggcaaggctctgcaccaggtattcggtgcgatctacggcgccgctttcagcggggtgagttggaccatgaagatactgatcggcgtcattatcacctggattgggatgaacagccgctcaacgagtctctccgtgagcctggtgctggtcggcgttgtgaccctctatttaggcgcgatggtccaagccgattccggttgcgtggtgtcatggaaatccaaggagctgaagtgcggctctggtatcttcatcaccgataacgtccacacctggaccgaacagtacaaatttcagcctgagagcccgtccaagttagcaagcgccatccagaaggcacacgaggagggtatctgcggcatccgttccgtgacccgcctcgagaatctaatgtggaaacagatcacaccagagctgaatcatatcctcagcgagaacgaggtgaagctgaccatcatgaccggcgacatcaaggggatcatgcaggctggaaagcgttccttgagaccacagcccaccgagctcaagtacagttggaaaacctggggcaaggccaagatgctgtcaaccgagtctcacaaccagacgttcctgatcgacgggcccgagaccgccgagtgtccgaacaccaaccgggcctggaactccctcgaggtcgaggactatggtttcggggtgtttaccactaacatctggcttaagctgcgcgagaagcaggacgtgttctgcgacagcaagctcatgtccgccgcgatcaaggacaaccgggccgtccacgccgatatgggctactggatagaatccgccctgaacgacacctggaagatggagaaggcctctttcatcgaggtcaagagctgtcactggcccaagtcccacacgctctggtcaaacggcgtcttagagtccgagatgatcatccccaagaacttcgcggggcccgtgtctcagcacaactaccgcccgggctaccacacccagaccgccgggccctggcacctgggcaaactggagatggacttcgacttttgcgagggaacgaccgtggtggtcaccgaggactgtggcaaccggggaccaagcctccgcacgacgaccgcctccggtaagctgatcaccgaatggtgctgtcggagctgcacgctgcccccgctccgttaccggggtgaggacgggtgttggtatggcatggagatccgcccgctgaaagagaaggaggagaacttagtgaactccctcgtgacggccggacatggccagatcgacaacttctcactgggcgtactgggtatggccctcttcctggaagagatgttacggacccgggtgggcaccaagcacgccatgctcctggtagtcgtgtcgttcgtgaccctcattacggggaatatgagctttcgggacctcggccgcgtcatggtgatggtgggggcgaccatgactgatgacataggcatgggcatcacctacctggccctgctcgccgcgttcaaagtcaggcccacgttcgccgcggggctactgctccggaagctaaccagcaaagaactgatgatggccaccatcggaattgccctcctgtcgcagagtaccatccccgagacgatccttgaactcacagacgcgctggccttgggcatgatggtgctaaagatcgtgcgcaacatggagaaatatcagctagccgtcaccataatggccataagctgcgtgccgaacgctgtgatactgcagaacgcgtggaaggtgtcctgcaccatcctcgccgcagtgagcgtcagccccctactgttaacgagctcccagcagaaggccgactggatcccgctggcgctgacaattaagggcctcaaccccaccgccatcttcctgaccacgctgtcgaggaccagtaaaaagcgctcctggccacttaacgaggctatcatggccgtgggcatggtctccatcctggcctccagtctgctcaagaacgacatcccgatgactggccccctggtagcagggggtttgctcaccgtgtgctacgtgctgacgggccgttccgccgacctggagctcgaacgagcggcagacgtcaagtgggaggaccaggcagaaatctccggatctagcccaattctctccataaccatcagcgaagacggctccatgagcatcaagaacgaggaggaggagcagaccctgaccatacttatccggaccggcctgctggtgatctccggcgtcttccccgtctcgatccctataactgcggccgcctggtacttgtgggaggtgaaaaagcagcgcgcaggcgtgctgtgggacgtacccagcccgccgcccgtggggaaggcagagctggaagacggggcttaccggatcaagcagcgcggaatcctcggctacagccagatcggtgccggggtgtacaaggagggcacattccacaccatgtggcacgtcacccgcggggcggtgctcatgcaccgcggcaaacgtatcgagccttcctgggccgacgtgaagaaagacctgattagctacggtgggggctggaaactcgaaggcgaatggaaggagggggaggaggtgcaagtgctggccctggaacccggcaagaacccacgcgctgtgcagacgaagcctggcctcttcaagaccaatactgggaccatcggcgctgtctccctggacttcagcccgggtacgtccgggagccccatcgtcgaccggaaaggcaaggtggtcgggctgtacggcaatggcgtggtgacccgctccggggcctacgtcagcgccatcgcgcagaccgagaagtccatcgaggacaatcccgagatcgaggacgacatatttcgtaagaagcgcctcaccatcatggatctccaccccggcgcagggaagacgaagcgttatctgcccgcaatagttcgcgaggccatcaagcgtggcctgcggaccctcatcctggccccaacccgcgtggtggcggccgagatggaagaggcactgcgggggctccccatccgttaccaaacacccgccatccgggccgaacacacgggccgcgagatcgtggatctgatgtgccacgccaccttcaccatgcggctgctaagccccgtgcgcgtcccgaactataacctgattataatggacgaggcccactttaccgacccagcgtctatcgccgcccggggctacatctccacgcgcgttgagatgggggaagcggctggcatattcatgacggccacaccacccgggagccgggacccgttcccccagtccaacgcgcccatcatggacgaggaacgcgagatccccgagcggagctggaactccggccacgagtgggtaaccgacttcaagggcaagacggtctggttcgtgccgagcattaaggcgggcaatgacatcgccgcctgcctgcgcaagaacggcaagaaagtgatccagctctcgcggaagaccttcgacagtgagtacgtcaaaactcgcgccaacgactgggacttcgtagtcaccacggatatttccgagatgggggccaacttcaaagctgagcgggtcatagacccccgacggtgcatgaagccagtaattttaacagacggcgaggagcgcgtgatcctggccgggcccatgccggtcactcacagctccgccgcccaacggcgcggcagaatcggacggaaccccaagaacgaaaacgatcaatacatctacatgggcgagcccctagagaacgatgaggactgcgcccactggaaagaggcgaagatgctgctggacaacatcaatacccccgagggcatcatcccgagcatgttcgagccggagcgggagaaggttgatgccatcgatggggagtaccggctccgcggcgaggcccggaaaacgttcgtggacctgatgcggcgcggggatctgcccgtctggctcgcgtatcgcgtcgcagcggagggcatcaactacgctgatcggcgctggtgttttgatgggatcaagaacaaccagatcttagaggagaacgtcgaagtcgagatctggaccaaggagggcgagcggaagaagctgaaacctcgctggctcgacgcccggatctattccgaccccctggcgttaaaggagttcaaggagttcgcggctggtcggaagtctctgaccttgaacctgatcaccgagatggggcggctccccacgttcatgacgcagaaggcccgcgacgcccttgataacctggccgtgctccacaccgcggaggccggagggagagcttacaaccacgccctgtccgagctgcccgagacgctcgagactctgctcctcctgacactcctcgcaaccgtcaccgggggcattttcctgtttctgatgagcgggaagggcatcgggaaaatgacgctcggcatgtgttgcataattactgcatctatccttctgtggtacgctcagattcagcctcactggatcgccgccagcatcatccttgagttctttctgatagtgctgttaatccccgagccggagaagcagcgaacgcctcaggataaccagctgacctacgtggtaatcgccattctgactgtggtggcggccactatggccaacgagatggggttcctagagaagaccaagaaggaccttggcctgggcagcatcgcgacccaagagtccgagagcaacatactcgatatcgacctgcggccagcctccgcgtggacgctgtacgccgtcgccacgacctttgtcaccccaatgctccgccacagcatcgaaaactctagcgtgaacgtctccctgaccgccatagcaaaccaggcgacggttctgatggggctcggcaagggatggcccttaagcaagatggacattggtgtgcccctgctagccattggttgctattcccaggttaacccgatcaccctgaccgctgccctgttactgctggtggcgcactacgccatcatcggccccgggctccaggcaaaggccacccgtgaagcccagaaacgcgcggccgccggaattatgaagaatcccacggtggacggcatcactgtaatcgacctggagcccatcccgtacgaccccaagttcgagaaacagctcgggcaggtcatgctcttgatcttatgcgtgacacaagtccttatgatgcgcaccacttgggccctgtgcgaggcgttgaccttagcgaccggcccaatcagcaccctatgggaggggaaccctggccggttctggaacacgaccatcgcagtgtccatggctaacatcttccgcggcagctatctagcaggggcgggcctcctgttctccataatgaagaacaccaccaacacacgtcgcgggaccggcaacattggcgagaccctgggggagaaatggaagtcccggctcaacgccctgggcaagtctgagttccagatctacaagaagtccgggatccaagaagtggaccgcaccctggccaaggagggcataaagcgcggcgaaacggaccaccacgcagtctctcgcggcagtgctaagctccggtggttcgttgagcgcaacatggttaccccggaaggcaaagtggtggacctggggtgcggccggggcggatggtcctattactgcggcgggctgaagaacgtccgcgaggtcaaggggctcacgaaaggcgggccaggacacgaggaacctattcccatgagcacgtacggctggaacctggtgagactgcagagcggggtggacgtcttcttcactccgcccgagaagtgcgatacgctcctgtgtgacatcggtgagtcaagccccaacccgacaatagaggctggcagaaccctacgggtgctcaacttagtggagaactggctgaacaacaacacgcaattctgtatcaaggtccttaatccgtacatgcccagtgtaatagagaagatggagaccctgcaacgcaaatacggcggggcactcgttcggaacccactttcacgcaactccacccacgagatgtattgggtttcaaacgccaccgggaacatcgtgtccagcgtgaatatgatatcccggatgctcatcaaccgcttcacaatgaagcacaaaaaggccacgtatgagcccgacgtcgacctcggctccgggacccgcaacattggcattgagtccgagatacccaacttagatatcatcggcaagcggatcgaaaagatcaagcaagagcacgagacgagctggcactacgaccaggaccacccgtacaagacctgggcctaccacgggtcctacgagacgaagcaaaccggcagcgcgagttcgatggtgaacggggtggtccgccttcttaccaagccttgggacgtggtgccgatggtcacccaaatggccatgaccgacaccacccccttcggccagcaacgggtgttcaaggagaaagtggacacccggacacaggagcctaaggagggcaccaagaagctgatgaagattacggccgagtggctctggaaggaactcgggaagaaaaagacgccacggatgtgcactcgagaggaatttacccggaaggtcagatccaacgccgccttgggcgcgatcttcaccgacgagaacaaatggaagtccgcccgggaggcggtggaggactcccgcttctgggagctcatcgaccgggagcgcaatctgcaccttgaggggaaatgcgagacctgcgtgtacaacatgatgggcaaacgggagaaaaagctcggggagttcggtaaggccaagggctcccgagcgatttggtacatgtggttgggggcccggttcctggagttcgaggcgctcggcttcttaaatgaggaccactggttttcccggggaaactccttaagcggcgtcgaaggggaaggcctacaccggctgggctacatcctgcgagacgtatccaaaaaggagggtggggccatgtacgccgacgacactgcagggtgggatacccggatcaccctcgaggacctgaagaacgaggagatggtaaccaatcacatgaagggggagcacaagaagctggccgaggccatcttcaagctcacgtatcagaacaaggtggtgcgcgtccagcgtccgacaccccgggggaccgtcatggatatcatcagccgccgggatcagcgcggctccggtcaggtggggacctacggcctgaacacgttcaccaacatggaggcacagctgatccgacagatggagggggagggcatcttcaagagcatacagcatttaaccgtcactgaggagatcgccgtgcagaactggctcgcgagggtgggccgggagagactgagccggatggccatcagcggggacgattgcgtggtaaagccccttgacgaccgcttcgcctcagccctgacggcccttaacgacatgggcaaggtgcggaaggacatccagcagtgggaaccctcacgcgggtggaacgactggactcaggtcccgttctgctcacatcacttccacgagctcatcatgaaggatggacgggtgctggtggtaccgtgccgcaaccaggacgagctgatcggtagggcgaggataagccagggtgcggggtggtccctcaaggagaccgcctgcctggggaaaagctacgcgcaaatgtggactctgatgtacttccaccggcgcgacctgcggttggccgcgaacgccatctgctccgccgtgcccagccactgggttcctacttccagaacaacctggagcatccacgccaagcacgagtggatgaccaccgaggacatgttggcagtctggaatcgagtttggatacaggagaacccgtggatggaggacaagacgcctgtggaaagctgggaagaggttccatacctaggaaagcgcgaggatcagtggtgcggttccctcatcggcctgactagccgcgctacctgggccaagaacatccagaccgcaattaaccaggtgaggagcctcatcgggaacgaagagtacacggactacatgccaagcatgaagcgctttcggcgcgaggaggaggaggccggcgtgctgtggtga

SEQ ID NO: 25170 - RNA, 9876 nt, synthetic construct
  misc_feature 1..9876: note = derived and/or modified CDS sequence (opt11) from DENV-2__EU569703__SS-prME
  source 1..9876: mol_type = other RNA
acggccggcgtgattatcatgctgatccccaccgccatggcgttccacctcaccacacggaacggggaaccccatatgatcgtaggtcggcaggagaaggggaagtccctattgttcaagacagaggacggtgtgaacatgtgtacgctcatggccatagacttaggggagctttgtgaggataccatcacctataagtgcccactcctgcgtcagaacgaacctgaagacatcgattgttggtgcaactctacctcgacctgggtgacttatgggacctgcaccacaacgggcgagcaccggcgcgagaagcggagtgtcgccctggtgccacatgtgggtatgggcctcgaaacacggaccgaaacctggatgtcgagcgagggggcctggaagcacgtacagcggattgaaacttggatcctgaggcacccgggctttaccataatggccgcgatcctggcgtacacgatcgggacgacccatttccagcgggccctcatcttcatcctcctgaccgccgtggcgcccagcatgaccatgcgctgcatagggatctccaaccgcgactttgttgagggcgtctcaggtggttcctgggtcgacattgtactagagcacgggagttgcgtcaccacgatggccaagaacaagccaaccctggacttcgagctgatcaagaccgaggccaagcagccagccaccctccgcaagtattgcatcgaggccaagctgactaataccaccacggaatcccgttgccctacccagggagagcctagtctgaacgaagagcaggacaagagattcatttgcaaacactccatggtcgacaggggctggggaaacggctgcggcttattcggaaagggggggatcgtaacctgcgcgatgttcacgtgcaagaagaacatggagggcaaggtcgtgctgcccgaaaacctggagtacaccatcgtgataacgccacacagcggtgaggagcacgcggtgggcaacgacacggggaaacatggcaaagagatcaagatcacacctcagtccagcattactgaggcggagctcacagggtacggaacggtcaccatggagtgtagcccccggaccggcctggacttcaacgagatggtgttactccaaatggaggataaggcatggctggtccaccggcagtggttcctggacctccccctgccctggttgcctggtgccgacacacaaggcagcaactggatccagaaggaaacgctggtgacatttaagaacccacacgcaaagaaacaggacgtcgttgtgctcgggtcccaggaaggggcaatgcacaccgcccttacaggggccacggagattcagatgagcagcggcaacttgctttttacaggccacctgaagtgtcgccttcgcatggacaagctgcagctgaaggggatgtcttactcaatgtgcacaggcaaatttaagatcgtcaaagagatcgccgagacccagcacgggacgatcgtcatacgcgtgcagtacgagggagatggctcaccatgtaagattcccttcgagatcatggacctggaaaagcggcacgtcctgggccgcctgatcactgtgaacccgatcgtgaccgaaaaggacagccctgtcaacatcgaggcggaaccaccattcggcgactcctacatcatcataggggtggaaccagggcaactgaaactgaactggtttaagaaaggatcctccatcggccagatgttcgagaccacgatgcgcggcgccaagagaatggccatcctgggggataccgcttgggacttcggctctcttggtggtgtgttcacttctatcgggaaagcgctgcaccaggtgtttggcgcgatctacggcgccgcgtttagcggggtgtcctggaccatgaagatcctgataggcgttatcatcacgtggatcgggatgaactctcgctcaactagtctcagcgtgtccttggtgctggtgggcgtcgtgaccctgtacctcggggtcatggttcaagccgactccggttgcgtggtgtcgtggaagaacaaggagctgaagtgtggttccggaatcttcataactgacaacgttcacacttggacggagcaatacaagttccagcccgagtcacccagcaagcttgcgtcagccatacagaaggcccacgaggaggggatctgcgggatccggtccgttacgcgccttgagaacctgatgtggaaacagatcacacccgagttgaaccacatattatccgagaatgaggtgaagttaaccataatgaccggcgacataaaggggataatgcaggcgggtaagaggtctctccgccctcagcctacggagctaaagtactcctggaagacctggggcaaggcaaagatgttaagcacggagtctcataaccagacctttctgatagacgggcccgagacggcggaatgcccgaatacaaatcgcgcctggaacagcctcgaggtggaggactacggtttcggggtcttttccacgaacatttggctaaagctgcgcgaaaagcaagacgtattctgcgacagcaaactcatgagtgccgccatcaaggacaatcgagccgttcatgcagacatgggctactggatcgagagcgccctgaacgacacttggaaaatggagaaggcctccttcattgaggtcaaaagctgccactggcccaagtctcacaccctgtggagcaatggcgtgctcgagagtgaaatgatcatcccgaagaacttcgcggggcccgtgagccagcacaactaccgcccgggataccacacacagaccgccggaccgtggcacctgggcaagctggagatggattttgacttctgcgagggcacaacagtggtggtgacggaggattgcggaaatcggggcccctcactccggaccaccaccgcgtccgggaagctgatcaccgagtggtgctgccggagctgcacgctgccgccgctccgctaccggggggaggacgggtgctggtacggcatggagatccgccccctgaaagagaaagaggaaaacctagtgaactcgctcgtgactgctgggcacggtcagatcgataatttttcgttgggcgtccttggcatggccctctttttagaggagatgctgcggacccgcgtaggcactaagcatgccattttgctggtagcggtctcgttcgtgacactgatcactgggaatatgtcttttagggacctcggtcgcgtgatggtaatggtaggggctaccatgaccgacgatatcggtatgggggttacctaccttgccctgctcgcagccttcaaggtgcgccccacgttcgcggcagggctgttactcaggaagcttacctcaaaggagttaatgatggccacgattggcatagctctcctgagccagagcaccatccctgaaacgatattggagctcacggacgcacttgcgctggggatgatggtacttaagatcgttcgcaacatggagaaataccagctggcggtcactattatggccattagctgcgtcccgaacgcggttatcttacagaatgcgtggaaggtctcctgcaccatccttgctgccgtctctgtctcccccctgttgctcacgtcatcccagcagaaggcagactggatccccctcgccctgaccatcaaaggcctgaaccccaccgcgatctttcttaccacgctgagccggaccagtaagaagcgcagctggccgctcaacgaggccgtgatggccgtgggtatggtcagtatactggcctcttccctgcttaaaaacgacatacccatgaccggaccgctggtggctggtggcctcctcaccgtgtgttacgttctaacgggtcgatccgcggacttagagctcgagcgcgccgccgatgtaaagtgggaggaccaggccgagatcagcggaagttccccaattctgtccatcaccatcagcgaggacgggtcgatgagcattaaaaatgaggaggaagagcataccctgacgatcttgatccggacgggcttactggtaatctccggggtcttcccggttagcattcctataaccgctgcggcctggtacctctgggaggtgaagaagcagcgcgcaggcgtcctgtgggacgttcccagcccgcctcccgtggggaaggccgagctggaggacggcgcctacagaattaaacagagggggatctttggctacagccagatcggcgcaggggtctacaaggaaggcacctttcacactatgtggcatgtgacccgcggcgccgtgctcatgcaccgcgggaagcggatcgaaccctcctgggccgacgtcaagaaggatctgatcagctacgggggcgggtggaagcttgagggtgaatggaaggagggcgaggaggtccaagtgctagcattggaaccaggcaagaacccccgcgccgtccagacgaagcccggtctttttaagacaaacaccgggaccattggagctgtgtccttagacttcagccccggcacatcagggtcacccatcgtggacaggaagggcaaggtcgtgggtctgtacggtaatggtgtagtaacccgctcaggagcctacgtgagcgctattgcccaaaccgagaagagcatagaggacaaccctgagatcgaggacgacattttccggaagaagcgcctgacaattatggatttgcacccaggggcggggaagaccaagcgataccttccagccatagtcagggaagccatcaagcggggcctgcggacccttatcctcgccccgacccgcgtcgtggccgcggaaatggaggaggctctgcgggggctgcccatccgctaccagacccccgccatccgggccgagcacacgggccgcgagatagtggacttaatgtgccatgccaccttcaccatgcgcctgttatctcctgtccgtgtgccgaactacaacttaatcatcatggacgaggcgcacttcaccgaccctgcgtcgatcgccgccaggggttacatctccacgcgcgtggagatgggggaggccgccggcatcttcatgacagccaccccgcctggtagccgtgacccgttcccccaatccaacgcacccataatggacgaagaacgcgagatcccagaaagatcctggaactccggccatgagtgggtaaccgacttcaaggggaaaacggtgtggttcgtgccgagcattaaggccggcaatgacatcgctgcctgcctgcgcaagaatggcaagaaggtgatccagctgtcccgaaagacctttgacagcgagtatgtgaaaacccgcgccaatgactgggacttcgtggtcacaacggacatctccgagatgggggcgaacttccgggcagaacgtgtgatcgacccgcggcgctgcatgaagcctgtgatccttaccgacggcgaagagcgggtcatcctggctggccccatgccggtgacccatagcagcgccgcacagcgccggggccggataggacgcaacccgaaaaacgagaacgaccagtacatctacatgggcgagcctctcgagaacgacgaagactgcgcccactggaaggaggcaaagatgctcctggacaacatcaacacgcccgagggcataataccgagcatgttcgaacccgaacgggaaaaggtggacgcgatagacggggaataccgcctgcgtggcgaggcccggaagactttcgtcgatctcatgcgacgcggcgacctgcccgtgtggctcgcctaccgggtggccgccgagggtataaactacgcggaccgcagatggtgcttcgacgggatcaagaataaccagatcctcgaggagaacgtcgaggtggagatctggaccaaagagggcgagcgcaaaaagctgaagccgagatggctggacgcacgcatctactccgatccccttgccctgaaggagttcaaagagttcgccgctggccgaaagtcactgaccctcaacctgatcactgaaatgggccgcctacctaccttcatgacacagaaggccagggacgcattagacaacctggcggtgttgcataccgccgaggtgggtgggcgggcgtacaaccacgccttatccgagctccccgagaccctggagacgctccttctgttaacgctgctggcgaccgtgaccggaggcattttcctctttctgatgagcgggaaggggatcggaaagatgacgcttggcatgtgctgcatcatcaccgccagtatcctgctgtggtacgcccagatccagccccattggattgcggctagcatcatcctggagttcttcctaatcgtcctgctgatccccgagccggaaaagcagagaacgccccaggacaaccagctcacctacgttgtcatcgccatcctgactgtcgtggccgccacgatggcgaacgaaatggggttcctggagaagaccaagaaggacctcggcctgggcagcatcaccacccaggagtccgagagcaacatcttggacatagacctacggccggcctccgcctggacgctgtacgccgtggctactaccttcgtcacccctatgctgagacactcaattgagaacagtagcgtcaacgtgtccctcacggctatagccaaccaggcaactgtcctgatgggtctgggccgcggatggccactctcaaagatggacatcggcgtgcccttgttagccatcgggtgctacagccaagtcaatccaatcaccctcaccgcggccttgctgctgctggtcgcgcactacgctatcatcggccccggcttgcaggccaaagcaacgcgagaggcccagaagcgcgccgccgccgggataatgaaaaaccccaccgtggacggtatcacggtgattgatttagagcccatcccgtacgatccaaaattcgagaagcaactgggacaggttatgctgctcgttttgtgcgtgacccaggtcctgatgatgagaaccacctgggcactgtgtgaagccctgactttggccaccggccccatttccacgctctgggaggggaacccaggcagattctggaacaccaccatcgccgtgagcatggccaacatcttccgcggcagctacctggccggggccggcctcctcttctccatcatgaagaacaccacgaacacccggagggggactgggaacatcggcgagaccctgggtgagaagtggaaatcccggctgaacgcgctcggcaagtccgagtttcagatatacaagaagtctgggatccaggaagttgatcgcactctggcgaaagagggcattaagcgcggggagaccgaccaccatgcagtgtcccgcggcagcgcaaagctgcgatggtttgtggagcgcaacatggtcaccccggaaggcaaagtcgtagatctcgggtgcggccgcggcgggtggtcatactactgcggcggtctgaaaaacgtgcgcgaagtcaaggggcttaccaagggcggccccggtcacgaggagcccattcccatgtcaacgtacggctggaacttagttcggctgcagagcggcgtcgacgtattcttcactccgcccgaaaaatgcgacacattattatgtgacatcggagagtccagccccaaccccacgatcgaggcgggccgtaccctgcgggttctgaacctcgtggagaactggctgaacaacaacacccagttctgcatcaaggtcctgaacccgtacatgccctcggttatcgaaaagatggagactctccaacgcaagtatggcggcgcactggttcgcaacccgctaagccgcaactccacccacgagatgtactgggtcagcaacgcaaccgggaacattgtgtccagcgtgaatatgatctcccgaatgctaatcaaccggtttacgatgaaacacaagaaggcgacctacgagccggacgtcgacctcgggtcgggtacccgcaacattggcatcgagaacgagatccccaatctggacatcataggcaaacggatcgagaagatcaagcaagagcatgagacatcctggcattacgaccaggaccacccttacaagacgtgggcctaccacgggagctacgaaaccaaacagaccggctccgccagttccatggtgaacggggtggtccgcctgcttaccaagccctgggacgtggttccgatggtaacgcagatggccatgacggacactacccccttcggacaacagcgggtgttcaaggagaaggttgacacgagaacgcaggaacccaaggagggcaccaagaaattaatgcggataaccgccgagtggttgtggaaggagctagggaagaagaagacacccaggatgtgcactcgggaggagtttacccggaaggtcagatcaaacgcagccctaggagccatcttcaccgacgagaacaagtggaagtcagcccgcgaggccgttgaggatagccggttctgggagctggtcgatcgcgagaggaacctccacctcgaggggaagtgtgagacatgcgtgtacaacatgatgggcaagcgcgagaagaagctaggtgagttcggtaaggccaagggcagtagagccatctggtacatgtggctcggggcccgctttctggagttcgaggccttggggttcctcaacgaagaccattggttttcccggggcaacagcctttccggcgtcgagggagagggcctgcacaaactgggctacatcctgcgtgacgtgagcaaaaaggagggcggagcaatgtacgcggatgacaccgccgggtgggatacccggattacactggaagacctcaagaacgaggagatggtcacgaaccacatgaagggtgagcacaagaagctggccgaggcgatattcaagctgacctatcagaacaaggtggtccgcgtacagcgcccaacgccccggggcacggtcatggacatcatctcccgcaaggaccagcggggttcgggccaggtcggcacgtacgggctcaacaccttcaccaatatggaggcgcagctgatcaggcaaatggaaggagaggggatcttcaaaagtattcagaggcttacggtaacagaggaaatcgccgtgcagaactggctcgccagggtcggccgggaacggctgagccgtatggccatctccggggacgactgcgtggtcaagcccctggacgaccgcttcgccagcgcgttaactgccctgaacgacatggggaaggtccggaaggacatccaacagtgggagccctcccgcggctggaacgactggacccaggtaccgttttgtagccatcacttccacgagttagtgatgaaggacggccgggtcctcgtggtcccgtgccgcaaccaagatgagctgatcgggcgggcgcgcatatcccagggcgccggttggagcctaaaggaaaccgcctgcctcggcaagtcatatgcgcagatgtggacactaatgtacttccatcggagagacttgaggctcgcggccaatgccatctgtagcgccgtgcccagccattgggttcccactagccgcaccacatggtccatccacgctaagcatgaatggatgaccacggaggacatgctggcagtgtggaaccgagtctggattcaggagaatccgtggatggaagacaagacacccgtagagtcatgggaagaggtgccgtacctcggcaagcgggaggaccagtggtgcgggagcctcataggcttaacttcccgcgccacctgggcaaagaacatccagacggcgataaaccaggtccgatccctgatcgggaacgaggagtacaccgactacatgccctctatgaagagattccggaaggaggaggaggaggccggcgtgctctggtga

SEQ ID NO: 25171 - RNA, 9876 nt, synthetic construct
  misc_feature 1..9876: note = derived and/or modified CDS sequence (opt11) from DENV-2__EU529694__SS-prME
  source 1..9876: mol_type = other RNA
accgccggcgttttcatcatgctgatcccaaccgcaatggcgttccacctcaccacccggaatggggagccccatatgattgtcggccggcaggagaaggggaagtcccttttgttcaagaccgaggacggcgtaaatatgtgcaccctaatggcaatggacctgggggagctatgtgaggacacgatcacctacaagtgcccgctcctcagacaaaacgagcccgaggacatcgactgctggtgcaacagcaccagcacctgggtgacctacgggacgtgcacaaccacgggcgaacaccggcgcgagaagcggtccgtcgccctggtgccccacgtaggtatgggcctcgagacccgaacagagacctggatgagcagcgagggcgcctggaagcacgtccagaggattgagacatggatcctccgccacccgggctttaccattatggccgctatcctggcatacaccatcgggaccactcatttccaacgggcgctcatcttcatactcttaacagccgttgcgccgtctatgacgatgcgctgcataggcatctctaacagggacttcgtcgagggggtcagcgggggctcctgggtggacatcgttcttgaacatgggagttgcgttactactatggccaaaaataagcctaccctggactttgaactgatcaagacggaggcgaagcaacccgcaaccctccgcaaatactgcatcgaggccaaacttacgaacaccactacagaaagtcggtgcccgacccagggagagcccagtctgaacgaagaacaggataagcgattcgtgtgcaagcactccatggtggatcggggatggggtaacggttgcggcctgtttggcaaagggggcatcgtgacatgcgcgatgttcacatgcaagaagaatatggaaggaaaggtggtgcttcccgagaatctggagtacaccatcgtcatcacaccccactcgggggaagaacacgccgtgggcaacgacactggaaagcacggaaaggagatcaagattaccccgcagagtagtatcaccgaggccgagcttacaggatatggcacggtcaccatggagtgtagcccccggaccggcttagatttcaacgagatggttctgctccagatggaggacaaagcctggctggtgcaccggcagtggttcctggacctccccctgccttggctgccgggcgccgacacccagggcagcaattggatccagaaggagacgctcgtgaccttcaagaacccacacgcgaagaagcaagacgtcgtggtcctggggtcccaggagggcgccatgcacaccgccctgaccggggccacggagatccagatgagcagcggcaacctcctattcaccggccatctgaagtgtcgcctccgaatggacaagctgcagctgaaggggatgtcctacagcatgtgcaccggcaagtttaagatcgtgaaagagatagccgagacccagcacggcacgattgtgatcagggtccaatacgagggtgacggctccccgtgcaagatccccttcgagatcatggatctagagaagcggcacgtgctgggacgcttaatcaccgtcaacccgattgttgcggaaaaggacagccctgtcaacatagaagccgagccgccttttggcgacagctacataataatcggtgtcgaaccagggcaactcaagctaaactggtttaaaaaggggagctcaatcggccaaatgtttgagaccaccatgagaggcgcaaagcgaatggctatattgggcgatacggcatgggacttcggcagcctagggggcgtgttcacctcgatcgggaaggcgctgcaccaggtgttcggcgcgatatacggcgccgcattttccggggtgtcctggacaatgaagatcctgataggcgtcatcatcacttggatcggaatgaacagtcgctccacttctctgtctgtgtccctcgtcttagtgggcgtggttaccctgtacctcggggcgatggttcaggccgactccggctgcgtagtatcctggaagtccaaggagctcaagtgtggctccggcatcttcatcaccgacaacgttcacacctggacggaacagtacaagttccagcccgagtccccctccaaactggcctccgccatccagaaagcccacgaggaaggcatctgcgggatccgctccgtgacccgcttagaaaacctcatgtggaagcaaatcacccccgaactaaaccacatcctcagtgaaaacgaggtgaagctgactatcatgacgggcgatatcaagggtatcatgcaagcgggcaaacggtccctgcgcccacaacccacggagctcaaatatagctggaagacttggggcaaggcgaaaatgttatccaccgagagccacaaccaaactttcctgatcgatgggcctgagacagccgagtgtccgaacaccaaccgggcgtggaactccctcgaggttgaagactatggtttcggggtgttcaccacaaacatttggctaaaattgcgcgagaaacaggatgtgttctgcgacagcaagctcatgtccgccgcgatcaaggacaaccgggccgtccacgccgacatgggctattggatcgaatccgccctgaacgacacctggaagatggagaaagcctccttcatagaggtgaagtcttgccattggcccaagtcccatactctgtggagcaacggcgtgctcgagtccgaaatgattatccctaagaacttcgcggggcctgtgagccagcacaactaccgcccgggttatcatacccagaccgcggggccgtggcacctgggcaagctggagatggactttgacttctgtgaggggacgactgtggtggtaactgaagactgcggtaaccggggccccagcttgcgcaccacgacggcctcagggaagctgatcaccgagtggtgctgccggagttgcaccctgcccccactccggtatcgtggcgaagacgggtgctggtacgggatggagatacgccccttgaaagagaaggaagaaaacctagtgaactccctcgtgacggcggggcacggccaaattgacaacttcagccttggggtcctgggaatggccttattcctggaagaaatgctgcggacccgtgtggggacaaaacacgccatgctcttggtagccgtctccttcgtaactttaatcaccgggaacatgagcttccgggacctgggtcgggtaatggtgatggtgggggccactatgacggatgacatcggaatgggcatcacttacctggctctgctcgcggccttcaaggtgagacccacgttcgcagccgggttactgctccggaagttgacatctaaggaactgatgatggccaccataggcatagcgctcctatcgcagagtaccatccccgaaacgatattggagctcaccgacgccctggcgcttgggatgatggtcctcaagattgtgagaaacatggagaagtaccaacttgccgtgacaatcatggccatcagctgcgttccaaacgccgttatcctgcaaaacgcatggaaggtgtcatgcaccatcctcgcggccgtcagcgtgagcccccttcttctcacaagctcccagcagaaggcagactggataccactggccctaaccatcaaggggctcaaccccacggccatctttctgacaacgctaagccggacatccaagaaacgctcgtggccgctcaatgaggccatcatggccgtcggtatggtgagcatcctggctagctcattgctaaagaatgacattccgatgaccggccctctagttgccggcgggctgctcactgtttgttacgtcttaacgggacggagcgcggatctggagcttgagagagccgccgacgtaaagtgggaagaccaggcagagattagcggcagcagccccatcctgagtatcaccatcagcgaggacggttcaatgagcatcaagaatgaggaagaggagcagacactaaccatcctaattcggacgggcctgctggttatctccggggtgtttccagtgagcatccccatcacagcagcggcgtggtacctctgggaggtcaagaagcagcgcgccggtgtgctgtgggacgtgccaagcccaccgcccgtcggaaaggcagagctggaggacggcgcttaccggatcaaacagcgcgggattttagggtacagccagattggtgccggtgtatacaaggaaggcacatttcacaccatgtggcacgtgacccgcggggccgtcttaatgcaccgaggcaagcggattgagccgtcttgggcggacgtgaagaaggacctgataagctatgggggcggatggaagttggagggggagtggaaggagggcgaagaagtccaagtactggccctagaacccgggaagaaccccagggccgtgcaaacaaagcctggcctcttcaagaccaacaccgggaccataggcgccgttagcttagacttcagccctggcacttcagggagcccgatcgtcgatcgtaagggtaaagtcgtgggactgtatggcaacggcgtagtgacacgttccggcgcttatgtgagcgcaatagcgcaaaccgagaaatctatagaggataaccctgagatcgaagatgatatattcagaaagaagcgcctcactatcatggacctgcaccctggtgccgggaaaaccaagcggtacttacccgcgatcgtccgcgaggcgatcaagcggggcctgagaacccttattctggcgccaacccgcgtggtagccgccgagatggaggaagccctgcggggcctccccataaggtatcaaactccggccattcgggcggagcacacgggacgcgagatagtcgacctgatgtgccatgccaccttcaccatgcggctgctctcacccgtacgcgtgcctaactataacctcataatcatggacgaggcacatttcacagatcccgcatctattgccgctagaggctacatatccacgcgggtagaaatgggggaggccgcaggtatcttcatgacggcaaccccacccgggagccgtgaccctttcccccaatctaatgcgcctataatggacgaggagagggagatcccagagcgcagctggaactccggccacgagtgggtgacagattttaaaggaaagacggtgtggttcgtccccagcatcaaggcgggcaacgacatcgcggcctgcctgcgcaaaaatggcaagaaagtgatccagctgtcccgtaaaacatttgacagcgagtacgtgaaaactcgggctaatgactgggattttgtcgtcactacggacatctccgagatgggggctaatttcaaggcggagcgagtgatcgatccccgtcggtgcatgaagcccgtcattctgaccgacggggaagaacgcgtgattctggccgggcccatgcctgtgacacacagtagcgcagcccagcgtcgaggccgcattggccgtaaccccaagaacgagaacgaccagtatatctatatgggcgaaccgctcgagaatgacgaggactgcgcacactggaaagaggccaagatgctgcttgacaacataaacacccccgaaggcattataccgagcatgtttgagcccgagcgcgagaaagttgatgcaatcgacggggagtaccggctccgcggggaagcacggaaaacgttcgtggatcttatgcgccgcggggatctaccagtttggctcgcctaccgcgtggctgccgaagggatcaattacgccgaccggcgctggtgtttcgacgggatcaagaacaaccagatcctggaggaaaacgtggaggttgagatctggaccaaggagggcgaacggaagaagctcaagccgcgatggctggacgcccggatttactcagaccccctggcactgaaggagtttaaggagttcgccgcaggtcgcaagagcctcaccctgaatctaattaccgagatgggtcgtctgcccacgttcatgacccaaaaggcccgcgatgcactggacaacctggccgtgctccacaccgccgaggctggcgggagagcgtacaaccacgctctgagcgagctgccagagaccctcgagacgctactgctcctgaccctgttggcgactgtcacgggcggcatcttcctgtttctcatgtcggggaagggcatcgggaaaatgacgcttggaatgtgctgtatcatcaccgcctccatcctcttatggtacgcccagatccagccgcactggatcgcagccagcatcatactagagttcttcctgatcgtcctgttgatcccagagcctgagaaacagagaacgccacaagataaccagctgacctacgtggtaattgccatcctgactgtcgtggccgcaacgatggccaacgagatgggctttctcgagaaaacaaagaaggatcttggcctgggcagcattgccacccaggaatccgagtcaaatatcctcgacatcgacctgcgcccggcgtccgcctggaccctgtacgccgttgcaaccacctttgtcacgcccatgctccgccacagcattgagaactccagcgttaatgtgtccttgaccgctatcgccaaccaagccacggtcctcatggggctcggcaaggggtggcccctgagcaagatggacatcggcgtgcccctactcgccatcgggtgttactcccaagtgaacccgataacccttactgctgcgctactgctgttggtcgcccattacgccatcatcggccctggcttacaggctaaggccacacgggaagcgcagaaacgcgccgctgccgggatcatgaagaacccaacggtggatggcatcacagtgattgacctggagccaattccgtacgaccccaagtttgaaaagcaattggggcaggtcatgctcttaattctgtgcgtgacccaggtgctcatgatgcggacgacttgggctctgtgcgaggcgctgactctagcaaccggtcccataagcacgctgtgggagggcaaccccgggcggttctggaacacgaccatcgcggtgagcatggccaacatattcaggggaagctacctggcgggggccgggctacttttctcaatcatgaagaacaccaccaacactcggagaggcaccggaaacatcggcgaaaccctgggggagaaatggaaatcccgcctcaacgccttgggcaagtccgagttccagatctacaagaagtcggggatccaggaggtggatcggaccctggccaaagagggcatcaagagaggggaaacggaccatcatgccgtgtcccgcggcagcgcgaagctccgttggttcgtcgagcgcaacatggtaaccccggagggcaaagtcgtcgacctagggtgcggacgcggcgggtggtcctactactgcggcgggctgaagaacgtgcgcgaggtgaaggggctgaccaaaggtggtcccggacacgaggagccaatccccatgtccacctacggctggaacctggtccggctgcagtcgggggtggacgtgtttttcacgccgccggagaagtgtgacaccctcctttgtgacatcggcgagtcgtccccgaacccgactatcgaggccggccgcaccctcagagtcctaaatctggttgagaactggctgaacaataacacgcagttctgcatcaaggtgctcaacccgtacatgcccagcgttatcgagaagatggagactctgcagcgcaaatatggaggagccctggttcgcaatccgctgagccgcaactctacccatgagatgtactgggtgtctaacgcgaccggtaacatcgtctcctcagtcaacatgatctcccggatgctcatcaaccgttttaccatgaagcacaagaaagccacgtatgagccggacgtggatctgggaagcgggacccgcaacataggcatcgaatctgaaattcccaacctagacatcatcggaaagcggatagagaagatcaagcaggagcatgagactagctggcactacgaccaggaccatccttacaagacctgggcgtaccacggatcatacgaaacgaagcagacaggatcagctagtagcatggttaacggggtggtcagactcctgaccaaaccctgggacgtcgtgcctatggtgacccagatggcgatgactgacaccacccccttcggccagcagcgggtcttcaaggagaaggtggatacccgcacgcaggagcccaaggagggaacgaagaaactgatgaaaatcaccgccgagtggctttggaaggagctcgggaaaaagaagacgcctcggatgtgcacacgcgaggagttcaccaggaaggtgcggagcaacgccgcgctgggggccatcttcaccgacgagaacaaatggaagtctgccagggaggctgtggaggacagtcgcttctgggagctaatagaccgggagcgcaacctgcacttggaagggaagtgcgagacttgtgtatacaatatgatgggcaaacgagaaaagaagctcggggagttcggcaaggcaaagggctcaagggccatatggtatatgtggctgggtgcccggtttcttgagtttgaggcattaggcttcctaaatgaggaccactggttttcacgcggcaattccctgtctggcgtggaaggggaaggtctccatcgactgggctacatactgcgcgacgtctcgaagaaggaagggggcgcaatgtacgcggacgacactgccgggtgggacacacgcatcaccctagaggacctgaaaaacgaggagatggttactaatcacatgaaaggcgagcataaaaagttggccgaggccatcttcaagctcacttatcaaaacaaggtggtacgcgtgcagcggccgactccccggggaaccgtcatggacatcatcagccgccgggaccagcgcggctccggacaggtcgggacctatggcctgaacacattcaccaacatggaggcccaactgatccggcagatggagggggagggcatatttaagtcaatccaacacctcacagtgaccgaggagattgcggtccagaattggcttgcccgcgtgggccgggaacgactgtcccgaatggccatctcaggggacgactgcgtggtcaagcccctagacgaccgattcgcctccgctctgacggcgctgaacgatatgggcaaagtgaggaaggatattcaacaatgggagccctcacgcgggtggaatgactggactcaggtgcctttttgctcccaccacttccacgagcttgtcatgaaagacgggcgggtactggttgtcccctgccgcaaccaggacgagttgatcggccgggccagaatctctcaaggcgcaggatggagcctcaaggagaccgcgtgcctaggcaagagctacgcacagatgtggaccctgatgtactttcaccggcgcgacttacggctcgctgccaacgctatatgttccgcggttcccagccactgggtccccacctctagaacgacatggagcatccacgcgaagcacgaatggatgaccacggaggacatgctggccgtatggaaccgggtgtggatccaggagaacccgtggatggaggacaagacgccggtagagagctgggaggaggttccctaccttggcaagcgcgaagaccagtggtgcggaagcctgatcggcctgaccagccgcgccacctgggccaagaatatccagaccgcgattaatcaagtgcggtccctcatcgggaatgaggagtacaccgattacatgcccagcatgaagcgcttccggcgcgaggaggaggaggcgggcgtgctgtggtga

SEQ ID NO: 25172 - RNA, 9876 nt, synthetic construct
  misc_feature 1..9876: note = derived and/or modified CDS sequence (opt11) from DENV-2__EU529695__SS-prME
  source 1..9876: mol_type = other RNA
accgctggcgtaataatcatgctgatccccaccgccatggcgttccacctaacaacccgcaacggcgagccccacatgattgtaggtcggcaggagaaggggaagtctctgctgttcaagaccgaagacggggtcaacatgtgtactctcatggcgattgacctgggggagctgtgcgaggacaccatcacctacaaatgccccctcctaagacagaacgagcccgaggatatcgactgctggtgcaacagcacatctacctgggtgacctacggaacatgtacaactacgggagaacaccggcgggagaaacgctccgtcgccctggtcccccacgtggggatgggcctcgagacccgcacggagacctggatgagctcggagggcgcctggaagcatgtccagcggatcgaaacctggatcctgcgccacccgggtttcaccatcatggccgcaatcctggcctacaccatcgggaccacccacttccagcgggccctcatatttatcctgctgaccgccgtggcgccgagcatgactatgcgatgtattggaattagcaacagggacttcgtggagggtgtcagcgggggctcctgggtggacatcgtcctcgagcatgggagctgcgtcaccacaatggcaaagaacaagcccaccctggacttcgagctgatcaagacggaggcaaagcaaccagccaccctcagaaagtactgcatcgaggccaagctgacgaacaccaccaccgagtcccggtgcccaacgcaaggcgagcccagcctgaacgaggagcaagacaagcgcttcatctgcaagcattccatggtggacaggggctgggggaacggctgtggcctgttcggcaagggtgggatcgtgacctgtgctatgttcacgtgcaagaagaacatggagggcaaggttgtgctacctgagaacctggaatacaccatcgtgatcacgccccactctggggaagagcacgccgtcggcaatgacaccggaaagcacggcaaggagatcaagatcaccccacaaagttcaatcaccgaagccgagctcaccgggtatggcacggtaaccatggagtgcagcccgcggaccggcctggacttcaacgagatggtgctgctccaaatggaggacaaggcttggctggtccaccggcaatggttcctggacctccccctgccctggcttccgggggccgacacccaaggcagcaactggattcagaaggagacgctagtaacctttaagaacccccacgcgaagaagcaagacgtggtggtgctggggagccaggagggcgcgatgcacaccgccctcaccggtgccacggagatccagatgtccagcggcaacctcttattcaccggccatctgaagtgcagactccggatggacaagctgcaactgaagggcatgagctacagcatgtgcacgggaaagttcaagatcgtaaaggagatagccgaaacccagcacggtacgatcgtgatccgagtgcaatacgagggcgacggctccccttgcaaaatccccttcgagatcatggatctcgagaagcggcacgtcctggggcgactgataaccgtgaacccgattgtgacggagaaggacagccccgtcaacatcgaggcggagccccccttcggcgactcctacatcatcatcggagttgagcccggccagctcaaactaaactggtttaaaaaggggagtagcataggccagatgttcgagaccacgatgcgcggcgcaaaacggatggccatcctcggggataccgcctgggactttggcagcctcggaggcgtgttcacgtccatcgggaaggccctgcaccaggtcttcggcgctatctatggtgccgcattcagcggggtgtcctggaccatgaagatcctgattggggtgatcatcacttggatagggatgaacagccgcagtaccagcctgagtgtcagtctcgtgctggtgggggtcgtgaccctctacctcggggtgatggtgcaggcggactccggctgcgttgtgagctggaagaacaaggagctgaagtgcggctccgggatcttcatcaccgataacgtccacacgtggaccgagcagtacaaattccagcccgagagccccagcaagctggcgtccgccattcagaaggcccacgaggagggaatctgcggcatccggagcgtgacccgtcttgaaaacctgatgtggaaacagataactcctgagctgaatcacattctctctgagaacgaggtcaagctgacgatcatgacgggcgacattaaggggatcatgcaggccggcaagagaagtctgcgcccgcagcccaccgaactcaagtacagctggaaaacatggggcaaggccaagatgctcagcacggaatcccacaatcagaccttcctgatcgacgggcccgagaccgcggagtgtccgaacacgaacagggcctggaacagcctagaggtcgaagattacggcttcggggtgttcagtacgaacatatggctgaaactccgtgaaaagcaagacgtgttttgcgactcaaaactcatgagtgccgccatcaaggacaatcgggccgtccatgcggacatgggctactggatcgagtcagccttgaatgacacgtggaagatggagaaggcatccttcatcgaggtgaagagttgccactggcccaagtcccacaccctgtggagcaacggcgtgctcgaatccgagatgatcatccccaagaatttcgccgggcccgtttctcagcataactaccgcccgggctaccacacccaaaccgccgggccctggcaccttggtaagctggagatggatttcgacttctgtgaggggacgaccgtggttgtcactgaggactgcggtaaccggggcccaagcttaagaaccacgactgcgtccgggaagctgatcaccgagtggtgttgcagaagctgtaccttgccgcccctccgttaccggggagaagatgggtgttggtacggtatggagatccgcccgttgaaggagaaggaggagaaccttgtgaactccctagtgacggccgggcacggacagatcgacaacttctcactgggcgtactgggcatggcccttttcctggaagaaatgctgcggacacgcgtgggcaccaaacacgccatcctcctggtggcggtttcctttgtgaccctgatcacggggaacatgagctttcgggacctcggccgcgtgatggtcatggtcggggcaacgatgacggacgacatcggcatgggggtgacgtacctggccctgctcgccgcgttcaaggtccgcccgacattcgcggccgggctgctgcttcggaagctgacctctaaggaactgatgatggccaccattggcatcgccctcttgagccagtccaccatacccgagacgatactcgagctcaccgacgccctggcgcttgggatgatggttctcaagatcgtgcgcaacatggagaagtatcagctcgccgtcaccatcatggccataagctgtgtgcctaacgccgtaatcctgcagaacgcctggaaggtcagttgtaccatcctcgcagccgtgtccgtgtctcccctactgctcacgagctcccaacagaaggcggactggatacccctcgccctgaccatcaaggggctcaaccccaccgcaatcttcctgaccacgctgagccgcacctccaaaaagcgctcatggccgctcaacgaggccgtaatggccgtgggaatggtctccattctggccagcagcctgctcaagaacgacatacccatgaccgggccactggtagccggcggactgctaaccgtatgctacgttctgacgggccgttccgcggacctggaactcgagcgtgcggctgacgtgaagtgggaggaccaggccgaaataagcgggtccagccctatcttgtccatcaccatcagcgaggacggctctatgagtatcaagaacgaggaagaggagcaaaccctgaccatactcatccggacgggattgctggtgatctccggggtcttcccggtgagcatccctatcaccgccgcggcctggtatctctgggaagtgaagaagcagcgcgccggcgttttatgggacgtgcccagcccgccgcccgtggggaaggccgagctggaagacggcgcctaccggatcaagcagcgcggcatcttcggctactctcagatcggagccggggtctacaaggagggaactttccataccatgtggcacgtgacccgcggtgccgtgcttatgcaccgcggcaagcggatagagccctcatgggcggacgtcaagaaggaccttatcagctatgggggcggctggaagctggaaggggagtggaaagagggtgaagaggttcaggtgttagctctggagcccgggaagaatccacgtgccgtacagacgaagccgggcctgttcaagacaaacaccgggaccatcggcgccgtgtccttggacttctctcccggaacgtcagggagtcccatcgtggaccggaaaggaaaagtcgtaggcctgtacggcaacggcgtggtcacgcgcagcggggcctacgtgtctgccatcgcccagaccgagaaaagtatcgaagacaaccccgagattgaggacgacatattccggaaaaagcgattaaccattatggacctccacccaggtgcgggcaagacgaagaggtacctgcccgccatcgtgcgcgaggccattaaacggggcctgcgcaccttaatcctcgcgccgacccgcgtcgtcgccgcggagatggaggaggctttaagagggctgcccatccgctaccagacgcccgcaatccgtgcagaacacacgggacgcgaaatcgtggaccttatgtgccacgcaaccttcacgatgcggcttctctcccccgtccgcgtgcccaactacaacctcattattatggacgaggcgcacttcaccgaccccgccagcatcgccgcgcggggctacatatccacccgcgtggagatgggggaggccgctggcatcttcatgacagccacgccgcccggtagcagagaccccttcccccagtctaacgcccccattatggacgaggagcgagagatccccgagcggtcatggaactccggccacgaatgggtcaccgacttcaaagggaagactgtgtggttcgtcccaagcatcaaggccgggaacgacatcgcggcatgcctgcgaaagaacggtaaaaaggtcatccagctttccagaaagacgtttgactcggagtacgtgaagacccgggccaacgactgggactttgtcgtcaccacggacatctccgagatgggggccaacttccgggccgagcgcgttatcgacccccggcgctgcatgaaacccgtgattctcaccgacggcgaggaacgagttatcttagccgggcccatgccggtaacgcacagctccgccgctcagcgtcgcggccggatcgggcgaaaccccaagaatgagaatgaccaatatatctacatgggcgagccgctggagaacgacgaggactgcgcccattggaaggaagccaagatgctgctggacaacatcaacacacccgagggcatcatcccttccatgttcgagcctgagcgagagaaagtagacgcaattgacggggagtatcgcttaaggggcgaggcccgcaagacattcgtcgacctcatgcgccgcggggatttgccagtgtggcttgcctatcgggttgcagccgagggtatcaattacgcggaccgccgatggtgcttcgatggcatcaagaataatcagatactcgaggagaatgtcgaagtggagatctggaccaaggagggcgagagaaagaagctgaagccgcggtggctggacgcccgcatctactcggacccactcgccctgaaggagttcaaggagttcgccgcagggcggaaatccctcaccctcaacctgattaccgagatggggaggctgcccacgttcatgacccagaaggcccgggatgcgctcgacaacttagccgtcctccacacggctgaggttggcgggcgagcgtataaccacgccttgtccgagttgcccgagaccctggagacactcctgctgctcacgttactggccacagttacgggcgggatattcttattcctgatgtcagggaagggcatcgggaaaatgacgctgggcatgtgttgcatcatcacagcgtctatcctcctgtggtacgcccaaatccagccacactggatcgctgccagcatcattctggagttcttcctcattgtcttgctgatccccgagcccgagaagcagcgaacaccccaggacaaccaattgacctacgtggtgatcgccatcctgacagtagtagccgccactatggcgaatgagatggggttcctagagaaaaccaagaaggacctaggcctgggctcaatcatcacccaggagtccgagtctaacatcctagacattgatctacgaccggcctccgcctggacgctgtacgccgtggccacgactttcgttacccccatgcttagacacagcatcgagaactcgtcagttaacgtgtccctcaccgccattgccaaccaggccactgtgctgatggggctgggtcgcggatggcccctgagcaaaatggacatcggcgtgcccctgttagccataggatgctactcccaggtgaatccgatcaccctcaccgcggccctgctacttctggtcgcccactacgccatcatcggcccaggcctgcaagccaaagcgacccgcgaagcgcagaagcgggccgccgccggcatcatgaaaaacccaactgtggacggcatcaccgtgatcgacctcgagcccatcccgtacgatcccaagttcgagaagcagctggggcaggtcatgctgctagtattgtgcgtgacccaggttttgatgatgcggaccacgtgggcgctctgcgaggccttaaccctggccaccggccctatcagcaccctctgggaggggaaccccggtaggttctggaatacgaccatcgcagtttccatggccaacatctttcgcggcagctatctagcgggggctggcctcttgttctccatcatgaagaacaccacaaatacgcggcgtgggaccggcaacatcggagagacccttggggagaaatggaagtcccggctgaacgccctgggcaagtcagagttccaaatatataaaaagtccgggattcaggaggtggaccgcacgttggccaaggagggcatcaagcgcggtgagacggaccaccacgccgtatcccgcgggtctgccaagctgcgctggttcgtcgagcgcaacatggtgaccccggagggcaaggtcgtggacctcgggtgcggccgtgggggctggagctactactgtggcgggctaaagaacgtacgcgaggtcaagggcctgaccaagggcgggcccgggcacgaggagccgattccaatgagcacgtacggctggaatttggtgcgtctgcagagcggcgtggacgtattcttcaccccgcccgagaagtgcgacaccctgctctgtgacattggcgagtccagccccaaccccaccatcgaggccggcagaaccctgcgggtgctaaacctcgttgagaactggctgaacaataacacgcaattttgcatcaaagtcctgaacccgtacatgccctccgtgattgagaagatggaaaccctccagcgcaagtacgggggcgccctggtgcgtaaccccttatctcgcaactccacccacgaaatgtactgggtaagcaatgccacagggaacatcgtatccagcgtgaacatgatttcccgcatgttaatcaacagattcaccatgaagcacaagaaggcgacgtacgagccagacgtcgaccttggcagcgggactcgcaacataggcatagagaacgagatacccaatctggacatcataggcaaacggatagagaagatcaaacaggaacacgaaacctcctggcactacgaccaggaccacccctacaagacctgggcgtaccacgggagctacgagacgaagcagaccggctccgccagctccatggtgaacggggtggtccgcttgctcactaagccctgggacgtggtgccgatggtcacccagatggccatgacggacaccacccccttcggccagcagcgggtatttaaggagaaagtggacacccgcacacaggagcccaaggagggcaccaaaaagctgatgcggatcaccgccgaatggctgtggaaagagctcgggaagaaaaagactccccggatgtgcacgcgggaggagttcaccaggaaggtccgcagtaacgcggccctgggcgccattttcaccgatgaaaataagtggaaatccgcccgcgaggcagtggaggacagccggttctgggagcttgtcgaccgcgagcggaacctccaccttgaggggaagtgcgaaacatgtgtgtacaacatgatgggcaagcgcgagaaaaagctgggggagttcggcaaggcgaagggctctcgggccatatggtacatgtggcttggggcccgctttctggagttcgaagcgctgggcttcctcaacgaggaccactggttctctcgggggaatagcttatccggcgtggagggggagggcctgcataagctcggctacatcctgagagacgtcagcaagaaggagggcggcgctatgtacgccgacgacacggcagggtgggatacccggatcaccctcgaggacttaaagaatgaggagatggtaaccaaccacatgaagggggagcacaagaagctggccgaagcgatcttcaagctgacctaccagaacaaggtggtccgcgtgcaaaggccgacaccccggggaaccgttatggacattatctcccgcaaggaccagaggggcagtgggcaggttgggacctacggcctcaatacgtttaccaatatggaggcgcagttgatccgccagatggagggtgaaggcatattcaagtcgatccagcaccttaccgtcaccgaggagatcgccgtgcagaactggctcgcccgggttggacgggagcggctgagccgcatggccatttccggggacgactgcgtcgtgaagcccctagacgaccggtttgcctctgcgctcacggccctaaacgatatgggcaaggtacgcaaggacatccagcagtgggagcccagtcggggctggaacgattggacccaggtaccgttttgcagccaccatttccacgagctggtgatgaaagacggacgcgtcctcgtcgtcccctgccgaaaccaagacgagctgatcgggcgtgcccgcatctcccagggcgccggatggagcctgaaagaaacagcctgtctcgggaagtcttacgcccagatgtggaccctgatgtacttccaccgcagagatctgcgcctcgccgcaaatgccatctgcagcgcagtcccctcccactgggtcccgacctcacggaccacctggtccatccatgcgaagcacgaatggatgaccaccgaggacatgctggccgtctggaatcgcgtctggatccaggagaacccctggatggaggataaaacgccggtcgagagctgggaggaagtaccctacctgggcaagcgtgaggaccaatggtgcgggagcctcatcggcctgacctcccgagcaacctgggccaagaacattcaaaccgcgatcaaccaggtccgcagcctcattgggaacgaggagtacaccgactacatgccctccatgaagcggtttagaaaggaggaagaggaagctggcgtactctggtag

SEQ ID NO: 25173 - RNA, 9876 nt, synthetic construct
  misc_feature 1..9876: note = derived and/or modified CDS sequence (opt11) from DENV-2__EU482562__SS-prME
  source 1..9876: mol_type = other RNA
accgccggggtgatcataatgctgatccccaccgccatggcgttccatcttaccacccggaacggggagccgcacatgatcgtggggcggcaggagaagggtaagtccctgctgttcaagaccgaagacggcgtcaacatgtgcacccttatggccatcgacctgggggaactgtgtgaggacacaattacatataagtgccccctcctgcgccagaacgagcccgaggacattgactgttggtgcaacagcacctccacctgggtgacgtacggtacctgcaccaccacgggcgaacacagacgcgaaaagcggagcgtagccttggtgcctcacgttggcatgggcctcgagacccggaccgagacctggatgagctccgagggggcttggaaacacgtgcagagaatcgaaacctggattttgcgccatccgggctttaccatcatggcggcgatcctggcctacaccataggaacgactcactttcaacgggccctcatctttatcctgctgaccgccgtggcgcccagcatgaccatgagatgcatcggcatctcaaacagggacttcgtggagggcgtcagcggtggaagttgggtggacatcgtgctcgagcacgggtcctgcgtaaccacgatggccaaaaacaagcccacactggacttcgaactgatcaagaccgaggctaagcagcccgccaccctgcgtaagtactgcatcgaggctaaattgacgaataccacaacggagagtcgctgccctacgcagggcgagccgtctctaaatgaggagcaggacaaacgattcgtgtgcaagcacagtatggtggatcgggggtgggggaacggctgtggcctcttcgggaaggggggtatcgtaacctgcgcgatgtttacgtgcaagaaaaacatggagggcaaggtggtgctgcccgagaacctggagtacaccattgtaattacgccccacagcggggaggagcacgcagtaggaaatgataccgggaagcacggcaaggaaatcaagatcactccgcagtccagcatcacagaggcggaactcacagggtatggcacggtgactatggagtgcagcccccggaccggcctggactttaacgagatggttctgctccagatggaagataaggcctggctggtgcaccggcagtggttcctggacctccccctgccctggctgccaggggccgacacccaaggaagcaattggatccagaaggagacgcttgtcaccttcaagaacccccacgcgaagaagcaagacgttgtggtgctgggctcccaggagggcgccatgcacaccgccctgaccggggcgactgagatccaaatgagtagcggaaacctcctgttcacaggacacctaaagtgccgcttacgtatggacaagctgcagcttaaggggatgtcctacagcatgtgtactggcaaatttaagatcgtgaaggaaatcgccgagacccagcatgggacgatcgtcatcagagtccagtacgagggagacggcagtccttgcaaaatacccttcgaaatcatggacctcgagaaacgacacgtgttggggcgcttaatcaccgttaacccgatcgtcactgagaaggacagccccgttaacatcgaagcagagccgcccttcggagacagttacataattatcggggtggaaccgggacagctcaagctgaattggttcaagaaggggagctctattggacagatgttcgagaccacgatgcgcggcgctaaacggatggccatactgggcgacacagcctgggactttggcagcctcgggggcgtcttcacgtccatcggcaaagccctgcaccaagtgtttggcgcgatctacggggccgccttcagcggggtgtcctggactatgaaaatcctgataggcgtcatcatcacgtggatagggatgaacagccgttccaccagcctgtcggtgagcctcgtgctggtgggagtggtcatactgtatctcggagctatggtccaagctgattcggggtgcgtagtgagctggaaatccaaggagctgaagtgcggcagcggcattttcatcacggacaatgtccatacctggactgagcagtacaaattccaacccgagagcccctccaagctagcctctgcaatccagaaggcccacgaagaagggatatgtggaatcagaagcgtcacaaggctcgagaatcttatgtggaagcagatcacccccgagctcaatcacatactcagcgagaacgaagtgaaactcaccattatgacgggcgacattaaagggataatgcaagctggcaagcggtccctgcgaccccagcccaccgagttgaagtattcatggaagacctggggtaaggcaaagatgctttcaaccgagagccacaaccaaactttcctgatcgatggccccgagactgccgagtgcccgaatacgaatcgggcctggaactcccttgaagtcgaagactacggtttcggcgtgttcacaacgaacatctggctgaagctgcgagagaagcaagatgtgttctgtgacagcaaactcatgtccgctgccataaaggataaccgtgcggtccacgcggacatgggctactggatcgagagcgcgctgaacgacacctggaagatggagaaagcgtctttcatcgaggtcaagagctgccactggcccaagtcccacacgttgtggtcgaacggcgtcctcgaatccgagatgatcattcccaagaactttgcggggcccgtgagccaacacaactaccggccgggctaccacacccagaccgcggggccctggcacctgggaaagctggagatggacttcgacttttgtgaggggacgacagtagtggtaaccgaggactgtggaaaccggggcccatctctgcgcacaacgacggcctccgggaagctgatcaccgagtggtgctgccggtcttgcaccctacccccgctccgctaccggggcgaggatgggtgctggtatggcatggagattcgtcccctgaaggagaaggaggagaacctggtaaactccctagtgacggcggggcacggccagatcgacaacttcagtcttggtgtcctcgggatggccctgtttctggaagagatgctacgcacacgcgtgggcacgaagcacgcgatactcttggtggcggtctcctttgtaaccttgattacggggaatatgagctttcgagacttaggccgcgtgatggttatggtgggggccactatgaccgacgacattggcatgggcgtgacctacctggccctgctcgccgcgttcaaagtccgccccacgttcgccgccggcctgctgctccggaagcttacgtcgaaggagctgatgatggccaccatcggtatcgcccttttaagccaatccaccatccccgagacaatactggagttaaccgacgcgctggcgttagggatgatggtgttaaagatcgttaggaatatggagaagtaccagctggctgtaacgatcatggccataagctgcgtccctaacgccgtaatactgcagaacgcgtggaaagtctcctgtaccatccttgcagccgtgagcgttagccccctgctgctaacttcgtcccagcagaaggcagattggatccccctagcactcaccatcaaggggctcaaccccaccgctatatttctgacaacgctgtcgcgtacctccaagaaacgctcctggccgctcaatgaggccattatggccgtcggcatggtctctatactggccagcagtctgctcaaaaacgacatccccatgaccgggcccctggtcgcgggcggcctgctcaccgtgtgctacgtgctgaccggccgttccgccgatctggaactcgaacgagccgccgacgtaaagtgggaggaccaggctgagatcagcgggtcatcacccattctgtccatcaccatctcagaggacggttccatgagcattaagaatgaagaggaggagcaaacccttaccatcctcatccggaccggcctgctcgtgatcagtggggtcttcccggtctcgatccccatcaccgcggccgcctggtatctctgggaggtgaaaaagcaacgcgccggagtgctgtgggacgtgcctagcccgccgcccgtgggtaaggcggagctggaggacggtgcgtacagaatcaagcagcgcgggatcttaggctatagccagatcggcgccggggtgtataaggaagggacttttcataccatgtggcacgtcacccgcggggccgtacttatgcaccgcggcaaacggattgagccctcctgggccgatgtgaaaaaggacttaatcagctacggggggggctggaagctcgagggtgagtggaaggagggagaagaagtccaggtgctggccctggagcctgggaagaatcctcgcgcggtgcagacgaaacctggcctatttaaaaccaacaccgggacaataggcgctgtatcactggacttcagcccaggcacgagcgggagccccatcgtggaccggaagggaaaggtggtcgggctgtacggcaatggcgtggtgacccgctccggagcctacgtctccgccatcgctcaaaccgagaagtccatcgaagacaacccagagatcgaggacgacatcttccggaagaaacgtctcaccataatggacctgcacccaggggcagggaagacgaaacggtacctgcccgccatcgtgcgcgaagccattaagcgggggctgcgcactctcatcctcgcccctacccgcgtggtcgcggccgagatggaggaggccctgagggggctccccatccgctaccagacccccgccatacgtgcggagcacaccggccgcgagatagtggacctcatgtgtcacgcgaccttcaccatgcggctactttcacccgtccgcgtccccaattacaacctgattatcatggacgaggctcatttcacagaccccgcgagcatcgccgcccggggctacatctccacgcgcgtggagatgggggaagcggccggaatcttcatgacggccactcctcctggaagtagagacccgttcccccagagcaatgcccccatcatggatgaggagcgcgagatcccagagaggagctggaacagcggacacgagtgggtgaccgattttaaggggaaaacggtttggttcgttccgtcgataaaggcgggcaacgatattgccgcgtgcctgcgcaaaaacggcaagaaagtgatccagctctcccgcaagaccttcgacagtgagtacgtgaagacccgcgccaacgactgggacttcgtagtcactacggacatttctgagatgggggccaacttcaaggcggagcgggtgattgatccgcgcaggtgcatgaaaccagtgatcctgaccgacggagaagagcgcgtcatcctggccgggcccatgccagtcacccacagctccgcggcccagcggcgcggtcgtatcggccggaaccccaagaacgagaacgatcagtacatctacatgggtgagcccctcgagaatgacgaggactgcgctcactggaaagaggccaagatgctgctggacaacattaacactcccgagggcatcatcccaagcatgttcgagcccgagcgcgaaaaggtggacgctatcgatggggaataccggctccgcggcgaagcccggaagacgttcgtggacttaatgcgcaggggtgacctgccagtctggctcgcctaccgcgtggcagcggaaggcatcaattacgcggatcggcgctggtgcttcgacgggataaagaacaaccagatcctagaggagaacgtggaagtggagatctggaccaaggagggcgagcgcaagaaactgaagccgcgctggttagacgcacggatctattccgaccccctcgccctgaaggagttcaaggagtttgctgccgggcgcaagtccctgacccttaacctaatcaccgagatggggcgtctaccgacgttcatgacgcagaaagcccgcgacgccctggacaacctggccgtgctacacaccgcggaggctggcgggagggcatacaaccacgcgctgtctgagctgccagagacgctcgaaacgctactgctgttgacgctgctcgctaccgtcaccggtggcatattcctgttcctgatgagcgggaagggtatcgggaaaatgactctcggcatgtgctgcatcataaccgcatccatcctgctgtggtacgcccagatacagcctcactggattgccgccagcatcatcctcgaattcttcctgatcgtccttctcatccccgagccagagaagcagcgaactccccaggacaaccagctgacctacgtagtcattgccatacttaccgtggtggccgcgacgatggcaaacgaaatggggtttctcgagaagaccaagaaagacctagggctcggcagcatcaccactcaggagtccgaaagcaacatcctcgatatagaccttcgtccggcatccgcctggacgctgtacgctgtcgccaccacgttcgttactcctatgctacgccacagcatcgagaattcctcggtgaacgtcagcctgacggccatagcaaaccaggcaaccgttctgatgggcctcggcaaggggtggcccctaagcaagatggacatcggcgtgcccctgctcgccatcgggtgctactcccaagtcaacccaataaccctcaccgccgctttactcctgctggtggcccactatgctatcatcggcccaggcctccaggccaaggcgacacgggaggcccaaaaacgcgctgcggccgggattatgaagaaccctaccgtggatggcatcaccgtaatcgacctggaaccaatcccgtacgaccctaagttcgaaaagcagctggggcaggtcatgctcttgattctgtgcgtgactcaagtactcatgatgcgcacgacctgggcactgtgcgaggcgctgaccctggccaccggccccatcagcacgctgtgggaggggaaccccggcagattctggaacaccaccatcgcggtgtccatggcgaacatcttcaggggatcatatctggccggggcaggcctattgttttccatcatgaagaacaccacgaacacccgacgcggaacaggcaatatcggcgagaccctgggtgagaagtggaagtcacggttaaatgcccttgggaagagtgagttccagatctacaaaaagtccgggatacaggaagtggaccgcacgctggccaaggagggcattaaacgcggtgagactgaccaccacgccgtgtctcgaggcagtgctaagttacgatggttcgttgagcgtaatatggtaacccctgagggcaaggtagttgacctggggtgcggacgtggcgggtggtcttactattgcggcgggctgaaaaacgtgcgggaggtcaaggggctaaccaagggcgggccggggcacgaggagccaatccccatgagcacgtacggctggaacctggtgcgcttgcagagcggggtcgatgtcttctttaccccgcccgagaaatgcgatacccttctgtgcgacatcggcgaatcgagccccaaccccaccatcgaggccggcagaacgctgcgggttctcaacctagtggaaaactggcttaacaacaacactcaattctgcataaaggtcttgaacccgtacatgccatccgtgatagagaagatggaaaccctgcaacgcaagtacggcggggcgcttgtgcgaaaccccctgagcaggaactctacgcacgagatgtactgggtgagcaacgccacagggaacatcgtgtccagcgtcaacatgatcagtcggatgctcatcaaccgctttaccatgaagcacaagaaggccacatacgagccggatgtagacttaggcagcgggacccgcaacatcgggattgagtccgagatccccaacctagacatcatcgggaagcgcatcgagaagattaagcaggaacacgagaccagctggcactacgaccaggatcacccttataagacgtgggcctaccacggttcctatgagaccaaacagacaggcagcgcgagcttcatggtgaacggggttgtccgcttgttaacgaagccctgggacgtggtgcccatggtcacgcagatggcaatgaccgacaccaccccctttggccagcagcgggttttcaaagagaaggtggacacgcgcacccaggagcctaaggaaggcaccaagaaactgatgaaaattaccgcagagtggctgtggaaagagctgggcaagaagaagacgccaagaatgtgcacgcgagaggagttcacaaggaaggtacgctccaacgctgccctgggcgccatcttcaccgacgagaataaatggaaatccgcacgggaggctgtcgaagacagtcgcttctgggagctgatcgatcgggaaaggaacctgcacttggagggaaagtgcgagacttgcgtgtacaatatgatgggcaagcgcgaaaagaagctcggggagttcggaaaggcgaaagggtcccgagccatttggtacatgtggctgggggctcggttcctggagttcgaggccctgggcttcctgaatgaggatcactggttttcccgcgggaacagcctgtccggcgtcgagggtgagggactccatcggctgggctacatcctgagagacgtgagcaaaaaggagggcggcgccatgtacgcagacgacaccgcaggatgggatacacggatcactctcgaggacctcaagaacgaggagatggttacgaatcacatgaaaggcgagcacaagaaactggcggaggcaatcttcaagctcacctatcagaacaaggtggtgcgcgttcagaggccgacgccgcggggcactgttatggatattatctcgcgccgagaccaacgcggcagcggccaggtagggacttacgggctgaacaccttcaccaatatggaggcgcagttaattcggcaaatggaaggtgagggcatcttcaagtcgattcagcatctgaccgtgactgaggagatcgcagtacagaactggctggcaagggtgggtagagaacgcctcagccggatggcgatctccggggacgattgcgtcgtgaaacccctcgatgaccgcttcgctagcgccttgaccgcattgaacgacatgggcaaggtcagaaaagacatacagcagtgggagccctcccgcgggtggaacgactggacccaggtacctttttgtagccaccacttccacgagttagttatgaaggacggtcgtgtactggtcgtgccctgtcgcaaccaggatgagctgatcgggcgggcacgcatatcacaaggcgcgggctggtcgttgaaagagaccgcctgtctgggtaagtcctatgcccagatgtggacgttaatgtacttccatagacgcgacctcaggcttgccgccaacgcgatatgctcggccgttccctcccactgggtccccacaagcagaaccacctggtcgatacacgcgaagcatgagtggatgaccacggaggacatgctggccgtatggaacagagtgtggatccaggagaatccttggatggaggataagacacccgtcgagagctgggaggaggtgccctacctgggcaagcgcgaggaccagtggtgcggctctctgatcggcctgacctcccgcgcgacatgggccaagaacatccagactgccatcaaccaggtccggagcctcattgggaacgaggaatacaccgactatatgcctagtatgaagcgcttccggcgcgaggaggaggaggccggcgtcctgtggtga

SEQ ID NO: 25174 - RNA, 9876 nt, synthetic construct
  misc_feature 1..9876: note = derived and/or modified CDS sequence (opt11) from DENV-2__EU482565__SS-prME
  source 1..9876: mol_type = other RNA
accgccggagtgatcatcatgctaatccccaccgcgatggcattccacctcaccacccggaacggggagccccacatgatcgtcggcagacaggagaaagggaagtccttactgttcaagaccgaagacggtgtaaacatgtgcaccttaatggccatcgacctgggtgagctgtgcgaggacactatcacctacaagtgccccctgctgcgccagaacgagcccgaggatatcgactgctggtgcaacagcacgtctacctgggtgacctacgggacctgcaccaccacgggcgagcaccggcgcgagaagcggtctgtggccctggtgccccatgtgggcatgggcctcgagacgcggactgagacctggatgagcagcgagggtgcctggaagcacgtgcaacgaatcgaaacctggatcctgaggcaccccggcttcactatcatggccgcgatcctggcttacaccatcgggactacacacttccagcgggccctcatcttcatcctccttacggccgtggcgccctctatgaccatgcgttgcataggcattagcaaccgcgacttcgttgaaggcgttagcggggggagctgggtggatatagttctagagcacgggagctgcgtcaccacgatggccaagaacaagcccacattggacttcgagttgattaagaccgaggccaaacagcccgccaccctccgcaagtattgcatcgaggccaagttaacgaataccactactgagtcccgttgccccacgcagggcgagccctccctgaacgaggagcaagacaagcgattcatctgcaagcattccatggtggaccgaggctgggggaacggctgcggcctgtttggcaagggcgggatcgtcacctgcgcgatgttcacgtgcaagaagaacatggagggcaaggtagtgctgcccgagaacttagagtacaccatcgtgattacgccccacagcggggaggaacacgccgtcggcaacgacaccgggaagcacggaaaggagatcaagatcaccccgcagtccagcatcaccgaagccgaacttaccgggtacggcaccgtcaccatggagtgtagccctcggacgggcctagacttcaacgagatggtgctgcttcaaatggaggacaaagcctggctggtgcaccggcagtggtttctggacctccccctgccctggctgccgggggccgacacacagggcagcaactggatccagaaggagacgctcgtgaccttcaagaacccccacgcgaagaagcaggacgtggtcgtgctgggctcccaggagggcgccatgcacacggccctgaccggggccacggagatccaaatgtcaagcggaaacttgctatttacaggccacctgaagtgcaggctgcggatggacaagctgcagctaaaggggatgtcctacagtatgtgtaccggcaaatttaagatcgtcaaggagatcgccgagacccagcacgggacgatcgtaatccgcgtccagtatgaaggcgacggctccccgtgcaagatccccttcgagatcatggacttggagaagcggcacattctggggcgcctgatcaccgtcaacccgatcgtgaccgaaaaggactcacccgtgaatattgaggctgagccgcccttcggggactcctacattatcattggggtcgagccgggccagctcaagctgaactggttcaagaaggggagctccatcggccagatgttcgagaccacgatgcgtggcgccaagcggatggccattctgggggacaccgcctgggacttcggcagcctcgggggcgtgttcacttccatagggaaggccttacatcaggtgttcggcgcgatttacggcgccgcttttagcggggtctcatggaccatgaagattctcatcggagttatcataacgtggatcgggatgaacagccgctccacttcactgtctgtgagcctcgttttagtgggcgtggtaaccctttacctcggtgtgatggttcaggccgactccggctgcgtcgtgagctggaagaacaaggagctgaagtgcggtagtgggatctttatcaccgacaacgtgcacacctggaccgagcagtacaagttccagcctgagagtccgcccaagctggcgagtgccatacaaaaagcccacgaggagggcatctgcgggatccgttccgtaacccgactcgagaatctgatgtggaaacaaatcacccccgaacttaatcacatcctcagcgagaacgaggttaagctgacgatcatgaccggagacatcaaggggatcatgcaggccgggaaacgttctctacgcccccagcccaccgagcttaagtacagctggaagacctggggcaaagccaagatgctctccacggagagccataaccagacctttctgatcgacggtccggaaaccgcggagtgcccgaacaccaaccgggcctggaactccctcgaggtggaagactacggctttggggtctttagcacgaacatctggctcaaactccgagagaagcaggacgtgttctgcgactccaagctcatgagcgccgccatcaaggataatagggccgtgcacgcggatatgggctattggatcgagtccgcactgaacgacacttggaagatggagaaggccagctttatcgaggtcaagtcctgccactggcccaagagccataccctgtggtcaaacggtgttctcgagagcgagatgatcatccccaaaaacttcgctgggccggtgtcccagcacaactaccgccccggctaccacacccagaccgccgggccctggcatctgggcaaactggaaatggacttcgacttctgtgagggaacgaccgtagtcgtgaccgaggattgcggcaaccggggccccagcctccggaccacgacagcgagcgggaagctgatcaccgagtggtgttgccggtcctgcaccctgcccccgctccgctacaggggcgaggacggatgctggtacggaatggagatccgcccactgaaggagaaagaggaaaacctggtgaattctctagtgacggccgggcacggccagatcgacaatttttccctgggcgtgctggggatggccctcttcttagaggagatgctgcggacccgcgtcggcaccaaacacgccatcttgctggttgcggtgtcattcgttaccttgatcacggggaacatgtcattccgggacctcggccgcgtgatggtgatggtcggggccacgatgaccgacgacatcggcatgggcgtcacttacttagccctgctcgccgccttcaaggtgcgcccgacgttcgcggccggactgctgctccggaaattgacctctaaggagctgatgatggccaccataggcatcgccctcctgtcccagagcaccatcccggagacgatcctggagctcaccgacgccttggcgctggggatgatggtcctcaagatcgtgcgcaacatggagaagtaccagttagccgtcacaatcatggccatctcctgcgtcccgaacgccgtgattctccagaatgcctggaaggtgagctgcaccatcctcgcggcagtctccgtgagccccctgctgttaacgtccagccagcagaaggccgactggatccccctggccctgaccatcaagggcctcaatccaaccgcgatcttcctgaccacgctttctcgtacctctaagaagcgttcctggcccctcaacgaggccgtcatggccgtgggtatggttagcatactggcctccagtctgctcaagaacgacattcccatgactgggcccctggtcgccggcgggctgctcactgtttgctacgtgttaacgggccggagcgccgacctggagctcgagcgcgccgccgacgtcaagtgggaagatcaggcagagatttccgggtcctccccgatcctgagcatcacaatttccgaggatggcagcatgtcgatcaaaaatgaggaggaggagcacactttaaccatactaatcagaacgggcctgctcgtgatcagcggggttttccccgtatccatccccataaccgccgctgcctggtacttatgggaggtgaagaagcagcgcgcaggcgtgctgtgggacgtgcccagtccgccacccgtggggaaggccgagctggaggacggcgcctaccggatcaagcagcgcgggatcttcggctatagtcagatcggcgccggggtgtacaaggaggggaccttccacactatgtggcacgtcacacgtggagcggtgctcatgcacagggggaagcggatcgagccgagctgggccgacgtgaagaaggatctgatttcctacggtggaggctggaaattagagggggagtggaaggagggcgaggaggtccaggtgctggccctggagcccggtaagaacccacgcgccgttcagaccaagcccgggctgttcaagaccaacaccgggaccataggcgcggtcagcctcgatttctccccaggcacgagcgggtcccccatcgtagaccggaagggcaaggtcgtcgggctgtacggcaacggtgtggtgacacgctctggcgcctacgtctccgccatcgcccagaccgagaagagtatagaggataacccagagatcgaggacgacatcttccggaagaagcgcctgacaatcatggacctccaccccggcgcggggaagacgaagcggtacctgccggccatcgtgagagaggccattaaacggggcctgcgcacactgatcctcgcccccacccgcgtggtcgccgcggagatggaggaggccctgagagggctgcccatccgctaccagacccccgccatccgggcggagcatacgggccgcgagatcgtggacctcatgtgccacgcaaccttcaccatgcggctgctgagcccggtgcgcgtccctaactacaacctaatcataatggacgaggcgcacttcaccgaccccgcttccatcgccgcacggggctacatttctacgcgcgtagagatgggtgaggccgcggggatcttcatgaccgcgacgccgccagggtcccgagaccccttcccccagagcaacgcccccatcatggacgaggagcgcgagatcccagagcggtcctggaacagcggccatgagtgggtcaccgactttaaggggaagacggtctggttcgtgccctcaataaaagccggtaacgacatcgcagcctgccttcgcaaaaacggcaagaaggttatccagctgagccggaagacgttcgactccgagtacgttaagaccagggccaacgactgggacttcgtggtcaccacagacatctcggaaatgggggcgaacttccgggccgagcgggtcatcgatccccgtcgctgtatgaagcccgtgatcctgaccgacggcgaggagcgggtgattttagcgggcccaatgcccgtcacccattccagcgccgcccagcgccgcggacgcatagggcgcaaccccaagaacgagaatgaccagtacatctacatgggcgaacccctggagaacgacgaagactgcgcccactggaaagaggccaagatgcttctggataacataaatactcctgagggcatcatcccgagcatgttcgaacccgagcgggagaaggtggacgcgatcgacggggagtatcgcctgcgtggagaggcccgcaagacgttcgtggacctcatgagacgcggggacctgccggtctggctggcctaccgggtggccgcggagggtattaactacgcggacagacggtggtgtttcgacgggattaagaacaaccaaatcttggaggagaacgtggaagtcgagatctggaccaaggaaggagagcgcaagaagctgaagccccggtggctggacgcccgtatctatagcgaccccctcgccctgaaagagttcaaggagttcgctgcgggccggaagtccctaacgctcaacctgatcaccgagatggggcgcctccccacctttatgacccagaaggcccgggacgccctcgacaacctcgcagtgctgcacaccgccgaagtcggggggcgcgcatacaaccacgcccttagcgagctgccggagaccctggagaccctcctgctgttaaccttgctcgccactgtgaccggcggcatcttcctatttctgatgtccgggaagggcatcgggaagatgacgcttggcatgtgctgcatcatcacagccagcatcctactgtggtacgcccagatccagccccactggatcgcggcctccatcatcctggagttcttcctcatcgtgctgcttatccccgagcccgagaagcaacgtaccccgcaggacaaccagctcacctacgtcgtgatcgccatcctgaccgtggtcgccgccacgatggcgaacgaaatgggcttcctggagaagaccaagaaggacctcggtctgggcagcatcactacgcaggagcccgaatcaaatatcctggacatcgacctccgcccggcgtccgcctggactctgtacgccgtggccaccacgttcgtgacccccatgctgcggcacagcatcgagaactccagcgtcaacgtgagtctcacggcgatcgccaaccaagccaccgtgctgatggggctgggccgcgggtggccgctcagcaagatggacatcggcgtcccgctgctcgcgatcgggtgctactcccaggtgaaccccatcaccctcacagccgccctgctgctcctggtggcccactacgccataatcggccccggcctgcaggccaaggctacgcgggaggcccagaagcgggcggccgccgggattatgaagaaccccacagtcgacggaatcaccgttatcgacctcgagcccataccctacgatcccaagttcgaaaagcagctgggccaggtaatgctcttggtattgtgcgtgactcaggtactgatgatgcggacgacctgggcactctgcgaggcgcttacactggccaccggcccgatcagcacgctctgggaggggaaccccgggcggttttggaacaccaccatcgccgtctccatggccaacatcttccgcggcagctacctggcgggggccggcctcctcttctccataatgaagaacaccactaacacccggcgcgggaccggcaacatcggcgaaacactgggggagaagtggaagtcacgcctgaacgctctcggcaagtccgagttccagatctacaagaagagtgggatccaggaggttgaccgcacgttggccaaagagggcatcaagagaggggagaccgaccaccacgcggtgtcgcgcggcagcgcgaagttgcggtggttcgtcgagcgcaacatggtgacacccgaaggtaaagttgtcgacctcgggtgcggccgcggcggctggtcatactactgcggcgggttaaagaacgttcgcgaggtgaaagggctgaccaagggcggtcccggtcatgaggagccgatccccatgtcgacgtacggctggaacctggtccggctccagtccggggtggacgtgtttttcactccccccgagaagtgcgacacgctgctctgcgacatcggggagtccagtccgaatcccaccatcgaggccggccgcacgctgcgggtcctgaatttagtggaaaactggttaaacaacaacacccagttttgcatcaaggtgctgaacccctacatgccgtccgtcatcgagaagatggaaaccctacagcgcaagtacgggggagccctggtgcggaaccccctgagccgaaacagcacccatgagatgtattgggtgagcaacgccaccggcaacatcgtctccagcgtcaatatgatttcccgtatgctgatcaaccgctttacgatgaagcacaagaaagcgacctacgagcccgatgtcgacctcggcagcgggacccgcaacgtcggcatcgagaacgagatccccaatctggacatcatcggtaagaggattgagaagatcaaacaggagcacgagacatcgtggcactacgaccaggaccacccatacaagacgtgggcctaccatgggagctacgagacaaaacagaccggctccgccagctccatggtgaacggggtggtccgcctgctcacgaagccctgggacgtcgtgcccatggtcacgcagatggccatgaccgacaccacccccttcgggcagcagcgggtgttcaaggaaaaggtggacacgcgcacccaggagccgaaagagggcaccaagaagctcatgcgtatcaccgccgagtggctgtggaaggagctcggcaagaagaagactccacgcatgtgcacccgggaagagttcacccgcaaggtccgaagcaacgctgccttaggggcaatcttcactgacgaaaataagtggaagtccgccagggaggccgttgaggactcgcggttctgggagctggtcgaccgcgagcggaacttgcacctggaggggaagtgcgagacgtgcgtgtacaacatgatgggcaagcgcgagaagaagctgggggagttcggcaaagcgaagggttcccgggcaatctggtacatgtggctgggggcccgcttcctggaattcgaggccctgggcttcctcaacgaggaccattggttcagccgggggaactccctgtctggcgtggaaggggagggcctgcacaagctcggttatatcctgcgtgacgtcagcaagaaggagggaggggcaatgtatgccgacgacaccgccggctgggacacccggatcacgctggaggatctgaagaacgaggaaatggtgacgaaccacatgaagggcgagcacaagaaactggcagaggctatcttcaaactgacctaccaaaacaaggtggtccgcgtgcagagacccacgccacgggggaccgtgatggacatcataagccgcaaggaccagcgcggcagcggccaagtagggacgtacggcctcaataccttcaccaacatggaggcacagctgatccgtcaaatggagggggagggaattttcaagtccatccagcggctgaccgtaacggaagagatcgccgtgcaaaactggctggcccgcgtcggccgagaacgcctgtcgcggatggcaatcagtggtgacgactgcgtcgtgaaaccgctagacgaccgcttcgctagcgcgttaacggccctgaacgacatggggaaggtccggaaggacattcagcagtgggagccctcacgcgggtggaacgactggacccaggtgcccttctgcagtcaccacttccacgagttagtgatgaaggatggccgggtcctcgtggtgccatgccgcaatcaggacgagctgatcgggcgggcccgcatctctcaaggcgccgggtggagtctgaaggagaccgcctgcctcgggaagtcttacgctcaaatgtggacgctgatgtatttccacaggagagacctgcggctcgccgccaacgcgatctgcagcgccgtcccgagccattgggtgcccaccagtcgcacgacctggtccatccacgcgaagcacgagtggatgaccacggaggacatgctggccgtgtggaaccgcgtgtggatccaggagaacccctggatggaggacaagacccccgtggagagctgggaggaagttccgtacctgggcaagcgtgaggaccagtggtgcgggtccctcatcggtctgacaagccgcgcgacttgggccaagaacatccagacggctattaaccaagtccgttctctgatcgggaacgaggagtacaccgactacatgccctccatgaagcggttccggaaggaggaggaggaagccggagttctctggtga

SEQ ID NO: 25175 - RNA, 9876 nt, synthetic construct
  misc_feature 1..9876: note = derived and/or modified CDS sequence (opt11) from DENV-2__EU529700__SS-prME
  source 1..9876: mol_type = other RNA
accgccggcgtgatcataatgttaatccccaccgcaatggccttccacctcacaacccggaacggggagccccacatgatcgtcggccggcaggagaaggggaagtccctgctgttcaagaccgaggacggcgtgaatatgtgcaccctcatggccatcgacctgggggagttgtgtgaggacaccatcacttacaaatgcccactcctgcgccagaacgagccagaggacatcgactgctggtgtaacagcaccagcacctgggtgacctacgggacctgcaccaccacgggcgagcaccggcgcgagaagcggtcagtcgcattagtgccccacgttgggatgggcttagagacccggactgagacttggatgtcctccgagggtgcatggaagcacgtccagcggatcgaaacatggatcctgaggcatccgggcttcaccatcatggccgcgatcttagcctacactatcggtactacgcacttccagcgggccctcatctttattcttctgaccgccgtggctcccagcatgaccatgcgctgcattggcatctccaaccgagacttcgtggagggcgtctccggagggtcctgggtggatatagtgctggagcacgggtcctgcgtcaccaccatggccaagaacaagcccaccctggactttgagctgatcaagactgaggccaagcaacccgccaccctccggaaatactgcatcgaggccaagctgaccaacactaccaccgagtccaggtgcccgacacagggggagccctccctgaacgaggagcaggacaagcgctttatctgtaagcactccatggtggatcgggggtgggggaacgggtgcggattatttggcaagggcggaatcgtgacgtgcgccatgttcacgtgtaagaagaatatggagggtaaggtggtgttacctgagaatctggagtatactatcgtgattacgccccactcaggagaagaacacgccgtgggcaacgacactggtaagcacggcaaggagatcaagatcaccccgcagtccagcatcacagaggccgaactcaccggctacggtacagtgacgatggagtgcagcccccggaccggactggacttcaacgaaatggtgctactccagatggaggacaaggcatggctggtgcaccggcagtggttcctagacttgcccctgccttggctgccgggggcggacacgcagggcagcaactggattcaaaaggaaacgctcgtgacatttaagaatccccacgctaagaagcaagatgtggtggtgcttgggtcccaggagggtgccatgcacaccgcgctgacgggggccacggagatccagatgagcagcggcaacttactgttcaccggccaccttaagtgcaggttgcggatggataagctacagctgaaggggatgtcctatagcatgtgcaccggaaagttcaagatcgtcaaggagatcgccgagacccagcacgggactatcgtgatccgcgtgcaatacgagggcgatggctccccctgcaagatccctttcgagatcatggacctcgagaagcgacatgtcctggggcgcctgatcaccgtgaacccgattgtgaccgaaaaggacagcccggtgaacatcgaggcggagccgcccttcggtgactcgtacattatcattggggtagagccgggccagctgaagctaaactggttcaagaaggggagctctatcggtcaaatgtttgagacaacgatgcgcggcgctaagcggatggccatcctcggtgataccgcttgggacttcggcagcctcgggggcgtgttcacctccatcgggaaggccctgcatcaggttttcggcgcgatctacggcgctgccttctcgggcgtgtcttggaccatgaaaatcttaattggagttataatcacttggatagggatgaacagccgctccacatcattgtccgtcagcctggttctggtgggcgtcgtgaccctgtatctcggggtgatggtccaggccgactccggctgcgtggtgtcttggaagaacaaggagctgaagtgcggctcggggatctttataaccgacaacgtccacacgtggaccgagcagtacaagtttcaaccggagagcccgagcaagctggcctccgcaatccagaaggcgcacgaggaggggatctgcggaatccggagcgtcacccgcttggagaacttgatgtggaagcagatcacccctgagttaaaccacatcttgtccgagaacgaagtgaagctgacgataatgacgggcgacatcaaagggatcatgcaggccggcaagcggagcctacgccctcagcccaccgagctcaagtactcgtggaagacctggggaaaggccaagatgctgagcacggagagccataaccagacctttctgattgacgggcccgaaaccgcggaatgccctaacaccaaccgggcctggaacagcctcgaagtcgaggattacgggtttggggtgttttccactaacatctggctgaagttacgggagaaacaggacgttttctgcgactccaaactcatgtccgccgccataaaggacaatcgggccgtccacgcggacatgggctactggatcgagagcgcgctgaacgacacctggaagatggagaaggcctcctttatcgaggtcaagtcctgccattggcctaagtcccacaccctgtggtctaacggggtgctcgagtccgagatgatcatacccaagaacttcgcggggcccgtgagccagcacaactaccgccccggctaccacacccagacggccgggccctggcacctgggaaagctagagatggacttcgacttctgcgaggggacgaccgtcgtggtcacagaggactgtggcaaccgggggccctccctccgcaccacgaccgcgtccggtaagctgattaccgaatggtgctgccgtagttgcaccctgcccccgctccgctaccggggcgaagacgggtgctggtacggcatggagatccgccccctaaaggagaaggaggagaacctggtgaactccctcgtgacagccgggcacggccagatagacaacttcagcctgggcgttttggggatggctctctttctcgaggaaatgttaagaacccgcgttggcaccaagcacgccatcttgctagtggcggtctccttcgtgaccctgatcaccggaaacatgagctttcgggacctgggccgcgtgatggtgatggtcggggccacaatgactgatgatatcggcatgggcgtgacctacctggcgttgctcgcggccttcaaggtccgaccaacgttcgcggcggggctgctgctcaggaagctgacctccaaggagctcatgatggccaccatcggcatcgccctcttaagccagtccaccatcccagagacgatcctggagctaaccgacgccctggcgttggggatgatggtgctcaaaatcgttcgcaacctggagaagtaccagcttgccgtcactattatggccatcagctgcgtccctaatgccgtgatcctacaaaacgcctggaaggtgtcctgcaccatcctggcggccgtgagcgtaagtcccctgctgctgacgagctcgcagcagaaggccgactggatccccctggccctcacaattaagggcctgaacccgaccgctatcttcctgactacgttgagccggacctccaagaaacgctcctggccgctgaacgaggccgtaatggccgtgggcatggtctccatcctggccagcagcttgctgaaaaatgacatacccatgaccgggcccctggttgcgggcggacttctgacggtgtgctatgtcctgacgggtagaagtgcggatctcgagctggaacgcgccgccgatgtaaaatgggaggaccaagccgaaatcagcgggtcaagccccatcctgagcattacaatctccgaagacggatcaatgagcatcaagaacgaagaagaggaacagaccctcaccatcctgatccggacgggccttctcgtgatctccggggtctttccggtgagcatcccgataaccgccgcggcctggtacctgtgggaggtgaagaagcagcgcgcaggcgtcctgtgggacgtgcccagcccgcctcccgttgggaaagccgaacttgaggacggcgcctaccggatcaagcagcgagggatcttcggttatagccaaatcggcgctggggtttacaaggagggcaccttccataccatgtggcacgtgaccagaggggccgtcctcatgcaccgcggaaaacgcatcgaaccctcctgggcggacgtaaagaaggacctgatcagctacgggggcggctggaagctcgagggggagtggaaggaaggcgaggaggtacaggtgctggccctggaacccggaaagaacccccgagccgtccagacaaagcccggtctcttcaagaccaacacaggaaccatcggcgctgtgtcccttgacttctcacctggcacgtctgggagccccatcgtggatcgtaaggggaaagtcgtgggtctgtacggcaacggggtggtcacccgctccggggcttacgtgagcgccatcgcccagaccgagaaatccatcgaggacaaccccgagatcgaagatgacatcttccggaagaagcgcctcaccataatggatctgcatcccggcgcggggaagacgaagcggtacttacccgccatcgtacgcgaagctataaagcgcggactgcgcaccctcatcctggccccgacccgcgtcgtggccgcagaaatggaggaggctctgcggggtctcccaatccgatatcagacccccgccatcagagccgagcacacgggccgagagatcgtggacctgatgtgtcacgccaccttcacaatgcggctactttccccagtaagggtgccgaactacaacctgatcattatggacgaggcgcacttcaccgaccccgccagcatcgccgcccggggttacatctcaacccgcgtggagatgggggaggccgcgggcatattcatgaccgcaacgccgcccggtagccgggatccgtttccccagtcgaacgcccccatcatggacgaggaacgcgagatccccgagcggagctggaactccggccacgagtgggtcaccgacttcaaggggaagacggtttggttcgtgccgagcatcaaggctggcaacgatatcgcggcgtgtctgcgcaagaacggcaagaaggttatccagctctcccggaagacgttcgacagcgagtacgtcaagacccgcgccaacgactgggacttcgtggttacgacggacatctccgagatgggggcgaacttccgggccgagagggtaatcgatccccggcgctgcatgaagcctgtgatactgacggatggcgaggaacgggtcatactggcagggcccatgcctgtcacacacagctccgcagcgcagcgccgcggccggattgggaggaaccccaaaaacgagaacgaccagtatatttacatgggcgagcccctcgagaatgacgaggactgtgcgcattggaaggaggccaaaatgctgctggacaacatcaacacccccgaggggatcatcccgtccatgttcgagcccgaacgcgagaaagtcgacgcgatcgacggggagtatcgcctgcggggcgaagcgcgaaaaacgtttgtagacctgatgcggcgtggcgacctgcccgtgtggcttgcctacagagttgccgcggagggcataaactacgctgaccggcggtggtgcttcgatgggatcaaaaacaaccagatcctggaggagaacgtcgaggtggaaatctggacaaaggaaggcgagaggaagaaattaaaaccgcggtggttggacgcccgcatttactccgaccccctggccctgaaagagttcaaggagttcgccgcgggccggaagtccctaaccttgaacttgatcaccgagatgggccgactccccacgttcatgacgcagaaggcacgcgacgccctggacaacttggccgtcttacacaccgccgaggtaggagggagagcgtacaaccacgccctgtccgagctgccggagactctcgaaacgctgctgctcttaaccctgttggccacagtaacaggcggcatcttcctgttcctgatgtcggggaagggtatcgggaagatgacgctcggcatgtgctgcataatcaccgcctcaatcctgctgtggtacgctcagattcagccgcactggattgcggcaagcatcattctcgagttctttctgatcgtcctgctcatccccgagcccgaaaagcagcgcacgccccaggacaatcagctaacctacgtggtgatcgcgatcttgaccgtcgtggcggctacgatggcgaatgagatggggttcctcgagaaaaccaagaaggacttaggcctgggctcaattaccacgcaggagagcgaaagcaatattctagacatcgacctgcgccctgcctcggcttggacgctgtacgcggtggcaaccaccttcgtcaccccaatgctcagacatagcatcgagaactccagcgtgaacgtgtccctgacggcgatcgccaaccaggccaccgtccttatggggctcggccgtgggtggcccctgagcaaaatggacatcggcgtgccgctactagcaatcgggtgctacagtcaggtgaacccgatcaccctgaccgcggctctgctcctgctagtcgcacactacgctatcatcggccccggccttcaggccaaggccacgcgcgaggcccagaagcgtgcggccgccggtatcatgaagaaccccaccgtggatggcatcaccgtgatcgatctggagcccatcccgtacgaccccaagtttgagaagcagctgggacaggtcatgctcctcgtgctctgcgtcacccaagtcctcatgatgcgcacgacctgggccctatgcgaggccctgaccctcgcaaccggccccatcagcacactgtgggaggggaatcccggcagattctggaacaccaccatcgcagtctccatggccaacatcttcaggggcagctacctggcgggggccggcctcctgttctccataatgaagaacacgactaacactcggagagggacaggcaacatcggcgagacactgggggagaaatggaagtcccgtctgaacgcccttggcaagtccgagttccaaatatacaagaagtccgggatacaggaagtggaccgcactctggccaaagagggcatcaaaagaggggagacagaccaccacgcggtctcccgcggatccgccaagctccggtggttcgtggagcgcaacatggtgacacctgagggtaaggtcgtggacttagggtgcggcaggggtgggtggtcctactactgcggcggcctgaagaacgtcagggaggtcaaggggctcaccaagggcgggcctgggcacgaggagccgatccccatgtccacgtacggttggaacctggtgagattacagagcggggtggatgtgttcttcaccccgcccgagaagtgcgacaccctcctttgcgatatcggagagtccagccccaaccctaccatcgaggccggccgcacgctccgggtgttaaacctcgtggagaactggttaaacaacaatacccagttctgtattaaggtactcaacccgtacatgccctcggtaatcgagaagatggagacgctgcagcgtaaatatgggggcgccctggtccggaaccctctgagtcgcaactccactcacgagatgtattgggtttcgaacgccaccgggaatatcgtgtcatctgtgaacatgatcagtagaatgctgatcaaccggttcacgatgaagcacaagaaggcgacgtacgaaccggatgttgacctggggagcgggacccgcaacatcggcatcgagaacgagatacccaacctggacatcatcggcaagcggatagagaagatcaaacaggagcacgagacctcctggcactacgatcaagaccacccctacaagacgtgggcctaccacgggagctacgagaccaaacagaccggctccgcgagctcaatggtgaacggtgtggtgcgcctcctaaccaaaccgtgggacgtggtgccgatggtcacgcagatggccatgaccgacaccaccccattcggacagcagcgagttttcaaggagaaggtggacaccaggacgcaggagcccaaggagggcaccaagaagctgatgcggataaccgccgagtggctctggaaggagctggggaagaagaaaacgccccgcatgtgcacgcgcgaggagttcacccgaaaagtgcggagcaatgcggccctgggcgctatcttcacagacgagaacaaatggaagtccgcccgcgaggccgtcgaggatagccgcttctgggagctagtcgaccgcgagcggaacctgcacttggagggtaagtgcgagacgtgcgtgtacaacatgatgggcaagcgagagaagaagctcggggagttcggcaaagcgaagggttcccgggccatctggtacatgtggctgggggcgcgcttcctggaatttgaggcgctaggcttcttgaatgaggaccactggttctcaagagggaactcactaagcggcgtagagggtgagggcctccacaaacttggctacatcctgcgcgacgttagcaaaaaggagggcggcgcgatgtatgccgacgacacagccgggtgggacacacggatcaccttggaggacttgaagaacgaggagatggtgacaaaccacatgaaaggcgagcacaagaagctagccgaagccatattcaagctcacctaccagaacaaggttgtcagagtgcagagaccgacgcctaggggtaccgtgatggacatcatctcccgcaaggaccagagaggcagcggccaggtaggaacatacggcctgaacacctttaccaacatggaagcacaactgattcgccaaatggagggggagggcatcttcaagtccatccagcacctgacggtcaccgaggagatcgccgtgcagaactggctagcccgcgtcggtcgcgaacgcctctctagaatggccatctccggggacgactgcgtagtaaagcccctcgacgaccggttcgccagcgcgctgactgccttgaacgacatgggcaaagtcagaaaggacatccagcaatgggagccgtcccgcggttggaacgactggacccaggtgcccttctgcagccaccacttccacgagctcgtaatgaaagacggccgcgtcctggtcgtgccctgccggaatcaggatgagctcatcggacgcgcacggatctcccagggcgccggctggagcctcaaggagaccgcttgtttgggaaagtcttacgcgcagatgtggacgctcatgtacttccatcgccgagacctccgcctggccgccaacgcgatctgcagcgccgtgccttcccactgggtgcccaccagtcggaccacctggtccatccacgcgaagcatgagtggatgactacggaagacatgctggccgtgtggaaccgcgtctggatccaagaaaacccgtggatggaggacaagacccccgttgagagctgggaggaggtgccgtacctcggcaagcgcgaggaccagtggtgtggcagcttaataggccttacctcccgggccacctgggccaagaacatccagacggcgataaaccaggtccgaagcctcatcgggaacgaggagtacaccgattacatgccctcgatgaagcggttccgcaaggaggaagaggaggccggcgttctgtggtga

SEQ ID NO: 25176 - RNA, 9876 nt, synthetic construct
  misc_feature 1..9876: note = derived and/or modified CDS sequence (opt11) from DENV-2__EU529701__SS-prME
  source 1..9876: mol_type = other RNA
actgcaggcgtgataatcatgttgataccgacggcaatggcgttccacctcacaacccgcaacggcgagccacacatgatcgttggcaggcaggagaaagggaaatccctgctgttcaagaccgaagacggcgtgaacatgtgcaccttaatggccatggatctaggagaattatgcgaggacacgataacttacaagtgtccactcctgcgccagaacgagcccgaggacatagattgctggtgcaacagcacgagcacctgggtgacctacgggacctgcaccacaacgggcgaacaccggcgtgagaaacgttccgttgccctcgtgcctcacgtggggatgggactcgaaacccgcacggagacctggatgagttcagagggggcctggaagcacgtgcagcggatcgagacctggatcctgcgccacccgggcttcaccatcatggccgcgatcctggcctatacaatcgggaccacgcacttccagcgggcgctcatcttcatcctactaaccgccgtggcgccaagcatgaccatgcgctgcatcggcatctccaaccgggacttcgtggagggcgttagcggaggatcctgggttgacatcgtgctagagcacggaagctgtgttacgacaatggctaagaataaacctaccctggacttcgaactaatcaagaccgaggcgaagcaacccgccacactcaggaagtactgcatcgaggccaagctcacgaacaccacaacggagtcccggtgcccgacacagggcgagcccagcctgaacgaagaacaggacaagaggttcttgtgtaagcactcgatggtggaccggggctgggggaacggctgcgggctgttcggcaagggcgggatcgtgacgtgcgcgatgttcacgtgcaagaagaatatggaaggcaaggtcgtgcagcccgaaaatctggagtacaccatcgtgatcacgccccatagcggcgaggagcacgccgtgggcaacgacaccggaaagcacggcaaagagatcaagatcaccccgcagtccagcatcaccgaggccgaactcacagggtacggtacggttacgatggagtgcagcccacggaccggcctggacttcaacgagatggtgctgctccagatggaggataaggcatggttagttcaccggcagtggtttctagacctgcccttgccctggttaccgggggccgacacgcagggcagtaattggattcagaaagagacactcgtgaccttcaaaaacccccacgccaagaaacaggacgtggtggtgctggggtcgcaggagggcgccatgcacaccgccctgaccggggccacggagatccagatgtcgagcgggaacctcctgttcaccggccacctgaagtgccgcttacggatggataagctccagttaaagggtatgagttacagtatgtgtaccggcaagtttaagatcgtcaaagagatcgcggagacacagcacgggacgatcgtgataagggttcagtatgagggcgacgggagcccctgcaagattccatttgagattatggacctcgagaagcggcacgtactggggcggctgataacggtaaatccgatcgtgacggaaaaagattcaccagtcaatatcgaggccgaaccgccatttggggactcctacatcatcatcggggtggaaccaggtcagctcaaactgaattggttcaagaaggggtcgtccatcggccagatgttcgagaccaccatgcgcggcgccaagcggatggccatactgggggacacggcctgggacttcgggagccttggtggcgtgttcacctccgtcgggaaggccctgcaccaggtttttggcgcgatttatggcgccgccttcagcggggtgtcttggaccatgaaaatcttcatcggcgtaatcatcacgtggatcgggatgaacagtcgctccacaagcctttccgtgagcctggttcttgtcggtgtggttaccctgtacctgggggccatggtacaggcagactccggctgcgtggtatcgtggaagaataaggagctcaagtgcggctccgggattttcatcaccgacaacgtccacacgtggaccgaacagtacaagttccagcctgagagcccatctaagctggcgtccgccatccaaaaggcccatgaggaaggcatctgcgggatccgttccgtgacccgcctggagaacctgatgtggaagcagatcaccccagagctgaaccacatcctgtccgagaatgaagtgaagctcacgattatgaccggcgacataaaggggatcatgcaggcaggtaaacggtcacttaggccgcagcccaccgagctcaaatacagttggaaaacctggggtaaggcgaagatgctctctacagaaagccacaatcaaaccttcctgatagatgggcctgagaccgccgaatgcccgaacaccaaccgggcctggaacagcctggaggtagaggactacggttttggcgtgtttacaacaaatatatggctgaagctccgcgagaaacaggacgtgttctgcgactcgaagttaatgagcgctgccatcaaagacaaccgggcggtccacgccgacatgggctactggatcgagagcgccctcaacgacacctggaagatggagaaggcgtcattcatcgaggtgaaatcgtgccactggcctaagagccacaccttgtggtccaacggggtcctggagagcgagatgatcatccccaaaaacttcgcgggtcccgtctcccagcataactaccgcccgggctaccacacccagacggccgggccctggcacttagggaagctagagatggatttcgatttctgtgaggggaccaccgtggtggttactgaggactgcggaaaccggggccccagcttacgcacgaccaccgccagtgggaagctcatcacagagtggtgctgcaggtcctgcacgctgccaccactgcgctatagaggggaagacgggtgctggtacgggatggaaatccgccccctcaaggagaaggaggagaaccttgtaaacagcctggtgaccgccggacacggacagattgacaacttctccctcggagtcctcggaatggcgctgttcctggaggagatgctgcgcacccgggtgggcaccaagcacgcgatcctcctcgtggccgtcagtttcgtgaccctgatcactgggaacatgtcctttcgggatttaggccgcgtaatggtaatggtgggggcgaccatgaccgacgatatcggcatgggcgtgacctacctcgcactgttagccgccttcaaggtccgccccaccttcgcggccggactcctgctgagaaagttaacgagtaaggagctgatgatggccaccatcggcatcgccctgctatcccagagcacgatccctgagacaatcctggagttgacggacgcgctcgccctggggatgatggtgctgaagatagtaaggaacatggagaagtaccagctcgccgttacgatcatggccatatcctgcgttccaaacgccgtgattctgcaaaacgcctggaaggtctcgtgtacgatcttggctgctgtctccgtcagccccttgttattaacctcaagccagcagaaggctgattggatccccctcgcgctgaccatcaaaggcctgaatcccacagcgatctttttgactaccctgtcgcggaccagtaaaaagcgctcatggccgctgaacgaggccatcatggcggtcggtatggtaagcatcctcgcgtccagccttcttaaaaacgacatccccatgacagggcccctggtcgctggtgggctgctgacggtctgctacgtgttgaccggccgaagcgccgatctagaactggagcgcgccgcggatgtcaaatgggaggaccaggccgagatcagcgggagcagccccatcctcagcatcaccatctccgaggacggctctatgtccatcaaaaacgaagaggaggagcagactttgacgatcttaatacggaccggccttctggttatttctggtgtatttccggtatccatccccatcaccgctgccgcctggtacctgtgggaggtgaagaagcagcgtgcaggcgtgctctgggacgtgccctcccctcccccagtggggaaggccgagctggaggacggagcgtaccggatcaagcagcgagggatcttaggctactcccagatcggcgccggcgtgtacaaggagggcacgttccatactatgtggcacgttacgcgcggtgccgttttgatgcaccgcggcaagcggatcgagcccagctgggcagacgtcaaaaaggacctgatttcctacggcggcggttggaagctggagggggagtggaaggagggtgaggaggtccaggttctcgccttagagccgggtaaaaatcccagggcggtccagaccaagcccggcctgttcaagacaaacacggggacgataggcgccgtctccctcgacttctcccccggtacctctgggtcccccatagtggatcgcaaagggaaggtggtcggtttatacggtaacggcgtcgtcacccgaagtggggcctatgtctccgccatcgctcagacagagaagagtatcgaggataaccccgagatcgaggacgacatctttcgaaagaagaggttgaccataatggacctccaccccggggccggaaagacgaagcggtatctgcctgcaatcgtgcgcgaagcgatcaaacggggtttgcgcaccctgattctagccccgacccgcgtggtggctgcagagatggaggaggctctgagagggctgcccatccgctaccaaacgcctgccatccgtgccgaacacaccggccgcgagattgtcgacctcatgtgccacgcgaccttcacaatgcggctgctctcgccagtacgtgtcccaaactacaacctcataatcatggacgaggcgcacttcacggacccggccagcatcgccgctcggggctacatcagtacccgcgtggaaatgggggaggcggccggcatattcatgactgccacgccgcccggatcccgggacccgttcccccagtccaacgcccctatcatggacgaggagcgggagattcccgagaggtcgtggaacagtggtcacgagtgggtcacggacttcaaggggaagaccgtctggtttgttccgtctatcaaagcggggaatgacatcgccgcatgcctgcggaaaaacggcaagaaggtgatccagttgtcgcggaagaccttcgattccgagtacgtcaagacgcgcgccaacgactgggactttgtggttacgacagacatcagcgagatgggtgccaacttcaaggcggagcgggtcattgatcccagaaggtgcatgaaaccagtgattctcaccgacggagaggagcgcgtcatcctggcagggcccatgcccgttacccactccagcgccgcacagcgtagaggccgcatcgggcggaaccccaaaaacgagaacgaccagtacatctacatgggtgaacccctagagaacgacgaagactgcgcgcactggaaggaggcgaagatgctcctggacaatattaacacccccgagggcatcatcccctcaatgttcgagccagaacgggagaaggtggacgccattgacggggagtaccggctgcgcggcgaggccaggaagactttcgtggacctcatgcgccgtggggacctgcccgtctggttggcctacagggtcgctgccgagggaatcaactatgcagaccggcgctggtgcttcgacggaatcaagaataaccaaatcttggaggagaatgtggaggtcgaaatctggaccaaggagggagaacgaaagaaactgaaacctagatggctagatgcgcgaatctactccgatccattagccttgaaggagttcaaggagtttgctgccgggcgcaagtccctcaccttaaacctaataacggaaatgggacggctgcccacgttcatgacccagaaagcccgtgacgccctcgataacctggccgtgctgcacaccgccgaggccggagggaaagcctacaaccatgcgttgtctgagctgcccgagacgttggagacccttctgctcctcaccctgctggcgactgttaccggcggcattttcctgttcctgatgtccgggaagggcatcggcaagatgacccttgggatgtgctgtatcatcaccgcgagcatcctcttgtggtacgcccagatacagcctcactggatagccgccagtatcatcttggagttcttccttatcgtgctgctgatccccgagcccgagaagcagcggacgccccaggacaaccagcttacctacgtggttatcgcaatactaacggtcgttgcggccaccatggccaacgagatgggattcctagagaagacgaagaaggacctcggcctgggctccatcaccacacaggagagcgagtccaacatactggacattgatctccgaccggcctcagcctggacgctgtacgcggtcgccactacctttgtgacgcccatgctgcggcattccatcgagaacagctccgtgaatgtatcactaaccgcaatcgccaaccaggctactgtgctgatggggctgggaaaggggtggccgctctccaagatggacatcggcgtccccctgctggcaatcgggtgttacagccaggttaacccgattacgcttacagcggccctgttgttgctggtggcccactacgcaatcatcggccccggactgcaagccaaggccacacgcgaagcccagaagcgggcagcggccgggataatgaagaaccccacggtggacgggatcaccgtcattgacctcgagcccatcccgtacgaccccaaatttgagaagcagctgggccaggtgatgctcctgatcttatgtgtaacgcaggtcctcatgatgagaaccacttgggctctctgtgaggccctgaccctggccacgggtcccatctccaccctctgggaggggaaccccggccgcttttggaacaccacaattgcggtgagcatggctaacatcttccgaggatcctatctggccggggccggtctgctgttcagcataatgaagaacacgactaataccaggcgggggaccggcaacataggcgagacgctaggagaaaagtggaagtcccgcctgaacgcgctcggcaagagcgagttccagatatataagaagtcagggatccaggaggtggaccggacgctggccaaagagggcatcaagcgcggtgagactgatcaccacgctgtatctcggggatcggcgaagctccgctggttcgtggagcggaacatggtcaccccagagggaaaggtggtggacttagggtgcggacgcgggggatggtcctactactgtgggggccttaaaaatgtgcgggaagtcaagggactgacgaagggaggtcccgggcacgaagaacccatacccatgtccacctacggttggaacctcgtgcgtctacagagcggggtcgacgtcttcttcaccccgcccgagaaatgcgataccttgctttgcgacattggcgagagctcccccaaccccacgatcgaggccggccggaccctgcgcgtgctgaacctcgtggagaactggctaaacaacaacacccagttctgcattaaggtcctgaacccatacatgcccagcgtgatcgaaaagatggagactcttcagaggaaatacggaggggcgcttgtgcgcaaccccctgtcccggaacagcactcacgagatgtactgggtctccaacgcaacagggaacatcgtgagctccgtgaacatgatcagccgcatgctaatcaaccgattcacgatgaagcataagaaagccacctacgagccagatgtcgacctcggctccgggacccgcaacatcggcatcgagagtgaaatccctaacttggacatcatcggcaagcgcatcgagaagatcaagcaggaacacgagacgtcctggcattatgaccaagaccacccctacaagacttgggcctaccacgggtcctacgagaccaagcagaccggctccgctagctccatggtgaacggagtggtgcggctgctcaccaagccctgggacgtggtaccgatggtcacgcagatggcgatgaccgacaccacgcccttcggccagcagcgggtgttcaaggagaaggtggatacccgcacccaagagcccaaagaggggaccaagaagttgatgaagattacggccgaatggctgtggaaggagctcggtaagaagaagacgccgagaatgtgcacccgtgaggagttcactcgcaaggtccgctccaacgccgccctcggcgccatcttcacggacgagaacaagtggaagtcagcgcgcgaggccgtggaggactcacggttctgggagttagtggaccgggaacgtaacctccacctggaagggaaatgcgaaacgtgtgtctacaatatgatgggcaaacgagagaagaaactgggggagttcgggaaagccaagggctcacgggcgatttggtacatgtggctcggagcgcgcttcctagagttcgaggcacttggcttcctcaacgaggaccactggttctcgagagggaactcactgtccggtgtggaaggggagggcctgcacaggttggggtacatcctacgggacgtcagcaagaaggagggcggggcaatgtacgccgacgacaccgccggctgggatacccgcatcacgctggaggacctcaaaaacgaggagatggtgaccaaccacatgaaaggggagcacaagaagctggcggaggccattttcaagctgacttaccagaacaaggttgtccgtgtgcagaggccgacaccccgggggacggtgatggacatcatatcccggcgcgaccaacggggcagcggccaggtcggcacatacggcctcaacacattcaccaacatggaagcccagctgatccgccagatggagggtgagggcatcttcaagtccatccagcacctgacggtgaccgaggagatcgccgtacagaactggctcgctcgggtcggacgcgaacggcttagcaggatggcgatctccggggacgactgcgtggtgaagcccttagatgatagatttgcctcagccctcaccgccctaaacgacatgggcaaagttcgcaaagacatccagcagtgggaacccagtagagggtggaacgactggacccaggtcccgttttgcagtcatcacttccatgagcttgtgatgaaggacggccgagtcctcgtggttccctgcaggaaccaagacgagctgatcgggcgcgcccgtatatcgcagggtgcaggctggagcctgaaagagacggcctgtcttgggaaatcctacgcccagatgtggactctaatgtatttccaccgccgggacctgcgattggccgccaacgcgatatgctctgccgtcccctcccattgggtgccgaccagccggactacctggtccattcacgccaagcacgagtggatgacgaccgaggacatgctggcagtctggaaccgcgtttggatccaggagaacccgtggatggaggacaagacccccgtggaaagctgggaggaggtgccctatcttggaaagcgggaggaccaatggtgcggtagcctcatcgggctgacctcccgggccacgtgggccaaaaatatccaaaccgccatcaaccaggttcgaagcctgattggaaacgaggagtacaccgactacatgcccagcatgaagcggttcaggcgggaggaggaggaggccggcgtgctctggtga

SEQ ID NO: 25177 - RNA, 9876 nt, synthetic construct
  misc_feature 1..9876: note = derived and/or modified CDS sequence (opt11) from DENV-2__EU569704__SS-prME
  source 1..9876: mol_type = other RNA
accgccggcgtgatcatcatgctgatcccaaccgcgatggcattccacctcaccacccggaatggggagccccacatgattgtgggccggcaggagaaggggaagtccctgctgtttaagaccgaagacggagttaacatgtgcacccttatggctatagacctgggggagctgtgcgaggacaccatcacgtataaatgccccctcctgcggcagaacgagccagaagacatcgactgctggtgcaatagcaccagcacttgggtgacctacgggacctgcactaccacgggcgagcatcggcgggagaagcggtccgtagcactggtgccccacgtggggatgggcctcgagacgcgcacagagacctggatgagcagcgagggtgcctggaaacacgtacagcggatagagacatggatccttcggcacccgggcttcacgataatggccgcgatcctggcctataccatcgggaccacgcatttccagcgcgccctcattttcatcctgctgactgccgtggcgcccagcatgacgatgcgctgcatcggcatctccaaccgcgactttgtggagggcgtctctgggggcagttgggttgacattgtgctcgagcacggtagctgcgtcaccacgatggccaaaaacaagcccacgctggatttcgagctaatcaagaccgaggccaagcagccagccaccctccgcaagtactgcatcgaggccaagttaacgaacaccaccaccgagtcccggtgtccgacgcagggcgagcccagcctgaacgaggagcaggacaagcgcttcctgtgcaaacactccatggttgatcggggttgggggaacggctgcgggctgtttggcaagggcgggatcgtgacctgcgcaatgttcacatgcaagaagaatatggagggtaaggtcgtgctgcccgagaacctcgagtacacgatagtgatcacgccccatagcggggaggagcatgccgtcggcaacgacaccgggaagcacggcaaggaaattaagattactccgcagtcctctatcacggaggccgagcttaccgggtacggcacggtgaccatggagtgtagcccgcggaccggcctggacttcaacgagatggtgctcctgcagatggaggacaaggcctggctagtccaccggcagtggttcctcgacctgcccctgccgtggctcccgggggccgacacccaaggcagcaactggatccaaaaggagacgctggtaaccttcaaaaacccacatgcgaagaagcaggacgtggtggtgctggggtcccaggagggcgccatgcacaccgcattgaccggggccacggaaatccagatgagcagcggcaacctgctgttcaccggccacctcaagtgccgcctgcggatggataagctgcaactcaagggcatgtcctactctatgtgcaccggcaaattcaagatagtgaaggaaatcgcggagacccagcacgggacgatcgtcatccgtgtccagtacgagggcgacggctccccctgcaagatccctttcgagatcatggaccttgagaagcgtcacgtcctggggcgactcataaccgtgaacccgattgtgaccgagaaggactcccctgtgaacatcgaggcggagccgcccttcggggactcctacatcatcatcggtgtggagccaggccagctgaagctgaattggttcaagaagggaagctccatcggccagatgttcgagaccacgatgcgcggagccaagaggatggccatcctcggggacaccgcttgggacttcggctccttgggcggtgtgtttacgtccattgggaaagccttgcaccaggtgtttggggcgatctacggcgctgccttctcgggggtctcatggaccatgaagatcctgatcggcgtaatcataacgtggatcgggatgaacagcagatcgacgtcactctccgtcagcctggtgctggtgggcgtcgtgactctgtatctgggggccatggtgcaggcggactccggctgcgtcgtgagctggaagaacaaggagctgaaatgcggctcaggcatcttcattaccgacaacgtgcacacgtggaccgagcagtataagttccagcccgagtcgcccagcaaactcgcgtccgccatccagaaggcccacgaggagggcatctgcgggatccggagcgtaacgcgcctggagaatctgatgtggaagcagatcacccccgagctcaaccacatcctgtccgagaacgaggttaagctcacgatcatgaccggcgatattaaggggatcatgcaagccggcaagcggagcctccgcccgcaacccaccgagctgaagtactcctggaagacatggggcaaggccaagatgctgagcacggagtcccacaaccagaccttcttgatcgacgggcctgaaaccgccgaatgcccgaacactaaccgggcctggaacagcctagaggtggaggactacggcttcggggtcttcactacaaacatctggctgaagctccgtgaaaagcaagatgtgttctgcgacagtaagttaatgtcagccgccattaaggataatcgggcggtgcacgctgacatgggctactggatcgagagcgcactgaacgatacctggaaaatggagaaggcgtcgtttatcgaggttaagtcctgccactggccaaagtcccacaccctctggagtaatggcgtgttggagagcgagatgatcatacccaaaaattttgccgggcccgtgtcccagcataattacagaccgggctaccatacccaaacagcggggccctggcacctgggcaagttagagatggacttcgacttctgtgaggggaccaccgtcgtggtcaccgaggactgtggcaatcgcggtcccagcctgaggaccaccaccgccagcgggaagttaatcaccgagtggtgctgccggtcctgcacgctgccgcccctgaggtaccggggcgaggacggttgctggtacggcatggagatccgccccctgaaggagaaggaggagaacctcgttaacagcctggtgaccgccgggcacggccaaatcgacaacttctcgctgggtatcctcgggatggccctgttcttggaggagatgctccggacacgcgtgggcaccaaacacgcgatactgctggtggccgtaagcttcgtgacgctcattaccgggaacatgtccttccgcgacctgggccgcgtaatggtcatggtgggcgcaaccatgaccgacgacatcggcatgggggtcacgtacctggcccttctggcggcgttcaaggtgaggcccaccttcgccgctgggctgctcctgcggaagctgacctctaaagagctcatgatggcaaccataggcatcgccctcctgtcccaaagcacgatccctgagaccatcctcgagctgaccgacgcgcttgcccttggaatgatggtgctgaagattgtacgtaacatggagaagtaccagctggccgtaacaattatggccatctcctgcgtgccgaacgccgtcatcctccagaacgcgtggaaggtgagctgcacgatcctggccgcggtgtccgtctctcccctactcctgacatccagccagcagaaagcagactggattcccctggcgttaactatcaagggcctgaaccccaccgccatcttcctgacgaccctcagtcggaccagcaagaagcgcagctggcccttgaatgaggccatcatggccgtcggcatggttagcatcctggcctcaagcctcttgaaaaacgacatccccatgactgggcccctggtagcgggcggcctcctgacggtgtgctacgtcctgactggccgctctgccgacctcgagctggagcgcgccgcggacgtaaagtgggaggaccaggccgagatctccgggagctcccccattctgagcatcaccatctccgaagacggcagcatgtccatcaagaacgaggaggaggagcagaccctcacgatcctgatccggactggcctgttggtgatcagcggtgtcttcccggtttccatccccatcaccgcggccgcatggtatctgtgggaagtgaagaaacagcgcgccggcgttctgtgggatgtgcccagtccgccgcccgtggggaaggccgagctcgaggacggcgcgtatcggatcaagcagagagggattctgggctacagccaaatcggggccggggtatacaaggaggggactttccataccatgtggcatgttacgcgcggggccgtgctgatgcaccgcggcaagcggattgagcccagctgggctgacgtcaagaaggacctcatctcctacgggggcggctggaagctggagggggaatggaaagagggcgaggaggtccaggtgctcgcgttagagcccgggaagaaccctcgggccgtccagaccaagcctggcctgtttaagaccaataccgggacgatcggggccgtaagcttggactttagccccggcactagcgggagtcccatcgtggaccggaagggaaaggtcgtcgggctctacggcaacggcgtggtaactcgcagcggggcttacgtgtccgccatagcacagaccgagaagtcgatcgaagacaaccccgagattgaggacgacatctttcggaaaaagcgcctgacgatcatggacctacaccctggcgccgggaagaccaagcggtacctgcccgccatcgttcgagaggccattaagcggggcttgcgcactctgatactggccccgacccgggtcgtggcggccgagatggaggaggctttgcggggcctgcccatccgctaccagacgccggcaattcgggccgagcacaccggccgcgagatcgtggaccttatgtgccacgcgacattcaccatgcgactcttaagccccgtccgcgtgccgaattacaatctgataatcatggacgaggcccacttcacggatccggcgtccattgccgcacggggctacatctccacacgcgtggagatgggcgaggccgccggtatcttcatgaccgccacgccgcccgggagcagagaccccttcccccaaagcaacgcccccatcatggacgaggagcgcgagatccccgagcggtcctggaacagcggccacgagtgggtcaccgacttcaagggaaagacggtctggttcgtgccgtccatcaaggcggggaacgacatcgccgcctgcttgcgcaagaacggcaagaaggtcatccagctgagtcggaagaccttcgactccgagtacgtcaagacccgcgccaacgactgggacttcgtagtgacgacagacatcagcgagatgggggccaacttcaaggcggagcgggtgatcgacccccgccggtgtatgaagcccgttatcctgaccgacggcgaggagcgcgtaatcctcgccgggccaatgccggtgacccactccagcgccgcgcagcggcgcggacgcatcgggcgaaacccaaagaacgagaacgatcagtacatttacatgggcgagcccctggaaaacgacgaggactgcgcccactggaaggaggcgaagatgctgctcgacaacatcaacactcccgaaggcatcatcccgtccatgttcgaacccgagcgcgagaaggtggacgccatcgacggggagtaccggctccggggcgaggcccggaagacctttgtcgacctgatgcgccgcggggaccttcccgtgtggctagcctaccgcgtggccgcggagggcatcaactacgccgatcgtcgctggtgctttgatggaatcaagaacaaccagatcctggaggagaacgttgaggtggagatctggaccaaggagggcgaacggaagaaactcaagccgcgctggctggacgcaagaatctactccgaccccctggccttaaaggagttcaaagagttcgcagccggccgtaagtccctgaccctgaacctaatcacggagatgggtcggcttcctaccttcatgactcagaaggcccgagacgccctggacaacctagcagtactgcacaccgctgaggccggcggtcgagcctacaaccacgcactaagcgagctccccgagaccctggagaccctactcctgctgaccctcctggccactgtcacgggcggcatcttcctatttctcatgagcgggaagggaatcgggaaaatgacactgggcatgtgctgcataatcaccgcgtctattctgctctggtacgcccagatccaaccgcactggatagcggcctctatcatcctggagttcttcctgattgtgctcctgatccccgagcctgagaagcagcgcacgccgcaggataaccaactgacatacgtcgttatcgccatcctcacggtggtcgcagccacgatggccaacgaaatggggttcttagagaagaccaagaaggacttaggcctcggctctatcactacgcaggagtcggaatccaacatcctggacatcgacctgcgcccggccagcgcctggaccctctacgcggttgccaccacctttgtgacgcccatgctgcgacactccatcgagaactcctccgtgaacgttagcctgaccgccatcgccaaccaggcgaccgtgctcatggggctgggcaaagggtggcccctgtctaagatggacatcggcgtccccttactggccatcgggtgctactctcaagtgaacccgattaccctgacggccgccctgctgctgctcgtggcgcactacgcgatcatcggccccggcctgcaggccaaggccacccgggaggcccagaagcgtgccgcggccgggatcatgaagaaccccaccgtcgacggcatcaccgtaatcgacctggaacccatcccgtatgaccccaagttcgagaagcagcttggccaggttatgctgctgatcctctgcgtcacacaggtgctgatgatgcgcaccacgtgggccctgtgcgaggccctcactttagcgacgggccccatcagtaccctgtgggagggaaaccccggcagattttggaacaccaccatagcggttagcatggccaacatcttccgaggctcctacctcgccggcgccggcctgctgttctcaatcatgaagaacaccaccaacacccggcgcggcaccggaaacatcggcgagaccctcggggagaaatggaagtcccggctgaacgcgctgggcaagagcgagttccagatctacaagaagtccgggatccaggaggtcgaccgaaccctagccaaggaggggataaagcgcggggaaaccgaccaccacgcggtgtctcgcggctccgcaaagcttcggtggttcgtagagcgcaacatggtcacccctgagggcaaagtggtggacctgggctgcggccgcggtgggtggagctactattgcggcgggctcaagaacgtccgcgaggttaaggggctgacgaagggcggcccagggcacgaggaaccaatccccatgtctacctacggctggaatctggtgagactccagagcggggtcgacgtgtttttcaccccgcccgagaagtgcgacactctgctgtgtgacattggcgaaagctcccctaaccccacgattgaagccggccgcaccctccgggtgctgaatctggttgaaaactggctcaacaataacacccagttctgcatcaaagtgctgaatccgtatatgccgagcgtgatcgagaagatggagaccttacaacgcaagtacgggggcgcgctggtccggaaccccctgtcccgcaacagcacccatgagatgtactgggtctctaacgccacgggcaacatcgtgagctcagtcaacatgatcagcagaatgctgatcaaccgcttcacaatgaaacacaagaaggccacctacgaacccgatgtggacctgggctccggcacccgcaacataggcatcgagagcgagatccccaacctcgacatcatcggcaagcgtatcgagaagattaagcaggagcacgagacttcgtggcactacgaccaggaccatccctacaaaacgtgggcctaccacgggtcttacgagactaagcagaccggttctgctagctccatggtcaacggggtcgtgcgcctgctaacgaagccctgggatgtggttccgatggtgacccagatggcgatgaccgacaccacgcccttcggccagcagcgcgtgttcaaggagaaggtcgatacccgaactcaggagcccaaggagggcaccaagaagttgatgaaaatcacagccgagtggctgtggaaggagctggggaagaagaagacgccccgcatgtgcacccgcgaggagtttacccggaaggtccgctcgaacgcagctctcggcgccatcttcacggacgaaaacaagtggaagagtgcgcgggaggccgtagaggacagccgcttctgggagctaattgatcgggagcgcaacctacacctcgaggggaagtgtgagacatgcgtttacaacatgatgggcaaacgggagaagaagctgggggaattcgggaaggccaagggatcccgcgccatctggtacatgtggctgggtgcacggtttctcgagtttgaggccctgggcttcctgaacgaggaccactggttcagccgcgggaacagcctctccggcgtcgagggagaggggctacaccggctgggctacatcctccgcgacgtctcaaagaaggaagggggcgcaatgtatgcagacgacacggccgggtgggacacccggatcaccctggaggacctgaagaacgaggagatggtcactaaccacatgaagggcgagcacaagaagctagcggaggcgatcttcaagcttacataccagaacaaggtggtaagggtacagcgaccgacgcccagagggaccgtgatggacatcatatcccgccgggaccagcgcggcagcggccaggtaggaacctacgggctgaacactttcaccaacatggaggcacagctcataaggcagatggagggagagggcatattcaagtctatccagcacctgacagttaccgaggaaatcgccgtgcagaactggctggcaagagtaggacgagagcgcctcagccggatggccatctccggggacgactgcgtggtgaagcccttggacgaccgcttcgccagcgccctgaccgccttgaacgacatgggcaaggttcggaaggacatccagcagtgggagccctcccgcggctggaacgactggacccaggtgccgttctgctcccaccacttccatgagctcgtgatgaaggacgggcgggttctcgtggtgccctgtcgcaaccaggacgagctcatcggacgggcccgtatttcccagggcgcgggctggtcacttaaggaaacagcctgcttggggaaaagctacgcccaaatgtggaccctcatgtacttccaccggcgcgacctgcggctggctgccaacgcgatttgtagcgccgtcccctcccattgggtgcccaccagccgcacgacctggtccatccacgccaaacacgagtggatgacaaccgaggacatgctcgccgtgtggaaccgggtctggatacaggagaacccatggatggaggacaagaccccggtggagagctgggaggaggtgccttacctgggtaagcgagaggatcagtggtgcgggagcctgatcggactcacatctcgggcaacttgggccaagaacatccagaccgccataaaccaggtccggagcttgatcggtaatgaggagtacaccgactacatgccctctatgaagaggttccggcgggaggaggaagaagccggcgtcttatggtga

SEQ ID NO: 25178 - RNA, 9876 nt, synthetic construct
  misc_feature 1..9876: note = derived and/or modified CDS sequence (opt11) from DENV-2__EU482568__SS-prME
  source 1..9876: mol_type = other RNA
actgcaggagtaatcattatgctaatcccaacggcaatggccttccacctcaccacccgcaacggggaaccccacatgatcgtagggagacaagaaaaaggcaaatcgctactcttcaaaacagaagacggagtgaacatgtgcacgctaatggccatagacctaggcgaactttgtgaagacacaataacctataaatgtcccctactgagacagaacgaaccggaagatatcgactgctggtgcaactcgacctcgacctgggttacatacggaacctgcacgacaacgggcgaacaccgacgagaaaaacggtccgtagccctggtaccccacgtcggcatgggccttgaaacacgaaccgagacatggatgtcgagcgaaggcgcgtggaaacacgtacagagaatcgaaacatggattctaagacacccgggattcacgatcatggcagccatactcgcatacactataggcacgacacacttccagcgcgcgctcatattcattctgttgacggcagtagctccaagcatgaccatgagatgcatcggaatttctaaccgggactttgtagagggagtaagcggaggcagttgggtcgacatcgtgttagaacacggctcatgcgtaacaacgatggccaaaaataaacccaccttagactttgagttaataaaaaccgaagcgaaacagcccgcaaccctaagaaaatattgcatagaggccaaactaacgaatacgaccactgaatcgcgttgtccaactcagggtgaacctagcttaaatgaggagcaagacaaaagattcctatgcaaacactcaatggttgaccgagggtggggaaacgggtgcgggcttttcggcaaaggcgggatcgtaacttgcgccatgttcacatgcaagaaaaacatggaagggaaagtagtgctaccggaaaatctggagtacacgatcgtcatcacaccccactccggcgaagaacacgccgtggggaacgacaccggaaaacacggaaaagaaatcaaaataacaccacaaagcagcatcaccgaagcggaactgactggctacggaacagtgacaatggagtgcagcccccgcacaggcttggacttcaacgagatggtgcttctccagatggaggacaaagcgtggctggtacaccgtcaatggttcctagacctacccctaccttggctcccaggagctgacacgcagggatccaactggatacaaaaggaaactctcgtgaccttcaaaaatccacacgcgaagaagcaggatgtggtggtcttgggatcacaggagggtgccatgcacacagctctcacaggggccaccgaaatacagatgtcgagcgggaacctactcttcacagggcatttaaagtgccgcttacgtatggacaagctacagctcaagggaatgtcgtactcgatgtgcactggtaagttcaagatcgtaaaggagatagctgaaacgcagcacggtacgattgtaattcgcgttcagtatgaaggagacgggtcgccctgcaagatcccatttgaaataatggatctcgaaaaacgccacgtactgggccggctaataaccgtcaatcctatcgtaactgagaaagactcccccgtcaacatagaagcggaaccgccgtttggggactcttatataataatcggagttgaacccggacaacttaaactgaattggttcaagaaaggtagctccatcggtcaaatgttcgaaacaacgatgcgtggggccaagaggatggcaatactgggggacacagcatgggactttgggagcctaggtggggtctttaccagcatcgggaaagctctccaccaggtgttcggggcaatatacggcgccgcattcagcggagtgtcttggacaatgaaaatacttatcggggttattatcacctggataggcatgaatagtagatcaacttccctgtcggtgagcctcgtgttagtaggtgtcgtcacactctacctaggcgctatggtccaggccgattccggctgcgtggtctcgtggaagaacaaggaactcaaatgtggatccgggatattcattacggacaacgtgcacacttggacggaacaatacaagtttcagcccgaatccccaagcaagctagcgagcgctatacaaaaggcacacgaagaagggatctgcggcataaggagcgtaacaaggctagagaacctcatgtggaagcagatcacgcccgaactaaaccacatactttcagaaaacgaagtcaaattaacaataatgacaggagatattcggggcataatgcaagccggcaagcgttccctcagacctcaaccaaccgaactcaaatacagttggaagacgtggggcaaagcgaagatgctcagcactgagagtcataaccaaacctttctaatagacggtcccgagacagctgagtgcccaaacaccaaccgagcttggaatagcctcgaagtagaagactatggcttcggagtcttcacaaccaatatctggctgaagctacgagaaaagcaagacgtattttgcgacagcaagttaatgtcagccgccatcaaagacaaccgagcagtacatgccgatatgggatactggatcgagagtgccctcaacgacacgtggaaaatggagaaagcgtcattcatagaagtgaaatcatgtcactggcccaagtctcacacattatggtcgaacggcgtcctagagtcggagatgataatacccaagaacttcgcaggacccgtatcccagcacaattacagaccaggttaccacacgcaaacggctggaccgtggcatctagggaaattagagatggatttcgacttttgcgaaggtacaaccgttgtggtcaccgaagactgcgggaacagaggaccttcactaaggactacaacggctagcggtaaactaatcaccgaatggtgctgtcgaagttgcacactgcccccgctgcgctaccgaggcgaggatggatgttggtacggcatggaaatccgaccgcttaaggaaaaagaggagaacctagttaactccctagtaacggccggacacggccaaatcgacaactttagcctgggcatacttggcatggccctcttcctcgaggaaatgttgcgaacccgagtcggcaccaaacatgcgattctgctcgtcgcagtgagttttgtgaccctaatcacgggaaacatgtccttcagggacctgggacgggtaatggtgatggtcggagccaccatgacggatgacatagggatgggggtaacttaccttgccctcttggcggcgttcaaagtgaggccaacgttcgccgcagggctactcctgcgaaaactaacctccaaggagctaatgatggcaaccataggcatcgccctgcttagtcagagtacaatcccagagactatattggaacttaccgatgccctagcattaggtatgatggtcttgaagatagtgcgcaacatggagaaataccaactagcagtcaccattatggccatctcctgcgtcccaaacgctgtaatcttacaaaacgcatggaaggttagctgtacaatcctagcagcagtatcagtatccccgctattgctaacaagttcccagcagaaagcagattggatcccgctagccctaactataaagggtctcaaccccactgcaatattcctgaccaccttgtccagaacctcaaagaagcgaagctggcccctgaatgaagcaatcatggcagtgggcatggtctccatcctggcctcatctttactgaaaaacgacatacccatgaccgggcctctcgtagcaggcggactgctaacggtctgctacgttctaaccggtcgctcggcggacctcgagttagaacgggcagcagacgttaaatgggaggaccaggcggaaattagcggctccagcccgatattatctataaccatatcagaagacggctcgatgagcatcaaaaacgaagaagaggaacaaacactcactattctgataagaacaggcctcctggtgataagcggagtattcccagtatcaatccctatcaccgcggcggcgtggtacctgtgggaggtcaagaaacaaagggccggtgtgttatgggacgtgccgtccccaccgccagtagagaaagccgagttagaggacggtgcatatcgcatcaagcaacgaggtatcctgggttactctcaaataggggccggtgtctacaaggaaggaaccttccacacgatgtggcacgtaacaagaggggcagtactgatgcaccgtggcaagcgagtggaacccagctgggcagacgtgaagaaagatctcatcagctacggcgggggatggaaactggaaggggagtggaaggaaggcgaggaggtccaagtcctagcactagagccaggcaaaaacccacgtgcggtacaaacaaagcccggcttgttcaagacaaacaccggcacaataggagcagtcagcctggacttctcgcccggaacctcgggctcaccgatcgtagacagaaaggggaaagtggtgggtctctacgggaatggagtagtcacccgtagcggtgcatacgtgagcgccatagctcaaaccgaaaagagcatcgaagacaacccagagatagaagacgatatattccgaaagaaacgcctgaccataatggacctacacccgggggccggcaagacgaagcggtacctgcccgcgatcgtgagggaagcaataaaaagggggctaagaacactcatcctggcaccgacaagggttgttgccgcagaaatggaagaggcccttcggggactcccaatacgataccagaccccggccatacgcgcagaacacacaggccgagaaatagttgacctgatgtgccacgctacctttaccatgcgactgctatccccagtacgagtgcccaactacaatctcatcatcatggatgaagcacacttcactgatcccgcgtcgatagcggcccgtggttacatcagcactcgtgtggagatgggcgaagcggcgggtatattcatgacggctacacccccgggcagtagggatccattcccacagtcgaatgcacccatcatggacgaggaacgcgaaataccggagaggagttggaactcggggcacgagtgggtaactgacttcaaagggaaaacagtatggttcgtaccgtctatcaaagcaggaaacgatatagccgcttgcctaaggaaaaacggcaagaaagtaatccaacttagtcgcaaaacattcgactctgaatatgtgaaaacgcgtgctaatgactgggatttcgtagtgacaactgatatatcggagatgggagctaacttcaaagcagaacgcgtaatcgacccgcgaagatgcatgaagcccgtcatccttacggacggggaggagcgcgtgatcctggcagggccaatgccggtgacacactcatccgctgcgcaacgacggggaagaataggcagaaatcctaaaaacgaaaacgaccagtatatctacatgggcgagcctctagaaaacgacgaggactgcgcacactggaaagaggcaaaaatgctattagacaacatcaacacaccagaagggatcataccaagcatgttcgagccagaaagagagaaagtagacgccatcgatggggaataccgccttcgtggcgaagcacgaaagacattcgttgatctcatgcgcaggggagatctaccggtctggctggcataccgagtggccgcagaaggaattaactacgcagacagaagatggtgttttgacggtataaagaacaaccagattttggaggaaaacgttgaagtagaaatctggaccaaggagggggaacggaagaaattaaagccacgctggctcgacgcacgaatatactcagatcccctcgccctgaaagagttcaaagagttcgccgccggacgaaaaagcctaaccctgaacctgataacggagatgggcagacttcctacctttatgacacagaaggcaagggatgcattggataatctcgcggttttacacaccgccgaggccgggggcagggcatacaaccacgcactgagtgagctaccagaaacgctagaaacgctgctactactcacgctcctcgctaccgtcacaggtggaatcttcctcttcctaatgagcggaaaaggaatcggcaagatgacccttggaatgtgctgcataataacggcaagcatactcctctggtacgctcaaatccaaccgcattggatcgctgcgtccatcatactggagttctttcttatcgttctgctgatacccgagccagaaaaacagcgcacacctcaagacaatcagctcacatacgttgtgatcgcgatcttgacggtagtagcggcgacgatggcgaacgaaatgggattcctggagaaaaccaaaaaggacctgggcctaggctctatcaccacccaagagtcagaatcgaacatcctcgacatagacctccgccccgcgtcagcctggaccttgtacgccgtcgccaccacgttcgttacgcccatgctccggcactcgatagagaatagctcggtaaacgtgtcactcacggcaattgcaaaccaggccactgtgctaatggggttaggcaagggatggcccctatccaaaatggatataggcgtcccccttcttgccatcggctgctacagccaggtcaaccccatcacactaaccgcagccttgctgctgctagtcgcccactacgcaatcatcgggccaggccttcaagcaaaggcgacacgagaagcgcagaagcgggccgcagctggcataatgaaaaaccctaccgtagacggaattacagtcatagaccttgaaccgataccctacgatccgaaatttgaaaaacaattaggccaagtcatgctacttatactctgtgtaacacaagttttgatgatgagaaccacatgggccttatgtgaagcattgacactagcaacaggccctataagcacgctgtgggaagggaaccccgggcgcttttggaacaccactatagccgtaagtatggctaatattttccgtggctcgtacctcgcgggagccgggctactatttagcataatgaaaaacacgacgaatacccggagaggcaccggcaacataggggagacattaggcgaaaaatggaaatctcgactgaacgcactcgggaaatcagagttccaaatctacaagaaatcagggatccaagaagtagaccgcacactagcaaaggagggcatcaagcgaggagaaaccgaccaccacgccgtaagccgcgggtccgccaagctgaggtggtttgtggagcgtaacatggtaacgcctgaggggaaggttgtagatctaggatgcggacgaggcggctggagttattactgcggagggctgaagaacgtgcgggaagtaaaggggctgaccaaaggaggacccggacacgaggaaccaatacccatgtcaacctacggctggaacctagtaagactgcagtctggagtagacgtgttcttcaccccaccagagaaatgcgacacgcttctctgcgacatcggtgagtcatcacccaacccgacaatagaagcaggacgtaccttacgagtcttaaacctcgtagagaactggctgaataacaatacacaattttgtataaaggtactgaatccatacatgcccagcgtcatcgagaagatggagaccctacagagaaagtacggcggagcattggtccgaaatcccttgtcgcgcaacagcacgcatgaaatgtactgggtatcgaacgcaacaggcaacatcgtctcgtcggtgaacatgatatcccgtatgctcataaatcgattcacgatgaaacataagaaagcaacatacgaaccggatgtggatctaggttccggaacccgtaacataggtatcgagtcagaaatacccaacctcgatatcattggtaagcgcatagagaaaatcaaacaagaacacgagacatcctggcattacgaccaggaccatccatacaagacatgggcctaccacggttcctatgaaactaagcaaaccggtagcgcgtcaagcatggtgaatggtgtagtacgcttgctcacaaaaccatgggatgttgtccctatggttacgcagatggccatgacggataccacaccatttggacaacaacgcgttttcaaggaaaaagttgacacgaggacccaagaacccaaagaaggaaccaagaagctaatgaagattacggcagagtggctatggaaggagctaggaaagaagaaaactccccgaatgtgtacacgcgaagagtttactcgcaaggtacgcagcaatgccgcgctgggagctattttcacggatgaaaacaaatggaaaagcgcaagggaagcagtggaggactctcgcttctgggaactgatcgaccgcgaaaggaatttacacttagaaggaaaatgcgaaacgtgcgtatacaacatgatgggcaaacgagagaagaaactaggcgagttcggaaaagcgaagggatccagagcaatttggtacatgtggcttggcgcaagatttctggagttcgaagcgttgggattcctaaacgaagatcactggtttagccgaggaaactcgctaagcggtgtagaaggcgaaggactccaccgattgggttatatcctacgagacgtgagcaagaaagagggaggagctatgtacgcagatgacacagctggatgggacacgagaataacactagaggacctcaaaaacgaggaaatggtgacaaaccacatgaagggtgagcacaaaaagttggcagaggcaatattcaagctcacataccaaaacaaggtcgtgagggtacaacgcccaacgccgagaggaactgtgatggacatcatctccagacgagaccagcggggcagcggtcaagtgggaacatatgggctaaacaccttcaccaacatggaagcgcaactcataaggcaaatggaaggagagggcatctttaaatcaatccaacacctgacagtaaccgaggaaatcgcagtgcaaaactggctcgcccgagtcgggcgggagcggctatcccggatggccataagtggagacgactgcgtcgtgaaaccacttgacgatcggttcgcaagtgcactgacggccctaaacgacatgggaaaagtacggaaagacatacagcaatgggaaccgtctcgaggatggaacgactggactcaagtaccgttttgttcacaccactttcacgaactggtaatgaaagatggacgtgtcctggttgtgccatgtagaaaccaggacgagctcatagggagagcccgcatctcacaaggagcaggctggtcattgaaagaaaccgcatgcctaggaaaatcctatgcgcaaatgtgggctctgatgtactttcaccggagggacctccggttagcggcgaacgctatttgctccgccgtgccctcgcattgggtacccacaagtaggacaacctggagtatccatgcaaagcatgaatggatgaccacggaggacatgttagctgtgtggaacagagtttggattcaggagaacccgtggatggaagacaagacgcccgttgaatcgtgggaggaagtcccctacctcggtaaaagagaagaccaatggtgtggatccctaataggactaactagcagagcaacatgggcaaagaacatccaaacagccataaaccaagtaaggagcctgatcggcaacgaagaatacacagattacatgccctccatgaaaaggtttcgacgagaagaagaagaggccggagtcttatggtaa

SEQ ID NO: 25179 - RNA, 9876 nt, synthetic construct
  misc_feature 1..9876: note = derived and/or modified CDS sequence (opt11) from DENV-2__EU482569__SS-prME
  source 1..9876: mol_type = other RNA
accgccggcgtgatcataatgctgatccctaccgccatggcgttccacctcacaacccggaacggggaaccccacatgatcgtcggtcggcaggagaaagggaagtccctgctgttcaagaccgaggacggcgtgaacatgtgcaccctcatggccatcgacctgggtgagctgtgcgaggacaccatcacgtacaagtgccccttactccgccagaatgagccggaggacatcgactgctggtgcaacagcacaagcacatgggtgacctacgggacctgcaccaccacgggcgagcaccggcgcgaaaagcggtccgtcgccctggtgccgcacgtgggcatgggcctcgagacccggaccgagacctggatgagcagcgagggggcatggaagcacgtccagcggatagagacctggattcttcgccacccgggcttcaccatcatggccgcgatcctggcctacaccatcggtaccacgcatttccaacgagccctcatcttcatcctgctgaccgcggtggcaccgagcatgacgatgcgctgcattggaatcagcaaccgggacttcgttgagggcgtcagcgggggctcttgggtggacatcgtgctcgagcacggaagctgcgtcaccacgatggctaagaataaacctaccctggacttcgagctgatcaagactgaggccaagcagcccgcaaccctccgcaagtactgcatcgaggccaagctgactaacaccaccaccgagtcccgctgccctacgcagggcgagccgagcttaaacgaggagcaggacaagcgcttcgtgtgcaagcactccatggttgaccggggctggggcaatggctgcgggctctttggcaagggtgggatcgtgacctgcgcgatgttcacgtgcaagaagaacatggagggaaaggtggtgctgcccgagaacctggagtacaccatagtcataacgccccacagcggggaagagcacgcggtgggcaacgacaccgggaagcacggcaaggaaatcaagatcaccccccagtcaagcatcacagaggccgagctcaccgggtacggcactgttaccatggagtgcagcccccggacaggtctggacttcaacgaaatggtcctcctccagatggaggacaaggcttggctagtgcaccggcagtggttcctggacctcccccttccctggctgccgggggctgacacccaaggctccaactggatccagaaggagacgctcgtgaccttcaaaaatccccacgcgaagaagcaggacgtggtggtcctggggtcccaggagggcgccatgcacaccgctttgaccggagcaacggagatccagatgagttcaggcaacctactgtttaccggccacctgaaatgccgcctccggatggacaagctgcagctgaagggtatgtcttacagcatgtgcaccggtaagttcaagatcgtgaaggagatagccgagacccagcacgggacgatcgtgattcgcgtccagtacgagggcgatggaagtccgtgcaaaatcccttttgagatcatggacctcgagaagcggcacgtgctggggcgcctgatcaccgtgaacccgatcgtcaccgagaaggacagccccgtgaacatagaggcggagccgccctttggcgattcctacatcatcatcggggtcgagccgggccagctcaagctgaattggttcaagaaggggtcatccatcggccagatgttcgagaccacgatgcgcggtgctaaacggatggctatcctgggagataccgcgtgggacttcggcagcctcgggggagtgttcacctccatcgggaaggccctgcaccaagtattcggcgcgatttatggcgccgccttcagcggggtttcctggaccatgaaaatcctgataggcgtcatcatcacgtggatcgggatgaacagccgctccaccagcctgagtgtaagcctcgtgctggtcggcgtggtgaccttatacctaggggccatggtccaggcggattccggctgcgtggtgagctggaagaacaaggagttaaagtgcggctcgggcatctttatcactgacaacgttcatacgtggacagagcagtacaagttccagcccgagagcccaagcaaactggcctccgccatccagaaggcccacgaggagggaatttgcgggattcggagcgtgaccaggctcgaaaatctgatgtggaagcagataaccccggagctgaaccatatcctctcagagaacgaggtgaaactgactattatgaccggcgacattaaggggatcatgcaggcgggcaagcggtctctgagaccgcagccaaccgagctcaagtactcctggaagacctggggcaaagctaagatgttgagcacggagagtcataaccaaacctttttgatcgacgggcccgagaccgccgagtgcccgaacacgaaccgagcgtggaactcactcgaggtcgaggactatggctttggggtgttcacgaccaacatttggctgaaacttcgcgaaaagcaggatgtcttctgcgactccaagctcatgagcgccgccatcaaagacaatcgggcggtccatgccgacatgggctactggatcgagtccgccttaaatgacacctggaagatggagaaggcctcgttcatcgaggtgaagagctgccattggcccaagagccacacactgtggtccaacggcgtgcttgagagcgaaatgatcatccccaagaatttcgccgggccagtctcccagcacaactaccgcccgggctaccacacccagacggcggggccctggcacctgggcaagttagagatggacttcgacttctgcgaagggaccaccgtcgtggtcaccgaggactgcggcaaccggggtcccagcctccgcactacgacagcctcagggaaactcatcaccgagtggtgctgcaggagttgcactctgccgccgctccgctaccggggcgaggacgggtgctggtacggcatggagatccgacccctgaaagagaaggaggagaacctggtgaacagtctcgtgaccgcaggtcacggccagatcgacaacttctccctgggagtcctgggtatggccctcttcctggaggaaatgctgagaacccgcgttgggaccaagcacgcgatcctcttagtggccgtcagcttcgtgactctgatcaccgggaacatgtccttccgggacctcggacgcgtgatggtcatggtgggggccaccatgaccgacgatatcggcatgggcgtaacatacctcgccctgctcgccgcgttcaaagtccgccccacgttcgccgcgggtctgctgctccggaagttgaccagcaaagagctgatgatggctaccatcggcatcgccctcctgtcccagagcactatccctgagaccatcctggagctcaccgatgcgctggcactgggcatgatggtgctcaagattgtacgcaatatggagaagtaccagcttgccgtcaccatcatggccatttcctgcgtcccgaacgccgtgatcctgcagaacgcgtggaaggtcagttgcacgatcttagcagccgtgtcagtgagcccactgctgctcacatctagccagcaaaaggccgattggatccctctagcgctgaccatcaaaggcctcaacccgaccgctatcttcctgacgaccctgtcacgtaccagcaaaaagcgctcctggccgctcaacgaggccatcatggccgtgggaatggtgtcaatcctggcctcgagcctgttgaagaacgatatccccatgaccgggcccctggtcgcgggcgggctgctcaccgtgtgctacgtgctgaccggccggtcggctgacctggaactcgagcgcgccgcagacgtcaagtgggaagaccaagccgagatatcagggtcatcccccatcctgagcatcaccatctccgaggacgggagcatgtccatcaagaacgaggaggaggagcagaccctgacgatcctcatccggaccggcctgctggtgatcagcggggtgttcccggtttcgatccccatcaccgctgccgcctggtacctctgggaggtgaagaagcaacgcgccggcgtcctgtgggacgtcccgtccccgccgcccgtggggaaggccgagctggaggacggcgcgtaccggataaagcagaggggtatcctcggctactcccagatcggcgccggggtgtacaaggagggcacgttccacactatgtggcacgtcacgcgcggcgccgtgctgatgcaccgaggcaagcgcatcgaaccaagctgggccgacgtgaaaaaggacctgatctcctacgggggcggctggaagctcgagggggagtggaaggaaggcgaggaggtacaggtgctggccctggagcccgggaagaaccccagggccgtgcagaccaagcccggcctcttcaagaccaacaccggcacgatcggcgccgtctctctcgacttctctcccggcacctctgggtcacccatcgtggaccgaaaggggaaggtagtcgggctttacggcaacggcgtggtgacccgcagtggggcttacgtctcggccattgcgcagaccgagaaatccatcgaggacaacccggagatcgaggacgacatcttccggaagaagcggctcacgatcatggacctgcaccccggcgctggtaaaacaaagcggtacttacccgccatcgtacgcgaggctatcaagcgtggacttcgaaccctcatcctggccccgacccgcgtcgtcgcggccgagatggaggaagccctgcgggggctccccatccgctaccagacgcccgccatccgggccgagcacaccggccgcgagatcgtggacttaatgtgccacgcgaccttcaccatgcgtctgctgagcccggtgcgcgtgccgaactataacttgatcataatggacgaagcccacttcacggaccccgcatccatcgctgcccggggctacatcagcacccgcgtggaaatgggggaggcggccgggatcttcatgactgctactccgcccgggtccagggacccgttcccccagagcaacgcccccatcatggacgaagagcgcgagatccccgagcgtagttggaacagcggacacgagtgggtgactgacttcaagggcaagacggtctggttcgttccgtcaattaaggcgggcaacgacatcgccgcctgcctgcgcaagaacggcaagaaggtgatccaactctctcggaagaccttcgactccgaatacgtcaagacccgcgccaacgactgggactttgtggtgacgaccgacatcagcgagatgggggcaaacttcaaggcagagcgggtcatcgacccccgccgctgcatgaagcccgtgatcctgaccgacggcgaagagcgcgtgatcctggccgggcccatgccggtcacccactcaagcgccgcccagaggagaggtcgcatcgggcgcaaccccaagaacgagaacgatcagtatatctacatgggagagccccttgagaacgacgaggactgcgctcactggaaggaggcaaagatgttactggataacatcaatacgcccgagggcatcattccgtccatgttcgagccagagcgcgagaaggtggacgcaatcgacggggaataccggctccgtggcgaagcccggaagaccttcgtggacctgatgaggcgcggggatctgcccgtttggctcgcctaccgcgtggccgcggaggggatcaattatgccgaccggcggtggtgcttcgacgggatcaagaacaaccagatcctagaggaaaacgtggaggtcgagatctggaccaaggaaggggagcggaagaagctgaagccgcgctggctagacgctcggatctacagcgatcccctggcactaaaggagttcaaggagttcgcggcaggccgtaagtccctcaccctgaacctgatcacagagatggggcggctccccaccttcatgacccaaaaggcccgcgacgccttagacaacctggccgtgctccacaccgcggaggctggtgggagggcctacaaccatgccctgagcgagctgcccgagacgctcgagactctactgctcctgacgctgctcgccaccgtcacgggaggcatattcctgttcctaatgtccgggaaaggcatcgggaagatgaccctcggcatgtgctgcatcatcaccgcgagcatcctgttgtggtacgcccagatccaaccgcactggattgccgcctccatcatcctcgagttcttcctgatagtgctgctcatccccgagccggaaaagcagcgcactccgcaggataaccagttgacctacgtcgtgatcgccatactgacggtggtggcggccaccatggcaaatgaaatggggtttctcgaaaagacgaagaaggacctgggcctgggaagcatcaccactcaagagtcagaaagcaatatcctcgacatcgatctccggccggccagcgcctggaccctgtacgccgttgcgaccacctttgtgacgccaatgctccgacactccatcgaaaacagctcagtgaacgtcagtctgaccgccatcgccaaccaagcgaccgttcttatgggactcggcaaggggtggcccctgtccaagatggacatcggcgtcccacttctcgccattggttgctactcccaggtcaacccgatcacgctgacggccgccctgctcctgctggtggcacactacgcgatcattggcccgggcctccaggccaaggccacacgggaagcgcagaagcgtgccgcggccggcatcatgaagaaccccaccgtggacggcatcacggtcatcgacctggagcccatcccgtacgaccccaagtttgaaaagcagctgggacaggttatgctcctgattctgtgcgtgacgcaggtcctcatgatgcgcacgacctgggccctgtgcgaggcgctgacattggcaacgggcccgatctccaccttgtgggagggcaacccgggacggttttggaacacaaccatcgcggtgagcatggccaacatcttccgcgggtcttacctggccggggccggcctcctgttcagcatcatgaaaaatacgacgaacacgcggcgtgggacgggcaacatcggtgaaacgttaggtgagaagtggaagtcacgtctaaacgcgctgggcaagaacgaatttcagatctacaagaaaagtgggatccaggaggtggatcgcaccctggccaaggagggcatcaagcgcggggagacggaccaccacgccgtctcccgaggcagcgccaagctccggtggttcgtggagaggaacatggttataccggagggcaaggtcgtggatctgggttgcgggaggggggggtggtcgtactattgcggcgggcttaagaacgttcgcgaagtcaaggggctcactaagggcgggcccgggcacgaggagcccatccccatgtctacttacggctggaacttggtgcggctgcagagtggggtggacgtcttctttaccccgccggagaaatgcgacaccctcctgtgcgacatcggcgagtccagccccaaccccacgatcgaggccggccgcacactgagggtgctcaacttagtggagaactggctgaataacaacacccaattctgcatcaaggtactcaatccgtacatgccctccgtaatcgagaagatggagaccctgcagaggaagtacgggggcgcgctggtgcggaaccccctgagcagaaactctacccacgagatgtactgggtctcaaacgccaccgggaacatcgtgtccagcgtgaacatgatcagtcggatgctcatcaatcgcttcacaatgaagcataaaaaggcgacctacgagccggacgtcgacctgggcagcggtacccgcaatatcggcatcgagtctgagatccccaacctggacatcattgggaagcggatagagaaaatcaagcaggagcatgagaccagctggcactacgaccaggaccacccctacaaaacgtgggcataccacggatcctacgagacgaagcagaccgggagcgcctccagcatggtgaacggggttgttcgcctactaaccaagccctgggacgtagtgcctatggtcacccagatggcgatgaccgacacgacaccgttcgggcaacagagggtgttcaaggagaaagtggacacgcgcacgcaggagcccaaggaaggcacgaagaagcttatgaagatcaccgctgagtggctctggaaggagctggggaagaagaaaacgccccggatgtgtacccgggaggagtttacccgaaaggtgcgctccaacgccgcccttggcgccatcttcactgacgagaacaagtggaagtctgcgagagaagcagtggaggatagccgcttctgggagctcatcgaccgggaacgcaatctgcacctggaggggaagtgcgagacgtgcgtgtacaatatgatgggcaagcgggagaagaagctcggggagttcggcaaagccaaaggcagccgtgccatttggtatatgtggctgggggcaagattcctggagttcgaggccctcgggtttctgaacgaggaccactggttctcccgcgggaacagcctgagcggcgtcgagggggaaggcctccaccggctgggctacatactgcgcgacgtgtccaagaaggagggtggggctatgtacgccgacgacactgcgggctgggacacccggataaccctcgaggatctgaaaaacgaggagatggtaacgaatcacatgaagggcgagcataagaagctggcggaagccatcttcaagctaacctaccagaacaaggtggttcgcgtgcagaggccgacgcctcgggggaccgtgatggacatcatcagccgccgggaccagcgtgggtccggccaagtggggacgtatggcttgaacaccttcacaaacatggaggcccagctgatccggcagatggagggcgaggggatattcaaaagcatccagcacctcaccgtcactgaggagatcgccgtgcagaactggctggcccgcgtgggccgggagaggctgtcccggatggcaatcagcggggacgactgcgtcgtgaagcctctcgacgaccgcttcgcctcagcgctgaccgccctgaacgacatgggcaaggtgcgaaaggacatacagcagtgggaaccgagccgtggatggaacgactggacccaggtcccgttctgctcccaccatttccacgagctcgttatgaaggatggccgtgtactcgtcgtcccctgcagaaaccaggacgagctaatcgggcgggccagaatcagtcaaggcgcgggctggtccctcaaggagaccgcgtgcctgggaaaaagctacgcccagatgtggacactgatgtacttccaccggcgcgacctccggctggcggccaacgcgatctgctccgccgtccccagccactgggtccccacctcccgcaccacctggagcatccacgccaagcacgagtggatgactacggaggacatgttagccgtgtggaaccgggtctggatacaggagaacccgtggatggaggacaagacccccgtcgagtcgtgggaggaggtgccctatctcggcaaacgcgaggaccagtggtgcgggtcactaatcggcctgaccagccgcgcaacctgggcaaagaacattcagacggccatcaaccaggtgagatccctcattgggaacgaggagtacaccgactacatgccgagcatgaagcgctttcggcgcgaggaggaggaggccggcgtcctgtggtga

SEQ ID NO: 25180 - RNA, 9876 nt, synthetic construct
  misc_feature 1..9876: note = derived and/or modified CDS sequence (opt11) from DENV-2__EU482570__SS-prME
  source 1..9876: mol_type = other RNA
accgcgggcgtgatcatcatgcttatccccaccgccatggcgttccatttgaccaccagaaacggggagccgcacatgatcgtcggccgccaggagaagggtaaaagcctgctgttcaagaccgaggacggcgtgaacatgtgcaccctcatggcaattgacctgggggagttatgcgaggacaccatcacctacaagtgcccgcttctgcgccagaacgagcccgaggacattgattgttggtgcaacagcaccagcacctgggtgacgtacgggacctgcactaccacgggcgagcatcggcgcgagaagcggtccgttgcgctagtgccccacgtcgggatgggcctcgagacccgcaccgagacttggatgagctccgagggcgcctggaagcacgtccaaagaatagagacatggatcctacgccacccgggcttcaccatcatggccgcgatcctagcctacaccatcggaaccacccacttccagcgggccctcatcttcatactgcttacggccgtagcgccctcgatgaccatgcgctgcatcggcatctccaatcgcgacttcgtggagggcgtcagcgggggcagctgggtggacatagtgctcgagcatgggagctgtgtcaccacgatggctaagaacaagcccactctagactttgagctgatcaaaaccgaggcgaagcagcccgccaccttgcgcaagtattgcattgaggctaagctgacaaacacaacgaccgaatcccggtgtccgacgcagggcgagccctcactgaacgaggagcaagacaagcgattcctatgcaagcactcgatggtggaccggggctggggcaacgggtgcgggctgttcggcaagggcggaatcgtgacttgcgcgatgttcacgtgcaagaagaacatggaaggcaaagtggttcagcccgagaatttagagtacacgatcgtgatcaccccccacagcggggaggaacacgccgtcggcaacgacaccgggaagcacggaaaggagataaagatcactccgcagtcgagcatcaccgaggccgagctcaccggatacggtacggtgaccatggagtgcagcccccgcaccggcctggatttcaacgagatggtgctgttacagatggaagacaaggcctggctggtccaccggcagtggttcctggacctccctctgccctggctgccgggcgccgatacccagggcagcaactggatccaaaaggagacactcgttaccttcaagaatccccacgcgaagaaacaggacgttgttgtgctgggttcccaggagggcgccatgcacaccgccctgacaggtgccacggagatccagatgagcagtgggaacctgctgtttaccggccacctgaaatgccggctccggatggacaagcttcagctgaaagggatgtcgtacagcatgtgcaccggcaagtttaaaatcgtcaaggagattgccgagacccagcacgggacgatcgtgatacgcgtgcagtacgaaggcgacggctccccctgcaagatccccttcgagatcatggacctcgaaaagcggcacgtcctggggcgcctgataacggtgaatccaatagtgaccgagaaggatagccccgtcaacatcgaggcggagccgcccttcggcgactcctacatcataatcggtgtggagccgggccagctcaaactgaactggttcaagaaagggagttcaattggccagatgttcgaaaccacgatgcgtggggcgaagcggatggccatactgggggacaccgcctgggacttcggcagcctcgggggggtgttcacctccatcgggaaggcgctgcaccaggtctttggcgctatctacggcgccgccttcagcggtgtgtcctggaccatgaagatactgatcggggtaatcatcacatggattgggatgaacagccgatctacctcgctgagcgtcagcctcgtactggtgggcgtagttaccctgtacttgggggccatggtgcaggcagactccggttgcgtcgtgtcatggaagaacaaggagttaaagtgcggctcggggatcttcatcaccgacaacgtacacacgtggaccgagcagtacaagttccagcccgagagccccagcaagctggcctcagcaatccagaaggcccacgaggagggcatctgtgggatccggagcgtgactaggctcgagaacctgatgtggaagcaagtcacccccgagctgaatcacatcctatccgagaacgaggtgaagttaacgatcatgactggcgacatcaaggggatcatgcaggccgggaagcgaagcctgcgcccccagcccaccgagctcaagtactcctggaagacctggggcaaggcgaagatgctttcaacggagagccacaatcagacttttctgatcgacgggcccgagacagccgagtgcccgaataccaaccgggcctggaacagcctcgaagtcgaggactacggcttcggcgtcttcacgaccaatatctggctgaaactgagagagaagcaggacgtcttttgcgattccaagctcatgagcgctgctatcaaggacaaccgggcggtacacgccgacatgggctactggatcgagtccgctctgaacgacacctggaagatggagaaggccagcttcatcgaggtgaagtcctgccactggcccaagtcccataccctgtggtccaatggcgtgctcgagagcgagatgatcatacctaagaacttcgccgggcccgtatcccagcacaattaccgcccaggctaccatacccagaccgcgggcccctggcatcttggtaaacttgagatggacttcgacttctgcgaggggaccaccgtggtggtcaccgaggactgcggcaatcggggacccagtctgcgcactaccaccgccagcgggaagctgatcacggagtggtgctgccggtcctgcacgctgccccctttacgctaccggggtgaagacgggtgctggtacggcatggagatccgcccactgaaggagaaggaggagaacctggttaacagcctcgtcacagccgggcacggccaaatcgacaatttttcgctgggcgtcctgggtatggctctattcctcgaagagatgctgcggacccgcgtgggcaccaagcatgcgatcctactggtcgccgtttcattcgtgacgctgatcaccgggaatatgtccttccgggacctaggccgggtgatggtcatggtgggggccactatgaccgatgacatcgggatgggagtgacgtacctggccctgctcgcagcgttcaaggtgcgccctaccttcgccgccgggctgctgttgcggaagcttaccagcaaggagctgatgatggccaccatcggcatcgcccttctgtctcagtccacgatccccgagactatcctggagctcaccgatgcgctggccctggggatgatggtgctcaagatcgtgcgcaacatggagaagtaccagctcgccgtcaccatcatggccatctcatgcgtccctaacgccgtgatcctgcagaacgcgtggaaggtcggctgcactatcctcgcagccgtgagcgtcagccccctgctgctcaccagctcccagcagaaggccgactggatacctctggcgctaacaatcaaagggctcaaccctactgccatcttcttgacgacattaagcaggacgtccaagaaacgcagctggccgctcaacgaggccatcatggccgtcggtatggtgtctatactggcgagcagtctgctgaagaacgatatccccatgactggcccgctggtcgccgggggcctgctaacggtgtgctacgttctgaccgggcggtcagcagacctggagctcgagcgcgccgccgacgtcaagtgggaagaccaggctgaaatcagcggctctagccccatactgagcatcacaatcagcgaggacggctccatgagtatcaaaaacgaggaggaggagcaaacccttacgattctcatccggacggggctgttggtgatcagcggcgtttttccagtcagcatcccaatcaccgcggccgcctggtacctttgggaggtgaagaagcagcgcgcaggggtgctgtgggatgtccccagcccgccccccgtgggcaaggcagagctggaggacggggcgtaccggatcaagcagcgcggcatactcggctacagccagataggggccggcgtgtataaggaggggaccttccacaccatgtggcacgtcactagaggcgccgtgctgatgcatcgcgggaaacgcatcgagccctcgtgggccgacgtgaagaaggacctgatcagctacggaggcggctggaagctagagggcgagtggaaggagggcgaggaggttcaggtgctggccctggaacccggcaagaacccacgcgcggtgcagaccaagcccggcctattcaagaccaacaccggaacgattggcgccgtctccctggacttcagccccggaaccagcggcagccccatcgtggaccggaaggggaaagtggtcggcctgtacgggaacggggtggtgacacgctccggagcctacgtcagcgccatcgcgcagaccgaaaagtccattgaggacaaccctgagatcgaggatgacatcttccgcaagaagaggctcacgattatggacctgcaccccggtgcgggcaagaccaagcggtatctacccgccatcgtgcgggaggctataaagcggggcctacgcaccctcatcctggccccgacccgcgtggtggcggccgagatggaggaggccctacggggtttacccatccgctaccagactcccgccatccgggccgagcataccgggagagagattgttgacttgatgtgccacgcgacctttaccatgaggctgctctcgcccgtgcgcgtcccgaactacaacctgatcatcatggatgaggcccacttcacggaccccgcctctatcgctgcccggggttacatctccacacgcgtggagatgggcgaggcggccggaatattcatgaccgccaccccgcccggctcgcgggacccgttcccccagagtaacgcccctataatggacgaggagcgcgagatccccgagcggtcgtggaactccgggcatgagtgggtgacggatttcaaaggcaagaccgtctggttcgtgccgtccatcaaggccggaaacgacatcgccgcctgtctgcggaagaacgggaaaaaggtgatccaactcagtcggaagacctttgacagcgagtacgtcaagacacgggccaacgactgggacttcgtggtgacgacagacatttccgagatgggcgccaacttcaaggcggagcgggtcatagacccccgccggtgcatgaagcccgtgatactgaccgacggggaggagcgcgtgatcctggccggccccatgcccgtcacccatagcagcgcggcccagagacgcgggcgcatcggccgcaaccccaagaacgagaacgaccaatatatctatatgggcgagcccctcgagaacgacgaggactgcgcccactggaaagaggcgaaaatgctgctggacaacatcaacacgcccgaaggcattatcccgagcatgtttgagccggagcgggagaaggtggacgccatcgacggcgagtaccggctcagaggggaggcccggaagactttcgtggacctgatgcgccggggagacctgcccgtctggctcgcctaccgcgtggcagcggaagggattaactacgctgatcggcgctggtgcttcgacggaattaagaacaaccagattctggaggagaacgtggaggtcgagatctggaccaaggagggcgagagaaagaaactgaagccgcgatggctcgacgccaggatctactccgaccccctggccttaaaggaattcaaggagttcgcggctgggcgcaagagcctgaccttgaacctgatcacggagatgggccggcttcccacctttatgacccaaaaagcccgcgacgccctggacaacctggccgtgctccacaccgcggaggctggtggcaaagcctacaaccacgccctgtctgagctgcccgagacgctcgagacgttattgctcctgacgctattggccaccgtcacgggaggcatctttctgttcctaatgagcggcaagggcataggcaagatgaccctcgggatgtgttgtatcatcaccgcgtccatcctgctgtggtacgcccagatccagccgcactggatagccgcctctatcatcctcgagttcttcctgatcgtgctgctcatccccgagcccgagaaacagcggacgcctcaggataaccagctgacctacgtcgttatcgccatccttacggtggtggcggccaccatggccaatgagatgggcttcctcgagaaaactaagaaggaccttggcctcggatccatcacaacgcaggagagcgagtcgaacatactcgacatcgacctacgcccggcatccgcctggaccctgtacgcggtcgccaccacattcgttacacccatgctccggcacagcatcgagaacagtagtgtaaacgtctcgttgaccgctatcgccaaccaggccaccgtgctgatgggcctcgggaagggctggcccctgagcaaaatggacatcggggtgccactcctcgccatcggctgctactcccaagtcaacccgatcacactgacggccgcactgctcctgctggtggcccactatgcgatcatcggccccggcttacaagctaaggccacccgcgaggcgcagaagagggccgcggccggcatcatgaaaaaccccaccgtggatgggatcacggtcatagacctggagcccatcccgtatgaccccaagttcgagaaacagctgggccaggtcatgctcttaatcttgtgcgtgacgcaggtcctcatgatgcggaccacctgggccctgtgcgaggccctgaccttggccacggggccaatctcgaccctttgggagggcaaccccggacgcttctggaataccacaatcgcggtgtccatggccaatatcttccgggggagctatctcgccggcgctgggcttttattctccatcatgaagaacacgaccaacacccgccggggcaccggcaacatcggggaaacgctgggggagaaatggaagtcccgcctcaacgcgctgggcaagtccgagttccagatctacaagaagtccgggatacaggaggtggacagaaccctggccaaggaagggatcaagcgcggcgagaccgaccaccacgccgtctcccgcggcagtgcgaagctccgctggttcgtggagcggaacatggtgaccccggaggggaaggtggttgacctaggctgcgggaggggcggctggtcctactactgtggcggcctgaagaacgtgcgggaggtcaagggcctcacgaaaggcgggcccggccacgaagagcccatccccatgagcacgtacggatggaacctggtgcgcctacagagtggagtcgatgtcttcttcaccccgcccgagaagtgcgacaccttgctgtgcgacatcggcgagtccagcccaaaccccacaatcgaggccggaaggaccctgcgcgtgctcaacctggtagagaactggctaaataacaacacccaattctgtatcaaggtactcaacccgtatatgccctccgtgatcgaaaagatggagaccctgcagcggaagtacggcggggcgctggtgcgaaatccactgagccggaattcgacccacgagatgtattgggtcagcaacgccaccggcaacatcgtgtccagtgtcaacatgatctctcgcatgctcatcaaccggttcaccatgaaacataagaaggccacctacgaaccggacgtcgaccttgggagcggtacccgcaacatcggcatcgagtccgaaatcccaaatctggacatcataggtaagcgcatcgaaaagattaagcaggagcacgagacgagctggcactatgaccaggaccacccttataagacctgggcctaccacggctcctacgagaccaagcagaccgggagcgcctcctctatggtaaacggtgtggtccgcctcctgaccaagccctgggacgtggtgccgatggtcacccagatggcaatgaccgacaccacgcccttcggacagcagcgggtattcaaggagaaggtggacacccggacccaggaacccaaggaggggaccaagaagctgatgaagatcacagccgagtggttatggaaggagctgggcaagaagaaaacgccccgtatgtgcacccgggaggagttcacccgcaaggttcgtagtaatgccgccttaggagccatcttcacggatgagaacaagtggaagtccgcgcgcgaggcagtcgaggatagtcggttctgggagcttgttgaccgcgagcggaacctgcatctagagggcaagtgcgagacctgcgtttacaatatgatggggaagcgcgagaaaaagctcggggagttcggcaaggccaaggggagcagagccatctggtacatgtggctgggcgcgagattcctggagttcgaggccctcgggttcctgaacgaggaccactggttcagccgggggaactcactgagcggggtggagggtgagggactccaccgcctggggtacatattaaaggacgtctccaagaaggagggcggagccatgtatgcggacgataccgcaggctgggacacccggatcacgctcgaggacctgaagaatgaggagatggtgaccaaccacatgaagggggagcacaagaagctggcggaggccatcttcaagctcacctaccagaacaaggtggtccgcgtgcagcggccaacgcctcgcggcacggtgatggatatcatcagccgtcgcgaccagcgcggctccgggcaagtcggcacctacgggctaaacacattcaccaacatggaagcccagctgatccggcagatggaaggcgagggcatcttcaagagtatccaacacctcaccgtgacagaggagatcgctgtacagaactggttggctcgcgtcgggcgggagcgcctgtcacggatggttatcagcggagacgactgcgttgtcaagcccctcgatgaccgcttcgcatccgccctgaccgccctgaacgacatgggcaaggtgcggaaagatatccagcagtgggagcccagccggggctggaacgactggacccaggtgccgttctgctcccaccacttccacgagctcgtcatgaaggacggccgggtgctggtggtcccctgccgcaaccaggacgaactgatcggcagagcacgcataagccagggcgccgggtggtccttgaaggagactgcatgtcttggcaagagctacgcccagatgtggaccttgatgtacttccaccggcgagacctccggctggccgccaacgccatctgctccgcggtgccctcgcactgggttcccacctcacgcacaacctggagcatccacgccaagcacgagtggatgacgacggaagacatgctggccgtatggaaccgggtgtggatccaggaaaatccgtggatggaagacaagacccctgttgagagctgggaggaggtaccctacctcgggaagcgcgaggaccagtggtgcggcagcctgatagggctcaccagtagggccacatgggcgaagaacatccagaccgccatcaaccaggtgcgctcgctcatcggcaacgaggagtataccgactatatgcccagcatgaagcgcttccggcgcgaggaggaggaggccggcgtgctatggtga

SEQ ID NO: 25181 - RNA, 9876 nt, synthetic construct
  misc_feature 1..9876: note = derived and/or modified CDS sequence (opt11) from DENV-2__EU482571__SS-prME
  source 1..9876: mol_type = other RNA
acagcgggagttataatcatgctaataccgacagcaatggcattccacctcacaacgcgcaacggcgaaccccacatgatcgtagggcgacaagaaaaagggaaatccctactcttcaaaacggaagatggagtaaatatgtgcacactcatggctattgatctcggcgaactttgcgaagacactataacatacaaatgtcccctcctgcgacaaaacgaacccgaagacatcgattgttggtgcaacagcacaagtacctgggtgacttacggaacttgcacgacaaccggcgaacatagaagagaaaaacggagtgtggccctagtaccgcacgtcgggatgggattagaaacacgaaccgaaacgtggatgtcaagcgaaggcgcatggaaacatgttcagagaatcgaaacctggatcctacgccatccgggttttacaataatggctgcgattctcgcctatacgatcggcaccacccacttccagcgagccctaatcttcatactacttacagctgtcgcaccgagcatgactatgagatgcatagggatatctaacagggacttcgtagagggcgtgagtggcggaagttgggtagatatcgtattggagcacgggtcttgcgtcactacgatggcaaagaacaagccaacgctcgatttcgaactcatcaagacggaagctaagcaaccagcgactcttagaaagtactgcatagaagcaaagctgaccaatacgaccacagaaagcagatgccccacacaaggcgagccaagtctcaatgaggagcaggacaaacgctttctctgtaagcactcgatggtcgacaggggctggggtaacggttgtggacttttcggaaaaggtgggatcgtgacatgcgcaatgtttacctgcaaaaagaatatggaaggtaaagtcgtattaccagaaaatcttgaatacacaattgtaataacaccgcatagtggtgaggagcacgccgtagggaacgatactggcaagcacggaaaggagataaagattacaccccaaagtagcataacggaagccgaactaaccggatacgggacagtaacaatggagtgcagcccacggaccggtctcgacttcaatgaaatggtcctactgcagatggaagacaaggcatggctagtgcacaggcagtggtttttagaccttccattaccatggctcccaggagcagacacccaaggaagcaactggatacaaaaagaaacccttgtcaccttcaaaaatccacacgcgaagaaacaagacgttgtggtactcgggtcgcaagagggcgcaatgcacaccgccttaacaggagccaccgagatacaaatgagttcagggaacctgctattcacgggacacctaaaatgccgcttgcgcatggataaacttcaactgaaagggatgagctacagcatgtgcacaggaaaattcaagatcgtgaaagaaatcgccgaaacgcaacacgggacaatcgtcatacgggtccaatatgaaggcgacgggagtccatgcaaaataccctttgagatcatggacctagaaaagcggcatgttctcgggcgtctaataacggtcaacccaatcgtgacggaaaaagattcccctgtaaacattgaggccgagcccccatttggtgacagctatataatcattggggtcgaacctggccagctaaagctaaattggttcaagaaaggcagctctattgggcaaatgtttgaaacgaccatgcggggtgcgaagcggatggcgatcctaggtgacaccgcatgggacttcgggtccctcggaggggtattcacgtctattggcaaggctctgcaccaagtcttcggggcgatctacggggcggcattcagcggagtatcttggacaatgaagatactaataggagtaataataacgtggatcggcatgaacagccgatcaacatcattaagcgtcagcctagtactggtaggagtggtgactctatacctaggggcaatggtgcaggccgattcaggatgcgtggtttcgtggaagaataaggaactcaaatgtgggagtggtattttcatcacagacaacgtgcacacctggaccgaacagtacaagttccaacccgaatcccctagtaagctcgcctcagcaatccaaaaagcccatgaagaaggtatatgcggaatcagaagtgtcacccgtttggaaaacctaatgtggaaacagataacccccgagctcaaccacattctcagtgagaacgaagtcaaactaaccataatgacaggggatatcaaaggaataatgcaagccggaaaacgatcactcagaccgcagccgaccgagctgaagtattcatggaagacttggggtaaagcgaagatgctatcgaccgaatcccataaccaaaccttcctcatagacggcccggagaccgcagaatgtcccaacacgaatcgcgcttggaactccctggaagtggaagactacggcttcggtgtattcaccacaaacatctggctgaaacttcgagaaaagcaggatgtattttgtgactccaaattaatgagtgcggctataaaagacaacagagctgtacacgcagacatgggctactggatcgaaagcgccctcaacgatacgtggaaaatggaaaaggctagcttcatagaggtcaaaagttgccattggccaaagtcacacactctctggagtaacggcgtcctagagagtgagatgataatacccaaaaacttcgctggtcccgtatcgcagcataattaccgccccggctatcacacccaaaccgcaggcccctggcatctaggaaagctcgaaatggacttcgatttctgtgagggaaccacagttgtcgtaacggaagactgcggcaacagagggcccagcctcaggacaacaactgcgtccggcaagctaatcacagaatggtgctgccgcagctgtacgcttccgcccctccgatacaggggcgaagatggttgctggtacggaatggagatacgacctctcaaggagaaggaagaaaacttagtgaacagcctcgtaactgccgggcacggacagatagacaacttctcactcggagtgctgggaatggcgctattcttagaagaaatgctccgaactcgcgtgggcacaaagcacgcaatcctcctagtagccgtatcatttgtaacgctaatcacagggaatatgtccttccgggacttgggtagagtcatggtcatggtaggcgctacaatgaccgatgacatcggcatgggcgtaacttacctagcactactggcagcatttaaagtaagaccaacgtttgcagccgggctccttctccgaaaactaacatcgaaggagctcatgatggcgacaataggcattgcactcttgtcacaaagtacgattcctgaaacgatcttagaactgacagacgccctggccttgggcatgatggttctaaaaatcgtccgtaacatggaaaagtaccaactagcagtaacaataatggcaataagctgcgtaccgaatgcagttatactccagaatgcatggaaggtttcgtgcacgatccttgccgccgtctccgtgagcccacttctcctcactagctcacagcagaaagcggactggataccattagccctcacgataaagggcctgaaccctacggcaatattcctcacgaccctgtccagaacgagcaagaagcgaagctggccacttaacgaagcaataatggccgttggaatggtgtccatactggcctcgtcactgctgaagaacgatataccaatgactggtccgctcgtggcaggcggattacttaccgtatgctacgtactcacgggccgcagcgctgacctcgagttagagcgagcagcggacgttaagtgggaagaccaagcggaaatatctggtagttccccaatcctatcaatcaccatttcggaggatggatcaatgtccatcaaaaacgaggaagaggaacaaacactcacgatactaattcgcactggtctactcgtaataagcggagtgttcccagtcagtattcccataactgcggccgcgtggtacctctgggaagtgaaaaagcagcgcgctggagtattatgggacgtaccaagcccaccacccgtaggaaaggcagaactagaggacggcgcgtaccgtataaaacaacgcggaatactcggctatagccagataggagcaggggtatataaagagggcacgtttcataccatgtggcacgttactcgtggcgccgtactgatgcataggggaaagcgcatcgaaccgtcatgggcggacgtaaagaaggacctaataagttacggaggaggttggaaactcgagggagagtggaaggaaggtgaagaagtacaggtcctagcactcgagccagggaaaaatccccgagcagtacagaccaaacccggcttgttcaaaactaataccggaactatcggagcagtaagcctagacttcagcccgggaacatctggtagccccatcgtggaccgcaagggtaaggtagtaggcctctatggcaacggagtggtcacacgaagcggggcctacgtgtcggccatcgcccaaacagaaaagtctatcgaagataacccggaaatcgaagatgacatattccgcaagaagcgcctaacaatcatggacttacacccgggagcaggcaagacaaagagatatttaccagccatagtgcgagaggccataaaacgcggactccgtacactaatactagcgccaacgcgcgtggtggctgccgaaatggaggaagccctacgcggactgcccatccgataccagacaccggccatacgagctgagcacaccggtagggagatagtggacctaatgtgtcatgcgacctttacgatgaggcttctatcacccgtcagggttcctaactataatctaataataatggacgaggcgcacttcacagacccggctagtatagcggctagaggttacatctcaacgagagtagaaatgggagaggcggcgggaatctttatgaccgccaccccaccaggcagtcgggatccctttccccaatcaaacgcccctatcatggacgaagagagagaaatcccagaaagaagctggaactccgggcacgaatgggtgacggactttaaggggaagaccgtttggttcgtcccaagcattaaggctggaaacgacatcgcggcgtgcctccgcaaaaatggtaagaaagtaatccagctctcaaggaaaacctttgacagcgaatacgttaagactcgagcaaacgactgggacttcgtggtcacgactgacatcagcgaaatgggcgccaacttcaaagcagaaagagtgattgatccccgccgctgcatgaaacctgtaatcctaacggacggggaagagagagttattctagccggaccaatgcccgtaacacactctagcgccgcccaacgtagaggccggattgggagaaaccccaaaaacgagaacgaccagtacatttacatgggagaacctctcgagaatgatgaggattgtgcgcactggaaggaagccaaaatgctacttgataacatcaacacgccagaaggaatcataccgtcgatgttcgaacctgaacgagaaaaggtcgacgccattgacggcgagtaccgactccgtggggaagctaggaagacctttgtagacctaatgcgtcgaggcgacctaccagtctggttagcttacagagtagcagcagagggaatcaactatgcagacagaagatggtgtttcgatggaatcaaaaacaatcaaatcctcgaagagaacgttgaagtagaaatctggactaaagaaggtgagcgtaaaaagctgaaaccgcggtggctggacgcaaggatttacagcgatcccctggcacttaaagagttcaaggagttcgcggccggcagaaagagtctcacgcttaatctgataactgaaatgggcagactgccgacgtttatgacccaaaaagcccgagacgcgctggataacttagcagtactacacaccgccgaagccggtgggcgggcatacaatcatgcgctctcagagctacccgaaaccctcgagacattgcttcttcttaccctactggctacggtcaccggtggcatatttctgttcctcatgagcgggaagggaatcggaaaaatgactctcggaatgtgctgcataattacagcatcgattctactttggtacgcgcagattcagccgcactggatagccgcgagcataattcttgaatttttcctgatagtgttactaattccggagcccgagaaacaacgcacgccacaagacaaccagctaacgtacgtagtaatagccattctgacggtggtagcagctacgatggcaaatgagatgggttttctagagaaaacgaagaaagaccttgggctaggaagtatcacaacacaagaaagcgaatcaaacatcctcgatatcgacctacgcccagcgtctgcctggaccctctatgcagtcgccacaaccttcgttaccccgatgctcaggcacagcatagaaaacagctctgtcaacgtctcgttaaccgccatcgcaaaccaggccaccgtactaatggggctgggcaagggctggccgctctccaagatggatataggagtcccactcctggcaattggatgctatagccaggtcaaccctatcacccttacagcggccctactactgctagtggcacactacgcgatcatcggccccgggctccaagcgaaagcgacaagggaggcccaaaaacgtgcagcggcaggcatcatgaaaaatcccacagtggatgggattacagttatcgaccttgaacccataccgtacgatcctaagttcgagaaacaactcgggcaagtcatgctactcatcttatgcgtgacacaagtactaatgatgagaacgacctgggcgctttgcgaagcactaactctggctaccggccccatcagcacactatgggagggaaatcctggaaggttttggaacacgacgattgcagtaagcatggcaaatatcttccgagggtcctacctagcgggggcggggctgctgttcagcattatgaagaacacgacaaacacacgaaggggaactggaaacatcggtgaaacgttgggggaaaaatggaaatccaggctgaacgcgttaggcaaatcagagttccaaatatacaagaaaagcggcatccaagaagtcgatagaacactagcaaaagagggcatcaaaagaggcgaaaccgatcaccacgcagtttcacgaggttctgccaagctgcgatggttcgtagagcgcaacatggtaacccccgaaggcaaggtcgttgatctgggttgcggcagaggaggatggagctactactgtggcggactcaagaacgtccgagaagtcaaaggtctaacaaaaggcggtcctgggcacgaggaacccatacctatgtcgacatacggttggaacctcgttagactccaatcaggagtagatgtgttcttcacgcccccagaaaaatgcgacaccctgctatgcgatattggcgagtcaagccccaatcccaccatagaagcaggtcgcacgctccgcgtactgaacctggtcgaaaactggctcaacaacaatactcagttctgcattaaagtgctaaacccttatatgccaagcgtcatagaaaagatggagacattgcaaaggaaatacggcggcgcactcgtacgaaaccccctgtcccgtaactcaacgcacgagatgtattgggtcagtaatgcgacagggaacatagtgtcaagcgtcaatatgataagccgaatgcttatcaaccgtttcacaatgaaacacaagaaggcgacgtatgagccagatgtcgacctaggaagcgggacgcgaaatataggaatagaaagcgagatacccaatctagacatcataggtaaacgaatagagaagatcaaacaggaacacgagacaagttggcactatgaccaggaccatccgtacaaaacgtgggcatatcatgggagttacgagacgaaacaaacaggatccgccagttctatggtgaatggcgtcgtgaggttactcacaaagccgtgggacgtagttcccatggtaacccagatggcgatgactgacaccacgccattcggccagcagcgggtctttaaagagaaggttgataccaggacacaagaaccgaaggagggcacaaagaagttaatgaaaataaccgcggcctggctttggaaggaactcggaaagaagaagacaccaaggatgtgcacccgggaagagttcaccagaaaggtaagaagcaacgccgcactcggggcaatcttcactgatgaaaacaagtggaaaagcgcacgcgaagcagttgaggactctcggttctgggaactcatcgacagagagcgaaacctacacctcgaaggcaaatgcgaaacatgtgtatacaacatgatggggaagcgggagaagaaattgggagaatttggaaaagccaaaggaagccgagcaatttggtacatgtggctaggagcaagattccttgaatttgaggcactcggattcctaaacgaggatcactggttcagccgagggaacagtctaagcggtgtagagggcgaaggccttcatcgactaggatacatactacgcgacgttagcaagaaagagggaggggccatgtacgcagacgacaccgccggatgggatacaaggatcaccctagaagaccttaaaaacgaagaaatggtcaccaatcacatgaaaggcgaacacaagaaactcgcggaggccatctttaaattaacttaccaaaataaagtggttcgagtacagagacccacaccacgaggaaccgtgatggacatcatcagccgccgcgaccaacgcggttcaggacaagtaggaacctacggcctcaatacattcaccaacatggaggcccaattaatccgccagatggaaggagagggcatcttcaagtcaatacaacacctgacagtaacagaagagatcgccgtgcaaaattggctggcccgagtgggccgagagagactgtcgaggatggcgatcagtggtgacgattgcgttgtaaaaccactagacgaccgcttcgccagcgccctgacggcactgaacgacatgggaaaggttcgaaaggatatccaacaatgggaaccaagcaggggctggaatgactggacacaggtgccgttctgtagccaccatttccacgagctcgtgatgaaagacggccgggttttagtggtcccatgccggaaccaagacgaacttatagggcgagctcgaataagccagggagcggggtggtccctgaaagagaccgcatgcctcgggaaatcctacgcccagatgtggaccctaatgtatttccacagaagagacctccgccttgcggcaaacgcgatatgttcggcagtacctagccactgggtacctacctcccgtacaacgtggagcatacacgcgaaacacgaatggatgacaactgaagacatgttagcagtctggaacagagtgtggatacaagaaaacccgtggatggaggacaagaccccagtcgagtcatgggaggaggtgccatacctaggcaagcgggaggatcagtggtgcggcagcttaataggactaacctcccgcgcaacttgggccaaaaacatccaaaccgcgataaaccaggttaggtctctaattggtaatgaagagtatacagactacatgccatcaatgaaaagattccggcgagaggaggaggaagccggagtactatggtaa

SEQ ID NO: 25182 - RNA, 9876 nt, synthetic construct
  misc_feature 1..9876: note = derived and/or modified CDS sequence (opt11) from DENV-2__EU482572__SS-prME
  source 1..9876: mol_type = other RNA
acggctggcgtaatcatcatgcttattccaaccgcaatggcgttccacctcacaaccaggaacggggaaccccacatgatcgttggcaggcaggaaaagggtaaatccctgctgttcaagaccgaggacggcgtaaacatgtgcaccttgatggccatcgacctgggggagctgtgtgaggacaccatcacatacaagtgccccctcctccgccaaaacgagcccgaggacatagactgctggtgcaatagcaccagcacttgggtcacgtacgggacgtgcaccaccacgggggaacaccggcgcgagaagcggagtgtcgcgctggtgccccacgtgggaatggggttggagacacgtaccgagacctggatgagctcagagggggcctggaagcacgtccagcggatcgagacgtggatcttaagacacccaggattcaccattatggccgctatcttagcgtacacgatcgggactacacacttccagcgggccttaatcttcatcctgctgaccgcagttgcgccctcgatgaccatgcgctgcatcggtatctccaaccgggacttcgtcgagggcgtaagcggcgggtcctgggtggatatagtgctcgagcacgggtcctgcgtcacgacgatggccaaaaacaagccaacgctggatttcgagctgatcaagaccgaggccaagcaacccgccacactccgcaaatactgcatcgaggcaaagttgacaaacacaacaactgagtcgcggtgcccgacgcagggcgagcccagcctgaacgaagagcaggacaagagattcttatgcaagcactccatggtcgatcggggctgggggaacggctgcgggctgtttggcaagggcgggatcgtgacttgcgcgatgttcacctgcaagaagaacatggaaggtaaggtcgtgcagcccgagaacttggagtacaccatcgtcatcacaccccactcaggggaagagcatgccgtcggtaacgataccgggaagcacggcaaagagataaagatcaccccccaatcttccatcacagaggccgagctgaccgggtacggcacggtgacaatggagtgctccccccggaccggtctggactttaacgagatggtactgctccagatggaggacaaggcctggctggtccaccgccaatggttcttggatctccccctcccctggttgccgggtgcggacacccagggctcaaactggatccagaaagagacgctcgtgactttcaaaaatccccacgcgaagaagcaggacgtggtcgtcctggggtcccaggaaggggctatgcacacagccctgaccggagcaacggagatacaaatgagcagcggcaacctactgtttaccggtcacctgaagtgccgcctaagaatggacaagctgcaactgaaggggatgtcctacagcatgtgtaccggcaagttcaagatagtcaaggagatcgctgagacccagcacgggacaatcgttatacgcgtccagtacgagggcgacggctccccctgcaagatccccttcgagatcatggacctcgagaagcgccacgtcctggggcgcctgattaccgtgaacccaatcgtgaccgagaaggacagccccgtgaacattgaggcggagccgccctttggcgactcctacatcatcataggggtggagcccggccagctcaagctcaactggttcaaaaaggggagctccatcggccagatgttcgagaccacgatgagaggggccaagcggatggccatccttggggacaccgcctgggactttggcagcctcgggggcgtgttcacgagtatcggcaaggcattgcaccaggtctttggagcgatatatggcgccgccttttccggggtgtcctggacaatgaagatactgatcggtgttatcatcacgtggataggcatgaacagccgctccaccagtctgtccgtcagcctagtgttggtgggcgtagttaccctgtacctcggggccatggtccaggcggactccggctgcgtcgtgagctggaagaacaaggagctgaagtgcgggtccgggatcttcatcacagacaacgtgcacacgtggaccgaacagtacaaattccagccggagagccccagcaagctggcctccgccatccagaaagcccacgaagaggggatctgtggtatccggtcagtcacccgcctcgagaacttgatgtggaagcaggtcactccggaactgaaccacatcctctccgagaacgaggtgaagctgacgatcatgaccggcgacatcaaggggatcatgcaggccgggaagcggagcctgagaccgcaacccacagagctaaagtactcctggaagacctggggcaaggccaagatgctctccacggagtcccacaaccagaccttcctgatcgacggcccggaaaccgccgagtgcccgaacacaaaccgagcctggaacagcctcgaagtagaggattacggcttcggtgttttcacgaccaacatctggctgaagctccgcgagaagcaggatgtattctgcgactccaaactaatgtcggccgccatcaaggacaaccgggcggtccacgccgacatggggtactggatcgaatccgccctgaacgacacctggaaaatggagaaggcctcgttcatcgaggttaagagctgccattggcccaagagccataccctgtggtccaacggcgtgctcgagagcgagatgataatccccaaaaacttcgcagggcccgtttcccagcacaactaccgcccgggctaccatacgcaaacggcagggccatggcatctgggcaaactggagatggacttcgacttctgcgaggggaccaccgtcgtggtcaccggcgattgcggcaaccgggggcccagcctccgcacaactaccgccagcggcaagctgataaccgagtggtgctgtcgctcctgcacgttacccccgctccgctatcgtggggaggacggctgctggtacgggatggagatccggcccttaaaagaaaaggaggaaaacctggtgaacagcttagtgaccgccggccatgggcagatcgataacttctccctgggggtcctaggcatggccctcttcctggaggaaatgctccggacccgcgttggcactaagcacgcgatcctccttgtggccgtcagcttcgtgacgttgatcaccggcaacatgtcgttccgtgatctcgggcgagtgatggtcatggtgggcgcaactatgacagacgacatcggcatgggggtgacctacctggccttgttggccgcgttcaaggtccgacccaccttcgcggccggcctgctcctccggaaattgacctctaaggaacttatgatggctaccatagggatcgccctcctgtcccagagcacaatccctgagacaatcctggagctcaccgatgcgctcgccctgggcatgatggtgcttaagatcgtccggaatatggagaagtaccagctggccgtcaccatcatggccatctcctgcgtgccgaacgcggtgattctgcaaaacgcgtggaaggtcagctgcactatcctcgccgtggtgtccgtgagccctttactgctcacctcatcgcaacagaaggccgactggataccattggccctgaccatcaagggcctcaaccccaccgcgatcttcctgacaaccctgtcccgcaccagcaaaaagcgctcctggccgctcaacgaggcaatcatggccgtggggatggtcagcatcctggcatcaagcctgctcaagaacgacatcccaatgaccggacccctggtggccgggggcctcctcactgtgtgctacgttctgaccgggcggagtgcagacctggagctcgaacgcgctgccgacgtgaaatgggaggaccaggccgagatttccggcagctcccccattctgagcatcaccatatccgaagacgggagcatgtccatcaagaacgaggaggaggagcaaaccctgacgatcctcatccggaccgggctgttggtgattagcggcgtcttcccggtgagtatccccatcactgccgcagcatggtacctgtgggaggtaaaaaagcagcgcgccggggtcctatgggacgtacccagcccgccgccggtgggcaaggccgagctggaggacggggcataccgaatcaagcagcgcggcatcctcggctactcccagatcggagcgggcgtctacaaggaaggaaccttccacaccatgtggcacgtgacgcggggggccgtgctcatgcaccgcggaaagaggatcgagcccagctgggccgacgtaaagaaggacttgatctcctatggcgggggctggaagctcgagggagagtggaaggaaggggaggaagtccaggtactggccctggaaccgggcaagaatccccgcgctgtccagaccaagcctggcctgtttaagaccaataccggaacgatcggcgcggtcagcctggacttctcacccgggaccagcggatctcccatcgtggaccggaagggtaaggtcgtgggcctttacgggaacggagtagtcacccgcagcggcgcctacgtgtccgccatagcacagactgagaagtctatcgaagacaacccggagatcgaggacgacatcttccggaagaagcgcttgacgatcatggacctgcatcccggggcaggcaaaaccaagcggtacctaccggccatcgttcgcgaggcgatcaagcgggggctgcgcaccctcatactggccccgactcgcgtcgtggccgcggagatggaggaggccttgaggggcttgcccatccgctatcagacgccagcaatacgggcagagcacactggccgcgagatcgtggacctgatgtgtcatgccactttcacaatgcggctgctcagccctgtccgcgtgccgaattataatctgatcatcatggacgaggctcacttcacggacccggcctccatcgccgccagggggtacatcagcacccgcgtagagatgggcgaggccgcaggcattttcatgaccgctacgccgcccggctccagggaccctttcccacaaagcaacgcccccatcatggacgaggagcgcgagatccccgagcggtcttggaacagcggacacgagtgggtcacggatttcaagggtaagaccgtgtggttcgtaccgtccatcaaggccggcaacgacatcgcggcctgcctgcggaagaacgggaagaaagtcatacagctcagtcggaagaccttcgactccgaatatgtgaagacccgcgctaacgactgggatttcgtggtcacgaccgacatcagcgaaatgggcgccaacttcaaggccgagcgggtgattgatccccgccggtgcatgaagcccgtaatcctgaccgacggggaggagcgcgtcatcctggcgggtcccatgccggtgacccactcgtcagccgcccagcggcgcgggcgcatcggcagaaaccctaagaacgagaacgaccagtacatctacatgggcgagcccttggagaacgacgaggactgtgcccactggaaggaggccaaaatgctcctagataacattaacacgcccgagggaatcatcccgtccatgttcgagccggaacgcgagaaggtggacgctatcgacggagagtatcggctccgtggggaggcccggaagacctttgtcgacttaatgcgccggggcgatctgccggtgtggctcgcctatcgcgtggccgctgaggggataaactacgcggaccggagatggtgcttcgacggcataaaaaacaatcagatcctggaggagaacgtggaggtggagatctggacaaaagagggcgaacgtaagaagctgaagccgcgttggctcgacgcccggatatactccgacccgcttgccctgaaggagttcaaggagtttgcagcgggacgcaagtccctcaccctgaacctgatcacggagatgggccggctccccaccttcatgacccagaaggcacgcgatgccctggacaacctggcagtcctccacaccgccgaagccggcggcaaggcctacaaccacgccctgtctgagctgcccgagacgctcgagactctgctgttgctgaccctgttggccaccgttacgggcgggatcttcctgttcctgatgtccgggaagggaatcggcaagatgacccttgggatgtgctgcatcatcaccgccagtatcctcctatggtatgcgcaaatccagccgcactggatcgctgcctcaatcatcctcgagttcttcctgatcgttctgctaatccccgaacccgagaagcagcggactccgcaggacaaccagctgacctacgttgtgatcgcgatcctgacggtggtcgccgcgacaatggccaacgagatggggttcctcgagaagactaagaaggacctagggctggggagcatcacgacgcaggagagcgaaagcaacattctcgacatcgacttgcgcccggccagcgcctggaccctgtacgccgtcgctacgacctttgttacgccaatgctccggcactccatagagaacagctccgtcaacgtgagcctgaccgcaattgccaaccaggccaccgtgttaatgggcttagggaagggatggcccctgtccaagatggacatcggggtcccccttctcgcgattggatgctacagccaggtcaacccgatcaccctgacggccgccctactcctgttagtagcccactacgccatcatcggccctgggctccaagcgaaggccacccgcgaggcccagaagcgggctgccgcgggcatcatgaagaaccccaccgtcgacgggatcacagtgatcgacctggagcccatcccgtacgatccgaaattcgagaaacagctgggccaggtgatgctgctgatcttatgtgtcacccaggtgatgatgatgcgaaccacctgggctctatgcgaggccctgaccctggccacggggcccatatccaccctctgggagggaaatcccggccgcttttggaacactaccattgccgtgagcatggcgaacatcttccgcgggtcctacctggccggagccgggctcctctttagcatcatgaaaaatactaccaacacccgccggggcaccggcaacatcggcgagacgttaggcgagaagtggaagtcccgcctgaacgccttaggaaagtcagagttccaaatttacaaaaagagcggtatccaggaggtagaccggaccctggctaaggaagggatcaagcgcggcgagaccgaccatcacgccgtgagccggggcagtgcgaagcttcgctggttcgtcgagcggaacatggtgaccccggaagggaaggtggtggacctcggctgtgggcgcggcggttggagctactactgcggtgggctcaagaacgtccgggaggtgaaggggttaacgaagggcgggcccggccacgaggagccgatccccatgtccacctacgggtggaacctcgttcgcctccaaagcggagtcgacgtgttcttcaccccccctgagaaatgcgacaccttgttgtgtgacatcggcgaaagctcccccaatcccacgattgaagccggaaggaccctgcgcgtcttgaacctcgtcgaaaattggctaaacaacaacacccagttctgtatcaaagtgttaaacccatacatgccgagcgtgatagaaaaaatggagaccctccagcggaagtacggaggggccttagtccgcaatcctctgtcccggaatagcacccatgagatgtactgggtgagtaatgcaacgggcaatatcgtaagctctgtgaatatgatatcccgcatgttgattaacaggtttaccatgaaacacaagaaggctacctacgagccggacgtggacctcgggtccggcacacgcaacatcggcatcgagagcgagatacccaacctcgacattatcgggaagcgcatcgagaagatcaagcaggagcatgagacgagttggcactacgatcaggatcatccctacaagacctgggcctaccacggcagctacgaggcgaagcagactgggtctgcgtcctccatggtgaacggggtcgtgcggctgctcacaaagccctgggacgtggtcccgatggtgacgcagatggcgatgaccgataccactcccttcgggcagcagcgcgtgttcaaagagaaagtcgatacgcggacccaggagcccaaggaggggaccaagaaactgatgaagatcacggccgagtggctatggaaggagctcgggaaaaagaagacgcccaggatgtgcacccgggaggagttcacccgcaaggttagatccaacgctgccctgggcgcaatattcacggatgagaacaagtggaaaagcgcgcgcgaggcagtggaggacagccgtttctgggagctggtcgatcgcgagcggaacctccacttagagggcaagtgcgagacgtgcgtgtacaatatgatgggcaagagggagaagaagctgggcgagttcggcaaggccaagggatctcgggccatctggtatatgtggctcggcgccaggtttctggagttcgaggccctcgggttcctcaacgaggatcactggttcagcagaggcaacagcctaagtggggtcgagggcgagggcctgcaccgcttaggctacatcctcagagatgtgagcaagaaagagggcggggccatgtacgccgatgacacagccggctgggacacccgtattaccctggaggacctcaagaacgaggagatggtgacgaaccacatgaaaggggagcacaagaagttggcggaggccattttcaaactcacctaccagaacaaggtggtgagggtgcagcgcccgacgccccggggcacagtcatggacatcatcagtcgccgcgaccagcggggcagcggccaggtggggacgtacgggctcaacacgttcacaaacatggaggcccaactgatccgccaaatggaaggcgagggcatattcaagtcaatccagcacctgaccgtgacggaggagatcgccgtgcagaactggctcgcgcgtgtggggcgcgagcggctgtcgcgtatggtaatctccggagacgactgtgttgtgaagcccttggacgatcgcttcgcgagcgccctgaccgccctgaacgacatgggaaaggtgcgcaaggacatccagcaatgggagccaagtagaggctggaacgactggacccaagtcccgttctgcagccaccactttcatgagttggtaatgaaggatggccgcgttctcgtcgtgccctgccggaaccaggacgaactgatcggcagggcccggatctcccaaggcgctggttggtcccttaaagagaccgcgtgcctgggcaagtcctacgcccagatgtggacgttgatgtatttccatcgcagggatctgcgacttgccgccaacgcgatctgtagcgcggtgccatcccactgggtcccaaccagccggacgacctggtccatacacgccaaacacgagtggatgaccacggaagatatgctggccgtgtggaatcgcgtttggatacaggagaacccgtggatggaagacaagacccccgtcgagagctgggaggaggtgccctacctgggtaagcgggaagatcagtggtgcggctccctcatcgggctgacctcacgcgcgacctgggcgaagaacatacagacggccatcaatcaggtgcgcagtttaatcggcaatgaggaatacaccgactatatgccgtcaatgaagcggttccgtcgggaggaggaggaggccggcgtcctctggtag

SEQ ID NO: 25183 - RNA, 9876 nt, synthetic construct
  misc_feature 1..9876: note = derived and/or modified CDS sequence (opt11) from DENV-2__EU482573__SS-prME
  source 1..9876: mol_type = other RNA
accgccggcgtgataattatgcttatccccaccgctatggccttccaccttacaacgagaaacggggaaccccacatgatcgtgggccgacaggaaaaagggaaatcgctgctgttcaaaaccgaagatggcgtgaacatgtgcaccctcatggccatcgaccttggggaactgtgcgaggacactatcacctacaagtgccccctcctgcgacagaacgagccagaggacattgactgctggtgcaactccaccagcacctgggtgacctatgggacctgcacaaccacaggcgagcaccgtcgcgagaagcggtcggtggcgctggtcccccacgtagggatgggattagagacccgcacggagacctggatgagcagcgagggcgcctggaagcacgtccagcggatcgagacgtggatcctgcgacaccccggcttcaccattatggcagccatcctggcttacaccatcggtaccacgcacttccagcgggccctcatcttcatacttctaacagccgtggcgccttccatgacgatgcgctgcattggaatcagtaaccgagacttcgtggaaggcgtcagcgggggttcgtgggtggacatcgtgctcgaacatgggtcgtgcgtcaccaccatggccaaaaacaagcccacactggacttcgagcttatcaaaaccgaggccaagcagccggcgaccctccgcaagtactgcatagaggccaagctcacgaacacgactaccgaatcccgatgcccgacgcagggagagcccagccttaatgaggagcaggacaagcgcttcctctgtaagcactccatggtggacaggggctgggggaatggctgcgggctgtttggaaaaggcggaattgttacctgcgctatgttcacgtgcaagaaaaatatggaaggcaaggtcgtgctgcccgaaaacctcgagtacaccattgtgatcacgccgcacagcggtgaggaacacgccgttgggaacgacacagggaagcacggcaaggaaattaagattacgccgcagtccagtatcaccgaggctgagcttaccgggtacgggacggtgaccatggagtgttcgcccagaacaggactagacttcaacgagatggtgctcttacagatggaggacaaggcctggctcgtacatcgacagtggttcttggacctgcccctgccatggctgccgggagccgacacccagggctcaaactggatccagaaagagacgctcgtgacatttaagaatccacacgccaagaaacaggacgtggttgtgttaggttcccaggaaggcgcgatgcacacggccctcaccggggcgacggagatccaaatgagctctggcaacctgctgttcaccgggcatttgaagtgccgcctgcggatggataaactacagctcaaggggatgagctacagtatgtgcaccggcaaattcaagatcgtaaaggagatcgccgagacccaacatgggacgatcgtgatacgcgtgcagtatgagggcgacggctccccgtgtaagatcccgttcgagattatggatctggagaagcggcacgtcctggggcgcctcatcaccgtgaacccgatcgttactgaaaaagacagccctgtcaacatcgaggcagaaccgcccttcggcgacagttatattatcatcggcgtggagccgggccagcttaaacttaactggttcaagaaggggtcttccatcggccaaatgttcgagaccactatgcgcggggccaagcgcatggccatactcggggacacggcttgggactttggatcgcttggcggcgtcttcacctcgattgggaaggccctgcaccaagtcttcggagcaatctacggtgccgccttttccggcgtttcctggaccatgaagatactgataggcgtgatcatcacgtggatcgggatgaacagcagatccaccagtctgtccgtcagcctggtgctggttggcgtcgtgacattatacctgggggccatggtccaggcggacagtggctgcgttgtcagctggaagaataaggagctcaagtgcggttcaggcattttcatcacggacaacgtgcatacgtggactgagcagtacaagttccagcccgagagcccgtcgaagctcgcctctgccattcagaaagcccacgaggagggcatctgcgggatccgtagcgttacccgactggagaatctgatgtggaaacagatcacccccgaactcaatcacatcctgtcagagaacgaggtcaagctaaccatcatgaccggagacatcaaggggatcatgcaagccggcaagaggagcctgcgccctcagcctaccgagttaaagtattcctggaagacctggggcaaggcgaaaatgttgtctacggaaagccacaatcagaccttcctgatcgatggccccgagacagccgaatgcccgaacaccaatcgggcctggaactctctcgaggtggaggactacggcttcggggtcttcacgaccaacatatggctgaagctccgcgaaaagcaggacgttttctgcgattccaagctcatgtcggccgcaatcaaggacaaccgggcggtgcacgctgacatgggctactggatcgagtccgccctgaacgacacatggaaaatggagaaggctagcttcatcgaagtaaagtcctgccattggcccaagagccacaccctgtggagtaacggcgtgcttgagagcgagatgatcattcccaagaactttgccgggcccgtaagtcagcacaactaccgcccggggtatcacacccagactgctggtccatggcacctcggcaaactcgagatggacttcgacttttgtgagggaacaaccgttgtcgtgaccgaggactgcggcaaccgcggacccagcctgcgtacgacaaccgcttccgggaagctcattacagagtggtgctgccggtcctgtaccctgccacccctgcgctaccggggcgaggacgggtgttggtacggtatggagatccgccccctgaaggagaaggaggaaaatctagttaacagcctggtaactgccgggcacggccagatcgataatttctccctgggcgtgctcgggatggccctgttcctggaagaaatgctccggacacgcgtaggcacgaagcacgccattctcctggttgcagtttcattcgtcacactcatcacagggaatatgtcattccgtgaccttggccgcgtgatggtgatggtcggggccactatgaccgacgacattggcatgggcgttacgtatttagccttactggccgcgttcaaggtgcgacccaccttcgccgccgggttgctcctacggaaacttacaagcaaagaactcatgatggcaacaatcggcatcgccctcctgtcccagtcaacgattcccgagacaatcctcgagctaactgacgccctggccctcggaatgatggtactgaagatcgtgagaaacatggagaagtaccagcttgccgtgaccatcatggccataagctgtgtcccaaacgccgtgatcctgcagaatgcctggaaggtgagctgcacgattctggcggccgtctccgtttcaccgctgctcctgacatccagccagcagaaggctgactggatcccgctggcgctcaccatcaagggccttaatccaaccgccatattcctgacgaccctatccagaaccagcaagaagcggtcctggccgttgaacgaggccatcatggccgtgggcatggtgtcgatcctggcatccagcctcctgaaaaacgacatccccatgaccggacccctggttgcgggcgggttgctcaccgtctgctacgtgctgaccggccgctcggccgacctcgagctggagcgcgccgccgatgtcaagtgggaagatcaagcggagatttccgggtcatctcccatcctgagcatcaccatatccgaagacggctcgatgtctatcaaaaacgaagaagaggaacaaactctcacgattctgatccggacggggctgctggtcattagcggggtgttcccggtgtcgatccccatcaccgcggccgcctggtacctgtgggaagtcaagaagcagcgggccggcgttctgtgggacgtacccagccctccacccgtcgggaaagccgagcttgaggatggcgcgtaccgtatcaagcaaagagggatcctgggctactcccagatcggcgcaggggtctataaggaaggcactttccacaccatgtggcatgtaacccgcggggccgtcctaatgcaccgcggcaagaggatcgagcccagttgggccgacgtgaagaaggacctcatcagctacgggggcggctggaaactggaaggtgagtggaaggagggcgaggaggtgcaggtcctagccctcgagcccggcaagaacccccgcgcggtacaaaccaagccgggcctgttcaagaccaacacggggactatcggtgccgtgagcttggacttttctcccgggaccagtgggtcccccattgtggaccggaagggcaaggttgtcgggctctatggcaacggggtcgtgactcgcagcggggcttacgtcagcgccatcgcgcagactgagaaatccattgaagacaaccccgagatcgaagacgacatcttccgaaagaagcgcctgacgatcatggacttgcaccccggagccggaaagacgaagcggtatctgcctgcaatcgttcgcgaggccataaagcggggcctcaggaccctaatactggccccgacgcgcgtggtggcggccgagatggaggaggcacttaggggactgcccatccgctaccaaactcctgctattcgcgctgagcacaccggccgcgaaatcgtcgacctgatgtgtcatgcgacattcacgatgagactcctatcaccggttcgcgtcccaaactacaacctgatcatcatggatgaagcccatttcacggaccccgcctccatcgccgctcggggctatatctccacccgcgttgagatgggggaagcggccggtattttcatgactgcgacgccacccgggtcccgcgatccgttcccgcagagcaacgcacccataatggatgaggagagggagatacccgagcgatcctggaacagcgggcatgagtgggtgacggacttcaaggggaagactgtatggttcgtcccgtctatcaaagcgggtaacgacatcgccgcctgcctccgcaaaaatggtaagaaagtgatacagctgagcaggaaaacctttgactccgaatatgtgaagactcgcgcaaacgactgggacttcgtcgtgacgaccgatatttccgaaatgggggccaacttcaaagcggaacgagtgatagacccccgcagatgcatgaagcccgtcatcctcaccgacggtgaggaacgcgtaattcttgccgggcccatgccggtcacccattcctccgcggcacaaagacgcggccgcatcggccgtaaccctaagaacgagaatgaccagtacatctacatgggagagccgctggagaacgatgaggactgcgcccactggaaggaagccaagatgctgttggacaacataaacacgcccgagggtataatcccttccatgtttgagccagaacgcgagaaggtcgatgccatcgacggggagtaccggctgcgtggcgaggccaggaagaccttcgtggatcttatgcgccgcggtgacctccccgtatggctggcctaccgtgttgccgcggagggcatcaactatgcagaccggcgctggtgctttgacgggatcaagaacaaccaaatcctggaggagaacgtggaggtggaaatatggaccaaggagggtgagcggaaaaagctcaagccacgctggctggacgcccggatctacagcgaccctctggcccttaaggagttcaaagagttcgcggccggccgaaagtcgctgaccctgaatctcattacggagatggggcggctgcccaccttcatgacccagaaagcccgcgacgctcttgacaacttagcggtcctgcataccgcggaggccggcgggcgggcctacaaccacgctctcagcgaactcccagagacgctggagaccctcctcctgctgacgttattggctaccgtaacgggcggcatcttcctgttcctcatgtccggcaaaggcatcgggaaaatgaccctgggaatgtgctgtatcatcactgcgagcatcttgctctggtacgcgcagatacaaccgcactggatcgccgcctccatcatcctggagttcttcctgatagtgctactgatccccgagcctgagaagcaacgaactccccaggacaatcagctgacctacgtcgtaatcgccattctcacggtcgtggcggccactatggccaacgaaatggggtttctggagaagaccaagaaggacctgggcttaggctcgatcaccacgcaagagtcagaatcgaacattttagatatcgatctgcggccggccagcgcctggactctctacgcggtggcaaccaccttcgtcacgccaatgctgcgccactccatcgaaaattcttccgttaacgtgagcttgaccgctatcgccaaccaagctacggtcctcatggggctgggcaagggatggccactgtcaaaaatggacattggggtgcccctactggccatcgggtgctacagccaggtaaacccgataaccttgacggcagccttacttctgctcgtggcccactacgcgatcatcggtccgggcctgcaggccaaggccacaagagaggcccagaagcgcgccgcggccgggatcatgaagaatcccacagtggatggcatcaccgtaatcgacctggagccaattccctacgatcccaagtttgagaagcaattgggacaagtgatgctactgatcctctgcgtgacccaggtactaatgatgcgaaccacgtgggccttatgcgaggccctaaccctggccacaggacccatctccaccctgtgggagggcaaccctggtcggttctggaacacaaccattgccgtaagtatggccaacatcttccgaggatcctatctagctggggcgggcctattgttcagcatcatgaaaaatacgaccaatactcgccgcgggaccggcaacataggggaaacgttgggcgagaagtggaagtcccgcttaaatgcgctgggaaagtcagagttccagatctacaagaaatccggcatccaggaggtcgatcgtaccctcgctaaggaaggaatcaaacgcggtgagacagaccaccatgcggtgtcacgcggatccgccaagctgcggtggttcgtcgaaaggaatatggtgacccctgaagggaaggtggtggacctggggtgcggccgcgggggttggagctactactgtgggggcctcaagaacgttcgcgaagtaaagggcttaaccaagggcggccccggtcacgaggagcccatcccgatgtcgacctacggctggaatctggtccggctccagtccggtgtggacgtgttcttcaccccgcccgagaagtgcgacaccttactttgtgacatcggcgagagcagtccgaatcccacgatcgaagccggccgcaccctccgggtcctgaacctggtggagaactggctcaacaacaacacccagttctgcattaaggtgctaaacccgtacatgcccagcgtcattgagaagatggagacccttcaacgcaagtacggaggggctctggttcggaatccgcttagtcgcaacagtacccacgagatgtactgggtaagtaacgctacggggaacatcgtatcatccgtgaatatgataagcagaatgcttatcaaccgcttcaccatgaagcacaagaaggccacttacgagccagacgtcgacctcggctccggcacacgcaacatcggcatcgaaagcgaaatccccaacctcgacatcatcggcaagcggatagagaaaatcaaacaagaacacgagacgtcctggcactacgaccaggaccatccctacaagacttgggcctaccatggtagctacgagaccaagcaaacaggctcagcgagcagcatggtcaacggagtggttcgcctattgacgaagccttgggacgtcgtcccgatggtcacccagatggccatgaccgacaccacgccctttgggcagcagcgtgttttcaaggagaaagtcgatacacgcacccaggagcccaaggagggaaccaagaagttgatgaaaatcacggcggagtggttgtggaaggaactagggaagaagaaaactccccgcatgtgcacccgagaggagtttactcgaaaggttcgctccaacgctgccttgggcgccatcttcacggatgagaacaaatggaagtccgcgcgtgaagccgtcgaggacagccgcttctgggagcttattgacagagagcgcaacctgcatctcgagggtaaatgtgagacgtgtgtgtataacatgatggggaagagggagaagaaactcggggaatttggtaaggcgaaaggcagcagggccatctggtatatgtggctgggggcgcggtttctcgagtttgaagccctgggatttctaaatgaggaccactggttctcacgtgggaatagcttgtccggcgtggagggtgagggccttcaccgcctggggtacatcctccgcgatgtaagtaagaaggagggcggcgccatgtatgcagatgacaccgccgggtgggacaccagaataacgctggaggacctgaagaacgaagaaatggttaccaaccatatgaaaggtgagcacaagaagctcgcggaggccatattcaagctaacatatcaaaataaagtcgttcgcgtgcaacggcctacgccgcgcgggaccgtgatggacatcatatcccgccgggaccagcgtggctcaggccaggttgggacatatggcctgaacacttttacaaacatggaggcccaactcattcggcaaatggagggggagggcatcttcaaatccatccagcatctgactgtgaccgaggagatcgccgtccaaaactggctggctagggtgggccgggagaggctcagccggatggcgatctccggggacgactgtgtagtcaagcccctggacgaccgctttgcttcagccctgaccgctctcaacgatatgggcaaggtgcgaaaagacatccagcagtgggagccctcccgaggatggaacgactggacgcaggttcccttttgttcacaccactttcacgagctggtcatgaaggacggccgggtcctggtggtcccctgccgcaaccaggacgaactcataggcagagcccgcatctcacagggtgccggctggtctctcaaggagacagcctgccttgggaagagttacgcccagatgtggaccctcatgtattttcaccggcgcgacctgcggctggcagctaacgcgatctgtagcgccgttccctcccactgggtgcctacgtcgcggaccacgtggtccatccacgccaagcacgagtggatgactaccgaggacatgctcgctgtatggaacagagtctggatacaagagaacccgtggatggaggacaagaccccggttgagagctgggaggaggttccctacttgggcaagcgcgaggatcagtggtgcgggagcctgatcggcctcacctcccgcgcgacatgggcgaagaacattcagaccgctatcaatcaagtacggtctctgatcggcaacgaggagtacaccgattacatgccctccatgaagagatttcggcgcgaggaggaggaagcgggagtcttgtggtaa

SEQ ID NO: 25184 - RNA, 9876 nt, synthetic construct
  misc_feature 1..9876: note = derived and/or modified CDS sequence (opt11) from DENV-2__EU482574__SS-prME
  source 1..9876: mol_type = other RNA
accgccggcgtgattatcatgctgattccgaccgccatggcgtttcatctcaccaccaggaacggcgaaccgcacatgatcgtcgggcggcaggagaaaggcaagtccctgctgttcaagactgaagatggcgtcaacatgtgcaccttgatggctattgacctgggggagctgtgcgaagacaccatcacctataagtgccccctattaaggcagaacgagccagaggacattgactgctggtgtaacagcacctctacgtgggtgacctacggcacctgcaccacaactggcgagcatcggagggaaaaacggagtgtcgccctggtgccccacgtgggcatgggtctcgagacccgcaccgagacttggatgagcagcgagggggcctggaagcatgtccaacggattgaaacgtggatcttgcggcacccgggcttcaccatcatggccgcgatccttgcctacaccatcgggaccacgcacttccaacgggcccttattttcatcctgctgactgccgtggctccgagcatgaccatgcgatgcatcggcatttccaaccgggacttcgttgagggagtgagcgggggctcctgggtggacatagtactggagcacgggtcgtgcgtcaccacgatggccaagaacaaacccactttagacttcgagctaatcaagaccgaggctaagcaacccgccaccctgagaaaatactgcattgaggccaagctgacgaataccaccactgagtcccggtgcccaactcagggtgagccaagtctcaacgaggagcaggacaagcgcttcctctgtaagcactccatggtggaccgtggttgggggaacgggtgcgggctgttcgggaaaggggggattgtgacctgcgccatgttcacgtgcaagaaaaatatggaggggaaagtcgtgttacctgaaaatctcgagtacaccatcgttatcacgccacatagcggcgaggagcacgccgtcggcaacgacaccggcaagcacggtaaggagatcaagatcaccccgcaaagcagcatcaccgaggcggaactgacggggtacggcacggtcaccatggagtgcagcccccggaccggactggacttcaatgagatggtgctcctgcacatggaggacaaagcatggctggtccaccgccagtggttcttagacctgcccctgccatggctgccgggggccgacactcagggatcaaattggatccagaaggagaccctggtgaccttcaagaacccccatgcgaagaagcaggatgtagtcgtactggggagtcaggagggcgccatgcacacggccctcacgggtgccactgagatccagatgagcagcggcaacctgctgtttactggccacttaaaatgtcggctgcggatggataagctgcagctcaaggggatgtcctacagcatgtgcaccggaaagtttaagattgtcaaggagatcgccgaaacacagcacgggacgatcgtgatccgcgtgcagtatgagggagacggctccccctgtaagatccccttcgagattatggacctggagaagcggcatgtgttagggcgcctcatcaccgtgaacccaatcgtgaccgagaaggacagccccgtcaacatagaggcggagccgcccttcggcgattcctacatcatcatcggggtggagccgggccaactgaagctgaactggttcaaaaaggggagctccatcggtcaaatgttcgagaccacgatgcgcggggcaaagaggatggccatacttggagacacagcgtgggatttcggcagcctcggcggggtgttcacatccatcgggaaggcactgcaccaggtcttcggggcgatctacggcgcagccttcagcggagtgagctggaccatgaagatcctgatcggcgtgattattacgtggatcgggatgaacagccgttcaaccagcctgtccgtcagcctggtgctggtgggcgtcgtgaccctttacctgggagccatggtgcaggcggatagtggctgtgtcgtcagctggaaaaacaaggagctgaagtgcggctccggtatcttcatcactgacaacgtacacacgtggaccgagcagtacaagttccaacccgagagccccagcaagctcgcttccgcaattcaaaaagcccacgaggaaggcatctgtggaatccggagcgtcacccgcctggagaatttgatgtggaagcaaatcacccccgagctcaaccacatcctgtcagaaaacgaggtgaagctgaccatcatgaccggggacatcaaggggatcatgcaagccggcaagcggagcctccgcccgcagcccaccgagttaaaatactcctggaagacgtggggcaaggccaagatgctgagtacagagtcccacaaccagaccttcttaatcgacgggcccgagaccgctgagtgtccgaacaccaaccgggcttggaacagcctagaagtggaggattacggcttcggggtcttcacgacgaacatctggctgaagctgcgcgagaagcaggatgtgttctgcgactccaagctaatgagcgccgccatcaaggataatcgtgcggtgcacgccgacatgggctactggatcgaatcggccctgaacgatacgtggaagatggagaaggccagcttcatcgaggtcaagtcctgccactggcctaagagccacaccctatggtccaacggcgtgctggagagcgagatgatcatacccaagaacttcgccgggcccgtgtcccaacacaactaccgcccgggctaccacacacagaccgcagggccatggcacctgggtaagctagagatggactttgatttctgtgagggaaccactgtcgttgtgacagaggactgcggaaaccggggcccaagcctgcgcacgacaaccgccagcgggaagctgatcacggaatggtgctgccggtcctgtacgctcccgccactgaggtaccggggcgaagacgggtgctggtacggcatggagatccgcccactgaaggagaaggaggagaacctcgtaaactcgctggtgacagccgggcacggacaaatcgacaatttctccttgggcgtgctcgggatggccttattcctggaggaaatgctacggacccgggtgggcacaaagcacgcgattctgcttgtggccgtgagcttcgtcaccctcattacggggaacatgagcttccgggacctgggccgcgtcatggtgatggtcggggccaccatgaccgacgacatcggcatgggcgttacttatctggccctgctggccgcgttcaaagtgagacccactttcgccgccggactgctcctgcggaaattaactagcaaggagctcatgatggccacgatcggcatcgcgctactttcgcagagcacgatcccagagaccatcctcgagctgacggacgcacttgccctagggatgatggtcctcaagatcgtgcgaaacatggagaagtaccagctggctgtgaccatcatggccatctcctgcgtccccaacgccgtaatcctccaaaatgcgtggaaggtgtcatgcacgatcctggcggccgtctccgtgtctccccttctcctgacctcctcgcagcagaaagccgactggatccccctggcgctcaccatcaagggccttaaccctaccgctatcttcctgaccaccctctccagaactagcaagaagcgctcctggccgctgaacgaggcgatcatggccgtgggcatggtaagtatcctagcctccagccttctaaagaacgacatcccgatgaccgggccactggtggcaggcgggctcctgacggtgtgctacgtgctgactggcaggagcgccgaccttgaactggagcgcgccgctgacgtgaagtgggaggaccaggccgagatttccgggagctcacccatcctgtccattaccattagcgaagacggcagcatgagcatcaagaacgaagaggaggagcagaccctgacgatcctgatccggaccggcttgttagtcataagcggggtcttcccggtgtccatccccatcaccgcggccgcctggtacctgtgggaagtcaagaagcagcgggctggcgtgctgtgggacgttccctccccgccgcccgtcgggaaggccgagctcgaagacggcgcgtatcggataaagcagcgtggcatcctgggctattcccagatcggggccggggtttataaagaagggaccttccacaccatgtggcacgttacgcgcggggccgtcttaatgcaccgcggcaagcggatcgagcccagctgggccgacgttaaaaaagacctgatctcctacgggggcggctggaagctggagggggagtggaaggagggcgaggaggtccaagtcctggctctcgagcccgggaagaatccccgcgcggtgcagaccaagccggggctgttcaagaccaacaccggtacgatcggcgccgtatcactggacttttcccccggcaccagcgggtcccccatcgtggaccggaagggcaaggttgtggggctctacggaaacggcgtcgtgacccgcagtggagcctatgtgtccgccatcgcgcagaccgagaagtccatcgaagacaaccccgagattgaggacgacatcttccggaagaagcgcctgacgatcatggacctgcaccccggcgccgggaagaccaaacgctacctgcccgcgatcgttcgcgaggccatcaagcgaggcctgcgtacccttatcctggcaccgacccgcgtggtggcagccgagatggaggaggccttacgagggcttcccatccgatatcagacgcccgccattcgggccgaacacaccggacgcgagatcgtcgacctgatgtgccatgctaccttcacgatgcggctcctgagccccgtgcgcgtgccgaactacaatctgatcatcatggacgaagcccatttcacggaccccgcgtccatcgctgcccgaggctacatcagcacccgcgtcgagatgggggaggcggccggcatcttcatgactgcgacgccgcccggatcacgggacccatttccccaaagcaacgcccccataatggacgaggaacgcgagatccccgagcggtcctggaacagcggccatgaatgggtgacggacttcaaggggaagaccgtgtggtttgtcccaagtatcaaggcgggcaacgacatcgccgcctgtctacgcaagaacggcaaaaaggtgatccagctctcacggaagacgttcgatagtgagtacgtgaagacccgggctaacgactgggacttcgtagtgacgaccgacatcagcgagatgggggccaacttcaaggccgagagggtcatcgaccccagacggtgcatgaagcccgtcatcctgactgacggcgaggagcgcgtgatactcgctgggcccatgccggtgacccactccagcgccgctcagcgcagaggccgcatcgggcggaatcccaagaacgagaacgaccagtacatctacatgggcgagccccttgagaatgacgaggactgcgcacactggaaagaagctaagatgctccttgataacatcaacacacccgagggcatcattccgtctatgtttgagccggaaagggaaaaggtcgacgccatcgacggggagtaccgactgcgcggtgaggctcggaagacattcgtggacctgatgagaaggggggacctgcccgtctggctggcctaccgcgtcgccgcggaaggcatcaactacgccgaccgacgctggtgttttgacgggataaagaacaaccagattctggaggagaacgtcgaggttgagatctggaccaaagagggtgagcggaaaaagttgaagccgcgctggctggacgcccgcatttacagcgatcccctcgccctcaaggagttcaaggaattcgcagccggccgcaagtccctgaccctcaacctcatcacggagatggggcgactgcccacttttatgacccagaaggccagggacgccctggacaacctcgccgttctgcacaccgcggaagccggcgggagagcctacaatcacgccctgagcgaactccccgagaccctggagaccctgctcctgctgaccctcctggccaccgtgacgggcggcatcttcctcttcctcatgtctgggaagggcatcgggaagatgacgctggggatgtgctgtatcatcaccgcgtcaatcctgctctggtatgcacagatacagccacactggatagccgcgtctatcatcctggagttcttccttatcgtcctcttaatccccgagccggagaagcagaggacgccccaggacaaccagctcacctatgtggtgatcgccatcctaacggtcgtggcggccacaatggccaacgagatgggttttctggagaagacgaagaaggacctgggactcggcagcatcaccacgcaagagtcagagtccaacatactagacatcgacttaaggccggcgtcggcctggaccctatacgccgttgccaccaccttcgtcacgcctatgctaaggcactccatcgagaacagctccgtgaacgtatccttgaccgccattgccaaccaggccaccgtcctcatggggctgggcaagggttggcccctgagtaagatggacatcggcgtgcctctcctggccatcggctgttacagccaggtgaacccgataacgttaacggccgcgctcctgctgctcgtagctcactatgcgatcatcggccccggcctccaagccaaggcaacccgggaagcccagaagcgcgcggcggcggggatcatgaagaaccccaccgtggacggaatcaccgtgatcgatctggagcccatcccgtacgaccctaagttcgagaagcagctcggtcaggtgatgctactgatactctgcgtaactcaggtgctgatgatgcgcaccacttgggccctgtgcgaggccctcaccctggctacgggcccgatcagtaccctgtgggaggggaaccccggccgattctggaacacgaccatcgcggtaagcatggcgaacatctttcgcgggtcctacctcgccggggccggcctgctgttcagcattatgaagaacacgaccaacacccgtcgcggtactggcaacatcggcgaaacgctcggtgagaaatggaagtcccggctgaacgctctcggcaagagcgagttccagatatacaagaagtccgggatccaagaggtcgaccgcactttggccaaggagggcatcaagcgcggggagacagaccatcacgccgtgagccgcgggtccgcaaagctacggtggtttgtcgagaggaacatggtgacgccggagggtaaggtagtcgacttaggttgtggccgcgggggctggtcgtactactgtggaggcttgaagaacgtgcgtgaagtaaaaggcctgacgaagggtggccccggacacgaggagcccatccccatgagcacgtatgggtggaacctggtccggctgcagtccggggtagacgtgttcttcaccccgcccgagaagtgtgacaccctgctgtgtgatatcggcgagtcctcccccaaccccacgattgaggcaggcaggaccctccgggtcttaaaccttgtggagaactggctcaacaacaacacccagttctgcatcaaagtcctgaacccgtacatgcccagcgtcatcgagaagatggaaacactgcagcgcaagtacggtggcgcgctggtgcggaaccccttatccaggaattcgacccatgagatgtactgggtttccaacgccacggggaatatcgtcagctccgtgaacatgattagccgaatgttgatcaaccgctttaccatgaagcacaagaaagccacctacgaaccggacgtggacctgggatccggtacccgcaacatcggcatcgagtctgagatccccaatctagacatcatcggcaagcgcatcgagaaaatcaaacaggagcacgaaacgtcctggcactacgaccaggaccacccatataagacctgggcgtaccacgggagctacgaaaccaagcaaaccggctccgccagctccatggtgaacggcgtggtgcgccttctgacgaaaccctgggacgtcgtgccgatggtgacccagatggcgatgaccgacaccactcccttcggtcagcaacgggtcttcaaggagaaggtggatacccgcacccaggagcctaaggagggaactaagaagctcatgaagatcaccgccgaatggctgtggaaggagctggggaaaaagaagacgccccgcatgtgcacgcgcgaggagttcacccggaaggtgaggagcaacgccgccctcggcgccatcttcactgatgagaacaaatggaagtccgcgcgggaagccgtcgaggactctcgcttctgggaactgatcgatcgggagcgcaacttacacctcgaggggaagtgcgagacctgcgtttacaacatgatgggcaagcgggagaagaaattaggagagtttggtaaggccaagggctcccgggccatctggtacatgtggctgggggcgcggttcctggaattcgaggccctgggcttcctgaatgaggaccactggttcagtcgcgggaatagcctctccggcgtggagggggagggcctgcaccggctcggctacatccttcgggacgtcagcaagaaggaaggaggagccatgtacgccgacgatacagcaggctgggacacccggatcactctggaggacctgaagaacgaggagatggtgaccaaccacatgaagggcgagcacaagaaacttgcggaggctatttttaagctaacctaccagaacaaggtcgtgcgcgtgcagcgaccgacgccccgcgggaccgtcatggacatcatctcccgccgggaccagcgcggatccggccaggttgggacatacggcttgaacactttcaccaatatggaagcacagctcatccggcagatggagggggagggcatcttcaagtccatccagcacttgacggtgactgaggagatagccgtccagaactggctggcccgggtcggacgtgagcgcttgagccgtatggcgatcagtggggatgactgtgtcgtgaagcctcttgatgacagattcgccagcgccctgactgcccttaacgatatgggcaaggtgcggaaggacatacagcagtgggagccctctcgcgggtggaacgattggacccaggtgccgttctgcagccatcacttccacgagctggtcatgaaggatggccgggtcctggtggtgccctgtcgcaaccaggacgagctcattgggcgggcccgcatctcccaaggcgccggctggagcctgaaagagacggcgtgtctggggaagtcgtacgcccagatgtggaccttgatgtactttcaccggcgagacctgcggctggccgccaacgcgatctgcagcgccgtgccctcacactgggtccccaccagccggaccacctggtccatccacgccaagcacgagtggatgacaacagaggacatgctcgccgtctggaaccgggtgtggatccaagagaacccgtggatggaagacaaaacccccgtggaatcttgggaagaagtgccctacctaggtaaacgcgaggaccaatggtgcgggtcactgatcggcttgacttcccgcgcaacgtgggccaagaacatccagacggcaatcaaccaggtgcggagcctaatagggaacgaagagtacaccgactacatgccatccatgaagcggttcaggcgggaagaagaagaggcgggcgtgctgtggtga

SEQ ID NO: 25185 - RNA, 9876 nt, synthetic construct
  misc_feature 1..9876: note = derived and/or modified CDS sequence (opt11) from DENV-2__EU482575__SS-prME
  source 1..9876: mol_type = other RNA
accgccggcgtgataatcatgctgatacccaccgccatggcgttccatctcaccactcgtaacggggaaccccatatgattgtcggccggcaagaaaagggtaagtccctgctgtttaaaaccgaggatggcgtcaacatgtgcaccctcatggccatcgacctgggagaactgtgcgaagataccataacctacaaatgccccctcctgcgacagaacgagcctgaagacatcgactgctggtgcaacagcaccagcacctgggtgacctacgggacctgcacaaccacgggcgagcggcgccgggagaagcgttccgtcgctctggtgccccacgtggggatgggcctcgagacccggaccgagacctggatgagcagcgagggggcctggaagcacgttcagaggatcgagacatggatcctgcggcatcctgggttcaccatcatggcggcgatactggcgtacaccatcgggacgacgcatttccaacgcgccctcatcttcatcttgctaaccgcggtggctcccagcatgaccatgcggtgcatcggtatctccaaccgggactttgtggagggcgtgagcgggggctcatgggtggacatcgtgctagaacacgggagctgtgtaacgacgatggccaaaaataagcccaccctggatttcgaactaatcaagaccgaggccaagcaaccggccactctccggaagtattgcattgaggcaaagctgacaaacaccactaccgagtcccgctgtccgacgcagggcgagcccagcctgaacgaggagcaggacaagcggtttctctgtaaacactccatggtcgaccgcggctgggggaacggctgtgggttgtttggcaagggcggcatcgtgacctgtgcgatgtttacgtgcaagaaaaacatggaggggaaggtcgtgctgcccgagaacctagagtacaccatcgtgatcacgccccatagcggggaggagcatgccgtcggcaacgacacgggtaagcacggcaaggaaatcaagataaccccgcagtcttctatcaccgaggccgagctgaccgggtatggcacggtaacaatggagtgcagcccccggacaggcctagactttaacgagatggtgctcttacaaatggaggacaaggcctggctggttcaccgccagtggtttctggacctgcctctgccgtggctcccgggggccgacacccagggctctaactggattcagaaggaaacactggtgaccttcaagaacccccatgcgaagaagcaggacgtggtcgttctgggttcccaggaaggcgccatgcacacggccctcaccggggccacggagatccagatgtcctctgggaacctgctgtttacgggccacctcaagtgccggctgcgcatggacaagctgcagctcaaggggatgagttatagcatgtgcaccggcaagttcaagatcgtcaaggaaatcgccgagacccagcacggtacgatcgtgatccgggtgcagtatgagggcgacggctccccctgcaagatccctttcgagatcatggacctggagaagcgccacgtcctggggaggttaatcaccgtgaacccaatcgtgaccgagaaggacagcccggtcaacatcgaggcggagccgcccttcggcgacagctacattatcattggggtcgagccgggccaactgaaattaaactggttcaagaaggggagctcgatagggcaaatgttcgagaccacgatgaggggcgccaagaggatggccatcctcggggacaccgcttgggacttcggcagcctcggcggcgtattcacctccatagggaaagccctgcaccaggtcttcggggcgatttacggcgccgccttcagcggggtgtcctggacaatgaagatcctgatcggagtgatcatcacgtggatcggcatgaacagccggtccacaagcctctccgtcagcctggtactggtgggcgttgttaccctatacctcggggccatggtgcaggcggactccggctgcgtagtgtcatggaagaataaggaactgaaatgcggctccgggatcttcataactgacaacgtgcacacatggaccgagcagtacaagttccagcctgagtcaccgagcaagctggcatccgccatccagaaggcccacgaggagggcatctgtgggatccgcagcgtcacacggctggagaacctgatgtggaagcagatcacccccgagctcaatcatatcctgtccgagaatgaggttaagctgaccatcatgaccggcgacatcaaagggatcatgcaggccggcaagcgcagcttacggccacaacccacagagctgaagtactcctggaagacctggggcaaagctaaaatgctgagcacggaatcgcacaatcagactttccttatcgacgggccggagaccgctgagtgtccgaacacgaaccgagcctggaacagcttggaggtagaggactacggcttcggagtcttctccacgaacatctggctgaagttgagggagaagcaggatgtgttctgcgattccaagcttatgtccgcggccatcaaggataatcgcgcggtgcacgctgacatgggctattggatagagtccgctctgaacgacacctggaagatggagaaggcttccttcatcgaggtcaagagctgccattggcccaagtcccacaccctatggtcgaacggcgtgctggagtccgagatgatcattcccaagaatttcgccgggccggtgagccagcacaactaccgaccgggctaccacacccagacagcggggccttggcacctgggcaagctagagatggacttcgacttctgtgaagggactacagtagtggtgaccgaagattgcggcaatcgcggccctagcctgcggactacgaccgcttccgggaagctgataaccgagtggtgttgtagaagctgcactctgccacccctgcggtacagaggcgaggatggttgctggtacggcatggagatcagacctctgaaggaaaaggaggaaaacctcgtcaactccctggtgacggctgggcacgggcagatcgataacttcagcctgggagtgctcgggatggccctgttcttagaggagatgttgcgcactcgggtcggtaccaagcacgcaatcctgctggtcgccgtgtcgttcgtcacattgattacggggaacatgagtttccgcgacctgggccgcgtgatggtaatggtcggggccaccatgaccgatgatataggaatgggcgtgacatacctagctctcctggccgcgttcaaggtccgaccgacgttcgccgccgggctgctcctccggaaactaacgagcaaggagctcatgatggccaccattggcatagccctgttaagccaatccacaatccccgaaacgatactcgagctgaccgatgcgctggcccttgggatgatggtcctgaagatcgtgcggaatatggagaagtaccaattggcggtaaccatcatggccatcagctgtgttcctaacgcggtaatcctccagaacgcgtggaaggtgtcctgcaccatcctggccgctgttagcgttagccccctactcctaacgtcgtcccagcagaaagccgactggatccccttagcgctcaccatcaagggcttaaaccccactgccatcttcctcaccacgctcagccgcacctccaaaaagaggagctggccgctgaacgaggccatcatggccgttggcatggtgtccatccttgcctctagcctcctgaagaacgacatccccatgaccggacccctggtagcgggggggctcctgaccgtctgctacgtgctgacgggacgctccgcagacctcgagcttgagcgggctgccgacgtgaagtgggaggaccaggccgaaatcagcgggtcctctcctattctgagcatcaccatcagtgaggacggctccatgtcaatcaagaacgaggaggaggagcagactctcaccatccttatccgcacgggcctcctagtcatctctggtgtgtttccagtgagcatccctatcaccgcggcggcctggtacttgtgggaggtcaaaaagcagcgtgcaggggtgctgtgggatgtgccgagtccgccgcccgtcgggaaggccgagctcgaggacggcgcgtaccgcataaagcagcggggaatactcggatacagccagatcggcgccggggtgtataaggagggcaccttccacaccatgtggcacgtgacgaggggtgccgtcctgatgcaccggggcaagcgcattgagccctcctgggccgatgtgaaaaaggacctcataagctatggtggaggctggaagttggagggggagtggaaagagggcgaagaggtgcaggtcctggccctcgagcccggcaagaacccccgtgcggtgcagacgaagcccggcctgttcaaaacaaacaccgggaccatcggcgcagtgtccttagacttcagcccggggacatcgggtagtcccatcgtcgaccgtaagggcaaggtggtagggctctacgggaacggcgtcgtgacccgctccggggcctacgttagtgctatcgcgcagaccgagaagtccatcgaggacaaccccgagatcgaggatgacattttccgcaagaagcggttgacaatcatggacctacaccccggagccgggaagactaagcgctacttgcctgccatcgtccgggaagcgattaagcgcggcctgcgcactttgatcctggcgccgacccgggtagtggctgcggagatggaggaggccctccgcggactccccatccggtaccagacccccgccatccgcgcagaacatacgggccgcgaaatcgtcgatctgatgtgccacgcgaccttcaccatgcgcctcttgtcccccgtgcgggtaccgaactacaacctgatcatcatggacgaggcccactttacggaccccgcctcaatcgccgcccgcggctacatcagtacgcgcgtcgagatgggggaggcggcgggcatcttcatgacagccaccccgcccgggagccgcgacccattcccgcagagcaacgctcccatcatggatgaggagcgggagatccccgagcggagctggaattccggccacgaatgggtgaccgacttcaaggggaagacggtgtggtttgtcccgagcatcaaggcgggcaacgacattgccgcctgcctacggaaaaacggcaagaaagtgatccagctgtctcgcaaaaccttcgacagcgagtacgtgaagacacgggccaacgactgggactttgtagttaccacggatatctccgagatgggggccaacttcaaggcggagcgcgtgattgaccctcggcgctgtatgaaacctgtcatcctgaccgacggtgaggagcgggtgatcctcgccgggcccatgccagtgacccacagctcggccgctcagcgccgcggccgcatagggcgcaaccccaagaacgagaacgaccagtacatctatatgggcgagcccctggagaatgacgaggactgcgcccattggaaggaggcgaaaatgctgctcgataacatcaacaccccggagggcatcattccgagcatgttcgagcccgaacgggagaaggtcgacgctatcgacggggagtaccgcctgcggggcgaagcacgcaagacgttcgtggacctgatgcgtcgcggagacctcccagtgtggctggcataccgtgtagccgcggaaggcatcaactatgccgaccgccggtggtgcttcgacggaatcaagaacaatcagatactggaggagaacgtggaggtggagatatggaccaaggagggtgagcgaaaaaaactcaagccgcgttggcttgacgcccgcatctactccgaccccttggccctcaaagagttcaaggagttcgcggcaggccgcaagagcctgacgctaaacttgatcaccgagatggggcggctacccaccttcatgacccagaaggcccgggacgcactggacaacctcgccgtcctgcacactgcagaggccggcgggagggcatacaatcacgccttgtcagagcttcccgagacactggaaacgctgttgctgctgaccctactagctaccgtgaccggcggtattttcctattcctcatgagcggtaagggcatagggaagatgacgctgggcatgtgctgcatcatcaccgcgtccattcttctgtggtacgcccagattcagccgcactggatcgccgccagcatcattctggaatttttcctgatcgtcctcctgatccctgagcccgagaagcagcggacgccccaggacaaccagctcacctacgtcgttatcgctatcctaacagtcgtggcggctacgatggccaacgagatggggtttcttgaaaagactaagaaggacttaggcctcggctctatcactacccaggagtccgaaagcaatatcctggacatcgacctgcgtcctgcttccgcttggacgctttacgcggtggccaccaccttcgtcacacccatgctgaggcacagcatcgagaattccagcgtgaacgtatctctgacggccatcgccaatcaggcgacggtcctaatgggactgggcaaggggtggcccctgagcaagatggacataggcgtgcccctgctcgccattgggtgttacagccaggtgaaccccataaccctgaccgccgccctcctgctgcttgtcgcccactacgcgattataggaccaggtctgcaggccaaggctacgcgcgaggcccagaagcgcgccgcggccgggataatgaagaaccccaccgtagacggaatcaccgtgatcgaccttgagccgatcccgtacgaccccaagttcgagaagcaactcgggcaagtcatgctgctgatcctctgcgtgacacaggttctgatgatgagaacgacctgggccctgtgcgaggccttaaccctggccactggccctataagcacgctgtgggaggggaaccccgggcgcttttggaacacaaccatcgcggtgtctatggcaaatatcttcaggggcagctacttagctggggcaggcctgctgttctccatcatgaagaacaccacgaacacccgcagagggacaggcaacatcggagaaaccctaggggaaaaatggaagtcgcgccttaatgctctcggcaagtcggagttccagatctacaagaagtccggaatccaagaagtggacaggacgctcgccaaggagggcatcaaacgcggggagaccgaccaccacgccgtgtcccggggtagcgccaagctgcgctggttcgtcgagcggaatatggttacccccgaaggcaaggtggtcgaccttgggtgcggccgcggggggtggagctattactgtggcggccttaagaatgtgcgggaagtgaagggcctgaccaagggcgggcccgggcatgaggagcccataccaatgtccacttacggctggaacttggtcaggctccagagcggtgtggacgtattcttcaccccgcccgagaagtgcgacacgctgctgtgcgacatcggcgagtccagccccaatcctaccatcgaggctgggcggacgttacgcgttctgaaccttgtggagaactggctcaataacaacactcagttctgcataaaggtgttgaacccgtacatgccctccgtcatcgaaaaaatggagaccctgcagcggaagtacggcggagcgttggtgaggaacccactcagccggaactccacccacgagatgtactgggtaagcaacgccaccggcaatatcgtttccagcgtcaacatgatttcccgcatgttaatcaatcgattcaccatgaaacacaagaaggccacctacgagccggacgtggacctgggtagcgggacgcggaatataggcatcgaatccgagatccccaacttggacatcatcggcaagcgcatcgagaagatcaagcaggagcacgagaccagctggcactacgaccaagatcacccctataagacgtgggcctaccacgggagctacgagactaagcagaccggcagcgcctcctcgatggtcaacggcgtcgtgcggctgctgacgaagccttgggatgtcgtgccgatggtgactcaaatggccatgaccgatacgactcctttcgggcagcagagggtcttcaaggagaaagttgacacccggacccaggaaccaaaggagggcaccaaaaagctcatgaagatcaccgccgagtggctctggaaggagctggggaagaagaagaccccgcgcatgtgcactcgtgaggagtttacccgcaaggtgcggtcgaacgccgccctaggcgccatctttacagacgagaacaagtggaagtccgcgcgcgaggccgttgaggactcacggttttgggaactgattgacagagagcggaaccttcatctcgaggggaagtgcgagacgtgcgtgtacaacatgatgggcaagagagagaagaagctcggggagtttggcaaagcaaagggcagccgagccatctggtacatgtggctgggtgcacgattcctcgagttcgaagccctgggtttcctgaacgaggaccactggttcagccgggggaactccttaagcggcgttgagggggagggccttcatcgcctgggttacattttacgagacgtctccaagaaggagggcggcgccatgtacgcagatgacactgccggatgggacaccagaatcactctggaggacctgaagaacgaggagatggtgacgaaccacatgaaaggggagcacaagaagctcgcggaagcaatattcaaactgacctaccagaacaaggtagtgcgggtccaacgcccgacgcctcgcgggacggtcatggacataatctctcgacgggaccagcggggctcgggccaggtggggacctacggtctgaacacgttcacaaacatggaggcacaactcatccgccagatggagggggagggcatctttaagagcatccagcatcttacagtaacggaagaaatcgccgttcagaactggcttgcccgggtggggagagagcggctctcccgcatggcgatcagcggggacgactgtgtggtcaaacctctagatgaccggttcgcctccgccctgaccgcgctcaacgacatgggcaaggtacggaaggacatccagcaatgggagccgagccgcgggtggaatgactggacccaagtgccgttctgctcccaccatttccacgagctggtcatgaaggacggacgcgtgctggtggtcccctgccggaaccaggacgaactgatcgggcgcgcccggatcagccagggcgcgggctggtccttaaaggagaccgcgtgcctcggcaagagctacgcccagatgtggactctcatgtacttccaccgccgggacctgcgactggctgccaacgcgatctgcagcgcagtacccagccactgggtgccgacctcccggaccacttggagcatccatgccaagcacgagtggatgaccactgaggacatgctcgccgtctggaaccgtgtgtggattcaagagaacccctggatggaagacaaaacccccgtggagagctgggaggaggtcccctacctgggcaagcgcgaggaccaatggtgcgggtccttgatcggcctaacaagccgggcgacctgggccaagaacatccagacggccatcaatcaggttcgctccctgatcgggaatgaggagtacaccgactacatgcccagcatgaagcggtttagacgcgaggaggaggaggccggcgtgctctggtga

SEQ ID NO: 25186 - RNA, 9876 nt, synthetic construct
  misc_feature 1..9876: note = derived and/or modified CDS sequence (opt11) from DENV-2__EU482578__SS-prME
  source 1..9876: mol_type = other RNA
acggccggcgtgatcatcatgctgatccccaccgccatggcgttccacctcacgacccggaatggggagccacacatgatcgtcggccggcaggagaaggggaagtccctgctcttcaagaccgaggatggcgtgaatatgtgcaccctcatggccatcgatctgggggagctgtgcgaggacacaatcacctacaagtgtcccctcctccgccagaacgagcccgaggacatcgactgctggtgcaacagcactagcacctgggtgacctacgggacctgcacaaccacgggcgagcatcggcgtgagaagcggtccgtggccctggtgccccacgtcgggatgggtctcgagacccgaaccgagacctggatgagctctgagggggcctggaagcatgtgcagcggatcgagacgtggatcctgagacatccgggcttcaccatcatggccgcgatcctggcttacaccatcgggaccacccacttccagcgagccctcatcttcatcctgctgaccgctgtagcgcccagcatgactatgcgctgtatcggcatctccaaccgggacttcgtggagggcgtcagtggcggctcctgggtggacatcgtgctcgagcacgggagctgcgtcactacgatggccaagaacaagcccaccctggacttcgagttaatcaagactgaggccaagcagcccgctaccctccggaagtactgcatagaggcaaagctgacaaacaccaccaccgagagccggtgcccgacgcagggcgagcccagcctgaacgaggagcaggacaagcgctttgtctgcaagcattccatggttgaccggggctgggggaacggatgcggcctcttcggcaagggcgggatcgtgacctgcgccatgttcacgtgcaagaagaacatggagggcaaggtggtgttgccagagaatctggagtacaccatcgtcatcacgccccactccggggaagagcacgccgtgggcaacgacaccgggaagcacggcaaagagataaagataacgccgcagtccagtatcacagaagcggagctcaccgggtacggcacggtaaccatggagtgcagcccccggaccggccttgacttcaacgagatggtcctgctccagatggaggacaaggcctggctggtgcaccggcagtggttcctagacctccccttgccctggctgccgggggccgacactcagggcagcaactggatccagaaggagacactcgtaaccttcaagaacccccacgcgaagaagcaggacgtcgtggtcctggggtcccaggagggcgccatgcacaccgccctcactggtgcgacagagattcaaatgagctcaggtaacctcctcttcaccggccacttaaagtgccgcctccggatggataagctgcagctgaaagggatgtcctacagcatgtgcaccggcaaattcaagatcgtgaaagagatcgccgaaacacaacatggtacgatcgtgatacgcgtccagtacgagggggacggctccccctgcaagatccccttcgagatcatggacttagaaaagcggcacgtgctggggcgcctgatcaccgtgaacccgatcgtcaccgagaaggacagccccgtgaacatcgaggcggagccgccctttggcgactcctacatcatcatcggggtggagcctggccagctcaagctgaattggttcaagaagggcagctccatcggccagatgttcgagaccacgatgcgcggcgccaaacggatggccatcctgggggacaccgcctgggacttcggcagcctcgggggcgtctttacctccatcgggaaagccctgcaccaagtgtttggcgcgatctacggcgccgccttcagcggggtgtcctggaccatgaagatcctgataggcgtcatcatcacgtggatcggtatgaacagccgctcaacaagcctgtccgtgagcctcgtgctggtcggcgtcgtgaccctttacctcggcgccatggtccaggcggattccggctgtgtcgtgagctggaagtccaaagagctgaaatgcgggagcgggatcttcatcactgacaacgtgcacacgtggaccgagcagtacaaatttcagcccgagagcccctccaaactcgcctccgccatccagaaggcccacgaggagggcatctgcgggatccggtccgtgacccgcctcgagaatctgatgtggaagcagataacgccagagctgaaccacatcctcagcgagaacgaggtgaagttaacgatcatgaccggcgacatcaaggggatcatgcaggccggcaagcggtccctgcgcccgcagcccacggagctcaagtacagctggaagacctggggaaaggcgaagatgctgtccacggagagccacaaccagaccttcctgatcgatgggcccgagaccgcagagtgcccgaacaccaaccgggcctggaattccctcgaggtcgaagactacggcttcggggtgttcaccaccaacatctggctgaaactacgtgagaagcaggatgttttctgcgactcgaagctcatgtccgccgccataaaggacaaccgggcggtccatgccgatatgggatactggatcgagagcgccttaaacgacacctggaaaatggagaaggcctccttcatcgaagtgaagagctgccactggcccaagtcccacaccctgtggagcaatggcgtgctcgagtccgagatgataatccccaagaacttcgccgggcccgtgagccagcacaactacaggcccggctaccatacccagacggcggggccctggcatctgggcaagctcgagatggacttcgatttctgtgaggggaccaccgtggtggtcaccgaggactgcggcaacaggggtccaagcctccgcacgaccaccgcctccgggaagctgatcactgagtggtgctgccgaagctgcactctccccccgctacgctaccggggcgaggacgggtgctggtacggcatggaaattcgccccctgaaagagaaggaggagaacctggtgaactccctcgtaaccgccgggcacggccagatcgacaacttcagcctgggcgtcctggggatggccctcttcctggaggagatgttacggacccgcgtggggacgaaacatgcgatcctcctggtcgccgtctccttcgtgaccctgatcaccgggaacatgtcattccgggacctcggccgcgtgatggtcatggtcggtgcgaccatgaccgacgacatcggcatgggcgtgacgtacctggcgctgctcgccgcgttcaaggtccgccccaccttcgccgcagggctgctgctccggaagctgacatccaaagagctgatgatggccaccattggaatcgccctcctgagccagtccacgatccccgagactatcctggagctcaccgacgctctggccttgggcatgatggtgctcaagatcgttcgcaacatggaaaaataccagctggccgtcaccataatggccatcagctgcgtgccgaacgccgtgatcctgcagaacgcgtggaaggtctcttgcacgatcctcgcggcggtgagcgtcagcccgcttctcctcacctcttcccagcagaaggccgactggattcccctggcgctgaccatcaagggcctcaacccgaccgccattttcctgacgaccctgagccggacctccaagaagcgcagctggccgttaaacgaggcaatcatggccgtgggcatggtgtccatcctggccagcagtctactcaaaaacgacatcccaatgaccgggccccttgtcgctggcgggctgctcacggtctgctacgtgctgaccggacgttccgccgacctagagctcgagcgcgccgccgacgtcaagtgggaagaccaggccgagatcagcgggtccagccccatactgtccatcaccatcagcgaggacggctccatgagcatcaaaaacgaggaggaggagcagaccctgacgatcctcatccggaccggactgctggtgatcagtggggtgttcccggtcagcatcccgatcaccgctgccgcctggtacctctgggaggtgaagaagcagagggccggcgtgctgtgggacgtccccagcccgccaccagtggggaaggccgagctggaagacggagcgtaccgaatcaagcagcgcgggatcctcggctacagccagattggcgccggggtgtacaaggagggaacgttccacacaatgtggcacgtcacgcgcggggccgtgcttatgcatcgcggcaaacggatcgagccctcctgggccgacgtgaaaaaggacctgatcagctacgggggaggatggaagctcgagggggagtggaaggagggcgaagaggttcaggtgctggccctggagcccgggaagaatccccgagccgtgcagaccaagcccggcctcttcaagactaataccgggacgatcggcgccgtgtcgctggacttcagccccggcacctccgggtcacccatcgtggatcgaaaaggaaaagtggtcgggttatacggcaacggcgtggtgacccgctccggggcatacgtcagcgccatcgcgcagaccgagaaatccatcgaggataaccccgagatcgaggacgacatcttccggaaaaagcgcctgacgatcatggacctacaccccggagccgggaagaccaagcgttacctgcccgccattgtgcgcgaggccatcaagcggggcctgcgcaccctcatcctggccccgaccagagtggtcgcggccgagatggaggaggccctgagaggtctccccatcagataccaaacacccgccatccgggccgaacacaccgggcgtgagatcgtggacctgatgtgccacgcgaccttcaccatgcggctgctctccccagtgcgcgtaccaaactacaacctgatcattatggatgaggcccatttcacggaccccgccagcatcgccgcccggggctacatctccacccgcgtggagatgggggaggcggccggcatcttcatgaccgccacaccgcccgggagccgggacccttttccccagtccaacgcccccatcatggacgaggagcgcgagatccccgagcggagctggaattccggccacgagtgggtgacggacttcaagggcaagaccgtctggttcgtgccgagcatcaaggcgggaaacgatatcgccgcctgcttgcgcaagaacggcaagaaggtgattcagctctcccggaagaccttcgacagcgagtatgtcaagactcgcgccaacgactgggacttcgtggtgacgaccgacatctccgagatgggggccaacttcaaagcggagcgagtcattgacccccgccggtgcatgaaaccagtgattctgaccgacggcgaggagcgcgtgatcctggccgggcccatgccggtcacccacagctccgccgcccagaggcgcggccgcataggtcggaacccgaagaacgagaacgaccagtacatctatatgggcgaaccactcgagaacgacgaggactgcgcccactggaaggaggcgaagatgctgctggacaacatcaacacacccgagggcataatcccgtcgatgttcgagcctgagcgggagaaggtggacgcaatcgacggggagtaccggctccgcggcgaggcccggaagaccttcgtggatctaatgcgccgtggggacctccccgtatggctcgcttaccgtgtcgccgcggagggaataaactacgcagaccggagatggtgcttcgatgggatcaagaacaaccagatcctggaggagaacgtggaggtagagatctggaccaaggagggagagaggaagaagctgaagccgcgctggctcgacgcccggatctactccgaccccctggccctgaaggagttcaaggagtttgctgccggaaggaagagcctcaccctgaacctgatcacggagatggggcggctccccaccttcatgacccagaaggcccgcgacgctctggacaacctggccgtgttgcacacggccgaggctggtgggcgggcctacaatcacgctctgtccgagctgcccgagacgctggagaccctgctcctcctgaccctgctcgccaccgtaactggcggcatcttcctgttcctgatgagcgggaagggcatagggaagatgaccctcggcatgtgctgcatcatcacggcgagtatcctgctgtggtacgcccagatccagccacactggatcgcggccagcatcatcctcgagttcttcctgattgtgctgctcatccccgagcccgagaagcaacgcacgccccaggataaccagctgacctacgtggtcatcgccattctgaccgtggtggcggccaccatggcaaacgagatggggttcctcgagaaaacgaagaaggacctgggcctgggcagcattacaacccaggagtccgaaagcaacattctcgacatagatctgagaccggcctccgcctggaccctgtacgctgtggctaccaccttcgtgacacccatgctccgacacagcatcgaaaactccagcgtgaacgtatccctgaccgctatcgccaaccaggcgaccgtgctgatgggtctgggcaaggggtggccactgagcaagatggacatcggcgtgcccctgctcgccatcgggtgctactcccaggtcaatccgatcaccctgacggctgccctgctcctgctagtggcccactatgcgatcatcggccccggcctccaggccaaggccactcgtgaggcccagaagcgcgccgccgccggtatcatgaagaaccccacggtcgacggcatcaccgttatcgacctggagcccataccgtacgaccccaagttcgagaagcagctggggcaggtcatgctcctgatcctgtgcgtgactcaggtcctcatgatgcgaaccacgtgggccctgtgcgaggccctgaccctcgccacgggccccatcagcaccctatgggaggggaaccccggcaggttctggaacactaccatcgcagtgtcaatggccaacatcttccgaggcagctacttagcgggggccggcctcttgttctccatcatgaagaacacgaccaacacccgacgcgggaccggcaacatcggcgagacgctgggggagaagtggaagtcccggctcaacgcgctggggaagtccgagtttcaaatatacaagaagtccgggatccaggaggtggaccgcaccctggccaaagagggcatcaaacgcggggagaccgaccaccacgctgtcagtcgcggcagcgccaagctccggtggttcgtggagcggaacatggtaaccccggagggcaaggtcgtggacctggggtgcggccgcggagggtggtcctattactgtggcgggctgaaaaacgtcagagaggtcaaggggctcacgaagggcgggcccgggcacgaggagcccattcccatgagcacctacggctggaacctggtgcggctgcagagcggggtggacgtctttttcaccccgcccgagaagtgcgacaccctcctgtgcgacatcggcgagtccagtcccaacccgacgatcgaggccggccgcaccctgcgggtgctcaacctggtggaaaattggctgaacaacaacacccagttctgcatcaaggtactcaacccgtatatgccctccgtcatcgagaagatggagaccctgcagcgcaagtacgggggcgcgctggtgcgaaaccccctgagccgcaactccacccacgagatgtactgggtcagcaacgccacggggaacattgtgagcagcgtgaacatgatatcccggatgctcatcaaccgctttaccatgaagcacaagaaggccacctacgagccggacgtagacctgggcagcggcactcgcaatataggcatcgagtccgagatcccaaacctggacatcattggcaaacggatcgagaagatcaagcaggagcacgagacgagctggcactacgaccaggaccacccctacaagacctgggcctaccacgggtcctacgagaccaagcagaccggcagcgccagcagcatggtgaacggggtagtccgccttctgacgaagccctgggacgtggtgcctatggtcacccagatggcgatgaccgacaccacgcccttcggccagcagcgggtcttcaaggagaaggtagacacccgcacccaggaacctaaggaaggcacgaagaagctgatgaagatcacggccgagtggttatggaaggagctggggaagaagaaaaccccccggatgtgcacccgtgaggagttcacccggaaggtccgttctaacgcggccctcggcgccatcttcacggacgagaacaagtggaagtccgcgcgggaggcggtagaggacagtcgcttctgggagctcatcgaccgagagcgcaacctgcacctggaggggaagtgtgagacctgcgtgtacaatatgatgggcaagcgtgagaagaagctcggggaattcggcaaggccaagggcagccgcgccatctggtatatgtggctgggggcgcggttcctggagtttgaagccctcggtttcctcaacgaggaccactggttcagccgcgggaactcccttagcggcgtcgagggggagggcctccaccggctgggctacatcctgagggacgtgtccaagaaggagggaggggccatgtatgccgacgacaccgccgggtgggatacgaggataactctcgaggacctcaagaacgaggagatggttaccaaccacatgaaaggcgaacacaagaagttggcggaggcgattttcaagctcacctaccagaacaaagtggtgcgcgtccagaggcccacgccccgtggaacggtaatggacatcatcagccgccgggaccagcgcggatccgggcaggtggggacctacggcctcaacaccttcaccaacatggaggctcagctgatccggcagatggagggggagggcatcttcaagagcattcagcacctcacggtcactgaggaaatcgccgtgcagaactggctggcccgcgtgggccgggagcgcctgtcccggatggcgatctcgggggacgactgcgtcgtgaagcccctcgacgaccgcttcgcctcagccctaaccgccctgaacgatatgggcaaggtgcggaaagacatccagcagtgggagcccagccgggggtggaacgactggacccaggtaccattctgctcccaccacttccacgagctcgttatgaaagacggccgcgtgctggtcgtcccctgccggaaccaggatgagctgatcgggcgagcccggattagccagggcgccggctggtccctaaaggaaacggcatgcctgggcaagagctatgcccagatgtggaccctaatgtactttcatcggcgcgacctccggctggccgccaacgcaatctgctccgccgtgcccagccactgggtccccactagtcggactacctggagcatccacgccaagcacgagtggatgactaccgaggacatgttagcggtgtggaaccgggtgtggatccaggagaatccgtggatggaggacaagacccccgtggagagttgggaggaggtgccgtatctcggcaagcgcgaggaccagtggtgcgggagtctgatcggcctcacctctcgcgcgacgtgggccaagaacatccagaccgctatcaaccaggtgaggtccctcatcgggaacgaagagtacaccgactacatgcccagcatgaagcgatttcggcgcgaggaggaagaggccggcgtcctgtggtga

SEQ ID NO: 25187 - RNA, 9876 nt, synthetic construct
  misc_feature 1..9876: note = derived and/or modified CDS sequence (opt11) from DENV-2__EU482580__SS-prME
  source 1..9876: mol_type = other RNA
accgccggcgtgatcatcatgcttatccctaccgcgatggcatttcacttaaccacccggaacggcgaaccccatatgattgtagggcggcaggaaaagggtaagtctctactcttcaagaccgaggatggcgtaaacatgtgcaccctgatggccatggacctgggggagttatgcgaggacacgatcacctataagtgcccactgctgagacagaatgagcccgaggatatcgactgttggtgcaacagcacctcaacctgggtgacctacgggacttgtacaacaacaggagagcaccggcgggaaaaacggagcgtcgccttagtgccccatgtagggatgggcctcgagaccaggaccgagacctggatgtcctccgagggcgcctggaagcacgtccagcggatcgagacttggatcctgcgccaccccgggtttacgatcatggcagcgatcctggcgtacaccatcggaaccacgcatttccaacgagccctcattttcatccttctgaccgccgtggcgccctcgatgaccatgcggtgtattggcatctccaaccgagacttcgtggagggcgtgagcgggggctcatgggtggacatagtgctcgagcatgggtcttgcgtcacaacgatggccaagaacaagcccaccctggacttcgaactgatcaagaccgaggccaagcagccggccaccctccgcaaatactgcatcgaggctaaactgacgaacaccaccaccgaaagtcggtgcccgacgcaaggggagcccagtctgaacgaggaacaagacaaacggttcctctgcaaacactcgatggtggaccgcggctggggcaatggctgtgggttgttcgggaagggaggtatagtaacctgcgcgatgtttacgtgcaagaagaacatggagggaaaggtcgtgcagcccgaaaacctcgagtacaccatcgtgatcacgccccacagcggggaagaacacgccgttggcaacgacactgggaagcacggcaaggagatcaagatcacgccgcaatcctcaatcaccgaggccgaattaacgggctacggcacggtgacaatggagtgttctccccggaccggcctggactttaacgagatggtgcttctgcagatggaggacaaggcctggcttgtccatcggcagtggttcctggacctcccgcttccctggctgccgggggccgacactcagggcagcaactggatccagaaggagacgctcgtgaccttcaagaatccccacgccaagaagcaggatgtcgtcgtcctggggtcccaagagggagccatgcataccgctctgactggggccaccgagattcaaatgagcagcggtaacctcctgttcaccggccacttaaagtgtaggcttcgaatggataagctgcagttgaaggggatgtcctactcaatgtgcaccgggaagttcaagattgtgaaggagattgcagaaacccagcatggaacgatcgtgatcagggtacaatacgagggcgacggttccccctgcaagataccgttcgagatcatggacctcgaaaagcggcatgtcctgggtcgtctgatcactgtgaatcccattgtgaccgagaaggacagcccggtcaacatcgaggcggagccgcccttcggtgattcctatattatcatcggggtggagccgggccagctcaagctgaattggttcaagaaagggagctctatcggccaaatgttcgagaccacaatgagaggcgccaaacggatggccatcttgggggacaccgcctgggacttcggtagcctagggggtgtgtttacctccatcggcaaggccctgcaccaggtcttcggcgcaatttatggcgccgccttcagcggggtgtcttggaccatgaaaatctttataggcgttatcataacttggatcggcatgaacagccgctccactagcctgtccgtcagcctggtgctcgtgggcgtcgtcacgctgtacctcggcgccatggtgcaggccgactccggctgcgtagtgtcatggaagaacaaggagctcaagtgtggatccgggatcttcataacggacaacgttcatacgtggactgagcagtacaagttccagcccgaaagccccagcaagctcgcctccgctatccaaaaggcccatgaggagggcatctgtggcatccgaagcgtaacgcgcttggagaacctcatgtggaagcaaattacccctgagctgaaccacatcctgtctgaaaatgaggtgaagctgactatcatgaccggagacatcaaaggtatcatgcaggccggtaagcggtctctgcgcccccagcccaccgagctgaagtattcctggaaaacgtggggaaaggcgaagatgctcagcacggagtcccacaaccaaaccttcctgatcgacggacccgagacggccgagtgtcccaatacaaatcgggcctggaatagcctggaggtggaggactacggcttcggggtcttcacgaccaatatatggctcaaattacgcgagaagcaagatgttttctgcgactccaaactgatgagcgccgccatcaaggacaaccgggcggtccacgcggacatggggtactggatcgagtccgccctcaacgacacatggaagatggagaaggccagcttcatcgaagtcaagtcctgccactggcccaagagccataccctgtggtcaaacggcgtgctggagagcgaaatgatcatccccaaaaatttcgccgggccggtgtcacaacacaactaccgcccgggctaccatacccagacggcggggccatggcacctcggcaagctagagatggacttcgacttttgtgaggggaccaccgtcgtcgtgaccgaggactgcggcaaccggggccccagccttagaaccaccacggccagcggaaagctcatcaccgagtggtgctgccggtcctgtacgctgccaccactgcgctatcgcggcgaggacgggtgctggtacggcatggagatccgccccctcaaggagaaggaagagaatctggtcaacagcctggttaccgccgggcacggccagatagacaacttctcgctgggcgtgctgggtatggccttattcctggaagagatgctgcggacccgcgttggtaccaagcacgcgatcctgctcgtggccgtgagcttcgttacgctgataaccggtaacatgtccttccgggacctgggccgcgtgatggtgatggtcggggccaccatgactgacgacatcggcatgggtgttacgtacctagcccttctggcggcgttcaaggtgcgtccaaccttcgccgctggacttcttctgaggaagctcaccagcaaggagctaatgatggcaaccataggcatagccctgctctcccagagcaccatccccgagaccatccttgagctgaccgacgcgctcgccctggggatgatggtcctgaaaatcgtgagaaatatggagaagtaccagctagccgttaccatcatggccatctcatgcgtcccgaacgctgtgatccttcagaacgcgtggaaggtgagctgcacaatcctggccgccgtctcagtaagtcccctactgttaaccagctctcagcagaaggccgactggatcccattggccctgacgattaagggactgaaccccacagcaatcttcctcaccaccctgagccggaccagcaaaaagcgctcctggccgctgaacgaggcgattatggccgtcggcatggtgagcatcctcgcgtctagcctgctgaagaacgacatccccatgaccgggcccctcgtggctggagggttactgacggtgtgctatgtccttacaggaagaagcgccgacctggaactggaacgcgccgcagatgtgaaatgggaagaccaagccgagatatccgggagctcccccatcttatcaatcactatctccgaggacggatcgatgagtatcaagaacgaggaggaggagcagaccctgacgatcctgatccggacagggctcctagtcatttcgggggtgttcccagtgtccatacccatcacagcggccgcatggtacctgtgggaggtaaagaaacagcgcgcaggagtgctctgggacgtgccctcaccgccgcccgtcggtaaagccgagctggaagacggtgcctaccggatcaaacagcgcgggatcttgggttactcccagatcggcgccggagtgtataaggaaggaaccttccataccatgtggcacgtgacacgcggtgccgtactcatgcaccgcggcaagcggatcgagcctagctgggccgacgtcaagaaagaccttatctcctatgggggcgggtggaagctggagggggagtggaaggagggcgaggaggtgcaagtgctcgccctggagcccggaaagaaccctcgagcagtgcagaccaagcccgggctgttcaaaaccaataccgggacgataggagccgtcagcctcgacttctccccagggaccagcgggtcccccatcgtagatcggaagggtaaggttgtcgggttatacggtaacggcgtcgtgacacgcagcggagcgtacgtttccgccatcgcgcaaaccgaaaagagcatcgaggacaaccccgagatcgaggacgacattttccggaagaaacgcctgacgatcatggacttacatccaggtgccgggaagaccaagagatacctgccggcaatcgtccgcgaggccataaagcgggggctgcgcaccctgatactcgcacctacacgcgttgtggcggccgagatggaggaggctctgcgggggctgcccatccgttaccaaacgcccgccatccgggctgagcacaccggacgcgagatcgtcgacctcatgtgccatgcgacatttacgatgagactgctgagccccgtgagggttccgaactacaacctcatcataatggatgaggcacactttacggatcccgccagcatcgccgcccggggctacatcagcacgcgcgttgagatgggggaagctgccggcatcttcatgaccgccaccccgcccggttctcgggatccgtttccccagtcgaacgctccaatcatggacgaagaacgcgagattcccgaacggtcctggaacagcggccacgagtgggtaaccgacttcaagggtaaaaccgtgtggttcgtcccgtctatcaaggcaggaaacgacatcgctgcatgcttacgcaagaacgggaagaaggttatccagctgtcccggaaaaccttcgactctgagtacgtgaagacacgggccaacgactgggactttgtcgtaacgaccgatatcagtgaaatgggggccaacttcaaagcggagcgggtgatagacccccgccgttgtatgaaaccggtcattctcaccgatggcgaggagcgggttatcctggctggtcccatgccggttacccacagcagcgccgcccagcggagggggcggatcgggcgtaatcccaagaacgagaacgatcagtatatctacatgggagagccactggagaatgatgaagactgcgcacactggaaggaggctaagatgctcctggacaacatcaacacacccgagggcataatcccgtcgatgttcgagcccgagagagagaaggtcgacgcaatagacggggagtatcgattgagaggagaggccaggaagaccttcgtggacttaatgcgccgcggggatctcccagtttggctggcctatagagtagcagcggagggcattaactacgcggaccggagatggtgcttcgacgggatcaaaaacaaccagatactagaggagaatgtagaagtggagatctggaccaaggagggcgagcggaagaagctgaagcctcgttggctggatgcccggatctacagcgaccccctcgctctaaaagagttcaaagagttcgcggcaggccgcaagtccctgaccctcaacctgatcacggagatggggcggctgcccaccttcatgacccagaaggcccgcgacgcattggacaacctagctgtactgcataccgcggaagcaggagggaaggcctacaaccacgcccttagcgagctacccgagacgctggagacacttctcctactcaccctgttggccaccgtgaccggcggcatctttctcttcctgatgtccggaaaaggcatcggtaagatgaccctgggcatgtgctgcatcatcactgcgagcattctactgtggtacgcacaaatccaacctcactggatcgcggcatccatcatcctagagttctttctgatagtcctgctaatcccggagcccgaaaagcagcggacgccccaagacaatcaactcacatacgtggtgatcgccattttgacggtagtggcggcaaccatggcaaatgaaatggggttcctggagaagactaagaaggacttggggctgggcagcatcaccactcaggaatctgaaagcaatatcctagacatcgacttgaggcccgccagtgcgtggaccctgtacgcggtggccactaccttcgtaacgccaatgctgcggcacagcattgagaatagctccgtgaacgtaagtctcactgcgatcgccaatcaggctaccgtactgatggggctgggcaagggttggcccctctccaagatggacataggcgtgcctctgctggcaatcggatgctacagccaggtgaacccgatcaccctcacggccgcactgctgctcctggtagcccactacgctatcattggccccggactccaggccaaggccactcgtgaggctcagaaacgggccgcggccggaatcatgaagaacccgacggtcgacggcatcacagtcatcgacctcgagcccatcccgtacgaccccaagttcgaaaagcagttagggcaggtcatgctgctcattctgtgcgtgacccaagtcctgatgatgcgtaccacctgggcattgtgtgaggccctgaccctggccactggccccatctcaaccctctgggaagggaaccccggccgcttctggaacaccaccatcgccgtgagcatggccaacattttccggggttcctaccttgccggggcaggcctcctgttcagtatcatgaagaacacaacaaacacccgccggggaaccggcaacatcggcgagacgcttggggagaagtggaagtcccgcctgaacgcgctaggcaagagcgagtttcagatctacaagaagtcggggatccaggaggtggaccgcaccctggccaaggaaggcatcaagcgcggggaaaccgaccaccacgccgtgagccggggctcggctaagctgaggtggttcgtcgagcgtaacatggtcacaccggagggcaaggtggtagacctcgggtgcggccgcggaggctggtcgtactactgtggcggcttgaaaaatgtgcgagaggttaagggcctgacgaaaggcggacccggacacgaggagcccatccccatgagtacctacggctggaacctcgtgcgcctgcagagcggggtggacgtgtttttcacaccgcccgagaaatgcgacaccctgctctgcgacatcggcgagtcttcccccaacccgactatcgaagcaggacggaccctgcgcgtcctaaacttggttgagaactggctgaacaacaacacccagttctgcatcaaggtcctgaacccctacatgccctcagtcatagagaagatggagacactccagcggaaatacggcggcgcgctggtgagaaacccactgtcgcgtaactcaacgcatgagatgtactgggttagtaatgccactgggaacatcgtcagctcagttaacatgatcagccgcatgctcatcaaccggttcaccatgaagcacaagaaggccacctacgagccggatgtggacttgggtagtgggacccgcaacatcggcatcgagtcagagatccccaacctggacataataggcaagcgcatcgaaaagataaagcaggagcacgagacatcctggcactacgaccaggatcatccctacaagacgtgggcttaccacgggagctacgaaacaaagcagaccggctccgccagttccatggtaaacggggtggtacggctgcttacaaaaccctgggacgtcgtgccaatggtaacacagatggctatgacggataccacgcccttcgggcaacaacgcgtttttaaggagaaggtggacacccgaacccaggaacccaaggagggcaccaagaagctgatgaagatcacagctgagtggctgtggaaggagcttgggaagaagaagacgcctcggatgtgcacccgggaagagttcacccgcaaagtacgtagcaacgccgccttaggtgccatctttacggacgaaaataaatggaagtccgcgcgcgaggcagtcgaagactccagattctgggagctcgtggaccgcgagcgtaacctccacctggaggggaagtgcgagacctgtgtgtacaacatgatgggcaaacgcgagaagaagctgggtgagttcggaaaggccaaaggctccagagccatttggtacatgtggctcggcgcgcgcttcctggagttcgaggcactcggctttctcaatgaggaccattggttctccagagggaatagcctctccggcgtcgagggggagggtctgcaccgactcggatacatcttgcgggatgtctccaagaaggagggcggcgctatgtacgccgacgacaccgccgggtgggacacccgtatcacgctggaggatctaaagaacgaggagatggtcaccaaccacatgaagggcgagcacaagaagctggcggaggctatcttcaagctaacgtatcagaacaaggtggtgcgggtgcagcgaccgacgccccggggcacagttatggatatcatctctcgacgcgaccagcggggcagcggccaggtggggacttatggcctaaacaccttcaccaacatggaggcccagctgatccgccagatggagggggagggcatcttcaaatccatccagcatctgactgtcaccgaggagatcgccgtgcagaactggctagcccgggtggggcgcgagcggctttctcgcatggcaatctcaggagacgactgcgtagtgaaacccctggacgaccgcttcgccagcgccctcaccgccctgaatgacatgggcaaagtgaggaaggacatccagcagtgggagccctcccggggttggaatgactggacccaggtcccgttttgtagccaccacttccatgagctggtcatgaaggatgggagggtgttggtcgtaccgtgccgaaaccaggatgagctgatcgggcgggctcggatctcccagggcgcgggatggagcctgaaggaaacggcctgcttggggaagtcctacgcccaaatgtggactttgatgtacttccaccgacgcgacctgcgcctcgcagccaacgccatttgctccgcagttccatcacactgggttcccacctctcggaccacctggtccatccatgccaagcatgagtggatgactacagaagacatgctggccgtgtggaacagagtgtggatccaggagaacccctggatggaggacaagaccccagttgaatcatgggaggaagtgccgtacctcggtaagcgggaggaccagtggtgtgggagcctcatcggcctcacatcccgcgcaacgtgggccaagaacattcagaccgccatcaaccaggtgcgcagcctgatcgggaacgaggaatataccgactacatgccgtctatgaagaggttccgacgggaggaagaggaggccggggtgctctggtaa

SEQ ID NO: 25188 - RNA, 9876 nt, synthetic construct
  misc_feature 1..9876: note = derived and/or modified CDS sequence (opt11) from DENV-2__EU482581__SS-prME
  source 1..9876: mol_type = other RNA
acggcgggggttatcataatgctgataccgaccgcgatggcatttcacttaaccacacgcaacggagaaccccacatgatagttgggcgccaggaaaaaggaaagagcttactattcaaaaccgaagacggagtgaacatgtgcactctgatggcaatagacctaggcgaactgtgtgaagacacgattacatacaaatgccccctactaaggcaaaatgaacccgaagacatagactgctggtgtaatagtacatccacctgggtgacgtatggaacctgtacgacaacaggcgaacaccggcgggaaaagcgaagcgtggctttagtacctcacgtgggcatgggactagaaacgcgtactgaaacatggatgtccagtgagggggcatggaaacacgttcagcggattgagacatggatactaaggcatcccgggtttacgatcatggcagctattttagcatacacgattgggacaacacacttccaacgggcactgatcttcatcttacttacagccgtagctcccagtatgaccatgcgctgtattggcatatcgaatcgcgactttgtagaaggtgtaagcggagggtcttgggttgacatcgtactggaacacggctcatgcgtaactacaatggcgaaaaacaaacccacactggacttcgaactaataaaaacggaagcaaaacagccagccacattacgaaaatactgcatagaagccaaacttacgaatacaactacagaatcccggtgccccactcaaggagaacctagcctaaacgaagaacaggataaaaggttcgtgtgcaaacatagcatggtagaccgcggatggggtaacggatgcggactatttggtaaaggaggcatagtgacatgcgcaatgtttacctgcaagaaaaatatggaaggcaaagtcgtcctaccagaaaacctggaatacaccattgttattacaccccacagtggcgaggaacatgcagtaggcaatgacacaggaaaacatggaaaagaaataaagatcacaccgcagtccagtataaccgaggcagagttaactggatacggcacagtaaccatggaatgcagcccacgtaccgggctagattttaacgagatggttctgcttcaaatggaagataaggcctggttagtgcaccgacaatggtttttagacctgccattaccatggctaccaggtgcagatacccaggggtcaaattggatccagaaagaaacgctggtcacgtttaaaaacccacacgcaaagaaacaagacgtagtcgttctcggatctcaggaaggcgcaatgcacacagccctcaccggagcaactgaaatccaaatgtcatccggaaaccttctttttaccggacacctaaagtgccgattacgaatggataaactccagctgaaagggatgagctactccatgtgcacgggcaagttcaagatcgtcaaggaaatcgccgaaacacagcacggaacgattgttattagggtacagtatgaaggtgacggctcaccctgcaagattccattcgagatcatggatctcgaaaagcggcatgtactgggcagactgattaccgtgaacccgatagtaaccggaaaggactctccagtcaacattgaggcggagccacccttcggcgacagctatataatcataggcgtagagccagggcaattaaagctaaactggttcaagaaaggtagctctatagggcaaatgttcgaaacaaccatgcggggagccaagcgaatggcgatcttgggcgacacagcttgggactttgggtccctcggcggcgtattcacctcgataggaaaagcgctacaccaagtattcggcgcgatatacggggccgcgttcagcggggtaagctggaccatgaagatactaattggtgttataatcacctggataggaatgaactcaaggtcgacgtcattgagcgtgagcctagtcctagtaggagttgtcacgctatacttaggcgccatggtgcaagcggactcgggttgcgtggtaagctggaaaagcaaagaactgaagtgcggatcaggaatcttcatcaccgacaacgtacacacatggacagagcaatacaagttccaacccgaatccccgtcgaaactagcctcggccatacaaaaagcacacgaggaaggaatatgcggaatccggtctgtaacacgcctcgagaatctgatgtggaagcagatcacacccgagctaaaccacatcctcagcgagaacgaagtaaagctgaccataatgacgggtgatataaaaggcataatgcaggcaggcaagcggagcttacgcccgcaaccaaccgaactgaagtactcctggaaaacgtggggaaaagcaaaaatgctatcaacggagtcccacaatcagactttcctcatcgacggccctgagaccgccgaatgtccaaacactaatcgggcttggaacagcctcgaggtcgaggactacggctttggcgttttcacgaccaacatatggctcaaactaagggaaaagcaagacgtcttctgcgactccaaactaatgtcagccgcaatcaaggataatcgagccgtacacgcggacatggggtactggatagaatcggccctaaatgacacgtggaaaatggaaaaggcgagctttatagaagtaaagagttgtcattggccaaaaagccacacactatggagcaatggagtactggagagcgaaatgatcattccaaagaatttcgctggaccggtatcccagcacaactatcgaccaggataccacacacaaacggccggcccatggcatctaggaaaactcgaaatggatttcgacttttgcgaaggtaccaccgtagtagtaaccgaagactgcggaaaccgcggcccctcactgcggaccaccacggcctcaggtaaattaatcaccgaatggtgctgtagatcatgcacactcccacccttgcgatatcgaggagaagacgggtgctggtacgggatggagatacggccactgaaagaaaaggaagaaaacctcgtgaacagcctggttacggcaggacacggccagatagacaatttctcactgggcgtcctaggaatggcgctgttcctcgaggaaatgttgcgaactagagtaggcacgaaacacgcaattctcttagtagcagtttcgttcgtcacgcttatcaccggaaatatgagttttcgagaccttggccgcgtcatggtcatggtgggtgcaactatgacggatgacatcggaatgggtgtaacctacctagctctcctcgccgcctttaaggtaagacccacattcgccgccggccttctgttaagaaagctaaccagcaaagagctcatgatggcaacgataggcatagcgctattaagtcaaagcaccatccccgaaacgatcctagaactcaccgacgccctagcgctgggaatgatggtcctaaaaatcgtgcggaacatggaaaaataccaactagcggtcacgatcatggcaatctcctgtgtacccaacgcagtcatactccaaaacgcttggaaggtatcttgcacaatcctagccgcggtcagtgtatcgccgctccttctaacgtcctcacaacaaaaggccgactggatccccctagccctaaccataaaaggcctaaatccaaccgcaatctttctcaccacacttagtcgaacaagcaagaaacggagctggcccctcaatgaagccataatggcagtgggaatggttagcatactcgcatcatcgctcctcaaaaatgatatcccgatgaccggacccctggtagcgggcgggctcctaaccgtatgctacgtgctgacaggacgatctgcggacctggagttagaacgtgccgcagacgtgaagtgggaggaccaagcagaaatatcggggagttcccccatactatcaatcacgatatccgaagacggatctatgagcatcaaaaacgaagaagaggagcagacccttacaatactaatacgtactggactcctggtcatatcgggggtatttcccgtcagcatacccatcactgcagccgcctggtacttatgggaagtgaagaaacaacgcgccggcgtcctttgggacgtccccagcccgccacccgtggggaaagccgagttagaggacggtgcataccggataaagcaacgcggcatcctaggctactcacagataggagccggtgtttacaaggaaggcaccttccacacgatgtggcacgtgacccgaggtgcggtcctcatgcaccgggggaagagaatcgagccatcctgggcagacgtcaagaaagatctaataagctacggcggcgggtggaagttagaaggggaatggaaagaaggcgaagaagtgcaagtcctagcactagaaccagggaaaaatccccgagcagtacagacaaaaccgggactctttaaaacgaacaccggaacaataggggcagtctctctagactttagccccggcacttcgggctccccaatcgttgaccgaaaagggaaagtagtaggcctctacggtaacggagtcgtcacgcgaagcggcgcatacgtctctgccatagcacaaacagaaaagagcatcgaggacaatcccgaaatagaagatgacatctttaggaagaaacgcctgacaatcatggaccttcatccaggagcagggaaaacgaaaagatacctaccggctatcgtgagagaggctatcaaacgaggactccgcaccctgatcctggcacctacccgcgtagtggctgctgagatggaagaagcgttacgaggattgcctattcggtatcagactccagccatccgggccgagcacacaggcagagaaatcgtagacttaatgtgccacgcaacgttcaccatgcgcctcctctcccctgtgcgggtgccgaactacaacctcatcataatggacgaagctcacttcaccgacccggccagtatcgcggcacgaggctacatatcaacccgcgtcgaaatgggtgaggctgcgggcatcttcatgacagccacgccacccggctccagagatccattcccacaaagcaacgcaccgatcatggacgaggaaagggaaattccggagcgcagctggaactcaggccacgagtgggtgaccgacttcaaagggaagacggtgtggtttgtgccctcaattaaggccggaaatgacatcgcggcgtgcctcaggaaaaacggcaagaaagtcatacaattatcacgaaaaacattcgacagcgaatacgtcaaaacccgagcaaacgactgggattttgtcgtcaccacagacatcagtgagatgggtgccaactttaaggccgaacgcgtcatcgatccgcgccggtgcatgaaaccagttatcctgacggatggagaagaaagggtaatactcgccggcccaatgcctgtaacgcattcctcagcagcccagcgccgcgggagaatcggacgcaaccccaaaaacgaaaacgaccaatacatctacatgggcgagcccctcgaaaacgatgaagactgcgcccactggaaagaggcaaaaatgctgctagacaatataaacaccccagaagggataatcccttcaatgttcgagccagagcgcgagaaagtagacgcgatagacggagaataccgactccgtggagaagcccgcaagacattcgtggacttaatgcgcagaggggacctccctgtatggctagcctacagagtagcagctgaagggataaactacgcagaccggcggtggtgcttcgacggcatcaaaaacaaccaaatacttgaagaaaacgtcgaagtcgaaatatggacaaaagaaggggagaggaagaaacttaaaccgcgttggctcgacgcacgcatttatagcgatcccctcgccctcaaggagttcaaggaatttgctgccggaaggaagtccctaacattgaaccttatcactgagatgggacgcctcccaaccttcatgacacaaaaggcacgcgacgcgctagacaatctggctgtactgcacacggcagaagccgggggccgagcgtacaatcacgccctatccgagctcccggagacactagagacactgttactgttgaccctattagccactgttaccgggggcatattcctgttcctaatgtctggcaagggcatcgggaaaatgacccttgggatgtgctgcattatcacagcatccatactactctggtacgcacagatacaacctcattggatagcggcctcgatcatactggagttcttcctgattgtacttttgatcccagaacccgaaaaacagcgcactccacaggacaatcagttaacctacgtcgtcattgcgatactgacagtcgtcgcggcaaccatggccaacgagatggggtttctggaaaagaccaagaaagacctaggtcttggcagtataacaacgcaagaatccgagtcaaacatactagacatcgacttacggccggcctcggcgtggactctatacgccgtagccaccaccttcgtaacaccaatgctgcgtcactccatagagaatagcagtgtaaacgtctcactaaccgcaatagcgaaccaagcaacagtgctgatgggactggggaaaggctggccgctgtccaaaatggacataggggtacccttactagccataggttgctacagccaagtaaatcctataacactaaccgcagctctcctactcctagtggcccattacgccatcattgggcccggactccaagccaaagctacacgggaagcgcaaaaacgcgccgcagctggtattatgaaaaacccgactgtggacggcattaccgtcatcgacttagaacctataccgtacgatccgaaattcgagaaacagcttggccaggtaatgctcctaatcctctgcgtgacacaagtgctcatgatgcgcacaacatgggccctttgcgaggccctaacattagctacgggtcccatatccacattgtgggaaggaaaccccggtagattttggaacacaactatagcagtcagcatggctaacatcttccgaggaagctatctcgcgggggcggggctcttgtttagcattatgaaaaatactaccaacacacggagggggacaggcaacataggggaaacgcttggagaaaaatggaagtcacgcctcaacgcattaggcaaatccgagttccaaatctataagaaatccggtatacaggaagtcgacaggacccttgccaaagaggggattaaaagaggggaaacggaccaccatgccgtttcgagaggcagcgccaaactacgctggttcgtagaaaggaacatggtcaccccagaaggaaaagtggtagacctaggatgcggacgcggcggatggtcctactactgcggaggactgaagaacgtaagggaagtaaagggcctgactaagggaggccccggccacgaagaacccatccctatgtcgacgtacgggtggaacctcgttaggctacaatcgggcgtagatgtgttctttactccacccgaaaaatgtgacaccctactctgtgacattggcgaaagcagcccaaatccgaccatagaagcaggacgaaccctacgggtcctaaatcttgtagaaaattggctgaacaacaacacgcaattctgtataaaggtactgaatccctacatgccaagcgttatagagaaaatggaaacgctgcaacggaagtacggcggcgcattagttcgaaaccccctaagcagaaacagcacccacgagatgtactgggtctcgaatgccactggcaacatcgtttcgagcgtaaatatgatctcccgcatgctcataaacaggttcaccatgaagcacaagaaagccacctacgaacccgatgtagacctaggatccggcacacgaaacatcggaatcgaaagcgaaattcctaatcttgacataataggcaagcgcatagaaaagatcaaacaagagcatgaaacgtcctggcactacgatcaggaccacccttacaaaacctgggcataccatgggagctatgaaacaaagcaaacgggctcggcctcctctatggtcaacggagttgtacgactactgacgaaaccctgggacgtagtccccatggttacccagatggctatgaccgacaccaccccctttggacaacaaagagtatttaaagagaaggtcgacactcgaacccaggaaccgaaagagggaactaaaaagctcatgaagataacagccgaatggctctggaaggaactggggaagaagaaaacacctcgcatgtgcaccagagaggagttcacacgcaaagtcagaagcaatgcggctttaggtgccattttcacggatgaaaacaagtggaaaagtgcacgagaggccgtggaagacagcagattttgggaactaatagaccgggagcgcaatcttcacctcgagggaaagtgcgaaacgtgcgtgtataacatgatggggaaacgggagaagaaactgggagagtttggaaaagcaaaagggtctcgggcgatctggtacatgtggcttggcgcgcgcttcctagagtttgaagccctaggattcctcaacgaagaccattggttttcacggggaaacagtctgtcaggcgtcgaaggagagggactacaccgactcggatacatactccgtgatgtcagcaagaaagaaggaggggccatgtacgcggacgataccgctgggtgggacacaaggattacactcgaggacctcaaaaacgaagaaatggtcacgaaccacatgaaaggagagcacaagaagctagccgaggcgatatttaagttgacctaccaaaacaaggttgtacgagtccagcgaccgacaccccggggtaccgtcatggacataatatccagacgtgaccaaagaggctcaggccaagtgggaacttacgggctaaacaccttcaccaacatggaagcgcagctaatccgacagatggaaggagaaggtatcttcaaaagcatccaacacctaaccgtaacagaagaaatcgccgtccagaattggctggcaagagtcgggagggagaggctgagccgaatggccataagcggggatgactgcgtcgtcaaacctttagatgatagattcgccagcgccttgacagctctcaatgacatgggaaaagtgaggaaggacatccaacaatgggagcccagccgcggttggaatgattggacacaagtgcccttttgcagccaccacttccacgaattagtgatgaaagacggtcgagtgctagttgtgccctgcagaaatcaggacgagttgatcggccgcgctaggataagccagggagcaggatggtccctgaaggagacggcgtgcttaggaaaaagctatgcccagatgtggaccctcatgtatttccacagaagggacctcaggctagcagcaaacgccatttgctcagcggtgccgtcacactgggtgcctacaagccgtacaacgtggtccatccatgccaagcatgagtggatgacgactgaggacatgctagcagtatggaaccgagtgtggatacaggaaaacccatggatggaggacaaaaccccagtagaatcatgggaggaagtcccctatcttggaaagcgggaagaccagtggtgcggcagcctgatcggcctaacatctagagcaacctgggcgaagaacattcagaccgccataaaccaggttcgcagcctcatcggtaacgaagagtacactgattacatgccaagcatgaaaagattcagacgagaagaggaagaagcgggagtcctctggtag

SEQ ID NO: 25189 - RNA, 9876 nt, synthetic construct
  misc_feature 1..9876: note = derived and/or modified CDS sequence (opt11) from DENV-2__EU482582__SS-prME
  source 1..9876: mol_type = other RNA
accgccggggtgatcatcatgctcatacccaccgcaatggcgtttcacctcaccacccggaacggggaaccccacatgatcgtgggccgacaggagaagggaaagtccctcctgttcaagaccgaggacggcgtgaacatgtgcacgttgatggccatcgacctgggggaactgtgcgaagacacaatcacctacaaatgccccctcctgcggcagaacgagcccgaggacatcgattgctggtgcaactcgactagcacatgggtgacttacggtacctgcaccaccactggcgagcaccggcgcgagaaaagaagcgtcgccctggtgccccacgtggggatgggcctcgagacgcgcaccgagacctggatgagctccgaaggggcctggaaacacgtacagagaattgagacatggatcttgagacacccgggcttcaccataatggccgcgatcctggcctataccatcgggacgaaccactttcagcgggccttgatcttcattcttctgacggccgttgcgccctccatgaccatgagatgcatcggcatctccaatcgggacttcgtggagggcgtctctgggggctcctgggtggatattgtgctcgagcacgggagctgcgttaccaccatggcgaagaacaagcccaccttggacttcgagctgatcaaaaccgaggccaagcagcccgccacactccgcaagtactgtatcgaggccaagctgaccaacacgaccaccgagtcccggtgtcccacccagggcgagcccagcctgaacgaggagcaggacaaacgcttcgtttgcaagcactccatggtggaccggggctgggggaatgggtgcggattgttcggcaagggcggcatcgtcacgtgcgctatgttcacgtgtaagaaaaacatggaggggaaggtggtgctgcccgagaatctggagtacaccatcgttatcacgccccacagcggggaggagcatgcagtggggaacgacacggggaagcacggcaaggaaatcaagatcaccccgcagtccagcatcaccgaagcggaactcaccggatatggcaccgtgacgatggaatgcagcccgcggaccggtctggactttaacgagatggtcctgctccagatggaggacaaggcctggttggttcaccggcagtggttcctggacctccccttgccgtggctgccgggggccgatacccagggcagcaactggatccagaaggagaccctcgtaacgttcaagaacccccacgcaaagaagcaggacgtcgtggtcctcgggtcccaagagggcgccatgcacaccgccctgaccggggcaaccgaaatccagatgagcagcggcaatctcctctttactggccacctcaagtgtcgcctccggatggataaactgcagcttaaggggatgtcctactcaatgtgcaccggcaaattcaagatcgtgaaggagatcgccgagacccagcacggaaccatcgtgatccgggtccagtacgagggcgacggctccccctgtaagatccccttcgagatcatggacctcgagaagcggcacgtgctgggtcgcctgatcacggtgaacccgatcgtcaccgagaaggacagccccgtaaacatcgaggctgaaccgcccttcggcgactcctacatcatcatcggggtcgagccgggccagctcaagcttaactggttcaagaaggggagctccatcggccaaatgttcgagactaccatgcgcggcgcgaaacggatggccatactgggggacacggcctgggacttcggtagcttagggggcgtcttcacctccatcggtaaggccctgcaccaggtgttcggagcaatctacggtgccgtgttcagcggagtctcctggaccatgaagatcctgatcggcgtgatcatcacctggatcgggatgaacagtcgctccacgtccctgtccgtgagcctcgtcctggtgggcgtggtcaccctttacctcggagccatggtgcaggctgactccggctgcgtagtttcttggaagtccaaggagctgaagtgtggctctgggatcttcataaccgacaacgtgcacacctggacggagcaatacaagttccagccggaaagccccagcaagctggcgagcgccatccagaaggcccatgaggagggaatctgcggcatccggtccgtgacccgcttagaaaacctgatgtggaagcagatcacccccgagctcaatcacatcttaagcgagaacgaggtcaagctgaccatcatgacgggcgacatcaaggggatcatgcaagccggcaagcggtccctgcgcccgcagcccaccgaattaaagtacagctggaagacctggggcaaggccaagatgctgtcgaccgagtctcacaaccagacgttcctgatcgacggtcccgagaccgctgaatgcccgaacaccaaccgggcctggaactcccttgaggtggaggactatgggttcggggtgttcaccacgaacatctggctgaagctgcgagaaaagcaggacgttttctgcgacagcaagctcatgtcggccgccattaaggacaaccgggccgtacacgctgacatgggctattggatcgagagcgccctgaacgacacctggaagatggaaaaggcctctttcattgaggtcaaaagctgccactggcccaaatcgcacaccctgtggagcaacggcgttctagagtccgagatgatcatccccaagaacttcgccgggccagtgagtcagcataactaccgcccgggctaccacacccagaccgcagggccatggcacctgggcaagctggagatggactttgacttctgcgaagggaccaccgtggtcgtgacagaggactgcgggaaccggggccccagcctcagaaccacgaccgcttccggcaaactgattaccgaatggtgttgtcggagctgcaccctgcccccgctccgctaccggggtgaggacgggtgttggtacggcatggaaatccggcccctgaaggagaaggaggagaacttagtgaatagtctcgtcacagccggacacggccagatagacaacttcagcctgggcgtgctagggatggccctcttcctggaggagatgctgcggacccgcgtaggcacgaagcacgccatcctcctggtcgcggtgtccttcgtgaccctgataacagggaacatgagcttccgggacctgggtcgcgtcatggtgatggtcggggcgacaatgaccgacgacataggaatgggggtcacctatctggccttattagccgcttttaaggtccgccccacgtttgcggccgggctgctcctccggaagctgacatccaaggaactgatgatggccaccatcggcatagccctactctcgcagagtaccatccccgagacgattctggagctcaccgatgccttggccctggggatgatggtgctcaagatagtccgcaacatggagaagtaccagttagccgtaaccataatggccatctcttgcgtgccgaacgccgtcatcctccagaacgcctggaaagtgtcctgcacaatcctcgccgccgttagcgttagccccctgctcctgacgagctcccagcagaaggccgattggatccctctggcgctgaccatcaaggggctcaatccaaccgcgatcttcctgaccacgctgagccgaacctccaagaagcgcagctggccgctcaacgaggctatcatggccgtgggcatggtctcaatcctggcttcctcactccttaagaacgacatcccaatgaccggcccgctggtcgccggcgggctgctcaccgtgtgttatgtcctgacggggcggtccgcggacctcgagctcgagcgcgccgccgacgtgaagtgggaggaccaggccgaaatcagcgggtccagccccatcctgtccatcaccatctccgaggacggctccatgagcataaagaacgaggaggaggagcagaccctgaccatcctcatcaggactggcctgctggtgatatccggggtcttcccggtcagcattccaatcaccgccgcggcctggtacctctgggaggtcaaaaagcagcgcgccggcgtcctatgggatgtgccttcgccgccaccggttgggaaggccgagctggaggacggcgcctaccggatcaagcagcgcgggatcctcggctacagccaaatcggcgcgggggtttacaaggagggcactttccacaccatgtggcacgtgacccgcggggccgtgctgatgcaccgcggcaagcgcatcgagccctcctgggccgacgtcaaaaaagacctgatcagctatgggggcggctggaaactagagggggagtggaaggagggcgaggaggtccaggtgttggctctggagcccgggaagaatccccgggccgtccaaacgaagcccggcctcttcaagacaaacactgggaccatcggcgcggtgtccctggacttctcccccggcacgtctgggagcccgattgtggatcggaagggcaaggtcgtggggctgtacggcaacggcgtggtgacacgctccggggcctacgtgagtgcgattgcccaaaccgagaagtccatcgaggacaaccccgagatcgaggatgatattttccggaagaagaggctcaccatcatggacctgcaccctggagcgggcaaaacgaagcggtatttgcctgccatcgtgcgcgaggccatcaagcggggcctacgcaccctaatcctggccccaaccagagtcgtggctgcggagatggaggaggccctgaggggactccctatacgctaccaaacccccgccatcagggccgaacacactggccgggagatcgtagacttgatgtgtcacgccacgtttactatgagactgctctcccccgtccgcgttccaaactacaacctgatcatcatggacgaggcgcacttcaccgaccccgctagcatcgccgcccgggggtacatctccacgagagtggagatgggagaggccgcaggcatcttcatgaccgcaacgcctcccggcagccgggatccgttcccccaatccaacgcaccaataatggacgaggagcgcgagatacccgagcggagctggaacagtggccatgagtgggtcaccgacttcaaagggaagacggtgtggttcgtgccgagcatcaaggccggcaacgacatcgcagcctgcctgcggaagaacggcaagaaggtcatacagctgtcccggaagaccttcgacagcgaatacgtgaaaacccgcgccaacgactgggacttcgtggtaacgacggacatctccgagatgggcgccaacttcaaggccgagcgcgtgatcgacccccgccggtgcatgaagcctgtgatcctgaccgacggggaagagcgcgtcatcctggcggggcccatgccggttacgcattcatcagccgcccagcggcgaggccgcattgggcggaaccccaaaaacgagaacgaccagtatatctacatgggtgagcccctcgagaacgacgaggactgcgcccactggaaggaggccaaaatgctgctggacaacatcaacacgcccgagggcatcatcccgagcatgttcgagccggagcgcgagaaggtggacgcgatcgacggagagtaccggttgcgcggcgaagctcggaagacgttcgtggacctaatgcgccgaggagatctccccgtgtggctcgcctaccgcgtcgccgctgagggtatcaactacgcggaccggcgctggtgcttcgacggtataaagaacaaccagatcctagaggagaacgttgaggtcgagatttggaccaaagagggcgagcgcaagaaactgaagccgcgatggctcgacgcccgaatctactcggatccacttgccctcaaggagttcaaggagttcgcggctggccgcaagagcttaaccctgaacctgatcaccgaaatgggtcggctccccacgttcatgacccagaaagcccgcgacgcccttgacaacctggccgtcctccacacggccgaggctggcggacgcgcctacaaccacgccttgtccgagttaccggaaaccctcgagactctgctgctgctgaccttgctcgccaccgtgaccggcggcatctttttgttcctgatgagcgggaagggcatcggtaagatgacgctcggcatgtgctgcatcatcaccgcatccattctgctctggtacgcgcagatccagccgcactggatcgcagccagcatcatcttagagttcttcctgatcgtcctgcttatcccagagcccgagaagcaacgcacgccacaggacaaccagctgacctacgtcgtgatcgccattctgaccgttgtcgccgcgacgatggcaaatgagatggggttcctcgagaagactaagaaggatttggggctgggcagcaccaccactcaggaatccgagagcaacatcctcgacatcgacctgagaccggcctccgcctggaccctctacgccgtggcgactaccttcgtcacgccaatgctccgacacagcatcgagaattcctcggtcaacgtctcccttaccgccatcgccaaccaggcaaccgtgctgatggggcttggtaagggttggcccctcagcaagatggatatcggggtccccctgctcgcgatcggctgctactcccaagtgaacccgatcaccctgacggccgccctgctccttctggtggcccactacgccatcataggccccggcctacaggcgaaggctacccgagaggcccagaagcgcgccgccgcagggatcatgaagaatcccaccgtcgacgggatcactgtaatcgacctggagcccatcccgtatgaccccaagttcgagaagcagctcggccaggtaatgctcctcatcctgtgtgtcacccaggtgctaatgatgaggaccacatgggccctgtgcgaagctctgaccctcgcaacaggccccatcagcaccttatgggaaggaaaccccggccgcttctggaacaccaccatcgccgtgtccatggcgaacattttccgcggctcgtatctggcgggggccggattgctgttctccatcatgaagaatacgaccaacacccggcgcgggaccggcaacattggcgaaacgttgggcgagaagtggaagtcccgactcaacgccttaggcaagtccgagttccagatctacaagaaatccgggatccaggaagtagacaggacactggcgaaggagggcatcaagcgcggtgagactgaccaccatgcagtctcccgcggcagcgccaagttgcggtggttcgtggagcgcaatatggtcaccccggagggtaaagtagtggacctggggtgcggccgcggcgggtggtcctattactgcggcgggctgaagaacgtccgagaggtgaaggggctcacgaagggcggcccagggcacgaagagcccatccccatgagcacttacggctggaacctggtccgcctgcagtccggggtcgacgtgtttttcacaccgcccgagaagtgcgacacactcttgtgtgacataggcgaatccagccccaatcccacgatcgaggccggcagaacactgcgggttctcaacttagtcgagaactggctgaacaataacacccagttctgcatcaaagtgctcaacccttacatgccctccgtaatagagaagatggagacactgcagagaaagtacgggggcgccctggttcggaaccccctttcacgcaactccactcacgagatgtactgggtgtcgaacgcgacgggcaacatcgtgtctaccgtcaacatgatcagccggatgctcatcaaccgcttcactatgaagcacaagaaggccacctacgagccggacgtggacttaggctccgggacgcgcaatatcggcatcgagagcgagatccccaacctggacatcatcggcaaacggatcgaaaagattaagcaggagcacgagacctcctggcactacgaccaggaccacccgtacaagacgtgggcctaccatgggagctacgagaccaagcagactggctccgcctcttctatggtgaatggagttgtgaggctcctgaccaagccctgggacgtggtaccgatggtgacccaaatggccatgaccgacacgacccccttcggccagcagcgcgtgttcaaagaaaaggtggacaccaggacccaagagcccaaagagggcacgaagaaactgatgaagatcaccgcggagtggctatggaaggaactggggaagaagaagacgccccggatgtgcacacgcgaagagttcacgcggaaggtgcgcagcaacgccgccctgggcgcaatcttcaccgacgagaataagtggaagtccgctcgggaggcggtggaagacagccgcttctgggagctcatcgatcgggagcgcaacctgcacctggaggggaagtgcgagacctgcgtctacaacatgatgggcaagagggagaagaagctaggggagttcggcaaggccaaaggctcccgcgccatctggtatatgtggttgggggctcgcttcctggagttcgaggcgctaggattcctgaacgaagatcactggttcagccgcggcaacagcctgtccggcgtggagggggagggcctccaccggctcggatacatcctcagggacgtcagcaagaaagagggcggggccatgtacgccgacgacaccgccgggtgggacacgcggattaccctggaggatctgaagaatgaggagatggttacgaatcacatgaagggcgagcacaaaaagttagccgaggcgatattcaagctcacctaccaaaacaaggtggtccgcgtgcaacggccgacgccacgcgggaccgttatggatatcatctcccgccgggaccagcgcggctcgggtcaggtcgggacctacggactgaacacctttactaatatggaggcacagctgatccggcagatggagggcgagggcattttcaagtccatccagcatctcaccgtgaccgaggagatcgccgtgcagaactggctggcccgcgtggggcgggagcgcttaagcagaatggccatctccggcgacgattgcgtggtgaagcccctcgacgatcgcttcgcgagcgccctgaccgcccttaacgacatgggcaaggtccggaaggatatccagcagtgggagccgagcagggggtggaacgactggacccaagttccgttctgcagccaccacttccacgaacttgtgatgaaggacggccgggtcctggtagtgccctgccgcaaccaggacgagctgattggacgtgcccgcatctcgcagggcgccggctggagcttgaaggagaccgcgtgcctggggaaatcatacgcccagatgtggacactgatgtacttccaccggcgtgacctccggctggccgccaacgccatctgcagcgcggtaccctcacactgggtgcccaccagccgcaccacgtggtccattcacgccaagcacgagtggatgaccactgaggacatgctcgccgtgtggaaccgggtttggatccaggaaaacccgtggatggaggacaagacccccgtggagagctgggaggaggtgccctacctcggcaagcgcgaggaccagtggtgcgggagcctgatcggcctgaccagtcgcgccacctgggcgaagaacatccaaaccgccataaaccaggtgcgtagcctcataggaaatgaggaatacaccgactacatgccatctatgaagcgcttccggcgcgaagaggaggaggccggcgtcctgtggtaa

SEQ ID NO: 25190 - RNA, 9876 nt, synthetic construct
  misc_feature 1..9876: note = derived and/or modified CDS sequence (opt11) from DENV-2__EU482583__SS-prME
  source 1..9876: mol_type = other RNA
accgccggggtgattatcatgttgattccaaccgccatggcctttcatctcacaacccgaaatggagagccccatatgatcgtcggccgacaggagaagggcaaatccttgctgttcaagaccgaggacggggtaaatatgtgcaccctcatggccattgacctgggcgagctgtgtgaggacaccatcacctataagtgcccccttctgcgccaaaatgaacccgaggacatcgattgctggtgtaatagcacctcaacctgggttacctacggaacctgcaccactacgggcgagcaccggcgcgaaaaacgctctgttgctctagtcccccacgtggggatgggcctcgagacccgaacggagacatggatgtcctcagagggtgcctggaagcacgtacagcgtattgaaacctggatcttacgccacccgggtttcaccatcatggcggcgatcctggcgtatacaatcgggacgacccacttccagcgggccctcatctttatattgctgacagccgtagctccctcaatgaccatgagatgcatcggtatcagtaaccgggacttcgtggaaggagtgagcggtggatcatgggtggacattgtgctcgagcacgggagttgcgtcacaacgatggcgaagaacaaacccaccctggacttcgaactgatcaagaccgaggccaagcaacctgccaccttacgcaagtattgtattgaagccaagctgacaaataccaccaccgagtcccggtgcccgacgcagggcgaacccagcctaaacgaggagcaagacaaaagattcgtgtgcaagcactccatggtggaccggggctggggcaacggctgcgggttattcggaaagggcgggatcgtgacgtgcgcgatgttcacctgcaagaagaacatggagggcaaggtggtgctgcccgagaatctggagtataccatagtcatcacgccccacagcggggaggagcacgccgtgggaaacgacaccggtaagcatggtaaagagattaagatcacaccgcagtctagcattaccgaggcggagttgaccgggtatgggacagtgaccatggagtgtagcccgcggacaggcctggattttaacgagatggttctgctccaaatggaggacaaagcgtggctggtgcatcggcaatggttccttgacctccccctgccctggctcccgggggctgacacacagggctccaactggatccaaaaggagacgttggtcacctttaaaaacccccacgcgaagaagcaggacgtcgtggtcctggggtcccaggaaggcgccatgcacaccgcgctgacaggggctacggagatacaaatgagcagcggcaacttactgttcaccggccacctgaaatgtaggcttcgcatggacaaactgcagctgaagggtatgtcttatagcatgtgtaccggtaagttcaaaattgtgaaggagatagccgaaacgcagcacggcacgatcgttatacgtgtgcagtacgagggcgacggctccccctgcaagatccccttcgagataatggacctcgagaagcgacacgtgctggggcgattaatcacagtaaatcctatcgtcacggagaaggacagccccgtgaacatagaagcggaaccaccgttcggagattcctacatcatcattggtgtcgaaccggggcaactcaagctgaactggttcaagaaaggtagctcaatcggccagatgttcgagaccacgatgaggggtgctaagcggatggccatcctgggggacaccgcatgggactttggcagcctcgggggagtcttcacctccatagggaaagccctgcaccaggtgttcggcgccatctacggagcagcgtttagcggggtgtcctggacaatgaaaattctgatcggggtcataatcacgtggatcggcatgaatagccgctcaacaagccttagcgtcagcctcgtgctggttggtgtggtgaccctgtatctcggggccatggtccaggcggactccggatgcgttgtgagctggaagaacaaagagctgaagtgcggcagcgggatcttcatcaccgacaacgtccacacgtggaccgagcagtacaagtttcagcccgagagccccagcaagctggcatccgccattcaaaaggcccatgaggagggtatatgcggaatccgtagtgtaacccggctcgaaaacctgatgtggaagcagatcaccccagaactgaaccacatcctctccgagaacgaagtgaagctgacgataatgaccggcgacatcaagggtatcatgcaggccggcaagcgttctcttcgcccccagccgaccgagttgaagtattcctggaagacgtggggcaaggctaagatgctgagcacggagtcccacaatcagacattcctcatcgacggacccgagaccgcagagtgcccgaacacgaatcgggcatggaacagcctcgaggtcgaggactatggctttggcgtgttcacgactaacatttggctgaaactgcgagagaaacaagatgtgttctgcgactccaagctaatgagcgccgcgatcaaggacaaccgggcagtccacgcggacatgggctattggatcgagtctgcgctcaacgacacctggaaaatggaaaaggccagtttcatcgaagtgaaatcctgccactggcccaagtctcataccctgtggagtaacggtgtcctcgagagcgaaatgatcatccccaagaacttcgccggaccggtatcccagcataattatcgcccggggtatcacacccaaacggcggggccctggcacctgggcaagctggaaatggactttgacttctgcgaggggacgactgtggtggtcactgaggattgcggcaaccggggaccctcactccgtacgaccacggccagcggtaagctgatcacagagtggtgctgccggtcctgcacgctgcccccgttgcgctatcggggcgaagacgggtgctggtatggcatggaaatccgcccattgaaggaaaaagaggagaaccttgtgaactccctcgtcaccgccggccacgggcagatcgacaacttttccctgggcgttctggggatggccctattcctggaggaaatgctgcgtacccgggtgggcaccaagcacgcgatcctccttgtggcagtaagcttcgttacgctgatcaccggaaacatgtcttttcgggacctcggccgcgttatggtgatggtaggtgctacaatgaccgacgacatcggaatgggagtgacctacctggccctattggcagctttcaaggttcgccccaccttcgcggcggggctactgttacggaagctaactagcaaggagctaatgatggccacaatcggcatcgcgctgctctcccaatcaacgatccccgaaaccatccttgagctgaccgatgcactggccctggggatgatggttctcaaaatcgttcgcaacatggaaaagtatcaacttgccgtaaccatcatggccatcagttgcgttccgaacgccgtcatcctacagaatgcctggaaggtgtcctgtacaatcctcgccgccgtgtcagtctcgccccttctgttgacaagttcccagcagaaagcagactggatcccattggcgctaaccatcaagggtctcaacccaaccgccatcttcctcacaactttgtctcggactagcaagaagcgctcctggccgctcaacgaagccatcatggcggttggcatggtgagcatccttgcatccagcctgctcaagaacgacatccccatgacggggcccttggtagccggcgggctcttgacggtgtgctacgtgctgaccggaagaagcgccgacctggagctcgaacgcgcggccgacgtcaagtgggaagaccaggcggagatatctgggagctcccccatcctcagcatcactatcagtgaagacggctcaatgtccatcaagaacgaggaggaggaacaaaccctgactatcctcatccgaaccggcctgctggtgattagcggggttttcccagtttctatccccatcacggcggccgcctggtacctctgggaggtaaagaagcaacgcgccggcgtgctgtgggatgtccccagcccgccgccggtagggaaggccgagttggaagacggggcgtaccggatcaaacagcgaggaatactaggttactcccagataggcgccggggtgtacaaggagggcactttccacaccatgtggcacgtaacacgcggggccgttttaatgcaccgcggcaagcggatcgagcccagttgggccgacgtgaagaaggaccttatctcctacggcggcggctggaagctcgagggggaatggaaagagggcgaggaggtccaggtcctggccctggagccggggaagaacccccgagcggtccagacaaagcccggcctctttaagaccaacaccggaacgatcggcgctgtctcactagacttctccccggggacctctggatccccgatcgtggaccggaaaggcaaggtagtggggctctatggaaacggcgtggtaaccagatctggggcatacgtctcagccatcgcacagaccgagaagtccatcgaagacaaccccgaaatcgaagacgacatcttccgaaagaaacgccttacgataatggacttacacccgggcgcgggaaagaccaagagatacttgcccgccatcgtgcgggaggcgatcaagcgaggccttagaacactgatcttggcacccacgagggttgtggctgccgaaatggaggaggccctgagggggctaccgatccgctaccagacgcccgccatccgggcggaacacaccggccgcgaaatagtggacctgatgtgccatgctaccttcaccatgcgtctgctcagccccgtgcgcgtcccgaactataacctgattattatggacgaggcccacttcacggaccccgcatccattgccgcacggggctacatcagcacccgcgtggagatgggtgaggcggccggcatcttcatgaccgccacgccacccgggagtcgggacccgttcccgcagagcaatgcccccattatggacgaggaaagggagataccggagcggtcttggaactcgggccatgagtgggtaacggacttcaagggcaagactgtctggttcgtgccgagcatcaaagcgggtaacgacatcgccgcgtgcctacgcaagaatggcaagaaagtgatacagctcagccggaagacctttgacgccgagtacgtcaagacccgcgccaatgattgggactttgtggtaacgaccgacatctccgagatgggagccaacttcaaggccgaacgagtaatcgatcctcgaaggtgcatgaagcccgtcatccttacggacggtgaagagcgagtaatcctggcaggaccgatgccggtcacgcacagctccgccgctcagcggcggggcaggatcggtcggaatcccaagaacgagaatgaccagtacatctatatgggcgagcccctcgagaacgacgaggactgcgcgcactggaaggaagccaaaatgcttctggataacatcaacacgcccgagggcatcattccgagcatgttcgagcccgaacgggagaaagttgacgccatcgacggggagtaccggctccgcggcgaggcccggaagactttcgtggacctgatgcgccgcggggacctgcccgtctggctcgcctaccgcgtggcggctgagggcatcaactatgccgaccggcgatggtgcttcgacgggataaaaaataaccagatcctggaggagaacgttgaggtcgaaatatggaccaaggaaggcgagcggaagaaactaaagccgcgctggctcgacgcccggatctattccgatccacttgctttgaaagagttcaaagagttcgccgccggccgaaagagccttactctcaatctaatcacggaaatggggcggcttcccaccttcatgacccagaaggcacgcgacgccttagacaacttggctgttctgcataccgccgaggccggcgggcgggcctacaatcatgctctgtccgagttacccgagacgttggagacactactgctcttgaccctcctcgcgaccgtgacgggcggaatcttcctatttctgatgtccggtaaagggatcgggaagatgaccctcgggatgtgctgcatcataacagcgtctatccttttatggtatgcgcagatccagccacactggatagcagcctcgatcatcctcgagttcttcctgatcgtactgctaatccccgagccagaaaaacagagaacgccccaggacaaccagctgacctacgtggtcatcgcgattctgacggttgtggctgcgaccatggcaaacgagatggggttcctcgagaagaccaagaaggacctcggactggggtccataaccacccaggagagcgagagcaacattttagacatcgacctgcggcccgcatccgcgtggaccttgtatgccgtggcaactacttttgttactcccatgctccgccacagcatcgaaaattcctcggtaaacgtgtccttaacagccatcgcgaatcaggccactgtactaatgggactgggcaagggttggcccctatcaaagatggacataggcgtgcccctgctagccatcggttgttacagccaagtcaatccaatcaccctgacggccgcacttctcctgttggttgcgcactacgccatcatcggcccaggcctacaggccaaggccacccgggaggcccagaagagagcggctgcagggatcatgaaaaatcccaccgtggacggcatcacggtcatcgacctggaacccattccgtacgatcccaaattcgagaagcagctggggcaagtcatgctcctcatcctgtgtgtcacgcaggtcctcatgatgcgcaccacatgggcactatgcgaagcgctcaccctggctacgggccccatctccacactctgggaggggaacccaggcaggttttggaacaccaccatagcggtgtctatggcgaatattttccgcggcagctacctggccggcgcagggctcttattctccattatgaagaacacaaccaatacccggaggggcaccggcaacatcggcgaaacgctgggtgagaagtggaagagtcggttaaacgccctcgggaagtccgagtttcagatatataagaagtccggaatccaggaagtggacagaaccctggcaaaggagggcattaagcgcggggagacagatcaccacgccgtatccagaggcagcgccaaactccggtggttcgttgagcgcaacatggtgactcctgagggcaaagtcgtggacctggggtgcggccgcggcgggtggtcttactactgcggggggctgaaaaacgtgcgcgaggtgaaagggctcactaagggcggacccggtcacgaggaacccatccccatgtctacatacggatggaacctggtaaggttacagagcggggttgatgtcttcttcaccccgcccgaaaagtgtgacaccctcctgtgcgacatcggcgagagctcacccaacccgacgatcgaagcggggcgcaccctgcgtgtcctcaacttagtggagaattggttaaacaacaatacgcaattctgcatcaaagttttgaacccgtacatgccctctgtgatagagaagatggagaccttacagcgcaagtacgggggggctctggtgcggaatcccctgagcagaaactccacgcatgagatgtattgggttagcaacgccacgggcaacatcgtgtccagcgtcaacatgatctctcggatgctcatcaaccgcttcaccatgaagcataagaaggccacctacgagccagacgtcgaccttggcagcggcacccgcaacatcggtatcgagtccgagatacccaacctggacatcatcggaaagcggatcgaaaagatcaagcaggagcacgagacgagctggcattacgatcaggaccacccctacaagacatgggcctaccacggcagctacgaaaccaagcagaccgggagcgcgtccagcatggtaaacggagtggtccgcctgctcacgaagccctgggacgtggtaccgatggttacacagatggccatgaccgacaccacgccattcggtcaacagagggtgttcaaggagaaagtagacacacgtacccaggaacccaaagaagggactaaaaaactgatgaagattaccgcagaatggctttggaaagagctgggtaagaagaagacgccacggatgtgcacccgcgaggaattcacccggaaggtacgcagcaacgcggccctgggagccatcttcactgacgagaacaagtggaaatccgcccgggaagccgtagaagactccaggttctgggagttgattgacagagagcgtaacttgcacctggaagggaagtgcgagacttgcgtttacaatatgatggggaagcgggaaaagaaactcggggaattcggcaaagccaaaggctcacgcgcgatctggtatatgtggctgggggcccgattcctggagttcgaggccttgggcttccttaacgaggaccactggttctcccgtgggaactcactgagcggagtcgagggggagggcctccatcggctgggatacatactcagagacgtgtctaaaaaagagggcggagcgatgtacgccgacgatactgcggggtgggacacacggatcaccttggaggacctaaagaacgaggagatggtcacaaaccatatgaagggggagcacaaaaagctggcggaggcgatctttaagctgacctaccagaacaaggtggtgcgcgtccaacggccgacgccacgcgggacggttatggacatcatcagccgaagggatcagcgcggctcaggccaagtagggacatacggcctaaataccttcaccaacatggaagcgcagcttatccgccagatggagggtgaaggcatcttcaagtctatccagcatctcacggttacggaggagatcgccgtccagaactggctggcgcgcgtaggccgggagcgcctttccagaatggccatcagcggagacgactgcgtcgttaagcccctagacgaccgcttcgcgtccgccctaaccgcactgaacgacatgggcaaagtgcggaaggacatccaacaatgggagccgagtcgcgggtggaatgactggacccaggtcccgttctgctcccatcactttcacgaactcgtgatgaaggacggccgtgtgctggtcgtaccctgccgcaaccaggacgaattaatcgggcgggcgcgcataagccagggggccggctggtccctcaaagagacggcctgcctaggtaagagttacgcgcagatgtggaccctgatgtacttccaccggcgcgacctcaggctagcagcgaacgccatatgcagtgctgtgccctcccactgggtccccactagtcgcaccacatggagcatacacgcgaagcacgaatggatgacgaccgaggacatgctagcggtttggaaccgggtctggattcaggaaaacccatggatggaggacaaaacccctgtggagtcgtgggaggaagtgccctacctcggcaagagggaagaccagtggtgtgggagcctgatcggattgaccagccgggcgacttgggctaaaaacatccaaaccgccattaaccaggtgcggtccctcatagggaacgaggagtacacggactatatgccgagcatgaagcgtttccggagggaggaggaagaggcgggcgtcctctggtga

SEQ ID NO: 25191 - RNA, 9876 nt, synthetic construct
  misc_feature 1..9876: note = derived and/or modified CDS sequence (opt11) from DENV-2__EU482585__SS-prME
  source 1..9876: mol_type = other RNA
actgcgggcgtaatcatcatgctaataccaaccgcgatcgcgttccacctcaccacccgcaatggcgagccccacatgatcgtcggacgtcaggagaagggaaaatccttgctgttcaagaccgaggacggcgtcaacatgtgcaccctaatggccattgacttaggggagctgtgcgaggacaccatcacatacaagtgcccactcctgcgacagaacgagccggaggacatcgattgctggtgcaacagcaccagcacctgggtaacctacggaacttgtaccaccacgggcgagcaccggcgcgagaagagatccgtcgctctggtgccccacgtgggcatggggctcgagaccagaaccgaaacctggatgagtagcgaaggagcctggaagcacgtccaacggatcgagacatggatcttaaggcaccccggcttcactataatggccgctatcctggcctacaccataggtaccacacatttccagcgcgcactcatcttcatcttgctgactgcagtcgcgcctagcatgacaatgcgctgcatcggcatcagcaaccgggacttcgtggagggggtcagcggcggctcgtgggtggatatcgtgctcgagcacgggagctgcgtaaccacgatggccaagaacaagcccacgctggatttcgagttaatcaagactgaggccaagcagcccgccacactccgcaagtactgcatcgaggcaaagctgactaacactacgacagagtcccgctgtccgacccagggcgaaccaagccttaatgaagaacaggacaagagattcgtgtgcaagcactccatggtggaccggggctgggggaacggctgcggcttgttcggtaaaggaggtatcgtgacctgcgccatgttcacgtgcaagaagaacatggaaggcaaggttgtgcttcctgaaaacctagagtacacgattgtaatcactccgcatagcggcgaggagcacgctgtggggaatgataccgggaagcacggaaaggagattaaaatcaccccacaaagctcaatcaccgaggccgaattgactggatatggaacggtgaccatggagtgctctcccaggactggcctggacttcaacgagatggtactgcttcagatggaggataaagcctggttggtacaccggcaatggttccttgacctccccctgccctggttgccgggggccgatactcagggaagcaattggatacagaaggagacgttagtgacattcaaaaacccccatgcgaaaaagcaggacgtcgtggtcctagggtcccaggagggtgccatgcacacggccctgaccggggccacggagatccagatgtctagcgggaacctcctgtttacaggccatctgaagtgccgcctccggatggacaagctgcagctcaagggcatgagctacagcatgtgcactggtaagtttaagatcgtgaaggagatcgccgagactcaacatgggacgatcgtgatccgggtacagtacgagggagacggctccccctgtaagattcccttcgaaatcatggacctggagaagcggcacgtgctggggcgcctgatcacagtgaaccccatagtcactgagaaagatagccctgtgaacatcgaggccgagccgcccttcggggactcctacatcatcatcggggtggagccgggccagctcaagcttaattggttcaaaaagggctcatccatcgggcagatgttcgaaaccacgatgcgcggtgcaaagcggatggccatcttaggtgatactgcctgggatttcggctcgctggggggcgtattcacctccatcggcaaggccctccaccaggtgttcggggcgatatacggagccgccttctccggggtgagttggacaatgaagatactaattggcgtcatcattacctggatcggaatgaactcccgctccacctctctgagcgtgagcttagtgctagtcggcgtggtcaccctgtaccttggggccatggtccaagcggattccggctgtgttgtgagctggaaatccaaggagctgaagtgcggctcgggtattttcatcacggataacgttcacacgtggaccgagcagtacaagttccagccggagagcccaagtaaactggccagcgccatacagaaggcccacgaggaaggtatatgcggcatcaggtccgtaaccaggctggagaacctgatgtggaagcagatcaccccagaacttaaccacatcctcagcgagaatgaagtgaaactgactatcatgactggcggcatcaagggcataatgcaggccggcaagcggtccttacgcccgcaacccacagagctcaagtactcgtggaaaacctgggggaaggcgaaaatgctgtccacagagtcccacaatcagaccttcctcatcgacgggccggagaccgcagagtgcccgaataccaatcgggcctggaactcactcgaggtggaggactatggtttcggcgtgttcaccactaatatttggctgaagctgcgcgagaagcaggacgtgttctgtgacagcaagctcatgtccgccgcgatcaaggacaaccgggcggtgcacgccgatatgggatactggatcgagagcgcactgaatgacacctggaagatggagaaggcctccttcatcgaggtcaagagctgccattggccaaaatcccacaccctgtggtcgaacggggtgctcgagtcagagatggtcatcccaaagaactttgccggtcctgtgagccagcataactacagacctgggtatcatacgcagacggcgggtccctggcacctcgggaagctggagatggattttgacttctgcgagggcaccaccgttgtcgttaccgaggattgcggcaatcgtgggccctccctccgcacgaccactgcctccggcaagctgatcaccgagtggtgctgccggtcatgtacgttgcccccgctccgctatcgcggggaggacggctgctggtacggcatggaaattcgtccccttaaagagaaagaggagaatctggtgaattccctggtcactgcgggacacggacaaatagataactttagcctgggggtgctgggtatggcccttttcttggaggaaatgctgcgtacgcgcgttggtaccaagcacgcgattctgctggtcgccgtgtccttcgtgacactgataaccggtaacatgagcttcagagacctcgggcgcgttatggtgatggtgggcgccactatgaccgacgacattgggatgggggtcacgtacctggcactgctcgctgcgttcaaggtgcgaccaactttcgccgctggactactcttacggaagctgacctccaaggagctcatgatggccacaatcgggattgccctcctgagccagtccacgatccccgagaccatcctggagttaaccgacgcgttggccctgggcatgatggtactcaaaatcgtccgcaacatggagaagtaccagttagccgttacgattatggccatcagctgcgtgcctaacgccgtcatccttcagaacgcgtggaaggtatcctgtacgatactcgccgctgtaagcgtgagccctctgctgctcacctcatcacaacagaaagcagactggattcccctagcgctgaccattaagggcctcaaccctacggccatcttcctgacgactttaagccggacctctaagaagaggtcttggccgctcaacgaggccatcatggcggtagggatggtctccatcctggcgagctcgctgctcaagaacgacatccccatgaccggcccccttgtggccggagggctgctcactgtttgctatgtcctgacgggccggagcgctgacctggagcttgagcgcgccgccgacgtgaagtgggaggaccaggctgagatctcaggttcctcaccaatcttgtccatcaccataagcgaagatggttccatgtcgatcaagaacgaggaggaggagcagaccctaaccatcctcatccggaccgggctgctggtgatctctggtgtattcccggtgagcatcccgataactgcggccgcctggtacctctgggaggttaaaaagcagagagcaggcgtgttgtgggacgtacccagcccgccgcccgtcggtaaggccgagctggaggatggggcctaccggatcaagcagcgtggcatcctcgggtacagccagataggtgcaggcgtctataaagaaggcacatttcacacgatgtggcacgtgacgcggggggccgtcttgatgcaccgcgggaagcgaatcgagccgtcctgggccgacgtcaagaaggacctaatcagctatggcggagggtggaagctagaaggggaatggaaagagggggaggaggtccaggtgcttgcgctggagcccggcaagaacccccgagcggtacagacgaagcccggccttttcaaaactaacacaggtacaattggagctgtgtccttagacttcagccccgggacgtccgggagccccatcgtggatcggaaggggaaagtcgtgggcctgtacggcaacggggtggtcacccgcagcggcgcgtacgtaagcgccatcgcgcagaccgagaagtccatcgaggataaccccgaaatcgaggacgacatcttccggaagaagcgcctcacaatcatggacctgcaccccggggccggcaaaaccaaacggtatctgcccgccatagtgcgcgaggccatcaagcgcgggctgagaacgctcatcctggcacctacccgcgtcgtggctgccgaaatggaggaggcactgcggggactccccatacggtaccagacgcccgccatccgcgccgagcacaccggtcgcgagatcgtggacctgatgtgccacgcgaccttcaccatgcggctgcttagccccgtgcgcgtgccgaactacaaccttattatcatggacgaagcccacttcacggacccggcgagcattgctgcccgtgggtatatctccaccagagttgagatgggcgaagccgcaggaatcttcatgaccgctacgccgccaggctcccgggacccgttccctcagtccaacgccccaatcatggacgaggaacgcgaaatccccgagcggagctggaactccgggcacgagtgggtcacggacttcaaaggcaagaccgtgtggttcgtgccgtcgatcaaggcgggcaacgacatcgccgcctgcctgcgcaaaaacgggaagaaggtcatccagctcagtcgcaagaccttcgatagcgaatacgtgaaaacccgcgccaatgattgggacttcgtggttacgacagacatatcggagatgggcgccaactttaaggctgagcgcgtgattgacccccgccggtgcatgaagccagtaatcttaaccgacggggaggagcgggtcatactagccgggcccatgcccgtgacccactcgtccgccgctcagcggcgtgggcgcatcggacggaaccccaagaacgagaacgaccagtatatttacatgggcgagcccctcgagaacgacgaggactgtgctcattggaaggaggcgaagatgcttctggacaatatcaacacgccagaggggattatcccgagcatgttcgagcccgagcgggaaaaggtggatgcgatcgacggcgagtaccggttacgcggtgaggcgaggaagacctttgtcgaccttatgcgtagaggcgacctgcccgtgtggctcgcctaccgcgtggccgcggaggggatcaactacgccgaccggcgctggtgcttcgacggcatcaagaacaaccagatactggaggagaacgtcgaggtggagatctggaccaaggagggtgagcggaagaagctgaagccccgctggctcgacgccagaatctactccgatccactggccctgaaggagttcaaagaattcgcggccggtcggaagagcttaacgttgaacctcatcacagagatgggccggcttcccactttcatgacgcagaaggcccgtgacgccctggacaatctagcagtcctccacaccgcggaggccggaggccgggcatacaaccacgccttaagcgagctgcccgaaactctcgagaccctgctgctcctgaccctgctcgccaccgtgaccggaggaatcttcctctttctgatgagcggcaagggtataggcaagatgaccctcgggatgtgttgcatcatcaccgcgtctatcctgctgtggtacgcgcagatccagccacactggatcgccgcctctatcatccttgagttcttcctgatcgtgctgctcatccccgaaccggagaagcagcgcacgccgcaggacaaccaactgacctacgttgtcatagccattctgacggtggtcgcggccaccatggccaacgagatgggtttcctcgagaaaaccaagaaggacctgggcctggggtctatcaccacgcaggaatccgagagcaacatcctcgatattgacctgagaccggcgtccgcatggaccctgtacgcggtggccacgaccttcgtgacacccatgttgcgccactcaattgagaactccagcgtcaatgtgtccctgaccgccattgcgaaccaggctacggtattaatgggactcgggaaaggatggccgttatcgaagatggacatcggggtccccctgttggctattgggtgctactcccaggtcaatccgattactctgacagccgccttgctcctgctggtggcccactatgcgatcatcggcccagggctccaggccaaagctaccagggaggcccagaagcgtgctgctgctggaatcatgaagaatcccacagtcgacggtataactgtgattgacctagagcccatcccgtacgaccctaagttcgagaagcagctcggccaggtgatgctcctgatcctctgcgtcacacaagtgctcatgatgcgcaccacctgggcgctttgcgaggcactcaccctcgccacggggcccattagtaccctctgggaaggcaaccccggccggttctggaacaccaccattgcggtgtcaatggccaacatcttccgcgggagctacctagctggtgcggggctcctgttctcaatcatgaagaacaccacgaacacccggcgcggcaccggcaacatcggggagacgctgggcgagaagtggaaatcccgtctcaacgctctggggaaatccgagttccaaatctacaagaagagtggcatccaggaggtagacagaaccctggccaaggaggggatcaagcggggcgagacagaccaccatgctgtaagtaggggttcggctaagcttcgctggttcgtggaacgcaacatggtcacacctgaggggaaggtcgttgacttgggctgcgggcggggcgggtggtcctactactgcggcggcctgaagaacgtgagggaggtgaaggggctcacaaagggcgggcccgggcatgaggagccaatccccatgagcacctacgggtggaacttagtgcggctgcaaagcggcgtcgacgtattctttaccccgcccgaaaagtgcgataccctcttatgcgacatcggcgagagctcccccaacccaacaatcgaggcagggcgcaccctgcgggtattaaatttggtcgaaaactggctaaactccaacacacagttctgcatcaaggtcctcaatccttacatgccgagcgtgatcgaaaagatggagactctgcagaggaagtacggcggtgcactcgtccggaaccccctgagccgcaactccacccacgagatgtactgggttagtaacgccacgggtaacatcgtgagctcggtcaacatgatctcgcggatgctcatcaaccgtttcacgatgaaacacaagaaagccacctacgagccggacgtggacctggggtctggtacacgcaacatcggcatcgagtctgagatccccaacctagacatcatcgggaaacgcattgagaagatcaagcaggagcacgagacctcgtggcactatgaccaggaccacccttataagacctgggcctaccacggcagctatgagacaaagcaaaccgggtccgcttcgtctatggtgaatggcgtggtgaggctcctgaccaagccctgggacgtagtcccgatggtgacccagatggcgatgactgataccacgccctttggccagcagcgtgtgtttaaggagaaagtcgacacccgcacccaggagcccaaggaagggaccaagaaactgatgaagattacggctgaatggctctggaaggaacttgggaagaagaaaacgccgcggatgtgcacccgtgaggagttcacccggaaggtgcgcagcaacgcggctctgggcgccatcttcaccgacgagaacaagtggaaatccgcacgggaggcagtggaggacagccgcttctgggagctcatcgaccgggagcgcaatctgcacctggaggggaaatgcgaaacatgcgtttacaacatgatggggaagagggagaagaagctaggcgagttcggcaaagccaaaggaagccgggccatttggtatatgtggttaggtgctcgctttctggaatttgaggccctcggtttcctgaatgaggaccactggttcagtcgcggcaacagcctgtccggggtggagggcgagggtctccaccgactggggtacatactgcgcgacgtcagcaagaaagaggggggcgctatgtacgccgacgacaccgccggatgggacacccggataacgctcgaggacctgaagaacgaagagatggtgacaaaccatatgaagggcgagcacaagaagctcgcagaggccatcttcaagctcacttatcaaaacaaggtggtgagggtacagcggccaacgccccgtgggacagtaatggacattatctcacgccgcgaccaacgcggctcaggtcaggtcggtacctacggactgaacacctttaccaacatggaggctcagctgatccgtcagatggagggcgagggtatcttcaagtccattcagcaccttacggtgaccgaggagatcgccgtgcagaactggctggctcgcgtcgggcgggagcgcttgagcagaatggcgatttccggcgacgattgcgtggttaagcccctcgacgaccgtttcgcctcggccttgaccgccttgaacgacatgggcaaggtccggaaggatatccagcagtgggagcctagtcgcggctggaacgattggacccaggtgcccttctgcagccaccacttccatgagctcgtgatgaaggacgggcgggtactggtggtgccctgccgaaaccaggacgaactgattggccgggcccgcatctcccaaggcgcggggtggagcttaaaggagacggcctgtctgggcaaatcatacgcacaaatgtggacgctgatgtatttccacaggcgcgacctccgactggccgccaacgcgatctgtagcgccgtcccctcacactgggtgcccacatcccgaaccacctggagcatccacgccaagcacgaatggatgacgaccgaggacatgctggccgtgtggaaccgagtctggatccaggagaacccgtggatggaggacaagaccccggtggagagttgggaggagattccctacctcggtaagcgcgaagatcagtggtgcggcagcctgatcgggcttacctcccgcgcgacttgggccaaaaacatccagacggccatcaaccaggtgcggtcactcatcggcaacgaggagtacaccgactatatgccctccatgaagcgattccgccgcgaggaagaggaggccggcgtgctgtggtaa

SEQ ID NO: 25192 - RNA, 9876 nt, synthetic construct
  misc_feature 1..9876: note = derived and/or modified CDS sequence (opt11) from DENV-2__EU482587__SS-prME
  source 1..9876: mol_type = other RNA
actgccggggtcatcataatgctcataccaacagccatggctttccatctaacaacccgaaatggcgaaccgcacatgatagtcggccggcaagaaaaaggaaaaagcctactattcaaaacagaagacggcgttaacatgtgcacacttatggcgatcgatttgggcgaactatgtgaagatactatcacctataaatgcccactcctgagacaaaacgaaccagaagacatagactgctggtgcaattccacgagtacttgggtcacatatggcacttgcaccactacaggggaacatcgtcgagagaaaagaagtgtagccctcgtgccacacgtcgggatgggcctggaaactagaaccgaaacatggatgtcttccgaaggggcgtggaagcatgtgcagcggatcgaaacctggattctcagacaccccggtttcacaatcatggccgcaatactggcctacacaataggaacaacacatttccagagagcacttatcttcatcctgctcaccgccgtcgcacccagcatgaccatgcgttgtatagggatatcgaaccgcgatttcgtggagggagtaagtggcgggtcgtgggtcgacattgttctcgagcacggcagctgcgtcactaccatggcgaagaacaaaccaacgctagattttgagctgattaagaccgaggcaaagcaacccgcaacactccggaaatattgcatcgaagctaaactaacaaatacaacaacagaaagccgctgcccaacgcaaggtgagccctcactaaacgaggaacaagacaagcggttcgtatgcaaacactcgatggtggatagagggtggggcaacggatgcggactgtttggaaagggaggtatagttacatgcgcaatgttcacttgcaaaaagaacatggaaggcaaagttgtcctcccagagaacttggaatacaccatagtcattacaccgcactccggagaagaacatgcagtagggaacgatactggaaaacacgggaaggaaattaagatcaccccacagagctccataacagaagtggagctcacagggtatggtaccgtaaccatggagtgtagccctcgcaccggcctggacttcaacgagatggtacttcttcagatggaagacaaagcgtggctagtccatcgtcaatggttcttagacttgccgttgccgtggctgccaggagcagacacacagggatccaattggattcagaaagagaccctcgtgacttttaagaaccctcacgccaagaaacaagacgtcgttgtcctcggatcacaggaaggcgccatgcacacagccttaacaggagcgaccgagatacagatgagtagcgggaacttactgtttacaggacatctaaaatgtcgactccgtatggacaaattgcaattgaaaggcatgagctacagcatgtgtacagggaagttcaaaatagtaaaggaaatcgccgaaactcaacacgggaccatagtgatacgagtgcagtatgaaggagacgggtctccatgcaaaatacccttcgagatcatggacctagaaaagcgacacgtgctcggtagattgatcacggtcaatccaatagtcacggagaaagattccccagtgaacatcgaagcggagccgcctttcggagattcatacatcatcatcggcgtcgaaccagggcagcttaaactcaattggttcaagaaaggatcaagcatcggccaaatgttcgagacgacaatgagaggggcgaaaaggatggcaatactaggcgacacagcatgggatttcggaagcctcggcggggtattcacgtccattggcaaagccctccaccaagtgtttggagccatatacggagccgcctttagtggagtatcatggactatgaaaatcctaattggggtcataatcacatggataggcatgaatagtagatcaaccagtttaagcgtgagccttgtcctggtgggggtagtgacactctacctaggcgccatggtccaagctgactctggatgcgtagtgtcatggaaatcccgcgagctcaaatgcggcagcgggatcttcatcaccgacaacgtgcatacctggacagagcaatacaaattccagccagaatcaccaagcaagttggcatccgccatacaaaaggcacacgaggagggcatttgcggaatacgcagtgtcacccggctcgaaaacctcatgtggaaacaaatcacacccgagctcaatcacatactctcagagaatgaggtcaaactgacaataatgactggcgatatcaagggaatcatgcaagcggggaagcggtcgttgcgaccccagcccacagaactaaaatactcgtggaagacatggggaaaggcgaagatgctaagtaccgagagccacaatcggaccttcctcatagatggccccgaaaccgcggaatgccccaatacgaaccgagcgtggaacagcctagaggtagaagattacggtttcggcgtgtttacaacgaatatatggctcaagttacgagaaaagcaagacgtattttgcgactccaaactcatgtcagcggccattaaagacaaccgagcggtccacgccgatatggggtattggattgaatctgccttgaacgatacatggaagatggaaaaagcatcgttcatagaagtgaaatcctgccactggccgaaaagccacactctatggagcaatggcgtactggagagtgagatgatcatccccaaaaacttcgccggacccgtaagccaacacaactaccgccccggatatcacacacagacggcagggccttggcacctgggaaaattagaaatggactttgacttctgcgaaggcactacggtagtggtcacagaggactgtggcaaccgaggccctagcttgcgaactacgacagccagcgggaaactaataacagagtggtgctgcagatcttgcaccctaccgcccctgagatacagaggtgaagacggatgctggtacgggatggagatcagacccctgaaagaaaaagaagaaaacctagtaaattcattagtaacggctggacacgggcagatagataacttctccctaggtgtgttagggatggccctatttcttgaagaaatgttacgcactagagtcgggacaaaacacgcgatcctgctagtagcagtaagtttcgtcacgctaataacagggaatatgtctttcagagacctgggccgcgtgatggtcatggtcggagcaacaatgacggatgatatagggatgggcgtaacgtacctagccctcctggccgccttcaaagtaaggccgaccttcgccgcagggcttctcctacggaaactcacaagcaaggagctcatgatggccacaatcggaatcgcgctcttatcccaatctactatccctgaaacaatactagaactaacagacgcccttgctctgggaatgatggtgctcaaaatcgtccgcaacatggagaagtatcaactggccgtcacaattatggccatttcgtgcgtaccaaacgccgtaatcctacagaatgcgtggaaggtgagctgcacaatcctcgcagccgtctcagttagcccactactgctaacgtcaagtcaacaaaaggcggactggataccactggcgctaacgataaaagggctgaatcccacagcgatattcctgactaccctctcccggaccagcaagaaacggtcatggccgttaaacgaggccataatggccgtcgggatggtgtctatcctcgcaagcagtctgctcaaaaacgacatacccatgacgggacccttagttgcgggcggactgttaaccgtctgctatgtactgacaggtcggtccgccgacctggagctagagagagccgccgacgtaaaatgggaagaccaagccgaaatatcgggcagctcacccattctcagcatcaccatttcagaagacggtagtatgagcatcaaaaatgaagaagaagaacagacactgactatcttgatccggaccggcctcctggtcataagcggagtatttccagtcagcatacccataactgcagcggcctggtacctatgggaggttaagaagcaaagagccggggtgctttgggatgtcccgtcaccacccccggtaggcaaggcggaactcgaggacggagcatatcggatcaaacagcggggaatcctagggtactcccaaattggagcgggagtctataaggagggtacgttccacacaatgtggcacgtgaccagaggcgctgtattaatgcaccgcggtaaaaggatagaaccatcctgggcagacgtgaagaaagatctcatcagttacggcggagggtggaaactggagggggaatggaaagagggagaagaggtccaggtcctcgcactagaaccgggcaagaacccgcgggcagtgcagacgaagccaggactattcaaaactaacacaggaacaatcggcgcagtctccttagacttcagccccgggacgagcggctccccaatcgttgacagaaaagggaaagtggtcggtctatacggcaacggagttgtcacccgctcaggagcctacgtcagtgcaatagctcaaacagaaaagagcatcgaagacaacccagaaatagaggatgatatttttcggaaaaagcgcctcacgataatggacctacacccgggagccggaaaaacgaaacgctacttacctgcaatcgtcagggaagcaatcaagcgcggtcttagaacacttatcttggcaccaacgagagtcgttgcagccgaaatggaagaagcactacgggggctccccattaggtatcagacgcccgccatacgcgcagaacatacagggcgcgagatcgtagacctaatgtgccatgcgactttcacaatgcgtctattgagccctgtacgcgtaccaaattacaatttaatcataatggacgaagcccacttcacagatccggcgagcattgcagctcggggctacattagcacacgggttgagatgggcgaagcagccggaatcttcatgaccgcgacgcctcccggctccagagatccgttcccccaatctaatgcacccattatggacgaagaaagagaaatcccagaacggtcctggaactccggccacgagtgggtcaccgactttaaagggaaaacggtctggttcgttccatcaataaaggctggcaatgacattgccgcgtgcctaaggaagaacggaaagaaagtcattcaattgtcaagaaaaacattcgactccgagtacgtaaaaacacgggcgaacgactgggacttcgtggttacaaccgacatctcagagatgggggcaaacttcaaagctgaacgcgtcatcgacccccggcgatgcatgaagccagtaatactcaccgacggagaggaacgggtcatcctagcgggaccaatgccggtgactcactccagtgcggcccagcgtcgcgggcggattggcaggaaccccaaaaacgagaatgaccagtacatctatatgggagaaccactcgagaacgacgaagactgcgcacactggaaggaggcaaagatgctactggacaatataaacaccccggagggtatcatcccttccatgttcgagccagagcgagaaaaagtagacgcgatagacggggagtaccgtttgaggggcgaggcccgaaaaacatttgtagacctaatgcgaagaggggacctcccggtttggcttgcatacagggtcgcggcagaaggcataaactatgccgaccgacgatggtgctttgacggcatcaagaacaaccagatacttgaggaaaacgtagaagtcgagatatggaccaaagaaggggagcggaagaagctaaagccacggtggctcgacgcgcgaatttactctgacccactggcccttaaagagttcaaagagttcgcggcgggacgtaagagcctaaccctaaacctcataacggaaatgggccgactacccacatttatgacacagaaagcccgagatgctctagacaatctagcggtgttgcacactgcggaggcaggcggacgcgcatataaccacgctctgtcggaactacccgaaaccctcgaaacactactcctcctgacactcctagcaactgtgaccggtggaatatttctgttcctcatgtctgggaagggaatagggaaaatgacattgggtatgtgctgcataataacggcaagtatcctactgtggtacgcgcaaatccagcctcactggatcgcggcctcgataatcttagagttctttttaatcgttctactcatccctgaaccagaaaaacaacggactcctcaggacaaccaactaacgtatgttgtaatagccattctaacggtcgttgccgccacgatggcaaacgaaatgggcttcctcgagaagaccaagaaagacctaggactagggtcgataaccacgcaggagtctgagagtaatatcctagacatcgacctaagaccagcctccgcatggaccctctacgcagtagcgaccactttcgtaacaccgatgctccgtcactccattgagaacagctcagtaaacgtttctctaacggcaatcgcaaaccaggctactgtactaatggggctcggaaaaggatggccactcagcaagatggacatcggcgtaccactccttgccattggctgttacagccaggtaaacccgataaccctaacagcggccctgctcttgctagtcgcccactatgccataatcggtccagggctacaggccaaggccacacgagaagctcagaaacgggcggcggcgggaataatgaaaaacccaaccgtcgacggcataacggtaatagaccttgagccaataccgtacgacccaaaattcgaaaaacagcttgggcaggtaatgctactaatactatgcgtgacccaagtcctaatgatgcgcactacctgggcgttgtgtgaagcactaacccttgcgacgggccccatcagcaccctatgggagggcaatccgggcaggttctggaacacaacgatcgcagtaagcatggcaaacatattccgaggatcctacctagccggcgcaggacttctgttcagtataatgaagaacacaactaacacccggcgcggcacgggaaacattggtgaaactctgggggagaagtggaaaagcaggctcaatgcactcggcaaatccgagttccagatctacaagaaaagcggtatccaagaagtagacagaaccctagccaaagaggggattaagcgaggagagactgatcatcatgccgtctcgaggggatccgctaaactacgatggttcgtcgagaggaacatggtaacacctgaagggaaagtagtcgacctgggctgcgggcgtgggggctggagctattattgtggcgggctgaagaatgtacgagaagtgaagggcttgacaaaagggggaccaggacacgaagaacccattccaatgagtacgtacggatggaacttggtgaggctacaatcgggtgtcgacgttttcttcactccaccagagaaatgcgataccctactgtgcgacatcggcgagtcttccccgaaccccacgatagaggcaggaagaacactccgcgtcctaaatctagtggaaaattggctgaacaacaacacacagttctgcatcaaagtcctgaatccgtacatgccatccgtcatagagaaaatggaaacacttcaaagaaagtacggaggcgccttggtgagaaacccactgtcacgcaatagcacacacgagatgtactgggtgtctaacgcgacaggtaatattgtcagctccgtcaacatgatcagccgcatgctaataaacaggtttaccatgaaacacaagaaagccacctacgaaccagacgtagatctcgggtcgggaacacggaatataggaatcgagagcgaaataccaaacctagacatcatcggcaagagaattgagaaaataaagcaggaacatgaaaccagctggcactacgaccaagatcacccatacaaaacatgggcataccacggaagctacgagacgaaacaaacagggagcgcgagctcgatggtaaacggggttgtacgtctattgaccaaaccgtgggatgtagtgcccatggtaactcaaatggccatgaccgacacaactccctttggccagcaacgggtatttaaagagaaggtagacacacgtacccaagaacccaaagaagggacaaagaaactaatgaagatcaccgctgaatggctctggaaggagctagggaagaagaaaacccccagaatgtgcacgcgcgaagagttcacgcgcaaagtccgcagtaacgccgcactaggggcaatattcacagatgagaacaaatggaaaagcgcccgcgaagcagtagaagattctagattttgggaactaatcgaccgcgaacgaaacctccatctcgagggaaaatgtgagacatgcgtgtacaatatgatgggaaaacgggagaagaaattaggagagttcgggaaagctaaggggagcagagccatatggtacatgtggctaggcgcgagattcctggagttcgaagccctaggattcctaaacgaagaccactggtttagtcgaggcaacagcctcagtggggtcgaaggcgaagggctccatagactgggatacatactgagagacgtcagcaaaaaggaagggggcgccatgtacgcagacgatactgcaggctgggacactagaataaccctagaagacctcaaaaacgaggaaatggtaacgaatcacatgaaaggagaacataagaagttagccgaagcaattttcaaactgacctaccagaacaaagttgtgcgcgtccaaaggccgacgccgagggggacagtaatggatatcatttcgaggcgagaccagcgagggagcggccaggtaggcacctatggtctcaacacattcacgaatatggaggcccaacttattcgacaaatggagggggagggtatcttcaagtcaatacagcacctaacggttaccgaagaaatcgcagtgcagaactggttagcaagggtgggaagagaaaggctatcgcgaatggcaatctcgggagatgactgcgtggtaaaaccgctcgacgataggtttgcttcagcgctcaccgcgttaaacgatatgggcaaagtcaggaaagacatccaacagtgggagccatctagaggatggaatgactggacccaggtccctttctgctcacaccatttccacgagatcgtcatgaaagacggcagggtactggttgttccatgccgcaaccaagatgaactgatcgggcgcgctcggatatcacaaggagcaggctggtcactgaaggaaacagcgtgcctcggcaaatcctacgcccaaatgtggactctgatgtacttccaccgccgagatctaagactagccgcgaatgcaatctgcagcgccgtgcctagccactgggtcccgacctcacggaccacctggagcatacacgcgaagcacgaatggatgacaacggaagacatgctggccgtgtggaatagagtatggatacaggaaaacccttggatggaagacaagacgccggtcgagagctgggaagaagtcccgtatcttggcaaaagggaggaccaatggtgcgggtcactcattggactcacgtcgagggccacgtgggctaaaaatatacaaacagcgatcaatcaggtccgcagccttataggaaacgaggagtacacagattacatgccatcgatgaaacggttcaggcgcgaggaagaagaggctggggtcctctggtaa

SEQ ID NO: 25193 - RNA, 9876 nt, synthetic construct
  misc_feature 1..9876: note = derived and/or modified CDS sequence (opt11) from DENV-2__EU482588__SS-prME
  source 1..9876: mol_type = other RNA
accgccggcgttatcattatgctgatccccacggccatggcgttccacctcacaacacggaacggggagccccacatgatcgtggggcggcaggaaaaggggaagtccctgctgttcaagaccgaggacggcgtgaacatgtgcaccctcatggcaattgacctgggggagctgtgcgaggacaccatcacctacaagtgccccctcctgcgccaaaacgagcccgaggacatcgactgctggtgcaatagcaccagcacttgggtgacctacgggacctgcaccaccacgggagagcaccggcgtgaaaagcggtccgtcgccctggtgccccatgtagggatgggcctcgagacccggaccgaaacctggatgagctctgagggagcctggaagcacgtccagcgcattgagacctggatcttgcgccacccgggcttcaccatcatggccgcgatcctggcatacaccatcgggaccacgcactttcagcgggcccttatattcatcctgctgaccgccgtggcgcccagcatgaccatgcgctgcatcggcatcagtaaccgggactttgtggagggcgtcagcgggggctcctgggtggacatcgttctcgaacacgggagctgtgtcaccacgatggcaaagaataagcccaccctggacttcgaattaatcaagaccgaggccaagcagcccgccacgcttcgcaagtactgcatcgaggccaagctgacgaacaccaccaccgagtcccggtgcccgacgcagggcgaacccagcctaaacgaggagcaggacaagcgattcgtgtgtaagcactccatggtggacaggggctgggggaacggctgcggcctcttcggtaagggtggcatcgtgacgtgcgcgatgtttacgtgcaagaagaacatggaaggcaaggtggtgctgcccgagaatctagagtacaccatcgtcatcacgccccactcgggggaggagcacgctgtgggcaacgacaccgggaagcacggcaaggaaataaagatcacaccgcagagcagcatcaccgaggccgagctcaccgggtacggcacggttactatggagtgcagcccccggaccggacttgacttcaacgagatggtcctgctccagatggaggacaaggcgtggttagttcaccggcagtggttcctggacctccccctaccctggctgccgggtgccgatacccagggcagcaactggatccagaaggaaacgctcgttaccttcaagaatccccatgcgaagaagcaagatgtagtggtccttgggtcccaggagggcgccatgcacacagcgctcacgggggccacggagatccagatgagcagcggcaacctcctgttcacaggccacctgaagtgccgcttacgcatggacaagctgcagctgaaggggatgtcctacagcatgtgcaccggcaagttcaagatcgtgaaggaaatcgccgagacccaacacgggacgatcgtcatccgcgtccagtacgagggcgacggctccccctgcaaagtgcccttcgagatcatggacctcgagaagcggcacgtgttagggcgcctgataaccgtcaatccgatagtgaccgagaaggacagccccgtgaacatcgaggcggagccgccattcggcgactcgtatatcatcatcggggtcgagccgggccagctgaagctgaactggttcaaaaaagggagctccatcgggcagatgttcgagaccacaatgcgcggcgccaagcggatggccatcctgggggacaccgcttgggactttggcagcctcgggggcgtgttcacctcaatcgggaaggccctgcaccaggtgttcggcgcgatctatggcgcggcctttagtggggtctcttggaccatgaagatccttatcggcgtcatcatcacgtggatcggtatgaactcgcgctccacctccctgtccgttagcctcgtactggtgggcgtggtcaccctgtacctcggggcgatggtgcaggcggactccgggtgcgtggtcagctggaagagcaaggagctgaagtgcgggtcagggatcttcgtgaccgacaacgtgcacacgtggaccgagcaatacaagttccagcccgagagcccctccaagctggcctcggccatccagaaggcccacgaggaaggcatttgcgggatccggtccgttacccgcctcgagaacctgatgtggaagcagatcacccccgagctgaaccacatcctcagcgagaacgaagtgaagctgactattatgaccggcgacatcaaagggatcatgcaggccggcaagcggtccctgcgcccgcagccaaccgagctcaagtacagttggaagacctggggcaaggcgaagatgctgtccactgagagccacaaccagaccttcctgatcgacgggcccgagactgccgagtgcccgaacaccaatcgggcctggaactccctcgaggtggaggactacggcttcggggtgttcaccaccaacatctggctgaaactgcgcgagaagcaggacgtgttctgcgacagcaagctcatgtccgccgccatcaaggataaccgggcagtgcacgccgatatgggctactggatcgaaagcgccctgaacgatacctggaagatggagaaagcctcctttatcgaggtcaagagctgccactggcccaagagtcacaccctgtggagcaacggcgtgctcgagtccgagatgatcatacccaagaacttcgccgggcccgtgagtcagcataattaccgccctggctatcacacccagacggcagggccctggcacctgggcaagttagagatggatttcgacttctgcgaggggaccaccgtcgtggtgaccgaggactgtggcaaccgaggcccaagcctccgcacgaccaccgcgtccggtaagttgatcacggagtggtgctgtagaagctgcacgctgcccccgctccgctaccggggcgaggacgggtgttggtacggcatggagatacgccccctgaaggagaaggaggagaacctggtcaactccctcgttaccgccgggcacggccagatcgacaacttcagccttggcgtgctggggatggcattgttcctggaggagatgctgcggacacgcgtcggcaccaagcacgcgatcctcctggtggccgtgtccttcgtgacgctgatcaccgggaacatgtccttccgggacctaggtcgcgtgatggtgatggtcggcgccaccatgacagacgatatcggcatgggcgttacgtatctggcgctgctcgccgcgttcaaggtgcgccccacgttcgccgccgggctgctgctccggaaactgacctccaaggagctgatgatggccacgatcggcatcgccctgcttagccagagcactatccccgagaccatcctggagctcacggacgcgcttgccctggggatgatggtcctaaagatcgtgcgcaacatggaaaagtaccagctggccgtaaccatcatggccatcagctgcgttccgaacgcggtgatactgcagaacgcgtggaaggtctcgtgcacgattctcgccgccgtgtcggtgagcccccttctgctcaccagctcccagcagaaagccgactggatacccctggcgctgaccattaaaggcctcaaccccaccgccatcttcctgacgaccttaagccggacctccaagaagcgcagctggcccctcaacgaagccatcatggccgtcggcatggtgtccatactggctagcagcctgctcaagaacgacatccccatgaccgggcccttagtggctggcgggcttctcacggtctgctacgtgctgaccggccggtccgcggacctggagctcgagcgcgcagctgacgttaagtgggaggaccaggccgagatcagcgggtcgagccccatcctgagcatcaccatcagcgaagatggttccatgagtatcaagaacgaggaggaggagcagaccctgacaatcttaatccgaaccggcctgcttgtaatctccggggtgttcccggttagcatccccattaccgcggccgcctggtatttgtgggaggtcaagaagcaacgcgccggcgtgctgtgggatgtgcccagcccgccacccgtaggcaaggccgagctggaggacggcgcgtatcggatcaagcaacgcgggatcctgggctacagccagatcggcgccggggtgtataaggagggcaccttccacaccatgtggcacgtaacccgcggggccgtcctaatgcatcgcggcaagcggatcgagccatcctgggccgacgtgaagaaggaccttatcagctacggaggcggctggaagctcgagggggagtggaaggagggcgaggaggtgcaggtccttgccctggagcccggaaagaacccccgcgcggtgcagaccaagccagggcttttcaagaccaacaccgggacgatcggcgccgtttccctggacttcagcccgggtacctcaggaagccctatcgtcgaccggaagggcaaggtggtggggctgtacggcaacggagttgtgacccgctccggcgcctacgtgtcggccatcgcgcagaccgagaagtcaatcgaggacaaccccgagatcgaggatgacatcttccggaagaagcgtctcacgatcatggacctgcaccccggggctgggaagaccaagcggtacctgcccgcgatagtccgcgaggccatcaagcggggcctgcgcaccctcattctggccccgacccgcgtggttgcggccgagatggaggaggccctgcgggggctccccatccgctaccagacgcccgccatccgagccgagcacacaggccgcgagatcgtcgacctgatgtgccacgcgaccttcaccatgcggctgctttcacccgtgcgtgtgccgaactacaacctgatcatcatggacgaggcccactttacggatcccgccagcatcgccgctcggggatacatctccactcgcgtcgagatgggggaggcggctggcatcttcatgaccgccacgccccccgggagccgggacccgttcccccagtccaacgcccccatcatggacgaggaacgcgagatccccgagcggagctggaactccggtcacgagtgggtgaccgacttcaaggggaagaccgtgtggttcgtcccgagcatcaaggctggcaacgacatcgccgcctgtctgcgcaagaacggcaagaaggtgatccagctctcccggaagacctttgactccgagtacgtgaagacgcgcgctaacgactgggacttcgtcgtaacgaccgacatctctgagatgggggccaacttcaaggcggaacgggtgatcgacccccgccggtgcatgaagcccgtcatcctgaccgacggcgaggagcgcgtgatcctggccgggcccatgccggtgacccacagctccgccgcccagcggcggggccgcattggcagaaaccccaagaacgagaacgaccagtacatctatatgggagagcccctcgagaacgacgaggactgcgcccactggaaggaggcgaagatgctgctcgacaacatcaacacgcccgagggtatcatcccgagcatgttcgagcccgagcgcgagaaagtcgacgccatagacggggagtaccggctccgcggcgaggcccggaagaccttcgtggacctgatgcgccgcggggatctacccgtgtggctcgcgtacagagtcgccgcggagggcatcaactacgccgatcggcgctggtgcttcgacgggatcaagaacaaccagatcctagaggagaacgtggaggtcgagatctggaccaaggaaggcgagcgtaaaaagctgaaaccgcgctggctcgacgcccgaatatactccgaccccctggccttgaaggagttcaaggagttcgccgccggccgcaagagcctgaccctcaacctgatcaccgagatggggaggctgcccaccttcatgacccagaaggcccgcgacgccctggacaacctggccgtgttgcacaccgctgaggcaggcgggcgggcctacaaccacgcgctgtccgagctgcccgagacgctcgagaccctgctgctcctgaccctgctcgcgaccgtgacgggcggcatctttctgttccttatgagcgggaaaggcattgggaaaatgacactcggcatgtgctgcatcatcaccgcatccatcctgttgtggtacgcccagatccagccgcactggatagccgccagtatcatcctagaattcttcctgatcgttctgctcatccccgagccggagaagcaacgtacgccccaggataaccagttaacctacgtggtgatcgctatcctgacagtcgtggctgccaccatggccaacgagatggggtttctcgaaaagaccaaaaaggacctgggcttgggcagcatcaccacacaggagagcgagagcaacatcctcgatatcgacctgcggccggcctccgcgtggaccctgtatgcggtggccaccacattcgtcacgcccatgctcaggcacagcatcgagaacagcagcgtgaacgtgtccctgactgccatcgccaaccaggcgactgtcctgatggggcttggcaaggggtggcccttgagcaagatggacattggcgtgccgctcctcgccatcgggtgctactcccaggtgaacccgatcaccctgacggccgcccttctcctgctggtagcccactacgctatcatcggccccggtttgcaggccaaggccacccgcgaggcccagaagcgcgcagcggccgggatcatgaaaaaccccaccgtcgacgggatcaccgtgatcgacttggagcccatcccgtacgatcccaagttcgagaagcagctggggcaagtgatgctcctgatcctctgcgtaacccaggttctcatgatgcgcaccacctgggcgctgtgcgaagccctgaccctcgcaacgggccccatcagcaccctgtgggaggggaaccctggccggttctggaacaccaccatcgccgtctccatggccaacatcttccgcggcagctacttggccggggccggcctcctcttttccatcatgaagaatacgaccaacacccggcgcggtaccggcaacatcggcgagacactgggggagaagtggaagtcacgattaaacgctctggggaagtccgagttccagatctacaagaagtccgggatacaagaggtggaccgcaccctggccaaggagggtatcaagcgcggggagacagatcaccacgccgtgtcccgcggcagcgccaagctccgatggttcgtcgagcgaaatatggtgaccccggagggcaaggtggtcgacctgggctgcggccgaggcggatggtcctactactgcggcggcctgaagaacgtgcgtgaagtgaagggcctcacgaagggagggcccgggcacgaggagcccatccccatgagcacctacggctggaacctggtccgcctgcagtcgggggtggacgtgttcttcaccccgcccgagaaatgcgacacgctactgtgcgacatcggcgagtcctcacccaaccccacgattgaggccggccgcaccctgcgtgtcctgaacctggtggagaactggttgaacaacaacacccagttttgcatcaaggtcctcaacccgtacatgccctccgtcatcgagaagatggagaccctgcagcgcaagtacgggggagcgctcgtgaggaaccccctgtccaggaactccacccacgagatgtactgggtgagcaacgccacgggaaacatcgtctccagcgtcaacatgatttcacggatgctgataaaccgcttcaccatgaaacataagaaggcgacctacgagccggacgtggatctgggaagtgggaccagaaacatcggcatcgagtccgagatccccaacctggatatcatcgggaagcggatcgagaaaatcaagcaggagcacgagacgagctggcactacgaccaggaccacccctacaagacctgggcataccacggctcctacgagaccaagcagaccggcagcgcttcctcaatggtcaacggtgtggtgcgcctcctgacgaagccctgggatgtcgtgccgatggtgacccagatggcgatgaccgacacgacgcccttcggtcagcagcgggtgtttaaggaaaaggtggacacccgaacccaggagcccaaggagggcaccaaaaagctgatgaagatcactgccgagtggctctggaaggagctgggtaaaaagaagacgccccggatgtgtacccgcgaggagttcacccggaaggtgcgctccaacgccgccctgggcgcaatcttcactgacgagaacaagtggaagtccgcacgggaagccgtcgaggacagccgcttctgggagctcatcgaccgggagcgcaaccttcatctggaggggaagtgcgagacctgcgtgtacaacatgatgggcaagcgcgagaagaaactcggggagttcggaaaggccaaaggttcgcgcgccatctggtacatgtggctgggggcgcggttcctggaattcgaggccctcggcttcctgaacgaggaccactggttcagccgcggtaactccctgagcggcgtcgagggggagggcctccaccggttagggtacatactgcgcgacgtgtccaaaaaggagggcggcgccatgtacgcggacgataccgccgggtgggatacccggatcacgttagaggacctgaagaatgaggagatggtgaccaaccacatgaagggcgagcataagaagctggcggaggccatattcaagctgacctaccagaacaaggtcgtccgcgtgcagcggcccacgcccagagggacggtaatggacatcatcagccgccgggaccagcgaggctcgggccaggtgggtacctatggcctgaacaccttcaccaacatggaggcccagctgatccggcagatggaaggggagggtatcttcaagagcatccagcacctcacggtgaccgaggagatcgccgtccagaactggctggccagggtgggccgggagcgcctgtcccggatggcgatcagtggggacgactgcgttgtcaagcccctcgacgaccgcttcgcctccgccctcaccgccctgaacgacatgggcaaggtgcggaaggacatccagcagtgggagcccagccgcgggtggaacgactggacccaggtaccattctgctcccaccattttcatgaactagtcatgaaggacggacgggtactagtggttccctgccgcaaccaggacgagctgatcggtcgggcccgcatctcacagggagctggttggtccctcaaggagacggcctgcctgggcaagagctacgcccagatgtggaccctgatgtacttccaccgtcgcgatctccggctggccgccaacgcaatctgctccgccgtgccctcacactgggtgcccacatccaggaccacctggagcatccacgcaaagcacgagtggatgacgaccgaagacatgctggcagtttggaaccgtgtctggatccaggagaacccatggatggaagataagacccccgtggagagctgggaggaggtcccctacctcggcaagcgcgaggaccaatggtgcgggtcccttatcggccttaccagccgcgccacgtgggccaaaaatatccagaccgccatcaaccaggtgcggtccctcatcggtaacgaggagtacaccgactacatgcccagcatgaagcgctttcggcgcgaggaggaggaggccggcgtgctgtggtga

SEQ ID NO: 25194 - RNA, 9876 nt, synthetic construct
  misc_feature 1..9876: note = derived and/or modified CDS sequence (opt11) from DENV-2__EU569705__SS-prME
  source 1..9876: mol_type = other RNA
actgccggcgtcatcatcatgctcatccccaccgccatggcattccacctgaccactcggaacggggagccccacatgatcgttggccgacaggagaaggggaagtccctgctgttcaaaaccgaggacggagtgaacatgtgcacgctcatggcaatcgatctgggcgaattgtgcgaggatactattacgtacaaatgcccgctcctgcgccaaaacgaacccgaggacattgactgctggtgcaacagcaccagcacgtgggtgacctacggcacatgcactacgacaggcgagcaccggcgtgagaagcgatccgttgccctggtgccccatgtggggatgggcctggagacccgaaccgaaacgtggatgagtagcgagggggcctggaagcatgtccagcggatcgaaacctggatcctacggcacccaggcttcaccatcatggccgcgatcctggcctacaccattggcaccacccacttccagcgagccctcatcttcatcctgctgacggccgtggcgcccagtatgaccatgcggtgcatcggcatctccaaccgcgatttcgtggagggcgtatctgggggatcctgggtggatatagtgctcgagcacgggagctgcgtgacgaccatggcaaagaataagcctaccctggacttcgaacttataaagactgaggccaagcagcccgctaccctccgcaagtactgcatcgaagcaaaactgactaataccaccacagaatcccggtgcccaacgcagggcgagccaagcctgaacgaggagcaggacaagaggttcgtatgcaagcactccatggtagatcggggctgggggaacggatgcggcctcttcggcaaaggtgggatagttacttgcgcgatgttcacctgcaagaagaacatggagggaaaggtagtgctacccgagaacctcgagtataccatcgtcatcacgccccactccggggaggagcacgcggtaggaaatgacaccggtaaacatggcaaggagataaagatcaccccgcaatctagcatcaccgaggccgagttaactgggtacggcacggtgacgatggaatgcagcccccggaccggcctggatttcaacgaaatggtcctgctccagatggaggacaaggcctggctggtgcaccggcagtggttcctggatctacccctgccctggctgccgggcgccgatacccagggcagcaactggatccagaaggagacgctcgtcaccttcaaaaacccccacgcgaagaaacaggacgtcgtggttctggggtcccaagagggcgctatgcacaccgccttaaccggggccaccgagatccagatgagcagcgggaacctcctattcaccggccacctgaagtgccgcctgcggatggacaagttacagctgaaggggatgtcctacagcatgtgtaccggcaagtttaagatcgtaaaagagattgccgagacccagcacgggacgatagtcatccgcgtccagtacgagggcgacggctccccctgcaagatccccttcgagataatggaccttgagaagcggcacgtgctggggcgccttatcaccgttaaccccatcgtcgcggagaaagacagccccgtgaacatcgaagcggagccgccctttggcgactcctacatcatcattggggttgaacccggccagctcaagctgaattggttcaagaaggggagctccatcggacagatgttcgaaaccacgatgcgcggcgcaaagcggatggcaatactgggggacacggcctgggatttcggcagcctcgggggcgtcttcacctctatcgggaaagcgctgcaccaggttttcggcgccatctatggcgccgccttcagcggggtgagttggaccatgaaaatcctcatcggggtaatcattacctggatcgggatgaacagccgaagcacgagcctctccgtgtcgttagtgctggtcggggtggtaaccctgtacctaggggcgatggtccaggcagattccggttgtgtggtgagctggaaaagtaaggaactgaagtgcggcagcgggatcttcatcaccgacaatgtccacacgtggacggagcagtataagttccagcccgagagcccctccaagctggccagcgctatacagaaagcccacgaggagggcatctgcgggatccggtccgtgacacgccttgaaaacctcatgtggaagcagatcacccccgagttaaaccacattctcagcgagaatgaagtgaaactgaccataatgacgggcgacatcaagggtatcatgcaggctggcaagcggtcactgcgcccgcagcctacggagctcaagtatagctggaagacctggggaaaggccaagatgctgtctaccgagagccacaaccagactttcctgatcgatgggcccgagaccgccgagtgcccgaacactaaccgggcctggaactccctggaggtggaggattacggcttcggggtgtttaccacgaacatctggctgaagctgcgggagaagcaggacgtgttttgcgacagcaagctaatgtccgccgcgatcaaggacaatcgggccgtccacgccgatatgggctactggatcgagagcgccttaaacgatacctggaagatggaaaaggcgtccttcatcgaggtaaagagctgtcactggcccaagagccacaccctgtggagcaacggcgtgctcgagtcggaaatgatcataccaaagaacttcgcggggccagtgagccagcacaattacagacctggctatcatacccagaccgccgggccctggcacctgggcaaactggagatggacttcgacttctgcgaagggacgaccgtggtggtcactgaggactgcggcaacaggggcccctctctcagaacgacgactgcctccgggaagctgatcaccgagtggtgctgtaggagctgcacccttccccctctccgctaccggggcgaggacgggtgttggtacggcatggagattcgcccgctgaaggagaaggaggagaacctggtgaactcgctcgtgacggccgggcatggccagattgacaacttctcactgggcgttctgggcatggctctcttcctcgaggagatgctgagaacacgcgttggcaccaagcacgccatgctactcgtggccgtcagtttcgtaactctgatcacaggcaacatgagcttccgtgacctcggccgcgtgatggtcatggtgggcgccactatgaccgacgacattggaatgggcatcacctacctggcattgctggcggcgttcaaggtgcgccccacgttcgcagccggcctgttgctccggaagcttacttcaaaggaactgatgatggccaccatcggcatcgcactcctgagccagtcgaccatacccgagacgatcctggaactcaccgatgccctggcactggggatgatggttctcaagatcgtgcgcaacatggagaagtaccagctagctgtgacgatcatggccatttcctgcgtccctaatgcggtaatcctgcagaacgcctggaaggtgtcctgcaccatcctggccgccgtgagcgtgtcacccctgctgctcacgtcctcccagcagaaggcggattggatccccctggcactgaccatcaagggcctaaatccaaccgctatcttcttgaccacgctgagccggacatccaaaaaacggagctggccgctaaacgaggccataatggccgtcggcatggtgtccatcctggcgagtagccttctaaagaacgacatccccatgacagggcccctcgtggctggcgggctgctcaccgtctgctacgtgctgacgggccggtccgcagacctggaacttgaaagagccgccgacgtgaagtgggaggaccaggctgaaatcagtgggtccagccccattctgtccatcaccatcagcgaggacggtagtatgagcattaagaacgaggaggaggagcagacccttacaatactcatccggacgggcttactggtcatatcaggggtgtttccggtgagcatccccatcactgccgccgcctggtatctctgggaagttaagaaacagcgcgcgggcgtgctgtgggacgtgccgagcccgccgcccgtcggtaaagccgagctggaggacggcgcttaccggattaagcagcgcggtatcctaggctactcgcagattggcgccggagtgtacaaggagggtacgttccacacgatgtggcatgtgacccgcggggcggtcctgatgcaccgcggcaagcggatcgagcctagctgggcagacgtgaagaaggatctgatcagctacgggggcggctggaagctcgagggggagtggaaggaaggcgaggaagtgcaggtactggcgctggagccagggaagaacccccgcgccgtgcagaccaagcccggtctcttcaagacaaacaccgggacaatcggcgcggtaagtctggacttcagccccgggacgtccggaagccccattgttgaccggaagggcaaggtggtgggactgtatggcaatggcgtcgtgacccgctccggggcctacgtgagcgcgatcgctcagaccgaaaagtccatagaagacaaccccgagatcgaggacgacatcttcaggaaaaagcgcctcactatcatggacttacacccaggcgccgggaagacaaagcggtacttgcccgccatcgtccgcgaggctatcaagcgtggcctgcgcaccctgattctggcgccgacgcgcgtagttgctgcggagatggaggaggccctgcgggggcttccgatccgctaccagacacccgccatccgggcggagcacacgggccgggagatcgtagacctgatgtgccatgcaaccttcaccatgcgacttctcagccccgtgcgcgtgccgaactataatctgatcataatggacgaggcccacttcaccgatcccgctagcatcgccgcgcggggctatatttccacgcgcgtcgagatgggggaagccgctggcatcttcatgacggccacgccgccggggtcacgggacccgttcccccagtccaacgcgcccatcatggacgaggagcgcgagatcccggagcgcagctggaacagcggacacgagtgggtgaccgacttcaaggggaaaacggtgtggttcgtcccgagcatcaaagccggcaacgatatcgccgcttgcctgcggaagaacggcaagaaggttatacagctatccagaaagaccttcgatagcgagtacgtgaagacccgcgccaacgactgggacttcgtcgtgaccacggatatttccgagatgggggctaacttcaaagcagagagagtgatcgacccacgcaggtgcatgaagcccgtcatccttaccgacggcgaggagcgcgtcatcctggccgggcccatgccggttacgcactcctcggccgcacaacggcgcggccgcataggacggaatcccaagaacgagaacgaccagtacatatacatgggcgaacccctcgagaacgatgaggactgcgcgcactggaaggaggcgaagatgctactggataacatcaacacccccgagggcataatcccgagcatgtttgaacctgaacgcgagaaagtcgacgctattgacggggagtatagactccgcggcgaggcccggaagacatttgtggatctgatgcgccgcggggacctacccgtgtggctcgcctaccgggtcgcggccgagggcataaattatgcggaccggcgctggtgcttcgatgggatcaagaacaaccagattctagaagaaaacgtggaagtggagatctggaccaaggagggcgaacgaaagaaactgaagccgcgctggttagacgcgcggatctactccgaccccctggcgctgaaagagttcaaggagttcgctgccggccgcaagagcttgaccctaaacctcatcaccgagatggggcggttacccacgttcatgacccagaaggcccgcgacgccctggacaacctggcggtcctccacaccgccgaggccggggggcgggcctacaaccacgccctgtccgagctgccggagactctagagacgctgctacttctgaccctgctcgcgactgttaccggcggcatcttcctgttcctgatgagcgggaagggaatcgggaagatgacgctaggcatgtgctgcatcatcaccgcctctatcctgctgtggtacgcccaaattcagccccactggattgccgctagcataatactcgagtttttcctgatcgtccttctcatccccgagcccgagaagcagcgcacgccccaagacaaccagctgacttacgtggtgatcgcgatcctgaccgtcgttgccgccacgatggccaacgagatggggttcttggagaagaccaagaaggacctgggcctggggagcattgctacccaggaatccgagagcaacattctggacatcgatctacggccggcgtccgcctggaccctgtacgccgtcgctacgaccttcgttacccccatgctccgccacagcatcgaaaacagttctgtaaacgtgtccctgacggcaattgccaatcaggccacggtccttatgggattaggcaagggttggcccttatcaaagatggacatcggcgtgcccctgctcgcaatcgggtgctactcccaggtgaatccgatcaccctgaccgccgcgctgctactgctggtagcccactacgccatcatcggccccggcctacaagccaaagccactcgcgaggcgcaaaagcgcgccgcagccggcatcatgaagaaccccacggtggacggtatcaccgtgattgacctggagcccatcccgtacgaccccaagttcgagaagcagcttgggcaggtcatgctcctgatcctgtgcgtgacccaggtcctcatgatgcgcaccacgtgggccttgtgcgaggcgttgaccctcgcgaccggccccatcagcaccctgtgggagggtaatcccggccgcttttggaacacgacaatcgcagtcagtatggccaacatttttcgcggcagctacctggcgggtgccgggttactgttttccatcatgaagaataccaccaatacgagacgcggaaccggtaacattggcgagaccctgggtgagaagtggaagtcccggcttaacgccctgggcaagagtgagttccaaatctacaagaagtccgggatccaggaggtggaccgcacccttgcgaaggagggcatcaagcgcggtgagaccgatcaccacgccgtgtccagagggagcgcgaagctcagatggtttgtcgagcgcaatatggtgacccccgaaggcaaagtggttgacctggggtgcggacgcggcgggtggtcttattactgcggcgggctgaaaaacgtcagggaggtaaagggactcacgaagggagggcccgggcatgaagagcccatacccatgtcaacctacggctggaatttagtccggctgcaatcaggggttgacgtattcttcacgccacccgagaagtgcgacaccttgctatgcgacatcggtgaatccagccccaaccccaccatcgaagccggccgcaccctgcgggtcctcaacctggtggagaattggcttaacaacaatacgcaattttgcataaaggtgctcaacccttacatgccctccgtcatcgaaaagatggagaccctgcagcgcaagtacggtggtgccctggtgcggaaccccctaagcagaaactccacccacgagatgtactgggttagcaacgccaccgggaacattgtctccagcgtgaacatgatttcccggatgttgattaaccgcttcaccatgaaacacaagaaagctacgtatgagccggacgtggacctgggaagcggaacccgcaacatcgttattgagtccgagatccccaacctggatatcattggtaagcggatcgagaagatcaagcaggaacacgaaacgagctggcactacgaccaagatcacccctacaagacgtgggcgtaccatggttcctacgaaacgaagcagaccgggagcgcctccagcatggtcaacggggtggtacgtctcctgaccaagccatgggacgtcgtgccgatggtcactcagatggccatgacggacaccacccccttcgggcagcaacgggtattcaaagagaaggtagacacccgcacgcaggagcccaaagagggcaccaagaagctgatgaagattaccgcagagtggttatggaaggagctgggaaagaagaagacaccccggatgtgcacgcgcgaggagttcacacggaaggtccgctcaaatgcggccctgggggccatctttactgacgagaacaagtggaagtccgccagggaggccgtggaagactccaggttctgggagctgatcgaccgcgagcgcaacctgcacttagagggcaagtgcgaaacttgcgtctacaacatgatggggaagagagagaaaaaactcggcgagttcgggaaggcgaaggggagtcgcgccatctggtacatgtggctaggcgctcggttcctggagtttgaggccctagggttcctcaacgaagaccactggttcagccgcggcaattccctgagtggcgtagagggcgaaggtcttcatcggctgggatatattcttcgggacgtgtccaagaaagagggtggggcaatgtacgcagacgatacggctggctgggacacccggatcaccttggaggatctaaagaacgaggagatggtcactaaccacatgaagggggagcacaagaagctggccgaagccattttcaagttaacttatcagaacaaagtggtgcgcgtccagcgaccgacgccccggggcaccgtcatggacatcatctcccgccgggaccagcgcggttccggccaggtgggcacgtacgggctaaacacgttcaccaacatggaagcgcagctgatacgacagatggaaggcgaggggatcttcaaaagcatccagcacctcaccgttaccgaggagatcgcggtgcaaaactggctagcccgcgtgggccgtgagcgcctgtcccggatggcgataagcggcgacgattgcgtcgtgaagcccctagacgatcgcttcgcgtccgcccttacggcgctcaacgacatggggaaggtgcgcaaggacatccagcagtgggaacccagccgtggctggaacgactggacccaggtaccgttctgcagccaccacttccacgagctcgtgatgaaggacgggcgggtcctggtggtgccttgccggaatcaggatgagctgatcggccgggcccgcattagccagggtgccggctggtccctcaaggagaccgcctgcctgggaaagagctacgcccagatgtggaccttgatgtattttcaccggcgcgacctccggctggctgccaacgccatatgctccgcagtgccgagccactgggtcccaacgtcccgtaccacctggagcatccacgcgaagcatgagtggatgaccaccgaggacatgttggccgtctggaaccgggtgtggatccaggaaaatccttggatggaagacaagacgcccgtcgagagctgggaagaagtgccctacctcggcaaacgcgaggatcagtggtgcggtagcctgatcgggctgacaagccgcgcgacctgggcaaagaacattcagacggccataaatcaggttaggtccctcatcggaaatgaagaatacacggattacatgcccagcatgaagcgctttcggcgggaggaggaagaggcgggggtcctgtggtaa

SEQ ID NO: 25195 - RNA, 9876 nt, synthetic construct
  misc_feature 1..9876: note = derived and/or modified CDS sequence (opt11) from DENV-2__EU482589__SS-prME
  source 1..9876: mol_type = other RNA
accgccggcgtcataatcatgctgatacccaccgccatggcgttccacctcaccacccgcaacggcgaaccgcacatgatcgtcggcaggcaggaaaaggggaagtccctcctgtttaagaccgaagacggggttaacatgtgcaccctcatggccatcgatctgggggaactgtgcgaagacaccatcacgtataagtgtcccttactccggcagaacgagcccgaggacatcgactgctggtgcaacagcacctccacatgggttacctacggaacctgcacgaccacaggcgagcaccggcgagagaagcgcagcgtcgcgctggtaccccacgtggggatgggcctcgagacccgaaccgagacctggatgagcagcgagggggcatggaagcacgtccagcggatcgaaacgtggatcttgcgccacccgggcttcacaatcatggcggcaatactggcctacaccatcggcacaacccacttccagcgggcgctcatattcatcctgctgaccgccgtcgcgccctcaatgaccatgaggtgcatcggtatctccaatagggatttcgtcgagggtgtctcgggcggctcctgggtggacatcgttctagagcatgggagctgtgtcacgacaatggccaagaacaagccaaccctggatttcgagttgatcaagaccgaagccaagcagcccgcgacccttcgcaaatattgtatcgaggccaagctaacgaataccactaccgagagtcgctgcccgacccagggcgagcccagcctgaacgaggagcaagacaagagattcgtttgcaaacacagcatggtggaccggggttggggaaacggctgcggccttttcgggaagggtggaatcgtaacgtgcgcgatgttcacctgtaagaagaacatggagggaaaggtggtgctccccgaaaacctggagtacacgatagtcataacaccccacagcggggaggagcacgccgttggtaacgacaccggtaaacatggtaaggagatcaagatcacgccgcaatcaagcatcaccgaggccgagttaactggatacggtacggtgaccatggagtgtagcccccggatgggcctcgacttcaatgagatggtcctgcttcagatggaggacaaggcctggctggtgcaccggcaatggttcctggacctccccctgccttggctgccgggggctgatacgcagggcagcaactggattcagaaggagaccctggtgacgttcaagaacccgcacgcaaagaaacaggacgttgtggttctggggtcgcaagaaggcgccatgcacaccgccctgaccggggccaccgagatccagatgagctcaggcaacctactgttcactggtcacttaaagtgccgcttacggatggacaagctgcagctaaaagggatgtcctacagcatgtgcaccggaaaattcaaaatagttaaggagatcgccgaaacccagcacggcacgatagtgatccgcgtccagtacgaaggtgacgggtccccctgcaaaattccctttgagataatggacctcgaaaaacggcatgtgctgggtcgcctaataacggttaaccccatcgtcaccgagaaggacagccccgtgaacatcgaggcggagccgccatttggtgactcctacatcattataggggttgagcctggccagctcaagctgaattggttcaaaaagggtagctccatcggccaaatgtttgagaccaccatgcgtggcgccaagcggatggccatcctgggtgacacggcctgggactttggttctctcgggggcgtcttcacctccatagggaaggccctgcaccaggtattcggcgcgatctacggtgccgcctttagcggggtgtcctggaccatgaagatactgatcggcgtgataatcacatggatcgggatgaacagccgctctactagcctgagcgtctccctcgtgttggtcggcgtcgttaccttgtacctcggggccatggttcaggcggactctggatgcgtggtgtcttggaagtccaaggagctgaagtgcggaagcggtatcttcattactgacaacgtccacacgtggacggagcagtacaagtttcagcccgagtcacccagcaagctggccagtgcaatccagaaggctcacgaggaggggatctgcggcatccggtccgtcacccgcctcgagaacctgatgtggaagcagataacgccagagctgaaccatatcctttcagagaacgaggttaaacttactataatgacgggcgacatcaaggggattatgcaagctggcaaacgatccctgcgcccacagcctaccgaacttaaatacagctggaagacctggggcaaggctaagatgctttctaccgaaagccataaccagacgtttttaatagacggtcccgagaccgccgagtgcccgaacacgaaccgggcctggaactccctcgaagtggaagactacgggttcggggtgttcaccacgaatatctggctgaagttacgcgagaagcaggacgtgttctgtgatagcaaacttatgtccgccgccattaaagacaatagggcggttcacgctgatatgggctactggattgagagtgcactaaacgacacctggaagatggagaaggcctccttcatcgaggttaagtcgtgccattggccgaaatcccacaccctgtggtctaacggcgtcctggaatccgagatgatcatcccgaagaacctggccgggcctgttagccaacacaattaccgaccggggtaccacacgcagacagcggggccctggcacctgggcaagctcgagatggactttgacttctgcgagggaacaaccgttgtcgttaccgaggattgcggcaatcggggacccagcctgcgaactacgacggcctccgggaaactcgtgaccgagtggtgctgccggagctgcacgctaccacccttgcggtaccggggcgaagatgggtgctggtacggtatggagatcaggccgcttaaggagaaggaggagaacctcgtgaactccctggtcacggcagggcacggtcaaatcgataactttagtctgggcgtgctcgggatggcgctgttccttgaggagatgctccggacacgtgtgggcaccaaacacgcgatccttctggtcgccgtttccttcgtgaccctgatcactgggaatatgtcgtttcgcgatctcggacgtgtcatggtgatggtaggcgccactatgactgatgacatcggcatgggcgttacatatctagcattattagccgcgttcaaggtgcgccccacgttcgccgccgggctgctcctacggaagttgacctccaaagagctcatgatggccacgatcgggatcgccttactgtcacaatccacaatcccagagacgattctggaactgaccgacgcgttggccctcgggatgatggtgctgaaaatcgtacgcaatatggagaagtaccagctggccgtgacaatcatggccatttcctgcgtcccaaacgccgttatcctccagaacgcctggaaggtatcgtgtacaatactcgccgccgtaagcgtgagccccctgttattaacgagctcgcagcaaaaggccgactggatccctctggcactcaccatcaagggtctgaaccccaccgctatcttcctgaccacgctcagccgtaccagcaagaagcgtagctggccgctcaatgaggccatcatggccgtaggcatggtcagtatcctcgcatctagcctcctgaagaacgatatccccatgaccgggcccctggtagccggagggctccttactgtatgttacgtactgactggccggtccgccgatctagagctggagcgcgctgccgacgtcaagtgggaagaccaagccgagatcagcggttccagccctatactgtcaatcacaatttcggaggatggctccatgtcgatcaagaacgaagaggaagaacagacacttaccattctcatccgaactggcctgctcgtgatctccggcgtctttccggtgagtatccccatcaccgcggcagcctggtatttgtgggaggtcaagaagcagcgcgcaggagtcctgtgggacgttccgagcccgccgccagtcggcaaagccgaactcgaggatggggcatacagaatcaagcagagggggatcctgggctacagccagatcggagcaggggtatacaaagagggcacgtttcacaccatgtggcatgtgacccggggtgctgtgctgatgcatcgcggcaagcgtatcgaaccctcctgggcagacgtcaagaaggatctcatctcatatgggggcggttggaaactggagggggagtggaaggagggcgaggaggtccaggtgctcgcccttgagccagggaagaatccccgggcagtccagacgaaacccggtctgttcaaaacgaacaccgggaccatcggcgccgtgtccctggatttcagcccgggcacctccggcagccccatcgtagaccgcaaggggaaggttgtgggactttacggcaacggagtggtcacccgctccggggcatacgttagtgccatagcgcagaccgaaaagtccattgaggacaaccccgaaatcgaggacgacatattccgcaagaagagactcaccattatggacttacaccccggcgccggcaagacgaagcgatatctgcccgccattgtgcgggaggccatcaagcggggcctccgcacactgatactggccccgacccgtgtggtggcagcggagatggaagaagcccttaggggactgcccattcgttatcagacgccggctataagagctgaacacaccggccgcgaaattgtggatctgatgtgccacgccacgttcaccatgcggttactgagtccggtccgagtgcccaactacaacctgatcatcatggatgaggcccactttacagatccagcaagcatcgcggcccggggctacatctccacacgagtggagatgggggaagcggctggcatcttcatgaccgccacgccgcccgggagccgggacccgtttccccagtccaacgcccccatcatggatgaggaacgcgagattcccgagcggagctggaactccggtcacgagtgggtcacagacttcaagggtaaaacggtttggttcgttccaagcatcaaggcgggcaatgacatcgccgcgtgtctacgaaagaacggcaaaaaggtaatccaactgtcccggaaaaccttcgacagcgaatatgtgaagaccagggccaacgactgggacttcgtggtcaccacggatatctccgagatgggtgccaacttcaaggcggagcgggtaatcgacccccgccggtgtatgaagccggtgatactcacggacggcgaggagcgcgtcatcctcgctggacccatgccggtaacccacagtagcgccgcgcagcgtcgcggccgcatcggtcgaaatcccaagaacgagaatgaccaatacatatacatgggagagcccctggagaatgacgaggactgtgcccactggaaggaggcgaagatgctgctcgacaacatcaacactcccgaaggcatcattccgtcgatgttcgaacccgagcgcgagaaggtggatgcaatcgacggcgagtatcgcctgcgcggcgaggcacggaagacgtttgtcgatctgatgcgcagaggggatctccccgtgtggttggcctaccgagtggccgctgaagggatcaactacgctgacagaaggtggtgcttcgacggtatcaagaataaccagatcctggaggagaacgtcgaggtggagatttggaccaaggagggcgagcggaagaagttgaaaccgcggtggcttgacgcccggatctactccgaccctctggctctgaaggagttcaaggagtttgcggctggacgcaaatccctcaccctcaacctcatcaccgagatggggcggctgcccacgtttatgacccagaaagcccgtaacgctttggacaatctcgccgtcctgcacaccgcggaggccggcggccgtgcctacaaccatgccctgtctgaattgcccgagaccttagagacgctcctcctgcttaccctcctcgccaccgtgaccggtggcatattcctattcctcatgtctgggaagggcattgggaagatgactctcggcatgtgctgcataatcaccgcgtctatcctgctctggtacgcccagatccagcctcattggattgccgccagcatcatcctggagttctttctgatcgtgttgctgatccccgagcctgagaagcagcgaacaccacaagacaaccagctgacctacgtcgtgatcgcaatcctcaccgtggtcgccgccacgatggctaacgagatgggattcctcgagaagaccaagaaagacctgggcctcgggagcataaccactcaggaatccgagtctaacatcctggacatcgacctccgaccggcgtccgcctggactctatatgcggtagccacgacctttgtcacccctatgctccgccactcgatcgaaaactccagcgtcaacgtctccttaacagccatcgccaatcaggcgaccgtgctcatgggcctgggcaaggggtggcccctgagcaaaatggacattggcgtccccttgttagcaatcgggtgctactcccaggtcaacccgataaccctgaccgctgccctcctgctgcttgtggcccactacgcgatcataggccccggcctgcaggccaaagccacgcgggaggcccaaaagcgcgccgcggccggtattatgaagaaccccaccgtcgacggcatcaccgtaatcgacctggagcccatcccgtatgatccgaagtttgagaagcagcttggacaggtgatgctgcttatcctctgcgtaacccaggtgctgatgatgcgcacaacctgggccttatgtgaagccttgacactggccacagggcctatcagcacgctatgggaagggaaccctggcaggttttggaacaccactatcgccgtgtctatggccaacatctttcgcgggtcctacttagcgggcgccgggttactgttttccatcatgaaaaataccacgaatactagacgcgggaccggtaacatcggcgagactctaggtgagaagtggaagtcaagacttaacgctctgggcaagagcgagtttcagatctacaagaagtccggtatccaggaggttgatcgcactctcgcgaaggagggaatcaagcgcggggaaacagaccaccacgctgtttccaggggctccgctaagctacggtggttcgtggagcgcaacatggtgacccccgaaggcaaggtggtggacctcgggtgtggacgcggagggtggtcctactactgtggcgggctcaagaatgtgcgtgaggtgaaggggcttacaaaaggcgggcctgggcacgaggagcccatccccatgtcgacgtacggctggaacctagttcgcctccaaagtggggtcgatgtgttcttcacaccgcccgaaaagtgcgacacactgctgtgcgatatcggcgagtccagccccaatcccaccatcgaagccggacgcaccctcagggtgttgaaccttgtggagaattggttaaacaataacacccagttctgcatcaaggtattgaacccatatatgccatccgtgatcgagaagatggagaccctgcaaaggaagtacgggggcgcgctagttcgaaatcccctcagccgaaattccacccacgagatgtactgggtaagcaacgcgacggggaacatcgtctcaagcgtcaacatgatttcccggatgttaatcaatagattcactatgaagcacaaaaaggccacatacgaacctgatgtggatcttgggtctgggacccggaacatcggaattgaaagtgagatacccaacctagacatcatcggcaagcggatcgaaaagatcaagcaggagcatgagaccagctggcactacgatcaagaccacccttataagacgtgggcctaccacgggtcatacgagaccaagcagaccggctctgccagtagcatggtgaacggagtagtgcgactgttgaccaagccctgggatgtagtcccgatggtgacacagatggccatgaccgacaccacccctttcggccagcaacgggtctttaaggagaaggtcgacactcgcacccaggagccgaaagaaggcaccaagaagctaatgaagataaccgctgaatggctgtggaaagagctgggaaaggagaagacaccccggatgtgtacgcgcgaggagttcacccggaaggtgcggtccaacgccgctctcggcgccatcttcaccgacgagaacaaatggaaatccgcgcgtgaggccgtcgaggacagtcgcttctgggagctcattgaccgcgaacgcaatctgcatctcgaggggaagtgcgagacttgcgtctacaatatgatgggcaagcgggaaaagaagctgggggagttcggcaaagccaaaggctcgcgggccatctggtacatgtggctgggggcgcgattcctcgagttcgaggccttaggctttctaaatgaagaccactggttctcacgcgaaaattcgcttagcggggttgaaggcgaggggctccaccggctaggctacattttacgagatgtctccaagaaggaaggcggggccatgtacgccgacgacacagcgggctgggatacccggataaccctcgaggacctcaaaaacgaggagatggtgacgaaccacatgaagggggaacataagaagctagcggaggccatctttaaacttacttaccagaataaggtggtccgcgtgcagcggccgacgccccgcggcaccgtgatggacattatcagccgccgggaccagcgcggtagtggtcaagtaggcacctacggactcaacacatttaccaacatggaagcccagctcatcaggcagatggagggcgaagggatcttcaagagcatccaacacctgacagccactgaggagatcgctgtccagaattggctggctcgcgtagggagagagaggctctcacggatggcaatcagcggtgacgattgcgtcgtcaaacccctggacgaccggtttgccagcgcactgaccgccctcaacgacatggggaaggtgcggaaggatatacaacagtgggagcccagccgagggtggaacgactggacgcaggttccgttctgctcccatcatttccatgagctggtgatgaaggacgggcgggtgctcgtcgtaccctgccgcaaccaagacgagctcataggccgagcgagaattagccagggggccggctggtcattaaaggagaccgcctgtctcggcaaatcctacgcccaaatgtggactctcatgtacttccacaggcgtgatctgagactagcagccaacgccatctgttccgcagtaccctcgcattgggttcctacatcccggaccacctggtcgatccacgcgaagcatgagtggatgacgacggaggacatgctcgcggtgtggaaccgtgtctggatacaggagaacccttggatggaagacaagacacccgtcgagtcctgggaggaggttccataccttgggaagagagaggaccagtggtgcggctccctgatcgggctcaccagccgcgccacctgggcaaagaacatccaaacggctattaaccaggtgcgcagtctcatcggcaacgaggaatataccgactatatgcctagcatgaaacgcttccggcgcgaagaggaagaggccggggttctgtggtag

SEQ ID NO: 25196 - RNA, 9876 nt, synthetic construct
  misc_feature 1..9876: note = derived and/or modified CDS sequence (opt11) from DENV-2__EU569706__SS-prME
  source 1..9876: mol_type = other RNA
accgccggtgtgatcatcatgctgatacccaccgccatggcgttccaccttaccacccgcaacggggagccgcacatgatcgtgggcagacaggaaaaggggaaatccctgctatttaagaccgaggacggcgtgaacatgtgcaccctcatggctatagacttaggggagctttgcgaggacacgattacctataagtgtcccctcctgcggcagaacgaacccgaggacatcgactgctggtgcaacagcaccagcacctgggtgacatacgggacctgcaccacgacgggcgaacaccggcgcgagaagcggtccgtcgccttagtgccccacgtggggatgggcctcgagaccagaaccgagacatggatgagcagcgaaggggcctggaaacacgtccaacggatcgaaacttggatcttacgccaccccggcttcactatcatggccgctatcctcgcgtacaccatcgggaccacccactttcagcgggcactcatctttattctgttaacagccgtggcgccatctatgacgatgcgctgcatcggcatttccaaccgggatttcgtggagggggttagcgggggctcctgggtggatatcgttctcgagcacgggagctgcgtcaccacgatggccaaaaacaaacccacgctggactttgagctgataaagacggaggccaaacagcccgccacattacgcaagtattgcattgaggccaagttaacgaacaccaccaccgaaagtcggtgcccgactcagggggagcccagcctaaacgaggagcaggacaagcgcttcatctgcaaacactctatggtggatcggggctgggggaatggttgcggcctcttcggaaagggcgggatcgtgacctgtgccatgttcacatgtaagaagaacatggagggcaaggttgtactacccgaaaacctagagtacaccatcgtgatcacgccgcacagcggcgaggagcacgccgtcggaaacgacaccggcaagcacggcaaagagatcaaaatcaccccccaatcgagcattaccgaggccgaattgaccgggtatggcacagtgaccatggagtgctcaccccggaccggtctggattttaacgagatggtgttactccagatggaagacaaggcctggctggtccaccggcagtggttcctggatctcccgctgccctggctgcctggggccgacactcaggggtctaactggatccagaaggaaacgctagtgaccttcaagaatccccacgcgaagaagcaagatgtggtcgtactggggtcccaggagggcgctatgcacacggcacttacgggggccacggagatccagatgagcagcggcaatctcctgttcactggccacctgaagtgccggctccggatggacaagctgcaactgaagggtatgtcctacagcatgtgcaccggcaagttcaagatcgtcaaggaaatcgccgagacccagcacgggaccatcgttatccgcgttcagtacgagggcgatggttccccctgcaaaatccccttcgagattatggacctcgagaagcggcacgtactggggcgcctgataactgtaaaccccatcgtggccgagaaggattcgcccgttaacatcgaggccgagccgcccttcggcgactcctacattatcatcggcgtggagccgggccagctcaagctaaactggttcaagaaggggagttccatcggccagatgttcgagaccaccatgcgcggcgctaaacggatggcaatactgggcgatacggcttgggactttggctcgctcgggggcgtcttcacatcaatcgggaaggccttgcaccaggtcttcggcgccatctatggcgcggccttcagcggggtgtcctggacgatgaagatccttatcggagtgatcattacctggattggaatgaacagccgctccacgagcctgagtgtaagcctcgtgctggtaggcgtagtaaccttgtacctgggggtaatggtccaggcggactccggctgtgtggtgtcatggaaaaacaaagagctgaagtgcggctccggaatcttcattacagacaacgtccatacctggacggaacagtacaagtttcagcctgagtcccccagcaagcttgcctccgccattcagaaagcacacgaagagggaatctgcgggatacggagtgtcacccgcctcgagaacttgatgtggaagcagataacaccagaacttaaccatattctgtccgagaacgaagtgaagctgactatcatgacgggcgacatcaaggggatcatgcaggcgggcaaacggagcctgcgcccgcaacccacggagctaaagtattcttggaaaacctggggcaaagcgaagatgctgagcaccgagagccataatcagacgttccttatcgatgggcccgagactgccgagtgcccaaatacaaatcgggcctggaactctctcgaggtagaggattacggcttcggggtgttctccaccaacatctggctcaagctgcgcgaaaagcaggacgtgttctgcgacagcaagttgatgtcagcggcaatcaaggataaccgggcggtccacgccgacatgggctactggatcgaatccgcactgaatgacacctggaagatggagaaggcctccttcattgaagtaaaatcgtgtcattggcccaagagccataccctgtggagcaacggcgtccttgagtccgagatgatcatccccaagaatttcgccgggccggtaagtcagcacaattaccgcccaggctatcacacccaaaccgcgggtccctggcacctgggcaagctggagatggacttcgacttctgcgagggaaccactgtcgtggtaaccgaagactgcggcaaccggggccctagcctccgcacaaccacggcttccggtaagttaattaccgaatggtgctgccggagctgcaccctgcctccgctccgctaccggggtgaggacgggtgttggtacggaatggagatccgcccgctgaaggagaaggaagagaacttagttaactccctagtgactgccggccacggccagatcgacaactttagtctgggcgttctggggatggcgttatttctggaggagatgctgcgaacgcgcgtgggtaccaagcacgcgatcctcctggtcgccgtctccttcgtgacactgatcaccggtaatatgtcatttcgggaccttggccgggtgatggttatggtgggggctacgatgaccgacgacatcggaatgggcgttacctatctggcccttctcgcggcatttaaagtccgccccacatttgctgccgggttactgctcagaaaactgacttctaaagagctgatgatggccaccatcggcatcgccctgctgtcccaatccacgattcccgagaccatactggagttaacggacgcgctggccctggggatgatggtcctgaagatagtgaggaacttagaaaaataccaacttgccgtcaccatcatggccataagctgcgtgcccaacgcggtgatactgcaaaacgcgtggaaggtcagctgcaccatactggcagccgtgagtgtcagccccttactcttgacaagctcccagcagaaggccgattggatcccgctggcgctgacaatcaagggcctgaatccaaccgccatcttcctgacgacccttagccgtacgtccaagaagagaagctggccgctgaacgaggcggttatggccgtgggaatggtctccattctggccagctctctgctgaagaatgacatccccatgaccggtccgctggtagcaggcgggttgctgacagtgtgttacgtccttaccggccggtccgccgacctggagttggagagggcggccgacgtgaagtgggaggaccaagccgagatcagcgggtccagcccaatcctctccatcacaatttcagaagatggttccatgtccatcaagaacgaggaagaggagcaaaccctcacgattcttatccgtacgggtttgttggtgatctccggggtcttccctgtcagcatccccatcactgcggcggcctggtatctgtgggaggtgaagaaacagcgcgccggcgtactctgggacgtaccttcaccgccgcccgtcgggaaggccgagctcgaggatggcgcgtatcgaatcaagcagcgcggtatcttcggctacagccagattggggccggggtctacaaggagggaaccttccacaccatgtggcacgtgacccgcggggccgtgctgatgcaccgcggcaaacggatagagccctcatgggccgacgtcaaaaaggacctgatcagctatgggggcgggtggaagctcgagggagaatggaaggaaggcgaagaagtgcaggtgctcgccctcgagcccgggaagaaccctcgggccgttcagacgaaacccgggcttttcaagacgaacactgggaccatcggcgctgtgagcctggacttcagccccggcacaagcgggagcccaatcgtagacagaaagggcaaggtcgtgggactgtacggaaacggggtggtcacgcgctccggggcctatgtttcggccatcgcgcagactgagaagtccatcgaggacaaccccgagatcgaggacgacatctttcggaagaagcgcctaacgatcatggacctgcaccccggcgccgggaagactaagcggtacctgcccgccatcgtgcgcgaggccatcaagcggggattacgcacgctcatcctagccccgaccagagtcgtagcggccgagatggaggaggcgctccgggggctcccgattcgttaccagacccccgccatcagagccgagcacaccggccgcgaaatcgtggacctgatgtgtcacgcgacgttcaccatgcggctgttgtcccccgtccgcgtgcctaactacaacctgattatcatggatgaggcccatttcaccgacccagccagtatagccgcccgcggttacatctccaccagggtggaaatgggggaggcagccggcatcttcatgacggctacgccgcccgggagcagagaccccttcccccaatctaacgcccccatcatggacgaggagcgcgagatccccgagaggtcttggaattccggccacgagtgggtcaccgacttcaaggggaagacagtttggtttgtgccgtcaatcaaggcgggcaacgatatcgccgcctgccttcggaaaaacggtaagaaggtcatccagctctcccggaagacgtttgactctgagtacgtgaaaacccgcgccaacgactgggatttcgtggtcaccaccgacatctccgaaatgggggctaatttccgggcagaacgggttatcgaccccaggcgttgtatgaaacccgtgatcctgacggacggcgaggagcgggtcatcttagcagggcccatgccggttacacactcaagtgccgcccaaagaagaggccggatcgggcgcaaccccaaaaacgagaacgaccagtacatttacatgggcgaacccctggagaatgacgaagattgcgcgcactggaaggaggcgaagatgcttctggacaatattaacaccccggagggcatcatcccgagcatgttcgagccagagcgggagaaggtggacgctattgacggggagtatagactccggggagaagcaaggaaaacctttgtcgacttgatgcgacgcggcgacttgcccgtgtggctcgcttatagagtcgccgcggagggcatcaactacgccgatcgccggtggtgtttcgacgggatcaagaacaaccagatcctggaggagaacgtggaggtggagatctggacgaaggagggcgagcggaagaaactaaagccacggtggcttgacgccagaatatactccgacccgctggccctgaaagagttcaaggagttcgcggctggccgcaagtcccttactttaaatctgattacggaaatggggcgcctgcccaccttcatgacgcaaaaggcacgggacgcactggacaatctagccgtgctacacaccgcggaagtgggagggcgcgcctacaatcacgccctgtccgagctgcccgaaaccctagaaaccctgcttctgctgacgcttctcgccacagtgaccggcggcattttcctctttctgatgtccggaaagggaatcgggaaaatgaccctcggcatgtgctgcattatcacggcctcaatcctgctttggtacgcacagatccagccccactggatcgccgccagcatcatactcgagttcttcctgatcgtcctgctcattcccgagcccgagaagcagaggacgccccaagataaccagctgacgtatgtggtgatcgccatacttaccgtagttgcagctaccatggccaacgaaatggggtttctcgagaagaccaagaaggacttgggactgggcagtatcaccacccaggagtcagagagcaatatactcgacatcgacctgagacctgccagcgcctggaccctgtacgccgtggcgacgaccttcgtcacgcccatgctccggcactctatcgagaactctagcgtaaacgtttccctcaccgctatcgcgaaccaagccacggtcctgatggggcttggccgagggtggccgctcagtaagatggacatcggcgttcccctgctagcgattggctgctactcccaggtcaatccgatcaccctgactgcggcgctactcctgctggtcgcccattacgcgatcatcgggccaggcctccaggcgaaagccactagggaggcccagaagcgggcagctgctgggatcatgaagaacccgacggtcgatggcatcaccgtcatcgacctggaacccatcccgtacgatccaaagttcgagaagcagctggggcaggtcatgctactggtactatgtgtgactcaagtactcatgatgaggaccacctgggccctgtgcgaggccctcactctcgccaccggtcccataagcaccctgtgggaggggaaccctggccgattctggaacacgaccatcgccgtgtccatggcgaacatcttcagaggcagctacctggccggtgccggactcctgttctcgatcatgaagaacactacgaacacccgacgcggaactggaaacatcggcgaaacacttggggagaagtggaaatcaagactcaacgccctgggaaaatccgagttccagatttacaaaaagtccgggatccaagaggtggaccgcaccctggcgaaagagggcatcaaacgcggggaaacagaccaccacgcggtctcacgcggcagtgccaagctcagatggttcgtggagcgcaatatggtgacccctgagggcaaggttgtcgacctagggtgcggtcgcggggggtggtcctactactgcggtgggctgaaaaatgtaagagaagtcaagggtctcaccaagggagggccggggcacgaggagccgatccccatgagcacctacggatggaacctggtgaggctgcagtccggagtggatgtcttctttactccgcccgagaagtgtgacaccctcttatgtgacatcggcgagtcctcgcccaaccccacgatcgaagccggccgcaccctgcgggtcttaaacctggtggagaactggctcaacaacaacacccagttctgcatcaaagttttgaatccatacatgccctccgtgatcgagaagatggaaactctgcaacgcaaatacgggggcgcgctggtgcggaatcctctgagccgtaactccactcacgagatgtattgggtcagtaacgctaccgggaacatcgtgtccagtgttaacatgatctcccgtatgctgatcaaccggtttaccatgaaacacaagaaggccacctacgaaccggatgttgatctgggcagcgggacccgaaacatcggtatagagaacgagatacccaacctggacatcatcggcaagagaattgagaaaatcaagcaagagcacgagaccagctggcactatgatcaggaccacccgtacaagacctgggcctaccacgggagctacgagacgaagcagaccggatccgcgagctccatggtgaacggggtggttcggcttttaaccaagccctgggacgtggtgccgatggtcacccagatggccatgacggacaccacaccattcggccaacaacgggtgttcaaagagaaggtggataccaggacgcaggagcccaaagagggcacgaagaagctgatgcggatcaccgcggaatggttatggaaggaactggggaagaagaagacgccccggatgtgcacgcgtgaggagttcacccgcaaagtccgcagcaacgccgccctgggagcgatctttaccgacgagaacaagtggaagtccgcgcgcgaggcggtcgaggacagccggttctgggagctcgtggatcgcgaacggaacctgcatctagaggggaaatgcgaaacctgcgtctacaacatgatgggcaagcgcgagaagaagctgggcgagttcggcaaggccaagggctcgcgggccatctggtacatgtggctgggtgcacgatttctggaattcgaggcgttgggcttcctgaacgaagaccactggttcagccgggggaacagcttatccggagtggagggggaggggctccataagctgggctacatattacgagacgtatccaagaaagagggcggcgccatgtacgctgacgacacggcaggctgggacacccggatcacgctcgaggaccttaagaacgaggagatggtgaccaaccacatgaaaggagagcacaagaagctggctgaggcaattttcaagcttacctaccagaacaaagtagtcagggttcagcgcccgacgccgcgcgggacggtgatggacatcatctcccgtaaggatcagcggggatctggccaggtcgggacctatggtctgaacacgttcaccaacatggaggcccaactgatccgacagatggagggtgagggcatcttcaagtccatccagcacctcacggtgaccgaggagatcgccgtgcaaaactggctggcaagggtcggtcgcgaaaggctgagcagaatggccatttccggggacgactgcgtcgttaagcccctcgacgaccggtttgcgagcgccctgacggccctcaatgacatgggaaaggtccgcaaagacatccagcagtgggagcccagtcgggggtggaacgactggacccaagtgcccttctgtagccaccacttccacgaactcgtcatgaaggacggacgcgtcctggtagtgccttgcaggaaccaagacgagcttatcgggagagcccggatatcccagggcgccgggtggagcctcaaggagacggcatgcctggggaaatcgtacgcccagatgtggacactgatgtacttccacagacgggacctccgcttagccgccaacgccatctgcagcgcagtccccagtcactgggtccccacgagccgaaccacctggtcaatccacgccaagcacgagtggatgaccaccgaggacatgctagcggtgtggaacagggtctggatccaggagaacccatggatggaggacaagacgccagtggagagctgggaagaggtgccatacctcggcaagcgcgaggatcaatggtgcggctcactgataggcctgactagccgggccacttgggcaaagaacatccaaacagctatcaaccaggtgcgcagcctcatcgggaatgaggaatacacggactacatgccctccatgaagcggttccgtaaggaggaggaggaggccggagtcctgtggtga

SEQ ID NO: 25197 - RNA, 9876 nt, synthetic construct
  misc_feature 1..9876: note = derived and/or modified CDS sequence (opt11) from DENV-2__EU569707__SS-prME
  source 1..9876: mol_type = other RNA
accgcgggggtaatcatcatgctcatccccacagccatggctttccacctcaccacccgcaacggggaaccccacatgatcgtaggtcggcaagagaaggggaagtccctgctgttcaagaccgaagacggagtgaacatgtgtaccctcatggccatcgacttaggggagctgtgcgaagataccatcacctacaagtgccccctcctgaggcagaatgagcccgaggacatcgactgctggtgcaacagcacgagcacctgggtgacgtacgggacctgcaccacaacaggtgagcatcggcgcgagaagcggtcagttgccctggtgccccacgtggggatgggccttgagacccgcactgagacctggatgagcagcgagggggcttggaagcacgtccagcggatcgagacctggattctgcgtcacccgggctttaccataatggccgcgatccttgcctacaccatcggaactacccattttcagcgtgctttaatcttcatcctgctgaccgccgtggcgcccagcatgacaatgcgctgcatagggatcagcaaccgggactttgtggagggcgtcagcggtggctcctgggtagacatcgtactcgagcacgggagctgcgtgaccactatggcaaagaacaagcccaccctggacttcgagctgatcaagaccgaagccaagcagcccgccaccctccgtaagtactgcgttgaggcgaagctgacgaacaccaccaccgagtcccggtgcccgacgcagggcgagccaagcctgaacgaggagcaggacaagcgcttcgtgtgcaagcactccatggtcgaccggggctgggggaatggctgcggactcttcggcaagggagggatcgtgacctgcgcgatgttcacttgcaagaagaacatggagggaaaggtggtcctgcccgaaaacctcgagtacaccatcgtgatcacgccccacagcggtgaggagcatgccgtgggtaacgacaccgggaagcacggcaaggagatcaagatcaccccgcagtccagcataactgaggccgagctcaccggatacggtacggtcaccatggaatgcagcccccgcaccggcctcgatttcaacgagatggtgttgctccggatggaggacaaggcctggctggtgcatcgccagtggttcttagacctccccctgccatggctcccgggggcggacacccagggcagcaactggatccagaaggagacgctcgtcaccttcaagaacccccacgcgaagaagcaggacgtggtggtgctggggtcccaagagggtgccatgcacaccgccctgaccggggcgacggagatccagatgagctctggcaacctcctgtttaccggccacctgaaatgccggctccgcatggacaaacttcagctgaaggggatgtcctacagcatgtgcacagggaagttcaagatcgtgaaagagatcgccgagacgcagcacggaacgattgtcatcagggtacaatacgagggcgacggctccccctgcaagattcccttcgagataatggacctcgagaagaggcacgtgctggggcgtctgatcactgtcaacccgatcgtggcagagaaggacagccccgtcaatatcgaggccgagccgcccttcggcgactcctacatcatcataggcgtcgagccgggccagctcaaacttaactggttcaagaaggggtcgtccataggccagatgttcgagaccacgatgcggggcgccaagcgcatggccatcctgggggacacggcatgggacttcggcagcctcgggggcgtgtttacctcgatagggaaagcgttacaccaggtgttcggggccatatatggcgctgccttcagcggggtctcctggaccatgaagatcctgatcggcgtgataatcacatggatcggaatgaacagccggtccacgagcctctccgtgagcctcgtcctggtgggcgttgtcaccctgtacctcggcgcgatggtgcaggccgattccggctgcgtggtcagctggaagtccaaggagctgaaatgcggcagcggtatcttcatcaccgataacgtacacacctggacagagcagtacaagttccagccggagagcccctccaagctggccagcgccatccagaaggctcacgaggagggaatctgcggcatccgcagcgtgacacggctcgaaaatctgatgtggaagcagataacccccgagctgaaccacatcctcagcgaaaacgaagtgaagctgaccatcatgaccggggatatcaagggcatcatgcaagcaggcaagcgctccctgcggccccagccgacagagctcaaatacagctggaagacctggggcaaagccaagatgctgtctaccgagagccacaaccaaacgttcctgatcgacgggccggagaccgccgagtgcccgaacactaaccgcgcctggaactccctcgaagtggaagactacggcttcggggtgttcactacgaacatctggctgaagctgcgggagaagcaggacgtcttctgcgacagcaagctcatgtccgccgcgatcaaggacaaccgcgccgtgcacgccgatatgggttattggatcgagtctgccctgaacgacacctggaagatggagaaggccagcttcatagaggtcaagagctgccactggcccaagtcacacactctgtggtccaacggtgtgctcgagagtgagatgatcatccccaagaacttcgcgggtcccgtatcacagcacaactaccggccgggctaccatacccagaccgccgggccctggcatctgggcaaactggagatggacttcgacttctgcgaaggtacgaccgtagtggtgaccgaggattgcggcaatcgcggccccagcctccggaccacgacagcttccgggaagctgatcaccgagtggtgctgtcgcagctgcaccctgccacccctccggtaccgcggcgaagacgggtgctggtacggcatggagatccggcccctgaaggagaaggaggagaacctggtgaactccttggtcacggcagggcacggccaaatcgacaacttcagcctgggcgtgctggggatggccctcttccttgaggaaatgctgcgcacccgggttggcaccaagcacgccatgcttctggttgccgtgtcatttgtgacactcatcacggggaatatgagtttccgcgacctcggccgcgtcatggtcatggtgggagccactatgaccgacgacatcgggatgggcatcacataccttgccctgctcgcggccttcaaggtccggccgacgttcgccgctgggctgctgctccgtaagctgacctcaaaggagctgatgatggcgaccatcggtatcgcactgctgagccaatccactatccccgagacgatcctggagttaaccgacgccctggccctgggcatgatggtgttaaagatcgtgcggaatatggagaagtaccagttggccgtcaccatcatggcaataagttgcgtaccgaacgcggtgatcctgcagaacgcctggaaagtctcatgcaccatcctcgccgccgtaagcgtctctcccctgctgctcacgagctcccagcagaaggctgactggatccccctggccctgaccatcaaaggcctgaaccccaccgcgatcttcctaaccacgttgagccgcacgtccaagaagcgttcgtggccgctcaacgaggccatcatggccgtgggcatggtaagtattctggcgagcagcctgttaaagaacgacatccccatgactggtcccctggtcgccggagggctgctcaccgtgtgctacgtgctgacgggccgctccgccgacctggagctcgagcgggccgccgacgtgaaatgggaggaccaagcggagattagcggttccagccccatcctttccattaccatcagcgaagatggctccatgagtattaagaacgaggaggaggagcagaccctgacaattctcatacgcacgggcctgctggtgatctccggtgtgttcccggtgagcattccgatcaccgcggcggcatggtacctctgggaggtgaagaagcagcgggctggcgtgctgtgggacgtccccagtcccccgcctgtggggaaggcggagctagaagacggcgcctaccgtatcaagcaacggggcattctcggatacagccagattggcgctggggtgtacaaggagggcaccttccacaccatgtggcacgtaacccgcggggccgtcctaatgcaccggggcaagcgcatcgagccttcttgggccgacgtgaagaaggacctgatcagctacgggggtggctggaagctcgaaggggaatggaaggagggcgaagaggtccaggtgctggccctggagcccggaaagaaccctcgggccgtgcagacgaagcccggcctcttcaagaccaacaccggtacaatcggcgccgtcagtctggacttcagcccgggcacgtcagggtcgcccatcgtggaccgcaaggggaaggtggtcgggctctatggcaatggcgtggtgacccgatccggggcttacgtgagcgcgatcgcgcagaccgagaaatccattgaggacaaccccgagatcgaggacgacattttccgcaagaaacggctcaccatcatggacctccacccgggcgcgggaaagacgaagcgctacctgcccgcaatcgtgcgggaagcaatcaagcgcggactgcgcactctcatcctggcgccgacacgggtggtcgccgccgaaatggaggaggcgctgagggggctccctatccgataccagacgccagccatccgcgcggagcacacgggccgggagatcgtggacctgatgtgccacgccactttcaccatgcgcttactctcgcccgtccgagtcccgaactacaacctgatcatcatggacgaggcccatttcaccgaccccgccagcatcgccgcgagggggtacatctccacacgggtcgagatgggggaggcggccggaatcttcatgaccgccacgccgccggggagccgtgacccgttcccccagtccaacgcgcccatcatggacgaggagcgggagatcccggaacgcagctggaacagtggccacgagtgggtgaccgacttcaaggggaagacggtttggtttgtgccgtccatcaaggccggtaacgacatcgccgcctgtttgcggaaaaacggcaagaaggtaatccagctctcccgcaagaccttcgacagcgagtacgtcaagacccgggccaacgactgggacttcgtggtgaccacggacatctccgagatgggggcgaatttcaaggccgaaagggtcatcgacccccggcgctgcatgaaacccgtgatcctgacagatggagaggagcgggtaatcctggctgggcccatgccggtgacccatagctccgccgcccagcgccgcggccggatcgggcgcaaccccaagaacgagaacgaccaatacatctacatgggcgagcccctcgaaaacgacgaggactgtgcccactggaaggaggcaaagatgttgctggacaatatcaacacacccgagggcatcatcccgagcatgttcgagccggagcgggagaaggtggacgccatagatggggaataccgcctccgcggggaggcccgaaaaacgtttgtggacctgatgcggcgcggggacttgcccgtctggttggcctaccgggtggcggcagaaggcattaactacgccgacagaaggtggtgctttgacgggatcaagaacaaccagatcctggaggagaacgttgaggtcgagatctggaccaaggagggcgagcgaaagaaactgaagccgcgatggctggatgcccgcatctactccgaccccctagcgttgaaagagttcaaggagttcgccgctggccggaagtccctgacgctgaacctgatcaccgagatggggcgcctccccacgttcatgacgcagaaggcccgggacgcactggacaatctggcggtgctccacaccgccgaggccgggggacgcgcctacaaccacgccctgtccgagctgcccgagaccctcgagacgctgctgctactgaccctgctcgctaccgtcaccggcggcattttcctgttcctgatgagcgggaagggcataggcaagatgacactcggcatgtgctgcatcatcaccgcctccattctgctatggtatgcccagatccagccgcactggatcgccgcgagcatcatcctcgagttcttcctaatcgtgctcctcatccccgaacccgaaaagcagcggactccgcaggataaccagctgacttacgttgtcatcgcaatcctgaccgtggtggctgctactatggccaatgagatggggtttttggagaagaccaaaaaggacctgggcttgggtagcatcgccacccaggaatccgagagtaacatcctcgacatcgacctgcgcccggcgtcagcctggaccctgtacgccgtcgccacaacctttgtgacccctatgctccgccactcaatagagaactccagcgtcaatgtctccctgaccgcgatcgccaaccaagccacggtgctgatggggctcggcaaggggtggccactgagcaagatggacatcggcgtgccgctgctcgctatcggatgctactcacaggtaaacccgattacccttaccgccgccctgctcctgctggtggcccactacgctatcatcggccctggcctccaggccaaggccacccgggaggcgcagaagcgagctgccgccggaatcatgaagaaccccacagtggacggcatcaccgtcatcgatctggagcccatcccgtacgaccccaagttcgagaagcagctgggccaggtaatgctcctaatcttatgcgtgactcaagtgctgatgatgcggaccacatgggctctttgcgaggctctgaccctggctaccggtcccatcagcacactgtgggaggggaacccgggccgcttctggaatacgactatcgccgtgtccatggccaacatcttccggggctcctacctggcgggggctgggctactattttccatcatgaagaacaccaccaatacgcgccgggggactggcaacataggtgagaccctgggagaaaaatggaagtccagactcaatgccctggggaaatccgagttccagatctacaaaaagagcgggatccaggaggtggaccggaccctagccaaggagggcatcaagcgcggggagacggaccaccacgccgtctcccggggaagcgcgaaacttcgctggttcgtggagcggaacatggttaccccggagggcaaggtcgttgacctagggtgcggccgcggtggctggtcctactactgcgggggactgaaaaatgtaagggaggttaagggcctcaccaagggcgggccagggcacgaggagcccatccccatgagcacatacggctggaatctggtgcgcctgcagagtggtgtggacgtcttcttcacgccgcccgagaagtgcgacacccttctgtgcgacatcggagagtccagccccaaccccaccatagaggccggccggaccttgcgcgtactcaacctggttgagaactggctgaacaacaacacgcagttctgtatcaaggtcctaaacccgtacatgccctccgtgatcgagaagatggagaccctgcagcggaagtacgggggagccctggttcgcaaccccctgagccggaactccacccacgagatgtactgggtaagcaacgccacgggtaacatagtctccagcgtcaacatgatctcccgcatgttgatcaaccgcttcaccatgaagcacaagaaggcaacgtacgagccggacgttgacctgggcagcggaacccggaatatcggcatcgagagtgagatccccaacctggacattatcggaaagaggatcgaaaagatcaagcaggagcacgaaacaagctggcattacgaccaggaccacccctacaagacatgggcgtatcacgggtcatacgagacgaaacagaccggcagtgcctcctcgatggtgaacggggtggtccggctcttaactaagccctgggacgtggttcccatggtcacacagatggccatgacggacaccacccccttcggccagcagcgtgtgttcaaggaaaaagtggacacacggacgcaagagcccaaagagggcaccaaaaagctgatgaagatcactgccgaatggctatggaaagaactgggcaagaagaagacgcctcgcatgtgcacccgggaggagttcacgcgcaaggtcagatccaacgccgcgctgggcgccatcttcaccgacgagaacaagtggaaaagcgcccgggaggcggtagaggactcccggttttgggagctcatcgaccgggagcggaacctccacctggaggggaagtgcgagacctgcgtatacaacatgatgggcaaacgcgagaaaaagctcggagagttcggcaaggcgaagggcagccgggccatctggtacatgtggctgggggcccgcttcctggagttcgaggcattaggcttcctgaacgaggaccactggtttagcagggggaactccctgagcggcgtcgagggggagggcctgcaccgcctggggtacatccttcgcgacgtgtccaagaaggagggcggggccatgtacgcggatgacacagccggttgggacacccggatcaccttggaggaccttaagaacgaggagatggtgaccaaccatatgaagggcgagcacaaaaagctggcggaggcgatcttcaagctcacgtaccagaacaaagttgtccgggtccagcgcccaacgccccgcggaaccgtgatggacatcatcagccggcgcgaccagcggggctcgggccaggtggggacctacggcctgaatacctttacaaacatggaggcgcagctgatccgccagatggagggagagggcatctttaagtctatccagcacctcaccgttaccgaggagatcgcggtgcagaattggctggcccgggtgggccgcgagcgactgtcccgcatggccatcagcggggacgactgcgttgtgaagccgctcgacgaccggttcgcctccgccctgaccgccctgaacgacatgggcaaggtacgtaaggacatccagcagtgggagccctcacgggggtggaacgactggacccaggtcccattctgctcccaccacttccacgagctcgtgatgaaggacggcagggtccttgtcgtgccgtgcaggaaccaggacgagttaatcgggcgcgctcggattagccagggcgctggatggtctctgaaagagaccgcctgcctgggcaagagctacgcgcagatgtggaccctgatgtacttccaccgccgtgacctccgcctggcggcgaacgccatctgctccgccgtgccctctcactgggtccccacgagtcgcaccacctggagcatccacgccaagcacgagtggatgacaactgaggacatgctggccgtctggaaccgcgtgtggatccaagagaacccgtggatggaagacaagacgcccgtcgagagctgggaggaggtgccctacctcggcaagagggaggaccagtggtgcgggtccctcatcgggctgaccagccgagccacctgggctaagaacatccagaccgccatcaaccaggtgcgctctctaatcgggaacgaagagtacaccgactacatgccaagcatgaagcgtttccgccgggaagaagaggaggcgggcgtcctgtggtag

SEQ ID NO: 25198 - RNA, 9876 nt, synthetic construct
  misc_feature 1..9876: note = derived and/or modified CDS sequence (opt11) from DENV-2__EU660399__SS-prME
  source 1..9876: mol_type = other RNA
accgccggggtcataataatgctgatcccgaccgccatggcgttccacctcaccacacgcaatggggaaccacacatgatcgtcgggcggcaggaaaaagggaagtccctgctgttcaagaccgaagatggcgtgaacatgtgtaccttaatggctatcgatctgggtgagctgtgcgaagacaccatcacctacaagtgccccctcctgcgccagaatgagcccgaagacatcgactgctggtgcaacagcaccagcacgtgggtgacctatggtacatgcaccaccacgggggagcaccgccgcgagaaacggtccgttgccctggtcccccacgtggggatgggcttggagacacgaactgaaacgtggatgagcagtgaaggggcctggaagcacgtccagcggatcgaaacctggatcctgcgtcacccggggttcacgataatggcggcgatcctggcgtacactatcgggaccacccatttccagcgtgcacttatcttcatcctgctgaccgccgtagcgcccagcatgacaatgcgctgcatcggcattagcaacagagacttcgtggagggggtttcaggaggatcatgggtcgacatcgtgctcgaacacgggagctgcgtcacgacgatggccaagaataaacccaccctggatttcgaactgatcaagaccgaagcgaagcagcccgcaaccctccgcaaatactgcatcgaggctaagctgaccaatacaacaaccgagtcccgatgccctacgcaaggcgagccttccctgaacgaggaacaggacaaacgctttgtttgcaagcactccatggtggaccggggctggggtaatggatgtggattattcggcaagggcggaattgtgacatgcgctatgttcacgtgcaagaagaacatggagggcaaggtagtgctgcccgagaacctggagtatactatcgtcattacgccccatagcggggaggaacacgccgtgggcaacgatacagggaagcacggtaaggagatcaagatcacgccgcagagtagtattactgaggcagagctcaccgggtacggcacggtcacgatggaatgcagcccacggaccggcctggacttcaacgagatggtcctgctccagatggaggacaaggcatggctggttcatcggcagtggttcctggacctacccctgccttggctaccaggggctgacacacagggcagcaactggatccagaaggaaacgcttgttacctttaaaaaccctcacgctaagaagcaggacgtcgtggtccttgggtcccaggagggcgcgatgcacaccgctctgaccggggccacggagatccagatgagcagcggcaacctgctgttcaccggccacctgaagtgccgcctccggatggacaagctgcagctgaaggggatgtcctactccatgtgtacaggaaaatttaagatcgtaaaggagatcgcggagacccaacatgggacgatagttatccgggtccagtacgaaggcgacggctccccctgcaagattcccttcgagatcatggacctcgagaaacggcacgtcctggggaggctgatcacagtgaacccgattgtggctgagaaagatagccccgtgaatatcgaagccgaaccgcctttcggagactcgtatatcatcatcggggtggagcctggacagcttaaacttaattggtttaagaaggggagctctatcggccagatgttcgaaaccacaatgcgcggcgccaagcggatggccatcctaggggacactgcctgggatttcggcagcctcgggggcgtcttcacctccatagggaaggcactgcatcaggtgtttggcgccatctacggggccgccttcagcggagtctcctggacaatgaagattctgattggagtcatcatcacatggatcggaatgaactctcgctccacgagcctgtcagtcagcctcgtgctggtcggcgtggtgaccctgtacctcggggcgatggtccaggccgattccggctgtgtggtgtcttggaaatccaaagagctaaagtgcggcagcgggatcttcatcacggacaatgtgcacacttggactgagcaatacaagttccagcccgaaagcccctccaagctagccagcgccatccagaaagcccacgaggaaggcatctgcgggatcaggtccgtgacacgccttgagaacctgatgtggaagcaaatcactccagaactgaaccacattctctccgagaatgaggtgaagctgaccattatgacgggcgacatcaaggggatcatgcaggcgggcaagcggtccctgcgcccgcagcccactgagctcaagtactcgtggaagacttggggcaaggccaaaatgctgtccaccgagagccataatcagactttcctgatcgacgggccggagaccgccgaatgcccgaacaccaatcgggcctggaacagtttggaggttgaggactacggctttggcgtctttaccactaacatctggctaaagctgcgcgagaaacaagacgtgttctgcgacagcaagctcatgtccgccgcgatcaaggacaaccgggccgtacacgccgacatgggctactggattgaaagcgcccttaatgacacttggaagatggagaaggcctcttttatagaggtcaagtcttgccactggcccaagtcccacaccctgtggtctaatggcgtgttggagtccgaaatgatcatcccgaagaacttcgcagggcccgtcagccaacacaactatcgccctggctaccacacgcagacagcggggccctggcacctgggtaagctggagatggatttcgatttctgcgagggtacgaccgttgtggtgaccgaagactgcggcaatcgtgggcccagcctcaggacaacgacagcctccgggaaactaattacagagtggtgctgccggtcctgcaccctgcccccactgcgataccggggtgaggacgggtgctggtatggcatggagattcgccccctgaaagagaaagaggagaacctggtaaactccctggtgacggcgggacacggccagatcgataacttcagcctaggcgtactggggatggccctcttcctggaggagatgctacggaccagagtgggcaccaaacatgccatgctcctggtggccgtatccttcgtgacactgatcacggggaacatgagcttccgggaccttgggcgggtgatggtcatggtgggggcaaccatgaccgacgacatcggcatgggcataacgtatctggcgctgctagcggccttcaaagtgcgccccaccttcgctgccggtctgctgctgcggaaactgacctccaaggagctgatgatggctaccatcggcatcgcgctcctgagtcagtccaccatacctgagacgatactagagcttaccgacgccctggccctggggatgatggtactgaaaatcgtgcgcaacatggaaaaataccagctggccgtaaccataatggctatttcttgcgtcccaaacgcggtgattctccagaacgcatggaaggtatcctgcaccatactcgccgccgtcagtgttagccccctactgctcacgtcctcccagcagaaggcggactggatacccctggccctgacaatcaaaggccttaaccctaccgccatttttctgacgacgctgagccgtacctccaaaaagcgcagttggccgctcaacgaggccgtcatggccgttgggatggtgtccatcttggcctcgagtttactaaagaacgacatacccatgaccgggcccctggtcgcaggcgggctgctcaccgtgtgctacgtgctgacggggcggtccgcagacctggagctcgagcgtgccgccgacgtgaagtgggaggaccaagcggaaatcagcggctctagccccattttgtccatcaccatctctgaggacggctccatgagcatcaaaaatgaggaggaggagcagaccttaaccatcttaattaggacgggactgctggtaatctcgggtgtattccccgtcagtatacccatcaccgccgcagcatggtacctttgggaggtgaagaagcaacgcgccggcgtgctgtgggacgttccaagcccgccgcccgtggggaaagcggagttagaggatggcgcctaccggataaagcagcgcgggatactcggctatagccagatcggcgcaggggtgtacaaggagggcacgttccacaccatgtggcatgttacccgcggggcggtgctgatgcacagaggtaaaagaatcgagccgtcgtgggctgatgtgaagaaggacctgatatcgtatgggggcggctggaagctcgagggggaatggaaggagggcgaggaagtccaggtattagcgctggagcccgggaagaacccccgcgccgtacagacaaagcccggactctttaagaccaacacaggtaccatcggtgccgtatccctggatttcagcccaggtacgtccgggagtcccattgtggaccgacaggggaaagtggttgggctttacggcaacggggttgtgactcgctccggggcctacgtcagcgcgatcgcccagacggagaaaagtatcgaggacaatcccgagatcgaggatgatatcttccgcaagaagcgccttacaattatggacctgcaccctggcgcggggaagacgaagaagtacctgcccgccatagtgcgggaagcgataaagcgcggcctgcggaccctcatcctggctccgacccgcgtggtcgccgccgagatggaggaggccctgcgcggactccctatccgctaccagacccccgctatccgcgctgaacacacgggaagggaaatcgtggacctgatgtgtcatgccaccttcaccatgcgattgctctcccccgtcagggtacctaattacaatctgattatcatggacgaggcgcacttcacagaccccgcgtcaatcgctgcccgcggatatatctccacgcgggtggagatgggggaagccgccgggatcttcatgacggcgacgccgccagggagccgcgacccattccctcagtctaacgcgccgataatggacgaggagcgcgagatccccgagcgcagctggaactctggccacgagtgggtcacagactttaagggtaagaccgtctggttcgtgccgagcattaaggccggcaatgacatcgccgcctgcctgaggaagaacggaaagaaggtgattcagctgtcccgcaagacttttgacagcgagtatgtcaagactcgggccaacgactgggactttgtggtgacaacggatatctctgagatgggcgcgaatttcaaggccgaaagagttatcgaccctcggcggtgtatgaaaccggtgatactgaccgacggcgaggagcgggtgattttagccggaccgatgccggtcacccacagcagcgccgcccaacgccggggccgcatcgggagaaacccaaagaacgagaacgatcagtacatatatatgggcgagcccctcgagaacgacgaggactgcgcacactggaaggaggccaagatgcttctggacaacataaacacccccgagggcatcattcctagcatgttcgagccggaacgagagaaggtggacgccatcgacggtgaatatcgactccggggtgaagccaggaagacttttgttgacttgatgcggcgaggggatctgccagtctggctcgcctaccgggtggcggccgagggcatcaactacgctgatcgcagatggtgcttcgacgggatcaagaacaatcagatactggaagaaaacgttgaagtagagatctggactaaggagggggagaggaagaaactgaaaccacgatggctcgacgcccgcatatacagtgacccgttggcgctgaaagagttcaaggagttcgccgctggccgaaagtccctcaccctgaatctgatcaccgagatggggcgcctccctactttcatgactcagaaagcccgggacgctttagacaacctggcggtgctccacacggccgaggctggtggacgcgcatacaaccatgccctgtccgagctgccggagaccctcgagacgctgcttctcttgaccctgctcgcgacggtgaccggcggcatctttctgttcctgatgtctgggaagggtatcggcaagatgaccctcggcatgtgctgcatcatcaccgcctccatcctgttgtggtacgcccagattcagccacactggatcgcagccagcataatcctcgagttctttctgattgtattgttgatccctgaaccggaaaagcagcggactccccaggacaaccagctaacttacgtggtcatagcgatcctgaccgtggtagctgcaacgatggccaatgagatgggtttcctcgagaagaccaaaaaggacctgggcttgggcagcatcgccacccaagagtccgagtcaaacatcctcgacatcgacttaaggcccgcttccgcatggactctgtacgccgtcgccacaaccttcgtgacccccatgctccggcacagcatcgagaactccagcgtaaacgtgtccctgaccgcgatcgccaaccaggctacggtgctgatgggcctcggcaaggggtggccccttagcaagatggacatcggcgtgcccctgctagccatagggtgctactcccaagtcaacccgataaccttgaccgccgcgctgctcctattagtggcccattatgctatcatcgggcccggcctccaagccaaggcaaccagagaagcgcagaagcgggccgccgctggtatcatgaagaaccccacagtggacggcataactgtcatcgacctagagccgatcccatacgaccccaagtttgagaagcaactggggcaagtcatgcttcttatcctgtgcgtgacccaggtgctcatgatgcgcaccacgtgggccctgtgcgaagcgctgaccctcgccaccggccccatctcaaccctgtgggaggggaatcccggacgcttctggaacacgaccatcgcggtttccatggccaacatatttcggggcagctatctggccggggccggtttgctattctccataatgaagaatactaccaacacgcgccgggggaccggaaacatcggtgagacgttgggagagaaatggaagtccaggctaaacgcgctggggaagtccgagttccagatctacaagaagtccggtatacaagaggtggaccggacgctggccaaggagggcatcaagcgcggggagactgatcaccacgccgtgtcccgaggctccgcgaagctccggtggttcgtggaaaggaacatggtgaccccggagggcaaggtcgtggacctcgggtgcggcaggggaggctggtcatactactgcggaggcctgaaaaacgtacgtgaggtcaaggggctcaccaaaggagggcccgggcacgaggagccgatccccatgagcacctacggctggaacctggtgcgtttgcaaagcggagtcgacgtattcttcacgccgcccgagaagtgcgacactttactgtgtgacatcggcgaatcttcgcccaatcccaccatcgaggcaggccggactctccgcgtgctcaacctggtggagaactggctcaacaacaacacgcaattctgcattaaggtcctcaacccctacatgccaagcgtgatcgagaagatggagacactgcagcggaagtacgggggcgcactggtgcgcaatcccttgagccggaactccactcacgaaatgtactgggtctctaacgctactggtaacatagtatccagcgttaacatgatctctaggatgctcatcaacagattcaccatgaagcataagaaggccacgtacgagcctgacgtcgacctgggtagcggcacgcgcaacatcggaattgagtccgagatccccaacctcgatatcatcggcaagcgtatcgagaagataaagcaggagcacgagaccagctggcactacgaccaggaccacccctacaagacctgggcgtaccacgggtcctatgaaactaagcagaccggctcggcctccagcatggtcaacggggtggtccgtttgctgaccaagccatgggacgtggtgccgatggttacccaaatggcaatgacagacaccacccccttcggccagcagcgcgtgtttaaggagaaagtcgacacccggactcaggagcccaaggagggcacaaagaagctgatgaagatcaccgccgagtggctctggaaggagctggggaagaagaaaacgccccgaatgtgcacgagagaggagttcacacgcaaggttcggtcaaacgccgcgctaggcgctattttcaccgacgagaataagtggaagtccgcccgcgaggccgtggaggactccagattctgggagcttatcgaccgcgagcggaatctgcacctggaggggaagtgcgaaacctgtgtgtataacatgatggggaagcgcgagaagaagctcggggagttcgggaaggcgaagggcagccgggccatttggtatatgtggctgggggcccgcttcttagagttcgaggcactcggcttcctgaacgaggaccactggttctcgcgggggaacagtcttagcggtgtcgagggggagggcctccaccggctgggctacatcctgcgggacgtgtccaagaaagaaggaggggccatgtacgctgacgacactgccgggtgggacactagaatcacccttgaggatctgaaaaacgaggaaatggtcaccaatcatatgaaaggcgagcacaagaagttagccgaggcaatcttcaagctcacttaccagaataaggtggtgagagtccagcgtccgacgccccgggggaccgtgatggacatcataagccggcgagatcagcgtggatcgggccaggtggggacgtacggactgaacacattcaccaacatggaggcccagctcatccgccagatggagggggaaggcatcttcaagagcatacagcacttgacagtcaccgaggaaatcgcggttcagaactggctagcccgcgtgggccgcgagcggctttcccgcatggcaattagcggggatgactgcgtggtgaagcccctcgacgacaggttcgcctccgcactgacggcgctcaacgacatgggcaaagtgcggaaggacatccagcagtgggagcccagccgggggtggaacgattggacccaagtcccgttttgcagccaccacttccacgagttggtgatgaaggacgggcgcgtcctggtcgtgccctgcagaaaccaggacgagctgatcgggcgcgcccgtatctcacagggcgccggctggagtctaaaagagaccgcttgcctgggaaagtcttacgcccaaatgtggaccctcatgtacttccaccgccgggatctccgcctggctgccaacgccatctgttccgccgtgccgagccactgggtcccaacatcccggacgacctggagcatccacgcgaagcacgaatggatgactaccgaggatatgctagctgtatggaatcgggtgtggattcaggaaaatccttggatggaagacaaaacgcctgtcgagagctgggaggaggtgccttacctcggtaagcgcgaggatcaatggtgcgggtccttgattggccttaccagccgcgctacctgggccaaaaacatccagacagccatcaatcaagtccggagtctaattggtaacgaagagtacacagactatatgcccagcatgaaacggttcaggcgggaggaagaggaggctggcgtcttgtggtaa

SEQ ID NO: 25199 - RNA, 9876 nt, synthetic construct
  misc_feature 1..9876: note = derived and/or modified CDS sequence (opt11) from DENV-2__EU569708__SS-prME
  source 1..9876: mol_type = other RNA
accgccggggtgatcatcatgctgatcccgaccgcgatggcattccacctcaccactcgcaacggtgagccgcacatgatcgtgggacggcaagaaaaggggaagtccctgctgttcaagaccgaggacggcgtgaatatgtgcacgctcatggcgatagacctgggggagctatgcgaggacaccatcacctacaaatgccccctgctacgccaaaacgagcctgaggacatcgattgctggtgcaacagcacctcgacctgggtgacctacgggacctgcaccaccacgggcgagcaccggcgcgagaagcggtccgtcgccctggtgccccacgtgggcatgggcctcgagacccgcaccgagacctggatgagctctgagggggcctggaagcacgtacagcggatcgagacctggatcctgcgccaccccggcttcgctatcatggcggccatcctggcctacaccatcgggaccacccacttccagcgggcattgattttcatcctgttaaccgcggtggcaccgtctatgaccatgcgctgcatcggcatctccaaccgtgacttcgtggagggcgtcagcgggggcagttgggtggatatcgtgttagagcacgggagctgcgtcaccaccatggccaagaataagccgacgctggacttcgagctgatcaagaccgaggccaagcagcctgccaccctccgcaagtactgcatcgaggccaagctgaccaacacaaccaccgagtcccggtgcccgacccagggcgagcccagcctgaacgaggagcaggataaacgctttatctgcaagcactccatggtggaccggggctgggggaacggctgtggcttgttcggcaagggtgggatcgtgacttgcgcaatgttcacgtgtaagaagaacatggagggaaaggtcgtgcttcccgagaacctggagtacaccatcgtgatcaccccccacagcggagaggagcatgccgtcgggaacgacacggggaagcacggcaaggaaattaagatcaccccgcagtccagcatcacagaggcagagctcaccggctatggcaccgtgacgatggaatgcagcccccggaccggcctggactttaacgagatggtgctgctacagatggaggagaaggcctggctggtccatcggcagtggttccttgacctccctctgccctggctgccaggggctgacacccagggcagcaactggatccagaaggagaccctcgtgacgttcaagaacccacacgccaagaagcaggacgtagttgtgctggggtcgcaagagggtgccatgcacacagccctaacgggggccactgagatccagatgagcagcggcaacttactattcaccggccacctgaagtgccgcctccggatggacaagcttcagctaaaggggatgtcctactccatgtgcactggcaagttcaagatcgttaaggagatcgcggagacccagcacgggactatcgtgatccgcgtgcaatacgagggcgacggctccccctgcaagatccccttcgagatcatggacctcgaaaaacggcacgtcctggggcgcctgatcacggtgaacccgatcgtcaccgaaaaggacagccccgtcaacatcgaggccgagccaccgttcggcgattcctacataatcatcggggtggagccgggccaactcaagctgaactggttcaaaaaaggaagctccatcggccagatgttcgagacaaccatgcgcggcgccaagcggatggccatcctgggggacacggcctgggactttggcagcctcgggggcgtgttcacctccatcgggaaggcgctgcaccaagtcttcggcgccatctatggcgccgcctttagcggcgtatcctggaccatgaaaatcctgatcggggtgatcatcacctggatcgggatgaacagccgatccacgagtctgtcagtcagcctagtgctggtgggggtcgtaaccctgtatttgggcgcgatggtccaagccgactccggctgcgtcgtaagctggaaaaacaaggaactgaagtgtggctcggggatcttcatcacggacaacgttcatacctggacggagcagtacaagtttcaacccgaatcaccctcgaagctcgcctccgccatccagaaggctcacgaggagggcatttgcgggatcagaagcgtaacccgcctcgagaacttgatgtggaagcagatcacccccgaactgaatcacatcttatcggaaaacgaagtgaagctcaccatcatcaccggcgacatcaaggggatcatgcaggcaggcaagcggagcttaaggccgcaaccgaccgagctcaagtactcctggaagacctggggcaaggccaagatgctgagcaccgagtcccacaatcagactttccttatcgatgggcccgagaccgccgagtgcccgaataccaaccgggcatggaatagcctagaggtcgaggactacggcttcggggtcttcacgacgaacatctggctgaagctgcgggagaaacaggacgtgttctgcgacagtaagctcatgagcgccgcgatcaaggacaaccgggccgtgcacgccgacatgggctactggatcgagtccgccctaaatgacacttggaagatggagaaggccagcttcatcgaggtaaagtcctgccactggcccaagagccacactctgtggtccaacggcgtactcgagagcgagatgatcatccccaaaaacttcgcggggcccgtgtcccagcacaactaccgccctggttaccacacccagaccgccggaccatggcacctaggcaaactggagatggacttcgacttctgcgaggggacgaccgtcgtggtgaccgaggactgcggcaaccgtgggcccagccttcgcaccacgaccgccagcgggaaacttatcacggagtggtgttgccggagttgcaccctgcccccgctccgctaccgcggcgaggatgggtgctggtacggcatggagatccgcccactgaaggagaaagaggagaacttagtaaacagcctcgttactgccgggcacggccagatagataacttctccttgggagtactagggatggcgctcttcctggaggagatgctgcggacccgcgtcggcaccaagcacgccatcctcctggttgccgtgagctttgtcaccctaattacggggaacatgtccttccgcgacctcggacgcgtgatggttatggtgggggccaccatgaccgacgacatcggcatgggcgtgacctacctggcgctgttagcggcctttaaagtgcggcccacgtttgccgcggggctgctactccggaagctgactagcaaggagcttatgatggctaccatcggtatcgcgttactgtcccagtccaccatccccgagacgatcttggaactcaccgacgctctggccctcgggatgatggtcctcaagattgtgcgcaatatggagaaatatcagctggccgtgacgatcatggccatctcctgtgtgccgaacgcagtgattctgctgaacgcctggaaggttagctgcaccatcctggccgccgtatccgtgtcgccgctgctcctgacaagtagccaacagaagaccgactggatccccctggcgctgaccatcaagggcctgaatcccacagccatcttcctgacgaccctctcccggaccagcaagaagcgttcgtggccgctaaatgaggcagtcatggccgtaggcatggtgagcatcctcgcctccagcctcctgaaaaatgatatccccatgaccgggcctttggtcgcgggtggcctcctgacggtttgctacgttctgaccggccggagcgccgacctcgagctagagcgggccgccgatgtcaaatgggaagaccaggccgagatcagtggcagctcccccatcctgtctgtgaccatctccgaggacggctctatgtccataaagaacgaggaggaggagcagactctcacgatcctgatccggacgggcctcctcgtgatcagcggggtctttccggtgtccatacccatcaccgcggccgcctggtacctgtgggaggtgaaaaagcagcgcgccggggtcctgtgggacgtgccctcaccgcctcccgtggggaaggccgagcttgaggacggcgcttaccgaataaaacagcgcgggatactgggctattcccagattggtgccggggtgtacaaggagggcaccttccacaccatgtggcacgtgacgcgcggggctgtactgatgcaccgcggcaaacggatcgagcccagctgggctgacgtcaagaaagacctcatctcctacgggggaggctggaagcttgagggggaatggaaggagggcgaggaggtccaggtactggccctggagcccgggaaaaacccacgtgcggttcagaccaaacccgggctgtttaaaaccaataccgggacgatcggcgcggtcagcctggacttctcccccggcacctcggggtccccgatcgtggacagaaagggcaaggtcgtggggctctacggcaacggcgtggtcacccgcagcggggcctacgtgagcgccatcgcgcagaccgagaagtccatcgaggataaccccgagatcgaggatgacatcttccggaagaagcgcctgacgatcatggacctgcaccccggcgccgggaagaccaagaggtacctgccggccatcgtgcgcgaggccatcaagcggggcctccgtaccctgatcctggcccctacccgcgtcgtggcagccgagatggaggaggccctacggggcctgcccatccgttaccagacgcctgctattcgagctgagcacaccggccgcgagatcgtggacctgatgtgccacgcaaccttcacaatgcggctcctgagccccgtccgcgttccgaactacaacctgatcatcatggacgaggcccacttcacagaccccgcctccatcgccgcgcggggctacatcagcacccgagtggagatgggggaggcggcggggatcttcatgacagccacgccgccagggtccagggacccgttcccgcagtcgaatgcccccatcatggatgaggagcgcgagatccccgagcggtcctggaatagcggtcacgaatgggtaacggacttcaagggtaagaccgtatggttcgtgccgtccatcaaggcgggcaacgacattgccgcctgcctccgcaagaacgggaagaaggtcatccagctgagccgcaaaactttcgactccgagtacgttaagacccgcgccaacgactgggacttcgtcgtcaccaccgacatcagcgagatgggggccaactttcgggcggagagggttatcgacccccgccgctgcatgaagcccgtgattctaaccgacggcgaagaacgcgtcatactcgcagggcccatgccggtaacccactcctccgccgcacagcggcgcggccgtattgggcgcaaccccaagaacgaaaacgatcagtacatctatatgggcgagccactggagaacgacgaggactgcgcccattggaaggaggcgaagatgcttctcgacaacattaatacgcccgagggaataatcccgtccatgttcgagcccgagcgggagaaggttgacgctatcgatggggaataccgcctgcggggagaagcccgcaagactttcgtcgatcttatgcggcgcggggatctgcccgtgtggctggcctaccgggtggcagcggaggggattaactacgccgaccgccgctggtgcttcgacggaatcaagaacaaccagatcctcgaagagaacgtggaggtggagatctggaccaaagagggcgagcgaaaaaagctcaagccgcgctggctggacgcaaggatctacagcgaccccctggccctcaaggagttcaaggagttcgcggccggccggaaatccctcaccctgaatctgatcacggaaatggggcgcctgccgacattcatgacccaaaaggcccgggacgccctggacaatctcgccgtcctgcacaccgcggaggccggcgggcgcgcgtacaaccatgccctgagcgagctccccgagaccctggagacactgcttctcctgacgctactggccactgtgacgggcggaatcttcctgttcctcatgtcaggcaagggcatcgggaagatgaccctgggtatgtgctgcatcatcaccgcgagcatcctgctctggtacgctcagatccagccgcactggatcgccgcctccatcatcctggagtttttcctgatcgtgcttctgattccagagcccgagaagcaacgcacgccccaggacaaccagctgacctacgtggtgattgccatcctcacagtggtcgcggccacaatggccaacgagatggggttcttagagaagaccaagaaggacctgggtctcggcagtatcaccacccaggagagcgagtccaacatactggatatcgacctgaggccggcaagcgcctggacgctatacgcggtggccaccaccttcgtcacgcccatgctgcggcactccatcgaaaacagttccgtcaacgtaagtctgaccgccatagccaaccaggcgaccgtgctcatggggcttggaaaagggtggcccctgtccaagatggatatcggcgtcccgttgctggccatcggatgctacagccaggtgaatccgattaccctgacggccgccctcctgctactcgtggcccactatgcgatcatcggccccggcctacaggccaaggccacccgcgaggcccagaaacgcgccgcggccgggatcatgaagaatcccaccgtcgacggaatcaccgtgatcgacctggagcccatcccctacgatcccaagttcgaaaaacagctcggccaggttatgctgctgatcctctgcgtcacccaggtgctgatgatgcgtaccacatgggccctgtgcgaggcgctcaccctggccaccggccccatctccactctgtgggaggggaaccctggccgcttctggaacaccacaatagcggtaagcatggccaacatcttccggggatcctacctcgccggggccggcctgctgttcagcatcatgaagaacaccaccaatacccgccgggggaccggcaacatcggcgagacgcttggggagaagtggaagtcccgcctcaacgcgctgggcaaaagcgagttccagatctataagaagtccgggatccaggaggtcgaccggaccctcgccaaggaggggatcaagcgcggggagaccgaccaccacgcggtgagccggggctccgccaagctccggtggttcgtcgagcggaacatggtcacccccgagggcaaagtggtggacctcgggtgcggtcgagggggctggtcgtactactgcgggggacttaaaaacgtgagggaggtgaagggactgacgaagggggggccagggcacgaggagcccatacccatgtccacctacggctggaacctggtacgcctccagagcggagtggacgtttttttcacccctcctgagaagtgcgacaccctgctctgcgacatcggcgaaagctccccaaaccccacgatcgaagctggtcggacgttacgagtgctgaacctggtcgagaactggctcaacaacaacacccagttttgcatcaaggtgctgaacccgtatatgccctcggtgatcgagaagatggagaccctccaacggaaatacgggggcgcgttggtccgcaaccccctgtcccggaacagcacccacgaaatgtactgggtgtcgaatgcgaccgggaatatcgtgtcaagcgtcaacatgatctccaggatgctgatcaaccgcttcaccatgaagcacaagaaggcgacatacgagccggacgtggacctgggatcagggacccggaacatcggcatcgagagcgagataccgaacttagatatcatcggcaagcggatcgagcgaataaagcaggagcacgagacctcctggcattacgaccaggaccacccctacaagacctgggcgtatcacgggtcgtacgaaacaaagcagaccggctcggcaagctccatggtgaacggggttgtgcgcctgctaacgaagccgtgggacgtggtaccgatggtgacccagatggcgatgaccgacaccacgccgttcggccagcagcgggtgttcaaggagaaggtcgacacacgcacccaggagcctaaggagggcacgaagaagctgatgcggatcacggccgagtggctgtggaaggagttagggaaaaagaagacgccccgtatgtgcactcgggaggagttcacgcgaaaggtgcgtagcaacgcagccctcggtgccgtgttcaccgatgagaacaagtggaagtccgcgcgggaggccgtcgaggattcccgtttctgggagctggttgaccgcgagcggaatctgcacttggagggtaaatgcgagacctgtgtctacaacatgatgggaaagagggagaagaagctgggggagttcggcaaggccaaaggatcccgcgccatctggtacatgtggctgggggcacgatttcttgaattcgaggcccttggcttcctgaacgaagatcactggttcagccggcgtaatagcctctctggggtcgagggggaggggctgcaccggctgggctacatcctccgcgacgtgagtaagaaggagggcggggccatgtacgcggacgataccgccgggtgggacacccgcatcacactggaggacctgaaaaacgaggagatggtcaccaaccacatgaaaggggagcacaagaagctggcggaggccatatttaagctgacctaccagaacaaggtggtgcgggtccagcgcccgacgccccggggcacggtgatggacatcatctcccgccgtgatcagcgcgggtcaggccaggtgggcacctacgggttgaataccttcaccaacatggaggcccagctcatccgacagatggagggcgaggggatcttcaagtcgatccaacacctgacagtcactgaggagatcgccgtgcaaaactggctggcccgcgtgggccgggagcgcctcagccggatggctatctcaggcgacgactgcgtcgtgaagcccctggacgatcgcttcgcgtcggcactgaccgccttgaacgacatgggtaaagtgcggaaggacatccagcagtgggagccctcccgcggctggaacgattggacccaagtacctttctgcagccaccactttcacgagctggtcatgaaagacgggcgggtgctggtagtgccctgccgcaaccaggacgagctcattggccgggcccgaatctcccagggagcgggctggagtctgaaagagacggcttgcctggggaagtcctacgcccagatgtggaccctcatgtacttccaccggcgggacctgcgcctggccgccaacgccatctgcagcgcagtgccctcccactgggtccccacctcacggaccacctggtccatccacgccaaacacgagtggatgacgaccgaggacatgttagccgtgtggaacagagtgtggatccaggagaacccgtggatggaggacaagacccccgtcgagagctgggaggaggtgccctatctggggaagcgggaggaccaatggtgcggcagcctgatcgggctcacctcgcgcgcgacctgggccaaaaacattcagaccgccatcaaccaagtgcggagtctgatcggcaatgaagagtacaccgactacatgccctccatgaaacgtttccggcgggaggaggaggaggcaggggtcctgtggtaa

SEQ ID NO: 25200 - RNA, 9876 nt, synthetic construct
  misc_feature 1..9876: note = derived and/or modified CDS sequence (opt11) from DENV-2__EU569709__SS-prME
  source 1..9876: mol_type = other RNA
actgccggcgttataatcatgctgatcccgacggctatggcattccacctcactacccgcaacggtgagccccacatgattgttggacggcaggagaaggggaagtccctgctgttcaagacggaggacggcgtgaacatgtgcacccttatggccatcgacctgggagagctgtgcgaggacaccatcacctataagtgccccttgctgagacagaacgaaccagaagacatcgactgctggtgcaacagcactagcacgtgggtgacctacgggacttgcacaacaacgggcgagcaccggcgagagaagagatccgtcgcgctcgtgccacacgtagggatgggactcgagacccgcaccgagacctggatgagcagcgaaggggcttggaaacatgtccagcggatcgagacttggatcctgcgccacccgggttttaccatcatggcagcgatcctagcatacaccatcggaaccacccacttccaacgagctctgatcttcatactgctgaccgccgtggctccgagcatgaccatgcgctgcatcggcatctccaatcgcgatttcgtggagggggtcagcggcgggtcgtgggtcgacatagtgctcgaacacggctcgtgcgtgaccacgatggccaaaaacaagcccacccttgacttcgagctgataaaaaccgaggccaagcagcccgccaccctccgcaagtattgcatcgaagccaagctgacgaacacaactaccgagtcccggtgcccgacgcagggcgaacccagcctgaatgaggagcaggacaagcgtttcatatgcaagcactcgatggtggaccggggttgggggaacggatgcggcctcttcggcaagggcgggatcgtgacctgcgcgatgttcacatgcaagaagaatatggaaggaaaggtcgtgctgcccgagaaccttgaatacactatagtgatcacgccccactcgggggaggagcacgccgtcggcaatgacaccgggaaacacggcaaggagatcaagatcaccccgcaatccagcatcaccgaggccgagctcaccgggtacggcacggtcactatggagtgcagtcccaggaccggcctagactttaatgagatggtactgctccagatggaggacaaggcctggctggtgcataggcagtggtttctggacctcccattaccctggctcccgggggcagatacccaaggttctaactggatccagaaggagacgctcgtaaccttcaagaaccctcatgcgaaaaagcaggacgtcgttgtgctggggtcccaggagggcgccatgcataccgccctgaccggggccacggagattcaaatgagcagcggaaacctcctattcaccggccacctaaagtgtcgcctccggatggacaaactgcagctgaaagggatgtcctactcgatgtgcacaggtaagtttaagatcgtcaaggagatcgccgagacgcagcatggaaccatcgtaatccgtgtgcagtatgagggcgacggatccccctgcaagatccccttcgagataatggacctggagaagcgatacgtcctggggcgcctgatcaccgtgaaccctatcgtgaccgagaaggacagcccagtcaacatcgaggcagagccgccttttggcgacagttacatcatcatcggggtggaaccgggccagctcaagctgaactggttcaagaaggggtcgtccataggccagatgttcgaaactaccatgcgcggtgccaagcggatggccatcctgggcgacaccgcgtgggactttggctctttggggggcgtgttcacttctatcggcaaggccctgcaccaggttttcggcgctatctacggcgccgcctttagcggagtgagttggacgatgaagatcctgatcggcgtcatcatcacgtggatcgggatgaacagtcgctccaccagcctatccgtcagcctagtgctggtgggagtcgtgaccctgtacctcggggtcatggtccaggccgactcaggctgcgttgtgagttggaagaacaaggagctcaagtgcggatccgggatctttatcaccgacaatgtccacacgtggacggagcaatacaagttccaaccggaaagccccagcaagcttgcgagcgctatccagaaggcccatgaggagggcatctgcgggatcaggagcgtgacccgcttggaaaacctgatgtggaagcaaattacacctgagctgaaccacatcttgtccgagaatgaggtgaaattgacgatcatgaccggcgacatcaaggggatcatgcaggccggcaaacgtagcctgcgaccgcagcccaccgagctcaagtatagttggaagacctggggcaaagccaagatgctaagcacggagtcacataatcagacctttctgatagacgggcccgaaaccgcggagtgcccgaacaccaaccgggcctggaatagcctggaggtcgaggactacgggtttggcgtgttctccacgaatatctggctgaagctgcgagagaaacaggacgtgttctgtgacagcaagctcatgtccgccgcgatcaaagataaccgggccgtacatgcggatatgggctactggatcgagtcggcgctgaatgacacctggaagatggaaaaggcttctttcatcgaggtcaagtcgtgccactggcccaagtcacataccctttggagcaacggagtgctcgagtccgagatgatcattcccaagaacttcgccggtcccgtgtcacaacacaactatcgccccggctaccacacccagacggcagggccatggcacttgggcaagctggagatggacttcgatttttgtgaagggaccaccgtggtggtcaccgaggactgcggcaaccggggtcccagcctccgcactacaacggcgtcgggcaaattaataaccgagtggtgctgccggtcatgcaccctccccccgctacgctatcggggcgaggatgggtgctggtacgggatggagatccgccctctgaaggagaaggaggagaacctggtgaatagtcttgtgaccgcaggtcatggccagatcgacaacttcagcctgggcgtccttggtatggccctcttcctggaagagatgctgcggacccgagttggaaccaagcacgccatcctcctggtggcggtctcattcgtaacactgatcacggggaacatgagcttcagggacctgggccgcgtgatggtaatggtgggggccacaatgaccgatgacatcgggatgggtgtgacgtacctggcgctgctcgccgcctttaaagtccgccccaccttcgcggccggtctgctgctcaggaagctgacgtccaaggaactgatgatggcaaccatcggcatcgcgctcctgagccaatccaccatccccgagacgatactagagttaacggacgccctggccctggggatgatggtgctaaagattgtgaggaacatggagaagtatcagttagcggtcacaattatggcgatcttgtgcgtgccgaacgccgtgatcttgcagaatgcctggaaggtatcgtgtaccatcctggccgccgtctctgtctcgcctttgctcctaacatccagccagcagaaggccgactggatcccacttgccctcaccataaaaggcctgaacccgaccgctatctttctcaccacgctcagtcgtacaagcaagaagcgctcatggccgctgaacgaagccgtgatggcagtgggcatggtctcaatcttggcctcctctctcctgaaaaacgacatccccatgaccgggccgctggtggccggcgggctcttaaccgtgtgctacgtactgacgggtaggagcgcggacctcgaactggagagagccgctgacgtgaaatgggaggaccaggcggagatctccgggagctcccccatcctgagcatcacgatctccgaagacggcagcatgtccattaagaacgaggaggaagagcagaccctgaccattctgatccgtacaggcttattggtgatcagcggggtattcccggtgtcaatcccaatcaccgccgcggcctggtacctgtgggaggtgaagaagcaacgcgcgggcgtcctctgggacgtacccagcccgccccctgttgggaaggccgagctcgaggacggcgcctatcggataaagcaacgcgggatctttggttactcacagatcggcgcgggggtttataaggagggcacctttcacaccatgtggcacgtgactcgaggagccgtgctgatgcatcggggcaagcggatcgaacccagctgggctgatgtcaagaaggacctgatcagctatgggggaggctggaagctcgaaggggagtggaaggaaggcgaggaagtccaggtgctggccttggagccagggaagaacccgcgcgccgtgcagacgaaacccggcctcttcaagaccaacaccgggaccatcggggcggtgtccctcgacttctcccccggcacgagcgggtccccaatcgtcgaccggaaaggcaaggtggtgggtctgtatggcaacggcgtagtcacccgcagcggggcctacgtctccgctatcgcccagactgagaaatccatcgaggacaaccccgaaatcgaggacgacatctttcgcaagaagcgcctcaccatcatggacctgcaccccggcgcgggcaagaccaagaggtacctgcccgccatcgttcgcgaggccatcaagcggggccttaggaccttaatcctggccccgacccgcgtcgtggccgctgagatggaagaagccttacgggggctccccatccgttaccagactcccgctatacgggcagagcacacgggccgcgaaatcgtggacctgatgtgccacgccaccttcaccatgaggctcctcagccccgttcgagtgcccaattacaacttaataatcatggacgaagcgcacttcaccgatcctgcctccattgccgcccggggctacatctccacacgcgtagagatgggcgaagccgctggcatcttcatgactgccacgccgcccggatcccgggatccatttccccaaagtaacgcccccatcatggacgaggagcgcgagatccccgagcggagttggaacagtggccacgaatgggtaacagacttcaagggcaagacggtctggttcgtaccgtccatcaaggcggggaatgatatcgcggcgtgcctgcgcaagaatggcaagaaggtcatccagttgagccggaagaccttcgactccgagtacgtgaagactcgggccaacgactgggacttcgttgttaccacagatattagcgagatgggagccaacttccgggccgagcgcgtgatcgacccacgccgctgcatgaagcccgtaatcttgaccgacggcgaggagcgtgtgatcctggcggggccaatgccggttacccactccagcgcggctcagcgccggggccgtattgggcgaaaccccaagaacgagaatgatcaatatatatacatgggcgagcccctcgagaacgacgaggattgtgcccattggaaggaagcaaagatgctcctggacaatatcaacacgccggaaggtataattccgtccatgtttgaacccgagcgggagaaagtggacgcgatcgatggggagtaccggctccggggcgaagcacgtaagacgtttgtcgacctgatgcggcgcggggacctgcccgtgtggctcgcctaccgggtagctgccgagggaatcaactacgcggatcgcagatggtgcttcgatggaatcaagaacaaccaaatcctggaggaaaacgtcgaggtggagatctggaccaaagagggcgagcgtaagaaattaaagccgcggtggttagacgcccgaatttactcggaccccctggccttaaaggagttcaaggagttcgctgcgggccgcaagtccttgaccctgaacctcattaccgagatggggaggcttccaacattcatgacccaaaaggcccgggacgccctggataacctggccgtcctccacaccgccgaggttggcgggcgcgcatataatcacgccctgagcgagctgcccgaaacgctggagacgctgctacttcttaccctcctcgccaccgtgacaggcgggattttcctctttctaatgtccgggaaaggcatcggaaaaatgacgctcggaatgtgctgcatcatcaccgccagcatccttctgtggtacgcccagattcagccgcattggatagctgccagtatcatcctcgagttctttctgatcgtcctgctcatccctgaaccagaaaagcagagaacgccccaggataatcagctgacatacgtggtgattgccatccttaccgtcgtggccgccacgatggcaaatgaaatggggttcctagaaaagaccaagaaggacttgggactggggtccataatcacccaagagagcgagagtaatatcctcgacatagacctgcgcccggccagcgcatggacactttacgccgtggctacgaccttcgtaacccccatgctccggcactccatcgagaacagctccgtgaacgtttcactgaccgctatcgccaatcaggcgacggtcctgatggggctcggaagaggatggcccctatccaagatggacatcggcgtgcctctgctcgccatcggctgctactcgcaagtgaacccgataaccctgaccgccgccctgcttctgctggtcgcccactatgccatcatcggccccggtctacaagccaaggcgacccgcgaggcccagaagagggcagccgccgggataatgaagaatccgacggtggatggcatcactgtaatagacttggagcccataccttacgaccccaagttcgaaaagcaactcggacaggtaatgctcctggttctgtgcgtgacccaggtcttgatgatgcgcactacatgggcgctgtgcgaggccttaaccctcgctaccggacccatttcaaccctgtgggaagggaatccaggtcggttttggaacacaacgatcgccgtgagcatggcgaacattttccgcggttcctatctggcgggggccgggctcctgttcagcatcatgaagaacaccaccaacacacgcagggggaccggcaatattggcgagacactgggggagaagtggaagtcacggctcaatgccttgggcaagagcgagttccagatctacaagaagtcaggaatccaggaggtagaccgcacgttggcgaaggagggcatcaaacgcggcgagacggatcaccatgcggtcagcaggggctccgccaaactccgatggtttgtggagcgcaatatggtgactcctgaggggaaggtagtggacctcggctgcggccgaggcgggtggagctactactgcggcgggttaaagaatgtgcgcgaggttaagggcctgaccaaaggcggacccggacacgaggagccgatccccatgtccacctacggctggaacctggtgcgcctgcagagcggggtggacgtgttcttcacgccgccagagaagtgcgacacactcctgtgcgacatcggggagagcagccccaatcccaccattgaggctggccgcaccttacgggttctcaatctggtggagaactggctgaacaacaacacgcaattctgcatcaaggtccttaacccgtacatgcctagcgtaatcgaaaaaatggaaaccttgcaaaggaaatatggcggcgcgctagtgcgtaatcccctttcccgcaacagcactcacgagatgtactgggtgtcaaacgcaaccgggaacatcgtgagttcagtgaatatgataagcaggatgctcataaaccggttcacaatgaaacataagaaggcgacatacgagccagatgtcgacctgggctccggcacccggaacatcggtatcgagaacgagatccccaaccttgacataatcggcaagcgaatcgagaagatcaagcaggagcacgagaccagctggcactacgaccaggaccacccctacaagacatgggcctaccacggttcgtacgagacaaaacagacaggcagcgcctcgtcgatggtaaacggggtagtacgcctgctgaccaagccttgggacgttgtgcccatggtcactcagatggccatgacggacacaacacccttcggacagcagcgagtgttcaaggagaaagtcgacacccgcacgcaggagcctaaggaaggcaccaagaagctgatgcggatcaccgctgagtggctgtggaaggagctagggaagaagaagacgccccggatgtgcacgcgggaggaattcacccgcaaggtccgatccaacgcggccctgggcgccatcttcaccgacgagaacaagtggaagtccgcacgtgaggccgtggaggactcccggttctgggagctagtagatcgcgagagaaacctgcacctggagggcaagtgcgaaacgtgcgtgtacaacatgatgggcaaacgcgaaaagaagctcggggagttcgggaaggccaaaggaagccgggctatctggtacatgtggctgggggcccgcttcctggagtttgaggccctcggcttcttgaacgaggaccactggttctcacggggtaactccctgagcggcgtggagggggagggccttcacaagctgggatacatcttgcgcgatgtctctaaaaaagaggggggggcgatgtacgccgacgacactgccgggtgggacacaaggattaccctcgaagatctcaagaacgaggagatggttaccaaccacatgaagggtgagcataaaaaactggccgaagccatctttaagctcacttaccagaacaaggtggtccgcgtccaacgcccaaccccacgggggaccgttatggacatcatcagccgcaaggaccagcggggctcaggccaggttggaacctacggtctcaatacgttcacgaacatggaggcgcagctgatccgacagatggagggcgagggcattttcaagtctatccagcacctcaccgtgaccgaagagatcgccgtgcaaaactggctggcacgggtggggcgtgagcggctatccagaatggccatcagtggagacgattgtgtggttaaacccctcgacgaccgctttgcctcagcgctgacggccttaaacgacatgggcaaggtacgcaaggacatacagcagtgggaacccagtcgtgggtggaacgactggacccaggtgccgttctgctcccaccacttccatgagctcgtgatgaaggacggccgcgttctagtggtaccctgccgtaaccaggacgagctgatagggcgcgccagaatcagccagggcgccggctggtctctcaaggagaccgcctgtctcggcaagtcttacgcgcaaatgtggacccttatgtattttcaccgcagagacctccggctggccgccaatgcaatatgttcagcggtcccctcgcactgggtgcccacatcccggaccacctggagcatccacgcaaagcatgagtggatgactaccgaggacatgctggccgtctggaaccgcgtctggatacaggagaacccgtggatggaagacaagacgccggtggagagttgggaagaggtgccatacctagggaagcgcgaggaccagtggtgtggatctctgatcggccttaccagtagagctacctgggccaagaacatccaaaccgcaatcaaccaggtgcgtagcttaatcgggaacgaggagtatacggactatatgcccagtatgaagcggtttcggaaagaagaggaggaggccggcgtgctgtggtga

SEQ ID NO: 25201 - RNA, 9876 nt, synthetic construct
  misc_feature 1..9876: note = derived and/or modified CDS sequence (opt11) from DENV-2__EU596485__SS-prME
  source 1..9876: mol_type = other RNA
acggcgggagtaattattatgctaataccaaccgcaatggcattccatctaacaacgagaaacggcgaaccgcacatgatcgtgggacgtcaggaaaaaggcaaatctctgttattcaaaacggaagatggagtgaacatgtgcaccctaatggcaatcgacttaggggaactgtgcgaagataccattacttacaaatgcccgctcctccggcagaatgagccagaagacatcgactgctggtgtaatagtacatcaacatgggtaacctatggcacatgcacgacaaccggtgaacaccggcgagagaaacggtccgtggcgctagtaccccacgtaggtatggggcttgaaacgcgaactgagacctggatgagctcagaaggcgcatggaaacacgtccaacgcatcgagacatggatattgcgccatccgggcttcaccataatggcagccattctagcatatacgatagggacaacacacttccagagggccctcatcttcatcctactcactgcagtcgcaccgtccatgaccatgcgctgtatcggaatcagtaaccgggactttgttgaaggtgtttcgggaggctcgtgggtagacatagtcctagagcacggcagctgcgtcaccacgatggctaaaaataaaccaacactagacttcgaattgatcaaaaccgaagcgaaacaaccagctaccctgagaaaatactgcatagaagcgaaactgactaacacaactaccgaatcccgctgtccaacccagggggagccgtctttaaacgaggaacaagataaaaggttcatctgtaaacatagtatggtggatcgaggatggggcaatggctgcgggttattcggcaaaggaggcatcgtcacgtgcgccatgttcacatgcaagaaaaatatggaaggaaaagttgtactgccagaaaacctagagtacaccatcgtcatcaccccacactcaggggaagaacacgctgtaggcaacgacactggaaaacacgggaaagaaataaaaataacacctcagtcatcgataaccgaagcggagctaaccggctacgggaccgtaacgatggaatgctcgccgcgaacaggactcgactttaacgaaatggtactcctccagatggaggacaaagcgtggctagtccatcgccaatggtttctcgatctgccactcccctggttgccaggagcggacactcaagggagtaactggatccaaaaagagacgctagtcactttcaaaaatccccacgccaagaaacaggacgtagtcgtactgggatcacaagaaggggccatgcacacagctctgacaggagctacagaaatccagatgtccagtggcaatctgctgttcactggacacttaaaatgccgattacgaatggataaacttcagctcaaggggatgtcctatagcatgtgcaccggaaaatttaaaatagttaaagaaatagccgaaacgcaacatggaacaatagtaatcagggtgcagtacgaaggcgatggatcaccctgcaaaatcccattcgaaattatggacctggaaaagagacacgtcctaggccgattgattacggtcaaccccatcgtgactgagaaggacagcccagtcaacatagaagcagaaccaccctttggcgactcatacatcataatcggggtagaaccagggcaactcaagttgaactggttcaagaaaggttcatccatagggcaaatgttcgagacgaccatgaggggcgcaaaacggatggcaatcctgggagataccgcatgggactttgggagcttaggcggggtatttacttcaataggaaaggcactgcatcaggtgttcggggccatctacggcgcggcattcagcggcgttagttggacgatgaaaattctcatcggggtgattataacatggattgggatgaacagcaggagcacgagcctaagcgtcagtttagtgctcgtcggagtcgtaacgctctatcttggagttatggttcaagccgacagcggctgtgtagtatcatggaagaacaaagaactgaaatgcggttcgggaatattcatcaccgataacgtgcacacctggaccgagcaatacaagttccagcccgaatcgccctccaagctagccagcgcaatccaaaaggctcacgaagaagggatttgcggcatcagatccgtcacgcgactagagaatctgatgtggaagcaaatcacgcccgagttaaaccacatcctatccgaaaacgaggtcaaactcacaatcatgactggcgacatcaaaggtatcatgcaggccggcaaacgaagcctacgcccacagcctacagagctcaaatactcatggaaaacatgggggaaggccaagatgctgagcaccgactcgcacaaccaaacgttcctaatagacgggcccgagaccgctgagtgcccaaacacgaaccgagcgtggaactctctcgaagtcgaggactatggattcggagtattcagcactaacatttggctcaaactgcgagaaaagcaggatgtattctgtgatagcaagctcatgtccgcggcgatcaaagacaaccgggcggtgcacgctgatatggggtactggatcgagtcggcactcaacgacacttggaagatggaaaaagcgagcttcatcgaagtgaaatcatgccactggccgaagtcgcacaccttatggtccaatggcgtactcgagtccgagatgataatccctaaaaacttcgctgggccagtatcacaacacaattaccgaccgggttaccatacccaaaccgcaggaccgtggcacctgggcaaactagaaatggacttcgatttctgtgaaggcaccaccgtcgtagtgactgaggactgcgggaaccgcggtccaagcctcagaacgaccaccgcgagtggaaagttgataacggaatggtgctgcaggagctgcaccttaccgcctttaagatataggggcgaagacgggtgctggtatggtatggaaataaggccattaaaggaaaaggaggagaatctagtgaacagcctagttacagcaggtcatggacaaatcgacaacttctccctcggggttctaggaatggcactctttctagaagaaatgctccgaacacgagtaggcacaaagcacgcaatactgctggtcgccgtatcattcgtaactctcatcactggaaacatgagcttcagggacctggggcgcgtaatggtgatggtaggtgccaccatgacagatgacatcggaatgggagtcacatatctagcgttattggcggctttcaaagtcaggccgacgtttgcagccggcctgttgctgcgaaaactaacgtcgaaagagctgatgatggcaaccatcgggatagcgttgctatcgcaaagcactatacccgagacaattttggaactaacagacgcgctcgcgctcggtatgatggtactcaaaatcgtccgcaacatggaaaaataccagctagccgtaaccatcatggcaataagttgtgtgcccaacgcggtaatactccagaacgcgtggaaagtctcgtgcacaatcctcgcggccgtaagcgtctccccgctgctgctcactagctcccagcagaaagcggattggataccattagccctgacaataaaaggactgaaccctacggcaatattcctcacaaccctaagccggacttctaagaaaagaagttggcccctaaacgaagcggtcatggcggtcggcatggtgagtatactggcctccagtctgctcaagaacgacattccaatgaccggccccctggtggctggcgggttactaaccgtgtgttatgtacttactgggagaagcgcagatcttgaactagagcgagcggcggacgtcaaatgggaggaccaagcggagataagcggcagcagcccaatcctatcgatcaccatctcggaggacggatccatgtctatcaaaaacgaagaggaagaacagaccctgaccatattaatcagaacagggctgctggtaatctcaggggtctttccagtttccatacccatcaccgccgcggcatggtacctctgggaagtcaaaaagcaaagggcgggagttttatgggacgtccccagcccgcctccagtgggtaaggcggagttagaggatggcgcttaccgaattaaacaaagaggaattttcggttacagccagataggcgcgggcgtatacaaggaaggcactttccacacaatgtggcatgtaactagaggagcggtgctaatgcacaggggtaaacgaatcgaaccctcatgggcagacgtcaagaaagacctaataagctacggagggggctggaagttggagggcgagtggaaagaaggcgaggaagtccaagtgctggcactagaaccgggcaagaacccaagagccgtgcaaacgaaaccaggtctgtttaagactaacacaggaacaatcggcgccgtctcgctagacttcagtccgggaaccagcgggagcccgatcgtagacagaaagggaaaggtcgtagggttgtacgggaacggcgtcgttacgcgatcgggagcgtatgtatccgcaattgcgcaaacggagaaaagcatagaagacaatcctgaaatcgaggatgacatcttcaggaagaaacgccttaccatcatggacctgcacccaggggccgggaagacgaagcgatatctccccgccatagttcgcgaagcgatcaagcgaggccttagaacactcatactagcccccactcgagtagtggctgcggagatggaggaggcccttagaggtctaccgatccggtatcaaacacccgcgataagggctgaacatacaggacgagagattgttgacctgatgtgccacgcaacatttaccatgcgactcctatcccccgttagagtcccgaactataacctgataataatggacgaagcccacttcaccgaccccgcaagcatagcagccagaggctacatcagcacgcgagtagaaatgggtgaggcggctggaatcttcatgactgcaacgccaccaggctcccgggacccctttccccagagcaacgcgccaatcatggacgaagaacgagagattccagaaagatcatggaactcgggacacgagtgggtcacggacttcaaaggcaaaactgtgtggttcgtaccctctataaaagccggcaacgacattgcggcatgcctacgcaagaacggaaagaaggtgatccaattatcccgcaagaccttcgactctgagtacgtgaaaacgagagcaaatgactgggacttcgtggtcactacagacatcagcgagatgggggcaaatttccgtgcggaacgggtgatagatccccgacgctgtatgaaacccgtaatacttacagacggtgaggaaagagtaatcctcgcgggacccatgccggtaacgcacagctccgcagcccaacggaggggccgaatcgggagaaatcccaaaaatgaaaacgaccaatatatatacatgggcgagccgcttgagaacgacgaggactgcgcacactggaaagaggctaaaatgctcctagataacataaacacaccagagggtataatacccagcatgttcgaacccgagcgagaaaaagtagacgcgattgacggcgagtaccgattacgaggagaagccaggaaaacattcgtagatctcatgagaagaggcgacctacccgtctggttggcatatcgagtggctgcagagggaatcaactacgcagacagacgctggtgcttcgacggtatcaaaaataatcagatactggaagaaaacgtcgaggttgaaatctggacgaaggaaggcgaacgaaagaaattgaagccaagatggctagacgcgcgcatctacagcgacccgcttgcactaaaggagttcaaggaatttgccgccgggcgcaagagcctgactctgaatctcatcaccgagatggggcggttaccaaccttcatgactcaaaaagcgcgcgacgcactcgacaatttggccgtactacataccgcggaagtaggtggccgcgcttacaaccatgcacttagcgaactgccggagacgctagagacactgctactgttaacactactagccgccgtcaccggaggcatttttctattcctaatgtcgggcaagggtatagggaagatgacactaggaatgtgttgcatcatcacggcatccatcctcctgtggtacgcacaaattcaaccccattggatcgccgcatcgataattttggagttcttcctgatagtcttactcatcccggagccggaaaaacaaaggacaccacaggacaaccaactcacgtatgtagttatagccatactaactgtagtggcggccacgatggccaacgaaatgggcttcctggagaagaccaagaaagacctcggactcgggagcataataacgcaagaatctgaatcaaatatcctcgacatcgaccttcgcccagcgagcgcatggaccctatatgccgtagcgacaacattcgtgacgccgatgctaaggcatagcatagagaatagttcagtaaacgtctcattgacagcaatcgcgaaccaggcgaccgtgctgatgggtttagggcgaggctggccactgagcaagatggatataggggtccccctgctggctatcggctgctattcccaggtgaatcctattacgctcacggctgcactgctcttattagtcgcgcactacgctatcataggccccgggcttcaagcaaaggcaacccgcgaggcgcagaagcgcgcagcagccggaataatgaagaatccaacggtggacgggatcacggtcattgacctcgaacccataccctatgacccgaaatttgaaaaacaactgggccaggtaatgctcctagtgctctgcgttacgcaggttctgatgatgaggacaacatgggctctttgcgaggcattgaccctcgcgactgggccaatctccacgctttgggaagggaatccaggccgcttttggaacacgaccatagctgtcagcatggcgaacatattccgaggctcatacctcgccggtgccgggcttctgttttcgataatgaaaaacacaaccaatacacggaggggtactgggaatatcggggaaactctgggagaaaaatggaaaagcagacttaacgctctaggtaagagcgagttccaaatctacaagaaaagcggaatccaggaagtggaccgaactctcgccaaggaagggatcaaaagaggggaaaccgatcaccacgcagtaagccgcggaagcgcgaagttacggtggtttgtagagcgaaacatggtcacgccggaaggaaaagtagtggatctggggtgcggaaggggaggatggtcgtactattgcggcgggctcaaaaacgtgagggaggtcaaaggcttaaccaaagggggccccgggcacgaagaacccattccaatgagcacctacgggtggaacctagttcgcctccaatcaggagtagacgtcttcttcacgcccccagaaaagtgcgacaccctgctatgcgacataggcgaaagctctccgaacccgaccatcgaagctgggagaacccttcgagttctcaacctcgtcgagaattggctcaataacaatacgcaattctgcataaaagtcctgaacccgtatatgccgtcagtaatcgagaaaatggaaacactgcaaagaaaatatggcggcgcactggtccgaaaccccctaagtagaaacagcactcacgaaatgtactgggtctcgaacgcaaccggcaatatagtcagctcggtaaacatgattagccgcatgttgataaaccgattcactatgaagcataagaaggcaacctacgaacccgatgtagacctaggctccggaaccaggaacatcggcatagaaaacgagataccgaatctggacataataggaaagaggatagaaaagataaaacaggaacatgaaacctcctggcactacgaccaagatcacccctacaagacctgggcataccacggttcatatgagacgaaacaaaccggttctgcgtcatcgatggtaaatggggtggtcagactcctaacaaaaccatgggacgtcgtacccatggtaacccagatggccatgacggacacaacgcctttcggacaacaaagagtgtttaaagaaaaagtcgatacacgaacccaggaacccaaggagggtaccaagaaactcatgagaatcactgcagaatggctctggaaagaattggggaaaaagaaaacacccagaatgtgtaccagggaagagtttgccaggaaagtcagaagcaacgcagccctcggagccatcttcaccgatgagaacaaatggaaaagtgccagagaagcagtagaggactctagattctgggagctggtagacagagaacgcaacctgcatctcgagggaaagtgcgaaacgtgcgtatacaatatgatgggaaagcgggagaagaaattgggggaatttgggaaagcgaaaggatctcgggcgatctggtacatgtggttgggagcccgatttctcgagttcgaagcgttgggcttcctaaacgaagaccattggttcagccgcggtaacagtctctcaggggtcgaaggcgagggcctccacaaactcgggtacatacttcgagacgtgtccaagaaagaagggggagccatgtacgcggatgacacagcaggatgggacactaggatcacgctcgaggatttaaagaacgaagaaatggtgaccaaccatatgaagggtgaacacaagaagttggcggaagccatcttcaaactcacttatcagaacaaggtcgttagagtacaacgacccacgccacgcggaacagtcatggacatcattagcaggaaagaccagcgtgggagcggacaggtgggcacatatggcctcaacacgttcacaaacatggaggcgcaactcattcggcaaatggagggggaaggtatctttaagagcatacaacacctaacggttacggaagagatcgcggtccagaactggctggcccgagtgggccgggagagactcagtcgaatggcgataagcggggacgactgtgtcgtaaaaccactggatgaccgtttcgcaagcgcgctaacagctctaaacgacatggggaaagtaagaaaagacatccaacagtgggaaccatcacgaggatggaatgactggacccaggtgcccttttgctcacaccatttccatgaactggtgatgaaagacgggagagtcctagtggtaccctgccgaaatcaagacgaactgatcgggcgcgcccgcataagccagggcgcaggctggagcctaaaggaaaccgcgtgcttagggaaaagctacgctcagatgtggacactaatgtacttccatagacgagacctaaggttggccgcaaacgcgatatgctcagcagtaccctcacactgggttcctacaagtaggacgacctggagcatccatgctaagcatgaatggatgacaaccgaagacatgctcgcggtatggaacagggtctggatacaagaaaatccatggatggaggacaaaacccccgtcgaaagttgggaggaggtaccctatcttggcaaacgggaggaccagtggtgtggcagcttaatcggattaacaagccgggccacctgggccaaaaacatccagacggccataaaccaggttcggtcgttaatagggaacgaggaatacactgactacatgccttcgatgaagcgattccgaaaagaagaagaagaagcgggcgtgctatggtga

SEQ ID NO: 25202 - RNA, 9876 nt, synthetic construct
  misc_feature 1..9876: note = derived and/or modified CDS sequence (opt11) from DENV-2__EU569710__SS-prME
  source 1..9876: mol_type = other RNA
accgccggcgtgataatcatgctgatccccaccgcgatggcgttccatctcaccacgcgcaacggggagccccacatgatagtgggtcggcaagagaaggggaagtccctgctgttcaagactgaagacggcgtgaacatgtgcaccttaatggcaatcgacctgggggagctgtgcgaggacaccatcacctacaagtgcccccttctgcggcaaaacgagcccgaagacatcgactgctggtgtaacagcaccagcacatgggtgacctacgggacatgcactacaacgggcgagcataggcgcgagaagcggtccgttgccctggttccccatgtcgggatgggcctcgagactcgcacagagacgtggatgagcagtgagggggcgtggaagcatgtgcagcgaatcgagacctggatcctgcgccacccgggcttcactatcatggccgctatcctcgcctacaccatagggaccacccacttccagcgggcattgacgttcatcctactaaccgccgtcgcccccagcatgactatgcgctgcatagggataagtaaccgggacttcgtggagggcgtcagcgggggttcttgggtcgacatcgtgcttgagcacgggagctgcgtcaccaccatggcaaaaaacaagcccaccctggacttcgagctgataaagaccgaggccaagcagcccgcaatcctcagaaagtactgcatcgaggccaagctgacgaacaccaccaccgagtctaggtgcccgacgcagggcgagcctagcctgaacgaagagcaggacaagcgcttcatctgcaaacacagcatggtggaccgcggttgggggaacggctgcggcctcttcgggaagggcggaatagtaacctgcgcgatgttcacgtgcaagaagaacatggagggcaaggtcgtgctccccgagaacctggaatacactatcgttatcacgccccacagcggggaggagcatgccgtcggcaacgataccgggaagcacggcaaggagatcaagatcaccccgcagtccagcatcacagaagccgagctaacaggctacggcacggttacgatggagtgcagcccccggaccggcttggacttcaacgagatggttttgctccagatggaggacaaggcctggttggtccacaggcagtggttcttagacctccccctgccatggctgcccggggccgatacccagggcagcaactggatccagaaggagacgctcgtcaccttcaagaacccccacgccaagaagcaggatgtggtcgtgctggggtcccaggagggcgccatgcataccgccctgaccggcgccacggaaatccagatgtccagcggcaacctcctgttcaccggccacctaaaatgccgcctccgaatggacaagctgcagctgaaggggatgtcctacagcatgtgtaccggtaagttcaagatcgtcaaggagatcgccgaaacccaacacgggaccatcgtgatccgcgtgcagtatgagggcgacgggagtccctgcaagatccccttcgaaattatggacctcgagaagcggtacgtcctggggcgcctgatcaccgtaaacccgatcgtgacggaaaaggacagccccgtcaacatcgaggcggagccgcctttcggagactcctacattatcatcggggtggagccgggccagctcaagctgaactggttcaagaaagggagctccatcggccaaatgttcgaaacaacgatgcgcggggccaaacggatggccatactgggggacaccgcctgggacttcggctcattagggggagtgttcacctccatcgggaaggctctgcaccaggtcttcggtgcgatttacggagccgccttctcaggggtctcctggaccatgaagatcctgatcggcgtgatcatcacgtggatcgggatgaacagcagatccaccagcctgtccgtatccctcgtcctggtgggggtcgtgaccctgtacctcggggtcatggtccaggccgactcaggctgcgtcgtgtcatggaagaacaaagagctgaagtgcggttctggaatcttcataaccgataacgtccacacatggaccgagcagtacaagttccagcccgagagcccctcgaagctggcgagtgccattcagaaggcacacgaagagggcatatgcgggatacggagcgtgacccgtcttgagaatctgatgtggaagcagataacccccgaactgaaccacatcctgtcggagaacgaggtcaagctgactatcatgacgggcgacatcaaggggataatgcaggccggcaagcggagcctgcggccgcagcccacggagctcaagtactcctggaaaacctggggcaaggccaagatgctgagcacggagtctcacaaccagaccttcctgatcgacgggcccgagaccgcggagtgcccaaacaccaaccgggcctggaattccctcgaagtcgaggactacggtttcggagtgttctccactaacatctggctgaagctgcgcgagaagcaggacgtgttctgcgatagcaagctcatgtccgccgccatcaaggacaaccgggccgtccacgcggacatgggctattggatcgagtcggccctgaacgacacgtggaagatggaaaaagcttccttcatcgaagtcaagagctgccactggcccaagtctcacaccctctggagcaatggcgtgctcgagtccgagatgatcattcccaagaacttcgccgggcccgtgtctcagcacaactaccggccgggctaccacactcagaccgccggaccctggcacctgggtaagcttgagatggatttcgacttttgcgaggggacgactgtggtggtcaccgaggactgcggtaaccggggcccctctctacgcaccacgacggcgtccggaaagctgatcaccgagtggtgctgcagaagctgcaccctgcccccactccgctaccggggcgaggatggctgctggtacggcatggagatccgccccctgaaggagaaagaggagaacctggtgaactctctcgtgacggccgggcacgggcagatcgataacttcagccttggagtcctgggcatggccctctttctggaagagatgctaagaacccgcgttggcaccaagcacgcaatcctcctagtggcggtgtcatttgtcacccttattacggggaacatgagcttccgtgacctcggtcgcgtgatggtaatggttggggccactatgaccgacgacatcggcatgggagtgacctacctggccctgctcgccgccttcaaggtcaggcctactttcgcggccgggctgctgctccggaagctgacctccaaagaactgatgatggccactatcggcatcgctcttctgagccagtccaccatccccgaaacgatcctggagctcaccgacgccctggcactcgggatgatggtgctcaaaatcgtgcgcaatatggagaagtaccagctggccgtcaccataatggccatcctgtgcgtgcctaacgctgtgatcctccagaacgcctggaaggtcagctgtaccatcctggcggccgtgtccgtcagcccattgctcctgacgtcctctcagcagaaggcggactggatccccctggccctcaccataaagggcctgaaccccacggccatcttcctgacgacgctaagccggacctcaaagaagcgctcctggcccctgaacgaagccgtgatggccgtgggcatggtttctatcctcgcctccagcttgctgaagaacgacatccccatgaccggtcctctggtggccggcgggctcctgaccgtgtgctatgtcctgacaggccggagcgcggacttagagctggagcgcgccgccgatgtgaagtgggaagaccaagccgagatatccgggagctccccgatcctgagcatcaccatatccgaggacggcagcatgtccatcaagaatgaggaggaggagcagacgctcaccatcctcatcaggacgggcctactcgtgattagcggggtgttccccgtgagtatccccatcaccgctgcagcctggtacctgtgggaggtgaaaaagcagagggccggagtcctgtgggacgtgccctcgcctccgcccgtgggaaaggccgagctcgaggacggcgcctataggatcaagcagcgcggtatcttcggctactcccagatcggcgcgggggtctacaaagaaggcaccttccacaccatgtggcacgtgacccgcggggccgtgctgatgcaccgcggcaagcgcatcgagcccagctgggccgacgtcaaaaaggacttgatcagctacgggggcggctggaagctcgagggggagtggaaggagggcgaggaagtccaggtgctggccctcgagcctggtaagaacccccgcgccgtccagacgaagccgggcctcttcaagactaacaccgggaccatcggcgccgtaagcctggacttctccccaggcacgagcggctcccccatagtggaccggaagggcaaagtcgtggggctgtacgggaacggcgtggtcacccgcagcggggcctacgtgtccgccatcgcccagaccgaaaagtccatcgaggacaaccctgagatcgaagacgacatattccggaagaaacgtctcaccatcatggatctgcaccccggcgcggggaagacgaagcggtacctgcccgccatcgttcgggaggccatcaagcggggccttcgcaccctcatcttggccccgacccgcgttgtggccgccgagatggaggaggctcttcggggcctccccatccgctaccagactcccgcgatccgggccgagcacacaggcagagagatcgtggaccttatgtgccacgcgacctttaccatgcggctgctcagccctgtccgtgtgccgaactacaatctgattatcatggacgaggcgcacttcaccgatcccgcatccatcgccgcccggggctacatcagcacgcgagttgagatgggggaggctgcaggtatcttcatgaccgcaacgccgcccgggtcccgggatccgtttccccaaagcaacgcccccattatggacgaggagcgcgagattcccgagcggtcctggaacagcggacacgagtgggtcaccgacttcaaggggaagacggtgtggttcgttccgtccatcaaggccggcaacgacatcgcggcctgcctgcgcaagaacggcaagaaggtcatccaactctctcggaagaccttcgactccgagtacgtgaagacccgcgctaacgactgggatttcgtggtcaccacggacatcagcgagatgggagccaacttccgggcagagcgagtgatcgaccccagacgctgcatgaagccggtgatactgaccgacggcgaggagcgggtcatcctggccggacccatgccggtgacccactcaagcgcggcccagcgccgcggccggatcgggcgcaaccccaagaacgagaacgaccagtacatttacatgggcgagcccctcgagaacgacgaggactgcgcccactggaaggaggctaagatgctgctggacaacatcaacactcccgagggcatcatcccgtccatgttcgagcccgagcgagagaaggtggacgcgatagacggggaatatcgcctccggggcgaggcccgcaagacgttcgtcgacctgatgcgtcggggcgacctgcccgtgtggctcgcctaccgcgtggccgcagaaggcataaactacgctgaccgccgctggtgctttgacgggattaagaacaaccagattctggaggagaacgtcgaggtcgagatctggaccaaggagggcgagcggaagaagctgaagccgcggtggctcgacgccagaatctacagcgaccccctggccctgaaagaattcaaagagttcgccgccggtcggaagtcccttaccctgaaccttatcaccgagatggggcgcctccccacgttcatgacccagaaggcgcgggacgcactggataacctggcagtcctccataccgccgaggtcggagggcgggcgtataaccacgcgctgagcgagttgcccgagacgttggagacgctgctgctcctcaccctgctcgccaccgtgaccggtggcatcttcctgttcctgatgtccggaaaaggaatcggaaagatgacgctcgggatgtgctgcatcatcactgcctcgatcttactgtggtacgcccagattcagccgcactggatcgcggcctccatcatcttagagttcttcctaatagtcctgctaatccccgagcctgagaaacaacggaccccccaggataaccagctgacttacgtggtgatcgccattctgactgtcgtggccgctacgatggctaacgagatgggcttcctcgagaagaccaagaaggacttaggactgggcagtatcattacccaggagagcgagtccaacattctcgacatcgacctgcgcccggccagcgcctggaccctgtatgccgtggcgacgaccttcgtcacccccatgctccggcactccattgagaacagctcagtgaacgtgagcctgacagcgatcgctaaccaggccacggtactgatggggctcggccgcgggtggccgctgtctaagatggacatcggcgtgcccctgctcgccatcgggtgctactctcaggtgaacccaatcacgctgacggcggccctactcctactggtcgcccactatgccatcatcggccccggcctccaggccaaggcgactcgcgaggcccagaagagggccgccgccgggatcatgaagaacccgacggtcgacggcatcaccgttatcgacttggagcccatcccttacgaccccaagttcgagaagcagctggggcaggtcatgctccttgtgctgtgcgtcacccaggtcctcatgatgcgcaccacgtgggccctgtgtgaggccctgaccctcgccaccggccccatctcaaccctgtgggagggtaaccccggcagattctggaacaccactattgccgtgagcatggcgaacatcttccgcggctcctacctggcgggggcagggctccttttctcgatcatgaagaatacaaccaacacgcggcgcgggaccggcaacatcggcgagaccctcggggaaaagtggaagtcccggctcaacgcgttagggaagagcgagttccagatttacaagaagtccggaatccaggaggtcgaccgcaccctggccaaggagggcatcaagcgcggggagacggaccaccacgcggttagcagagggtccgccaagctccggtggttcgtagagcgcaacatggtgaccccggagggcaaggtcgtggacctggggtgcgggcgcggtggctggtcgtactattgcggcgggctgaagaacgtgcgcgaggtcaaggggctgaccaaaggcgggcctgggcacgaggaacccatcccgatgtccacctacggctggaacctggtgcggctgcagagcggggtggacgtgttcttcacgccgcccgagaagtgcgatactctcttatgcgacatcggcgagagctcccccaaccccacaatcgaggccggccgcaccctgcgggtgctcaacctggtggagaactggctaaacaataacacgcagttctgcatcaaggtcctcaacccctacatgccaagcgtaattgaaaaaatggagacactgcagcgcaagtacgggggcgccctggtgcggaaccccctgtcccgcaacagcacccacgagatgtattgggtttcgaacgccaccgggaacatagtaagctccgtgaacatgatatcacgtatgctcatcaaccggttcacgatgaagcacaagaaggcgacatacgagccggatgtcgacctggggtccgggacccgcaacatcggcatagagaacgagatccccaatctggatattatcggcaagaggatagagaagatcaagcaggaacatgagacatcgtggcactacgaccaggaccacccctacaaaacctgggcctaccacgggtcatatgagacgaagcaaaccggctcagcctccagcatggtgaacggtgtggtacgcctcctgacaaagccctgggacgtcgtaccgatggtcacacagatggccatgactgacaccaccccctttggccagcagagggtgtttaaggagaaggtggacacccgcacgcaggagcccaaggagggcaccaaaaagctgatgcggatcactgccgaatggctctggaaggaactggggaagaagaagacgccccgaatgtgcacccgggaggagttcacgaggaaggtccggtccaacgcggccctgggcgccattttcaccgacgagaacaagtggaagtcagcccgcgaggccgtggaggactcccgtttttgggagctcgtcgaccgggagcggaacctccatctagaggggaaatgtgaaacttgcgtatacaacatgatgggcaagcgcgaaaagaagctcggggagttcggtaaggcgaaaggcagccgggccatatggtatatgtggctcggggctcgctttctggagttcgaggcgctcggattcctgaacgaagatcactggttctcccggggcaacagcctgtcaggcgtggagggggagggcctccacaagctgggctatatcctgcgcgatgtctccaagaaggagggcggagcgatgtacgccgacgacacggctgggtgggacacccggatcaccttagaagacctgaaaaacgaggagatggtgaccaaccacatgaagggtgaacataagaaattagcggaggctatcttcaaactcacttaccagaacaaggtggtccgcgtgcagcgcccgactccccgggggaccgtgatggatatcatctcacgcaaggaccagcggggaagtgggcaggtcgggacctacggactcaacacattcacgaatatggaggctcagctgatccgtcagatggagggggagggcatcttcaaatctatccagcacctgaccgttaccgaggagatcgccgtgcagaactggctggctcgggtcggcagagagagactgtcccgcatggcgatctctggggacgattgcgtggtgaagcccctcgacgatcggttcgcctcagcgctgacggccctgaacgatatgggcaaggtccgcaaggatatccagcagtgggaacccagccgggggtggaacgactggacccaggtgcctttctgttcccaccacttccacgagctcgtgatgaaggacggccgcgtcctagtggttccctgccggaatcaggacgagctgatcgggcgcgcccgaatcagccagggtgccggctggagtctcaaagagaccgcatgcctgggcaagagctacgcgcagatgtggaccctcatgtatttccaccgcagggacctccgcctcgcggccaacgcaatctgctccgccgtacccagccactgggtgcccacatcccgaaccacctggagcatccacgcgaagcacgaatggatgaccaccgaggatatgctggccgtgtggaaccgcgtctggatccaggagaacccgtggatggaggacaagacgcccgtggagtcctgggaagaggtgccctacctcgggaagcgcgaggatcagtggtgcgggagcctgattggcttaaccagccgggctacatgggccaagaacatccagaccgccattaaccaggtccgctccctcatagggaacgaagagtacacggactacatgccttcgatgaagcggttccgcaaagaggaagaggaagccggcgtgctgtggtga

SEQ ID NO: 25203 - RNA, 9876 nt, synthetic construct
  misc_feature 1..9876: note = derived and/or modified CDS sequence (opt11) from DENV-2__EU596486__SS-prME
  source 1..9876: mol_type = other RNA
accgccggcgtgatcatcatgctgatccccaccgctatggccttccaccttactacacgaaacggggagccccatatgatagtgggccggcaggaaaaggggaagtccctgctgttcaagaccgaagacggcgtgaacatgtgcaccttgatggccatcgatctgggggaactttgtgaggacactatcacttacaagtgtcccctccttcgacagaatgagcccgaggacatcgactgctggtgtaactcgacctccacctgggtgacctacgggacctgcacaactacgggtgagcaccggcgcgagaaacggagcgtcgctctggtaccccacgtaggaatgggcctcgagaccaggactgagacctggatgagcagcgaaggtgcatggaagcatgtccaacggatcgaaacctggatcttacgccacccgggcttcaccataatggcggcgatattggcctacacaatcgggactacccactttcagcgggccctcatcttcatcctactgaccgcggtggcgcccagtatgacgatgaggtgtataggcatctccaaccgggacttcgtggagggcgtcagcgggggctcctgggtcgacatcgtgctcgagcacgggagctgcgtcactactatggccaagaacaaacccaccctggactttgagctgattaagacagaagccaagcagcccgccaccctccgcaagtactgcatagaggccaagctgaccaacaccaccaccgagtcccgctgtccgacgcaaggggagccctcgctgaacgaggagcaggacaaacgctttatctgcaagcattccatggtggatcggggctgggggaacggctgcggcttgttcggcaagggcgggatcgtgacgtgcgcgatgttcacgtgcaagaagaacatggaaggcaaggtcgttctaccagagaaccttgagtatactatagtgattaccccccacagcggggaggagcacgctgttggcaatgacactgggaaacacggcaaggaaatcaagatcaccccgcagtccagcattacagaggccgaactaaccggttacgggacggtgaccatggagtgcagcccaaggaccggcctggatttcaacgagatggtgctcctccaaatggaggacaaggcgtggctggtccaccggcagtggtttctggatctccctctgccctggctgccgggggcagacacccaaggctctaattggatccagaaggagacgctagtgaccttcaagaacccccacgcgaagaagcaggacgtcgtcgtgctggggagccaggagggtgccatgcacaccgcacttaccggggcaacggagatccagatgagcagcggcaacctcctcttcactggccacctgaagtgccgactccgcatggacaagttgcaactgaaggggatgtcctacagtatgtgcaccggcaaatttaaaatcgtcaaggagatcgccgagactcagcacgggacgatcgtgatccgcgtgcagtacgagggcgacggttctccatgcaagatccccttcgagatcatggacctcgagaagaggtacgtcctggggcgcctgatcacagtgaacccaatcgtgacggagaaggatagcccggtcaacatcgaggcagagccgccattcggcgactcctatatcatcattggggtggagccgggccagctcaagctgaattggttcaagaaggggagctccattggtcaaatgttcgaaactacgatgcgcggcgccaagcggatggcaatcctgggggacaccgcctgggatttcggcagcttggggggtgtgttcacctcaatcggtaaggccttacaccaggtcttcggggcaatctacggagcggccttcagcggggtgtcgtggacaatgaagatcctgatcggcgtgatcataacgtggattggcatgaacagccgctccaccagcctgtccgtcagccttgtgctggtgggggtcgtcaccctgtacctgggggtgatggtccaagcggactccggctgcgtggtgagctggaaaaacaaggagctgaagtgcggcagcggaatcttcatcaccgacaacgtccacacgtggaccgagcagtacaaattccagcccgagagccccagcaagctggcgagcgccatccagaaagcgcacgaggaaggcatctgcgggatccggagcgtgacacgcctcgagaacttgatgtggaagcagatcactcccgagctcaaccatatcctcagcgagaacgaggtgaagctgacgatcatgaccggcgacatcaaggggatcatgcaagccggcaaacggtccctgcgcccgcagcccaccgagttaaagtattcatggaagacctggggcaaggccaagatgttgagcacggagtcccacaaccagacatttctcatcgatgggcccgagaccgcggagtgcccgaacaccaaccgggcctggaactcattagaggttgaagactacggcttcggcgtattctcaacgaatatttggctgaagctgcgcgagaaacaggatgtgttctgcgacagcaagctcatgtcagccgccatcaaggacaaccgggctgtccacgcggacatgggctactggattgagagcgccctgaacgacacctggaagatggagaaagcctccttcatcgaggttaagagctgtcactggcccaagtcccatacactgtggagcaacggcgtactcgagtccgagatgatcattcccaagaatttcgcgggacccgtgagccaacacaactatcgaccgggctaccacacccaaaccgcgggaccgtggcaccttggcaagctggaaatggacttcgacttctgcgaggggacgactgtggttgtaaccgaggactgcggcaatcggggccccagtctcagaaccactactgcatccgggaaactcatcacagaatggtgctgtcgcagctgcaccctgcccccgctccgctaccggggcgaggacggatgctggtacggcatggagatccgccccctgaaggagaaggaagagaacctggtgaactccttggtgaccgccggccacggccaaatcgacaacttctcgctgggtgtcttggggatggccctctttttggaggaaatgttacggacgcgtgtgggcactaagcacgccatcctccttgttgccgttagctttgtgaccctgatcacggggaacatgtcctttcgtgacctcgggcgggtcatggtaatggtgggggccactatgacggacgatattggcatgggtgttacgtaccttgccctgctggctgccttcaaggtccgccccacgttcgctgccggcttgctgctccggaagctgacttccaaggagctaatgatggccaccattgggatcgccctcctgagccaatccaccatcccagaaacgatcctggagctcaccgacgccttggcactggggatgatggtgctcaaaatagtgcggaacatggaaaagtaccagctcgccgtcacgatcatggccatcctgtgcgtgccgaacgccgtgatcctccagaatgcctggaaggtaagctgcacgatcctagctgccgtgtccgtcagccccctgctactaacttcctcccagcagaaggccgattggattcccctggcgctcaccatcaagggcctgaaccccacggcgatcttcctaaccactttgtccagaaccagtaagaagcgctcctggccgttgaatgaagccgtcatggccgtgggcatggtcagcatcttggcgtccagcctcctgaagaacgacatcccaatgaccgggcctctcgtcgccggcgggctcctgaccgtgtgttacgtcctgactggtcggtctgcggatctagagctggaacgcgccgctgacgtcaagtgggaagaccaggccgagatatccgggtctagccccatattgagcatcaccatcagtgaggatggcagtatgtccatcaagaacgaggaggaggagcagaccctcaccatcctgatccggacgggcctgctcgttatcagcggggtattcccggtgtccatccccatcaccgctgcggcctggtacctgtgggaggtgaagaagcagagggccggagtactgtgggatgtgcccagtcccccgcccgtggggaaagccgagcttgaggacggcgcgtaccggatcaaacaacgtggtatcttcggctattcgcagatcggcgcaggcgtgtacaaagagggcaccttccacacgatgtggcacgttacccgcggggccgttctgatgcaccgcggtaagcggatcgaacccagctgggccgacgtcaaaaaggacctgatctcatacgggggcggctggaagctcgaaggggagtggaaggagggagaggaagtccaggtgctggccttagaacccggaaagaacccccgcgccgtccagacgaaacccggtctgttcaagaccaacaccgggaccataggcgcggttagccttgatttctcccccggcacgagcgggtcgccgatagtggatcggaagggcaaagtcgtcggtctgtacggcaacggcgtggtcacccgctcgggagcctacgtgtccgcaatcgcccaaactgagaagtccattgaggacaaccccgagatcgaggacgacatcttccggaagaagcgcctcactataatggacctccaccccggcgcagggaagaccaaacggtacctgcccgccatcgtcagagaggccattaagcggggcctgcggaccttgatccttgcccctacccgcgtcgtggccgcggaaatggaggaggctctgcgggggctcccgatccggtaccagacccccgccatccgggccgagcatacgggccgcgagatcgtggacttgatgtgccacgccacgttcacaatgcggttactcagccctgtacgcgtgccgaactacaacttaatcatcatggacgaggcgcactttaccgaccctgcctccatcgccgctcggggctacatcagcacgagagtagagatgggggaggccgcgggcatcttcatgaccgccacgccccctgggtcccgggacccgttccctcagagcaacgcgccaatcatggatgaggaacgcgaaatccccgaacggtcctggaacagtgggcacgagtgggtcactgacttcaaaggcaagacggtctggtttgtcccgtccatcaaggccggcaacgacatcgccgcctgcctgcgcaagaacggcaagaaggtgatccagctctcccggaagacattcgactccgagtacgtgaaaactcgcgcgaacgactgggacttcgtagtaaccacggatatcagcgaaatgggggccaattttcgggccgagcgagtgatcgacccacggcgctgcatgaagcccgttatattgaccgacggcgaggagcgggtcatcctggcggggcccatgccggtgacccactccagcgcggcccagcgtcgcggcaggatcgggcgcaatccgaagaacgagaacgatcagtatatctacatgggcgagccgctcgagaacgatgaggattgcgcccactggaaggaggccaagatgctgctagacaacatcaatacccccgaggggataatcccttccatgtttgagccggagcgggagaaggttgacgcgatcgacggagagtaccgcctccggggcgaggccagaaagacgttcgtcgatttaatgcgacgcggtgacttacccgtatggctagcgtaccgagttgccgccgaaggtatcaactacgcggatcgccggtggtgcttcgacgggatcaagaacaatcagatcctggaggagaacgttgaggtggagatctggacaaaggagggcgagcgcaagaagctgaagcccagatggctcgatgccaggatctatagcgacccccttgcccttaaggaatttaaggaattcgctgccggcagaaagtcactcaccctaaacctgattacggagatgggccgcctccccacgttcatgacgcagaaggcgcgggacgccctggacaacctggccgtacttcacacggccgaggtgggagggcgcgcgtacaaccacgccttaagcgagctgcccgagacgttggagacgcttctgcttctcaccctgctcgccaccgtcaccggggggattttcctgttcctgatgtccgggaaagggatcgggaagatgacgctcggaatgtgctgcatcattaccgccagcatccttctatggtacgcccagatccagccgcactggatcgcggcctccatcatcctcgagttcttcttaatcgtcctactcatccccgagccagagaagcagcggacgccccaagacaaccagctaacatacgtggtgatcgcgatactgaccgtagtggccgctacgatggccaacgagatgggcttcctcgagaagaccaagaaggatttaggcctgggctcaatcatcacccaggagagtgagtccaacatcctcgacatcgacctgcgcccggccagcgcctggaccctgtacgcggtagcaacaaccttcgtcacccccatgctccgtcattcaatcgagaacagcagcgttaacgtgagcttgaccgcaatcgccaaccaggccacagtgcttatggggctcggccgcgggtggcccctgtccaagatggacatcggcgtgcccctgctcgccatcgggtgctactcgcaggtgaatccgatcaccttaaccgcggccttgttacttctggttgcccattacgctatcatcgggcctggcctccaggccaaggcgacccgtgaggcccagaagcgggccgctgccgggattatgaagaaccccacagtggacggcatcacagttatcgacctggagcccataccgtacgaccctaagttcgagaagcagctgggtcaggtcatgctcctggtgctgtgcgtcacccaagtcctcatgatgcgcacaacgtgggcgctctgtgaagcactcaccctcgccaccggacccatcagcaccttgtgggaggggaaccccggacggttttggaacacgaccatagccgtgtctatggccaacatcttccgcggctcctacctcgcgggggccggactcctgtttagcatcatgaaaaacaccaccaacaccaggcgcgggaccggcaacattggcgagaccctgggagaaaaatggaagtcccggctcaacgctctgggcaagagcgaattccagatttacaagaaatccggaattcaggaggtggaccgcaccctagccaaggaggggatcaagcgcggggagacagaccaccatgcggtttcgcgcggctcggccaagctccggtggtttgtggagagaaacatggtgaccccggagggcaaggtcgtggacctggggtgcggccgcggcgggtggagctactactgcggcgggctgaagaatgtgcgcgaagtcaaggggctcaccaagggcgggcctgggcacgaagagcccatccctatgtccacctacggctggaacctggtgcggctccagagcggggtggacgttttctttaccccacccgaaaagtgcgacaccttactgtgcgatattggggagtccagtcccaaccccaccatcgaggccggccgaaccctgcgagtgctcaacctggtagagaactggctgaataacaatacgcagttctgcataaaagtccttaacccttacatgccgtcggtaatagagaagatggaaacactgcaaaggaaatacgggggcgccctggtaagaaacccgctgtccagaaacagcacccatgagatgtactgggtcagtaacgccaccgggaacatcgtgtcttcagtgaacatgatcagtcggatgctcatcaaccgtttcactatgaagcacaagaaggcgacttacgagccggacgtcgacttaggcagcgggacacgcaacatcggaatcgagaatgagatccccaacctggacatcatcggcaagcggatcgagaaaatcaagcaagagcacgaaacgagctggcactacgatcaggaccacccctacaagacctgggcctaccacggatcctatgagacgaagcagacggggagcgcctccagcatggttaatggggtggtaagactcctgaccaagccctgggatgtaattcccatggtcacccaaatggccatgacggacaccacccccttcggccaacagcgggtattcaaggagaaggtggacacacgaactcaggagcctaaggaaggcaccaagaagctcatgcggatcaccgccgaatggctgtggaaggaactgggtaagaagaagacgcctagaatgtgcacgagggaggagttcacccgcaaggtccggtccaacgcggcactgggcgccatcttcacagacgaaaacaagtggaagtccgcccgagaggccgtcgaggactcccgtttctgggagctcgtggaccgtgagcgcaacctgcatctcgaaggcaagtgcgagacctgcgtctacaacatgatgggcaagagagaaaaaaagctcggagagttcggtaaggcgaaaggcagccgcgccatctggtacatgtggctgggggcccgctttctcgagttcgaggctctcggctttctgaacgaagaccactggttctcacgggggaatagtttgagcggcgtggaaggggagggtctccacaagttaggctatatcctgcgcgacgtctccaagaaggagggcggcgcgatgtatgcagacgacaccgcaggttgggacacgcggattaccctcgaggacctaaagaacgaggagatggtcaccaaccacatgaagggtgagcacaagaagcttgctgaggccatcttcaagctaacgtaccagaataaggtggtccgcgtccagcgcccgacgcccaggggcaccgtaatggatatcatcagccgcaaggaccaacgggggtccggccaggtagggacctacggcctgaacacgttcacaaatatggaagcgcagttgatccgccagatggagggggaggggatcttcaaaagcatccagcacctcaccgtcactgaggagatcgccgtgcagaattggctggcacgagttggccgcgagcggctctcccgcatggccatcagcggggacgactgtgtcgtgaagccactcgacgaccggttcgcgagtgcgctgactgctctgaacgacatgggaaaggtaaggaaggacatccagcagtgggagccaagccggggctggaatgactggacccaggtcccgttctgcagtcaccactttcatgagttagttatgaaggacggccgcgtgttagtcgtgccctgccggagccaagacgagctgatcgggagggcccgaatctcccagggggccgggtggagtctcaaagagaccgcttgcctggggaagtcctatgcgcagatgtggaccctgatgtacttccaccgccgggacctccgcctagccgccaatgccatctgctctgccgtgccctcccactgggtccctacgagccggaccacgtggtcgatccacgccaagcacgagtggatgactaccgaggacatgctggctgtgtggaacagagtgtggatccaggagaacccgtggatggaagacaaaacgccagtcgagagctgggaggaggttccctacctcggcaagcgcgaggatcagtggtgcgggagcctgataggcctcacctcccgggcaacctgggccaagaatatccagaccgcgattaatcaggtgcgcagcctcatcgggaacgaggagtatatcgactacatgcccagcatgaagcgtttccgcaaggaagaggaggaggctggcgtcctgtggtga

SEQ ID NO: 25204 - RNA, 9876 nt, synthetic construct
  misc_feature 1..9876: note = derived and/or modified CDS sequence (opt11) from DENV-2__EU687212__SS-prME
  source 1..9876: mol_type = other RNA
acggccggcgtcatcgtcatgcttatccccaccgccatggcgtttcacctcaccacacgcaacggggaaccgcatatgatcgttggccggcaggagaagggaaagtccctgttatttaagactgaggacggcgtaaacatgtgcactctcatggccatcgacctgggggagttatgcgaggacacgattacgtacaagtgcccactactgcggcagaatgagccggaggacattgactgctggtgcaacagcaccagcacctgggttacctatggaacctgcaccacgacgggcgagcaccggagggaaaagcggtcagtggccctggtcccccacgtcgggatgggcctcgagacgagaacggagacatggatgagcagcgagggggcctggaagcacgttcaacgaatcgagacctggatcctgcgccacccgggcttcactatcatggccgcgattctagcatatacaatagggacgactcattttcagcgggccttaatatttatccttctgactgccgttgcgcccagtatgacgatgcgctgtatcggtatttcaaaccgggattttgtcgagggcgtgagcgggggttcttgggtagacatcgtcttggagcacggtagctgcgtgacaacaatggccaagaacaaacccaccctagacttcgagcttatcaaaacagaggccaaacaacccgccaccctccgcaagtactgtatcgaagcaaagctgacaaacacgactaccgaaagccggtgcccgactcagggcgagccaagtctaaacgaggaacaggacaaacgctttatctgtaaacactccatggtggaccggggctgggggaacggttgcgggctgttcggcaaaggcggtatagtgacctgtgcgatgtttacttgtaagaagaatatggaagggaaggttgtgcagcccgagaacctggagtataccatcgtaatcacgccgcactcgggggaggagcatgcagtgggaaacgacacgggaaagcacggaaaggagataaaaatcaccccccagagtagcatcaccgaagccgagctcaccggatacggcacggtgacgatggagtgcagcccccgtacaggcctagactttaacgaaatggttctgctccagatggaagataaggcctggctggtgcatcggcagtggttcttggatctgcccctcccctggctgccgggggccgacacccagggaagcaattggatccagaaggagacgttggtaacttttaagaaccctcacgcgaagaagcaagacgtcgtggtactggggagtcaggaaggggcaatgcacacggcgctgaccggggcaacggagatccaaatgagctccggcaatttactgttcacgggccaccttaagtgtcgcctgcggatggacaaacttcagctgaaaggtatgagctacagcatgtgcaccggcaaattcaagatagtcaaggagattgccgaaacacagcacggtactatcgtgatcagagtccagtacgagggtgacggcagcccctgcaagattccattcgagataaccgacttggaaaaacggcacgttctggggagactgatcaccgtcaatcctatcatcaccgagaaggatagcccagtcaacatcgaagctgagcctccgttcggagattcctacataattatcggggttgaaccgggccaactgaaactcaactggttcaagaagggcagctccattgggcaaatgttcgaaactaccatgcgcggcgccaaacgaatggcaatcttaggtgacaccgcgtgggatttcggcagcctcgggggggtgttcacctccatcgggaaggctcttcaccaggtcttcggcgccatctacggtgccgctttctccggggtatcatggacaatgaaaatcctgatcggtgtgataataacgtggataggtatgaacagccggtccaccagtctgtctgtcagcttagtgttagtcggcgtggttacactgtacctgggggcaatggtccaggcggactcgggctgcgtcgtgtcatggaagaataaagagctcaagtgtggctccgggatcttcataacggacaacgtgcacacctggactgagcagtacaagttccagcccgagagccccagcaagttagccagtgcaatacagaaggcgcatgaggagggtatctgcgggatccggagcgtcacgcgcctggagaacctcatgtggaagcaaatcactcccgaactgaatcatatcctgtcagagaacgaggtgaaacttaccatcatgacgggtgacatcaaggggatcatgcaggcgggcaagcggagcctgcgccctcagcccaccgagttaaaatactcgtggaagacatggggcaaggcgaagatgctcagtaccgagtcccacaaccagaccttcctgatcgacgggcccgagaccgccgagtgcccgaacactaatcgggcctggaactctctggaagtggaggactacggcttcggggtcttcacgaccaacatctggctgaagttacgcgagaagcaagacgtcttttgcgacagcaagctgatgagcgcggcaatcaaggacaaccgggcggttcacgccgatatgggttattggatagagtccgctttaaacgacacctggaaaatggagaaagccagcttcatcgaagtaaagtcttgccactggcctaaaagccacaccttatggtcgaacggtgtgctggagagcgagatgatcatcccaaaatccttcgccggcccagtttcgcagcacaattacagaccgggttaccacacgcaaaccgcagggccctggcatctgggcaaactagagatggacttcgatttctgcgagggtaccacagtcgtcgtgacggaagactgcggcaaccggggcccatccctgcgcaccactaccgccagcgggaagctcatcacggagtggtgctgtcggagctgcacgctcccccctctgcgctaccggggtgaggatgggtgctggtacggcatggaaattcgccctctcaaggagaaggaggagaatctcgtcaactcattagttaccgccggacatggccagatcgacaactttagccttggtgtgttggggatggccttgttcttggaggagatgctacggacccgcgtcggcactaagcacgccatcttactcgtggcggtgtccttcgtcaccctcatcacaggcaacatgtcgttcagggacctgggacgtgtgatggtgatggtcggggccactatgactgacgacatcggaatgggcgtgacgtacctcgccctgctggccgcattcaaggtgcgccccactttcgccgccgggttgctgctcaggaaactcaccagtaaggaacttatgatggctaccattggcatcgctctgctcagccagtccacaatgcccgagacaatcctggagttaaccgacgccctagccctgggtatgatggtcctgaaaattgtacgtaatatggagaagtatcaactcgccgtaacaattatggccatctcgtgcgtcccgaacgccgtaatcctgcaaaacgcgtggaaggtgtcttgtaccatcctggcaaccgtcagtgtgtctcccctccttcttaccagctcccagcagaaggccgactggatccccctcgcactgacaattaaggggctgaacccaaccgcgatcttcttgaccactttatcccggacgtccaagaagcgctcttggccgctgaatgaggcgatcatggcagtgggcatggtgtccatcctcgcgtctagcttactgaaaaacgacataccaatgaccgggcccctagtggccggcgggctcctgaccgtctgctatgtcctgacaggacgctcagcggatctagaactcgagcgggccgcggacgtgaagtgggaggaccaggccgagatctccgggtcctcgcccatcctctccatcactatcagtgaggacggcagcatgtcgatcaagaacgaagaagaggagcagacgctgaccatccttatccggaccggcctcctggtcatctcaggcgtgttcccggtatctatcccgatcactgccgcggcctggtacttatgggaggtcaagaaacagagggccggtgtgctttgggacgtgcccagcccgccgccggttgaaaaggccgagctcgaggatggggcataccgaatcaaacaacgcggcatcctgggttacagccagattggcgcgggcgtttataaggaggggacgtttcacacaatgtggcacgtgacccgaggcgccgttctaatgcatcgcggcaaacgaattgaacccagttgggccgacgttaagaaggacctgatcagctacggcggggggtggaagctggaaggcgagtggaaggagggggaggaagtgcaggtccttgcattggagcccggtaagaacccaagggccgtgcaaacaaagcccgggatcttcaagactaacaccggcaccataggggcggtgtctctggacttctctcccgggacctcgggctcacccatcgttgatagaaaggggaaggtggtggggctctacggtaatggcgttgtcacgcgcagcggggcctacgtgagcgcaattgcccagaccgaaaagtccattgaggataacccggagatcgaggacgacattttccggaagaagcgtctgacgatcatggacctgcaccccggggcgggcaagacgaagcggtatctccccgccatcgtccgtgaggccataaagcgcggtctacggacgctgatcctggccccgacccgcgtagtcgccgcggagatggaggaggctctccggggtctccccatcaggtaccagacccccgccatcagagccgagcacacagggcgggagattgttgacctgatgtgtcacgccacgttcactatgagactactgtctcccgtgcgtgtgccgaactataacctgatcataatggacgaagcgcatttcaccgaccccgctagcatcgccgcccgcggctacatctcgacccgcgtcgagatgggcgaggcggccgggatcttcatgacggcgacgccacccggcagtcgggacccttttccgcagtccaacgcccccatcatggacgaggagcgagagatccccgaacggtcctggaacagtgggcacgagtgggtaaccgactttaagggcaagacagtctggttcgtaccgagcatcaaggccgggaacgacatagcggcgtgcctccgcaaaaacggcaagaaggtgatccaactgtcccggaagacctttgattcggagtacgtgaagacccgtgccaacgattgggacttcgtcgtgacaaccgatatatccgagatgggcgccaacttcaaggccgagcgggtaatagacccccgtcggtgcatgaaacccgtgatactgacggacggggaggagcgtgtaattctcgcgggacccatgccggttacccacagctccgctgcccaacggcgcggaagaatcgggcgcaatcccaagaatgagaacgaccagtacatctacatgggtgagcccctagagaacgatgaagactgcgcccactggaaggaggccaaaatgctgctcgacaatattaatactcccgaggggatcattccgagcatgttcgaacccgagcgcgaaaaggtcgacgcgatcgatggcgagtaccggctgcgtggggaggcccggaagacgtttgtggacctaatgcgccggggggacctccctgtgtggttagcctacaaggttgccgccgaaggtatcaactacgcagaccgcaagtggtgcttcgacggaatcaagaacaaccagatcctggaagagaatgtggaggtggaaatctggaccaaggagggggagcggaagaagctcaagccgaggtggttggacgcccggatttacagtgaccccttagccttgaaggagtttaaggagttcgcagcgggccgaaaatccctgacactgaacctaatcaccgagatgggccggctgcccacgtttatgactcagaaggcccgcaacgccttggacaatttagccgtcctgcataccgccgaagccggggggcgggcctacaaccacgcgctgagcgaacttccagagaccttagagaccctgctcttactgacactactggccaccgtcacagggggaatattcctcttcctcatgagcggcaaagggatcggcaagatgaccctggggatgtgctgcatcattaccgcctccatcctactctggtatgcgcagattcagccccactggatcgcggctagcatcatcttagagttcttcctaatcgtcctcctgatccccgagcccgagaaacagcgcacgccccaggataaccagctgacgtacgtggtgatcgccatcctcaccgtcgtggccgctaccatggctaacgagatgggcttccttgaaaagacgaagaaggacctgggtcttggctccatcacgacccaagaatccgagagcaacatactggatatcgacctgagaccggcctcagcctggaccctttacgcagtcgcgacgaccttcgtcacccccatgttacgccacagcatcgagaactcgtcagtgaacgtgtccctgaccgccatagccaaccaggcaactgtcctcatgggcctggggaaaggctggcccctgagcaaaatggacatcggggtgcccctgctagcgatcggctgctactcccaagtaaacccgatcaccctgacggccgccctcttacttctcgtcgcgcattacgccatcatcggtccaggcctccaggcgaaagccacacgagaggctcagaagagagccgcggcggggatcatgaaaaaccccacggtggacggaatcacggtgatagacctcgaacccatcccgtatgaccccaaattcgagaagcaactcggccaggtcatgctgctcatcctctgcgtgacccaggtgctgatgatgcggactacgtgggccctctgcgaggctctcaccctggctacaggacccataagcaccctgtgggagggcaaccccgggcgcttttggaacacgaccatcgccgtctccatggcgaacattttccgcggcagctatctcgctggcgccgggctgctattctccatcatgaagaataccaccaatacgcggcgcggcactgggaatataggcgaaacgctcggcgagaaatggaagtcccggctgaatgccctgggtaagtccgagttccagatctacaagaagagtggaatccaggaggtggaccgtaccttagcaaaagagggtatcaagcggggcgagacggaccaccacgcggtctcccgtgggagcgccaagctgcggtggttcgtcgagcgcaatatggtaaccccggagggcaaggtggtcgatctgggctgtgggcggggcggctggagctactactgtggcgggctcaagaacgttcgcgaggtgaaagggttgaccaagggcggccccgggcacgaagagcccgttcctatgtccacctatgggtggaacctggtccggttgcagagcggcgtcgacgtcttcttcacgccccccgaaaagtgcgacacgctgctgtgcgacatcggcgaatcctcacccaacccaaccatcgaggcaggccgcactctccgggtgctgaacttggtcgaaaactggctcaataataatacccagttctgtatcaaagtccttaatccgtatatgccgtccgtgattgaaaagatggagacgcttcagcgcaagtacggcggtgccctcgtgcggaatccccttagccgcaacagtacccacgagatgtactgggtcagcaacgctaccggcaatatcgtgtcctctgtcaacatgatctcccggatgctcatcaaccgattcaccatgaaacataagaaagcgacatacgaacccgacgtcgacctggggagcggcaccagaaacatcggcatcgagagcgagatccccaacctcgacatcatcgggaagcgtatcgagaagattaagcaagagcatgaaacttcctggcactacgaccaggatcacccctacaagacttgggcctatcacggatcctacgagacgaagcagacagggtcggcatccagcatggtgaacggtgtggtccgcctgctgaccaaaccgtgggacgtggtgccaatggtaacccaaatggccatgacggacacgaccccatttgggcagcagcgtgtattcaaggagaaggttgacactcgcactcaggagccaaaggaaggtaccaagaagctcatgaagatcacggcggagtggctgtggaaggaactgggcaagaaaaagactccccggatgtgcacacgcgaagagtttactaagaaagtcaggtcgaacgcggcactcggcgcaatttttaccgacgagaataaatggaaatctgcgagggaagcggtagaggacggccggttttgggagctggtagacagggaacggaacttacacctagagggcaaatgcgagacctgtgtttataacatgatggggaagcgcgaaaagaagctgggggagttcgggaaggccaaaggaagcagagccatctggtacatgtggcttggggcgcggttcctcgagtttgaggccctaggtttcctcaacgaggatcactggttcagccggggtaacagcttgtccggagtcgaaggggagggcctgcaccgccttgggtatattttgagagaggtcggaaagaaggagggcggggctatgtacgcagacgacacggcgggctgggacactcgcattacgttggaggacctgaaaaatgaggagatggttactaaccacatgaagggggagcacaagaaactcgcggaggcgatcttcaagctgacttatcagaacaaggttgtgcgtgtgcagcgcccgacgcccagaggaacagtgatggacatcatcagcagaagggatcagaggggaagcgggcaggtcggaacgtacggcctaaatacattcaccaacatggaggcccagctcatacgccagatggagggtgaaggcatcttcaaaagcatccaacacttaaccgcgaccgaggagatcgccgtgcaaaactggctggcgcgcgtcgggcgcgaacgtctatcccgcatggctataagcggcgacgattgtgtggtgaagcccatcgacgaccggttcgcgtcagccctgacggccctgaacgacatggggaaggttaggaaggacatccagcagtgggagcccagccggggatggaatgattggacacaagtaccattctgctcccaccatttccacgagcttgtaatgaaagacgggcgcgtgctagtcgtgccctgccgcaatcaggatgagctgatcggcagagcacggatctcccagggagcggggtggtcactcaaggagaccgcctgtttagggaagagctacgcacagatgtggaccttaatgtacttccaccgccgggacctccgcctcgcagccaatgcgatctgttcagccgtgcccagccactgggtgccgacgtcacggacgacctggagcatccacgcgaagcacgaatggatgaccaccgaggacatgctggccgtttggaatcgcgtgtggatccaggagaatccgtggatggaagataagacacctgtcgagagctgggaggaagtcccctacctcggtaagcgtgaggaccagtggtgcggcagcctgatcgggctgaccagcagagcgacctgggctaaaaacatacagaccgccatcaaccaggtgcggtcccttattggcaacgaggagtacacggactatatgccatcaatgaagcgctttcgccgggaggaagaggaagcgggggttttatggtga

SEQ ID NO: 25205 - RNA, 9876 nt, synthetic construct
  misc_feature 1..9876: note = derived and/or modified CDS sequence (opt11) from DENV-2__EU660400__SS-prME
  source 1..9876: mol_type = other RNA
accgccggcgtgatcatcatgctaatcccaactgccatggcgtttcatctcaccacccgtaacggggaaccacacatgatcgtggggcgacaggagaaaggcaaatccttactgttcaagactgaggatggcgtgaacatgtgcactttgatggccatcgacctgggggagctgtgcgaggatacaatcacctacaaatgcccactcctgcgccagaatgagcccgaggacatcgactgctggtgcaacagcaccagtacctgggtgacgtacgggacttgcaccactacgggcgaacacaggcgcgagaagcgttccgtcgccctagtaccccacgtggggatgggcctcgagacccgcacggagacctggatgtcatccgaaggggcctggaagcacgtccagcggattgagacctggatcctgcgccacccgggcttcaccattatggctgcgatcttagcctacactatcgggaccactcacttccagcgggccctcatcttcatcctgctgaccaccgttgcccccagcatgaccatgcgctgcatcggtatctcgaaccgggacttcgtggagggagtctcgggggggtcctgggtggacattgtgttggagcacgggagctgtgtcaccaccatggctaagaataagcctaccttggacttcgagctaattaagaccgaggccaagcagcccgccacgctgcgcaaatactgcatcgaggccaagctgaccaacaccacaacggagagccggtgcccgacccagggagagcccagcctgaacgaggagcaggacaagcgcttcatctgtaagcacagcatggtcgaccggggctgggggaacggctgcggcctgttcggcaaaggcgggatcgtgacctgcgcaatgtttacgtgcaagaaaaacatggagggtaaggtcgttctacctgagaacctggagtacacgatagtgattacaccccatagcggggaggagcacgcggtgggcaacgacaccgggaaacacggcaaggagatcaagataaccccgcaatccagcattaccgaagccgagttaacggggtacggcacggtgaccatggagtgcagcccccgaaccggcctggacttcaacgagatggtgcttttacaaatggaagacaaggcctggttagtacaccggcagtggttcctggacctccccctgccctggctgccgggggccgacacgcagggcagcaattggatccagaaggagactctcgtgacctttaagaacccccatgccaagaagcaggacgtagtcgtgctggggtcccaggagggagcgatgcacacggccctaacgggggccactgagatccaaatgtcgtcgggcaacctcctgttcacgggccacctcaagtgccgcctcaggatggacaaattgcagctgaaggggatgagttatagcatgtgcaccggcaaattcaagatagtcaaagagatcgcagagacacaacacgggactatcgtgatacgcgtgcagtatgagggtgacggaagcccctgtaagattcctttcgagatcatggacctcgagaagcgccacgtgctggggcgcttaatcaccgtgaacccgatcgtgaccgagaaagacagcccggtaaacatcgaagccgagccgcccttcggcgattcctacataatcatcggggtggaaccgggtcagctcaagttaaactggtttaagaaggggagctccatcggtcagatgttcgagacgaccatgcgcggcgcgaaacggatggccatcctgggggacaccgcctgggacttcggcagcctaggtggcgtgttcaccagtatcgggaaagcccttcatcaggtctttggcgcgatatacggtgcagcctttagcggggttagctggacgatgaagatcttaataggcgtgatcatcacctggattgggatgaacagccgctcgaccagcctgtcagtttctctcgtgctggtgggcgtagtgactctgtacctaggggtgatggttcaggccgactccggctgcgtggtgtcttggaaaaacaaagagttgaagtgcggctcagggattttcataacagacaacgttcacacctggaccgagcagtacaagttccagcccgagagcccgagcaagctggcctctgcgatccagaaggcccacgaggagggcatctgcgggatccggtcggtgacccgcctggaaaatctgatgtggaagcagatcacgcccgagctgaatcatatcctctccgagaacgaggtgaaactgaccataatgacaggggacatcaaggggatcatgcaagccggtaagcggagcttgcgcccgcagcccaccgagctcaaatactcgtggaaaacgtggggtaaggccaaaatgttaagcactgagtcccacaaccagactttcctgatcgacgggcccgagacagccgagtgcccgaacacgaatcgagcatggaattcgctcgaggtcgaagactacggctttggggtattctccaccaacatctggctcaagttgcgcgagaagcaggacgtgttctgcgacagcaagctcatgtccgctgctatcaaggacaaccgggcagtccatgccgacatgggttactggatcgagagcgcgctgaacgacacctggaagatggagaaggcctccttcatcgaggtcaaaagctgccactggcccaagtcccacaccctgtggagcaacggggtactcgagtccgagatgataattcccaagaatttcgcagggccagtcagccagcacaactaccgcccgggctaccacacccagacggccgggccctggcacctgggcaaattggagatggacttcgacttctgcgaggggaccaccgttgttgtcaccgaggactgcggcaacaggggccccagcttacgtacgaccaccgcctccgggaagctgatcaccgagtggtgctgccggagctgcactttgcccccgctccgctaccgcggcgaggacgggtgctggtacggcatggagatacgccccctgaaggaaaaggaggagaacctggtaaactccctcgtgaccgcggggcatggccaaatcgacaatttcagcctgggcgtgctggggatggccctattcctggaggagatgctgcggacccgcgtgggcaccaagcacgccatcctcctggtggccgtcagcttcgtgacgctgattaccgggaatatgagcttccgcgacctcggtcgcgtgatggtcatggtgggggcaaccatgactgacgacataggcatgggggtgacgtacttagcccttctcgccgccttcaaggtcaggcccaccttcgccgcgggcctgctgctcagaaagctgacctctaaggagctgatgatggccaccatcggcatcgccctcctgagccaatccacaatccccgaaaccatcttggagctaacagacgccttggccctggggatgatggtgctcaagatcgtgcgtaacatggaaaagtaccagcttgcggtcaccattatggctatcagctgcgtgcctaacgcggtgatcctgcagaatgcctggaaggtctcctgcacgatcctagccgcggtgagcgtctcgccgctgcttctgacctcgtcacgtcagaaggccgactggatccctctggccctgaccatcaagggccttaaccccaccgccatcttcctgacgaccctgagccgaacctcgaagaagcggagctggccgctcaacgaggcggtgatggccgtgggcatggtctcaatcttagccagcagtctgctcaagaacgacatcccgatgaccggaccacttgttgccggcgggctgctcacagtgtgctacgtcctgacgggccgctccgcagatctagagctcgagagggccgcggacgtgaagtgggaagaccaggcagagataagcgggtccagccctatcctgtccatcaccatcagcgaggacggctccatgagcatcaagaacgaagaggaagaacacaccctgacgatcctcatccgcaccggactgttagtgatatccggggtcttcccagtcagcattcccataaccgccgccgcgtggtacctctgggaggtgaaaaagcaacgtgccggcgttctatgggacgtgccctcaccgccgcccgtggggaaggcagaactggaggatggcgcctacaggatcaaacagcgggggatttttggctacagtcaaatcggcgcaggggtctacaaggagggcaccttccacaccatgtggcacgtgacgcgcggggctgtcctcatgcaccggggcaagcgcatcgagccctcctgggcagacgtcaagaaggacctgatcagctacgggggcggttggaagctggagggggagtggaaggagggcgaggaggtccaggtgctagccctagagcctggcaagaaccctcgggcggtgcaaaccaagcccggcctgttcaagaccaacactgggactatcggcgccgtgtccctcgacttcagtcccggaacctccgggagcccgatcgtggaccgcaagggcaaggtggtggggctgtacggcaacggagtggtcacccggtccggagcgtacgtgagtgccatcgcccaaaccgagaagtccatcgaggacaaccccgagatcgaggacgacatcttccgcaagaaacggctgacgatcatggacttgcacccgggtgccgggaagactaagcgctacctaccagccatcgtgcgcgaggccatcaagcgcggactaagaaccctgatcttggccccgacccgggtcgtggctgcggaaatggaggaggctctgcgagggctgcccatccggtatcagacacccgccatcagagccgagcacaccggccgggagatcgtagacctcatgtgccacgctacgttcaccatgcgcctgctgtcccccgtcagggtgccgaactacaaccttatcatcatggacgaggctcactttactgatcccgcaagcatagccgcccgcggctacatctccactcgggtagagatgggggaggcagccggcattttcatgaccgcgacgccgcccgggagccgcgacccgttccctcaatccaacgcccccatcatggacgaggagagagagatccccgagcgctcctggaactcaggccacgagtgggtcacggacttcaaggggaagaccgtgtggttcgtgccgagcatcaaggccggcaacgacatcgcagcatgcctacggaagaatggcaagaaggtcatccagctatccagaaagaccttcgattcagagtacgtgaagaccagagccaacgactgggacttcgtggtcacgaccgacatctccgagatgggggcaaacttccgcgccgaacgggtgatcgacccccgccggtgcatgaaacccgtgatcctcacagatggcgaggagcgagtcatcctggccgggcccatgccggtgacccacagctccgcggcccagaggcggggccgcatcgggcggaaccccaaaaacgagaacgaccagtacatctacatgggcgagcccctggaaaatgacgaggactgcgcccactggaaggaggccaagatgctcctggacaacatcaacacgcccgagggcatcatcccgtcgatgttcgagcccgaacgcgagaaggtggacgctatcgacggggagtaccggctgcgcggcgaagcgagaaaaaccttcgtcgacctgatgcgccggggggacctgcccgtgtggctcgcataccgcgtggccgccgagggtatcaactacgccgaccggcggtggtgcttcgacgggattaaaaacaaccagatcctcgaggagaacgttgaggtggagatctggaccaaggaaggcgaacggaagaagctgaaaccgcgatggctggacgcccgaatttactccgaccccctcgccctgaaggagttcaaggagttcgccgcgggccgcaagagcctgaccctcaacctgataacggagatggggcggctgcccaccttcatgacccagaaggcgcgcgacgccctcgacaacttggccgtcctgcacacagccgaggttggcggccgggcctacaaccacgcgctatccgagctcccggagacgctggagactctcttgctgctcaccctgctcgccaccgtgacgggcgggatcttcttgttcctgatgtcagggaagggcatcgggaagatgaccctgggaatgtgttgcatcatcaccgcctccatcctcctgtggtacgcccagatacagccgcactggatcgccgcgagcatcatcctggagttctttctcatcgtcctgctaatccccgagcccgagaagcagcgcacgccccaggacaaccagctcacctacgtcgttatcgccatcctaaccgttgtcgcagccaccatggccaacgagatggggttcctggagaagaccaagaaggacttgggcctgggaagcatcacaactcaggaatccgagagcaacatcctggacatcgaccttcggccggcctccgcttggaccctatacgccgtcgctaccacattcgtcacgcccatgctgcgccacagcatcgagaactccagcgtgaatgtgtcactcaccgccatcgctaaccaggccaccgttcttatggggctgggcagggggtggcctctcagcaagatggacatcggcgtgcccctcctggccatcgggtgctactcccaggttaacccgatcacattaacggcagcgctgctgttgctggtggcccactacgcgatcatagggcccggcctacaagcaaaggccacccgtgaggcgcagaagcgcgccgccgccggtatcatgaagaatcccaccgtggacggaatcaccgtgatcgatctcgagcccatcccgtacgacccaaaattcgagaagcagctggggcaggtcatgctactcgtactgtgcgtgactcaggtcctgatgatgcggaccacgtgggctctctgtgaggcactgacgctggccacgggccccatcagcaccctctgggaaggtaaccccggacgcttctggaacaccaccatcgccgtgtcgatggccaacatcttccggggctcctacttggccggtgcgggcctgctcttttccatcatgaagaacactaccaacacccgtagggggaccggcaatatcggcgaaacgttaggtgagaagtggaaatcccgcctgaacgccctcggcaagtccgagttccagatttacaagaagtctgggatccaggaggtggatcgtaccctggccaaagagggtatcaagcgcggggagaccgaccaccacgccgtctccagaggcagcgcgaagctacgctggtttgtcgagcgcaatatggtgaccccggaaggcaaggtcgtggacctcgggtgcggccgcgggggctggtcctactactgcgggggcctaaagaatgtgcgggaggtcaaaggcctaacgaaaggcggtcccgggcacgaggaacccatccccatgagcacttacggctggaacctcgtgcgcctgcaaagcggggtggacgtattcttcaccccgcccgagaaatgtgacaccctgctctgcgacatcggcgagtcttcgcccaaccctacgatcgaggccggccggaccctgcgcgtgctgaacctcgtggagaactggttaaataacaacacccagttctgcatcaaggtccttaacccgtacatgccttccgtgatagaaaagatggagaccctccaacgcaagtacgggggcgcactggtgcgcaacccattaagccggaactctacccacgagatgtactgggtcagcaacgccacggggaacatcgtgtccagcgtgaatatgatctcccggatgcttatcaacagattcaccatgaagcacaagaaggccacgtacgagccggacgtagacctcggcagcgggacccggaacatcgggatcgagaacgagattcccaacctggacattatcggcaagcgcatcgagaagattaagcaagaacacgagacgtcctggcactacgaccaggaccatccctacaagacctgggcttaccacgggagctatgagaccaagcaaacgggctccgcctcttccatggttaacggcgtggtcaagctgctcacgaagccctgggacgtggtgccgatggtcacccaaatggccatgactgacacgacgcccttcggccaacagcgggtcttcaaggagaaggtggacaccaggacccaggagcccaaggagggcaccaagaagctgatgcggatcacggccgagtggctgtggaaggagctcgggaagaagaaaacgcccagaatgtgtacccgtgaggagtttacccgcaaagtccggagcaacgcagcgctgggcgccatcttcaccgacgagaacaagtggaagtccgcccgcgaggccgtggaggacagccggttctgggagctggtcgaccgcgagcggaacctgcacctggaggggaagtgcgagacctgcgtgtacaacatgatgggcaagcgcgagaagaagctgggggagttcggcaaagccaagggctcgagagcgatatggtacatgtggctcggggccagattcctggagttcgaggccctgggcttcctcaacgaggaccactggttcagccgggggaacagcctgtcaggtgtggagggggaaggcctgcataagctcggttacatcctgcgcgatgtctcaaaaaaggagggcggagccatgtacgcggacgacaccgccgggtgggacacccggatcacgctggaggacctgaagaacgaagagatggtgaccaaccacatgaagggcgagcacaagaaactggctgaggccatcttcaagctgacctaccagaacaaggttgtccgcgtacagcgcccaacgccccgggggacggtgatggacataatctcccgaaaagatcagcggggttctgggcaggtcgggacctacggcttaaacacctttaccaacatggaggcccagctgatacgccaaatggagggggagggcatcttcaagtcgatacagcggctgacggtgaccgaggagatcgcggttcaaaattggctcgccagagtcggccgagagcggctcagccggatggcgatctccggggacgactgcgtggtaaagcctctggacgaccgcttcgccagcgccctcaccgctctgaacgacatgggcaaggtccggaaggacatacagcaatgggagccctcccggggctggaacgactggacccaggttccgttctgcagccaccacttccacgagctggtgatgaaggacggccgggtcctcgtagtgccctgccgaaaccaggacgaactgatcgggcgggcccgcatctcccagggcgccggctggagcctgaaggagacggcttgtttagggaagtcctacgcccagatgtggaccctgatgtactttcaccggcgcgaccttcggctcgcggccaacgcaatctgctcagccgtcccctcccactgggtgcccaccagccgcaccacctggagtatccacgccaagcacgagtggatgacgaccgaggacatgctggctgtctggaatcgagtctggatccaggagaacccgtggatggaggacaagacccccgtggagagctgggaagaagtgccctacctgggtaagagagaggaccagtggtgtgggagcctcatcggcctgacctcccgcgccacgtgggccaagaacattcaaaccgcaatcaaccaggtccggagcctgatcggcaacgaggagtacaccgactatatgccctccatgaagagatttcggaaggaggaggaggaggcgggcgttctttggtag

SEQ ID NO: 25206 - RNA, 9876 nt, synthetic construct
  misc_feature 1..9876: note = derived and/or modified CDS sequence (opt11) from DENV-2__EU569711__SS-prME
  source 1..9876: mol_type = other RNA
acggccggcgtgattataatgctgatccctacggcgatggcgtttcacctcaccactcggaacggagaaccacacatgatagtcggacgacaggagaaggggaagtccctcctgttcaagaccgaggacggtgtgaacatgtgtaccctgatggccatcgatctgggggagctgtgcgaagacaccatcacttataagtgccccctcctgcgccagaacgagcccgaggacatagactgctggtgtaacagcaccagcacctgggtgacctacgggacctgcaccaccacgggcgagcaccggcgcgaaaaacgctccgtcgctctggtgccccacgtggggatgggccttgaaacccggaccgagacgtggatgagctccgagggggcgtggaagcacgtacagcggatcgagacgtggatcctcaggcacccgggtttcaccatcatggcagcgatcctggcctacaccatcgggactacgcatttccagcgggcactcattttcatcctgctgactgccgttgcgccttcaatgacgatgcgctgcatcggcatctcgaaccgggacttcgtggagggcgtctcagggggctcctgggtcgacatcgtcctcgagcacggcagctgcgtcacgacgatggccaagaacaagcccaccctggacttcgagctgattaagaccgaggccaaacagcccgccaccctccgtaaatactgcatcgaggccaaactgacgaatactaccaccgagtcccggtgcccgacccaaggcgagcccagcttgaacgaggagcaggataagcgttttatctgtaagcacagtatggtagaccgcggctgggggaacggctgcggccttttcggcaagggcggcatagtgacctgtgcgatgttcacgtgcaagaaaaacatggagggcaaagtcgtactgcccgagaacctggagtacaccatcgtaatcacgccccacagcggggaggaacacgcggtcggaaacgacaccgggaagcacgggaaggagatcaagatcaccccacagtccagcatcaccgaggccgagttgaccgggtacggaacggtgaccatggaatgcagcccccggaccggcctggacttcaacgagatggtgctgctccaaatggaggacaaggcatggctggtgcaccgacagtggttcttagacctcccactgccctggctgccgggggccgacacccagggatccaactggatccagaaggagacgctcgtgaccttcaaaaatccacacgcgaaaaagcaagacgttgtagttttagggtcccaggaaggcgcaatgcacaccgccctgaccggtgccacggagatccagatgtctagtggcaacctcctgttcaccgggcatcttaaatgccggctgcgtatggataagctgcagctgaaggggatgtcctacagcatgtgcacaggaaagttcaagatcgtcaaggagatcgccgagacccagcacgggacgatcgtgattagagtgcagtatgagggcgacggctccccatgcaaaataccgttcgaaatcatggacctcgagaagcggcatattctagggcgcctgatcaccgtcaatccaatagtgacggagaaggactcgcccgtcaacatagaggcggagcccccattcggcgattcctacatcatcatcggggtcgagccgggccagcttaaactgaactggttcaagaagggaagtagcatcggacagatgttcgagactacgatgcgcggcgccaagcggatggccatcctgggggacaccgcgtgggacttcggcagcctcggaggcgtgttcacgtccataggcaaagccctgcatcaggtgttcggcgcaatctatggggcggccttttccggggtctcttggaccatgaaaatcttgattggggtgataattacttggatcgggatgaatagccgctctacctctctgagcgtgagcttggtcctggtaggcgttgtaaccctgtacctcggggttatggtgcaggccgactccggctgcgttgtaagctggaagaacaaagaactgaagtgcggctcagggatctttatcaccgacaatgtccacacgtggaccgagcagtacaagttccagcccgagtcacccagtaagttggcgtctgccatccagaaagcgcacgaggagggaatttgcggtatccggagcgtgacgcgactcgagaatctgatgtggaagcagattacgcccgagctgaatcacattctaagcgagaacgaggtgaaactgacgatcatgacaggggatatcaaggggatcatgcaggctggtaagcggtcactgcggccccagcccaccgagctaaaatactcctggaagacgtggggcaaggccaagatgttgagcaccgagtcccacaaccagaccttcctgatcgacgggcctgagaccgcggagtgcccgaataccaaccgggcctggaactccctcgaggtggaggactacgggtttggggtcttctccacaaacatctggctgaagctgcgggagaagcaagacgtgttctgtgatagcaagcttatgtccgccgcaataaaggacaaccgagctgtgcacgcggatatggggtactggatcgagtcggcgctcaacgacacgtggaagatggagaaggcctccttcatcgaagtcaaaagctgccactggccaaagagccacacactctggagtaacggtgttctcgagtcagagatgattatcccgaagaacttcgccgggcccgtctcgcagcacaattatagaccgggctaccatacccagaccgccggtccctggcatctgggtaagctggagatggacttcgatttttgcgagggaacgaccgttgtggtgacagaggactgcggcaaccgcggcccgtccctccgcactacgaccgcgtcagggaagctgatcacagagtggtgctgtcgcagctgcactctgcccccgttgcgctaccggggcgaggacgggtgttggtacggcatggagatccgtccactgaaagagaaggaggagaacctggtaaactctctcgtcacggccgggcacggacagatcgacaacttcagcctcggcgtgcttgggatggccctcttcctcgaggaaatgctgcggacacgggtcggaacgaagcacgccatcctcttagttgcagtctccttcgtcaccctgatcacgggcaacatgagcttcagggacttaggccgcgtgatggtgatggtgggagccacgatgaccgacgatattggtatgggggtaacctacctggcgctgctcgccgccttcaaggttcgccccacatttgcggccggcctgctgctccggaagctgacctccaaggaactaatgatggccaccatcgggatagcgttgctgagccagtccaccatccccgagacgatcttagagctcaccgatgccctggcgttagggatgatggtccttaagatcgtgcgcaacatggagaagtaccagctggccgtgaccattatggccatcagctgcgtcccgaatgccgtgattctgcagaatgcctggaaggtttcttgcaccatcctcgcggccgtcagcgtaagccccctccttctgacgagctcccagcagaaggccgactggatacccctggcactgacaatcaaaggcctgaacccaaccgcgatcttcctgaccacgctgtcgcggacctccaaaaagcggagttggccgctcaatgaggccgttatggccgttggaatggtgtccatcctggcctcatccctgcttaagaacgacatacccatgacagggccgctggtcgccggagggctcctaaccgtgtgctacgtgctgacgggccggtcagcagaccttgagttagaacgcgccgcggacgtcaagtgggaggatcaagccgagatatcagggtcctcgcccatcctgtcaattacaatcagcgaagacggctccatgtctatcaagaacgaggaggaagagcacaccctcaccatcctcatcagaacgggcctgctggtgatctccggcgtgttccccgtcagcatacccatcaccgccgcagcctggtacctctgggaagtgaaaaaacagcgcgcgggggtgctgtgggacgtaccaagcccgccgcctgtggggaaggccgaactggaggacggcgcctaccggatcaaacagagagggatcttcggctatagccagatcggcgctggggtctacaaggaaggcaccttccacaccatgtggcacgtcacccgcggggccgtgctcatgcatcgcggcaagcggatcgagccctcctgggccgacgtgaagaaagacctgatctcatacgggggcggctggaaactggagggggagtggaaggagggcgaggaggtccaggtgctcgctctggaacctgggaagaaccctcgtgccgtgcagacgaagccaggcctgtttaagaccaacaccggtaccatcggcgcggtctccctggacttcagcccgggcacgtccgggtcgcccatcgtcgaccgaaaaggaaaagtggtagggctgtacggcaacggggtcgtgacccgatctggggcttacgtcagcgccatcgcccagaccgagaaaagtatcgaagacaaccctgagatcgaagatgacatcttcaggaagaagcgcttaaccataatggacctacaccctggcgcgggaaaaacaaagaggtacttgcccgccatcgtccgggaggccatcaagcggggcctaaggacccttatcctcgccccgaccagggtggtcgccgcggaaatggaagaggccctgagggggctgccaatacgctaccagaccccagccatccgggccgaacatacgggccgtgagatcgtggacctcatgtgccacgcgaccttcaccatgcggttgctgtcccccgtgcgcgtcccgaactacaacctcataatcatggacgaggcgcatttcaccgacccggcaagcatcgccgcgcgcggctacatttccacccgtgtagagatgggggaggccgcgggaatcttcatgacggccaccccccccgggagccgggaccctttcccacagagcaacgcccccataatggacgaggagcgcgagatccccgagcggagctggaactccgggcacgagtgggtaacggatttcaaagggaagacggtttggttcgtccccagcatcaaggccgggaacgacatcgcggcctgcctgcgaaaaaacggcaagaaagttatccagttgtcccggaaaaccttcgattccgagtacgtgaagacccgcgctaatgactgggactttgtggtgaccacggatatctccgaaatgggggccaacttcagagctgaacgtgttatcgacccgaggagatgcatgaagcccgtgatcctcacagatggtgaggagagggtgatcctggcaggccccatgccggtcacccattcatcagccgcccaacgccgcggccgaataggtcgcaacccgaagaacgagaacgaccagtatatctacatgggcgagccgctggaaaatgacgaggactgcgcacactggaaggaagccaagatgctccttgataacatcaacacgcctgaaggcatcatcccaagcatgttcgagccggagcgggagaaagtggacgcgatcgacggggagtaccgcctacggggcgaagcccgcaaaacgttcgtagacctcatgcggaggggggatctgcctgtgtggctggcatatcgggtggccgccgagggtatcaactacgcggaccgccgatggtgtttcgacgggattaagaacaaccagatcctcgaggagaatgtggaggtcgagatctggaccaaggagggtgagaggaaaaagctgaagccgcgctggttggacgcccgcatctactccgaccccctggccctcaaagagttcaaggaattcgccgcgggccgaaagtctctgaccctcaatctcatcacggagatggggcggctgcccacgttcatgacccagaaggcccgggacgcccttgacaacctggccgtgctgcacaccgccgaggtaggcgggcgcgcgtataaccacgccctctccgagctccctgagaccctggagacgctcctactgttgaccctactggccaccgtgaccggcggcatattcctcttcctgatgtcagggaagggcatcgggaagatgacgctgggcatgtgctgcatcattaccgcgtctatactcctatggtacgcccagatccaaccgcactggatcgccgcgtctatcatcctggagttcttcctcatcgtactgctcatccccgagcctgagaagcagcggacgccgcaggataatcagctaacttatgtcgtgattgccatcctgaccgtggtcgcagcgacgatggcgaacgagatggggttcctggaaaaaaccaaaaaagacctcggcctgggctcgatcacgacccaggaatccgagagcaacatcctggacatcgacttgcgtccggcatctgcctggacgctgtacgccgtggccaccaccttcgtgacccccatgttacgtcactccatcgagaactcgagcgtcaacgtatccctcacggccattgccaatcaagctaccgtgctcatggggctgggtcgcgggtggcccctcagcaagatggacattggcgttccactactagccatcgggtgctattcgcaggttaacccgatcaccctaaccgcggcgctgctgctcctggtggcccactatgccattataggccccggcctgcaggccaaggcgacgcgcgaagcccagaaacgtgcagccgctgggatcatgaagaaccctaccgttgatggcatcaccgttattgatctcgagccaatcccatacgacccgaagttcgagaagcagttgggccaggttatgttgttggtcctgtgcgtgacccaggtgctgatgatgcgcacgacatgggccctctgcgaagcgttaacgctggccaccggtcccatctctacgctctgggaggggaaccccggccggttctggaacaccaccatagccgtctcgatggccaatatttttcgcgggtcctacctcgcaggcgccggcctcttattttccatcatgaagaatacgacgaatacccggcgcgggaccgggaacataggcgaaactctgggggagaaatggaagagccggctgaacgccctcggcaagtccgagttccagatctacaaaaagagtggcattcaggaggtggatcggacgctggcaaaggaaggaatcaagcgaggggaaaccgatcaccacgcggtttcccgcggcagcgccaaactacggtggttcgtcgaacggaatatggtgactcctgagggcaaggtggtagacctcgggtgcggcaggggcgggtggtcctactactgtggcggactgaagaacgttcgcgaggtcaaggggctgaccaagggcgggcccgggcacgaagagcccatacccatgagtacctacggctggaacctcgttcggctccagagcggggtagatgtgttcttcaccccgccggaaaagtgtgataccctgctctgtgacataggtgagtcatcacctaaccccaccatcgaggcgggccgaacgctgcgggtcttaaatttagttgagaactggctgaataacaatacccagttctgcatcaaggtactaaacccttacatgccctctgtcatcgagaagatggagaccctccagaggaaatacgggggcgcccttgtgcggaatcctttgagccggaacagcacccatgagatgtactgggtgagcaacgccaccgggaacatcgtctcctccgtgaacatgatctcacgaatgcttatcaaccgatttacgatgaagcataagaaagcgacatacgagccggacgtcgatctcggcagcgggaccagaaacataggcatcgagaacgagatcccgaacctcgacatcatcggcaagcggattgagaagataaaacaagaacacgagacctcctggcactacgaccaggaccatccctacaagacatgggcttatcacggttcgtacgagaccaaacaaaccggctccgccagctccatggttaacggggtcgtgagactgttgaccaagccctgggacgtcgtgccgatggtaacgcagatggccatgaccgacaccactccgttcgggcaacaacgggtcttcaaggaaaaggtggacaccagaacgcaggaacccaaggagggcaccaagaaactgatgcgcatcaccgcggagtggctgtggaaggagctcgggaagaagaagacccctagaatgtgcacccgggaggagttcaccagaaaggttcgaagcaatgcagctctgggcgccatcttcaccgacgagaacaagtggaaatccgcccgcgaggccgttgaggacagccggttttgggagctggtggatcgcgaaagaaacttacacctggagggtaaatgcgagacatgtgtctacaacatgatgggtaaacgtgagaagaagctgggggagttcggcaaggcgaagggcagccgggccatctggtacatgtggttgggcgcccggttcctggagttcgaggcgctgggcttcctaaatgaagaccattggttcagcagggggaacagcctttccggcgtggagggggagggactacacaaactaggatatatcctgcgcgacgtgtctaagaaagagggcggggcgatgtacgcagacgacacagccggctgggacacacggatcacactcgaggacctcaaaaacgaggagatggttaccaaccacatgaagggcgagcacaagaagcttgccgaggcaatctttaagcttacctaccagaacaaggtggtgcgcgtccaacgcccaaccccacgtgggaccgtcatggacattatctcccgtaaagaccagcggggcagcggccaggtgggaacttacggattgaacacctttaccaacatggaggcccagttgatcagacagatggaaggagagggaatattcaaaagcattcagcggctgaccgtgacggaggagatcgccgtgcagaactggctcgccagggtgggcagggagcgcctgtctcgcatggccatctcgggggatgactgcgtcgtgaagccactcgacgaccgtttcgccagcgcgctcaccgcgctgaatgacatgggaaaggtgcggaaggatatccagcagtgggagccctcccgcggttggaacgactggacccaggtgccgttctgttcacaccacttccacgagctggtgatgaaggacggccgggtgctcgtcgtgccctgccgcaaccaggatgagctgatcggccgggcccgcatctcccagggggccggctggtctctgaaagaaacagcgtgcctcgggaaatcctatgcgcagatgtggacactgatgtactttcaccggcgcgacctgcggctcgccgcgaacgcgatctgttcggccgtgccctcccactgggtcccaaccagccgcaccacctggtccatccacgctaagcatgagtggatgaccacggaggacatgctggcagtgtggaaccgcgtgtggatacaagagaacccttggatggaggacaagacccccgtcgaaagctgggaggaagttccctacctgggcaagagggaggaccagtggtgcgggagcctcatcggcttgacctcgcgcgcgacctgggccaagaacattcaaacagctattaatcaggtgagaagcctcataggtaacgaggagtacactgattacatgccatctatgaagcgctttcggaaggaggaggaggaagccggcgtcctctggtaa

SEQ ID NO: 25207 - RNA, 9876 nt, synthetic construct
  misc_feature 1..9876: note = derived and/or modified CDS sequence (opt11) from DENV-2__EU569712__SS-prME
  source 1..9876: mol_type = other RNA
acagccgggatgatcataatgctgatccccaccgccatggcgtttcacctcaccacccgcaacggggaaccccacatgatcgtggggcggcaagagaaagggaagtccctgctgttcaaaaccgaggacggggtcaacatgtgcacccttatggccatcgacctgggggagctgtgcgaagacacaattacctataagtgccccctgctccgccagaacgaacccgaggatattgactgctggtgcaacagcaccagcacctgggtgacctacgggacctgcaccacgacgggcgagcaccggagggagaaacggtctgtggccctagtcccccacgtgggaatgggtctggagacacgcacggagacctggatgtctagcgagggtgcctggaagcacgtccagagaatcgaaacctggatactgcgccacccgggcttcaccatcatggccgcgatcctggcctataccatcgggactacgcatttccagagggccctcatcttcatcctgctgaccgcggttgcgcccagcatgactatgcgctgtattggaatttcgaaccgggactttgtcgagggggtgagcggtggctcctgggtcgacatcgtcctcgagcatgggtcctgtgtaaccacaatggccaaaaacaagcccaccttggacttcgaactgatcaagaccgaggccaagcagcccgccaccctccgcaagtactgcatcgaagcaaaactgacaaacacaaccaccgaatcccggtgcccaacgcaaggcgagcccagcctgaacgaggaacaggataagcgctttatctgcaagcactcgatggtcgaccgcggctgggggaacggctgcggccttttcggtaaaggcgggattgtaacctgcgcgatgtttacgtgtaagaagaacatggagggcaaggtggtcctgccggagaacctggagtacaccatagtaatcacaccacacagcggggaggagcacgcggtgggaaacgataccgggaagcacggaaaagagattaagatcaccccgcagtccagcatcactgaggccgagctcacggggtacggcacggtcaccatggagtgtagcccccggacaggcctggacttcaacgagatggttcttctccaaatggaggacaaggcctggctggtgcaccgacaatggtttctggacctccccctgccctggttacctggggcagatacccagggcagcaactggatccagaaagaaacactcgtcaccttcaaaaacccccacgcgaagaagcaagacgtggtcgtcctggggtcacaggaaggcgcaatgcacactgcactgaccggggccactgaaattcagatgagctcaggcaatttgctgttcaccgggcatctaaagtgccgtcttagaatggacaagctgcaactgaaggggatgtcctatagcatgtgtacgggtaagttcaaaatagtgaaagagatcgccgagacccagcacggaacgatcgtgatccgagtgcagtatgagggtgacgggtccccttgcaaaatccccttcgagataatggacttagagaagcggtacgtattgggaaggttaatcaccgtgaacccgatcgtgacggagaaggactccccggtgaacatcgaggcggagccacccttcggcgacagttatatcatcataggggtcgagccgggacagctcaagctcaactggtttaaaaaggggagctccatcggtcagatgttcgagactactatgcgcggcgctaagcggatggcaatccttggggacaccgcctgggactttgggagcctcgggggagtgtttacctccatcggtaaggccttgcaccaggtgttcggagctatctacggcgccgcgttctccggggtctcgtggaccatgaagatcttaatcggcgtgatcatcacgtggatcggaatgaacagcaggtccactagcctgtccgtgagccttgttctggtgggagtcgtcaccctgtacctcggggtgatggtgcaagccgactccggctgcgtcgttagttggaagaacaaggagttaaagtgcggctccggtatcttcattaccgacaacgtccatacctggacggagcagtataagttccagcccgagagccccagcaagttggcgtccgcgatccagaaggcacacgaggagggcatctgcgggatcaggagcgtaacccggctcgagaacctgatgtggaagcagataaccccagagctgaaccacatcctctccgagaatgaggtgaagctgacgatcatgaccggggacatcaaggggataatgcaggcagggaagcggagcttacggccacagcctaccgagcttaagtacagttggaagacctggggcaaagcaaagatgctgtcgactgagtcccacaaccagaccttcctgatcgatgggcccgaaacagcggagtgtccaaacacgaaccgggcctggaacagcctcgaagtggaggactacggcttcggtgtcttctctacgaacatctggctgaagctgcgtgagaaacaggatgtgttttgcgactctaagctcatgtcggcagccatcaaggataaccgggccgtgcacgctgacatgggctactggattgagagcgcgctgaacgacacttggaagatggagaaggccagcttcatagaagtcaaatcatgccactggcctaagtcccacaccctgtggagcaacggcgtgctcgagtccgagatgatcattcccaaaaacttcgccgggcccgtgagccaacataattatcgccctggctatcacacccagacagccgggccgtggcacctgggcaagctggagatggacttcgatttttgcgaggggacgaccgtcgttgtgaccgaggactgcggcaacagaggacccagcttacgcaccacgaccgcgtccggtaagctgatcactgagtggtgttgccggtcttgcaccctccctcctctccgctatcgcggcgaagacgggtgctggtacggcatggaaattcgccccctgaaggaaaaagaggaaaaccttgtaaactccctcgtgaccgccggccacggccagatagacaacttctcactaggcgtgctggggatggcgctgttcctagaggaaatgctgcggacccgggtgggcacaaaacacgctatcctccttgtcgcggtgtccttcgtcacactgatcacgggaaacatgagcttccgcgacttaggccgcgtgatggtgatggtgggggccaccatgaccgacgacattggcatgggtgtcacgtatctcgccctgctcgccgccttcaaggtccgccccacgttcgcggctggtctactgctccggaagctaacctccaaagaactgatgatggctacaatcggcatagcgttgctgagccagtccaccatcccagagaccatcctggagttaaccgacgcgttggcgttgggtatgatggtgctaaagatcgtccgcaacatggagaagtatcaactagccgtgaccatcatggcgatactgtgcgtccccaatgccgtaatactccagaacgcctggaaggtaagctgcaccatactggctgccgtcagtgtttcacccctgttgttaacgtcttcgcagcagaaggccgactggatccccctggcgctcaccatcaagggtctcaatccaactgcgatcttcctgaccacgttatcccgtaccagcaagaaacgcagttggccactgaacgaggcggtgatggccgtgggaatggttagcatcctggcgagtagcctcctgaagaacgacatccccatgacagggcccctggtcgccggcggcctcctgacggtatgctacgtcctgacgggccgtagcgcggacctcgagctggagcgggccgccgacgtcaagtgggaggatcaggccgagatctccgggagctcccccatcctgtcaataacgatcagtgaggacgggagcatgtccatcaaaaacgaggaggaggagcagaccctcactattctgatccggacgggactgcttgtgatctccggggtcttcccggtcagtatacccatcactgccgcagcttggtatctgtgggaggtgaagaagcaacgcgccggagtgctgtgggacgtcccatccccgcctcccgtcgagaaggccgaactcgaggatggtgcatacagaattaagcagcgcggcatcttcgggtattcgcagatcggcgcgggcgtgtacaaggaaggtaccttccacaccatgtggcacgtcacccggggagccgtgctaatgcaccgcgggaagcgaatcgagccaagctgggccgacgtgaagaaggacctgatcagctacggcgggggctggaagctcgagggtgagtggaaggaaggggaagaggtgcaggttctggccctagaacccggcaaaaacccccgcgcggttcagacgaaaccgggtcttttcaaaaccaacaccggtactatcggggccgtcagccttgacttctcccccggcactagcgggagccccatcgtagatcggaagggaaaggttgtcggcctctacggaaacggtgttgtgactcgcagcggcgcttacgtctccgccattgcccagaccgagaaatcaatcgaggacaacccagagatcgaggacgacatcttccggaaaaagcgactaacaatcatggacctgcatccgggggcgggcaagacaaagcggtacctgcccgcaatcgtgcgcgaggcaataaaacgtgggctgcgcaccctcatcctggccccaacccgcgttgtcgcggctgagatggaggaggccctgcggggactccccatccggtaccagacccccgccatccgggctgagcatacgggtcgcgagatcgtggacctgatgtgccacgcgacctttaccatgcggctgctctcgcccgtccgcgtcccgaactataacttgatcattatggacgaggcgcacttcaccgaccccgccagtatcgccgcccggggctacatcagcacgcgggtggagatgggcgaagcagcggggatctttatgaccgctacgcctcccggctcccgagatcctttcccccagtcgaacgcaccaatcatggacgaggagcgagagattcccgaacggtcctggaacagcgggcacgagtgggtgaccgattttaagggcaagactgtctggtttgttcctagcatcaaggccgggaatgacatcgcggcgtgcctgcgcaagaacggcaagaaggtgatccagctcagcaggaagaccttcgactcggagtatgtgaaaacccgcgccaacgactgggacttcgtggtcaccacggacatcagcgagatgggtgcaaacttccgggccgagcgcgtcatcgatcccagacgctgtatgaaacccgttatcctgaccgacggggaggagcgggtgatactggcgggaccgatgccggtcacgcactccagcgcggcgcagcgccgcggtcggatcggtcgcaaccccaagaacgaaaatgaccagtatatctacatgggggagcccctcgaaaacgatgaggactgcgcacactggaaggaggccaaaatgctgcttgacaacataaacacccccgagggcataatcccgtctatgttcgagcccgagcgggagaaagtggacgcgatcgacggcgaataccgcctaagaggggaagcccgcaaaaccttcgtggacctgatgcggaggggcgacctgcctgtctggctagcctacagagttgccgccgaggggattaactacgcggaccgccggtggtgcttcgatggcatcaagaataaccaaattctggaggagaatgttgaggtcgaaatatggaccaaagaaggggagcggaagaaactaaagccgcggtggctcgatgcccgaatctactcggaccccctggctttaaaggagttcaaggagttcgcggccgggcggaaatccctcaccctaaacctcatcacggagatgggcagactccctacgttcatgacgcagaaggcccgagacgccctggacaatctggccgtgctccacaccgctgaggtcgggggaagggcgtacaaccacgcactgagcgaactgcccgaaacccttgagacgcttctgctccttaccctgctcgccacggttaccgggggcatcttcctgttcctgatgagcggcaagggaatcgggaagatgaccctagggatgtgctgtatcatcaccgccagtattctgctatggtacgcgcagatccagccgcactggattgcggcctccataatcctcgagttcttcctcattgtattgctaatccccgagcccgagaagcagcggacgccccaagacaaccagctgacctacgtcgtcattgcaatcctgacagttgtcgcggccacgatggcgaatgagatgggcttcctcgagaagacaaagaaggacttagggctggggtccataatcacccaagagagcgagtccaacatcctcgatattgacttgcgcccggccagcgcctggaccctatacgccgtggccaccacattcgtgacacccatgctgcggcactcgatcgagaacagcagcgtcaacgtcagcctgaccgcgatcgccaaccaagccacagtgctaatgggtctggggcgaggctggccactgtccaagatggatatcggggtcccgctgctcgccattggctgctactcacaggtgaacccgatcactctcaccgcagccctgctactgctcgtggcacactatgccatcatcgggccaggcctccaagccaaagcgacccgcgaggcccagaaaagggcagcggccgggataatgaagaaccccacggtcgacgggattaccgtgatcgacctggagcccatcccgtacgaccccaaatttgagaagcagctgggccaggtcatgctgctagtgctgtgcgttacacaggttctaatgatgcgcaccacgtgggccttatgcgaggctttaaccttggccaccggtcccatctccaccctttgggagggcaaccccgggcggttttggaacacaacgatcgccgtgagcatggccaacatcttccgcggcagctacctggctggggcagggctcttgtttagcattatgaaaaacaccaccaacacgcgacgcggcacggggaacatcggggagacccttggcgaaaagtggaagtcccgtttaaacgccctgggcaagagtgagttccagatctacaagaagtccggcatccaggaggttgatagaaccctagccaaggagggaatcaagcggggcgagactgaccatcacgcggtgagcagaggctcggccaaactccgatggttcgtcgaacgcaacatggtgacgcctgagggcaaggtggtcgacctcgggtgcggtcgcggcgggtggtcatactactgtggagggctgaagaacgtgcgcgaggttaagggcctcaccaagggaggtccgggccacgaggagcccatcccgatgtccacgtacggttggaacctggtccgactgcagagcggagttgacgtgtttttcacgccgcctgagaagtgcgacacactattgtgcgacatcggagaaagctcccccaacccgaccattgaggccggccgcacactgcgcgtcctcaacctagttgagaattggctgaataacaacacgcaattctgtatcaaggtgctcaacccatacatgcccagcgttattgagaaaatggagaccttgcagcgcaagtacggcggggcactggtgcggaaccccctgtcccgcaacagcacccacgagatgtattgggtgtccaacgcgaccggcaacatcgtgtcatccgtgaatatgatcagccggatgctcatcaatcggtttaccatgaagcacaaaaaggccacgtatgagccggacgttgacctggggtcaggcacccgcaatatcggtatcgaaaacgagatccccaacctggacatcatcggcaagcggatcgagaagattaagcaagagcacgaaaccagctggcactacgaccaggatcacccctataagacctgggcctaccacgggtcctacgagacgaagcagacaggtagcgcctccagtatggtaaacggcgtggtgcgcctcttgacaaagccttgggatgtggtgccgatggtgacccagatggccatgacagataccacccccttcggacaacagcgggtctttaaggagaaagtggacactcgcacacaggaacccaaggaggggacaaagaagctgatgcggatcacagcagagtggctctggaaggagctggggaagaagaaaacgccgcgcatgtgcacgcgagaggagttcacacgcaaagtccggtccaacgcggccctgggggctatcttcacagatgaaaataaatggaagtctgcacgcgaggccgtcgaggatagcaggttttgggagctcgtggaccgcgagcggaacctgcaccttgagggcaagtgtgagacctgcgtttacaacatgatgggcaagagggagaagaagctgggcgagtttgggaaggccaagggctctcgggccatatggtacatgtggctgggcgcgcgctttctggagttcgaggccctcgggttcctgaacgaggaccactggttctcccggggtaacagcctcagcggggtggagggcgaagggctacacaagttaggctacatcctcagagacgtatccaagaaagagggcggggcgatgtacgctgacgacaccgccggttgggacacgaggatcacgctagaggacctgaaaaacgaggagatggtcaccaaccacatgaagggggagcacaagaagctcgccgaagcgatctttaaacttacgtatcagaacaaggtggtacgcgtccagcgcccgacgccccggggtaccgttatggacatcatctcccgcaaggaccaacggggcagcggtcaggtgggcacctatgggttaaacacgttcactaatatggaggcacagctgataaggcagatggagggcgagggcatctttaagagcatccagcacctcacagtcaccgaggagattgccgtgcggaactggctggcccgagtgggcagggagcgcttgtcccggatggccatcagcggcgatgattgcgtagtgaagccactagatgaccggttcgcttccgccctgacggccctgaacgatatgggaaaggtcaggaaggacatccagcagtgggagccctctcgcggctggaacgattggacccaggtcccgttctgctcccaccatttccatgaactcgtaatgaaggatgggcgggtgctagtcgtgccctgcaggaaccaggacgagctgatcggccgtgctcgcatctcccaaggcgccggctggtcgctcaaagagaccgcctgcctaggaaagagctacgcgcagatgtggacgctgatgtacttccaccggcgcgatctacggctggccgccaacgccatatgcagtgccgtgccctcacactgggtccccacctcccgcacgacctggtcgattcacgcgaagcatgaatggatgacgaccgaggacatgttagcagtctggaaccgcgtgtggatccaggaaaacccgtggatggaggacaagacgcccgtcgagtcatgggaggaggtcccctacctcgggaagcgggaggaccagtggtgcggctctctaatcggcctgaccagccgcgccacctgggccaagaatatccaaacagccatcaatcaggtgcggtccttgatcggaaatgaggagtacacagactacatgcccagcatgaaacgcttcagaaaagaggaggaggaggctggggtcctgtggtag

SEQ ID NO: 25208 - RNA, 9876 nt, synthetic construct
  misc_feature 1..9876: note = derived and/or modified CDS sequence (opt11) from DENV-2__EU596487__SS-prME
  source 1..9876: mol_type = other RNA
acagccggagtgatcatcatgttaatccctactgctatggcgttccacctcaccacccgtaacggagagccccacatgatcgtgggccggcaggagaaggggaagtccctgttattcaaaaccgaggacggcgtgaacatgtgcaccctcatggcgatcgatctgggggagctttgtgaggacacaatcacctacaagtgccccctcctgcggcagaacgagcccgaggacatcgactgctggtgcaactcaaccagcacgtgggtgacctatgggacctgcaccacgacaggcgaacatcggcgcgagaagcgttccgtcgccctggttccccacgtggggatgggcctcgagacccgcacagagacctggatgagcagcgagggggcctggaagcacgtgcagaggatcgaaacctggatcctgcgacacccgggcttcaccatcatggccgcgatcctggcctacaccatcgggaccacgcattttcagcgggctctcatcttcatcctgttaactgccgttgcgccctccatgaccatgcgctgcattggtatctccaaccgggatttcgttgagggtgtcagcgggggctcctgggtggacattgtgctcgagcacgggtcttgcgtcacgacgatggccaaaaacaagcccaccctggacttcgagctgattaagaccgaggccaaacaacccgccacattgcgcaaatactgcatcgaggcaaagctgactaacaccaccaccgagtcccggtgcccgacgcaaggcgagccgtcgctgaatgaggagcaggacaagcgtttcatctgtaagcactccatggtggaccggggttgggggaacgggtgcggcctcttcggcaaaggcgggatcgtgacctgcgcgatgttcacatgcaaaaagaacatggagggcaaagtagtgctgcctgagaacctggagtacacaatcgtgatcactccccactcaggggaggaacacgccgtcggcaacgacaccgggaagcatggaaaggagatcaagatcaccccgcagtccagcatcacagaggccgaactcaccggctacggaacggtgactatggagtgtagcccccgtacggggttagactttaacgagatggtgctgctccagatggaggacaaggcctggctggtacaccggcagtggttcctggatctcccactgccctggttgccgggggcagatacccaggggagcaactggatccaaaaggaaacgctagtcaccttcaagaacccccacgccaagaagcaagacgtggtcgtcctgggatcccaggagggggccatgcataccgccctgaccggtgctaccgaaatccaaatgtctagcggcaacctcctcttcacgggccacctgaagtgccgcctccggatggacaagctgcagctgaaggggatgtcctacagcatgtgcacgggcaaattcaaaatcgtaaaggagatcgccgagacccagcacgggactattgtgattcgcgtgcagtacgagggcgacggctccccctgcaaaattccattcgagatcatggacctcgaaaaacggcacgtcctagggcgcctgataacggtcaacccgatagtaaccgagaaagacagccccgtaaacatagaggctgagccgcccttcggcgactcgtacatcatcatcggggtggagcctggccagttaaagctgaactggttcaagaaggggagctccatcggccagatgttcgaaactacgatgcgcggggcaaaacggatggccatcctgggggacacggcctgggacttcgggagcctcgggggcgtgttcacctccatcgggaaagccttacaccaggtcttcggcgcgatctacggggccgccttcagcggggtgtcctggactatgaagatcctgatcggagtgatcatcacctggatcgggatgaattcacgctccaccagcctgtccgtctccctcgtgctggtgggagtcgtgaccttgtatctcggtgtcatggtccaggccgactccggatgcgtagtgagctggaagaacaaggagctaaagtgtggctccggcatcttcataaccgataacgtgcacacgtggaccgagcagtacaagttccagcccgaaagccccagcaagctagcgtccgcgatacagaaggcacacgaggagggcatctgcgggattcgcagcgtcacaaggctcgagaacctgatgtggaaacagattactccagaactcaaccatatcctctccgagaacgaagtgaaactgacgatcatgactggcgacatcaaggggatcatgcaagccggtaagcgctcactacggccgcagcccaccgagcttaagtactcctggaagacctggggcaaggctaagatgctgagtacggagagccacaaccagacgttcctgatcgacgggccagagaccgcggagtgccctaacacaaaccgggcctggaacagcctcgaggtcgaggactacggcttcggtgtattctccacgaacatctggctgaagctgcgggaaaaacaggacgtgttttgcgacagcaagctaatgtccgcagccatcaaggacaaccgggccgtccacgcagacatgggctactggatagagagcgccctgaacgacacctggaaaatggaaaaggcgagtttcatcgaagtcaagagctgtcactggcctaagtcccacacgctttggagcaacggcgtgctcgagtccgagatgataatccccaagaacttcgccgggcccgttagccagcacaattatcgtccgggctatcacacccaaaccgccgggccctggcacttaggcaaactggagatggactttgacttctgcgagggcacgacagttgtggtcaccgaggactgcggaaaccggggcccgagcctccgcaccacgacggcgtccgggaagcttatcaccgagtggtgctgtcggagctgcaccctgcctccgctccgctaccgtggggaagacggctgctggtacgggatggagatacgccccctgaaggagaaggaggagaacctggtaaattccctcgtgacggccgggcacggccagatcgacaatttctcactgggagtcctggggatggccctcttcctggaggagatgctgcggacccgcgtgggcaccaagcacgccatcctactagtcgcggtctcctttgtgaccctgatcacgggcaacatgagctttcgggacctcggccgcgtcatggtcatggtgggggctaccatgaccgacgatattggcatgggcgtaacgtacctggccctgctcgccgccttcaaggtccgccccacgttcgcggccgggctgttattgcggaaactgacttccaaggagctgatgatggccaccataggaatcgccctcttaagccagtcaaccatccccgagacgatccttgagctcacggacgcgctggctcttgggatgatggtgctcaagatcgttcgcaatatggagaagtaccagctggctgtcaccatcatggccatcagctgtgtcccgaacgctgtaatcctacagaatgcttggaaggtctcctgcaccatcctagcggctgtgagcgtgagcccgctgctgcttacgtccagccagcagaaggccgactggatccccctggccctgactatcaagggcctcaaccccaccgcgatcttcctgaccacgctgagcagaacttccaagaaacgctcttggccgctcaacgaggccgtgatggctgtgggcatggtgagtatcctggcttcaagcttgctcaagaacgacatccctatgacggggcccctggtggccggggggctgctcaccgtgtgctatgtcctgacgggccggtccgcggacctggagctggagcgcgccgccgacgtgaaatgggaggaccaagccgagatctcagggtcctcccccatcttgtccatcacgatctcagaggacggctcaatgtcgatcaagaatgaggaagaggagcacaccctgacaatcctcatccggacgggactcctggtaatcagtggagtcttcccggtgtcaatccccataaccgccgccgcctggtatctgtgggaggttaagaagcaacgcgccggcgtcttgtgggacgttcccagcccgccgccagttgggaaagcagagctagaggatggcgcctacaggatcaagcagcgcgggatattcggctacagccagatcggcgcgggggtctataaggagggcaccttccacaccatgtggcacgtgacccggggtgccgtgctcatgcaccgcggcaagaggatcgagccttcctgggccgacgtaaagaaggacctgatcagctacgggggcgggtggaagctggagggggagtggaaagagggcgaagaggtccaggtgctggccctggagccagggaagaacccccgagccgtccaaactaagccagggctgttcaagaccaacaccgggactattggcgccgtgtccttagacttctccccagggacgtcaggttcacccatcgtagaccggaagggcaaagtggtggggctgtatggcaacggcgttgtcaccaggtccggggcctacgtgagcgcaatcgcccagaccgaaaagtccatcgaggataaccccgagatcgaggacgatatcttccggaagaagcgccttaccatcatggacttgcacccaggcgcagggaagaccaagcggtacttgcccgcgattgtgcgcgaagccatcaagagggggttacgcactctcatccttgctcccacacgcgtcgtggccgctgagatggaagaagccctgagagggcttcccatacgctatcagaccccagccatccgtgccgagcatacaggccgcgagatcgtggacctcatgtgccacgccacgttcaccatgcggctgctatcgccggtccgtgtaccgaactataacctgataatcatggacgaggcccactttaccgatcccgccagcatcgcggctcggggctacatatccactcgcgtggagatgggggaggccgcgggcattttcatgaccgccacgccaccggggagccgcgacccgttcccccagtccaatgcccccatcatggacgaggaaagagaaattcccgagcggagctggaacagcggtcacgaatgggtaaccgacttcaaggggaagacggtgtggttcgtgccgtcgatcaaggccggtaacgacatcgccgcctgcctgcgcaagaatggtaagaaggttattcagctgtcgcgaaagacattcgactcggaatacgtaaagactcgcgccaatgactgggatttcgtggttaccactgacatctccgagatgggagccaacttccgggccgagagggttatcgacccccggcgctgcatgaagcccgtgatcctcaccgacggcgaggaacgggtcatcctcgcggggcccatgccagtgacccacagctccgccgcccaacgccgcggacgaatcggccgcaaccccaagaatgagaacgaccagtacatctacatgggtgaaccgctggagaacgatgaggactgcgctcactggaaggaggccaagatgctcctggacaacatcaatacccccgagggcatcatcccgagtatgttcgagcccgaacgggagaaggttgacgccatcgacggggaatacaggctgaggggcgaagcacgcaagacgtttgtcgacctcatgcggcgcggggacctacctgtttggctggcctaccgggtggccgccgaaggcattaactatgcagatcggcggtggtgcttcgatgggatcaagaacaaccagatcctcgaggagaacgtcgaggtagagatttggaccaaggagggcgagcgcaagaaactgaagccgcggtggctggacgcccgcatctattccgaccccctcgcccttaaggagtttaaggagttcgccgctggccgtaaatctctgaccttaaacctgatcaccgagatggggcgactgcccacgttcatgacccaaaaggcccgggacgcgctcgacaacctggccgtgctgcacaccgccgaagtgggcgggagagcgtacaatcatgccctctccgaattgcccgagaccctggagacgttattactgctcactctgctggctaccgtaactggcggcatcttcctttttctgatgtcggggaagggcataggcaaaatgacgttaggcatgtgttgcatcatcaccgcctccattctcctttggtacgcccagattcagccccattggatcgcggccagcatcatactggagttcttcctcatagtcctgctgatccccgagcctgagaagcagcggactccccaagacaaccaactcacctacgtggtgatcgccatcctgactgtcgtggccgcaacgatggcgaatgagatggggtttctggaaaagactaagaaggacctcggcctgggcagcattaccacccaggagtccgagagcaacatcctggacatcgacctacgcccagcctccgcctggacgctgtacgccgtggccaccaccttcgtcacgccaatgttgcggcacagcattgagaacagcagcgttaatgtgagcctcactgcgatcgccaaccaggccaccgtcctcatggggctgggccgtgggtggcccctctcaaagatggacattggggtgcctctgctggccatcgggtgctattcccaggtcaacccgatcacgctcaccgcggccctgctgctcctcgtcgcgcattacgccatcatcgggcccggactgcaggcaaaggccacgcgagaagcccagaagcgggccgccgctgggatcatgaagaaccccactgtggacggcatcacagtaattgacctcgaacccatcccttatgaccccaagttcgagaagcaattagggcaggtcatgctgctcgtgctgtgtgtgacccaggtcctgatgatgagaacgacctgggcgctctgcgaggcccttaccctggccaccggccccatcagcacgctctgggaagggaacccgggccggttctggaacaccaccatcgccgtgagtatggccaatatattcagaggatcctacttggcgggggccggtctcctcttttccatcatgaaaaacacaacgaatactcggcgcggaaccggcaacatcggcgagacactgggggagaagtggaagtccaggttgaacgctctaggcaagtccgagttccaaatctacaagaagtccgggatccaggaagtggaccgcacgctggccaaggagggcatcaaacggggggagaccgaccatcacgcggtctctcgcggctccgcgaagctgcggtggttcgtggagcgcaatatggtaaccccggagggtaaagtcgtggacctcgggtgcggccggggggggtggtcctactactgtggcgggctgaagaacgtgcgcgaagtcaaggggcttaccaaaggggggcctgggcacgaggagcctatccccatgagcacgtatggctggaacctcgtacggcttcagagcggggtggacgtcttcttcaccccgcccgagaagtgcgacaccctgctctgcgatatcggcgaatccagtcccaaccccaccatcgaggcaggtcgtaccctacgtgtgctaaacctcgtggaaaactggctgaataacaacactcagttctgcataaaggtccttaacccgtacatgccctccgtgatcgagaagatggagaccctccagcgcaagtacgggggcgccctagtgcggaaccccttgtcacgcaactccacccacgagatgtattgggtcagcaatgccacagggaacatcgtgtccagcgtgaatatgatctcccgcatgttgataaaccggttcacgatgaaacacaagaaggccacctacgagcctgacgtcgacttaggcagcggtacccgcaatatcggcatcgaaaatgagatacccaacctggatatcatcggcaaacggatagagaagattaagcaggagcatgagacctcctggcactatgaccaggaccatccatataaaacgtgggcctaccatggatcctatgagacaaagcagactggctcggccagttccatggttaacggggtggtaaagttactcaccaaaccctgggacgtggtgccgatggtcacgcagatggccatgaccgacaccacccccttcggccagcagcgagtgttcaaggagaaggtggacacccgaacccaagaacccaaggagggcacaaagaagctgatgcgcatcaccgcagagtggctctggaaagagcttggtaagaagaagacgccccgaatgtgcacccgagaggaattcacccggaaggtccgcagcaacgcggccctgggcgccatcttcaccgatgagaacaagtggaagtccgcccgggaggccgtcgaggacagcagattctgggaactggtcgatcgggagcgcaacctccacctggagggcaagtgcgagacgtgcgtgtacaacatgatgggcaagcgggagaaaaagctgggggagtttggcaaagctaaaggctcacgcgctatctggtacatgtggctcggggccaggtttcttgagttcgaggccctcggttttctcaatgaggaccactggttcagccgagggaacagcctttccggcgtggagggagagggcctgcacaagttgggttatatcctgcgagacgtaagcaagaaggaaggcggtgcgatgtacgccgatgacacggcggggtgggacacccgcatcaccctggaggatcttaagaacgaggaaatggtgacgaaccatatgaagggcgaacacaagaagttagccgaagccatcttcaagctcacctaccagaacaaggtcgtccgggtgcagcgcccgacgccccggggaaccgtgatggacatcatctcccggaaggatcagagaggtagcggccaggtcgggacgtacggcctgaacaccttcaccaacatggaggcgcagctgatccggcaaatggagggggagggcatcttcaagtccatccagcgcctgaccgttacggaagagatcgccgttcagaattggctcgcccgggtcggacgcgagcggctgagccgcatggcaatttccggggacgattgcgtggtgaagccgctggacgaccggttcgccagtgcgctcaccgcgctcaacgacatgggcaaggtccgcaaggacatccaacagtgggagccctcacgggggtggaacgactggacccaggtgccgttctgctcgcatcatttccatgagctggtcatgaaggacgggcgcgttctcgtggtgccctgccggaaccaagacgagctgatcgggcgtgcccggatttcccagggcgccggctggagcttgaaggaaaccgcctgcctcgggaagtcctacgcgcagatgtggacgctgatgtattttcaccgccgagacttaagactcgcggccaacgccatctgctctgccgtcccctcccactgggtgcccacctctcggaccacctggtcaatccacgcgaagcatgagtggatgaccacggaggacatgctggccgtgtggaaccgcgtctggatacaggagaacccgtggatggaggacaaaacccccgtggagagctgggaggaggtcccttacctgggcaagcgcgaggaccaatggtgcgggagcctcattgggctgacctcccgggccacctgggccaagaacatccagacggcgatcaatcaggtccggtcgttgatagggaacgaggagtacacagattatatgccaagtatgaagcggttccgtaaggaggaggaggaggccggcgtgctatggtga

SEQ ID NO: 25209 - RNA, 9876 nt, synthetic construct
  misc_feature 1..9876: note = derived and/or modified CDS sequence (opt11) from DENV-2__EU569713__SS-prME
  source 1..9876: mol_type = other RNA
accgccggcgttatcatcatgctgatcccgaccgccatggcgttccatctcacgacccgtaacggggagccccacatgatagtcggccggcaggaaaaggggaagtcgttgttgttcaagaccgaagacggagtcaacatgtgcaccttaatggccatcgaccttggagagctttgtgaggataccatcacatacaagtgccccctactgcggcagaacgagcccgaggatatcgattgctggtgcaactcaaccagcacctgggtgacctacggaacctgcaccacaacgggcgagcacagacgcgagaagcggtccgtcgccctcgtcccccacgtggggatgggcctcgagaccagaacagagacctggatgagcagcgagggtgcctggaagcacgtccagaggatcgagacctggatcctgcgccacccgggcttcacgatcatggccgcgatcctggcctatacaatcgggaccactcactttcagcgcgccttaatcttcatactgctgaccgccgtggcgccatcgatgaccatgcgctgcattggcatctccaaccgtgatttcgtcgagggcgtcagcgggggctcctgggtggacatcgtgctcgagcacgggagctgcgtgaccacgatggcgaagaacaaaccgaccctggacttcgagctgatcaagaccgaggccaagcagcccgctaccctccgcaagtactgcatcgaggccaagctgacaaacaccactaccgagtcccggtgcccaactcagggcgagcccagcctgaacgaggagcaggacaagcgtttcatctgcaaacattccatggtcgaccggggctgggggaacggctgcggcctcttcggcaagggtgggatcgtaacctgcgcgatgttcacttgtaagaaaaacatggagggcaaggtcgtgctgcccgagaacctggagtacacgatcgtgatcacgccccacagcggggaagagcacgcggttggctccgataccgggaagcacggcaaggagatcaagattacgccgcagagcagcatcaccgaggccgagttaaccgggtatggcaccgtgaccatggagtgcagcccacgcaccggcctggacttcaacgagatggttctactccagatggaggacaaggcctggctggtccacagacagtggttcctggacctccccctgccctggctgccgggggccgacacccaggggtccaactggatccagaaggaaacgctggtgaccttcaagaatccacacgctaagaagcaggacgtggtcgtgctggggtcacaggagggcgccatgcacaccgccctgaccggggccacggagatccagatgagctcgggcaacctcctattcaccggccacctgaagtgccgtttacggatggacaagctccagctcaaggggatgagctattccatgtgcaccgggaagttcaagatcgtcaaagaaatcgccgaaacccagcacgggacgatcgtaataagagtgcagtacgagggcgacggcagtccctgcaagatccccttcgagatcatggacctcgagaagcgatacgtcctcgggcgcctgatcaccgtgaacccgatcgtgaccgagaaggactcccccgtcaacatcgaggcggaaccgcccttcggcgacagctacataattatcggggtggaaccgggccagctcaagttaaattggttcaagaaggggtccagcatcggccagatgtttgagaccaccatgcgtggcgcgaagcggatggccatactgggggacaccgcttgggacttcggctccctcggcggcgtgttcaccagcatcgggaaggcgctccaccaggtattcggcgcgatctatggcgcggccttctccggggtgagctggaccatgaagatcctgatcggcgtgataatcacttggatcgggatgaacagtcgcagcacctccctgagcgtatccctcgtgctggtgggcgtggtgaccctgtatctgggagtgatggtccaggctgacagcggctgtgtagtatcctggaagaacaaggagctgaagtgcggctcaggaatcttcatcaccgacaacgttcacacgtggacagagcagtacaagttccaacccgagagcccgtccaagctcgcgagcgccatccagaaggcccacgaggagggcatctgcgggatacgctccgtgacccgcctcgagaacttaatgtggaagcagattacccccgagctgaatcacatcctcagcgagaacgaagctaagttgacgatcatgaccggcgacatcaaggggatcatgcaggccggcaagaggtccctgcgcccccagcccaccgagctcaaatacagctggaagacctggggaaaagcgaagatgctgagcacggagagccacaaccaaaccttcttaatcgacggacccgaaaccgccgaatgcccgaataccaaccgggcctggaactccctcgaggtggaggactatggcttcggggtctttagtacaaacatctggctgaaactgcgcgagaagcaggacgtgttctgcgatagtaaattgatgtccgctgccatcaaggataaccgtgcggtgcacgccgatatgggttactggatcgagtccgccctgaacgacacgtggaagatggagaaggccagcttcatcgaggtcaagtcctgccactggcccaagagtcacaccctgtggtccaacggggtgctcgagagcgagatgatcatacccaagaacttcgcagggccggtgagccagcacaactacagaccgggttaccacacgcagaccgcagggccatggcacctgggcaagttggagatggacttcgacttttgcgaggggacaaccgtcgtagtgaccgaggactgcggaaaccgggggcccagtctcagaactacgaccgccagcgggaaactgattaccgagtggtgctgccggtcctgtaccctgccgccgttgcgctaccggggcgaggacgggtgctggtacggcatggagatccgccccctgaaggagaaggaggagaacctggtcaacagcctcgtgacggctgggcacggccagatcgacaacttctccctgggcgtgctggggatggccctcttcctggaggagatgctgcggacccgggtcggaaccaagcatgcgatcctcttagtggccgtgtccttcgtcacactgatcacggggaacatgtccttcagggacctcggcagagtgatggtgatggtcggggccaccatgacagacgatatcggcatgggcgtcacctacctggccctgctcgccgcgttcaaggttcgccccaccttcgccgccgggctgctgctccggaagctgaccagcaaggaactgatgatggctacgattggcatcgccctcctgtcccagtctactatccccgagacgatcttggagctcaccgacgcgctggccttggggatgatggtcctcaagatcgtgcgcaacatggagaagtaccagctggccgtgaccattatggccatcctgtgcgtcccgaacgccgtgatcctgcagaacgcgtggaaggtatcctgcacaatcctggccgctgtcagcgtgagcccccttctcctgacgagctcccagcagaaggccgactggatccccctcgcgctcaccataaagggcctgaatcccaccgctatcttcctgaccacgctctcgaggacctccaaaaagcgcagctggccgctgaacgaggctgtcatggctgtgggcatggtgtccatcctggccagtagcctcctgaagaacgacatccccatgaccgggcccttagtcgccggggggctcctgaccgtctgctacgtgctgacggggaggtccgccgacctagagctggaacgcgccgcggacgtcaagtgggaggaccaggcagagatctcagggtccagccccatcttaagtatcaccatcagcgaggacggcagtatgagcattaagaacgaggaggaggagcagactctcaccatccttatccggacgggcctgctcgtgatctccggggtgttcccggtcagcattcccatcactgcggcggcctggtacctttgggaggtgaagaagcaacgcgccggtgtcttgtgggacgttcccagccctccgcccgtcggtaaggccgagctcgaggacggcgcttaccgcatcaaacagcgcgggatctttggctacagccagataggcgccggggtgtacaaggagggcaccttccacaccatgtggcacgtcacccgaggtgccgtgctgatgcacaggggcaagcgcatcgagccctcgtgggccgacgtgaagaaagacctaatcagttacggtggcggctggaaactcgagggggaatggaaggaaggggaggaggtccaggtgctggccctggagcccgggaaaaaccccagggctgttcagacgaagcccggcctcttcaagaccaacaccgggaccatcggcgccgtctccctggacttctcgcccggcacgagtgggagccccattgtggaccggaagggtaaggtggtcgggctgtacggcaacggcgtggtcacccgctcgggggcctacgtctcggcaatcgcgcagaccgagaagtcgattgaggacaaccccgagatcgaggacgacattttccggaagaagcgcctcaccatcatggacctgcaccccggcgcggggaagacgaagcggtaccttcccgccatcgtgcgcgaggctattaaacgggggctacgcaccctcatactggcaccgactcgcgtggtcgccgcggaaatggaggaagccctgagggggctacccatccgataccagacccccgccatccgggccgagcacacgggccgcgagatcgtggacctgatgtgccacgcgaccttcaccatgcggctgctatctccagtgcgcgtcccgaactacaacctgatcatcatggacgaggcacacttcaccgaccccgcgagcatcgccgcaagaggttatatatccacacgcgtggagatgggggaggcggccggcatcttcatgactgcaacaccgcccgggagtcgtgacccgtttccccagtcgaacgcccccatcatggacgaggagcgcgagatccccgagcgtagctggaactccggccacgagtgggtgaccgacttcaaggggaagaccgtctggttcgtgccgagcatcaaggctggcaacgacatcgccgcgtgcctgcgcaagaacggaaagaaggtgatccagctgtcccggaaaaccttcgacagcgagtacgtcaagacccgggcaaatgactgggactttgtggtgaccacggacatctccgagatgggggccaacttccgggcggagcgcgtcatcgacccccggcgatgcatgaagcccgttatcttaacggatggggaggagcgggtcatcctggcgggtcccatgccggtgacccacagctccgcggcccagcgcagaggccggatcgggcgcaaccccaagaacgaaaatgaccagtatatctacatgggggagcccctcgaaaacgacgaggactgcgctcactggaaggaggcgaagatgttgctggacaacatcaacacccccgaggggatcatcccgagcatgtttgagcccgagcgagagaaggtggacgccatcgacggggagtaccgcctccggggggaggcccgcaagacatttgtggacctgatgcggcggggcgatctgcccgtctggctcgcttaccgggttgcggcggaaggaatcaactacgccgaccgccgttggtgctttgacggtatcaagaacaaccagatcctggaggagaacgtggaagtcgagatctggaccaaggagggtgagcgcaagaagctgaagccgcgctggctcgatgcccgcatttactccgaccccctggccctgaaggagttcaaagaattcgcggcgggccgcaagagcttgacactgaacctgatcacagaaatggggcgcctgcccacgtttatgacccagaaggcccgggacgccctggacaacctggccgtgctgcacaccgcggaggtcggcggccgcgcctacaaccacgccttgtcagagctgcccgagaccctcgaaacgttgctgctactgactcttttagccaccgtgaccggcggcatctttctgttcctgatgagcgggaagggcatcggaaagatgacgcttggcatgtgctgcatcatcacagccagcattctcctctggtacgcgcaaatccaaccgcactggatcgccgccagcatcatcctcgagttcttcctgatcgtgctcctcatccctgagccagagaagcagcgcacgccacaggacaaccagctgacctacgtcgtgatcgccattctgaccgtggtcgccgcaaccatggccaatgagatggggtttctcgagaagaccaagaaggacctgggactgggcagcatcattacccaggaatcagagagcaacatcctcgacatagatctgcgcccggcctccgcgtggaccctgtacgctgtggcaacaaccttcgttacccccatgctccggcatagcatcgaaaatagtagcgtcaacgtgtccttaaccgccatcgccaaccaggcgacggtacttatggggctcggacgcggctggcccctgagcaagatggacatcggcgtacccttactagcgatcgggtgctactcccaagtaaaccctattaccctgaccgccgcccttctcctgttagtggcacattacgcgatcataggccccggccttcaagcgaaggccacccgcgaggcccagaagcgggcggccgcgggcatcatgaagaaccctaccgtcgatggcatcaccgttatcgacctggagcccatcccgtacgaccccaagtttgagaagcagcttgggcaggtgatgctcctggtcctgtgcgtgactcaggtgctcatgatgcgaaccacgtgggccctgtgcgaggccctgacgctcgccactggccccatcagcaccctgtgggagggaaaccccggccggttctggaacacgaccatagccgtgagcatggcgaacatcttccgcggcagctacctggccggggccggcctcctgttcagtatcatgaagaataccaccaatacgcggcgggggacaggcaacatcggcgagaccctgggggagaagtggaagtccagacttaacgccctgggcaagtccgagttccagatatacaagaagtccgggatccaagaggtggatcgcaccctggcgaaggagggtatcaagcgcggggagaccgaccaccacgccgtgtcccgggggagcgccaagctgcggtggttcgtcgagcgcaacatggtgaccccggagggcaaggtcgttgatttggggtgtggcaggggcgggtggtcatactactgcggcgggctgaagaacgtacgcgaagtgaaggggttaactaagggcgggcccggacacgaggagcccatcccaatgagcacctacggctggaacttagtccggctgcagagcggtgtggacgtgttctacacaccgcccgagaagtgcgacaccctcttatgtgacattggcgagtcaagccccaacccaaccatcgaggcaggccgaaccctgcgggtcttaaacttggtggagaattggctgaacaacaacacccagttctgcataaaggtgctcaacccgtacatgccctccgtcatcgagaagatggagacgctgcagcgcaagtatggaggcgcattggtgcggaaccccttaagccgcaattccacccacgaaatgtattgggtgagcaacgcgacggggaacatcgtctccagcgtgaacatgatctcacgcatgctcatcaatcgcttcaccatgaagcataaaaaggccacgtacgagccggacgtggaccttggcagcgggacccgaaacatcggtatcgagaacgagatcccaaacttagacatcatcggcaagcggatcgagaagatcaagcaggagcacgagacctcctggcattacgaccaggaccatccctacaagacctgggcctaccacgggtcgtacgaaacgaagcagaccggttcagccagctccatggtcaacggtgtcgtgcgccttttgaccaagccctgggacgtcgtgccaatggtgacacaaatggccatgacggataccaccccttttgggcagcagcgggtcttcaaggagaaggtggacacgcgcacacaggagcccaaagagggcaccaagaagctgatgcggatcaccgcggagtggctctggaaggagctggggaagaagaagacgccccggatgtgcacccgggaggagttcaccagaaaggtaagaagcaacgcggccctgggcgcaatcttcaccgacgagaacaagtggaagagtgcccgcgaggcagtcgaggacagccggttctgggagctggtggaccgcgagcgaaacctgcatctggaggggaagtgcgagacctgcgtgtacaatatgatgggcaagcgcgaaaagaagcttggggagttcggcaaggcaaagggcagtcgggccatctggtatatgtggttaggggcccgcttcctggagttcgaggccctcggcttcctgaatgaggaccactggtttagtcgagggaattctctgtccggcgtcgagggggaaggtctccacaagctgggctacatcctgcgcgacgtgagcaagaaggagggcggggccatgtacgcggatgatacggccgggtgggacacccgaatcacgctcgaagacctgaagaacgaggagatggttaccaaccacatgaagggggagcacaagaagcttgccgaggcgatctttaagttaacgtaccagaataaggttgtgcgcgtccagcgcccgacgccccgggggacggtgatggacatcatctcccggaaggaccagcggggcagcggccaggtggggacctacggcctgaacacgttcaccaacatggaggcccagctgatccgccagatggaaggggagggcatattcaagtccatccaacatctcaccgttaccgaggagatcgccgtgcagaactggctggcccgggtcggccgcgagcgtctgagccgcatggctatctctggggatgactgcgtcgtgaaacccttggatgataggttcgcaagcgccctgacggcccttaatgacatgggcaaggtgcgcaaggacatccagcagtgggagccctcacggggttggaacgactggacccaggtcccgttttgcagccaccacttccacgagttggtgatgaaggacggccgcgtgctggtcgtgccctgccggaaccaggacgagctgatcgggcgcgcccggatctcccagggcgcgggctggagcctaaaggaaaccgcctgcttagggaagtcctacgcccagatgtggaccctgatgtacttccatcgccgcgacctccgcctggccgccaacgccatttgcagcgcggttcccagtcattgggtgcccacgagccggaccacctggtcaatccacgccaaacacgaatggatgaccaccgaggacatgctggccgtgtggaaccgcgtgtggattcaggaaaacccatggatggaggacaagacaccggtcgaaagctgggaggaggtgccctatcttggtaagcgcgaggaccagtggtgcggtagccttatcggcctgacctcccgcgccacctgggctaagaacatccagaccgccatcaaccaggtgcgcagcctcattggcaacgaagagtatacggactacatgccctccatgaaacggttccgaaaggaggaggagaaagccggagtcctgtggtga

SEQ ID NO: 25210 - RNA, 9876 nt, synthetic construct
  misc_feature 1..9876: note = derived and/or modified CDS sequence (opt11) from DENV-2__EU569714__SS-prME
  source 1..9876: mol_type = other RNA
accgctggcgtgataatcatgctgatccccaccgccatggctttccacctaacgacccggaacggggaaccgcacatgattgtcggccggcaggagaaggggaagtctctgctgttcaagaccgaggatggcgtgaacatgtgcaccctcatggccatcgaccttggggagttgtgcgaggacaccattacctacaaatgtcccctcctgaggcaaaatgagcccgaggacatcgactgctggtgcaacagcactagcacctgggtgacctacgggacttgcacgaccacgggcgagcatcggcgcgagaagcggtcggtcgcactggttccccacgtggggatgggcctagagacgcgaaccgagacttggatgagcagtgagggcgcatggaagcacgtccagcggattgagacctggatcctacgccacccgggcttcacgatcatggcggcaatcttggcatacaccatcggcaccacgcactttcagcgtgctctaatcttcatcctgctgactgccgtggcgcccagcatgaccatgcgctgcatcgggatctccaaccgagacttcgtggagggtgtgtcaggtgggagttgggtggatatcgtgctcgaacacgggagctgcgtaaccacgatggccaaaaacaagcccaccctggatttcgagctgatcaagaccgaggccaagcagcccgccactctcagaaagtattgtatcgaggccaagttgactaacaccaccacggagtcccggtgcccgacgcaaggcgagccctcgctgaacgaggagcaggacaagcgtttcatctgcaagcactccatggtagatcgggggtggggtaacggatgcggactgtttggcaagggcgggattgtcacgtgcgccatgttcacgtgcaaaaagaatatggagggaaaggtcgtgctacccgagaacttggagtacacaatcgtgatcacgccccacagcggtgaggagcatgccgtcggaaacgacaccgggaagcacgggaaggagatcaagatcacaccgcaatccagcatcactgaagcggagctcaccgggtacggcacagtgaccatggaatgctcaccccgaaccggcctggactttaacgagatggtcctgctccagatggaggacaaggcgtggctagtccatcgtcagtggttcctggacctcccgctgccatggttgccgggggctgacacgcaaggcagcaactggatccagaaggagacgttggtgacgttcaagaacccgcatgcgaagaaacaggacgttgtcgtgctgggctcccaggagggcgctatgcacaccgccctgaccggggcgaccgaaattcagatgagcagcggcaacctcctctttaccggccacctaaagtgcaggctccggatggacaaactgcagttgaaggggatgtcctacagcatgtgcaccggcaagttcaagatcgtcaaggagatcgctgagacacagcatgggacgatcgttatacgtgttcagtacgagggcgacggctccccctgcaagataccattcgagatcatggacctagagaagcgccacgtcctgggtcgcctgatcacggttaacccgatcgtgactgagaaagatagccccgtgaacatcgaagcggaaccgcccttcggggactcctacatcatcatcggggtggagccgggccagctcaagctgaactggttcaagaaagggagctccatcggccagatgttcgagactacgatgaggggcgccaagcggatggccatcttaggggacactgcctgggattttggcagcctcggtggggtgttcacctcaatagggaaggctctgcatcaggtctttggagctatctacggcgccgctttctccggggtgtcctggactatgaagatcctgataggcgtgatcataacgtggatcgggatgaacagcagatctaccagcctatccgtcagcctggtgctagtgggggtcgtgacgctttacctcggtgtgatggtacaagccgactccggatgcgttgtgagctggaagaataaagagctgaaatgcggaagtgggatattcatcaccgacaacgtccacacttggactgaacagtacaagttccagcccgagtcaccctcaaaactggcgtccgccatccagaaggcccacgaagaggggatctgcgggattcggagcgtgacacgcctcgagaatctcatgtggaagcagatcactccagaactgaaccacatactctccgagaacgaggtgaagctgacgataatgacgggcgatataaaaggaatcatgcaggccggaaagcgaagcctgcggccgcagcccaccgagcttaagtacagctggaagacctggggcaaggccaaaatgctgtccacggaatctcacaatcagaccttcctgatagacggccccgaaaccgctgagtgcccaaataccaatcgggcctggaacagcctcgaggtcgaggactacggcttcggggtattctcaactaacatctggctaaagttgcgagagaagcaggacgtgttctgcgactccaagctaatgtctgccgccataaaggataatcgggccgtccacgccgatatgggctattggatcgaaagcgccttaaacgacacctggaagatggagaaggcatcgtttatcgaagtaaaatcctgccattggcccaagtcccacaccctgtggagcaacggggttctcgagtccgagatgatcatccccaagaacttcgccgggcctgttagccagcacaactatcggcccggctaccatacccagaccgcagggccctggcacctcggcaaactggagatggatttcgacttctgcgagggcactaccgttgttgtcaccgaggactgcggcaacagagggccctcacttcggaccacgaccgcgagcggaaaactgataaccgagtggtgttgccgcagctgcacgctacccccgcttcgatacaggggcgaggacggttgttggtacggcatggagattcgccccctgaaggagaaggaggagaacctggttaactctttggtgaccgcggggcacggccagatcgataacttctccctgggcgtcctggggatggccctattcctggaggaaatgttacggaccagggtgggcaccaagcacgtgatcctgctggtcgccgtgtcgttcgttaccctgatcacggggaacatgagtttccgtgatctaggccgcgtcatggtgatggtgggcgcgactatgaccgacgacatcggaatgggcgtcacctacctggccttactcgccgcgttcaaggtacgccctacgttcgccgcggggctgctactcagaaagctgacctccaaggagctaatgatggccacaataggcatcgcccttctgagccagtccaccatccccgagacgatcttagagctcaccgacgccctggccctgggtatgatggtcctcaagatcgtccgcaacatggagaagtaccaactagcggtcaccattatggccatcagttgtgtgccgaacgccgtcatcctgcagaacgcttggaaggtctcctgcaccatcctcgcagtggtaagtgtaagcccgttattactcacgagctcccagcagaaggcggactggatccccctggcgctgactatcaagggcctcaaccccaccgctatctttctgacaacactaagcaggacgtccaagaagcggagctggccgctcaatgaggccgtcatggcagtagggatggtgtctatactggccagttcgctcctcaagaacgacataccgatgactgggcccctggtcgccggcggactactcacagtgtgctacgtcctgacggggcgatccgcagatctagagctcgagcgcgccgctgacgtcaagtgggaggatcaggccgagatctcagggtcctcgcctatcttatcaatcaccatcagcgaggacggcagcatgagcatcaaaaacgaggaggaagaacagaccctgaccatccttatacggacagggctgttagtgatctccggtgtgttcccggtcagcatacccatcaccgcagccgcctggtacctttgggaggttaagaagcagcgtgcgggcgtattgtgggacgtccctagcccaccgcccgtgggcaaggccgagcttgaggacggcgcgtaccggatcaagcagcgcgggatattcggttacagccagatcggcgctggtgtttacaaggaggggacatttcacaccatgtggcatgtcacgcgcggggccgtcctcatgcaccgcggcaagcgaatcgagccctcctgggcagatgttaagaaagacctgattagctacggaggaggctggaagctggaaggagagtggaaggagggagaggaggtccaggtgctcgctctggagcctgggaagaacccccgcgcggtccagacgaagccgggtcttttcaagaccaacacagggactatcggcgctgtctccctcgatttttctcccggcacgtccgggagtcccatcgtggaccggaagggcaaagtagtgggtctttacggcaacggcgtggtgacccgctccggggcctacgtcagcgcgatcgcccagaccgagaagagtattgaggacaacccggagattgaggacgacatctttcgtaagaaacgcctgactatcatggatctccatccgggagcggggaagacgaagagatacctgcctgcaatcgttagggaagcgatcaagcgggggctgcgcaccctgattctcgcacccacccgagttgtcgccgccgagatggaagaggccctgcgagggctgcccatccgataccagacacccgcgatccgggccgagcacacgggtcgagagatagtggacttgatgtgccacgccaccttcacgatgcggcttctcagccccgtcagagtccctaactacaatttaatcataatggacgaagcccacttcacagaccccgctagcatcgcggcccggggctacatatccacgcgcgtggagatgggggaggccgccggcatattcatgaccgccacaccgccggggtcccgtgacccgttcccccaatctaatgcgcccatcatggacgaggagcgcgaaatacccgaaagaagttggaacagtggccacgagtgggtgaccgacttcaagggtaagaccgtttggttcgtgccgtcgatcaaggctggcaacgacattgccgcttgcctgcggaagaacggcaagaaggtaatccagctgtcccggaagaccttcgatagcgaatacgtcaagacccgcgcgaatgactgggacttcgttgtcaccacggatatctccgagatgggagccaacttccgggccgagcgcgtcatcgacccccggcgctgcatgaagcccgtgatcctcacagatggcgaggagcgggtgatcctggcggggcccatgccggtcacgcacagttccgccgcgcagcgccgcggccggataggacgcaatccaaagaacgagaacgaccagtacatctacatgggcgagcctctggagaacgacgaagattgcgctcactggaaggaggctaagatgctcctggacaacataaacaccccagagggcatcatcccgagcatgttcgaacctgagagagagaaggttgacgccatcgacggggagtaccgtctgcgtggcgaggcgcgtaagacgttcgtggacctcatgcggagaggggacctgcccgtctggctggcctaccgggtggccgccgagggcattaactatgccgaccgccggtggtgtttcgatgggatcaagaacaaccagatcctcgaagagaacgtcgaggtggaaatatggacgaaggagggcgagcggaagaagctgaagccgcggtggcttgacgccaggatatactccgaccccttagccctgaaggagttcaaggagttcgccgccggccggaagtccctgactctcaatttgatcacagaaatgggtcgactccccacgtttatgactcagaaagcccgggacgccttggacaacttagcagtgttgcacaccgcagaggtaggagggcgcgcctataatcacgcgctatccgaactgcccgaaacactggagacgctgctgctcctcaccctgctggctgccgttactggcggcatttttctctttctgatgtcggggaaaggcatagggaagatgacgctgggcatgtgttgcatcatcacggcgtcgatcctactgtggtatgcccagatccagccgcattggattgccgcgagcatcattctagagttcttcctcatcgtgctcctaatccccgagccagagaagcagcggacgccccaggataaccagctgacctacgtcgtaatcgcgattctgaccgtagtcgcagcaaccatggccaatgagatgggattcctggaaaagacaaagaaggacctcggcctgggcagcatcattacgcaggaaagtgaaagcaacatcttggatattgacctacgcccggcatccgcctggacactgtacgcggtggccaccacgttcgtaacccccatgttacggcactcgatcgagaactcctctgttaatgtgtctctcaccgccattgcgaaccaggccaccgttctgatggggctgggcagagggtggcccctcagcaagatggatatcggggtacccctgctggccatcgggtgctactcccaggtgaaccccatcacgttaaccgcagcgctgctgctcctggttgcccactacgctattatcggacctggcctgcaggccaaggccacgcgcgaggcccaaaagcgggccgccgccgggatcatgaaaaaccctaccgtagacggcatcacggtgatcgatctcgagcctatcccgtacgatcccaaattcgagaaacagctgggacaggtgatgctgctcgtcctatgtgtgacccaggtgctgatgatgcgcaccacctgggccctctgcgaggcgctgaccctggccaccggccccatttccacactatgggagggtaaccctggcagattctggaatacgacgatcgctgtctccatggccaacattttccgcggctcttacctggccggcgcggggctccttttctccataatgaagaacaccaccaacacccggcgcgggaccggcaacatcggcgaaaccctgggtgagaagtggaagtcccggctgaacgccctcggtaagtcagagtttcagatctacaagaagtccgggatccaggaggtggaccgtaccctggccaaggaggggataaagcgcggggagaccgaccatcacgccgtgtccagaggcagcgcgaagctgcggtggtttgtcgaacgaaacatggtgacaccagagggcaaggtggttgacttagggtgcggccgcggagggtggtcctactattgcggcggcctgaagaatgtacgcgaggtgaagggcttaaccaagggcgggcccgggcacgaggagcccataccaatgagcacctatggctggaacctcgtgcgcctacagtcaggagtggacgtattcttcaccccaccggaaaagtgtgacacgttactttgcgacattggcgagagtagccccaacccgaccattgaagccgggcggacccttcgggtactgaacctcgtcgagaactggttaaacaacaacacccagttctgcattaaggtactgaacccttacatgccctccgttatcgagaagatggagacattacagcgcaagtacgggggcgcgctggtgcgcaacccgctgagtcgtaactccactcacgaaatgtactgggtttcgaatgccaccgggaacatcgtctcttctgtgaacatgataagcaggatgctgataaaccggttcaccatgaagcacaagaaggccacctacgaacctgacgtggatctcgggagcgggacccgcaacatcggcatcgagaacgagatccctaatctggatatcataggcaagcggatcgagaagatcaagcaggagcacgagacatcctggcactatgaccaagaccatccctacaagacctgggcgtaccatgggagctatgagaccaagcagactggatccgccagctcaatggtcaacggcgtagtgcgcctgctcaccaagccctgggatgttgttcccatggtgactcaaatggccatgacggatacgacaccctttggtcagcagcgggtgttcaaggagaaggtggatacgcgcacccaggagccaaaggagggcacgaaaaagttaatgcggattaccgcagaatggctatggaaggagctcgggaagaagaagacaccccgtatgtgcacccgagaggagttcacgcgcaaagttcggagcaacgcagcgctgggtgccatctttactgacgagaataaatggaagtccgcccgcgaagccgtagaggacagccggttctgggagttagtcgaccgcgaacggaacctgcacctggaggggaaatgcgagacttgcgtatataacatgatgggcaagcgcgagaagaagctgggggagttcggcaaagcaaaggggtcccgggcgatctggtacatgtggttgggggcccgctttctggagttcgaggccctgggctttctcaacgaagaccactggttcagtcgcgggaacagcctgtccggcgtggaaggggaaggcctacacaaattagggtatatccttcgggatgtgtcgaaaaaggagggcggagccatgtacgcggatgacacagccggatgggatacgcgtatcacgctggaagacctcaagaacgaggagatggtcaccaaccacatgaagggcgagcacaagaaacttgcggaggccatctttaaactcacctaccagaacaaagtggtacgtgtacagagaccgacgccccgagggactgtaatggacataatctcccgcaaggaccagcggggcagcggacaggtggggacgtacggcctcaacaccttcacgaacatggaggcacagctgattcgccaaatggagggggagggcatcttcaagtccatccaacacctgaccgtcacagaggaaatcgcagtacagaactggctcgcccgagtaggccgcgagcgactgagccgcatggccatcagtggggatgactgcgtcgtgaagcccttggacgaccggttcgccagcgccctcaccgcgctgaatgacatgggcaaggtccgcaaggatatccagcagtgggaaccctcccgggggtggaacgactggacgcaggtccctttctgcagccatcatttccatgagctggtgatgaaggatggccgcgtgttagtcgtgccctgtcgtaaccaggatgaactaatcgggcgagcgcggatatcgcagggcgccggctggagtctgaaggaaacagcctgcctcggtaagagttatgcccagatgtggaccctgatgtactttcaccgccgtgacctgcggctcgctgccaacgcgatctgttctgccgtgcccagtcattgggtacccacctccaggactacatggtccatccacgccaagcatgagtggatgaccacggaggacatgctagctgtttggaacagagtgtggatccaggagaacccgtggatggaggacaaaactcccgtggaaagctgggaggaggtcccctacctgggcaaacgcgaagaccagtggtgcgggagtctcatcggcctgacctcccgtgccacctgggcaaagaacatccagaccgcgatcaaccaggtgcgcagcttgatagggaacgaggagtacacggactacatgccgtctatgaaacggttccgtaaagaggaggaggaggccggcgtcttatggtga

SEQ ID NO: 25211 - RNA, 9876 nt, synthetic construct
  misc_feature 1..9876: note = derived and/or modified CDS sequence (opt11) from DENV-2__EU569715__SS-prME
  source 1..9876: mol_type = other RNA
accgccggcgtcatcattatgctgatccccaccgccatggcattccatctcaccacccggaacggtgaaccccatatgatagtgggccggcaggagaaagggaaatccctgctgttcaagactgaagacggcgtgaacatgtgcacattaatggccatcgacctaggggagctgtgcgaagacaccataacgtacaagtgtcccctcctacgccagaacgaacccgaagatatcgactgttggtgcaactcgacaagcacctgggtcacctacgggacatgtaccaccacgggggagcaccgacgcgagaagcggtccgtcgctctggtcccccacgtgggaatgggcctcgaaaccaggaccgagacctggatgagctccgagggcgcctggaagcacgtccaacggatcgagacgtggattctgagacacccgggcttcaccatcatggccgcgatcctggcgtacaccattgggaccacccacttccagcgggccctcatcttcatccttctgaccgccgttgcgccctctatgaccatgaggtgcatcggcatctccaaccgggactttgtggagggcgtcagcggaggatcctgggtggacatcgttctggagcacgggagctgcgtaaccactatggccaagaacaagcccacactggacttcgagctgatcaagaccgaggccaagcagcccgccaccctccggaaatactgcatagaggcaaagttaacgaataccacgaccgaatcccggtgcccgacccagggcgagcccagcctgaacgaggagcaggataaacgtttcatatgcaaacacagcatggttgatcggggctgggggaacggctgcggcctttttgggaaaggcgggatcgtaacctgcgccatgtttacctgcaagaagaacatggagggaaaggtcgtgctgcctgagaacttggaatacaccatcgtgataacgccccacagcggtgaggagcatgccgtgggcaacgataccgggaagcacggcaaagaaatcaagatcacccctcagtccagcattaccgaagctgagctcaccgggtatggcaccgtaaccatggagtgcagcccccggaccggcctggacttcaacgagatggtgctgctccaaatggaagacaaggcctggctggtccaccggcagtggttcctggaccttcccctgccatggctcccgggggccgacacgcaaggcagcaactggatccagaaggagacgttagtgaccttcaaaaatccccacgcgaaaaagcaagacgtggtcgtgctcgggagccaggagggcgccatgcacaccgccctgaccggggccacggagatacaaatgagttcgggcaacctactgttcactggtcatttgaagtgccgcctccggatggacaagctccagctgaaggggatgtcctatagcatgtgcacgggcaagtttaaaatcgtcaaggagatcgctgagacacaacatgggactatcgtgatacgcgtgcagtacgaaggcgacggttccccctgcaaaatccctttcgaaatcatggacctcgagaagcggcatgtcttagggcgcctgatcaccgtgaacccgatcgtgaccgagaaggacagcccggttaacatcgaagcggagccgcccttcggtgattcgtatatcatcatcggggtagagccgggccagctcaagctcaactggttcaagaaggggagctccataggccagatgttcgagaccacgatgcgcggcgccaagcggatggccatcctgggggacactgcctgggattttggcagccttggcggcgtattcacctccatagggaaggccctgcaccaggtgttcggggcaatctacggcgccgcctttagcggggtgagctggaccatgaagatcctcatcggtgtgatcatcacgtggatcgggatgaactcgcgctccacctcgctgtccgttagcctcgtgctggtgggcgtcgtgaccctgtaccttggggtgatggtccaggccgactcaggctgcgttgtgagctggaagaacaaggagctgaaatgtggcagtggtatctttatcaccgacaatgttcacacgtggaccgagcaatacaaattccaacccgagtctcccagcaagctggcatcagctatccagaaggcacatgaggaaggcatatgcgggatcagaagcgtaacccgcctcgaaaacctgatgtggaagcagatcacccccgagctgaaccacatcctctctgagaacgaggtgaagctgacgatcatgacaggcgacatcaagggaattatgcaggccggaaaacggtcgctgcgcccccaacccaccgagttaaagtactcctggaagacctggggcaaggccaagatgcttagcacggagtcccataaccagaccttcctgatcgacggtcccgagaccgccgagtgcccaaacacgaaccgggcgtggaatagcctcgaggtagaggactacggattcggtgtgttctccacgaacatctggctgaagctgcgcgagaagcaagacgtgttctgcgacagcaaactcatgtccgccgccatcaaggacaaccgagccgtccatgcggacatgggctactggatcgagagcgccctcaacgatacctggaagatggagaaagccagtttcatcgaggtcaagagctgccactggcccaaaagccacaccctgtggagcaacggcgtgctcgagtccgaaatgatcatccccaagaatttcgccggtcctgtgagtcagcacaattaccgcccgggttaccacacccagaccgccgggccatggcacctgggaaaacttgagatggacttcgatttctgcgaggggacgaccgtcgtggttacggaggactgcggcaatcggggccccagcttacgcacgacgacagcatccggtaaattaatcaccgagtggtgctgccgcagctgcaccttgcccccgctccgctatcggggtgaagacgggtgctggtacggcatggaaattcgccccctgaaggagaaagaggagaacctggtgaactccctggtgacggccgggcacggccaaatcgacaacttctccctgggcgtcctgggaatggccctcttcctggaggagatgctgcggacccgcgtgggcaccaagcacgccatcctcttagtggcggtctccttcgtgaccctgatcactgggaacatgtcgttccgggatctcggccgcgtaatggtgatggtgggggccaccatgaccgacgacatcgggatgggggtgacctacctggcccttctcgccgcctttaaggtccgccctacttttgcggctgggctcctgctccggaagctgaccagtaaggagctgatgatggccaccatcggcatcgccctcctgagccagtccacaatccccgaaactatcctggaactgaccgatgccttggcgctgggtatgatggtgctaaagatcgtccgcaacatggagaaataccagttagccgtcaccatcatggctatatcgtgtgtcccgaatgccgtcatcctacagaatgcctggaaagtctcctgcaccatccttgctgccgtgtctgtcagcccgttgctgctcacgagctcccagcagaaggccgactggatccccctggccctgacaatcaagggcttgaaccccacggcgatcttccttaccaccctgagccgaaccagtaagaagcggagctggccgttgaacgaggccgtgatggcggttggcatggtcagcatcttagctagcagtctgttgaagaatgacatccccatgaccgggccattggtggctggcgggctgctcaccgtctgttatgttctgacgggccggagcgcggatctggagctcgagcgcgcagccgacgtgaaatgggaagaccaggcagaaatatcagggtccagccccatcctgtccatcacaatcagtgaggacggctccatgtctatcaagaacgaagaggaggaacacaccctgaccatactcatccggacgggtctgctggtaatatccggggtcttcccggtcagcataccaatcaccgccgcggcctggtacctatgggaggtgaagaagcagagagccggcgtcttatgggacgtacccagcccaccccctgtggggaaggccgagttagaggatggtgcataccggatcaagcagcgcggaatcttcggctacagccagatcggcgcgggtgtatataaggagggcaccttccatactatgtggcacgtcactcggggagccgtgctcatgcaccgtggaaagagaatcgagccctcctgggcagacgtgaagaaggacttgatcagctacggagggggttggaagctggagggtgagtggaaggagggcgaggaggtccaggttcttgccctggagcccgggaagaatccgcgcgccgtccagaccaagcccggcctgttcaagaccaacaccggaacgataggcgcggtgtccctcgacttcagtccagggacgtccgggagtcccattgtcgatcggaagggtaaggtcgtggggctgtatggcaatggagtggtcacccgctccggtgcctacgtgagcgccatagcccagaccgaaaagtccattgaggacaaccccgagatagaggacgatatcttccggaaaaagaggcttaccataatggacctccatcccggcgcggggaagacaaagcggtatctgcccgccatcgtgcgcgaggccatcaagcggggtctgcgcaccctcatattggccccgacccgcgtcgtggccgctgaaatggaggaggctttgcgaggactgcctatacggtaccagacccctgctatccgtgccgagcacacaggtcgcgagattgtggacctcatgtgccacgccaccttcaccatgcggctgctatcgcccgtgcgcgtaccgaactataatctcatcatcatggacgaggcccacttcaccgacccggcgagcatcgcggcccggggctacatctccactcgcgtggaaatgggggaggccgcgggcatattcatgaccgccacgccgccgggaagccgggacccgtttccccaaagtaacgcccccataatggacgaggagcgagaaatccctgaacggagctggaactctggtcacgaatgggtgacagacttcaagggcaagaccgtgtggttcgtgccaagcatcaaagccggcaacgacatcgccgcctgcctccgcaagaacggcaagaaggtcatccagttaagtcggaagaccttcgacagcgaatatgtcaagacccgggcaaacgactgggacttcgtggtaaccaccgacatctccgagatgggggccaacttccgggccgagcgcgtgatcgacccccggcgctgcatgaagcccgtgatcctcaccgacggagaagaacgggtcatcttggcggggcccatgccagtgacccacagctccgcagcgcagcgccgtggcaggatcgggaggaaccccaagaacgagaacgaccaatacatctacatgggggagcctctggagaacgacgaggactgcgcccactggaaagaggccaagatgcttctggacaacatcaatacacccgagggcatcatcccaagcatgtttgagcccgagagggagaaggtggatgcgatcgacggggaataccgcctgcggggcgaggcccgcaagaccttcgtagacctcatgcgccgcggggacctgcccgtttggctggcctaccgggtcgccgcggaaggcatcaactacgcggaccgacggtggtgcttcgacgggatcaaaaataaccagatactcgaggagaacgtggaggtggaaatctggacaaaggaaggcgagagaaagaagctgaagccgcgttggctggacgcccgcatctactcagaccccctcgccctgaaagagtttaaggagttcgccgcgggtcggaagagtctgaccctcaacttgatcaccgagatggggcgcctgcccacgttcatgacccagaaggcgcgagacgccttggacaatctagcagtcctgcacaccgcagaggtcggcgggcgcgcgtataaccacgccctctcagagctgcctgagaccctggagactctcctgctgctcaccctgctggccaccgtgaccggcggtatcttcctattcctgatgagcgggaagggcatagggaagatgacgctgggtatgtgctgcataatcaccgcatccatcctgctgtggtacgcacagatccagccgcactggatcgcggctagcatcatcctggagttcttcctcatcgtactgctgatccccgagcccgagaagcagcgcacgcctcaggacaaccagctaacatacgtggtgattgccatcctgaccgtcgtggcagccacgatggcgaatgagatggggtttctggagaagaccaagaaggatctcggtctgggctcaattaccacccaagagtccgagagcaacatcctggatattgacctccgcccggcttccgcatggacactgtacgcggttgccacgacctttgttacacccatgctgcggcacagcatcgagaactccagcgtgaacgtgagtctcacggcgatcgccaaccaggccactgtcctgatgggtttgggccgcgggtggcccctcagcaagatggacatcggcgtgccattgcttgccatcgggtgttattcccaagtgaacccgatcaccctaaccgccgcgctcctgctccttgtcgcccactacgccatcatcggccctgggctgcaagccaaagcgacgagggaggcccagaagcgggccgccgccgggatcatgaagaatcccaccgtggacggcatcactgtcatcgacttggaacccatcccgtacgaccccaagttcgagaagcaattagggcaggtcatgcttctcgtgctgtgtgtgacccaggttctgatgatgcgcaccacctgggcgctctgcgaggccctgacccttgccacaggccccatcagcactctatgggaggggaaccccggtcggttctggaacaccaccatcgcagtgtccatggccaacatctttcgcggcagctacctggcgggggccggcctcctgttctccattatgaagaacaccacgaacacgagacgcgggaccggcaacattggcgaaaccttaggggagaagtggaagtcccggctgaatgcactaggcaagtccgagttccagatctacaaaaagtccgggatacaagaggtggacagaacgctggccaaggagggcataaagcgcggtgagaccgatcaccacgccgtctcccgcggctctgccaagctgcggtggttcgtggagcgtaacatggtgacgccggagggaaaggtcgtagacttggggtgcggccgcggcggttggtcctactactgcggtggtctgaagaacgtgcgcgaggtcaaagggctgaccaagggcgggcccgggcacgaggagcccatccccatgagcacatacggttggaacctggtacggctgcaaagcggggttgacgtattcttcaccccgcccgaaaaatgcgacaccctgttatgcgacattggcgagtcctcacccaaccccaccatcgaagccggccgaacgctacgggtgctgaacctcgtggaaaactggcttaacaacaatacccagttctgcatcaaggtcctgaacccttacatgccgtccgtgatcgagaagatggagacactccagcgcaaatacgggggcgccctggtgcgaaaccccctaagccgcaactccacccacgaaatgtactgggtcagcaacgccaccgggaacatcgtgtccagcgtgaacatgataagtcgcatgctgatcaaccggttcacgatgaagcacaaaaaggcgacttacgagccggacgtcgacctcggaagcgggacccgcaacatcggcatcgagaacgagatccccaacctggatatcatcggcaagcggatcgagaaaatcaagcaagagcacgaaacttcctggcactatgaccaggaccatccctacaagacctgggcgtatcacggcagctacgaaactaagcagaccggctccgccagctccatggtcaacggggtggtcaaactcctgactaagccctgggacgtagtgccgatggttacgcagatggctatgacggacacaaccccctttggacagcaacgcgtgttcaaggaaaaggtggatactcggacacaggagcccaaggagggcaccaagaagctgatgcgcatcaccgctgagtggctgtggaaggagctcgggaagaaaaagacgcctcggatgtgcacccgtgaggagttcacccggaaggtccgcagcaacgcggccctgggcgccatcttcaccgacgagaataagtggaagtccgcccgggaggccgtagaagatagccgtttctgggagctggtcgaccgggaacgcaatctccatctcgaggggaagtgcgaaacttgcgtgtacaacatgatgggcaagcgggagaagaaactgggggagttcggcaaggccaaggggagcagagccatatggtacatgtggctcggggccaggttcctcgagttcgaggcactgggcttcttaaacgaggatcattggttcagccgcgggaacagcctatccggcgtagaaggggagggcttacacaagctcggctatatattgcgcgacgtcagcaagaaggagggcggagcgatgtacgccgatgacacagccgggtgggacacccgcatcaccttagaggacctcaagaatgaggagatggtgacgaaccacatgaagggggagcacaagaagctggccgaggccatcttcaagctgacctaccagaacaaggttgtccgggttcaacgccctacccccgggggcactgtgatggacatcatctccagaaaggaccagcggggctcagggcaggtcggcacctacgggcttaacaccttcacaaacatggaggcgcagctaatacgccagatggaaggcgagggtatcttcaagtccatccagcggctaaccgtgacggaggagatcgccgtgcaaaattggctcgcccgcgttgggcgggagcgcctgagcaggatggcgatctccggcgacgactgcgtggtgaagccgctggacgatcgcttcgcctccgcgcttactgccctgaacgacatggggaaagtccggaaggacatccagcagtgggagccctcccgcggctggaacgactggacacaggtgccgttctgttctcaccacttccatgagctggtaatgaaggacgggcgggtccttgttgtaccctgccggaaccaggacgagctgatcggccgggcccgtatctcccagggcgccgggtggtccctaaaggagaccgcttgcctcggaaagtcctacgcgcagatgtggacgctgatgtactttcatcgtcgcgacctgagactcgcggccaacgccatctgctccgctgtcccctcccactgggtgcccactagccgcaccacctggtccattcacgcgaagcacgaatggatgaccacggaggacatgctggccgtgtggaaccgggtctggatccaagagaacccgtggatggaagataagacccccgtggagagctgggaagaggtcccatatctggggaagagagaggaccaatggtgtggctctctcatcggactgacctcccgcgccacctgggccaagaacatccagacagcaatcaaccaggtccggagcctcatcggcaacgaggagtacaccgactacatgccctctatgaagcgctttcggaaggaggaggaggaggctggcgtgctgtggtga

SEQ ID NO: 25212 - RNA, 9876 nt, synthetic construct
  misc_feature 1..9876: note = derived and/or modified CDS sequence (opt11) from DENV-2__EU569716__SS-prME
  source 1..9876: mol_type = other RNA
accgccggtgtgatcatcatgctcatccccaccgcaatggcgttccacctcaccaccagaaacggggaaccccacatgatcgtgggccggcaggagaagggtaagtcgctgttgttcaagaccgaggatggcgtgaacatgtgcaccctcatggcgatcgacctcggcgagctgtgtgaggacaccatcacctacaagtgccccctcctgcggcagaatgagcctgaggacatcgactgctggtgcaacagcaccagcacctgggtgacttacgggacctgcaccacgacgggcgagcacagacgcgaaaaacgaagcgtcgccctcgtgccccacgtgggtatggggctcgagactcggactgagacctggatgtcaagcgagggggcctggaagcacgtgcagcgcatcgagacttggatactgcgccaccccggctttaccataatggcagcgatcctggcctacaccatcgggaccacacacttccaacgggccctcatcttcatccttctgacggccgtggcgcccagcatgaccatgcgctgcatcggaatcagcaatcgggacttcgtggagggcgtctcgggaggctcgtgggtggacatagtgttagagcacgggtcatgcgtcaccacgatggccaagaataagcccaccctggacttcgagttaatcaagaccgaggcaaagcagcccgctaccctcagaaagtactgcatcgaggccaaactgacgaataccaccaccgagtcccggtgcccgactcaaggagagcctagcctgaatgaggagcaagacaaacgctttatctgcaagcactccatggtggaccggggctgggggaacggttgcggcctattcgggaaaggaggtatcgtgacctgcgcgatgttcatctgcaaaaagaacatggagggcaaggtcgtgctgcccgagaacttggagtacaccatcgttatcacgccccacagtggggaggagcacgcagttggaaacgacacggggaagcacggtaaggagataaagatcaccccgcagagcagcataaccgaagccgagctcacgggctatgggaccgtgacgatggagtgcagcccccgaaccggcttggacttcaacgaaatggtgttactccaaatggaggacaaggcttggctggtccaccgtcagtggttcctggacctccccctgccctggttgccgggggccgacacccagggcagcaactggatccaaaaggagaccctcgtgaccttcaaaaacccccacgcgaagaagcaggacgtggtcgtgctggggtcccaggagggcgccatgcacactgccctgaccggggccaccgagatccagatgagctcggggaatttgctttttacaggccacctgaagtgccgcctccggatggacaagctgcagctgaagggaatgtcctacagcatgtgcactggcaagtttaagatcgtcaaggaaatcgcggagacccagcacgggacgatcgtgatacgcgttcaatacgagggcgacgggtccccttgcaagatcccgttcgagatcatggacctagaaaagcgatacgttctggggaggctgattacagtgaacccgatagtgaccgagaaagatagcccggtcaacatagaggcggagccacccttcggagactcctacatcataataggggtggagccaggccagttaaagctgaactggttcaagaaggggagctccatcggccagatgttcgagacaaccatgcgcggggcgaagcgtatggcaatcctgggggacacggcctgggacttcggcagcctcgggggcgtctttacctcaatcggcaaggccctgcaccaggttttcggtgctatctacggggccgccttcagcggtgtgtcctggaccatgaagattctgattggcgtgatcattacctggatcgggatgaacagcaggtccacgagcctttccgtgagcctcgtcctggtgggggtcgtgactctgtatctgggggtcatggttcaggccgactccggatgcgtggtgagctggaagaacaaggaactgaagtgtgggtcgggaatcttcatcaccgacaacgtccatacatggactgagcagtataagttccaacccgaaagcccctctaaactggcgtctgccatacagaaggctcacgaggagggcatctgtgggattcggagcgtgaccaggctcgagaacctgatgtggaagcaaattaccccggagcttaatcacattctatccgagaatgaagtgaaacttaccatcatgacgggtgacatcaagggaatcatgcaggccggcaagcggtctttacgcccgcagcctaccgagctcaagtactcctggaaaacttggggcaaggcgaagatgttatctaccgagtcccacaaccagacgttcctgatcgacggtcccgagaccgcggaatgcccaaacacaaaccgggcctggaacagcctcgaggtcgaggactacggcttcggggtcttctccaccaacatctggctgaagctacgcgagaagcaggacgtgttctgcgactcaaagctcatgtccgccgcaatcaaggacaaccgcgccgtgcacgcggacatgggctactggatcgagagcgccctgaacgacacgtggaagatggagaaagcctccttcatcgaagtcaagagttgccactggccaaagtcccacaccctgtggagcaacggagtcctcgagagcgagatgataatccccaagaacttcgctggccccgtgagccagcacaactacagaccgggctaccatacccaaacagccgggccctggcacctgggcaagttggagatggacttcgacttctgcgaggggaccacggtagtggtcaccgaggactgtggcaatcggggaccgtcattgcgcactacaacagcgtccgggaagctgatcaccgaatggtgttgtcggagctgcaccctgcccccgctccgctaccggggcgaagatggctgctggtacggtatggagatccgccctctgaaggagaaggaggaaaacctagtgaactcccttgtgaccgccggccatggccagatcgacaactttagcttaggcgtactggggatggccctcttcctggaggagatgctgcggacgcgcgtgggcactaagcatgccatcctgctggtggcggtgtccttcgtcacactgatcaccgggaatatgtcatttcgggaccttggcagagtgatggtcatggttggggccacgatgaccgacgacatcggcatgggcgtaacttacctggccctactcgccgcgttcaaggtaagacccaccttcgcggccggactgctgctccggaagctgacatccaaggagctaatgatggcaaccattggtatcgccttactgtcacagagcaccattcccgagacgatactggagctgacggacgccctggcgttgggtatgatggtgctcaagatagtgcggaatatggagaagtaccagctggccgtcaccattatggccatcctgtgcgtaccgaacgccgtgatcctccaaaacgcctggaaggtcagctgtactatcctggcggccgtaagtgtcagccccctgctcctgacctccagtcagcagaaggccgattggataccgctggctctaacgatcaagggcctgaaccccaccgcgatcttcttgactaccctctcccggactagcaaaaagagatcctggccgctgaacgaggcagtgatggctgtaggaatggtaagcatcctggcctcctccctactgaagaacgatatccccatgacaggacccctggtagccggcgggttactgaccgtgtgctacgtcctgacaggccggagcgcagacctcgagctggagcgtgcggccgacgtgaagtgggaggaccaggcagagatctcaggttcatctcccatcttaagcatcacgatctccgaggacggcagcatgtctatcaagaacgaggaagaggaacagacccttacaatattaatacggaccggcctgttggtgatcagcggagtattcccggtgtccatcccaatcacagctgctgcttggtacctctgggaggtgaagaagcagcgcgccggagttctgtgggacgtaccaagcccgccgcccgtcgggaaggccgaactcgaggacggcgcctaccgtatcaagcagcgcggaatctttggctactcccagatcggcgcgggggtttacaaggagggaaccttccacaccatgtggcacgtgaccagaggggccgtgctgatgcaccgaggcaagcggatagagcccagctgggccgacgtcaagaaggacctgatctcctacggtgggggctggaagctcgagggggaatggaaggaaggggaggaagtccaagtgctggcgctggagcctgggaagaacccccgcgccgtccagacaaagccgggcctatttaagacgaacaccggcaccatcggcgccgtgagcctggatttctccccgggcaccagcgggtcccccatcgtggaccggaagggtaaagtcgtcgggctgtacgggaacggagtggtaacgcgctcaggagcctacgtgtccgccattgcccagacagagaaatccatcgaggataaccccgaaatcgaggatgatattttccggaagaagcgactgactatcatggacttgcaccccggagcagggaagaccaaacgatacctgcccgccatcgtgcgcgaggccatcaagcggggcctgaggacgctcatactggcccctacccgcgtcgtggccgcggagatggaggaagccctgcgtgggctccccatcagatatcagacccccgccatccgtgccgagcacaccggccgcgaaatcgtggacctgatgtgccacgcaacgttcaccatgcggctactcagcccggtccgcgtgccgaactacaacctgatcatcatggacgaggcgcatttcacggaccccgcctccattgccgcacggggttacatcagcactcgtgtggagatgggggaagccgctggcatcttcatgacggcgacgcccccaggcagccgagaccccttcccccagtcgaacgctcccattatggacgaggagcgcgaaatccccgagcggtcctggaacagcggacacgagtgggtcacagacttcaaggggaaaaccgtgtggttcgtcccatccatcaaggccggcaacgacatcgctgcctgtctacgcaaaaacggtaagaaggtcatccagctcagccggaagacttttgactccgagtacgtgaagacccgggccaatgactgggacttcgtcgttacgaccgacatttctgaaatgggggccaatttcagagccgagcgcgtgatcgacccccggcgctgcatgaagccagtgattctgacggacggcgaggaacgggttatactggcgggccccatgccggtaactcattcaagcgccgcccagcgcagaggcaggatcggcagaaatcccaagaacgagaatgaccagtacatttacatgggcgaaccactcgagaacgacgaggactgcgcccactggaaggaggccaaaatgctgctggacaacatcaacacccccgagggcattatcccgtccatgttcgagccagagcgggagaaggtcgatgcaatcgacggggaataccgcctccggggcgaggcacgcaagacgttcgtggacctgatgcggcgcggggacctgccagtgtggctcgcctaccgtgtggccgcggagggcatcaactacgcggaccgccggtggtgcttcgacgggatcaagaacaaccaaattctggaggaaaacgtcgaggtagagatctggacgaaggagggtgagagaaagaagctgaagccccggtggctcgacgcccgtatctatagcgatccgctggccctgaaggagttcaaagagttcgccgcaggccggaaatccctcaccctcaacctgatcactgagatggggcgactccccaccttcatgacgcagaaagcccgcgacgcgctcgacaacctggcagttctccacaccgctgaggtagggggccgcgcatacaaccacgccttaagcgaacttcccgagaccctcgaaaccctgctccttttgacgctgctcgccaccgtgactggcgggattttcctgttcctgatgtccgggaagggaatcgggaagatgaccctcggcatgtgctgcataataactgcttcgatcctgctttggtacgcgcagatccagccgcactggatcgcggcctccatcattttagagttcttcctgatcgtcttattgatccccgagcccgaaaaacagcggacgccccaggacaaccagctgacctacgtggtgatcgctatactgaccgtcgtggccgctaccatggctaacgaaatggggttcctcgagaagacgaagaaggacctgggtctgggcagcatcatcacacaggagagcgagtctaacatcctcgatattgacctgaggcctgctagcgcgtggaccctgtatgccgtggccaccacgttcgtgacgcccatgctacggcactcgatcgagaactcatcggtgaacgtgagcctgaccgcgatagccaaccaggccaccgttttaatgggactcggcagagggtggcccttatccaagatggacatcggcgtgcccctgctcgctatcgggtgctacagtcaggtgaaccccatcacgctgaccgctgctctgctcctcctggttgcccattacgccatcatcggaccgggcttgcaggcaaaagcgacccgcgaagcccagaaacgggctgccgccgggataatgaagaaccccaccgtggacggcatcacggtgatcgaccttgagcccatcccatacgatcccaagtttgagaagcagctcggtcaggtcatgttactggtgctgtgcgtgacacaggtcctcatgatgcgaaccacctgggctctgtgcgaggccctgacgctcgccactggccccatctccacactatgggaggggaaccccggccgattctggaacacgactatcgccgtgtccatggccaacattttccgcggttcctacctggcgggggccggcctcctgttcagcatcatgaagaatactacgaacacccggcgcgggacgggcaacatcggagagaccctgggggaaaaatggaagagtcggctaaatgcattgggcaagagcgagttccagatctataagaagtccggcatccaagaggtggatcgcacccttgccaaggagggaatcaagcgcggggagaccgaccaccacgctgtcagccgcggctccgccaagctacgctggttcgtggagcgcaacatggtaacgccggagggcaaggtcgtggacctgggctgcggccggggcgggtggagctactactgcggcgggctgaaaaacgtgcgcgaggtcaaggggcttaccaagggaggtcccgggcacgaggagcccatccccatgagcacctatggctggaacctggtcaggttgcagagcggggttgacgtcttcttcacaccacccgagaagtgcgacaccctactgtgtgacattggcgagagctccccgaatcccaccatcgaggccggacgtacccttcgggtgctgaacttggtggagaactggctgaataacaacacccaattctgcatcaaagtgctcaacccgtacatgcccagcgttatcgagaagatggagactttacagcgcaagtacggcggcgccctagtgcggaaccccctatccagaaattccacccacgagatgtattgggtgtccaacgccaccggtaacatcgtgtcctccgtaaacatgatctcgcgcatgctcatcaatagattcaccatgaaacataagaaggccacctacgagccggacgtcgatctgggctccgggactcgcaacatcggcatcgagaacgagatccccaaccttgacatcatcggcaagagaatcgagaagatcaagcaggagcacgagaccagctggcactacgatcaggaccatccatataaaacgtgggcctaccacgggtcctacgagaccaagcagactggcagcgcctcaagcatggtcaacggggtggtccgcctcctgacaaagccatgggacgtcgtcccgatggtcactcaaatggccatgaccgacacgacccccttcgggcagcaacgggtgttcaaggagaaggtggacacccgcacgcaggagcccaaggaaggcacgaagaaactgatgcggatcacggccgagtggctttggaaggagctggggaaaaagaagacgccccggatgtgtacccgggaggagtttacgcgcaaggtcagatccaacgccgccctgggcgccatcttcaccgacgagaacaagtggaagtccgccagagaggccgtagaggattctcggttctgggagctcgtcgaccgcgagcggaacctgcacctggaggggaagtgcgaaacatgcgtgtacaacatgatgggcaagcgcgagaagaagctcggggagttcggcaaggcaaaggggagccgggccatatggtacatgtggctgggggcccgattcctggagttcgaggcactcggcttcctgaacgaggatcactggttcagccgcgggaacagcttgagcggcgttgagggggagggtctccacaagctgggctacatcctgcgcgatgtttctaagaaggaagggggcgcaatgtacgccgacgacaccgccggatgggacacgcggattacactggaggacttaaagaacgaggagatggtgaccaatcatatgaagggcgagcataagaaattggcggaggctatattcaagctcacttaccaaaacaaggtggtccgggtgcagcgcccgacgccccgaggcaccgtgatggatatcatcagtcgcaaagatcagcggggctccggccaggtggggacctacggcctgaacaccttcacaaacatggaggcacagctgatccgccaaatggaaggagagggcatcttcaagagcatccagcatctcactgtgaccgaggagatcgccgtgcagaattggctggcccgggtgggccgtgagaggctgtcccgcatggctataagtggggatgactgcgtggtgaagcccttagatgatcgtttcgcctccgcgctgacagccctgaacgatatgggtaaggtccgcaaggatatccaacagtgggaaccctcgcgagggtggaacgactggacccaggtgccattctgctcccatcacttccacgagctcgttatgaaagatggacgcgtcctggtggtgccctgtagatcgcaggatgagctgatcggccgcgcccggatctcccagggcgccggctggagcctaaaggagaccgcctgcttagggaaatcttacgcgcagatgtggaccctaatgtactttcatcgccgggacctccgactggccgccaacgccatctgctcagccgtgcctagtcactgggtgccaaccagccggacgacatggtccatccacgcgaagcacgagtggatgaccactgaggacatgttagccgtctggaatcgcgtatggatccaagaaaatccgtggatggaagacaagacgcccgtggagagctgggaggaggtgccctaccttggcaagcgcgaggaccaatggtgcgggagcctgatcggcctgacatcccgggccacctgggccaagaatattcagacagcgatcaatcaggtacgcagcctcatcggtaacgaggagtacacagattacatgcccagtatgaagcggttcaggaaagaggaggaggaggcaggcgttctgtggtag

SEQ ID NO: 25213 - RNA, 9876 nt, synthetic construct
  misc_feature 1..9876: note = derived and/or modified CDS sequence (opt11) from DENV-2__EU569717__SS-prME
  source 1..9876: mol_type = other RNA
acggccggcgtgataatcatgctgatacctaccgcaatggcgttccacctcactacgcggaacggggagccccatatgatcgtggggcggcaagagaaggggaaaagcctcttgtttaagaccgaggacggcgttaacatgtgcacattaatggccatcgatctgggggagctgtgcgaggacacgatcacgtacaagtgccccctccttcgccagaacgagccagaagacatcgactgttggtgcaacagcacctcgacgtgggtgacctacggcacatgcaccacgaccggcgagcatcggcgcgaaaaacgatccgtagccctcgttccccatgtggggatgggcctggagacccgaacagagacctggatgagcagcgaaggggcgtggaaacatgtccagcggattgagacgtggatccttaggcacccgggcttcaccatcatggctgcgatcttggcgtacacgatagggaccacgcacttccagcgtgccctcatatttatcctgctgaccgccgtggcgccaagcatgaccatgcgctgcataggcatcagcaaccgggacttcgtggagggcgtcagcggcggctcctgggtggacatcgtcttggagcacgggagctgcgtcacgactatggctaagaacaagccgaccctggacttcgagctaattaagaccgaggctaaacagcccgctaccctgcgcaaatactgcatcgaggcaaagctgacaaacacgacaaccgagtcccgatgcccgacgcagggggaaccatctctaaatgaggagcaggacaagcgctttatctgcaagcattccatggtcgacagaggctgggggaacggctgcggtttattcggcaagggcgggatcgtgacctgcgccatgttcacatgcaagaagaacatggagggcaaggtggtgctgcccgagaacctggagtacaccatcgtcatcacgcctcacagtggggaggaacacgccgtgggtaacgacacagggaagcacggtaaggagatcaagatcaccccacaaagtagcatcaccgaagccgagctcaccggatatgggacggtgaccatggagtgcagcccccggaccggtctggacttcaacgaaatggtcctactgcagatggaggacaaggcttggctggtccaccgccaatggttcctggacctccccttgccatggctgcccggggccgacacacaaggttccaactggatccagaaggagaccctcgtgaccttcaagaacccccatgcgaagaagcaggacgtcgtcgtgttagggagccaggagggcgctatgcataccgcgctgacgggggccacagagatccagatgtctagcggaaacctcctgttcacagggcacctgaaatgccgcctacgaatggacaagctgcagctgaaggggatgtcatacagcatgtgcaccggcaagttcaagatcgtcaaggaaatagccgagactcagcacggaacaatcgtgatccgggttcagtacgagggggacggatccccatgcaagatcccttttgagatcatggacctcgagaagcggcacgtcctggggcgcctgattactgttaacccgatagttaccgagaaggacagcccagtgaacattgaggcggagccgccgttcggcgactcctacataataatcggggtagagccgggccagctcaagctgaactggttcaagaaggggagctccattggccagatgttcgagaccacgatgagaggtgccaagcggatggctatcctcggggacaccgcgtgggactttgggagcctcgggggcgtgttcacgtccattgggaaggctctgcaccaagtgtttggcgcgatctacggtgccgcctttagcggggtgtcctggaccatgaagatcctgatcggtgtgatcatcacgtggatagggatgaacagcaggtccaccagcttgtccgtctctctcgtcctggtcggcgtcgtgaccttgtatctaggggtgatggtacaggctgattccggttgcgtggtgagctggaagaacaaggagctgaagtgcgggtccgggattttcatcactgataacgtccacacgtggaccgaacagtacaagtttcagccagaatcaccgagtaagctggcgtctgcaattcagaaggcccacgaagaggggatttgcgggatccggagcgttacccgcctcgaaaacctgatgtggaaacagatcacccccgagctgaaccacatactctccgaaaatgaggtgaagctgacgatcatgaccggcgacataaaggggatcatgcaggccgggaaacggtctcttcgacctcagcctaccgagctgaagtactcctggaagacctggggcaaggccaaaatgctttccactgaatcccacaaccagaccttcctgatcgacggccccgagacggcggagtgccctaacaccaatcgcgcctggaacagcctcgaggtggaggactatggcttcggggtgttctctaccaatatctggctgaagctacgcgaaaagcaggacgtgttctgcgacagcaagctcatgtctgccgcgatcaaggacaaccgggcagtccacgcggacatgggctactggatagagagcgccctcaacgatacctggaaaatggaaaaggcatccttcatcgaggtcaagagctgccattggccaaagtcccacacattatggagcaacggagtgctcgaatccgaaatgatcattcccaagaacttcgccggtcccgtgagccagcacaattaccgcccgggctaccatacccagaccgctggtccctggcacctgggcaagttggaaatggacttcgacttctgcgaggggacgaccgtcgtggtcaccgaggactgcggcaacagaggcccatcgctcagaaccacgacagcgtcgggcaagttgattaccgagtggtgctgcagatcgtgtaccctgcccccgctcaggtaccggggcgaggacgggtgctggtacggcatggagattcgccccctcaaggagaaagaggagaacctggtgaactccctcgtcacggcggggcacggccaaatcgacaacttcagtctgggcgtcctcgggatggcgctattcctggaagagatgctgcggacccgcgttggcaccaagcatgcaatcttgctggtggcggtcagcttcgtgacactgatcacgggcaatatgtctttccgggaccttggacgcgtgatggttatggtgggggccacaatgacggacgacataggcatgggcgtgacctacctggctctgctagctgcattcaaagtccgccccacgttcgcggccggactgctgttacgaaagctgacatccaaggagctgatgatggccaccatcggcatcgccctcttaagccagtcaacgatccccgagactatcctggagctcactgacgcgcttgcgctggggatgatggtgctcaagattgtgcgcaacatggagaagtaccagctggccgtcacaatcatggctatcagctgcgtcccgaacgccgtgatactgcaaaacgcgtggaaggtctcctgcaccatcctcgccgcggtgtcggtcagccccctgctgctcacgagctcccagcagaaagccgactggatcccgttagccctgacgattaagggcctcaaccccaccgctatctttttgacgacgctgtcgcggacctctaaaaagcgcagctggccgcttaacgaggccgtgatggctgtaggcatggtgtccatactggccagcagcctgctcaaaaacgacatcccgatgaccggacccctggtggccggtgggttattaaccgtgtgttacgtcctaacgggccggtccgcggacctggagctggagcgagcggcagacgtgaaatgggaggatcaggccgagatcagcgggtccagccctatactgagtatcaccatcagcgaagacggcagtatgagcatcaaaaacgaggaggaggaacataccttgaccatactcatacgtacgggcctgctggtgatctccggggtattcccggtgtcgatccctattacagcggcggcttggtacctgtgggaggtgaagaagcaacgcgcaggcgtactgtgggacgtgcccagcccaccgcccgtgggaaaggcggagctggaggacggtgcctatcgtattaagcagaggggcatcttcggttatagccagatcggtgcaggggtgtacaaggagggcacgtttcacaccatgtggcacgttacccgaggagccgttcttatgcatagaggcaaaagaatcgagccttcttgggccgacgtaaagaaggacctgatcagctacggtggcggctggaagctggagggggagtggaaggaaggggaggaggtccaagtccttgccctggaaccagggaaaaatccccgcgccgtccagacgaagcccggcctgttcaagacaaacaccgggaccatcggcgccgtctcattagacttcagcccaggcacgagcgggagccccatcgtcgaccggaagggaaaggtcgtgggtctgtacggcaacggtgtggtcacccgcagcggtgcctatgttagcgccatcgcccagacggagaagtccatcgaggacaaccccgagatcgaggacgacatcttccggaagaagcggctgaccatcatggatcttcaccccggcgcgggtaagacgaaacgttatctgcccgccatcgtgcgggaggccatcaagcggggcttaagaacgttaatcctggctcccacccgcgtagtagctgccgagatggaggaagctctccgggggctgcccattcgctatcaaacccccgccatccgggctgagcacacgggccgtgagattgtggacttgatgtgtcacgccacattcacaatgaggctgctgtcccccgtaagggtgcccaactataacctcatcatcatggatgaggcgcacttcaccgacccggctagcatcgccgcacggggttatatctccacccgcgtggagatgggggaggccgcgggcatcttcatgacagccacgcctcccgggagccgggacccgttcccccaatctaacgcgccgataatggatgaggagcgcgagatcccggagcgcagctggaactccggccatgagtgggtaactgacttcaagggaaagacggtctggtttgtgccctcaatcaaggccggcaacgacatagctgcgtgcctgagaaagaatggcaaaaaggttatacagctgtcccggaagaccttcgactccgagtacgtgaagacgcgtgccaacgactgggactttgtcgtgaccactgacatctccgagatgggtgccaactttcgggccgagcgcgtgatcgacccccgccggtgcatgaagccggtaatcttaacggacggcgaggagcgtgtcattctggccggacccatgccggtgacccactcgtcagccgcccagcgacgcggccggatcggtaggaaccccaagaatgagaacgaccaatacatctatatgggcgagcccctggagaacgacgaagactgtgcccactggaaggaagccaagatgctcctggacaacattaatacgcccgagggtatcatcccgtctatgtttgagccggaacgggaaaaggtggacgccatcgacggggagtaccggttaagaggcgaagcccgaaagacgttcgtggatcttatgagacgcggggacctgcccgtctggttggcgtaccgagtcgccgccgagggcattaactacgcggatagacggtggtgctttgacgggatcaagaacaatcaaatcctcgaagagaacgttgaggtggaaatctggaccaaagaaggcgaacggaagaaacttaagccccggtggctggacgcccgaatctactccgaccccctcgcgttaaaggagtttaaagagttcgccgcaggacggaagtccctgaccttaaatctgataactgaaatggggagactacccacttttatgacacagaaggcccgcgatgcattggacaacctggctgttctgcacacagccgaagtagggggccgcgcgtacaaccacgccctctccgagctgcccgagaccctcgaaactctcctgttgctcacactgctggccaccgtgacagggggtatcttcctcttcctgatgtccggcaaaggcatagggaagatgacgctgggcatgtgctgcatcatcaccgcctcaatcctcctgtggtacgcccagatccagccacactggatcgcggcgtcaataatcctggagtttttcctcatagtactgttaatccccgagcctgagaagcagcggacccctcaggacaaccaactcacctacgtggtgatcgcgatcctgaccgtcgtagccgccacgatggcaaacgagatggggttcctggagaagactaagaaggacctcgggctggggagcattaccacccaggaatccgaaagcaatatccttgacatagacttacgaccggcctccgcctggaccctgtacgccgtggccaccacctttgtgacccccatgctgcggcacagcattgagaactccagcgtgaacgtgtctctcacggcgatcgccaatcaggccaccgttttaatgggactcgggcgcggttggcccctcagcaaaatggacatcggcgttcccctgctggccatcggatgctactcccaggtaaacccgatcaccctcaccgctgccctgctgctcctggtcgcccattacgccataatcggcccgggtctgcaggccaaggcgactcgcgaggcccagaaaagggccgccgccggtatcatgaagaaccccacagttgacggcataaccgtgatcgatctcgagcccattccgtacgaccccaagtttgaaaagcaactggggcaagttatgctgctcgtgctctgtgttacccaagtcctgatgatgcgcacgacatgggcgctgtgcgaggccctgaccctggctaccggccccatcagcacgctgtgggaagggaatcccggccgattctggaacaccacaatcgccgtgagcatggcaaatatatttagaggcagctacctggcgggtgcgggattactgttctccatcatgaagaacaccacgaacacgcggcgcgggaccggcaacatcggcgaaaccctgggggagaagtggaagtcccggctgaacgccctaggcaagtccgagtttcagatatacaagaagtccggtatccaggaagtagaccgcacgctggccaaggagggcatcaaacgaggggaaaccgaccatcatgcggtttcacggggctcagctaaattacgatggtttgtggagaggaatatggtgaccccggagggcaaggtcgtcgacctcgggtgcggccgcggcgggtggagctactactgtggcgggttaaagaacgtgcgcgaggtcaaagggctgaccaagggtgggcctgggcacgaggagcccatcccaatgagcacgtacggctggaacctcgtgcggctgcaaagcggcgtggacgtattcttcaccccacccgagaagtgcgacacccttctctgtgacatcggcgagtccagccccaaccccacaatcgaggccggccgtacgctgcgggtgctgaatctagtggagaattggctgaacaataacacgcaattctgcatcaaagtactgaacccgtacatgccctctgtaatcgagaagatggagaccctccagcgcaagtacggcggcgctctggtgcgcaacccactttcgcggaactccacccacgagatgtactgggtcagcaatgccaccgggaatatcgtgtcctccgtgaacatgatctcccgcatgctggtaaaccggttcacgatgaagcacaagaaagctacctacgaaccggacgtggacctcggcagcgggacccgcaatataggcatcgagaatgagataccgaatctggacattatcgggaagcggatcgagaagataaagcaggagcacgagacctcctggcactatgatcaagaccatccctacaagacctgggcctatcacgggagctacgagacaaaacagacgggctccgcgagctccatggtgaacggggtcgtgcgcctgctcacaaagccctgggacgtggtaccgatggtgacgcaaatggcaatgaccgacacaacccccttcggccagcagcgggttttcaaggagaaggtcgacacgcgcacccaggagcccaaggaagggaccaagaaactgatgaggatcacagccgagtggctttggaaggagctagggaagaagaaaacgcccaggatgtgtacccgggaggagttcaccagaaaggtacggagcaacgcggcgctgggcgccatcttcaccgacgagaacaagtggaagtccgcgcgcgaggctgtcgaggacagtcggttctgggagttggtggatcgcgaaaggaatctccacttagaagggaagtgcgagacgtgtgtgtataacatgatgggcaagcgcgagaagaaactgggcgagttcggcaaagccaaaggcagccgtgccatctggtatatgtggctcggggcccgcttcttagagttcgaagccctcggcttcctcaacgaggatcattggtttagccggggaaattcgctgagcggagttgagggggagggtttacacaagctcggctatatcctccgagatgtgtcgaaaaaggaaggaggcgcgatgtacgccgacgacaccgccgggtgggacacacggatcacgttggaggacttgaaaaacgaagagatggtgacgaatcacatgaagggcgagcacaagaaactggccgaggcgatcttcaagttaacctaccagaacaaggtcgtccgtgtgcagcgcccaacaccacgcgggaccgttatggacatcatctcccgcaaagaccagcgaggaagcggtcaggtggggacatacggcctcaataccttcactaatatggaggcgcagctgatccgccagatggagggtgaaggcatcttcaaatccattcagcggttaacggtgacggaggagatcgctgtccagaactggctagctcgcgtaggcagagagcggttaagccggatggccatctccggggacgactgcgtagtcaagccactggatgatcgcttcgccagcgctctcaccgccctgaacgacatgggtaaagtgcgtaaggacattcagcagtgggaaccctcgcgcgggtggaacgactggacccaggtgcctttctgcagccaccacttccacgagctggtcatgaaggacggccgggtgctcgtcgtcccctgccggaaccaggatgagctcatcggccgtgcccgcatttcccagggcgccggatggtcgctgaaagagacagcatgcctagggaagtcgtatgcgcagatgtggacgttgatgtacttccaccggcgagacctgcggctagccgccaacgcgatctgcagtgccgtaccctcccactgggtgcccacaagtcgcactacctggtccatccatgcgaaacacgaatggatgaccacggaggacatgctggccgtctggaaccgcgtgtggatccaggagaatccatggatggaagacaagacccccgtagagagctgggaagaagtcccctaccttggcaagagggaggaccaatggtgcggatctctcatcggcttgacctccagagccacctgggccaagaacatccaaactgcgatcaaccaggtgcgcagcctgatcgggaacgaggagtacaccgattatatgcccagcatgaagcgcttccggaaagaggaagaggaggccggtgtgctctggtga

SEQ ID NO: 25214 - RNA, 9876 nt, synthetic construct
  misc_feature 1..9876: note = derived and/or modified CDS sequence (opt11) from DENV-2__EU569718__SS-prME
  source 1..9876: mol_type = other RNA
accgccggcgtgatcatcatgctgatccccaccgccatggctttccacctcaccacccgcaatggggagccccacatgatcgtcggccggcaggagaaggggaaatcgctgctgtttaagaccgaggacggcgtgaacatgtgcaccctcatggccatcgacctcggggaactgtgcgaggacaccatcacctacaagtgccccctcctgcgccagaacgagcccgaagacatagactgctggtgcaacagcacctccacgtgggtgacatacgggacctgcaccaccactggggagcaccggcgcgagaagcggtccgtcgccctggtgccccacgtggggatgggcctcgagacacgtaccgagacctggatgagcagcgaaggggcgtggaagcacgtccaacggatcgagacctggatcctgaggcacccgggtttcactatcatggcagcgatcctggcgtacaccatcgggacgacgcacttccagcgggccctcatctttattttactgaccgccgtagcgccctcgatgaccatgcgctgcattggcatctccaaccgggacttcgtagagggtgtaagcgggggctcctgggtggacatcgttctcgagcatgggagttgcgtcaccacgatggccaagaacaagcccaccttggacttcgagttgatcaagacggaggcgaagcagcctgccacactccgcaagtactgcatcgaggccaagctgactaacaccacaacggagtcgcggtgccccacgcagggcgagccctcgctgaacgaggaacaggataagcgctttatctgcaagcactccatggtcgaccggggctggggcaacggctgcggccttttcggtaagggcgggatagtgacctgcgccatgttcacgtgtaagaagaacatggagggtaaggtcgtgctgcccgagaacctggagtacaccatcgtgataacgccccacagcggggaggagtacgccgtcggcaacgacaccgggaagcatggcaaggagattaagatcaccccgcagtccagcatcaccgaagctgaactcaccggctacggcacggtgacgatggagtgtagcccccggacaggcctggatttcaacgagatggttttgttacagatggaggacaaggcgtggttggtccaccggcagtggttcctggacctccccctgccatggcttccgggtgccgacacgcagggctccaactggattcagaaggagacactcgtgaccttcaagaacccccacgcgaagaagcaggacgtggttgtgctgggtagccaggagggcgccatgcacaccgctctgaccggcgctacggagatccagatgtcatccgggaacctacttttcaccggtcacctgaagtgccgcctccggatggacaagttacagcttaaggggatgtcctacagcatgtgcaccgggaagttcaagatcgtaaaggagatcgccgagacccagcacggcacgatcgtgatccgtgtacagtatgaaggcgacggctccccatgcaagattccctttgaaatcatggacctcgagaagcggcacgtcctggggcgcctgatcaccgtgaacccgatcgtcaccgagaaggatagccccgtcaatgtggaggcggagccgcccttcggtgattcctacatcatcatcggggtggagcccggccagctgaaacttaattggttcaagaaggggtcttccatcggccagatgtttgagaccacgatgcgcggcgcgaaacggatggccatcctgggcgacaccgcctgggacttcggcagcctcggaggcgtcttcacctcgatcggcaaagcgcttcaccaggtgttcggcgcgatttacggcgccgccttcagtggagtgtcctggaccatgaagattctgatcggggtcatcattacgtggatcggcatgaacagccgctccaccagcctgtccgtatctctcgtcctggtcggcgtggtgaccctgtacctcggggtcatggtccaagccgactccggatgcgtggtcagctggaagaacaaagaactgaagtgcgggtccgggatcttcatcaccgacaacgtgcacacgtggactgagcagtacaagttccagcccgaaagcccctcaaaactggcgtccgccatccagaaggcccacgaggagggtatctgcgggatccggagcgtgaccaggctcgagaacctgatgtggaagcagatcactcccgagctgaaccacatcctctctgagaatgaggtcaagctaacgattatgaccggtgatatcaaagggattatgcaggcgggcaagcgcagcttgagaccgcagccgaccgagctcaaatactcttggaaaacctggggcaaagccaaaatgctgtcaacagaaagtcacaaccagaccttcctgattgatgggcccgagacagcagaatgcccgaacaccaaccgggcctggaactccctggaggtggaggactacggtttcggggtgttctccacgaatatctggttaaagctacgcgagaagcaggacgtcttttgtgactcaaagctcatgtcagccgccatcaaggacaaccgggcggtgcacgcggacatgggctactggatcgaatctgcactgaacgacacatggaagatggagaaggcatcgtttatcgaagtcaagagctgccactggccaaagtcccacaccctgtggagcaacggcgtgctcgagtccgagatgatcatccccaaaaacttcgccgggcccgtgagtcagcacaactatcgcccaggctaccacacccagaccgccgggccctggcacctgggtaagctggagatggatttcgacttttgcgaggggacgaccgtggtcgtgaccgaggactgcggcaaccggggcccgagcttgcgcaccactaccgcgtcggggaagttgatcaccgagtggtgctgtaggagttgcaccctgccgccgctccgctaccggggagaggacgggtgctggtacggcatggagatccgcccactgaaggagaaggaggagaatctggttaactccctcgtcacggccggacacggccagatcgacaacttcagcttgggcgtgctgggcatggccttattcttagaggagatgctgcgtacccgcgtcggcacgaagcatgccatcttactggtcgcggtgtccttcgtgacccttatcacgggtaacatgagcttccgggacctcgggcgcgtgatggtgatggtgggcgccaccatgaccgacgacatcggcatgggcgtgacctatctggccctgctcgccgctttcaaggtacgacccacgttcgcggccgggctgctgctccgtaagctaacctccaaggagctgatgatggccaccatcggcatcgccctcctgagccagagtaccatccccgagacgatcctcgagttgaccgacgccctggcactaggcatgatggttctcaaaatcgtccgcaacatggagaagtaccagctggccgtgaccatcatggccatcagctgcgtgccgaacgccgtcatcctgcagaacgcatggaaggtgtcctgcacaatcctcgccgccgtcagcgttagccctctgctgctcacgagctcacagcaaaaggcagactggatccctttagctctgaccatcaagggcctcaacccaaccgcaattttcttaactacgctgagccgaacctccaagaagcggagctggccgctcaacgaagccgtgatggccgtgggcatggtttccattctggcgagcagcctgctcaagaacgacatccccatgaccgggcccctggttgccggcggtttactgaccgtctgctacgtgttgaccggccgttcggcggacctggagctcgaacgagccgccgacgtgaagtgggaggaccaggctgaaatcagcgggtccagccccatcctgtccatcaccatcagcgaagacggctcgatgagcatcaagaatgaggaggaggagcagacccttaccatactcatccggacgggcctgctggtgatctccggggtgttcccggtgagcatccccattaccgccgcggcgtggtacctgtgggaggttaagaagcagcgcgccggagtgctgtgggacgtacccagcccgccacccgtcgggaaagccgagctggaggatggcgcctaccgtatcaaacagagagggatcttcggctattcccagatcggcgcgggggtctacaaagaaggcaccttccacactatgtggcacgtgacacgaggggccgtcctcatgcaccgcggcaagcgaatcgagccctcctgggccgacgtgaagaaggacctgatcagctacgggggcggctggaagctcgaaggtgagtggaaagagggcgaggaggtgcaggtcctcgccctggagccgggcaagaaccctcgcgccgtacaaacgaagcccggcctgttcaagaccaacaccgggaccatcggcgcggtctccttggacttctctccaggcacgtccgggagccccatcgtggaccggaagggcaaggtggtgggcctgtacggcaacggcgtcgtgaccaggtcgggggcgtacgtgagcgccatcgcccagaccgagaagtccatcgaggacaaccccgagatcgaggatgatatcttccggaagaagcgcctgacaatcatggatctccacccaggtgcggggaagacgaagcgatacttgcccgccatcgtccgcgaggccatcaagcggggcctgcgcactctgatcctcgccccgacgcgagtggtagccgcggaaatggaggaagccctgcgggggctgcccatccgatatcagacccctgccatccgggcagagcacaccggccgcgagatagtcgacctcatgtgccacgcaaccttcaccatgcggctgctgtcacccgttcgggtgcccaactataacctcataatcatggacgaggcgcacttcaccgaccccgcctcgattgccgcccggggctacatctccacccgcgtcgagatgggggaggccgcgggcatcttcatgaccgccacgccgccggggtcgcgcgacccgttcccacagtccaacgcccccattatggacgaggaacgagagatccccgagcggtcatggaactccggacacgagtgggtaaccgacttcaaggggaagacggtgtggttcgtcccgagcatcaaagccggcaacgacatcgcagcctgcctgcgcaagaacggcaagaaggtgatccagctgtcacgtaagaccttcgactccgagtacgtgaagacaagagctaacgactgggacttcgtggtgaccacggacatcagcgagatgggggccaattttcgggccgagcgcgttattgacccgaggcggtgcatgaagccggtcatcctcaccgacggcgaggagagagtgattctggcggggcccatgccggtgactcacagctctgccgctcagcgccggggaagaatcgggcgcaaccctaagaatgagaatgaccagtacatctacatgggcgagcccctagagaacgacgaggactgcgcccactggaaggaggccaagatgttactggacaacatcaacacccccgagggcatcataccgagcatgttcgagcccgagcgggagaaagtcgacgcgatagatggggagtaccgcctccggggcgaggccaggaaaacatttgttgacctcatgcgaagaggggatctgcccgtgtggctggcctaccgtgtcgccgccgagggaatcaattacgcggaccgccgctggtgcttcgacgggataaagaacaaccagatcctcgaggaaaacgtggaggtcgagatttggaccaaggagggcgagcgcaagaagctgaagccgcgctggctggacgcacgcatctactccgaccccctggccctaaaggagttcaaggaatttgccgcgggccggaagtcgctaaccctcaaccttattactgaaatggggcgcttacccacgtttatgacccagaaggccagagacgccctcgataacctggcggtgctgcacactgccgaagtgggcgggaaggcgtacaaccacgccctctccgagctgcccgagaccctggagaccctcctgctgctcaccctgcttgccactgtcacagggggcatattcctcttcctgatgagcggcaagggcattggcaagatgacgttgggcatgtgctgcattatcaccgcctccattctcttatggtacgcccagatccagccgcactggatcgcggccagcatcatcttggagttcttcctcatagtgctgctcatacccgagcccgagaaacagaggacaccccaggacaatcagctcacctacgtggttatcgccattctgaccgtcgtggccgctactatggcgaatgagatgggatttctggaaaagaccaagaaagacttgggattaggtagcatcaccacccaagagtccgagtcaaacatcctggacatcgatcttcggccggccagcgcttggacgctgtacgccgtcgccacaaccttcgtgacccctatgctgcgccacagcatcgagaactccagcgtgaacgtctccctaacggcgatcgcaaaccaggccacagtgctaatggggttgggccgtgggtggcccctgtccaagatggacatcggcgtgcccctgctggcaatcggttgctactcccaggtcaaccccatcaccctcaccgcggcccttctgctcctggtggcccattacgccatcatcggccctggcctgcaggccaaggcgacgcgggaagcccagaagagggccgccgccgggatcatgaaaaaccctaccgtagacgggatcaccgttattgacctcgagcccataccatacgaccccaagttcgagaagcagctgggtcaggtgatgctgctcgtgctgtgtgtaacccaggtgctaatgatgcggacaacctgggccctctgcgaggcacttaccctcgccaccggccccataagcaccctctgggagggcaaccccggccgcttctggaacaccaccatcgccgtctccatggccaacatcttccggggatcatacctggcgggggccgggctcctcttctcgatcatgaagaacaccacgaacacccgcagggggacaggcaatattggcgagaccctgggggagaagtggaagtcgcgcctgaacgccctcggaaaatctgagttccagatctacaagaaaagcgggatccaggaggtcgacaggacgctggctaaggagggcatcaagcgcggggaaacagaccaccacgcggtgtcccggggcagcgccaagctgcgctggttcgtggagaggaatatggtcaccccggagggcaaagtggtggacctgggatgcggccgcggagggtggagttactactgcggaggcctgaagaacgtccgagaggtgaagggcctcaccaaaggcggacccggccatgaggagccaatccccatgagcacgtacggatggaacctggtgagactgcagtcaggggtcgacgtgtttttcaccccgcccgagaagtgcgacaccctgctctgcgacatcggcgagtcgagccccaatcccaccatcgaggccggccggacgctgcgcgtgctgaacctcgtcgagaactggctcaataataacacccagttctgcatcaaggtgctgaacccgtacatgccctccgtcatcgagaagatggagaccctccaacggaagtacgggggtgctctggtccgcaaccccctgtcaagaaactccacccacgagatgtactgggtgtcaaacgcaaccggcaacatcgtgtctagcgtcaacatgatcagccgtatgctgatcaaccgattcaccatgaagcataagaaggcaacctacgagccggacgtggacttaggaagcgggacgcggaacattggcatagagaacgagatccccaacctggacatcatcggcaagcgcatcgagaagatcaagcaagagcatgagacctcctggcactacgaccaggaccacccatacaagacatgggcctaccacgggagctacgagaccaagcagaccggctccgccagctccatggtgaatggggtcgtgcgtctgctcacgaagccctgggacgtcgtcccgatggtgacgcagatggccatgaccgacaccacccccttcggccagcagcgcgtgttcaaggaaaaggtcgacacacggactcaagagcccaaggagggtaccaagaagctgatgagaatcaccgccgagtggctgtggaaagagctcgggaagaagaagacacccaggatgtgcacccgagaggagttcaccagaaaggtgcgcagcaatgcggcccttggcgccatattcaccgacgagaacaaatggaagagtgcacgggaggcggtcgaggacagccgcttctgggagctggtggatcgggagcgcaacctccacctggaggggaagtgcgagacgtgtgtttacaacatgatgggtaagcgggagaagaagctgggggagttcggcaaggcgaagggctcccgcgcaatctggtacatgtggcttggggcccgattcttggagttcgaagctctgggcttcctcaacgaggatcactggttcagccgcgggaacagtttgtccggagtcgagggagaggggctgcacaagctcggctacatcctgcgggacgttagcaagaaggaaggcggggcgatgtacgccgacgacaccgccggctgggacacgcgcatcaccctggaggatctcaagaacgaggagatggtgacgaaccacatgaagggcgaacacaagaaactggcagaggccatattcaagctgacctaccagaataaggtcgtgcgggtgcagcgcccgacgcccaggggaaccgtaatggacattatctcccgtaaggaccagcgcgggtcaggacaggtggggacgtacggtctgaacaccttcacaaacatggaggcgcagctgatacgacaaatggagggggaaggtatcttcaagtccatccagcgcctgaccgtgacggaggagatagccgtccagaactggctcgccagggtgggccgcgagcggctgagccgcatggccatctccggggacgactgcgtggtcaagcccctggacgaccggtttgctagcgcgctcaccgccctgaatgacatgggcaaggtgcgcaaagacatccagcagtgggagccctctcgtgggtggaacgactggacccaagttccattctgctcacaccacttccatgagctggtcatgaaggacggcagagtgctcgtggttccgtgccggaaccaggacgaactgatcggccgtgcccggatctcacagggcgccggctggtctctgaaagagaccgcctgcctcgggaagtcgtatgcgcagatgtggacgctgatgtacttccaccgcagggacctgcgcctcgccgccaatgccatctgcagcgccgtgccctcccactgggtgcccactagccggaccacttggtccatccacgcgaagcacgagtggatgaccacggaagacatgctggccgtgtggaaccgcgtatggatccaggagaacccatggatggaggacaaaactcccgtggagagctgggaggaggtcccctacctgggcaagcgcgaggaccagtggtgcggaagcctcatcggcctgacctccagagcaacctgggccaagaacatccagacggcgattaaccaggtgcggtctctgatcgggaatgaagagtacacggactacatgccctccatgaagcggttccgcaaggaggaagaggaagccggtgtgctctggtga

SEQ ID NO: 25215 - RNA, 9876 nt, synthetic construct
  misc_feature 1..9876: note = derived and/or modified CDS sequence (opt11) from DENV-2__EU596488__SS-prME
  source 1..9876: mol_type = other RNA
acagcaggggtcatcatcatgctcatcccaaccgtcatggcgtttcacctcaccacccgcaacggggagccccatatgatcgtgggccgtcaagagaagggtaaatccttgctgttcaagaccgaggacggggtgaacatgtgcacactcatggcgatcgatctgggggagctctgcgaggatacaatcacctacaagtgccccctcctgcggcagaatgaaccggaggacatcgactgctggtgcaatagcaccagcacctgggtaacctatggtacctgcactaccactggggagcaccggcgcgaaaagcgatccgttgcgttggtgccccacgtgggtatgggcctcgagacccgcactgagacctggatgagcagcgaaggagcctggaaacatgtgcagagaatcgagacctggatactgagacacccgggattcacaatcatggccgccatcctggcgtacaccatagggaccacacactttcaacgggccttgatcttcatcctcctgaccgccgtcgcccctagtatgaccatgcggtgcatcggcataagtaatcgggatttcgtcgagggcgtcagcgggggctcgtgggtggatatagtcctcgaacacgggagctgcgtgaccactatggcgaagaataagccaaccctcgacttcgaactgatcaaaacggaagcgaaacagcccgcaacactgaggaagtactgcatcgaggccaaactgaccaacaccaccaccgagtcccggtgcccgacacagggggagccaagccttaatgaggaacaggacaaaaggttcatctgcaagcattccatggtggaccggggctgggggaacggatgcgggctgttcggaaaaggagggattgtgacctgcgccatgttcacatgtaagaaaaacatggagggcaaagtggtgttgcccgagaatctggagtacaccatcgtcatcacgccccacagcggggaggagcacgcagtgggaaacgacaccggaaagcacggtaaggagattaaaattacccctcagtcaagcattaccgaggccgagctcaccggatacggcacggtgaccatggagtgcagcccccgcaccggtctagacttcaacgagatggttctgcttcagatggaggataaggcttggctggtgcatcggcagtggttcctggacctccccctgccctggctccccggtgccgatacccagggcagcaactggatccagaaggagacgttggtgaccttcaagaacccccacgccaagaaacaggatgtcgtggtcctggggtcgcaggagggggcgatgcacaccgccctgaccggtgccacggagatacagatgagcagcggcaacttgctttttaccggccaccttaagtgtcgtttaagaatggacaaactgcaactgaaagggatgtcctacagcatgtgcactggcaaattcaagatcgtgaaggagatcgccgagacccagcacgggacgatagtgatcagagtccagtacgagggtgatggtagtccctgcaagattcccttcgagatcatggacctggagaaacggcacgtgttagggcgcctgatcactgtgaacccgatcgtcaccgagaaggacagccccgtgaacatcgaggccgagccgcccttcggggactcctatatcatcatcggagtggagcccggccagcttaagctgaactggttcaagaagggtagctcaatcggtcagatgttcgaaacgaccatgcgcggtgctaagcggatggccatcctaggagataccgcctgggacttcggaagcctcgggggcgtcttcacctctatcgggaaggctctgcaccaggtgtttggtgcgatctatggcgcggccttctccggggtgtcctggaccatgaagattctaatcggggttataatcacgtggatagggatgaatagccgctcgaccagcctgtccgtcagcctggtcttggtaggcgtcgtgaccctgtacttaggggtcatggtgcaggccgatactgggtgcgtggtctcatggaagaacaaggagttgaagtgcggcagcgggatattcattacggacaacgtgcatacatggaccgagcagtataaattccagcccgagtcgccgagcaaactagccagcgcgatccagaaggctcatgaagagggcatctgcgggatccggtcagtgacccgtctcgagaacctgatgtggaagcagataacgcccgaattgaatcacattctcagcgagaatgaggtaaagttaacaataatgaccggcgacatcaaggggatcatgcaagcaggcaagagaagcctccgcccacaacccacggagctcaaatacagctggaagacctggggcaaagccaagatgctgtcgaccgagagccacaatcagacatttctgatcgacgggcccgagaccgcagaatgcccgaacactaaccgggcgtggaactccctcgaggtggaagactatggcttcggggtgttcagcacaaacatctggctgaaactgagagagaagcaggacgtcttctgcgactccaagctcatgtcggccgctatcaaggacaaccgggcagtgcacgccgacatgggatactggatagaatccgcactgaacgacacctggaaaatggaaaaagccagcttcatcgagatcaagtcctgccactggcccaagagccacaccctgtggtccaacggtgtgctagagagcgagatgatcattcccaaaaatttcgccgggcccgtctcccagcacaactaccgcccgggttaccacacacagaccgcggggccttggcatttgggcaaactggagatggattttgacttctgcgaggggaccaccgtggtcgtcaccgaggactgtggaaaccgggggcccagcctccgcacgaccacagccagcggtaaactaatcactgagtggtgctgccggtcctgcacgttgccgccgttacgctatcggggcgaggacggttgctggtacggaatggagatccggcccttgaaggagaaggaggagaatctagtgaacagcctagtgactgcggggcacggacaaatagacaacttttccctgggcgtgttgggtatggccctctttctggaggagatgcttcgaacgcgcgtcggcaccaagcacgcaatcctcctggtagccgtcagtttcgtgacgctaatcacggggaacatgtccttccgagacctcggccgcgtgatggtcatggtgggggcgacaatgacagacgacatcggcatgggcgtgacatacttagccctgctggcggccttcaaagttcgccccaccttcgcagcaggtctgctcctccggaagctgacctcgaaggagttaatgatggcgaccatcggtatcgccctcctatcacagagcactatccccgagaccattttagagcttactgacgctcttgccctgggaatgatggtgctcaagatcgtgcgcaacatggagaagtaccagctggcggtcaccatcatggccatctcctgtgtgccgaacgccgtcatcctccagaacgcctggaaggtctcgtgcacgatcctcgccgcggtgtccgtcagccccctgctgctcacaagtagccagcaaaaggccgattggatccccctggccctgaccataaaaggcctcaacccaacggcgattttcctaaccaccctgtcccgcacctcaaagaagcgctcctggccgttgaacgaggccgtgatggcagtcggtatggtctctatcctggcctctagcctgctcaagaacgatatccccatgaccggtcccctggtggctggcgggctgctcactgtgtgctacgtcctgaccggccggagcgccgatttagagctcgagcgcgccgccgacgtaaagtgggaggatcaagcggagatctccggatcatcccccattctgagcataaccatctcggaggatgggtcaatgtcaatcaagaacgaggaggaggaacacacccttactatcttgatccgtacaggcctgttggtgatcagtggggtcttcccggtgagcatccccatcaccgccgccgcgtggtacctctgggaggtaaagaagcaacgcgccggcgtcctgtgggacgtgcccagccctccgcccgttggcaaggccgagctagaagacggcgcgtaccgtataaagcagcgcgggatcttcgggtactcgcagatcggagccggggtctataaggaaggcaccttccacaccatgtggcacgtgactcgcggggcggtgctcatgcaccgaggcaaacggatcgaaccctcttgggcggatgtcaagaaagacctgatctcctacggaggcgggtggaagctggagggggaatggaaggagggtgaggaggtccaggtgctcgccctggaacccgggaagaacccgcgggcagtacagaccaaacccgggctgtttaagaccaacactgggacgatcggcgccgtatcattggacttctcccccgggacgtcgggctcccccatagtggaccgaaagggcaaggtcgtggggctgtatggaaacggagtggtcacccggtccggggcctatgtgtcagccatcgcccagaccgagaagtccatagaagacaaccccgagatcgaggacgacatcttccggaaaaagcgcctgacgatcatggacctccaccccggcgccgggaagacgaagcggtacctgcccgcgatcgtccgagaggccatcaaacggggcctgcgcaccctcatactcgccccaaccagggtcgtggccgctgagatggaagaggctctgcgaggactgccaatccgctaccagacgccggccatcagagccgagcacacgggccgggagatagtggacttgatgtgccacgccacattcaccatgcggctgctgagccccgtacgcgtgccgaactacaacttgataatcatggacgaggcccacttcacggatccggcgtccatcgccgctagaggctacatcagcacccgcgtggagatgggggaggctgcaggaatatttatgacagcgacgccgcccgggagcagagacccgttcccccagagcaacgctcccatcatggacgaggagcgtgagatccccgagcggtcatggaactccggccacgagtgggtcacggattttaaagggaagaccgtatggttcgtaccgtccatcaaagccggaaacgacatcgcagcgtgtctgcgcaaaaacggcaaaaaggtcatacagctgtcgcgcaagaccttcgactccgagtacgtgaaaacccgcgccaatgactgggattttgtagtcacgaccgacatcagcgagatgggggccaacttccgggccgagcgcgtgatcgatccccggcgctgtatgaagcccgtgatcctgaccgacggcgaggaacgggtcatcctggccgggcccatgccagtgacccacagcagcgcggctcagcgccgcggacggatcgggcgaaaccccaaaaatgaaaacgaccagtacatctatatgggcgagcccctggaaaacgacgaggattgcgcccattggaaagaagcgaagatgctcctcgataacataaacacgcccgagggcataatcccttccatgttcgaaccggagcgggagaaggtggatgccatcgacggggagtacagactccggggcgaagcgcgcaagactttcgttgacctcatgcggcgcggtgacctgccagtgtggctggcctaccgggtggccgccgaaggtatcaactacgccgaccgccgttggtgcttcgacgggattaaaaacaaccaaatcctcgaagagaacgtcgaagtggagatttggaccaaggaaggtgagaggaaaaagctgaagccccgctggctggacgcacgcatatacagtgaccccctagccctgaaggagtttaaggagttcgccgcaggcaggaagtccctgaccctcaacctgatcactgaaatggggcgcctgccgaccttcatgacacagaaagcacgggacgccctcgataacttggccgtgctgcacactgccgaggtgggtggtcgcgcctacaaccacgccctgagcgagttgcctgagacactggagaccctactgctgctcacactgttagccactgtgactgggggcatcttcctcttcctgatgtccggaaagggcatcgggaagatgaccctgggtatgtgctgcataatcaccgccagcatcctcctctggtacgcccagatccagccgcattggatcgccgcatcgattatccttgagttctttctcatcgtgcttttaatccccgagccggagaaacagcggacaccccaggacaatcagcttacctatgtggtgattgccatactgacggtcgtggccgccaccatggccaacgaaatggggttcttagagaagaccaagaaagacctcggactggggagcatcaccacgcaagagtcagagtccaacatcctggacatcgacttacgcccagcgagcgcctggaccctgtacgccgtggcgaccactttcgtcactcccatgctgcggcactccatcgagaacagctccgtcaacgtgtctctcaccgccattgcgaatcaagccactgtcctgatggggctggggagggggtggcccctcagtaagatggatatcggagtccccctcttagccatcgggtgctatagccaagtcaaccctatcaccctcacggcagcgctgttgctcctggtcgcccactacgccattatcggccccgggctgcaggccaaggccacccgcgaggcgcagaagaggaccgccgccgggataatgaagaacccaaccgttgatggcatcacagtgattgacttggaacccatcccgtacgaccccaagttcgaaaagcagctggggcaggtcatgttgctagtgctgtgcgtgacgcaggtcctgatgatgaggaccacatgggcgctctgcgaagctctaacgttagcgaccggacccatctccaccctctgggaggggaaccccggtcgtttctggaacaccacaatagcggtaagcatggccaatatcttccgcggctcctacctggcaggggcaggcctcctatttagcatcatgaaaaacacaatcaatacgcggcgcgggaccggtaatataggagagacgctgggtgagaagtggaagtcccggcttaacgcgctcggaaagagcgagttccagatctacaagaagtccgggatccaagaagtggataggaccctggccaaggagggtatcaagcgcggtgagactgaccaccacgcggtcagccgcggttccgcgaagctgcggtggtttgtggagcgtaacatggttacccctgagggcaaggtagtggacctcgggtgcggacgcggcgggtggtcttactactgcggcgggctgaagaacgtccgcgaggtcaaggggcttacgaaaggtgggcccggccacgaggagccaattcccatgtccacctacggatggaacttagtacggttgcagagcggggtagacgtcttcttcacaccgcccgagaaatgcgacaccctgctatgcgacatcggagagagctcccccaaccccacaatcgaggcaggccggactttacgggtgctaaacctcgtggagaactggctgaacaacaacacccagttttgcgtcaaggtgctaaatccttacatgcccagcgtgatagagaaaatggaaacacttcagcgcaaatatggaggcgccctggttcggaatccactgagccgcaactcaacccacgagatgtactgggtgtccaacgctacgggcaacatcgtgagctccgtcaacatgatcagccgcatgctcataaaccggttcaccatgaaacataagaaagccacgtacgagcccgatgtggacctcggctcagggacgcgcaatatcgggatagaaaacgagatacccaacctggacatcatcggcaaacgaatagaaaagatcaaacaggagcacgagacgagctggcactacgaccaggaccatccgtacaagacctgggcatatcatgggtcgtacgagaccaagcaaaccgggtcagcgtctagcatggtgaacggcgtcgtcaagctactgacaaagccctgggacgtggtgcctatggtgactcagatggccatgaccgacactactccattcggccaacagcgcgtgttcaaggagaaggtggacaccaggacccaggagcccaaggagggcacgaagaaactgatgcgcatcacggccgaatggctgtggaaggagctcgggaaaaagaagacgcctaggatgtgcacccgggaggagttcacccggaaggtccgtagcaacgccgcccttggtgcgattttcacggacgaaaataagtggaagtccgctagggaggcagtagaggattcacggttctgggagctcgtggacagggagcgcaatttacatctcgaagggaagtgtgaaacatgtgtttataacatgatgggcaagagagagaaaaagctgggcgagttcggcaaggcgaagggcagccgtgcgatctggtacatgtggctcggggcgcggtttctggagttcgaggctcttgggttcctcaacgaagaccactggttctcccgcggcaatagcctgagcggcgtggagggggaaggactgcacaaacttggttacatattgcgggacgtttccaagaaggagggaggggctatgtacgctgacgacactgcgggatgggatacgaggataacattagaggatctcaagaatgaggagatggttaccaaccacatgaagggtgagcacaaaaagctggccgaggcgatcttcaagctaacctaccagaacaaagtcgtgcgggttcagcgtcccacgccccgggggacggtcatggacataattagccgaaaagaccagcgcggctccggtcaggtagggacctacggcctcaacacctttaccaacatggaggcccaactgatacggcagatggagggtgaggggatcttcaagtctatccagcgcctcactgtcacagaggagatcgccgtccagaactggctcgcgagagtgggccgcgagcggctttctaggatggcgattagcggggacgactgtgtggtcaaaccactggacgatcggttcgcatccgccctaacggccctcaacgacatgggcaaggtgcgaaaggacatccagcagtgggagcccagcagggggtggaacgactggacgcaggttccgttttgctcccaccacttccacgaactggtaatgaaggacggccgcgtgctcgtggttccctgccggaatcaggacgagctgattgggcgcgcccggatctcgcagggcgccgggtggagtctgaaggagacggcctgcttgggcaagagctacgcgcagatgtggaccttaatgtacttccataggcgggacctgcgactcgccgcaaacgcaatctgctccgctgtgccctcgcactgggtacccacctcccggaccacttggagcatccacgccaagcacgagtggatgacgactgaggacatgctggcagtctggaaccgcgtgtggatccaggagaatccgtggatggaggacaagacgccagtggagagctgggaggaggttccctacctgggcaaacgcgaggaccagtggtgcggttctctcattggcctgacatcgcgggccacgtgggccaagaacatccagaccgcgatcaaccaggtgcgatctctgatcgggaacgaggaatacaccgattacatgcccagtatgaaacggttccgcaaagaggaggaagaggccggtgtgctctggtga

SEQ ID NO: 25216 - RNA, 9876 nt, synthetic construct
  misc_feature 1..9876: note = derived and/or modified CDS sequence (opt11) from DENV-2__EU596489__SS-prME
  source 1..9876: mol_type = other RNA
accgccggggtgatcatcatgctgatcccgactgccatggcgttccacttgaccacccggaacggggagccccatatgatagtcggacggcaggaaaagggaaagagcctgctgttcaagacggaggacggcgtgaacatgtgcaccttgatggccatcgatttgggggaactgtgcgaagacacgatcacctacaagtgcccactcctacgccagaatgagcccgaggacatcgattgctggtgtaattccacgagcacgtgggtgacctacgggacttgcaccactacgggcgaacacagacgtgagaagcggtccgtcgccctggtgccccacgtggggatgggcctggagacacgcaccgagacctggatgagctccgagggggcttggaagcacgtgcagaggatcgagacgtggatcctgcgtcaccccggtttcaccaccatggccgcgatcctggcctacaccatcgggacgacgcacttccagcgggctctcatctttattctgctgaccgccgtggcgcccagtatgaccatgcgctgcatcggcatctccaaccgggacttcgttgagggcgtcagcgggggttcctgggttgacattgtgctcgagcacgggagctgcgtcacaaccatggccaagaacaagcctaccctggacttcgagctgatcaagaccgaggccaagcagcccgccacgttacgcaagtactgtattgaagccaagcttaccaacaccaccacagagtcccggtgccccactcagggggagccctccctaaatgaggagcaagacaagcgattcatttgcaaacactccatggtcgaccggggctggggaaacggatgcggcctgttcggcaagggcggaatcgtgacctgcgctatgttcacgtgtaagaagaacatggagggcaaggtcgtgctgcccgagaatctggaatacacgatagtgatcacgccgcactcaggggaggagcacgcagtcggcaacgacaccgggaagcacgggaaggagattaagatcaccccacagtccagtattaccgaggccgagctcacggggtacggcaccgtgaccatggagtgcagcccccgtacaggcttagactttaacgagatggtattactgcagatggaggacaaagcctggctggtccacagacagtggttcctagacctccccctgccctggctgcctggggcagacacgcagggcagcaactggatacagaaagaaaccctcgtaaccttcaagaatccccatgccaagaagcaggacgtggtcgtgctgggatctcaggagggcgcgatgcacaccgctctgacgggggccaccgagattcaaatgagcagcggcaacctcctgttcaccggacacctgaagtgtcgcctccggatggacaagctacagctgaaggggatgagctatagtatgtgcaccggcaagttcaagattgtaaaagagatcgccgaaacgcagcacgggacaatcgtgatccgcgtgcagtacgagggcgacggctccccatgcaagatcccctttgagatcatggatctagagaagcggcatgtcctggggcgccttatcaccgtgaatccgatcgtgaccgaaaaggacagccccgtcaacatcgaggcagagccgccctttggagactcctacataatcattggggtggagccgggccagctcaagctgaactggtttaagaagggcagctcaattggccagatgttcgagacgaccatgcgcggagccaagcggatggctatcctgggcgacactgcctgggactttggcagcctcggcggcgtgtttactagtatcgggaaggccctgcatcaggtctttggcgcgatctatggcgccgcgttcagcggggtgtcgtggacgatgaagatcctcatcggcgtgatcatcacatggatcgggatgaacagccgctctaccagcctgtcagtcagcctggtgctggtaggcatcgtcaccttatatctcggagtgatggtgcaggcagacaccgggtgcgttgtctcctggaagaacaaggagctaaagtgcggcagcgggatctttatcaccgacaacgtacacacatggacggagcaatataaattccagcccgagttcccctccaaactggcgagcgccatcaaaaaggcccacgaagaggggatctgcgggattcgtagcgtcactagactcgagaacctaatgtggaagcagatcacccccgagctgaaccacatcctgtccgagaatgaggtgaagctgaccattatgaccggcgatattaaggggattatgcaggcgggcaagcggagtctgcgtccgcaacccacggagttaaagtactcttggaagacctggggcaaggccaaaatgctgagcactgagtcccacaaccagaccttcctgattgatgggcccgaaacggcggagtgcccgaataccaaccgggcctggaacagcctcgaggtggaggactacggcttcggggtcttctccaccaacatttggctcaagctgcgcgagaagcaggatgtgttctgcgattcaaagttgatgtcggccgccatcaaggacaaccgggccgtgcacgcggacatgggctactggattgagagcgccttaaacgacacctggaaaatggagaaagcttcgttcatagagatcaagagctgtcactggccaaagtcccacaccctgtggagcaacggggtcttagagtccgagatgattatacccaagaacttcgccgggcccgttagccagcacaattaccgcccgggctaccacacacagaccgccgggccctggcacctgggcaagctggagatggacttcgacttctgcgaagggaccactgtagtcgtgacggaggactgcggcaaccggggcccctcccttcgcaccaccaccgcgtctggcaagttgatcacggagtggtgctgccgaagctgcaccctgcctccgctccgataccggggagaggacgggtgctggtacggcatggagatccgcccgctgaaggagaaggaggaaaacctggtgaactccctcgtcactgccggccacggacagatcgacaacttcagcctgggcgtcttggggatggctctcttcctggaggaaatgctgcggacccgcgtgggcacgaaacacgccatcctcttagtcgcggtgtccttcgtgacccttattacgggaaacatgagcttccgggacttaggccgggtcatggtgatggtgggggccacaatgacggacgacatcggtatgggcgtcacatacctagccctgctcgccgccttcaaggtccgccccacctttgcggccggtctgctgctccggaagctgacctcgaaagagcttatgatggcaactatcggaatagccctcctgagccagtccaccatccccgagacgatcctggagctcaccgatgcgctggcgctggggatgatggtgctcaagatcgtcagaaacatggagaagtaccagctggccgtgacgataatggccatcagttgcgtgccgaacgcagtaatactgcagaacgcctggaaggtgagctgcactatcctcgcggccgtatcagtctcgcccctgttgttgacttcctcccagcagaaggccgactggatccccctggccctgaccataaaggggctaaaccccacggcgatctttctgaccacactttctaggacctccaagaagcgcagttggccgctcaatgaggccgttatggccgtcggcatggtgagtattctggccagctccctgctcaaaaacgacatccccatgacggggccactggtagcgggcgggctccttaccgtctgctacgtgctgaccgggcggagtgctgacctggagctagagaaggccgccgacgtgaagtgggaggatcaggccgaaatcagcgggtccagccccatcctgtccatcaccatcagcgaggatggctccatgtcgatcaagaacgaagaagaggagcacacgcttaccatcctcatacgcaccggattgttggttatttcaggggtattcccggttagcatccccattaccgccgcggcctggtacctctgggaggtcaagaagcagcgggccggagtgctgtgggatgtgccaagcccaccgcctgtcgggaaggccgagctggaggacggtgcctatcgtatcaagcagcgggggattttcggctatagccagatcggcgcgggagtctacaaggagggtacattccataccatgtggcacgtcacccgcggggccgttctgatgcaccggggaaagcgcattgagccatcctgggccgatgtgaagaaggacctgatctcatacgggggcgggtggaagctcgagggtgagtggaaggaaggcgaggaggtacaggttttggccctggagcccggaaaaaatccccgggccgtgcaaactaagcccggcctgttcaagacgaacacggggaccataggcgcggtatccctcgacttcagccccggcacctccggtagtcccatcgtcgaccgcaagggcaaggtggtggggctgtacggtaacggcgtcgtcactcggtccggagcttacgtgagcgcgatcgcccaaacggagaaaagtattgaggacaacccggagatcgaagacgacatctttcgcaaaaagcggctgaccatcatggacctccatcccggcgcggggaaaaccaaacgctacctgcccgccatcgtccgtgaagcaatcaagcgcggcctgcggaccctgattctcgccccgacgcgcgtggtggccgcggagatggaggaagcccttcgcgggctacccattcgatatcagacccccgccataagggccgagcacaccggccgtgaaattgtggatctcatgtgccacgccaccttcacgatgcgcctgctgagtcccgtacgtgtgccgaattacaaccttatcatcatggacgaggcacactttacggaccccgccagcatcgccgcccgtggctatatttccacacgggtcgaaatgggtgaggctgcgggtatcttcatgacggccacgccgcccggctcacgggatccgtttccccaatctaacgcccccatcatggacgaggaacgggagatccccgagcgaagctggaactccggccacgagtgggtgaccgacttcaagggcaagaccgtgtggttcgtcccctcgatcaaagccggcaatgacatcgcggcctgcctccggaagaacggcaagaaagtgatccagctatcccgcaagaccttcgacagcgagtacgtgaagacacgagccaacgactgggacttcgtcgtgaccaccgacatttcagaaatgggggccaactttcgcgcggagcgcgtgatagacccgcgccggtgcatgaagcccgttatcctcactgacggcgaggagagagtgatccttgcggggcccatgccggtcacgcattcttccgccgcccaacggcgtggccgcatcgggcggaaccctaagaatgagaacgaccagtatatctacatgggagagcccctcgagaacgacgaggactgcgcccactggaaagaggccaagatgctcctggacaacatcaacacccccgagggaattatcccgagcatgttcgagcccgagagagagaaggtcgacgcgatagacggggagtataggctgcggggcgaagcccggaagacgttcgtggacctcatgcgccgcggagacctgcccgtgtggctggcctaccgcgtcgccgcagaggggatcaactacgctgaccggcgttggtgctttgacgggatcaagaacaaccagatattagaggaaaacgtcgaggtggagatatggacgaaagagggggagcggaagaagctaaagcctagatggctggacgccagaatctattccgaccccctcgcgttaaaggagtttaaggagttcgccgcgggacgtaaatcgctgacgctcaacctcatcaccgagatggggcggctcccaacctttatgacccagaaggctcgcgacgcccttgacaacctggcagtcctccacacggccgaagttggagggcgggcgtacaaccacgccctctccgagctgcccgagaccctggagaccctcctgctgctcaccctgctggcgacggtcaccgggggcatcttcctcttcctgatgtcagggaagggcatagggaagatgacgctgggcatgtgctgcatcatcactgcctcaatcctcctgtggtacgcccagatccagcctcactggatcgccgcctccatcatcctggagttcttcttaatcgtcctgctgatccccgagcccgaaaaacagcgcaccccccaggacaaccaactgacgtacgtggtgattgccatcctaaccgtggtggccgctactatggccaacgagatggggttcctggaaaagacaaaaaaggacttgggcctgggctccatcacaacccaggagagcgagtccaacatcctggacatcgacttacgcccggcctccgcatggaccctgtacgccgtcgccaccacgttcgtgacccccatgctacgccactccatcgaaaactccagcgtgaacgtctccctcaccgccattgcgaaccaggccacggtgctcatgggcctgggccgggggtggcccctcagcaagatggatataggtgtgcccttgttagccatcgggtgttactcccaggtcaacccgatcactttgaccgcggccctgctgctcttagtcgcccactacgccattatcgggcccggcctgcaggcaaaggcgacgcgcgaggcccagaagcgcaccgccgccgggatcatgaagaatcccacggtggacggcatcaccgtcatcgacctcgaaccgatcccgtacgaccccaagttcgagaagcagctgggccaggtaatgttgctcgtgctgtgcgtcacccaggtgctgatgatgcggaccacctgggccctctgcgaggcactgaccctggcaaccggccccatcagcaccctatgggagggcaaccccgggcgcttctggaacacaaccatcgccgtttccatggccaacatttttcggggctcctacctggccggggcgggactcttattttccatcatgaagaacaccaccaacacgcgccgggggaccggcaacatcggcgagacgctgggagagaagtggaaatcgcgcctgaacgccttgggcaagtcggagttccagatatacaagaagtctgggatccaagaggtcgaccggaccctggccaaagagggcattaaacggggagagacggaccatcacgccgtgtcccgggggtcagcgaaactgcgctggtttgtggagcgaaacatggtcaccccagagggtaaggtggtagacctcgggtgtggccgcggtggctggagttactactgcggaggactgaagaatgtccgggaggttaagggcctgactaagggagggcccgggcacgaagaaccgatccccatgtctacctacggctggaacctagtgcgcctacagtccggggtcgacgtgttcttcactccgccagaaaagtgcgacacactcctctgcgacatcggcgagagtagcccaaaccccaccatcgaggctggccgaacactgagagtattgaacctcgtcgagaactggctcaacaacaacacccagttctgcgtgaaagtgctcaacccgtacatgccctccgtcatcgagaagatggagacgctccagagaaagtacgggggcgcactggtgcgcaaccccttgtcccgtaactccacccacgagatgtactgggtgagcaacgccaccgggaatatcgtctccagcgtaaacatgatctcccgaatgcttattaaccgcttcaccatgaagcacaagaaagcaacatatgagccggatgtggacctgggctcggggacccggaatattggtatcgagaatgaaatccccaatctcgacatcatcggcaaacgcattgaaaaaatcaagcaagagcacgagacctcctggcactacgaccaggaccatccctacaaaacgtgggcataccacgggagctatgagacgaagcagaccggctccgccagctctatggtcaacggggtggtaaagcttctcaccaaaccctgggacgtcgttccaatggtgacccagatggccatgaccgacaccacccccttcggccagcaacgggtattcaaggagaaggttgacacgagaacccaggaaccaaaagagggcactaagaaattgatgcggattacggccgagtggctgtggaaggagctcggtaagaagaaaacgccacgcatgtgcacgcgagaagagttcactcgcaaggtacggagcaacgccgcgctgggtgccatcttcaccgacgagaacaagtggaaatctgcgcgcgaggcggtcgaggatagccgtttctgggagcttgttgacagggagcggaacctacatttagaggggaagtgtgagacctgcgtctacaacatgatgggtaaacgcgagaagaagctgggggagttcgggaaagcgaagggctcccgggcgatctggtacatgtggttaggggcccgcttccttgagttcgaggccctgggctttctcaatgaggaccactggttcagccggggcaactccctgagcggagtggagggggagggactacacaagctcgggtacatattacgcgacgtgagcaagaaggagggcggggccatgtacgcagatgacacggccggttgggacacccggatcaccctggaagatctaaagaacgaggagatggtcaccaaccacatgaaaggcgaacacaagaagcttgccgaggccatcttcaaactgacgtatcaaaacaaggtggtgcgcgtccagcggccgacgcccagagggaccgtcatggacatcatctcccgaaaggaccagagaggcagcggccaggttgggacctacggcctcaacacgtttaccaacatggaggcccagctgatacgccagatggagggggagggaatcttcaaatccatccagcggctgaccgtcaccgaagagatagcggtgcagaactggcttgcccgcgtgggccgggagcgcttgagtcggatggccatttctggcgacgactgtgtcgtcaagcccctggacgaccgcttcgccagcgccctcacggccctgaacgacatgggtaaggtgcgtaaggacatccaacagtgggagccttcccgaggttggaacgactggacccaggttccgttttgctctcaccactttcacgagctggtgatgaaggacggccggatgctcgtagtaccctgccgcaaccaagacgagctgatcgggagggcccgcatctcacaaggggccggatggtctctgaaagaaactgcctgcctagggaagtcctatgcccagatgtggaccttaatgtacttccaccggcgagacctgcggttagcggcaaacgcaatttgcagcgcggtgccatcccactgggtgcccaccagccgtacgacctggagcatccatgcgaagcacgagtggatgacgaccgaggacatgttggccgtatggaaccgggtgtggatccaagagaacccatggatggaggacaagacgcccgttgaaagctgggaggaggtcccctacctgggcaagcgcgaggaccaatggtgcggatcactcatcggcctgactagcagagccacctgggccaagaacatccagaccgccatcaaccaggtgaggagcctgatcgggaacgaggagtacacggactacatgccttccatgaagagatttcggaaggaggaggaggaggcgggcgtgctatggtga

SEQ ID NO: 25217 - RNA, 9876 nt, synthetic construct
  misc_feature 1..9876: note = derived and/or modified CDS sequence (opt11) from DENV-2__EU596490__SS-prME
  source 1..9876: mol_type = other RNA
accgccggagtaattattatgcttatccccacagtcatggcgttccacctcacgacccgcaacggtgagccccacatgatcgtaggccggcaggagaaggggaagtccctgctgttcaagaccgaagatggagtcaatatgtgcaccttaatggcgatcgacctgggagagttgtgcgaggataccatcacatataaatgccccctcctgcgccagaacgagcccgaggacatcgactgctggtgcaactcgaccagcacctgggttacctatggcacctgcaccaccactggcgaacaccggagggaaaagcggtccgtggccctggttccccatgtcgggatgggcctcgagacccgaaccgagacctggatgtccagcgaaggggcctggaagcacgttcagcggatcgagacgtggattctgcgccatcctggcttcactattatggcagcaatcctggcgtataccatcgggaccacgcacttccaacgggccctcatcttcattctgctgaccgctgtggccccctcgatgaccatgcgctgtatcggcatctccaaccgggacttcgtagagggggtgagcgggggctcttgggtggacatcgtcctcgaacacgggagctgcgttaccacgatggcgaagaacaagcccacactggatttcgagctgataaagaccgaggcaaaacagccggctaccctccgcaagtactgcattgaggccaagctgactaacaccactaccgaaagccggtgcccgacacagggtgaacccagcctgaacgaggagcaggacaaacgcttcatttgcaagcactccatggtggataggggttggggtaacggctgcggtttattcggcaagggcggtatcgtgacctgtgccatgttcacgtgcaaaaagaacatggagggtaaggtggtgcttcccgaaaatctggaatacaccattgtgatcacgccccactctggggaggagcatgcggtcggcaacgacaccgggaagcacgggaaggagataaagataaccccgcagtccagcatcaccgaagccgagttaactggctacgggacggtgaccatggagtgctcgccccgaacaggacttgattttaacgagatggtcctgctccagatggaagacaaggcctggctagtgcacagacagtggtttctggacctccccctgccctggctgccaggagcggatacacagggcagcaactggatacaaaaggaaacacttgtgaccttcaagaatccgcacgccaagaaacaggacgtcgtggtcctggggagtcaggaaggcgcgatgcacaccgcactgacaggggccacggagatccagatgagcagcggcaacctcctgttcaccggccatttgaagtgcaggctccgtatggacaaactgcagctgaaggggatgtcctactcaatgtgcaccggcaaattcaagatagtgaaagagattgccgaaacccagcacgggaccatcgtaatccgcgtccagtacgagggcgacggctccccctgtaaaatcccattcgagatcatggacttggaaaagaggcacgtgctcgggcgcctgatcacagtgaacccgatagtcacggagaaggactcacccgtgaacatcgaagccgagccgcccttcggagactcctacatcattatcggtgtggagccgggccagcttaagctgaattggttcaagaaggggagctcaatcggccagatgttcgagaccacgatgcgcggcgcgaaacgcatggccatcctcggggataccgcctgggatttcggctccctggggggagtcttcactagcatcgggaaagccctccaccaggtgttcggcgcgatctacggtgcggccttctctggggtgtcctggaccatgaagatcctgattggcgtcatcataacgtggatcggcatgaactcccgctccaccagcctgtccgtgtcactcgtcctggtcggtgtggtgactctgtatctcggggtgatggtgcaggccgacaccggctgcgtggtcagttggaagaataaagagctgaagtgcggcagtgggatattcataacggacaacgtgcacacttggaccgagcagtacaagtttcagccggaatccccgagcaagctggcaagcgcgatccagaaagcgcacgaggagggtatctgtgggatcaggagtgtgaccaggctcgaaaatttgatgtggaagcagatcacgcctgaactgaaccacatcctgagcgagaatgaggtcaaactgaccataatgaccggcgacataaagggtataatgcaggcgggcaagcggagtttgcgcccccagccgaccgagctcaagtactcatggaaaacgtggggcaaggccaagatgctgtccacagagagccataaccaaaccttcctcatagacgggcccgagaccgctgagtgcccgaatacgaatcgggcgtggaattccctcgaggtggaggattacggcttcggggtgttctcaaccaacatctggttgaagctgagagagaagcaagacgtcttctgcgactccaaactcatgagtgccgcgatcaaggacaaccgcgccgtgcacgccgacatgggctactggatcgagtccgcgctgaacgacacctggaagatggagaaggccagcttcatcgagattaagtcctgccactggccaaagtcccacaccctgtggtccaatggcgtgctagagtcggagatgatcatacccaagaacttcgccggccccgtctcccagcataactaccggccgggctaccacacccagactgcagggccatggcacctgggcaagctggagatggacttcgatttctgcgagggaacaaccgtggtagtcaccgaggattgcggtaacaggggccccagcctccgcacgacaaccgcaagcggtaagctgataaccgagtggtgctgcaggtcctgcacgctgccgccgctcaggtaccggggcgaagacgggtgttggtacgggatggagatccgccccctgaaagagaaggaggagaacctcgtaaattcgctcgttaccgcggggcacggccagatcgacaacttctccctgggggtcctgggcatggcactcttcttggaggaaatgctgcggaccagagtgggcaccaagcacgccatcctcttagtggccgtcagcttcgttactctgattaccggtaacatgtcctttcgggacctcggccgagtgatggtaatggtgggggcgacgatgaccgacgatatcggcatgggcgtgacgtatttggccctgctcgccgctttcaaggtccgccccacattcgcggccggcctgctgctccggaagctgacctcgaaggagctgatgatggcgaccataggcatcgccctcctgtcccagagcacgatccccgagaccatcctggagctcaccgacgcgctagccctgggaatgatggtgctcaagatcgtgcgcaacatggaaaagtaccaacttgctgttacgattatggccatctcctgtgtgccgaacgccgtgatcctgcaaaacgcatggaaagtcagctgcacgatcctcgcagcggtgtctgtcagccccttactcctaacctccagccaacagaaggccgactggatcccactggcgcttaccatcaagggcctcaaccccacggccatcttcctgacgaccctgagccgtacctccaaaaagcgatcctggcccttaaacgaagcggtgatggccgtgggaatggtctctatccttgcctcctcgctactcaagaatgacatacccatgaccgggcctctggtcgccggcgggttactcacggtgtgctacgtcctgaccgggcggagcgccgacctggagctagagcgagccgccgacgtgaaatgggaagaccaggccgagatcagtgggtcatccccaatcctgagcatcacaatctcagaggacggcagtatgtccatcaagaacgaggaggaggaacataccttgacgatccttatccggacgggcctgctggtgattagcggggtcttcccggtctccataccaatcaccgcagccgcgtggtatctctgggaggtgaagaagcagcgcgccggcgtcttgtgggacgttccatcgccgcctcccgtggggaaggccgaactagaggacggagcctatcggatcaagcagcgcgggatctttggctactcccagatcggagccggggtctacaaggagggcaccttccacaccatgtggcatgtgacgcgtggggcggtgctcatgcaccgcggcaagcggatcgagcctagctgggccgacgttaagaaggacctgatctcctacgggggcggctggaagctggagggggagtggaaggagggggaggaggtccaagtcctcgccctggagcccggcaagaaccctcgggccgtccagaccaagcccggccttttcaagacgaacaccgggacaatcggggccgtgtccctcgacttctccccgggcaccagcgggagtcccatcgttgaccggaaaggcaaagtggtggggctgtacggcaacggggtcgtcacacgctcaggggcgtacgtgtccgccatcgcccaaacggagaagagtatcgaggataatcccgaaatcgaggacgacatcttccggaagaaacgcctgactatcatggacttacaccccggcgcagggaagaccaagcggtacctgccagcgatcgtccgcgaagccatcaagaggggcctgcgcacactgatcctggcccctacccgcgtcgtggccgcggaaatggaggaggcgctgcgggggctgccaatacgctaccagacgcccgccatccgggccgagcacacgggcagggagatcgttgacctcatgtgccatgccactttcaccatgagactgctgagccccgtccgcgtgccgaactataaccttatcatcatggacgaggcccactttacggacccggcgtccatcgcagcccggggctacatctcaactcgcgtagaaatgggggaggcagccggcatcttcatgaccgcgacgccccccgggtcccgggacccattcccccagagcaacgccccgatcatggacgaagagcgcgagatccccgagcgctcctggaacagcggccatgagtgggtcacggatttcaaagggaaaaccgtgtggttcgtaccaagtatcaaggctggcaacgacatcgccgcgtgcctgaggaagaacgggaagaaggtcatccagttgagccggaaaacctttgactccgagtacgtgaagacacgtgcgaacgactgggacttcgtggtcacgaccgacatcagcgagatgggcgcaaacttccgggcagagcgcgtgatcgacccccggaggtgcatgaagcccgtgatattaacggacggcgaggagcgggtcatcttggccgggcccatgccggtgacccactcctctgccgcccagcgccgcggccggatcgggagaaaccccaagaacgagaacgatcagtatatctacatgggcgagcccttagaaaacgacgaggactgtgcccactggaaggaagccaagatgctcctggataatatcaacacgcccgagggcatcatcccgagcatgttcgagcccgaacgggagaaggtcgatgccatcgatggggagtaccgtctgcgtggggaggcgcgcaagacctttgtcgatctcatgcggcgaggggacttacccgtgtggctggcctaccgcgtggccgccgagggaatcaactacgctgaccgtcggtggtgtttcgatgggatcaaaaacaaccagatcttagaagagaacgtcgaggtggaaatatggaccaaggaaggcgagcggaaaaagctgaagccgcggtggctggacgcgcgaatctattccgatcccctcgcactaaaggagttcaaggagtttgccgccggccggaagtcactgacattgaaccttataactgagatgggccgcctacccaccttcatgacccagaaggcgcgggacgccctcgacaacctggccgtcctgcacaccgccgaggtcggcggccgcgcctacaaccacgcgttaagcgagctgcccgagacgctggagaccctcctgctgctgaccctgcttgccacggtgacgggcggcatcttcctctttctaatgtccgggaagggcatcgggaagatgaccctaggcatgtgctgcatcatcacagcctctatcctcctgtggtacgctcagatacagccccactggattgccgcgtccattatcctggaattcttcctcatcgttttgctgatacccgagcccgagaagcagcggacaccccaggacaaccagctcacctacgtggtgatcgccatcctgacggtcgtggccgccaccatggcgaacgagatggggtttctggagaagaccaagaaagacctcggcttaggcagcatcaccacgcaagagagcgagtccaacattctggacatagacctacgcccggcgagtgcctggacactctacgcggtggctacgaccttcgtcacgccaatgctgcggcactccatcgaaaacagttccgtgaacgtgagcctcaccgccatcgcgaaccaggccacggtattaatggggctgggacgcggctggcctctctccaagatggacgtgggcgttcccctgctggcgatagggtgctacagccaagtgaacccgataacgctcacggccgcgctgctgctcctggttgcccactacgccattatcggtcccgggttgcaggccaaggccactcgggaagcgcagaagcggaccgccgccgggataatgaagaatccgactgtggacggcatcacggtaatcgacctcgagcccatcccgtacgatcccaaattcgagaaacagctgggccaggtgatgcttctagtgctgtgcgttacccaggtgctcatgatgagaactacctgggccctctgcgaggcccttacgctggctaccggccccatttccaccctttgggaggggaaccccggcagattctggaacacaacgatcgccgtgtctatggctaacatattccgcggctcctatttagccggggctgggctcctctttagcataatgaagaacaccactaacacccgacgggggacgggcaacatcggggaaactttgggggagaaatggaagtcccggctgaacgctctgggaaagtcggaattccaaatctacaagaagtccgggatccaggaggtcgaccgcaccctggccaaggaaggcataaagcgaggtgagaccgatcaccacgccgtgtcccgcgggtccgcaaagctgcgttggttcgtcgagcgaaatatggtcaccccggagggcaaggtcgtagacctcgggtgcggccgcggcggatggagctactactgcggcggcctgaaaaacgtccgggaagtgaaggggctgaccaagggcggtccaggtcacgaggagcccataccgatgtccacctacgggtggaacctcgtgcggttacagagcggggtcgatgtcttcttcactccgcccgagaagtgcgacacgctcctctgtgacatcggcgagtcatcaccgaaccccaccatagaagcggggcgcactttgcgggtgctgaaccttgttgaaaactggctgaacaacaacacccagttctgtgtgaaggtgctgaacccgtacatgccctccgtcatcgagaaaatggagaccctccagcgcaaatacgggggagccctagtgcggaaccccctgtccaggaacagcacgcatgagatgtactgggtgtccaacgccaccggaaacatcgtctcttccgtgaacatgatcagccgcatgttgatcaacaggttcaccatgaagcacaagaaggccacatacgagccggacgtggaccttggctccgggacgcgcaacataggcatcgaaaacgaaattcccaacctagacatcatcggcaagcggatcgagaaaatcaaacaggagcacgagaccagctggcattacgaccaggaccacccctataagacttgggcctaccatgggtcatacgagaccaagcagacgggcagcgctagcagcatggtgaatggggtggtaaagttactcacgaagccatgggacgtcgtgccgatggtgacccagatggccatgaccgatacaacccccttcggtcagcagcgcgtcttcaaggagaaagtggacacccggacacaggagcccaaggagggtacgaagaagctgatgcgcatcaccgccgaatggttgtggaaggaactcgggaagaagaagacgccccggatgtgtacgcgtgaggaatttacgcggaaagtccgctctaacgcggccctgggcgcgattttcaccgacgagaacaagtggaagtccgccagagaagcagtggaggactcccgcttctgggagctggtggatcgggagcggaacctccacctggaggggaagtgtgaaacctgcgtctacaacatgatgggcaagagggagaagaagctcggggagttcggcaaggccaagggcagcagggccatctggtacatgtggttaggggcgcgattcctggagttcgaagccctagggttcctcaacgaagaccactggttctcccgcggcaatagcctgagcggcgtggagggagagggcctccacaagctggggtacatcctgcgggatgtgtccaagaaggaggggggggccatgtacgctgacgacacggcggggtgggacacgcggatcacgttggaggacctcaagaacgaggagatggtcaccaaccacatgaagggcgagcataagaagctcgcagaggccattttcaagctgacctaccaaaataaagtagtgcgggtccagagacctacaccccggggaaccgtgatggatatcataagccggaaggaccaacgcggctccggccaggtggggacctacggactcaacacctttacgaacatggaggcacaactgatccgacagatggaaggggagggaatcttcaagagcatccaacgtctgaccgtcaccgaggagattgccgtgcaaaactggctcgcaagagtaggccgcgagaggctgtcccgcatggcgatcagcggggacgactgtgtcgtaaaaccactggacgaccggttcgcctccgcgctcacagccctgaacgacatgggcaaggtgcgcaaggacatccagcagtgggagcccagccgggggtggaacgactggacgcaagtaccgttctgctcccatcacttccacgagctggtgatgaaggacggcagagtgctcgtcgtgccatgccggaatcaggacgagctgatcggccgcgcgcggatcagccaaggtgccggctggtccctgaaggagacagcttgcttaggcaaaagctacgcccagatgtggacactgatgtattttcaccgccgggacctacgcctcgccgcgaacgctatttgctcagcagtaccatcccactgggtcccgacctccaggaccacgtggagcatccacgccaagcacgagtggatgaccaccgaggatatgctggccgtgtggaaccgcgtgtggatccaggaaaacccatggatggaggacaagacgcccgtcgagtcctgggaggaagtgccctacctgggcaagcgcgaggatcagtggtgcgggagcctcatcggcctgaccagccgggcgacatgggccaagaacatccagaccgcgatcaaccaggtgcgctcgctgatcgggaacgaagagtataccgactacatgcccagcatgaagcggttccgcaaggaagaggaggaggccggggtcctctggtga

SEQ ID NO: 25218 - RNA, 9876 nt, synthetic construct
  misc_feature 1..9876: note = derived and/or modified CDS sequence (opt11) from DENV-2__EU596491__SS-prME
  source 1..9876: mol_type = other RNA
accgcgggtgtgataatcatgctcatcccaaccgtgatggcattccacctcaccactagaaacggggagccccacatgatcgtcgggcggcaggagaaagggaagtccctgctttttaagaccgaggacggtgtgaacatgtgcaccctcatggcaatcgacttgggcgagctgtgcgaagataccatcacatacaagtgccccctcttacgccagaacgagcccgaggatatagattgctggtgcaacagcacatccacctgggttacatacgggacctgcaccacaacgggggagcaccgacgcgagaaacggtccgttgccctagttccccacgtcgggatggggctggagactcggacggagacatggatgtccagtgagggggcctggaagcacgtgcagcggattgagacctggatcctgcggcacccgggcttcaccatcatggcagccatcctagcctataccatcgggaccacgcatttccaacgggcgctaatttttatcctgctgaccgcagtggcccccagcatgaccatgaggtgcatcggcatctccaaccgtgacttcgtagaaggcgtcagcggaggctcatgggtggatatagtgctggagcacggtagttgcgtgaccactatggcgaagaacaagcccacgctggatttcgagctgatcaagactgaggcgaagcaacccgcgaccctccgcaagtactgtatcgaggccaagttgacgaataccaccaccgagtccagatgtccgacgcagggtgagcccagcctgaacgaagaacaggacaagaggttcatctgcaaacacagtatggtggatcggggctgggggaacggctgtgggctgttcggcaaaggtggcattgtaacctgcgcgatgttcacgtgcaagaagaatatggagggtaagattgtgcagcccgaaaacctggagtataccatcgtgatcacgccccacagcggggaagaacacgctgtaggcaacgataccggtaaacatggcaaagaaatcaagatcaccccgcaatccagcaccacggaggccgagttgactggatatggcacagtgaccatggagtgctcaccacgaaccggcttggatttcaacgagatggttctgctgcaaatggaagacaaagcctggctcgtccatcggcagtggtttttggacctgccactcccttggttaccgggcgccgacacgcaagggtcaaactggatccagaaggaaaccctcgttaccttcaagaatccccacgccaagaaacaggacgttgtcgtgctcgggtcccaagagggtgctatgcatacggccctgacgggggcgaccgaaatccagatgagctcaggcaaccttctgttcaccggccacctgaaatgtcgcctgaggatggacaagctccagctgaagggaatgtcttactctatgtgcaccggaaagtttaagatcgtcaaggaaatagccgaaacgcagcatggtacgatcgtgatccgcgtgcaatacgaaggcgatggctccccctgcaagatccccttcgagatcaccgacctggaaaagagacacgtgctcgggaggctgattaccgttaatcctatcgtcacagaaaaggacgcccccgtcaatatcgaggccgagccgccgttcggtgacagctacattatcgtgggggtggaaccgggtcaattgaaacttaattggttcaagaaagggtcgagcatcggccagatgttcgagaccacgatgcgcggcgctaaacggatggccattctgggggacaccgcatgggactttggctccctcggcggagtcttcacctccatcggaaaggcactccaccaagtcttcggagcgatctacggcgccgccttctcaggggttagctggacgatgaaaatcctgatcggcgttatcataacctggatcgggatgaactcgcgttctacatccctgagcgtgtccctggtgctagtcggcgtggtgacgctgtatctgggggccgtggttcaagcggactctggttgcgtcgtgtcgtggaagaataaggagctcaaatgcggcagcgggatattcatcacggacaacgtgcacacctggaccgagcagtataagttccagcccgagtccccctcaaagctggcctcggccatacaaaaagcccacgaagagggcatctgcggaattaggtcagtaaccaggctggagaacttaatgtggaagcaaatcactccagaactgaaccacatcctgagcgagaacgaggtcaagctcaccatcatgaccggcgacatcaaggggataatgcaggccggaaagcggagcctgcgccctcagccaacggaactgaagtactcttggaaaacctggggcaaggccaagatgctctccacggagagccataaccagacgttccttatcgatgggcccgagactgcggagtgccctaacaccaatcgggcatggaactccctagaggtggaagactacggctttggggtgtttaccactaatatatggcttaagctgcgcgagaagcaggatgtcttctgcgatagcaagctgatgtccgcggccatcaaggataaccgggcagtgcacgccgacatgggctactggatcgagtctgcacttaatgacacatggaagatggagaaggcctcgttcatagaggtcaagagctgccactggccaaaatcccacaccctgtggagcaacggcgtactagagagcgaaatgatcatacccaagaactttgcggggccggtgagccaacataattatcgcccaggttaccacacccagacggcaggaccctggcacctgggcaagctggagatggacttcgacttctgcgaaggaaccacggtagtagtgacagaggactgcggcaaccggggaccgtccctccgcaccacaaccgcgagcgggaaacttataaccgagtggtgctgccggagttgcaccttgcccccgctgcgctatagaggcgaggatggctgctggtacgggatggagattcgcccactcaaggagaaggaagagaacctagtgaactccctggtcaccgcgggtcacggtcagatcgataacttctccctgggcgtcctggggatggccctgttcctcgaagagatgttgcggacacgggtgggcaccaagcatgcgaccctgctcgtcgccctatcatttgtgactctgataacgggaaacatgtcgttccgggatttgggtcgagtgatggtcatggtgggggcaacaatgactgacgatatcgggatgggcgtaacgtacctggccctgttagccgcatttaaagtccgccccacgtttgccgccggcctgttactccgcaaacttacctccaaagagcttatgatggcgaccattggcatcgccctcctgagccagtccaccctgccggagacgattctagagctaaccgacgcgcttgccctcgggatgatggttctgaagattgtgcgcaacatggaaaaatatcaactggctgtaaccatcatggccattagctgcgttccgaacgccgttatcctacagaatgcctggaaagtcagctgcactattttagccgccgtgagcgtgtcgccacttctcctaaccagctcacagcagaaggctgactggattccgctggcgctcaccatcaaggggctgaaccccaccgcaattttcctgaccacgctcagccgtacctccaagaagcgctcatggccgctgaacgaggctatcatggccgtgggaatggtctccatcttggcaagttccctcttgaaaaacgatattccgatgaccgggccgctcgtcgctggcgggctcctaaccgtgtgctacgtgttaacggggcggtcagcggacctcgaactggagcgcgccgccgacgtcaagtgggaggaccaggccgagatctccgggagtagccccatcctatccattaccatcagcgaggacggatctatgtcgattaaaaacgaagaggaagaacagaccctcaccatcttgatcagaaccggcttgctcgtcatttccggggttttcccggtcagtatccctataacagcggcggcctggtacctatgggaggttaagaaacaacgcgccggcgttctttgggacgtcccctccccaccgcctgtagggaaagccgagctcgaggatggagcgtaccgaatcaagcagagggggattcttggctactcacagatcggcgccggggtgtacaaggagggcaccttccacaccatgtggcacgtcacccggggtgcggtgctgatgcacaggggcaagaggatcgagccatcatgggccgacgttaaaaaggacctaatatcttacgggggcgggtggaagctggagggtgagtggaaggagggcgaggaggtccaagtattggctctcgagcctggcaagaacccacgcgcagttcagacaaagcccggcatcttcaaaaccaacaccggaacaatcggcgccgtctccctagatttcagcccaggcacgtccgggagccccatcgtagaccgcaagggaaaagtcgtcgggctctacggaaacggcgtggtgaccagaagcggggcttacgtctcggccattgcgcagaccgagaagtccatcgaagacaaccccgaaatagaggatgacatcttccggaagaagcgcctcaccatcatggacttacaccccggcgcgggaaaaacgaagcgctacttacccgccatcgtgcgcgaggctatcaagcgtggtctccgaaccctgatcctggccccgacacgcgtggttgcggccgaaatggaggaggccttgagaggactcccaatcagataccagaccccagcgatccgggccgagcacacgggacgcgagatcgtggacctgatgtgccatgcgaccttcaccatgcgactgctcagccccgttcgcgttcccaactataacctgatcataatggacgaggcacacttcaccgaccccgcgagcatcgccgcacgaggatacatctccacccgcgtggaaatgggtgaggcagctggcatcttcatgaccgccacgccgccggggagccgggacccgttccctcagtccaatgcgcccattatagacgaggagcgcgagatccccgaacggtcttggaactcaggccacgagtgggtgaccgacttcaaggggaagacggtttggttcgttcctagcatcaaggcgggcaacgacatcgctgcttgtctgcgcaagaacgggaaaaaggttatccagctctcccggaagaccttcgacagcgagtacgtcaaaacgcgcgccaacgactgggactttgtcgtaaccacggatatcagtgaaatgggagctaacttcaaggcagaacgggtcatcgacccgcggcggtgcatgaagccggtgatcctaaccgatggcgaggagcgtgtgatcctggccgggcctatgccggtcacccactcttcagccgcccagcggcgcgggcgcattgggcggaaccccaagaatgagaatgaccagtacatctacatgggagagccactcgagaatgatgaagactgcgcgcattggaaggaggcgaagatgctgttggacaatatcaataccccggaggggataattccgagcatgttcgagcccgagagggaaaaggtggacgccgtggacggggagtaccggctgcgcggggaggcacgtaagacattcgtagacctgatgcgccgcggagatctgcctgtgtggctcgcctacaaggtggcagcggagggcatcaattacgccgaccgcaagtggtgcttcgacgggataaagaacaatcaaatccttgaggaaaacgtcgaggtagagatctggactaaggagggcgagcggaagaaactgaaaccacgctggctcgacgctcggatttactccgacccgctggccttgaaagagttcaaagagttcgcggccggtcgcaagagcctcacgcttaatttgatcaccgagatgggccggttacccaccttcatgacccaaaaggcccgaaatgcactggacaatttggcggtcctccacaccgcggaggtcggtgggagggcccataaccacgcgctgagcgagttacctgagaccctcgagactctgctgctcctcactttactcgccaccgtgaccggcgggatcttcttattcctaatgagcgggaagggaatcggaaagatgaccctcggcatgtgctgtattataacggcgtccattttactgtggtatgcgcaaattcagccgcactggatcgcagccagcatcatcctcgagttctttcttattgtcctgctcattccggagcccgaaaagcagcgcacgccgcaagacaaccaactgacctatgttgttatcgcaatactgaccgtagtagccgctacgatggcaaacgagatggggtttctcgagaaaaccaagaaggacctcggcttcggatctattacaacacaggagtccgaaagtaacattctggacatcgacttgcggcccgcctccgcctggacgctgtacgccgtggccaccacattcgtgacccccatgctgagacacagtatcgagaactccagcgtcaatgtgtcgctcacggcaatagcaaaccaggcgaccgttctgatgggtttagggaaaggctggcccctcagcaagatggacataggggtgcccctcctggcgatcgggtgctattctcaggtgaacccgataaccctcaccgcagccctgctgcttctggtcgcccattacgccatcatcggtcccgggctgcaagcgaaggccacccgggaggcccagaagcgcgccgccgcggggattatgaagaatcctaccgtggacggtatcacagtgatagacctcgagcccatcccgtacgaccccaagttcgaaaagcagctggggcaggtcatgctattgatcctgtgcgtcacccaggtgctgatgatgcggacgacctgggcactctgtgaggccttgaccttagcaacaggtcccatcagcacgctctgggagggaaaccccggccggttctggaacactaccatagcggtcagcatggccaacatcttccgcggcagctatcttgccggtgcagggttactgttttccataatgaagaataccacaaacacacggcgcgggaccggcaacgtgggcgagaccttaggggagaagtggaagtcccggctgaatgcgctaggcaagtccgaatttcagatatacaagaagtccgggatccaggaggtggatagaactctggcgaaagagggcatcaagcgcggagagactgaccaccacgcggtgtcccggggtagcgcaaagttacggtggttcgtggagcgcaacatggttaccccggaaggaaaggtcgtggacctaggttgcgggcggggcgggtggtcatactattgcggcggactgaagaatgtccgcgaggtgaagggtctgaccaagggcggccccgggcacgaggagccaatccccatgagtacatacggctggaatctcgtgcggctacagtccggggtagatgttttcttcaccccgccggaaaagtgcgacaccctgctttgcgatatcggtgagagcagtcccaaccccactatcgaggccggccgcacgctgcgggtcctgaacctagttgagaactggctaaacaacaatacacagttctgcattaaggtcctcaacccgtatatgcccagtgtgatcgagaagatggagaccctccagcgtaagtacggaggcgcgctggtgcgtaacccactctcaagaaactctacccacgagatgtactgggtgagcaacgccaccgggaacatcgtgtcgagcgtgaacatgatctccagaatgctgataaaccgcttcacgatgaagcataagaaggctacttacgagccagacgtcgacttggggagcgggactagaaacattggcatcgaatccgagatccccaatctggacatcatcggcaagcgcatcgagaagatcaaacaggaacacgagaccagctggcactatgaccaggatcacccgtacaagacgtgggcctatcatgggtcttacgagacgaagcagacgggcagcgcctcctcaatggtgaacggagtcgtccgactgctcacaaagccctgggatgtggtgccgatggtaacccagatggcaatgacggacactacccctttcggtcaacagcgggtgttcaaggagaaggtggacacgcgcactcaggagcccaaggaaggaaccaagaagttgatgaagatcaccgctgaatggctgtggaaagagcttgggaagaagaaaacaccccggatgtgcactagggaggagttcacccggaaggtccgctccaacgcggccctgggagccatcttcaccgacgaaaataaatggaaatcagcccgggaggcggttgaagatggccgcttctgggagctggtcgaccgggaacggaacctccacctggagggcaaatgcgagacatgtgtgtacaatatgatgggaaagcgggagaaaaagttaggagagttcggtaaggccaaaggatcccgggctatctggtatatgtggctcggcgcacgttttctggagttcgaggcgctggggttcttgaacgaggaccactggtttagccgcggcaactccctaagcggggtggagggcgagggattgcaccgactagggtacatcctcagggaagtcggcaagaaggaaggtggtgccatgtacgccgacgacaccgctgggtgggatacccggatcaccctggaggaccttaagaacgaggagatggtgacgaaccacatgaagggagagcataagaaactggcggaggcgatattcaagctgacctaccagaacaaggtggtgcgcgttcaacggccgacgccccggggcacggtaatggatatcatatcaaggaaggaccagcgcggtagcggccaggtcgggacctacggcttgaacactttcaccaatatggaggcccagctaatccgacaaatggagggcgaggggatcttcaagagcattcaacacctgaccgccacggaggaaattgccgtgcagaactggctcgcccgggtgggtcgcgagcggctctcccgcatggcgatcagcggggatgactgcgtcgtaaagcctatcgacgaccgttttgcctcggccctgacggccttaaacgacatgggcaaagtgcgtaaggacatccagcagtgggaaccaagcagaggttggaacgactggacccaggttccattctgctcccatcatttccacgagctggtgatgaaagacggcagggtgctggtggtgccctgccggaatcaggatgagctcatcggacgagcacggatcagccagggcgcgggctggtcgctaaaggagaccgcttgcctgggcaagagctacgcccaaatgtggaccttaatgtattttcaccgccgggatctgcgcctagccgccaacgcaatctgctccgcggtacccagccactgggtcccaacttcccggaccacctggtctatccacgccaaacacgagtggatgacgacggaggacatgttggccgtgtggaaccgcgtctggatccaggagaatccatggatggaagacaaaacgcccgtggaatcctgggaggaggtgccatatctgggtaagcgcgaggaccagtggtgcggtagcctcatcggcctcacgagccgcgcgacgtgggcgaagaacatccagacggctattaatcaagtgcggtcgctgatcggcaacgaggaatataccgattatatgcccagtatgaagcgcttccgcagggaggaggaggaggccggggttctgtggtga

SEQ ID NO: 25219 - RNA, 9876 nt, synthetic construct
  misc_feature 1..9876: note = derived and/or modified CDS sequence (opt11) from DENV-2__EU677141__SS-prME
  source 1..9876: mol_type = other RNA
acagccggtgtgatcattatgctgatccccaccgccatggcgttccatctcactacccgaaacggggagccccatatgatcgtgggccgtcaggagaaggggaagtcccttctgttcaagaccgaggacggcgttaacatgtgcacacttatggccatcgacctgggcgagctgtgtgaagacaccatcacgtataagtgcccgctcctgcgccaaaacgagcccgaggacattgactgctggtgcaatagcaccagcacctgggttacctatgggacctgcaccaccacaggggaacaccggagagagaaacggagcgtcgccctggtgccccacgtggggatgggcttagagacccgtacagaaacctggatgagcagcgagggggcatggaagcacgtacagcgcatcgagacttggatcctgcgccacccggggttcacaatcatggcagcgatccttgcctacaccatcggaacaacccacttccagcgggccctcatcttcatcctactcacagccgtggccccatctatgactatgcgctgcatcggaatctccaatcgggacttcgtggagggcgtcagcggaggctcctgggtggacatcgtgttagagcacgggagctgcgtgaccacaatggccaagaataagcctacccttgacttcgaactgatcaagactgaggccaagcagccggcgaccttgcgcaagtattgtatcgaagccaagctgacaaataccaccactgagtcgaggtgccctacccagggcgagccctctttgaacgaggaacaggacaaacgattcatttgcaagcactccatggtggacagaggttggggaaacggctgcggactatttggaaagggaggtattgtaacctgcgctatgttcacgtgtaaaaagaacatggaaggtaaggtggtgctgcctgagaacctggaatacactatcgtgataacgcctcatagcggggaagagcacgctgtcggaaacgacacagggaagcatggcaaggaaatcaaaataacgccgcagtccagtatcaccgaggccgagttgaccgggtacggcacggtgaccatggaatgctctccccgcaccgggctggacttcaacgagatggtccttctccaaatggaggacaaggcctggttagtccaccggcagtggtttctggacctccccttaccctggctgcccggggcagacacccagggcagcaactggatccaaaaagaaacgctcgtgaccttcaagaatccccacgcgaagaagcaggatgtggtggtcctggggtcccaggagggcgccatgcacactgccctgaccggagcaacagagatacaaatgagcagcggtaatctcctgttcaccgggcacctaaagtgccgacttcggatggacaagctgcagctgaaggggatgtcctactccatgtgtaccggcaagttcaagatcgtcaaggagatcgctgagacccaacacgggactatagtgattagagtgcagtacgagggcgacggcagtccgtgcaagattcccttcgagatcatggacctcgagaaaaggtacgtgcttggccgcctaattaccgtgaatcctatcgtgaccggcaaggactctcccgtcaacattgaagcggagccgcccttcggtgactcctacatcatcataggtgtggagcctggtcagctcaagttaaactggttcaagaagggcagctccatcgggcagatgtttgagaccactatgcgcggggccaagcggatggccatccttggcgacaccgcttgggacttcggcagcctggggggtgtttttacgtcgatcggcaaagcgctgcaccaggtattcggtgcgatatacggagccgcctttagcggcgtgtcctggaccatgaagatcctgatcggcgtgatcattacgtggataggcatgaacagtcgcagtacaagcctgagcgtcagccttgtgctggtgggggtagtgactctgtacctcggcgtgatggtccaggctgactcgggctgcgtggtgagctggaagaacaaggaactaaagtgcgggtccggcatcttcataacagacaacgtccatacttggacagaacagtacaagttccagccagagagtccaagcaagctggcgtccgccatacagaaggcacacgaggaggggatctgcggtatccggagcgttacccgcctcgagaacctgatgtggaagcagatcacacccgagctgaaccacatactctccgagaacgaggtgaagctgacaatcatgaccggagatataaagggtatcatgcaggccggcaagcggtcgttgcgccctcagccaaccgagctgaaatacagctggaagacctgggggaaggccaagatgctgagtaccgaatcccacaaccagacattcctgatcgacgggccagagacagcggagtgtccaaacaccaacagggcctggaattccctagaggtcgaggactacgggttcggtgtgttctccacgaacatctggctgaagttgcgcgagaaacaggacgtattctgcgatagcaagctcatgagcgctgccatcaaggacaatcgggccgtacacgcggacatggggtattggatcgagagcgccctgaacgacacctggaagatggaaaaggcctccttcatcgaggtcaagagctgtcattggccaaagtcccacaccctctggagcaacggcgtgctcgagagcgagatgatcatccccaagaacttcgccggcccagtcagccagcataactatcgcccggggtaccacacccagacagccggcccttggcacctggggaaactagaaatggacttcgatttctgcgagggcaccacggtcgtggtcaccgaggattgcggcaatcgggggcccagcctccggacgacgaccgcgtccggtaagctgataaccgagtggtgctgtcggagctgcaccttaccccccctccgctatcgcggagaggacggctgttggtacggcatggagatccgccccctgaaggagaaagaggagaacctcgtaaactcgctcgtgacggccgggcacggtcaaatcgacaactttagcctgggggtcctggggatggcgctcttcctggaagagatgctgcggacccgcgtggggaccaagcacgccattttactggtcgcggtctcctttgtcacgctcattacgggcaacatgagcttccgggatttggggcgcgtgatggtcatggtgggcgcaaccatgaccgatgacatcggcatgggggtgacttacttagccctgctcgccgccttcaaggtccgtcccacgttcgcggccgggctactcctccgtaagctgactagtaaggagttgatgatggccaccatcggaatcgccttgctaagccagtcaaccatccccgagactatactggagttgacggacgccctggcgctgggaatgatggtgctcaaaatcgtgcggaacatggagaagtaccagttggccgttaccatcatggccatactgtgcgtgccaaacgccgtaatcctccagaatgcttggaaggtcagttgtaccatactggctgcggtgtcagttagcccattactcctgacaagcagccagcagaaagccgactggatccccctggccctcacaattaagggactgaatcccaccgcgatcttcctgaccacgctttcccggaccagtaagaagcgctcctggccgctgaacgaggccgtgatggccgtaggaatggtcagcatactggcatcatctctcctgaagaatgacatcccgatgacaggccccctggtagccggtggcctcctaaccgtgtgctacgtcctcaccgggcggagcgcggatctcgagctggagagggcggctgacgtaaagtgggaagatcaggctgaaatcagtggatcatcccccatcctgagtatcaccatcagtgaggacggcagcatgtccatcaagaacgaggaggaggagcagaccctcactatcttaatccggacggggctgctcgtgataagtggcgtattcccggtttccataccaataaccgccgcggcttggtacctgtgggaggtcaaaaagcagcgcgccggagtcctatgggacgttccctctccgccaccagtgggcaaggccgagctcgaggatggagcctatcggataaagcagcgcggcatcttcggctattcccagatcggggcgggcgtttacaaagaggggaccttccacaccatgtggcacgtgacgcggggtgccgtgctgatgcaccgcggaaagcggatcgagcccagctgggccgatgtcaagaaggaccttatctcctacggcggggggtggaagctcgagggcgaatggaaggagggtgaagaggtccaagtgttggccctggagccaggcaagaacccccgcgccgtccagacaaagccaggccttttcaagaccaacaccggaaccatcggagcggtgagcctggacttctccccgggtacgagcggctcccccatcgtggaccggaagggcaaggttgtgggcctgtacggcaacggggtcgtcacccgaagcggagcctatgtaagcgcgatagcccagactgagaagtccatcgaggacaatcccgaaattgaagatgacatattccgtaaaaagcgcctaaccatcatggacctgcatcccggggctggtaagacgaagcgttacctgcctgccatcgttcgtgaggccatcaagcgtgggctgcgcacgctcatcctcgccccgacacgtgtcgttgccgctgagatggaagaggctcttcgcggcttacccatccgctatcagacaccggcgatccgggccgagcacacgggcagggagatcgtggacctgatgtgtcacgccactttcaccatgcggctgctctcgccggtccgcgtgccgaactacaacctgatcattatggacgaggcgcacttcaccgaccccgcctccatcgccgcccgggggtacatcagcactcgcgtggagatgggcgaagcggcggggatcttcatgaccgcgacaccgcccggctctagggatccgtttccgcagagcaacgcacctatcatggacgaggagcgcgaaatccctgagagatcctggaacagcggacatgaatgggtcaccgacttcaagggcaagaccgtgtggtttgtaccgtccataaaagccggcaacgacatcgcggcctgcctgcgcaagaacgggaaaaaggtcatccagttaagccggaagaccttcgactctgaatacgtgaagacccgcgccaacgactgggacttcgtggtcacgacagacatcagcgagatgggcgccaacttccgggccgagcgcgtgatcgacccgcggcggtgcatgaagcccgtgatccttaccgacggggaggagcgggtaatcctggcgggcccgatgccggtgacccactccagcgccgctcagcgccgcgggcggatcggccgcaaccctaagaacgagaatgatcagtacatctacatgggggagcccctagagaacgacgaggattgcgcccactggaaggaggccaagatgctgcttgacaacatcaacacccctgaggggataatcccgtccatgtttgaaccagagcgggaaaaggtggacgccattgacggcgagtaccgcctcaggggcgaggcacgcaaaacgtttgtcgacctcatgaggcgcggagacctgcccgtgtggctcgcctatagagtggccgcagaggggatcaactatgctgatcgtcggtggtgtttcgatggcatcaagaacaaccagatactggaggagaacgtcgaagtggagatatggacgaaggagggcgagcgcaagaagctgaaaccgcggtggctcgacgcccgcatttacagcgacccactggccctgaaagagtttaaagagttcgccgcggggcggaagtccctcaccttaaacttaataaccgagatgggcaggctcccaacattcatgactcagaaagccagagacgctctggataatctggccgtcctccataccgccgaggtcggggggagagcttacaatcacgccctgagcgagctgccggagaccctggaaacgctgctgctactgaccctgctcgcgaccgtgacgggcgggatctttttgtttctgatgtccgggaagggcataggcaagatgactctcgggatgtgctgcataattacagccagcatattgctgtggtatgcccaaatccagccccactggatcgcggcctccataatcctcgagttctttctgatcgtccttctcatccccgagccggaaaagcagcggacgccacaggacaaccaactgacctatgtggtaatcgccatactgaccgtagtggcggccacgatggcgaacgagatgggcttcctcgagaagaccaagaaggacctgggcttggggagcataataactcaggagtccgagtcaaacatcctcgatatagacttacgcccggccagcgcctggaccctgtatgcagtggccaccaccttcgtgacacctatgttacgtcatagcatcgagaacagcagtgtgaatgtgtccctaaccgctattgcgaaccaagccacggttttgatgggcctagggcgcggctggccactgtccaagatggacatcggggtgccactgctcgccatcggatgctatagccaagtgaatccgatcacccttactgcggcgttactcttgctggttgctcactacgccatcattggacccgggctccaggccaaggccacccgcgaggcccaaaagcgggccgccgccggcatcatgaagaaccccacggtggacggaatcactgtgatcgacctggagcccataccctatgacccgaagttcgagaagcaactgggccaagtcatgcttctggtgctgtgcgtgacccaggtcctcatgatgcgcaccacatgggcgctgtgcgaagcactgacgcttgccaccgggcccatttcaactctgtgggagggcaacccgggccgtttttggaacacgactatcgcagtgagtatggccaacatcttccgtgggtcctatttagcgggtgccgggcttctgttcagcatcatgaaaaatacgacgaatacgagaaggggcaccggcaacattggggagacccttggcgagaagtggaagtcccggctaaacgccctgggtaagagtgagtttcagatttacaagaaatccggcatacaagaggtggaccggacactggcaaaggagggcatcaaacggggcgaaacagaccaccacgcagtgagcaggggaagcgccaaactccgctggttcgtggagcgcaacatggtgaccccggaggggaaggtcgtagacctgggctgtgggagaggcggctggtcatattattgcggcggcctgaaaaacgtccgcgaagtcaaggggctcactaaaggcgggcccggccacgaggagccgatacccatgagcacctacggatggaacctggtgcggctgcagtcgggagtggacgtcttctttacaccgcccgagaaatgcgatacattgctgtgcgacataggagagtcaagtcccaaccccaccatcgaagccgggcgaacgctcagagtcctcaacctggttgaaaattggttgaataacaacacgcagttttgcatcaaagtattaaacccgtacatgcccagcgtaatcgagaagatggaaaccttgcagagaaagtatggcggggcactggttcggaacccgctgtcccgtaactccacacacgaaatgtactgggtcagcaatgccacaggcaacatcgtgagctccgtgaatatgatctcccgcatgctcattaatcggttcacaatgaagcacaagaaggccacgtacgagccggacgtcgacctggggtccggcacacgcaacataggcattgagaacgaaataccaaacttggatattatcgggaaacggatcgagaaaatcaagcaggagcacgagacgagctggcattacgaccaggaccacccttacaagacctgggcctaccatgggtcctacgagacgaagcagaccggaagcgcatccagcatggtaaacggcgtggtccggctcttaaccaagccctgggacgttgtccctatggtcacgcaaatggcgatgacggataccacccctttcggacagcagcgggtgttcaaagagaaggttgatacccgcacgcaggagcccaaggaggggaccaagaagctgatgcggataacggccgagtggctctggaaagaactgggcaagaagaagacgccccgaatgtgcacgcgggaagagtttacgcgcaaagtgcggtccaacgcggccttaggggccatcttcaccgacgagaataagtggaagtccgctcgcgaggcagtggaggacagtcggttttgggagctagtcgaccgtgaacggaacctgcatttggagggtaaatgtgagacctgtgtgtacaacatgatgggtaagcgcgagaagaagctcggcgagttcggcaaggcgaaggggtcacgtgcgatctggtacatgtggctgggtgcccgctttctggaatttgaagcactaggcttcctgaacgaagatcactggttcagtcgtggaaactcactgagcggcgtggaaggcgagggcctccacaagctggggtacatcctgcgtgacgtaagtaagaaggaaggcggagcgatgtacgccgacgatacggccggctgggatactcggataaccctcgaggacctcaagaacgaagagatggtgaccaaccatatgaagggggaacataagaagctggctgaggccatattcaagctaacgtaccagaataaggtcgttcgcgttcagcggccgacaccgcgggggaccgtgatggacatcatcagccggaaggaccagcggggctccggacaggttggaacctacgggctgaacacctttacaaacatggaagcacagctgatccgccagatggagggcgagggtatcttcaagagcatccagcacctcaccgtcaccgaagagatcgcggtgcaaaactggctagctcgggttgggcgcgagagactgtcccgcatggccatcagcggtgacgactgcgtcgtcaaacccctcgacgaccggttcgcttcggcgctgacggccctgaacgacatgggcaaggttcgcaaggacatccagcagtgggagcccagccgtggctggaacgactggacccaagtaccgttctgctcccatcacttccatgaactcgtgatgaaggacgggcgggtcctggtggtgccgtgccggaaccaggacgagctgatcggccgagcgcgaatcagccaaggcgcgggctggtccctcaaggagacggcctgcctgggtaaaagctacgcgcagatgtggactctcatgtacttccaccgtcgcgaccttcgcttggccgcgaatgcaatctgttccgctgtccccagtcactgggttccaacgtctcgcaccacctggagcatccatgcgaagcacgagtggatgacgaccgaggacatgctggccgtttggaaccgagtctggatccaggagaacccatggatggaagacaagacacccgtggagagttgggaagaggtgccctaccttgggaagagagaagatcagtggtgcggctcactgatcggcctgacatctcgggcaacttgggccaagaacattcagactgcgatcaatcaggtccgctctttaatcggcaacgaggagtacacggactatatgcccagcatgaagcggttccgcaaggaagaggaggaggccggcgtgctgtggtga

SEQ ID NO: 25220 - RNA, 9876 nt, synthetic construct
  misc_feature 1..9876: note = derived and/or modified CDS sequence (opt11) from DENV-2__EU677144__SS-prME
  source 1..9876: mol_type = other RNA
actgcaggcatgatcatcatgctgatccccaccgccatggcgttccacctcaccacccgcaacggggagcctcacatgatcgtgggccggcaggagaaggggaagtccctgctgttcaagaccgaggacggcgtgaacatgtgcaccctcatggccatcgacttaggcgagctgtgcgaggacaccatcacctacaaatgccccctcctgcgccagaacgagcccgaggacatcgactgttggtgcaactccaccagcacctgggtgacctacggtacctgcaccaccacgggcgagcaccggcgagagaagcggtctgtggccctggtcccccacgtcgggatgggcctggagacccgcaccgagacctggatgagctccgagggggcctggaagcacgttcaacggatcgaaacatggatcctgcgccacccgggcttcaccattatggcagcgatactggcctacaccatcgggaccacacacttccagcgggccctcatcttcatcctgctgaccgccgtcgcgcccagcatgaccatgcgctgcatcgggatctccaaccgggactttgtggagggcgtgagcggaggctcctgggttgacatcgtgctcgagcacgggagctgcgtcaccaccatggccaagaacaagccgaccctggacttcgagctcatcaagaccgaggcaaagcagcccgcgaccctccggaagtactgcatcgaagctaagctgacgaacaccaccaccgagtcccggtgcccgacgcaaggcgagcccagcctgaacgaggagcaggacaaacgcttcatctgcaagcacagtatggtcgaccgcggctggggaaacggctgtgggctgttcggcaagggcggtatcgtgacctgcgcgatgttcacgtgtaagaagaacatggagggaaaggtggtactgccagagaacctggagtacaccatcgtcataacgccccacagcggggaggagcacgccgtgggcaacgacaccgggaagcacggcaaggagatcaagatcacaccgcagagtagcatcaccgaggcagagctcacggggtatgggacggtcaccatggagtgcagtccccgtaccggcctcgacttcaacgaaatggtgctgctccagatggaggataaggcctggctggtgcaccggcagtggttcctggatctacccctgccctggctgccgggggccgacacccagggcctcaactggatccaaaaggagacgttagtcacattcaagaacccccacgcgaagaagcaggacgtggtggtactggggagccaggagggggccatgcataccgccctcaccggggccactgagatccagatgtccagcggcaacttactgttcaccggccacctaaagtgccgcctgaggatggacaagctgcagctcaaagggatgagctactccatgtgcaccggcaagttcaagatcgtgaaggagatcgccgagacccagcacgggacgatcgtcatacgtgtgcagtatgagggcgatggcagcccctgcaaaatccccttcgagataatggatttagagaaacggtacgtccttgggcgtctcatcaccgtcaacccgatcgtgaccgaaaaggactcccccgtgaatatcgaggcggagccgcccttcggcgacagctatattatcatcggggtcgagccgggccagctgaaactgaactggttcaagaaggggtccagcattggccagatgttcgagaccaccatgcgcggcgcgaagcggatggccatcctcggggacaccgcctgggacttcggctccctcgggggcgttttcaccagcatcgggaaagccctgcaccaggtattcggcgcgatctacggcgccgcgttctccggcgtgagctggaccatgaaaatcctgatcggcgtaatcatcacgtggatagggatgaactcccgcagcacgtccctcagcgtgtccctggtcctggtgggcgtggtcaccttgtacctgggagtgatggtgcaagccgacagcggctgcgtcgtgtcctggaagaacaaggagctgaagtgcggcagtgggatcttcatcactgacaacgtgcacacgtggaccgaacagtacaaattccagcccgagtcccccagtaagttggcgagtgcaatccaaaaagcccacgaagagggcatctgcgggatccggtccgtcacccgcctggagaacctgatgtggaagcagataacccccgagctcaatcatatactgagcgaaaacgaggtaaagctgacgataatgaccggcgacataaaaggcatcatgcaggccggcaagcgaagtctcagaccgcagccaacggagctcaagtacagctggaagacatggggcaaggccaagatgctgtccacggagagccataaccagaccttcctcatcgacgggcccgagaccgcggagtgcccgaacaccaaccgggcctggaattccctggaggtggaggactacggcttcggggtcttcagcacgaatatctggctgaagcttagggagaagcaggacgtgttctgtgactccaagctgatgagcgccgccatcaaggacaaccgggccgtgcatgcagacatgggttactggattgagtccgcactgaacgacacctggaagatggagaaagccagcttcatcgaggtaaagagctgccactggcccaagagccacaccctctggtccaacggcgtgctggagtcggagatgataattcccaagaacttcgccgggcccgtctctcagcacaactaccgtccgggctaccacacccaaacggccgggccctggcacctcggcaaactcgagatggatttcgacttctgcgaggggacgacggttgtagtgaccgaggactgcggtaaccggggccccagcttgcgcacgacgaccgcgagtgggaagctgatcacggagtggtgctgtcggtcctgcaccctcccccccctgcgctatcggggcgaggacgggtgctggtatggaatggagatacgccccctaaaggagaaggaggaaaatctcgtcaacagcctggtgacggccgggcacggccagatcgacaacttctccctgggcgtacttgggatggcccttttcctggaggagatgcttaggacccgagtcggcaccaaacacgccatcctgctcgtggcggtgagcttcgttaccctcatcacggggaacatgtcctttcgggacctgggccgcgtgatggtgatggtcggggccaccatgaccgacgatatcggcatgggcgtgacctacctggccctcctcgccgccttcaaggtgcgccctacgttcgcggccgggctgttactacggaagctaaccagcaaggagctcatgatggccaccatcggcattgcactgctgtcccaaagcacgatccccgagacgatcctcgaactgaccgacgctctggcgctggggatgatggtcctaaagatcgtgcgaaacatggagaagtaccagctagccgtaaccatcatggccatcctctgcgtccccaacgccgtaatcctgcagaacgcctggaaggtttcctgcaccatactagcggccgtcagcgtgagccccctcctcctcacgagctcccaacagaaagcagactggatcccgttagccctgaccatcaagggcctgaaccccaccgcgatctttctcaccacgctaagccggacgagtaagaagcgcagctggccgctgaacgaggccgtcatggccgtaggcatggtgtccatcttggccagctcgctgctgaagaacgacatccccatgaccgggcccttagtcgccggcgggttactgaccgtgtgctacgttctgacgggccgctcggcggacctggaactggagcgcgccgccgacgtcaagtgggaggaccaagccgaaatcagcgggtcaagcccaattttgtccataacgattagcgaagacggctcgatgagcatcaagaacgaggaggaggagcagactctgaccatcctgattcgcacgggcctcctggtgatctccggggtgttcccagtctctatacccattaccgccgcggcgtggtacctgtgggaagtgaagaagcaacgcgcgggcgtgttatgggacgtccccagcccgccgcccatggagaaggccgagctggaggacggagcataccggatcaagcagcgcggcatcttcgggtacagccagatcggcgcgggcgtgtacaaagagggcacctttcacacaatgtggcacgtgacccgcggtgccgttttaatgcaccgcggcaaaagaatcgagccctcctgggccgacgtgaagaaggacctcatcagctacggcgggggctggaaactggagggggagtggaaggagggggaagaggtacaggtcctggccctcgagcctggcaagaacccccgagcggtgcagactaagcccgggctcttcaagaccaataccggcaccattggggcggtgtccctggacttcagcccgggaacgtccggtagcccgatcgtcgaccggaagggcaaggtggtgggcctctacggtaacggcgtcgtgacccgctccggcgcctacgtgtcggccatcgcccagaccgagaagtccatagaggacaaccccgaaatagaggatgacatcttccgtaagaagcgcctgaccatcatggacctgcaccccggggcgggcaagacgaagcggtatctgcccgccatcgtacgcgaggccatcaagcgcgggctccgcaccctgatcttagccccgacccgcgtagtggccgcagagatggaggaggccctccggggcctgcccatccgataccagacgcccgccattcgggccgagcacacgggccgcgagatcgtcgacctgatgtgccacgccaccttcacaatgcggctgttgagccctgtgcgcgttccgaactataaccttatcatcatggacgaggcacatttcaccgaccccgccagcatcgccgcccgggggtacatctccactcgagtcgagatgggcgaggcggccgggatctttatgacagcaacgccgcccggcagccgggacccgtttccccagtccaacgcccccatcatggacgaggaacgcgagatcccggaacggagctggaactccggtcacgagtgggtcacagacttcaagggaaagacggtgtggttcgtccctagcattaaggccgggaacgacatcgcggcgtgcctgcgcaagaacggcaagaaggtcatccagttatcccggaagaccttcgacagcgagtacgtgaagacccgtgccaacgactgggacttcgtggtgaccacggatatctccgagatgggcgccaacttccgggccgagcgcgtaatcgatccccgccgctgcatgaagcccgtcatcctgaccgatggggaggagcgggttatcctcgcggggcccatgccggtgacccacagctccgccgcccagcgccgcgggcggatcggccgcaatcccaagaacgaaaacgaccagtatatctacatgggggagcccttagagaacgatgaggactgcgcccactggaaggaggccaagatgctgctcgacaatatcaacacccccgagggcatcattccgagcatgttcgagccggagcgggagaaggtagacgcgatagacggcgagtaccgcctgaggggtgaggcccgcaagacgttcgtggacctgatgcggcgcggcgacctccccgtgtggttggcctaccgggtcgccgctgaagggatcaactacgcggatcgccggtggtgcttcgatggcatcaagaacaaccagattctggaggagaacgtggaggtggagatctggacgaaggaaggtgagcgcaagaagctcaagccgcggtggctggacgcccgcatctactctgaccccctggccctcaaggagttcaaggagtttgccgcgggtcggaaatccctgaccctgaacctcatcaccgagatgggtcgcctacccacgttcatgacccagaaggcccgggacgccctggataacctcgcggtcctgcacacagccgaggtcgggggccgcgcgtacaaccacgcgctgtccgagcttcccgaaacactggagacgctgctcctgctgaccctcctggccaccgttaccggcggcatcttcctcttcctcatgagcggcaaggggatcggtaagatgacgctggggatgtgctgcatcatcaccgcctcgatactgctctggtacgcccagatccagccccattggatcgcggccagcatcatcctggagttcttcttgattgtgctcctgatccctgagcccgagaagcagcggacgccccaagacaaccagctgacctacgtggtcatcgccatcttaaccgtggtcgccgctacgatggcgaacgagatgggcttccttgaaaagaccaagaaggacttagggctcggctcaatcatcacccaggagagcgagagcaacatcctggacatcgacctgcgcccggccagtgcctggaccctctacgccgtcgcaacgaccttcgtcacccccatgctgcggcatagtatcgagaactcctcggtgaacgtctctctcaccgcaattgccaaccaagccacggtgctcatgggccttgggcgcggatggcccctgtccaagatggacatcggggtgcccctcctggccatcggctgctactcccaggtcaacccgattaccctgaccgcggcccttctgctactcgtggcgcactacgccatcatcgggcccggcctgcaggccaaggcgactcgcgaggcccagaagcgcgccgcagccggcatcatgaagaaccccacggtggacgggatcaccgtcatcgacctcgagcccatcccatacgaccccaagttcgagaagcagctcggacaggttatgctgctggtgctttgcgtcacccaagtgcttatgatgcgcaccacgtgggcgctgtgtgaggccctcaccctagcaaccgggcccatcagcaccttatgggagggaaaccccgggcggttctggaacacgaccatcgccgtgtccatggccaacatcttccgcggcagctacttagcgggcgccgggctgctgttctccatcatgaagaacaccaccaacacgcggcgcggcaccgggaacatcggggagaccttgggcgaaaaatggaaatcccggctgaacgccctgggcaagagcgagtttcagatctacaagaagtccggaatccaggaagtcgaccgaaccctcgctaaggaggggatcaagcggggcgaaacggaccaccacgcggtgtcccgcgggtccgccaagcttcggtggttcgtggagcgcaacatggtcaccccggagggcaaggtggtggacctgggctgcgggcggggcgggtggtcctattattgtggtgggctcaaaaacgtgcgcgaggtgaagggactgaccaagggcggtcccggccacgaggagccgatccctatgagcacctacgggtggaatctggtgcggctacagtctggcgtcgacgtgttcttcacgccgcccgagaaatgcgacaccctactgtgcgacatcggggagtcctcacccaaccccaccatcgaggccgggcgcacactccgggtgttgaacctggtcgagaactggctcaacaacaacactcagttttgcataaaggtgctgaacccgtacatgccctccgtgatagagaagatggagaccctgcagcgtaagtacggcggggccttagtccggaaccccttgagccgcaactccacccacgagatgtactgggtgagcaacgccaccggcaatattgtgtcctccgttaacatgatctcccgaatgctgatcaaccgtttcaccatgaagcacaagaaggcgacgtacgagcccgacgtggacttggggagtggcacccgcaatatcgggatcgagaacgagatccccaacctcgacatcattggcaagcgaatcgaaaagatcaagcaggagcacgagacctcatggcactacgaccaggaccacccctataagacctgggcgtaccatggcagctacgagacgaagcagaccgggtcggccagctccatggtgaacggcgtcgtgcgcctgctaaccaagccgtgggatgtggtcccgatggtcacccagatggccatgacggacaccaccccctttgggcagcagcgggtattcaaggagaaggtcgacacccgcacgcaggaaccgaaggagggcaccaagaaactcatgcggatcaccgccgagtggctgtggaaggagctgggcaagaagaagacgccccgcatgtgcacgcgggaggagttcacccgcaaggtgcggtcgaacgcggccctcggtgccatcttcacagacgagaacaagtggaaaagcgcccgcgaagccgtggaggacagccggttctgggagctggtcgatcgcgagcgtaacctgcacctcgagggcaagtgcgagacctgcgtgtacaacatgatgggtaagcgcgagaagaagctgggcgagttcgggaaggcgaagggctcccgcgcgatctggtacatgtggctgggcgctaggttcctcgagttcgaggcgctggggttcctgaacgaggaccactggttctcacggggcaactccctcagcggggtggagggcgaggggctgcacaagctgggctacatcctccgcgacgtgagcaagaaggaggggggtgctatgtacgcagacgacacggccggttgggacacccggatcactcttgaggacctaaaaaacgaggaaatggtcaccaatcacatgaagggggagcacaagaagctcgctgaggccatcttcaagctgacctaccagaacaaggtcgtgcgcgtgcagcgcccgacgccccgcggcacggtcatggacatcatctcccgcaaggaccagcgggggtcgggccaggtgggcacctacggactgaacaccttcaccaacatggaggctcagctcatacgccagatggaaggcgaggggatctttaaatccatccagcacttgaccgtaaccgaggagatagccgtgcgcaattggctggcccgcgtgggcagagaacgcctcagccggatggcgatatcgggcgatgactgcgtggtcaagccgctggacgaccgcttcgccagcgcgttaacggccctgaacgacatggggaaggtgcggaaggacatccagcagtgggagccttcccgcggatggaacgactggacccaggtgccgttctgcagccaccacttccacgagctggtgatgaaggacgggcgggtgctagtggtgccatgccgcaaccaggatgagctcatcgggagagcccgcatctcccagggggccggctggagcctgaaggagaccgcctgcctgggcaagtcctacgcgcagatgtggaccctcatgtacttccaccggcgagacctgcggctggccgccaacgcgatctgcagcgccgtaccctcccactgggtgcctacgagccgtaccacctggtccatccacgcgaagcacgagtggatgaccaccgaggacatgttggcggtctggaatcgcgtgtggatacaggagaacccgtggatggaggacaagacccccgtggagagctgggaggaggtcccctacttagggaagagagaggaccagtggtgcggctccctgattgggctcaccagccgcgccacctgggcaaagaacatccagaccgcgatcaatcaggtgcggagcctcatcggcaacgaagagtatacggactacatgccttccatgaagagattccggaaggaggaggaggaggccggggtgctgtggtag

SEQ ID NO: 25221 - RNA, 9876 nt, synthetic construct
  misc_feature 1..9876: note = derived and/or modified CDS sequence (opt11) from DENV-2__EU677145__SS-prME
  source 1..9876: mol_type = other RNA
actgccggcgtcattgtcatgctgatccccaccgcaatggctttccacctcaccacccgcaacggcgaaccccacatgattgtgggccgacaggagaaggggaagtccttgctgttcaagaccgaggatggcgtgaacatgtgcaccctcatggccatcgacctgggggagctatgtgaggacacaataacttataaatgcccactcctgcggcaaaacgagcccgaggatatcgactgttggtgcaactccaccagcacgtgggtaacctacgggacctgtacgacgactggcgagcaccggcgcgagaagcggtccgtggcactggtaccccacgtggggatgggcctagaaacccgcaccgagacgtggatgtcctcagagggggcctggaagcacgttcagcgcatcgagacctggatcctacgtcacccgggcttcacaatcatggctgctatcttagcctacactatcgggaccacgcacttccaacgggctctcatcttcatcttactgaccgccgtcgcccccagcatgacaatgcgctgcattggcataagcaatcgggacttcgtcgagggcgtaagcgggggctcctgggtggatatcgtactcgagcatgggagctgtgtgacaacgatggccaagaacaagcccacccttgacttcgaactgataaagaccgaggctaagcagccggcgacattacgcaagtactgcatcgaggccaagctgactaacaccacaactgagtcccggtgcccgacgcagggcgagcccagcctgaatgaggagcaggacaagcgcttcatctgcaaacactccatggtggaccggggctgggggaatggctgcggtttatttggcaagggtgggattgtgacctgcgcgatgttcacttgcaagaagaacatggaggggaaggtagtgcagcccgagaatttggaatacaccatcgtcatcacgccccactctggagaggaacacgctgtgggcaacgacacagggaagcacggcaaggagatcaaaatcaccccgcaatcaagcattaccgaggcagagctgacagggtacggcacggtcacgatggaatgcagcccccggaccggcctggatttcaatgagatggtcctgttgcagatggaagataaggcctggctggtgcatcggcagtggttcttagacctgcccctcccctggcttccaggggcagatacccagggaagcaactggatacagaaggagacgctggtcaccttcaagaacccccacgcgaagaagcaagacgttgtggtcctcgggtcccaagagggcgcaatgcataccgccctgaccggggctacggagattcagatgagtagcggcaaccttttgttcaccggtcaccttaaatgccgcctgcgcatggacaagctccagctgaaagggatgtcctacagcatgtgcacagggaagttcaagatagtgaaggagatcgccgaaacccagcatgggacgatcgtgatacgcgtgcagtacgagggagatggctccccctgtaaaatcccatttgagattaccgacttagagaagcggcatgtactcgggaggctaatcaccgtgaacccgatcatcaccgagaaggattcacccgtcaacatcgaggccgagcctcccttcggcgactcctatatcataatcggcgtggaaccgggccagcttaaactaaattggtttaagaagggttcgtccattgggcagatgttcgagactacaatgcgtggcgccaaacgcatggccattctgggggacaccgcttgggacttcggcagcctcggaggggtgttcaccagcataggtaaggcactccaccaggtcttcggggcgatctacggggcagccttcagcggggtgtcctggacgatgaagatcctgataggcgtgatcatcacctggatagggatgaatagccggtccacgagcctgtctgtcagcttggtgctcgtgggcgtcgttaccctgtacctgggggctatggtgcaggcggactccggttgcgtggtatcttggaagaataaggagctcaagtgcggctctgggatcttcatcacggacaacgtgcacacgtggaccgagcagtacaagtttcagcccgagtcaccgagcaagctggcctctgccatccagaaggcccatgaggaaggcatctgtggtatccggagcgtcaccagactggagaacctcatgtggaagcagattacgcccgagctcaaccacatcctgtccgagaacgaggtcaagctcaccataatgaccggcgacatcaaagggattatgcaagccggcaagagatctctgcggcctcagcccaccgagctgaagtatagctggaagacgtggggcaaagcgaaaatgctctcgaccgaatcccacaaccagacctttctgatagatgggcccgagaccgccgagtgcccgaacaccaacagagcctggaacagcctggaggtggaggactacgggttcggcgtcttcaccaccaacatctggctcaagctgcgggagaaacaggacgtcttctgcgactccaaactgatgtcggccgctatcaaggacaaccgggcggttcatgccgatatggggtactggatagagtcggccctcaacgacacttggaagatggagaaagccagcttcatcgaggtcaagtcctgccactggccaaagagccacaccctgtggtccaacggcgtgctggagagcgagatgatcatccctaaatccttcgccggtccggtgagtcaacacaactaccgcccgggctaccatacgcaaaccgcggggccttggcacctcggaaagttagagatggactttgacttctgtgaagggaccaccgtggtggttacggaggactgtggaaaccgggggcccagcctgcgcacgaccaccgcaagcgggaagctcatcacggaatggtgctgccggagctgtaccctgcccccgctgagataccgtggcgaggacggatgctggtatggaatggaaatccgacccttaaaggagaaggaggagaacctggtcaactccctggtgaccgccggccacggccagattgacaacttttccttgggcgtgctcgggatggccctgttcctagaagagatgttgcggacccgcgtcggtacgaagcacgccatcttgcttgtggccgtctctttcgtcactctgatcaccgggaacatgtcgttccgcgacttaggccgcgttatggtgatggtgggggctaccatgacggacgacattggtatgggcgtgacatatctcgccctgctggccgcgttcaaggtgcgccccaccttcgccgccgggctcctgttacggaagctcacctcaaaggagcttatgatggccaccatcggaatcgcactgctcagccaaagtacaatgcccgagacaatcctggaactgaccgacgcgctagccctggggatgatggtcctaaagatagtgcgcaatatggagaagtaccagctcgcggtgactatcatggccatcagctgcgtcccgaacgctgttatccttcagaacgcatggaaggtctcctgcaccatcctcgcgaccgtcagcgtgagccccctcttactaacgtcgagtcaacagaaggccgactggatccccctcgccttgacgataaaggggctgaaccccaccgcaatcttcctaaccaccctcagccggacatccaagaaacgcagctggccgttgaatgaggccatcatggccgtcggcatggttagtatcctcgccagctctctgctgaagaacgacatccccatgaccgggcccctcgtggctggcgggctgctgacagtatgctacgtgcttacgggccggtcggctgacctcgagctggaacgcgcggccgatgtgaaatgggaggaccaggcagaaataagcgggtccagccccatcctcagcattactatttccgaagacggatccatgtccatcaaaaatgaggaagaggagcaaactctgaccatcttgatccggacgggacttctggtaatctccggggttttcccggtttctatccccataaccgcagcggcttggtacttgtgggaagtcaagaagcagcgcgccggcgtcctctgggacgtgcctagcccgccgcccgtcgggaaggccgaattggaggatggggcctaccggattaagcagcgcgggatactcggctactctcagatcggcgcgggtgtatacaaggaagggactttccacaccatgtggcacgtgacccgcggagcggtcctcatgcatcgcggcaagcggatagagccctcctgggccgatgtaaagaaggacctaataagctacgggggcggatggaagctcgagggggagtggaaggagggcgaagaagttcaagtactcgccctggagcccgggaagaacccccgcgcagtgcagaccaagcctggcatcttcaagacaaacaccgggaccataggcgcggtttccctggacttctccccgggaacctccgggagccccatcgtcgatagaaagggtaaggtggtaggtctatatggaaatggcgtagtgacgcggtccggggcctatgttagcgccattgctcagacggagaagtctatcgaggacaatcccgaaatcgaagacgatatattcaggaaaaagcgcctgacaatcatggacctacaccccggcgccggcaagactaagcggtacctccccgccatagtccgcgaggccataaagcggggcctgcgcacgctaatccttgccccgactcgcgtggtggccgcggagatggaggaggccctccgggggctgccaatacgctatcaaactcccgccatccgagcggaacataccggccgtgaaatcgtcgacctcatgtgccatgcaactttcaccatgcggctgttgtcccccgtgagagtcccgaactataacctgatcatcatggacgaggcacacttcaccgacccagccagcatcgccgctcggggctacatctccacccgcgtcgaaatgggggaggccgccggcatcttcatgacggccacgccgcccggaagccgtgaccccttcccccaatccaatgctcccatcatggacgaggagcgggagatcccggagcgaagctggaatagtggccacgagtgggtaacggacttcaagggcaagacggtatggtttgtcccgagcataaaggccggcaatgacatagcggcctgcctccgcaagaacggcaagaaagtgattcaactctccaggaagacgttcgacagcgaatacgtaaagactcgcgccaatgactgggacttcgtcgtgacgactgacatctccgagatgggggccaatttcaaggccgagcgggtgatcgaccccagaaggtgcatgaagcccgtcattctgacggacggcgaggaacgcgtgatcctcgcggggccgatgccggtgacacacagctcggcagcccagcgacgcggccgcatcggtcggaaccccaagaatgagaacgaccagtacatatacatgggcgagcccctggagaacgacgaggactgcgcccactggaaggaggctaagatgctgctcgataacataaacacccccgaggggataatcccgagtatgttcgagccggagcgcgaaaaggtcgatgccatcgacggggagtaccggctgcgcggcgaagcccggaagactttcgtggacctgatgaggcgcggggacctccccgtctggctggcctaccgcgtcgccgctgagggcatcaattatgcggaccgcaagtggtgcttcgacgggatcaagaataaccagatcctggaggaaaatgttgaggtggagatttggacgaaagaaggcgagcgcaagaaactcaaaccgcgttggctggacgcccgcatctacagtgaccccttggccctcaaagagttcaaggagttcgccgcgggacgaaaatcactcactttaaaccttataactgagatggggcgcctacccaccttcatgacgcaaaaggcgcggaacgcgctggacaacctcgccgtccttcacacggccgaggcgggcgggagggcctacaaccatgccctgtccgaactacccgaaaccctggagacactgcttctgctgacgctcctggccaccgtgaccggcggcatctttcttttcctcatgagcgggaagggcattggcaagatgaccctgggcatgtgctgtataattaccgcctccatcctgctctggtatgctcagatccagcctcattggatcgccgccagcatcatcctggagttcttcctgatcgtcctgctgattccggaaccagagaagcagcggacgccacaggacaaccagctgacatacgtcgtgatcgcgatcctcactgttgtggccgcgaccatggcgaacgagatggggttcctggagaagacgaagaaggatctgggcctcggctcgatcaccacccaggagtccgaaagcaacatcctagatatcgacctgcgcccggcctccgcctggaccctgtacgccgtggcgacgaccttcgtaacacccatgctacggcatagtattgagaactcctccgtgaacgtttccctgaccgcgatcgcaaatcaggccactgtcctcatggggctgggcaaagggtggcccctgtctaaaatggacataggtgtccccctactggcaatcgggtgctattcccaggtaaaccctattactctgaccgccgccctcttattgctcgttgcacactacgccataatcggaccaggcttacaggcaaaggccacacgcgaggcccagaagcgggccgctgcgggaatcatgaagaaccccacggtggacggaatcaccgttatcgaccttgaaccaataccgtatgaccctaagttcgaaaaacagctcggacaggtaatgctgctgatcctctgtgtgacccaagtgctgatgatgcgcaccacgtgggctctttgcgaggccttgactcttgctaccggtcccattagcacactgtgggagggaaaccctggcaggttctggaacactaccatcgcagtctctatggcgaacatcttccggggcagctacctagcaggggccggcttactgttctcgatcatgaagaatactacaaatacacgccgggggactggcaacataggtgaaaccctcggagagaagtggaagtcccgcctgaacgcactgggcaagtccgaatttcagatatacaagaagtcaggtatccaggaggtggaccggaccctagcgaaggagggaatcaagcgcggggagacggaccaccacgccgtgtcccgcggcagtgccaagctgcgctggttcgtcgagcggaacatggttaccccggagggcaaggtggtggacctgggatgtgggagaggagggtggtcctactactgcggaggtctcaagaacgtgcgggaggtaaaaggtctaacgaagggcgggcccggacacgaggagccggtcccgatgagcacgtacggatggaacctcgtccgcctccagtccggggtggacgtcttctttacgccgccagaaaaatgtgatacgctgctgtgcgacatcggcgaatccagcccaaaccccaccattgaggcgggccgtaccctacgcgtacttaatctggtggaaaactggctcaacaacaatacccagttctgcatcaaggtcttaaacccgtatatgccctccgtgattgaaaagatggagactctgcagcgcaaatacgggggcgccctggtgcgtaatcccctgtcaagaaattccacgcacgagatgtactgggtgagcaacgcgaccgggaacattgtgtccagcgtaaacatgatttcccgcatgctcatcaaccggttcaccatgaagcacaagaaggcaacctacgaaccggatgtcgacttgggctctgggacccgtaacatcggtattgaatccgagatccccaatttggatatcatcggcaaacgcatcgagaagatcaagcaagagcacgagacttcgtggcattatgaccaggatcacccatacaagacttgggcctaccacgggtcctacgaaacgaagcagaccggcagcgccagctccatggtcaacggagtggtccgcctgttaaccaagccctgggatgtagtgccaatggttacccaaatggccatgacggatacgacccccttcggacagcagcgcgtgtttaaggagaaggtggacaccaggacccaggagcccaaggagggcaccaagaaacttatgaaaatcacagcggagtggctttggaaggagctgggaaagaaaaagacgccccgcatgtgcacgagggaagagttcaccaagaaggtccgctccaacgccgccctgggcgcaatattcacagacgagaataaatggaagtccgcacgggaggcggttgaggatgggcgcttctgggagctggtggaccgggagcgaaacttacatttagaagggaaatgcgagacgtgtgtctataacatgatggggaaacgggagaagaagctgggcgagttcggcaaagccaaggggtcgcgagcgatctggtacatgtggcttggcgcccggttcctggagttcgaggctctggggttcctgaacgaggatcattggttctcgcgcggcaacagcctaagcggggtggagggggaaggcctgcaccgtctggggtacatcctccgcgaggtcggcaagaaggagggcggcgccatgtacgctgacgacacggccgggtgggacaccaggattaccctggaggacctaaagaatgaggagatggtcaccaaccatatgaagggcgaacacaagaagctagccgaggcgatcttcaagctgacgtaccagaacaaggtggtgagggtgcaacgtccgacgccccgtggcaccgtgatggatatcatctctcggcgcgaccagcgagggtcgggccaggtcgggacctacggcctgaacacattcactaacatggaggcccagctcatccgtcagatggaaggcgaaggcatcttcaagagtatccagcacctaacggccaccgaggagatcgccgtacagaattggctagccagagtgggccgtgagcgcctctcccgtatggcgatcagcggggatgattgcgtcgtgaagcccatcgatgacaggttcgcctccgccctgacggccctaaacgacatggggaaggttcggaaagatatccagcagtgggagcccagccgcgggtggaacgactggacccaggtcccgttctgctcacatcacttccacgagttagtgatgaaggacggacgggtgctggttgtaccttgccgcaaccaggacgaactgataggccgggcacgcatcagccagggggcggggtggtccctcaaggagacggcttgcctgggtaagagttacgcccagatgtggaccctgatgtacttccaccggcgcgacttaagactggcggcaaacgctatctgctccgccgtgcccagccactgggtgcccacctctcgcacgacttggagcatccacgcgaaacacgagtggatgacgaccgaggacatgctggccgtgtggaaccgggtgtggatacaggaaaacccgtggatggaggataagacgccggttgaatcctgggaagaagttccatacctcggtaagcgcgaagaccaatggtgcggatcactgataggcttaaccagccgtgcgacctgggccaagaacatccaaaccgccataaatcaggtgaggtccctcatcggcaatgaggagtacaccgactatatgccatctatgaagagattccgtcgagaggaggaggaggccggcgtcctgtggtga

SEQ ID NO: 25222 - RNA, 9876 nt, synthetic construct
  misc_feature 1..9876: note = derived and/or modified CDS sequence (opt11) from DENV-2__EU677146__SS-prME
  source 1..9876: mol_type = other RNA
accgtgggagtcatagtgatgctaatccccaccgcgatggcctttcacctcaccacccgcaacggagagccgcacatgattgtcggcaggcaggagaaggggaagtccctactgttcaaaaccgaggacggggtcaacatgtgcactctcatggcgatagacctgggggaactgtgcgaggataccatcacctacaagtgcccgctcctgcggcagaacgagcccgaggacatcgattgctggtgcaacagcaccagcacctgggtgacctacgggacctgcaccactacgggcgaacacaggcgcgagaaacggtcggtggccttggtcccgcacgtgggaatgggactcgagacccgcactgagacctggatgagctcagagggcgcatggaagcatgtgcagcgaatcgagacctggatcctgcgccacccgggatttaccattatggccgctatcctggcgtacaccatcggaacgacccacttccaacgggctctcattttcatcttgctaaccgccgttgcgcccagcatgaccatgcgctgtatcggcatctctaacagagacttcgtggaaggcgtgagtggggggtcatgggtcgatattgtgctcgagcacggtagctgcgtgaccacgatggcgaagaacaagcccaccttagacttcgagctgataaagacggaggcgaaacagccggccaccctccgcaagtactgcatcgaggccaagctgacaaacaccacaacggagtcccggtgcccgacgcagggagaacctagcctgaacgaggagcaggacaagaggtttatctgcaagcactctatggtcgaccggggctgggggaacggctgcggcctgttcggcaagggcgggatcgtcacctgcgctatgttcacgtgcaaaaagaacatggagggcaaggtggtcctacctgagaatttagagtacacaattgtgatcacgcctcacagcggagaggagcacgcagtgggcaacgacaccgggaagcacggtaaggaaatcaagatcaccccgcagtccagcatcacagaggccgagttaaccggttacggcacagtgaccatggagtgcagcccccggaccggtctggatttcaacgagatggtactactccagatggaggacaaagcttggctggtgcaccggcagtggttccttgacctccccctgccctggctcccgggggcagacacccagggcagcaactggatccagaaggagacgctggttaccttcaagaacccccatgcgaagaagcaggacgtagtggttttggggtcccaggagggtgccatgcacactgccctgaccggggccacagaaatccagatgagcagcgggaacctactgttcaccggtcacttgaaatgtcgcctccggatggacaaactgcaactaaagggcatgtcctactccatgtgtacgggtaagtttaagatcgtgaaggagatcgccgagacccagcatgggacgatcgtcatccgcgtgcagtacgagggtgacggttccccctgcaagatccccttcgaaatcatggacctcgaaaaacggcacgtgttggggaggttgatcacggtcaatccgattgtgaccgagaaggatagccccgtgaacatcgaagcagagccacctttcggcgactcctacatcatcataggggtagagccaggccagctcaagctgaactggttcaagaagggctcctccataggccagatgttcgagactaccatgcgaggcgcgaagcgtatggctatattgggtgacactgcctgggacttcggcagcctcgggggcgtttttacctccatcggcaaggccctgcaccaggtgttcggcgcaatctacggcgcggccttctctggggtttcatggaccatgaaaatcctaataggcgtgatcatcacgtggatcggaatgaactcgcgcagcaccagtctgtccgtaagcctggtgctggtgggcgtggttaccctgtatctcggggtgatggtgcaggccgacagtggctgcgtggtgagctggaagaataaggaactgaagtgtgggtcgggaatattcataaccgacaacgtgcacacgtggaccgaacagtataagttccagcccgagagccccagtaaactggcctccgcgatacagaaggcccacgaagagggtatctgtgggatccggtctgtcacccgcctcgagaatttaatgtggaagcagatcacacccgagcttaaccacatcctctctgagaacgaggccaagttaacaataatgacgggtgacatcaaagggataatgcaggcgggaaagcggtcactgaggccgcagcccaccgaactcaagtattcctggaaaacgtggggcaaggcaaagatgctgagcacggagtcccataaccagaccttcctgatcgacggacccgagaccgcggagtgcccgaacaccaaccgtgcctggaacagccttgaagtggaggactacggattcggggtctttagtacgaatatctggctgaaactgcgcgagaagcaagatgtcttctgcgacagtaagctgatgtcggccgccataaaagataaccgggccgttcatgctgacatgggatactggattgaaagtgctttgaacgacacttggaagatggagaaggcctcctttattgagatcaagagctgccactggcctaagtcacataccctctggagcaacggcgtcctcgagtccgagatgatcatccccaagaacttcgctgggcccgtctcgcaacataactaccgcccgggctaccacacgcagacggccgggccttggcacttggggaaactggagatggacttcgacttctgcgaagggacgaccgtggtggtcactgaagattgcggtaaccggggtcccagcctcagaacaacgacggcatccgggaagctgatcaccgaatggtgctgtaggagctgcaccctgcccccgctccggtatcggggcgaggacgggtgctggtacggcatggagatccgtccactgaaggagaaggaggaaaacctggtaaactccctcgtgacggccgggcacggccagatcgacaactttagcctgggcgtgttggggatggcgctcttcctggaagagatgttacggacccgcgtgggcacaaagcacgccatccttctggttgccgtcagctttgtgacactgattactggtaacatgagcttccgggacctcggccgcgtgatggtcatggtgggggccactatgacggatgatattggcatgggtgtgacctatctggctctgctagccgccttcaaggtccgacccacgttcgcggccggcctgctgctcagaaaactaacctccaaggaactgatgatggccacgatcggtatcgccctcctcagccagtccacaatacccgaaaccatccttgagttgacggacgcgctggccttggggatgatggtgctcaagatcgtgcgcaacatggagaagtaccagctggccgtcacaatcatggcgataagctgcgtgccgaacgcggtgatcctgcagaacgcctggaaggtctcctgcaccatcctcgcggctgtgagcgtctcccccctgctgctcacaagttcccagcagaaagccgactggatacccctggccctgaccatcaagggcctaaaccccacagcaatcttcctgaccacgctgagccggacctccaagaagagaagctggccgctcaacgaggccgtgatggctgtaggcatggtgtccatcctggccagcagcctgctcaagaacgacatcccaatgaccggccccttagtagccggcgggctgctgaccgtctgctacgttctgacaggcagatccgcggatctggagttggagcgcgcggccgacgtgaagtgggaggaccaggcagagatcagtgggtccagccccatcctctccatcaccattagcgaggacggctccatgtcaataaagaacgaggaggaggagcacacgctgaccatcctcatacggacgggcctgctggttatctcgggggtcttcccggtgtctattcccataaccgccgcggcatggtacctctgggaggtgaaaaagcaacgcgccggtgtcctgtgggacgtgcccagcccgccgcccgtggggaaggccgagctagaggatggcgcatatcggataaagcagcgcgggatattcggctacagccagatcggcgcgggagtctacaaagaaggcactttccacacgatgtggcacgtgacccgcggggcagtgcttatgcaccgcggcaagcggatcgagccctcttgggccgacgtcaaaaaggacctgatctcatacgggggcggctggaagctcgagggggagtggaaggaaggagaggaggttcaggtgctcgccttagagcccgggaagaacccacgcgccgtccagacgaagccgggccttttcaagaccaacaccgggaccatcggcgcggtctccctcgacttctcacccggaacgtccggttcacccatcgtggatcgcaagggtaaggttgtggggctgtatggcaacggtgtggtcacccgctccggcgcctacgtgtccgccatagcccagaccgagaaatccattgaggacaaccccgagatcgaagatgacatcttccggaagaagcggctgaccatcatggacctccaccccggcgcggggaagaccaagaggtatctgcccgccatcgtgagagaggctataaaacggggactgcgcaccttgatcctcgccccgaccagggtagtggccgcggaaatggaggaagccttacgggggttacccatacgttaccaaactcccgccatccgggccgagcacaccggccgtgagatcgtggatctcatgtgtcacgccaccttcactatgcgtctgctaagtcccgtccgagtgcccaattataatctcattatcatggacgaggcgcacttcaccgaccccgctagcatcgccgcgcggggttacatctccacgcgggtggagatgggggaagctgcgggcatctttatgacggccacgccgccggggtcccgggacccattcccccagagtaacgcaccgatcatggatgaagagcgtgaaatccccgagcggagctggaactccggtcacgagtgggtaaccgacttcaaggggaagactgtgtggttcgtaccgagcatcaaggcgggcaatgacatcgcggcgtgcctgcgcaagaacgggaagaaagtgatccagctgtcccggaagaccttcgattccgagtatgtgaagacccgagctaacgactgggactttgtagtcaccacggatatttccgagatgggcgccaacttccgggccgagcgagtgatcgaccccaggcgctgcatgaagcccgttatcctcacagacggcgaggagcgggtcattctggcggggccgatgccggtgacgcacagctcagccgctcagcgccgcggtaggatagggcgcaaccctaaaaacgaaaacgaccaatacatctacatgggggagcccctggaaaacgatgaggactgtgcccactggaaggaggctaagatgcttctagacaatattaatactcctgagggcatcataccgtctatgtttgagcccgagcgggaaaaagtggacgcgatagacggggagtaccgtctgagaggggaggccaggaagacttttgttgatctcatgcgtaggggggacctgcctgtgtggctggcataccgggtggcagccgagggcatcaactacgcggatcggcgatggtgcttcgacgggataaaaaacaaccagattctcgaagagaatgtcgaggtggagatctggaccaaggagggcgagagaaagaaactgaagcctcggtggctggacgcccgtatatactccgacccgctcgctcttaaggaattcaaggagtttgccgcgggtaggaagtccctgaccctcaacctcataactgagatggggcgcctgcccactttcatgacccagaaggcccgggatgccctcgacaacctggccgtcctgcataccgccgaggtcggcggtagagcgtacaaccacgccctttccgagcttcccgagactctggagacgttacttctcctcaccttactggctactgtcaccggtggaatcttcctcttccttatgagcgggaaaggcatagggaagatgacgttgggcatgtgctgcatcatcaccgcgtccatcctcctgtggtacgcacagatccagccccactggattgcggccagcataatcctggaatttttcctcatagtcctgctgatccccgaaccggagaagcaacggacgccccaagataaccagctcacctacgtggtgatcgccatcctaacagtagtggccgccacgatggcgaacgagatggggttcctggagaagaccaaaaaggacctcggcctgggtagcatcactacccaggaatccgagagcaacatcctggacatcgatctccgcccggcctccgcatggaccctgtacgctgtggccaccaccttcgtcactcctatgcttcggcacagcatcgagaactcctcggtgaatgtctccttgacggccatcgccaaccaagctaccgtcctgatggggctgggcagaggatggcctctgtctaagatggacatcggcgtgcccttgttagccatcgggtgctacagtcaagtgaacccgatcaccctcaccgctgccctcctgctgctggtggcccactatgccatcatcggcccaggcttacaggccaaggcgacgcgcgaggctcaaaagcggaccgccgccggtattatgaaaaacccaacagtggacggcatcactgtgatagacctcgagccgatcccatatgaccccaagttcgaaaagcagctggggcaggtcatgttattagtgctatgcgtgacgcaagtcttaatgatgcgcacaacgtgggccttgtgcgaggcgctgaccttggccacgggtcccatcagcaccctatgggaggggaatccgggccggttctggaacaccaccatcgccgtctctatggccaatatcttccgcggctcttacctagcgggtgcggggctcttgttctctataatgaagaatacgaccaacacacggcgggggacgggtaacatcggggagacgttgggagagaagtggaagtcacggctaaatgccttaggcaaatccgaatttcagatttacaagaagagtgggatccaagaagtggatcgcaccttggcgaaagagggcatcaagcgtggagagaccgaccatcacgccgtcagccgcggcagcgcgaagctgcggtggttcgtggaacgaaatatggtgaccccggagggaaaggtggtggatctcggctgcggccgcggcgggtggtcctactactgtggcggactgaaaaacgtgcgcgaggtcaaggggctgacaaagggcggtcccggccacgaagagcccatccctatgagcacctatggctggaacttggtgcggctacaaagcggggtggatgtgtttttcactccgcccgagaagtgtgacaccttgctctgcgacataggagaatccagtcccaaccctacgatcgaagccgggcgcaccctgcgggttctgaacctggtggaaaactggctgaacaataacacccagttctgcatcaaggtcctgaacccgtatatgccatccgttatagagaagatggaaacactccagcgcaagtacgggggcgccttggtgcggaaccctttgagccgaaactccacccacgaaatgtattgggtcagcaacgccacggggaacatcgtgtcctcggtgaacatgatctcgcgtatgcttatcaaccggttcaccatgaagcacaagaaggctacttacgaaccggacgtcgacctcggcagcgggacccgtaacatcggcatcgaaaatgagatccccaacctggatatcatcggcaagcggatcgagaagatcaagcaagagcatgagacgagctggcactacgatcaggaccatccttacaagacctgggcgtatcacgggtcctacgagaccaagcagaccggatccgcctcatccatggtgaacggcgtggtaaagcttcttaccaaaccatgggacgtagtgccgatggtcacacagatggccatgaccgacaccacgccattcggccagcagcgcgtgttcaaggagaaggtggacacgcggacccaggaaccaaaggagggcaccaagaagctgatgcgaatcacggccgagtggctgtggaaggagctcgggaagaaaaaaacgccccggatgtgcactcgcgaggagttcactcggaaggtccgcagcaacgccgcgctgggcgccattttcacggacgagaacaagtggaagtccgcccgggaagcagtggaggacagccgattttgggagctggtcgaccgggagcgcaacctacacctggaggggaagtgcgagacgtgtgtgtacaacatgatggggaaacgggagaaaaaactgggggagtttggcaaagcaaaggggtcccgcgccatttggtacatgtggttaggggcaagatttctggaatttgaggcattaggcttcctgaacgaggatcattggttcagccgtggaaacagtttgagtggcgtggagggagagggactgcacaagcttggctatatcctccgggacgtcagcaagaaggaggggggggccatgtatgcagatgacaccgccggatgggacacccgcatcacgctggaggatctcaagaacgaggagatggtaaccaaccacatgaagggcgaacacaagaagctcgccgaggccatcttcaaactgacctaccagaacaaggtggtccgggtgcagcggccgacgcccaggggaacggtgatggacatcatctcccggaaagatcagagggggagcggccaggtaggtacctacgggctcaatacattcacaaacatggaggcccagcttatacggcagatggagggggagggcatcttcaagtccatccagcgcctgacggtaaccgaggagatcgcggtgcaaaactggctcgcgagggtcggccgcgaacgcttaagccgcatggccatctccggagacgactgcgtggtcaagccgctggacgatcgtttcgccagcgccctaactgcgctgaacgacatgggcaaggttcgcaaggacatccagcagtgggagccgagccgggggtggaatgattggacccaggtgccgttctgtagccaccatttccacgagttagtgatgaaggatggccgggtcctcgttgtgccctgcagaaaccaggatgagttgattggacgcgccagaatatcgcaaggcgccggctggagcctaaaggagacggcctgcctcggaaagagctatgcccagatgtggaccctgatgtacttccatcgccgggacctgcgcctcgctgccaacgctatatgttcagccgtcccctcccattgggtgcccactagccggaccacctggtcaatccacgccaagcatgagtggatgactaccgaggacatgctggcggtctggaaccgcgtctggatccaggaaaatccgtggatggaggacaagacgcccgtggagagctgggaggaggtgccgtacctgggcaagcgagaggaccaatggtgtggctcgctcataggtctgacttcccgtgctacctgggccaagaacatccagaccgccattaaccaggtccgatccctgatcggcaacgaggagtacaccgattacatgccctccatgaaacgtttccgcaaagaggaagaggaggcgggggtgttgtggtga

SEQ ID NO: 25223 - RNA, 9876 nt, synthetic construct
  misc_feature 1..9876: note = derived and/or modified CDS sequence (opt11) from DENV-2__EU687214__SS-prME
  source 1..9876: mol_type = other RNA
accgccggggtaattattatgctgatccccaccgcaatggcgttccacctcaccacccggaacggggagccccacatgatcgtcggccggcaggagaaggggaagtcccttctgttcaagaccgaggacggcgtgaacatgtgcaccctcatggctatagacctgggggagctctgtgaggatacaataacatacaaatgccccctcctgcgacagaacgagcccgaggacatcgactgctggtgcaacagcaccagcacgtgggtcacatacgggacctgcaccaccaccggcgagcaccggcgcgagaagaggtccgtggccctggtgccccatgtggggatgggactagagactcggaccgagacttggatgagctcagagggggcctggaagcacgtccaacggatcgagacctggatcttaaggcacccgggctttaccatcatggccgcgatcctggcatacactatcgggaccacgcacttccaacgggctctcatctttatcctgctgaccgccgtggcgccctctatgaccatgcgctgcataggcatctccaaccgggacttcgtagagggcgtaagcggcggcagctgggtggacatcgtgctcgagcatgggtcgtgcgtcactacaatggccaagaacaagccaaccctggacttcgagctgatcaagaccgaggccaagcagcccgccacgcttcgcaagtactgtatcgaggccaagctgacgaacaccaccaccgaatcccggtgccccacgcagggcgagccctcgctgaacgaggagcaggataagcgcttcatttgcaagcactccatggtcgaccggggctgggggaatggctgcggcctcttcgggaaaggcgggatcgttacctgcgcgatgttcacgtgcaagaagaacatggagggcaaggtcgtgctgcctgagaacctggagtacaccatcgtgataacgccccatagcggggaggaacacgcagttggcaacgacaccgggaaacacggaaaagagatcaagatcaccccgcagtccagcatcactgaggcagagctcaccgggtacggcacggtgaccatggagtgcagcccccggaccgggctggatttcaacgagatggtcttactccagatggaagacaaggcctggctggtccaccggcagtggttcctggacctccccctgccctggctgccgggggccgatacccaaggcagcaactggatccagaaggagacgctggtgaccttcaagaacccccatgccaagaagcaggacgtggtagtgctggggtcccaggagggcgccatgcacacggccctgaccggtgccacggaaatccagatgagctccggcaacctcctgttcaccggccacctaaaatgccgtctccgtatggacaagctgcagctgaaggggatgtcttatagcatgtgcaccggcaagttcaagatcgtcaaggagatcgccgagacacagcacgggacgatcgtgatccgagtgcagtatgagggcgacggctccccctgcaagatccctttcgagatcatggacttagagaagcggcacgtcctggggcgactgatcaccgtgaacccgatcgtcaccgaaaaggacagccccgtaaacatcgaggcggagccgcctttcggagactcttacatcatcatcggggtggagccgggccagctgaaactgaactggttcaagaaggggagctccatcggccagatgttcgagaccacgatgaggggcgctaagcggatggccatcctgggagacaccgcctgggacttcggcagcctagggggcgtgttcacatccatcgggaaagcactgcaccaggtcttcggcgcgatctacggcgccgccttcagcggggtgtcctggactatgaagatcttaatcggcgtgatcatcacgtggatcgggatgaatagccgctccaccagcctttccgtcagcctagtgctagtgggcgtcgtgaccctgtacctcggcgtgatggtccaggcggacacgggctgcgtagtgtcctggaagaacaaggagctgaagtgcggaagcgggattttcatcaccgacaacgtgcacacctggacggaacagtacaagttccaacccgagagccccagcaagctggcgagcgccatccagaaggcccacgaggagggcatctgcgggatccggtccgtcaccaggttggagaatttgatgtggaagcagatcacgcctgagctaaaccacatcctcagtgagaacgaggtaaagctgaccatcatgaccggcgatatcaaggggatcatgcaggccggcaagcggtccctacgcccgcaaccaaccgagctcaagtacagctggaagacgtggggcaaggccaagatgctgagtaccgagtcgcacaaccagaccttcctgatcgatgggcccgaaactgccgagtgcccgaacacgaaccgggcctggaactccctcgaggtagaagactacggcttcggagtgttcagcactaacatctggctaaaacttcgcgagaagcaagacgtgttctgcgactccaagctcatgagcgccgccatcaaggataaccgggccgtccacgccgacatgggctactggatagagtcagcgctaaacgacacctggaagatggagaaggcctccttcatcgaaatcaagtcctgccactggcccaagagccacaccctctggtccaacggcgtgcttgagagtgagatgattatacccaagaacttcgccgggcccgtgtcccagcacaactaccgcccgggctatcacacccagacggccgggccctggcacctgggcaagctggagatggacttcgacttctgcgagggaaccaccgtcgttgtgaccgaagattgcggaaaccggggtcccagcctcagaacgaccactgctagcggaaagctgattaccgagtggtgctgccggtcgtgcacgctgcccccactacgctaccggggcgaggacgggtgctggtacggcatggagatccgacctctgaaggagaaagaggagaacctggtcaactctctcgtgaccgccgggcatggccagatcgacaacttctcactgggcgtgctgggcatggcccttttcctggaggaaatgctccggacccgcgtcggcacaaagcacgccatcctcctcgtggcggtgagtttcgtcacgctgatcaccgggaatatgtccttccgcgacttgggccgcgtgatggtaatggtcggggcaaccatgaccgatgacatcggcatgggcgttacgtacttggccctgttggcagccttcaaggtgcgccccacctttgcggccggcctgttactcagaaagctgacatctaaggagctgatgatggccaccataggcatcgccctcctaagtcagtccacgatcccagagaccatcctggaactaaccgatgccctggcgctggggatgatggtcctcaagatcgtgcgcaacatggagaagtaccagctggccgtgaccattatggccatctcctgtgtccccaacgccgtgatcctgcagaatgcctggaaggtgagctgcacgatcctcgcggccgtctccgttagccccctgctgctcacctctagccagcagaaggccgactggatccccctggccctgaccatcaagggcctcaacccaactgccatcttccttacgaccttgtcccggacaagcaagaagcgaagctggccgctcaacgaggctgtcatggctgtgggtatggtgagcatcctggccagtagcctgctcaaaaacgacatccccatgaccggtcccttggtcgccggagggctgttaaccgtgtgctacgtgctgaccggccggagcgcggaccttgagctcgagcgtgcggctgatgtcaagtgggaggaccaggccgaaatctccggaagctcccccatcctaagtatcaccatctccgaggacggcagcatgagtatcaagaacgaggaggaagaacacacccttacgatcctcatccgtacggggctgctggtgatctctggagttttcccggtctccatccccatcacagccgcggcctggtacctctgggaagtgaagaagcagcgcgcgggcgtgctatgggacgtccccagcccgccacccgtgggaaaggccgagctggaggacggcgcctaccggatcaagcagcgcgggatcttcggctactcgcagatcggcgcaggggtttacaaggagggaaccttccataccatgtggcacgtcaccagaggggcggtgctcatgcaccgcggcaagcgaatcgaacccagctgggccgacgtgaagaaggacctgatctcctacgggggcggctggaagttagagggggagtggaaggaaggcgaggaggtacaagttctcgccctggagcccgggaagaatccccgcgctgtgcagaccaagcccggactgttcaagactaacaccggcacgatcggcgcggtcagcctcgatttttcccccggcacatctggttcccccatcgtggatagaaagggcaaggtggttgggttgtacggaaacggcgtggtgacgcgcagcggggcctacgtcagtgccatcgcccagactgagaagagtatcgaggataacccagaaatcgaggacgacatcttccggaagaagcgcctgactataatggacctccaccccggcgcggggaagaccaagcggtacctacccgccatcgttagagaggctatcaagcgtgggctgcgcactctgattctcgccccaacccgagtggttgccgcagagatggaggaggcgctgcgggggctgcccatccgctaccagacacccgccatccgtgccgagcacaccggccgcgagatcgtggacctaatgtgccatgccacctttacaatgcgtctgctgagccccgtgagggtccctaactacaacctcatcatcatggacgaggcgcacttcactgaccccgcttccatcgccgcccgcggttacatctcgacccgcgtggagatgggggaggccgcaggaatcttcatgaccgcaacgccgcctgggtccagagacccgttcccccagagcaacgcccccataatggacgaagagagggagatccccgagcggtcttggaactcgggccacgagtgggtgactaacttcaaggggaagacagtctggttcgtgccgtccatcaaggcgggcaacgacatcgcggcctgtctgcgcaagaacggaaagaaggtgatccagctgtcacggaagaccttcgactccgaatacgtcaagacccgcgccaacgactgggacttcgtggtgacgaccgacatcagcgagatgggggccaattttcgtgccgaacgcgttatcgacccccggcgctgtatgaagcccgtgatcttaacagacggcgaggagcgggtgatcctggcgggacccatgccggtcacccactcctcagccgctcagcgcaggggccgaatcgggcgcaaccccaagaacgagaacgaccagtacatctacatgggcgagccgctggagaacgatgaagactgcgcccactggaaggaggccaagatgctgctggacaacattaacacgcccgagggcatcatcccgtccatgttcgagcccgaaagagagaaggtggacgcgattgacggggagtaccgcctgcggggagaggctcgcaagaccttcgtggacctgatgcggcgcggggacctgccggtctggctggcctaccgggtggccgccgagggcatcaactacgcggaccgacggtggtgtttcgacgggatcaagaataaccagatcctcgaagagaacgtggaggtagagatatggaccaaggagggcgagcgcaaaaagctgaagccgcggtggctcgacgcgcgcatctacagcgacccactcgccctgaaggagttcaaggagttcgcagccggccggaaatccctgacgctcaacctgatcacagagatggggcgcctgccaaccttcatgactcagaaggcccgcgacgctttggacaacctggccgtgctgcacacggccgaggtcggcgggcgcgcgtataaccacgccctcagcgaactgcccgagacgctggagaccctcctgctgctcaccttactggccaccgttacgggcggcatcttcctcttcctgatgtccggaaagggcatcgggaagatgaccctggggatgtgctgtatcattacagctagcatcctcctgtggtatgcccaaattcagccgcactggatcgcggcctccatcatcctggagttcttcctcatcgtgctccttatcccggaacccgagaagcaacggacgccccaggacaaccagctcacctacgtcgtgatcgccatcctcactgtggttgccgccaccatggctaacgagatggggtttctggagaagaccaagaaggacctcggcctgggctctatcacgacgcaggagagcgagtccaacatccttgacatcgatcttagaccagccagcgcctggaccctatacgccgtggccaccaccttcgtgacgcccatgctgcgacactccatagagaacagctccgtcaacgtgagcctcactgcgatcgccaatcaagccaccgtactgatggggttgggccgcgggtggcccctcagcaagatggacatcggcgtgcctctcctggccatcgggtgctacagccaggtgaaccccataaccctcacggcggcactgctgttgctagtggcccactacgccatcatcgggcccgggctccaggccaaagcgacgcgcgaggcccagaagcggacagccgccgggatcatgaagaaccccaccgtagacggcatcacggttatcgacctcgagcccatcccgtacgaccccaagttcgagaagcagctgggacaggtgatgctgctcgtcctgtgcgttacccaggtactgatgatgcgtaccacctgggccctctgcgaggcgttgacgctggccaccggccccatctccactctctgggaggggaacccaggccggttctggaacaccacaatcgccgtcagcatggccaacatcttccgcggcagctatctggctggggcgggtctcctcttcagcatcatgaagaacaccaccaacacccgacgcgggacgggcaatatcggagagaccctgggggaaaagtggaagtcccggctcaacgccctcggcaagagcgaatttcaaatctacaaaaagagcgggatccaggaggtggaccgcactctggccaaggagggtataaagcgcggggaaaccgaccaccacgccgtgtcgcgcggatctgcgaaacttcggtggttcgtcgagcgcaacatggtcacgccggaaggcaaggtggtcgatctcggctgcggccgcggcggatggtcatactactgcggcgggctgaagaacgtgcgagaggtgaaggggttgaccaagggcgggcccgggcacgaggagcccatcccaatgtccacatacggctggaacctcgtacgactgcagagcggggtggacgtgtttttcaccccgccagagaagtgcgacaccctgctctgcgatattggcgaaagcagccccaaccctaccatcgaggcgggccgcaccctgcgagtcctgaatctcgttgagaactggctgaacaacaacacccagttttgcgtgaaagttctgaacccgtacatgcctagtgtaatcgagaaaatggagaccctccagcgcaagtacggaggggccctggtgcgaaaccccctgtcccgcaactcgacacacgagatgtactgggtttccaacgcgaccgggaacatcgtgagctcggtgaacatgataagccgtatgctgatcaaccgcttcaccatgaagcataagaaggccacctacgagccggacgtcgacctcggatctgggactcgcaacatcggcatcgagaacgagattcccaacctagacatcatcggaaagcggatcgagaagatcaagcaggagcacgagacgagctggcactacgaccaggaccacccctacaagacatgggcgtaccacgggtcctacgagacgaagcagacgggcagcgcttctagcatggtgaacggagtggtcaagttgctcaccaagccttgggacgtagtaccgatggtcacccagatggccatgacagacaccacccccttcggccagcagcgcgtgttcaaagaaaaggttgacacccggacccaagagcccaaggagggcacgaagaagctgatgcgcatcaccgcggagtggctttggaaggagctagggaagaagaaaacgccgcgtatgtgcacccgcgaggagttcacgcggaaggtccgctccaacgccgcgcttggggccatcttcaccgacgagaacaagtggaagtccgctagggaagcggttgaggacagccgcttctgggagctggtcgaccgggagcgcaacctccacctggaggggaagtgtgaaacctgtgtgtacaacatgatgggcaagcgggagaagaagctcggtgaatttgggaaggcgaaaggtagccgagccatctggtatatgtggttaggtgcccggttcctggagtttgaggccctaggcttcctcaacgaggaccattggttcagccgcgggaactcgctgtccggagtggagggggagggcctccacaaacttggctacatccttcgggacgtctccaagaaagagggtggtgccatgtacgctgacgacactgctgggtgggatacgcgcatcaccctggaagacctcaaaaacgaagagatggtgaccaaccacatgaaaggcgagcacaagaagctggccgaggctatcttcaagctgacctatcagaacaaggtggtccgggtccagcgccctacgccacgcgggaccgtgatggacattatcagccggaaggaccagcgcggctccggccaggtcgggacgtacggcctcaacaccttcacgaacatggaggcccagctgatacgacagatggagggggaggggatcttcaagtctatccagcgcctgaccgtgaccgaggagatcgcggtgcagaactggctcgcaagagtcggccgcgagagactgtcccgcatggccatctcgggggatgactgcgtagtgaagcccctggacgaccggttcgcctcggcattaattgcgctgaacgacatgggcaaggtccgaaaggacatccagcagtgggagccaagccggggttggaacgactggacccaggtgccgttctgcagccaccactttcacgaattggtcatgaaggacggccgcgttctcgttgtgccgtgcagaaatcaagacgaactgatcgggcgcgcacggatcagccaaggtgccggctggagcttaaaggagacggcatgccttggcaagtcgtacgctcagatgtggaccctgatgtattttcaccgacgggatctgcgcctcgcggccaacgccatctgctccgccgtccccagccactgggtccccacctcccgcaccacctggagtatccacgccaagcatgagtggatgacgaccgaggacatgctggccgtgtggaaccgcgtctggatccaggagaacccgtggatggaggacaagacccccgtggagtcctgggaggaggtgccctaccttggcaagcgcgaagaccagtggtgcgggagcctcatcggcttaaccagccgcgccacgtgggccaagaacatccaaacagccattaatcaggtgcgctccctgattgggaacgaggagtatactgactacatgcccagtatgaagcggttccgcaaggaggaggaggaagcgggcgtcctctggtga

SEQ ID NO: 25224 - RNA, 9876 nt, synthetic construct
  misc_feature 1..9876: note = derived and/or modified CDS sequence (opt11) from DENV-2__EU687215__SS-prME
  source 1..9876: mol_type = other RNA
accgccggggtcatcataatgctgatccccaccgccatggcgttccacctcaccacccgcaacggggaacctcatatgatcgttggtcggcaggagaagggtaagtctctgctattcaagactgaggatggtgtgaacatgtgcaccctcatggccatcgacctgggggagctgtgcgaggataccatcacgtacaagtgccccctcctgcggcagaacgagcccgaggatatcgactgctggtgcaacagcacctcaacctgggtgacctacggtacctgcaccaccacgggcgagcaccggcgcgagaagcggtccgtcgctctggtgccccacgtcgggatggggctcgaaacccgcactgagacctggatgagctccgaaggggcctggaagcacgtccagcggatagagacatggattctgcgtcatccggggttcacaatcatggccgcgatactggcctacaccatcgggactacgcacttccagcgtgccctcatcttcattcttctaacagctgtggctcctagcatgaccatgcgctgcatcggcatctccaaccgggacttcgtggagggcgtctctgggggctcctgggtggacatcgttctcgagcacgggagctgtgtcaccaccatggccaaaaataagcccaccctggacttcgagctaatcaagaccgaggccaagcagcccgccacccttcgcaagtactgcatcgaagccaagctgacaaacaccaccaccgagtcccggtgcccgacgcaaggcgagcccagcctcaacgaggaacaggacaagcgcttcatctgcaagcactccatggtggaccggggctgggggaacggctgcggcctgttcggaaaaggagggatcgtgacctgcgccatgttcacgtgcaagaagaatatggagggcaaggtcgtgctgcccgagaacctggagtataccatcgtgatcacaccccacagcggcgaggagcacgccgttggcaatgacactggcaagcatggcaaggagataaagataacaccgcaaagtagcattaccgaggctgagcttacaggctacggcacggtgacgatggaatgtagcccccggaccggactggatttcaacgagatggtgttgctccagatggaggacaaggcctggctagttcaccggcagtggttcctggacttacctctgccgtggctgcccggggctgatacacagggcagcaattggatacagaaagagacgctcgtgaccttcaagaacccccacgcgaaaaagcaggacgtagtcgttctgggtagtcaggagggggccatgcacaccgcgctgaccggagccacggagatccagatgtctagcggcaacctcctattcaccggacacctgaagtgccgcctccggatggacaagctgcagctgaagggtatgtcctacagcatgtgcacaggcaaattcaaaatagtcaaagagatagccgagacccagcacgggacgatagtgatccgcgtgcaatacgaaggagacggctccccctgcaagatccccttcgagattatggacctcgagaaacggcatgtcctgggtcgcctcatcaccgtgaatccaattgtaaccgagaaggacagccccgtcaacatcgaagcggagccgccctttggtgattcctacataatcatcggggtggagcccggtcaactcaagttaaactggttcaagaaggggagctccatcggtcagatgttcgagaccacgatgcgaggcgccaagcggatggccatcctgggcgacaccgcctgggatttcgggagcctcgggggcgtgttcacgtccatcgggaaagccctccaccaggtcttcggggcaatctacggcgccgccttcagcggggtctcctggaccatgaagatcttgatcggcgtgataatcacctggatagggatgaacagccgttcaaccagcctgtccgttagcctagtgctggtgggcgtggtgaccctgtacctcggggtaatggtccaagccgacaccggctgcgtggtgagctggaaaaacaaggagctgaagtgcggatcagggatcttcatcacggacaacgtacacacctggaccgagcagtacaaattccagcccgagtccccgagcaaactggcgagcgccatacagaaggcccacgaagaaggaatctgcgggattcggtccgtaacgcgcttggaaaacttaatgtggaagcagataacgcccgaactgaaccacatcctcagcgaaaacgaggtgaagctgacaattatgaccggcgacatcaaggggatcatgcaagccggcaagcggtccctgcgcccgcaaccgacggaactcaagtattcttggaagacttggggcaaagccaagatgctgtccacggagagccacaaccagaccttcctcatcgacgggccggagaccgctgaatgtcctaatacgaaccgggcttggaactctcttgaggtcgaggattatggcttcggggtgttcagcaccaacatctggctgaaactaagggagaagcaggacgtattttgcgattccaagctcatgtccgccgcaatcaaagacaatcgcgccgttcacgcagacatgggctattggatcgagtccgcgctgaacgacacctggaagatggagaaggccagctttatcgagattaagtcttgccactggccaaagagccacactctgtggtccaatggcgtgctcgagagcgagatgattatccccaagaacttcgcagggcccgtgtcgcaacacaactaccgcccgggatatcacacccagacagccggtccatggcacctgggtaagttggagatggacttcgacttctgtgagggcaccaccgtcgtggttaccgaggactgtggcaaccggggccctagtctgcgcacgaccaccgcaagtgggaaattaatcaccgagtggtgctgccggtcgtgcacgctgcccccgctacgctacagaggggaagacggctgctggtatggcatggagatccgcccattaaaggagaaggaggaaaacctggtcaacagcctcgtgaccgccgggcacggacaaatcgacaatttctccctgggcgtcctcggcatggccttgttcctggaagaaatgctgcggacccgcgtcggaaccaagcatgccatcctcttggtagctgtgagcttcgtgacgctgatcaccgggaacatgtccttccgggacttgggccgcgtgatggtgatggtcggggcgaccatgacagacgacatcggcatgggcgtgacgtacctcgcattgctagccgccttcaaggtgcggcccactttcgcagccgggttactgttgcgcaaactgactagcaaagagctgatgatggccactatcggtatcgcactcctatcacagagcaccatccccgagaccattttagagctcacggacgccctggcgttggggatgatggtccttaagatcgtgcgcaacatggagaagtaccagctggccgttaccatcatggccatctcttgcgtcccgaacgcagtgatactgcagaacgcgtggaaggtgagctgcaccatcctcgcggccgtgtccgtgagccccctgctgcttacctccagccagcagaaggccgactggatccccctggcccttaccatcaagggcttgaaccccacagcgatcttcctgacgaccctgtcccggacgtctaagaagaggtcctggcccctgaatgaggcagtcatggcagtgggaatggtgtccatcttagcctccagcctgctcaagaacgacattcctatgaccgggcctctagtcgccggtgggttgctcactgtgtgctacgtgttgaccggccggagcgcggatctcgagctcgagcgagccgccgacgtgaagtgggaggatcaggccgagatctcaggtagctccccaatcctcagcatcaccatcagtgaggacggatcaatgtccatcaagaacgaggaggaggagcacaccctaacgattcttatccggaccggcctattggttatcagcggtgtgtttccggtcagcatccccatcacggccgcggcctggtacttatgggaggtgaagaaacaacgagccggcgtgctgtgggacgtccccagcccgccgccggtgggcaaggccgagctggaggacggagcctaccggatcaagcagcgcgggatctttggctactcccagatcggcgcgggggtgtacaaagagggtaccttccacaccatgtggcacgtcacgcgcggggcggtgctcatgcaccgtggcaagcgcatcgagcccagctgggccgacgtgaagaaggacctgatcagttacgggggcggctggaagctggaaggagagtggaaagagggcgaggaggtacaagtgctggctctcgagcccgggaagaacccccgagccgtgcagaccaagcccgggctgttcaagaccaagaccgggacgataggcgcggtgtccctcgacttctctcccggaaccagcgggtcccccatcgttgaccggaagggcaaggtggtggggctgtacggcaatggggtggtgacccgcagcggggcctacgtttccgccatcgcccaaaccgaaaagagcatagaggacaatcccgagatcgaagacgacatattccggaagaagcgcctgacgataatggacctccaccccggtgcggggaagaccaagcggtatctccccgcaattgtaagagaggccatcaagcggggcctccgaacccttatcctcgcgccgacccgcgtggtcgctgcggagatggaggaagccctccggggactgcccatccggtaccaaacgcccgcaatccgggccgaacacaccggccgcgaaatcgtggacctcatgtgccacgcaacattcacgatgcggctgctgagtcccgtccgcgtcccgaactataacctcatcattatggacgaggcgcacttcaccgatcctgcctccatcgccgccagaggctacatcagcacccgcgtggagatgggggaggcggccggcatcttcatgacagccacgccgcccgggtcccgggacccgttccctcagagcaatgcccccataatggacgaggagcgcgaaatccccgaacgcagctggaactccgggcatgagtgggtcacggactttaaggggaagactgtgtggttcgtgccgtccattaaagccggcaacgacatcgctgcttgcctgcggaaaaacggcaaaaaggtgatccaactcagccggaagactttcgactccgagtacgtcaaaacccgcgccaacgactgggacttcgtggtgacgactgatatctctgagatgggggcgaacttccgggccgaacgcgtcatcgaccctagaagatgcatgaaacccgtgatcctaaccgacggcgaggaacgggtgatactggcggggcctatgccggtcacccactcctcagccgcccagcgccgcggccggatcggtcgcaacccaaagaacgaaaacgaccagtacatctacatgggggagcccctggagaacgatgaggactgcgcccactggaaggaggccaagatgctcctggataatatcaacacgcccgagggcatcattccctccatgttcgagcccgaacgggagaaggtggacgcgatcgacggggagtaccgcctgaggggcgaagcgcgcaagacctttgtggacctcatgcggcgcggggacctgccagtttggctcgcctaccgtgtggcggccgagggcatcaattacgccgacagaaggtggtgcttcgacgggatcaaaaacaaccagatcttggaagagaacgtggaagtcgagatatggaccaaggagggcgagcggaagaaactcaagccgcggtggctggacgccaggatttacagtgaccccctcgctttaaaggagttcaaggagttcgccgcgggccggaagagtctgaccctgaacctgatcacggagatggggcgcctgcctaccttcatgacccagaaggcacgcgacgccctcgacaacctggccgtgctacacaccgccgaggtcgggggacgcgcatacaaccacgcgctcagcgaacttcccgagacgttggagaccctcctgctgctcaccctgctggccacagtgacaggcggcatcttcctctttctgatgtccgggaagggcatcgggaagatgaccctgggcatgtgctgcatcatcactgccagcatcctcctgtggtacgcacagatccagccgcactggatcgccgcctcaatcatcctggagttctttctcatcgtcctgctgatccccgagcccgagaagcaaaggacgccccaggacaaccaactcacgtacgtcgtgatcgccatcctaacagtggtcgccgccaccatggcgaatgagatggggttcctcgagaagactaagaaggacctcggcttaggcagcataactacgcaggagagcgagtccaacattctggatatcgacctacgaccggcctccgcttggaccctgtacgccgtggcgaccgcgttcgtgacccccatgctgcggcactccatcgagaactctagcgtcaatgtgtccctcacggccatcgccaaccaggccaccgttctgatggggctgggccgcgggtggcccctctcgaagatggacataggcgtgcccctgctagcaatcgggtgctacagccaggtgaacccgatcacactcaccgcagccctgctgctcctggtggctcactacgccattatcggcccgggcctgcaggcgaaggccacgcgcgaggcccagaagcggaccgccgctggtatcatgaagaaccccaccgtagacggcatcaccgtgatcgacctcgaacccatcccgtacgaccccaaatttgagaagcagctgggccaggtgatgctgctcgtcctgtgcgtgacccaggtgctgatgatgcgcacaacatgggcgctctgtgaggccctgacgctagcaacgggccccatttccactctgtgggagggcaatcccgggaggttctggaacactaccatcgccgtgagcatggccaatatctttaggggctcctacctggcaggggcaggcctcttattctcgatcatgaagaacacgaccaatacccgccgcgggaccggcaacatcggcgagacgttgggggagaagtggaaaagtcggctgaacgctttaggaaagagcgagttccaaatctacaagaagtccgggatccaagaggtggaccgcactctggccaaggagggaatcaagcgtggagagaccgaccaccacgcggtgagtcgcggttccgccaagctgcggtggttcgtcgagcggaacatggtgacccctgagggcaaggtggtcgacctcgggtgcggccgcggcgggtggagctactactgcggcgggcttaagaatgtgcgcgaggtgaagggactgacgaagggcgggcccggccacgaggagcccatccccatgtccacatacggctggaacctcgtccggctgcagagcggtgtggacgtgttcttcaccccacccgagaagtgtgacaccctgctctgtgacatcggcgagagctcacccaaccccacgattgaggccggccgcacattgcgagttctgaacctcgtggagaattggttgaacaacaacacccaattctgcgtgaaggtcctaaacccgtacatgcccagcgtgatcgagaagatggagactctccagcgcaagtacgggggcgccctagttcggaaccccctgtcccgcaatagtacgcacgagatgtactgggtcagcaacgcaacgggcaacatagtgagctccgtaaacatgatctctcgcatgcttatcaatcggtttaccatgaagcacaagaaggcaacctatgagcccgacgtcgatctcggctccgggacccgcaacatcgggatcgagaacgagatccccaacctagacatcattggaaaacgcatagagaaaattaagcaggagcatgaaacgagctggcactacgaccaagaccacccctataaaacctgggcctaccacgggtcctacgagaccaagcagaccgggagcgcctcctctatggtgaacggggtggtcaagctgctgactaagccgtgggatgtggtcccgatggtgacccaaatggccatgaccgacaccacgcctttcggccagcaacgcgtgttcaaggagaaggtcgacacccggacacaagagccaaaggagggcactaagaagctgatgaggatcacggccgagtggctgtggaaggaactggggaagaagaagacgccccggatgtgcacgcgtgaggagtttacccggaaggtccgctccaacgcggctttaggggccatcttcacggacgagaacaagtggaagtccgcccgggaggctgttgaggactcacgcttctgggagctggtcgaccgggagaggaacctccatctggagggtaaatgcgagacctgcgtttacaacatgatgggaaagcgggagaagaaattaggggagttcggtaaggcgaagggttctagggccatctggtacatgtggcttggcgcccggtttctggagttcgaggctctgggcttcctcaacgaggaccattggttctcgagagggaacagcctgagcggcgtggagggggagggcctccacaaattaggctacatcctgcgggacgtctcgaagaaggagggcggggcgatgtacgctgacgacaccgccgggtgggacacgcgcatcacgctagaggatctcaagaatgaggaaatggtaaccaaccatatgaagggcgaacacaagaagctggccgaggccatcttcaagttgacttaccagaacaaggtggtaagagtgcagaggcctacaccccgggggacggtgatggacataatcagccgaaaggaccagcgcgggtccggccaggtcgggacctacggcctcaacaccttcaccaatatggaggcccagctgatacggcagatggagggggagggcatcttcaaaagcatccaacgtttgacggtgactgaggaaatcgccgtacagaactggctggcccgggtcggccgcgagcggctgtcccgtatggccatcagcggggacgactgcgtggtgaagcccctggacgaccggttcgcatcggcgctcactgccctgaacgacatgggaaaagttcggaaggacattcagcagtgggagccctcgcgggggtggaatgactggacccaagttccgttttgctcccaccacttccacgagttggtgatgaaggacggcagagtcctcgtcgtgccgtgtcggaaccaggacgagctgattgggcgcgcccggatctcccagggtgcgggttggtccctgaaggagacggcctgcctcggcaagagctacgcgcagatgtggaccctgatgtacttccataggcgggacctgagactcgcggccaacgccatctgtagtgccgtcccctctcactgggtgcctacctcccgcacaacctggtcgatccacgcgaagcacgaatggatgacaaccgaggacatgttagccgtgtggaacagagtctggattcaggagaatccatggatggaggacaagacccccgtggagtcctgggaagaagtgccctacctgggcaagcgcgaggatcagtggtgcgggtcactcataggcttgaccagccgggcaacgtgggctaagaacatccaaaccgctataaaccaggtacgctccctgatcgggaatgaggaatacactgactacatgccctcaatgaagcggttccgcaaggaagaggaggaggccggcgtgctgtggtga

SEQ ID NO: 25225 - RNA, 9876 nt, synthetic construct
  misc_feature 1..9876: note = derived and/or modified CDS sequence (opt11) from DENV-2__EU687216__SS-prME
  source 1..9876: mol_type = other RNA
acggccggcgtgatcgtcatgctgatacccaccgcgatggcgttccatctcacaacccggaatggagagccccacatgatagtaggccggcaggagaaggggaagtccctgctgtttaagacggaagacggcgtgaacatgtgtaccctcatggccattgacctgggtgagctgtgtgaggacacaatcacgtacaagtgtccgcttttgcgccagaatgagcccgaggacatcgactgctggtgcaactctacctctacctgggtcacctacgggacgtgcacaaccactggcgagcaccggcgggagaagcggtccgtggccctggtccctcacgtcggaatgggccttgagacacggaccgagacttggatgagctcggagggagcgtggaaacacgtacagcgcatcgagacttggatcctacgtcacccgggcttcacgattatggccgcgatcctcgcctacaccatcgggactactcatttccagagagccctcatcttcattctgctgaccgccgtggcccccagcatgacaatgcgctgcatcggaatctcgaaccgggacttcgtcgagggcgtgagcgggggttcatgggtggacatcgtccttgagcacgggtcttgcgtgaccacgatggccaagaacaagccgacgctggactttgagctgatcaagactgaagccaagcaacctgccacccttcgcaaatactgtatcgaggccaagctcacgaatacaaccacggaatcccggtgcccaacacagggcgagcccagcttgaacgaggagcaggacaagcgcttcatatgcaagcatagtatggttgatcgcggctgggggaacggctgcggcttattcggcaaggggggaatcgtgacctgcgcgatgttcacgtgcaagaagaacatggagggtaaaatcgtgcagcccgagaatcttgagtacaccatcgtcataacgccccacagcggggaggagcacgccgttggcaacgacactgggaaacacgggaaggagatcaagatcacccctcagtccagcaccaccgaggcggaattaacggggtacggcacagtgacaatggagtgcagcccacggaccggcctcgacttcaatgagatggtgcttctgcagatggaggacaaggcttggctcgtccacagacagtggttcctggacctccctctcccctggctgccgggggccgatacgcagggcagtaattggatccagaaggaaactctggtgaccttcaagaacccccacgcaaagaagcaggacgtggtcgtcctcggatcccaggagggcgcgatgcacaccgccctgacgggggccacagagatccagatgtcgtcggggaacctcttatttactgggcacttaaaatgccgcctacgtatggacaagctccagctgaaggggatgtcctacagcatgtgcacaggcaaattcaagatcgtcaaagaaatcgctgaaacgcagcacgggaccatcgtgatcagagtacaatacgaaggcgacggctcgccgtgcaaaatacccttcgagataacggatcttgagaagcggcacgtcctcggccgacttatcaccgtgaacccgattgtgacggaaaaggacagtccggtcaacatcgaagcggagcccccctttggcgactcctatattattgtaggtgtcgagccgggccagttgaagctcaactggttcaagaaggggagctccattggtcagatgttcgagaccactatgaggggcgccaagcggatggcaatcctaggggataccgcatgggacttcggaagcctcggcggggtattcacgtccataggaaaagcgctccatcaggtatttggtgcgatatacggcgctgccttcagcggggtgagctggacaatgaaaatcctgattggcgtcatcatcacctggatcgggatgaactcacgctccacttctctgtccgtgtcgctggttctcgtcggcgtggtcacgttatatctaggtgcaatggtccaggcggactcggggtgcatcgtgagttggaaaaataaggagctcaagtgcggctccgggatcttcatcacagataatgtgcacacctggaccgagcagtacaaattccagcccgagtcgccaagcaagctggcctccgcgatccagaaggcccacgaggaggggatctgcgggatccggtctgttacgcgcctggagaacctcatgtggaagcaaatcactcccgagctgaaccacatcctgagtgagaacgaggtgaaattgaccatcatgaccggcgacatcaaggggatcatgcaggccggcaagcgtagcctgcggccgcagcccacggagctgaaatacagctggaagacctggggtaaggcgaagatgctctctaccgagtcgcataaccagaccttcctaatcgatgggcccgagacagcagagtgcccgaacaccaaccgggcttggaactctctcgaggtggaggattacgggttcggagtcttcaccacgaacatctggctcaagctgcgtgaaaaacaggacgtgttctgcgactccaagctgatgagcgccgctattaaggacaatagggcggtgcatgccgacatgggctactggatcgagtccgccctgaatgacacctggaagatggagaaagcaagctttatagaggtcaagtcgtgccattggcccaaaagccacacgctttggtcgaacggcgtgctggagtcagagatgatcatcccaaagaacttcgccgggcccgtgtcccagcacaactatcgcccgggctatcacacccaaaccgctggcccgtggcacctcggcaagctggagatggattttaacttctgcgaggggaccacagtcgttgtcaccgaggattgcggcaaccggggccccagcttacggaccaccaccgctagcgggaagctcatcaccgagtggtgttgtcggtcgtgcaccttacccccgctgcgataccgaggcgaggacggatgttggtacggcatggagatccgtcccctcaaggaaaaggaggagaacctggtcaactcactggtcacagccggtcacgggcagatagacaattttagtctcggcgtgctggggatggccctttttttggaagagatgttgcggacgcgcgttggcacaaaacacgcgatcttactcgtggcattgagcttcgtgacgttgatcaccggaaacatgagcttccgagacctcggacgcgtaatggtgatggtgggggccactatgaccgatgacatcggcatgggggtaacctacctggccctattagccgcgttcaaggtgcgacctactttcgccgcagggctcctgttacggaagctgacgagcaaggagctcatgatggcgaccatcggcatagcccttctgtcccagagcaccctgccagaaaccatcctcgaactgactgacgctctggccctcgggatgatggtattgaagatcgtccgcaacatggagaaataccagctggccgtgactatcatggccataagctgcgtgccaaacgcagtcatcctccagaacgcctggaaggtgagctgtactatcctggccgcagtatccgtcagccccctgcttttgacctccagtcagcagaaggccgattggattcccctggcgctcaccatcaagggcctgaatcctacggccatctttctgaccaccctctcccggacgagtaagaagcgctcgtggccgctgaacgaggccatcatggcagtgggcatggtcagcattttggcctcctcacttctgaagaatgacatccccatgaccgggcccctagtggcgggcgggttgttaaccgtgtgctacgtcctcaccggccggtcggcggacctcgagctggaacgcgccgccgatgtgaaatgggaggaccaggcagagatctctggtagcagccccatcttgagcatcactatctctgaggacggcagcatgtccattaaaaacgaggaggaagagcaaaccctaactatcctaatccggactggtctactcgtgattagcggggtcttcccggtgtccatccccattactgcggccgcgtggtacctgtgggaggtgaagaagcaaagggccggtgtcctgtgggatgtgcccagcccgccgccggtgggaaaagccgagctcgaagacggggcgtatcgtattaagcagcgcgggatcctgggctactcccaaatcggcgccggggtatacaaggagggcacgttccacaccatgtggcatgtgacccgaggagctgtgctgatgcaccgcggtaagcggatcgaacccagctgggctgacgtcaagaaggatctcatctcctacgggggaggatggaaactggagggggagtggaaggagggagaggaggtccaagtgctggccctcgagcctgggaaaaacccccgtgctgtccagaccaagcccggcatcttcaagacgaacacggggaccataggggccgtgagcctggatttctcgcccggcaccagcgggtcccctatcgtggaccggaagggcaaggtagttgggttgtacggcaacggcgttgtcacgcgcagcggtgcatacgtatctgccatcgcgcaaaccgagaagtctattgaggataaccccgagatcgaagacgacatcttccggaaaaagcgcctaaccataatggacttgcaccccggggccgggaaaaccaaacggtacttacccgccatcgtaagggaggccatcaagcgaggcctgagaacgctcatccttgcgccgaccagggtcgtggcggcagaaatggaggaggcgctgcgggggctgcccatccgctaccagacacccgccatccgggccgagcacaccggtcgcgagatcgtagacctgatgtgccacgcgacgttcaccatgcggctgttaagtcccgtccgcgtaccgaattataacttgatcataatggacgaggctcactttacggaccccgcctcaatcgctgcccggggttacatttctacccgcgtggagatgggggaggcggcgggcatctttatgacggcaacgccgcccgggtcccgggacccattcccccagagcaacgctcccattatggacgaggagagagagatccccgagcggtcctggaacagcggtcatgagtgggtcacagacttcaaggggaaaacggtgtggttcgttccctccattaaggcgggcaacgacatcgccgcatgcttacggaagaacggcaagaaggtgatccagcttagtcggaagacgtttgactcagagtacgtcaagacccgtgccaacgactgggacttcgtggtcaccaccgacataagcgagatgggcgccaatttcaaagcggagagagtaatcgatccccgccgatgcatgaagcccgttatccttactgacggcgaagaacgcgtcatcctagccgggcccatgccggtgacccactccagcgccgcccaacggcgcggacggattgggcggaatcccaagaacgagaacgaccagtacatctatatgggcgagccccttgagaacgatgaggactgcgcccactggaaggaggcaaagatgctgctggacaatataaatacccccgagggaattatcccgtccatgttcgagcccgagcgcgagaaggtcgacgcgatcgacggagagtacagattacgcggcgaggcccgcaagactttcgtagagctgatgcggcgcggggatctgcccgtttggttagcctacaaggttgccgcggagggtatcaactatgccgaccgcaagtggtgcttcgatgggatcaaaaacaaccagatactggaggagaacgtcgaggtggagatatggacgaaggagggagagcggaaaaaactgaagccgaggtggctcgacgcccggatttactctgaccccctggcactgaaggagttcaaggagtttgccgccggccgcaagagtctcaccctgaatctgataactgagatggggcggttgccgaccttcatgacccagaaggcccgcaacgccctagataacctggccgttctacataccgcggaagtcggcgggagggcctacaaccatgcgctgtcagaattgcccgagacgctcgaaactctgcttcttctgaccttactcgccacagtgacgggcggcatcttcttgttccttatgtccggaaagggggtaggtaagatgaccctcggcatgtgctgtatcatcaccgcatctatccttctgtggtatgcgcagatccagccacactggatcgccgcctccattatcctcgagttcttcctaatcgtgttgttgattcccgaacccgaaaagcagcgcacgccccaagacaaccaactgacctacgtggtcatcgccattctgacggtggtggctgcgaccatggccaacgaaatgggcttcttggagaagacgaaaaaggacctgggattcggcagcataaccacccaggagagcgagtccaacatcctggacatagatctccggcccgcatccgcctggaccctgtatgccgtcgccacgaccttcatcacaccaatgctgagacactccatcgaaaatagctccgttaacgtaagcctcaccgctatagccaatcaggccactgtcctgatgggactgggcaagggatggcccctcagcaagatggacatcggcgtgcccctgttggcgatcgggtgctacagtcaagtgaacccgatcacccttaccgccgccctgctgctcctggtggcccattacgccatcatcggccccggcctgcaggcgaaggccacccgcgaagcccagaagcgagctgccgctgggatcatgaagaacccgacggtcgatggcattaccgtaatcgacctcgagcccatcccgtatgatcccaagttcgagaaacaactggggcaagtcatgttactcatcctgtgtgtgacccaggtgctgatgatgcgcaccacttgggccctttgcgaggccctgactctggccaccggcccgatctccaccctctgggaagggaaccccggccgtttctggaacactaccattgctgtgagcatggcgaacatctttaggggctcgtacctggccggggctggcttactgttcagcataatgaagaacaccacaaacacgcggcgagggacaggcaacgtgggcgagacacttggcgagaagtggaagtctcgtctgaacgccttgggcaagagcgagttccagatatacaagaaatcgggtatccaggaggtggaccggaccctggcgaaggaggggatcaagcgaggtgagacggaccaccacgctgtctcgcgcggctccgcgaagctgcggtggtttgtagagcgcaatatggtgactccggagggcaaggtcgtggatctcgggtgtgggcgcggtggctggtcatattattgcggcggcctgaagaacgtgcgcgaagtcaaaggactgaccaagggcggccccggtcacgaggaacccatacccatgtccacctacggatggaacctcgtgagactgcaaagcggggtggacgtcttcttcacgccgcccgagaagtgtgacactctgctctgtgatataggcgagagctcccccaatcccaccatcgaagctggccgcacactgcgggtactgaatctcgtggagaattggctgaacaacaacacccaattctgcatcaaggtgctgaatccgtacatgcccagcgtgatcgagaagatggagacgctccagcgcaagtatggaggcgctctggtaagaaatcctctgtcccgcaatagcacacacgagatgtactgggtctccaacgcgactgggaatattgttagctccgttaacatgatcagccgtatgctcattaaccgcttcaccatgaagcacaagaaagccacgtatgagccggacgtcgacctcggctcgggaacccggaacatcggcatcgagtctgagatacccaacctggacatcatcggcaagcgaatcgagaagatcaagcaagaacacgagacctcctggcactacgatcaggaccatccttacaagacttgggcttaccatgggagttacgaaacaaagcagactggctccgccagctccatggtgaacggcgtggtccgcttactcacgaagccttgggatgtggtaccgatggtgacgcagatggccatgactgacacgacccccttcggccaacagcgggtgttcaaggagaaagtggacacgcggactcaagagcccaaagagggcacgaagaagcttatgaagataaccgcggaatggttgtggaaggagctcggaaaagagaagacgccacggatgtgcacgcgcgaagagtttactcggaaagtccgcagcaacgccgcactgggcgcaatcttcacggacgaaaacaagtggaagagtgcacgggaggcagttgaggacggacgcttctgggagctggttgaccgggagcgcaatcttcacttagagggcaagtgcgagacgtgcgtctacaacatgatgggtaagcgagagaagaagctgggcgagtttggcaaggccaaagggagccgcgccatttggtacatgtggcttggcgcacggttcttggagttcgaagcgctaggcttcctcaacgaggaccactggtttagccgcggcaacagcctaagcggggtggagggggagggcctccaccgtctcgggtacatcctgcgggaagtcggaaagaaggagggcggagccatgtacgccgacgacacggcaggctgggacacacggatcacgctggaagacctcaaaaacgaggaaatggtgactaatcacatgaagggcgagcacaagaagctggccgaggcgattttcaagctgacgtatcagaacaaggtggtgcgcgtgcagcgcccgacgccacggggcaccgtgatggatatcatctcacggaaggaccagcgcgggagcgggcaggtcggcacctacggattaaacaccttcacgaacatggaggcccaactgatacgccagatggaaggcgaagggattttcaaatccatccagcatctgaccgccacagaggaaatcgccgtccaaaactggctcgcacgggtgggacgggagcgtctgagccgcatggctatttccggggacgattgcgtcgtgaagccgatagacgaccggttcgcctcggcactgacggccctgaacgacatgggcaaggtgcgcaaggatatccagcagtgggagccttccagagggtggaatgattggacccaggtgccgttctgcagccaccacttccacgagcttgtcatgaaggatggacgcgtcttggtcgtgccctgccgaaaccaggacgaactcataggtcgcgctcggatttcccagggagcgggctggagcttaaaggagaccgcgtgtttagggaaatcctacgcccagatgtggaccctcatgtatttccaccgtcgggacctgcgccttgccgccaacgccatttgctccgccgtgccctcccactgggtccccaccagccggacgacctggtccatacacgccaaacacgaatggatgaccactgaagacatgctcgccgtgtggaaccgggtgtggatccaggagaacccgtggatggaggacaagacgccagtagagagctgggaggaagtcccctatctgggcaagcgggaggaccagtggtgcgggtccctgatcggccttaccagccgagcgacctgggccaagaacatccagacggccatcaatcaggtgcggagcctcattggcaacgaagagtacacggattatatgccgtccatgaaaaggtttcgtcgggaggaagaggaggccggagtcctatggtaa

SEQ ID NO: 25226 - RNA, 9876 nt, synthetic construct
  misc_feature 1..9876: note = derived and/or modified CDS sequence (opt11) from DENV-2__EU726770__SS-prME
  source 1..9876: mol_type = other RNA
accgctggcgtgatcattatgctaattcccacggcaatggcttttcacctcaccacacgaaacggagaaccacacatgatcgttgggcgccaagaaaaaggaaagagcttgctattcaaaaccgaggacggagtcaacatgtgcacgctgatggcgatagatctcggagagctatgcgaagacacgattacctacaaatgcccactactcaggcaaaacgaaccggaagatattgactgttggtgcaattcaacatccacgtgggtcacgtatggaacatgcacaacaacgggagagcacagaagggagaaaaggtcggtagccctagtcccacacgtgggtatgggcctagagacacgaacagaaacctggatgtcatccgagggagcatggaaacacgtacaaaggatagaaacgtggattctacgccatccgggcttcaccataatggcggccatactcgcctacactataggcacaactcacttccaaagagccctgatattcatactgctcaccgcggtagcgccctccatgaccatgcgatgcatcggaatatcgaaccgcgattttgtagagggtgtgtcaggaggctcatgggtagacatagtcctagaacacgggagctgtgtaactacaatggcaaagaacaagccaacactcgacttcgaactaatcaagacggaagcgaaacaacctgctacactgcgcaagtactgcatagaggctaagttgacaaacaccacaacggaaagcagatgtcccactcagggagaaccaagtctaaatgaggagcaagataaaagattcatatgtaaacactcgatggtggacagagggtgggggaacggttgtgggctcttcggcaagggcggtatagttacatgtgccatgttcacctgcaaaaagaacatggagggcaaagtggtcctgccagagaacctagaatacaccatagtaataacaccccattctggcgaagaacacgccgtggggaacgataccggaaagcacggcaaagagataaagataacgccgcaaagcagcataacagaagcggaactgaccggctacggcactgtaaccatggaatgctcgccgagaaccggattagatttcaacgaaatggtccttcttcaaatggaagacaaagcgtggctagttcatcgccagtggttcctagacctccctctaccatggctacccggcgccgatacacagggatcgaactggatccaaaaagaaacactagttacattcaaaaacccgcatgcaaagaaacaggacgtggtagtattaggatcacaggagggcgctatgcacacagcacttacgggcgcaacggaaatacaaatgtcatcaggaaatctcttattcaccgggcacttaaaatgtagactacgcatggacaaactgcaattgaaagggatgtcttactctatgtgcacggggaaatttaaaatagtgaaggaaatcgccgagacacaacacggtactatagtgatccgggtccaatacgaaggggacggcagcccctgcaagataccttttgagatcatggacttggagaagagacacgtactgggacggctaattaccgtcaatccgatcgtcacagagaaggactcgcccgtcaacatcgaggccgaaccgcccttcggcgatagctacataataattggagttgaacccggccaactgaagctgaactggtttaagaagggatcttccattgggcaaatgttcgagacgaccatgcggggagcgaaacgaatggccatactgggggatacagcatgggatttcggcagcctaggtggagtatttacgtcaatcggcaaagcactgcaccaagtcttcggggctatctacggggcggcattcagcggagtatcatggacgatgaagatactgatcggcgtaataataacttggatcgggatgaatagtagaagcacctcactttcggtgtcgttagtgctggttggtgtagtaacactctatctcggagtcatggtgcaagccgacactgggtgcgtagtaagctggaaaaataaggagttgaagtgcggcagcggcattttcatcactgataacgtacatacgtggaccgagcaatacaaattccaaccagaaagcccgagtaaactagcaagtgccatccaaaaagcccatgaagaggggatctgtggcataagaagcgtaacccgcctcgagaatttaatgtggaaacagattacccccgagctcaaccacattctgagcgaaaacgaagtcaaactaaccataatgacaggtgatataaaaggaatcatgcaggcgggcaaacggagcctaaggccccaaccaaccgaactgaagtacagttggaaaacgtggggcaaagcaaaaatgttaagcacagagtcacacaaccaaacgtttctcatagacgggccggaaacggcggaatgtccaaacacaaacagggcctggaattccctggaggtcgaagactacggcttcggagttttcagcacgaacatttggctcaaactgcgggaaaaacaagacgtattctgcgactcaaagttgatgagcgctgccattaaagataacagggccgtccacgccgatatgggatactggatcgaatcagcattaaacgatacatggaaaatggagaaagcatcgtttatagaaataaaatcctgtcattggcctaagagccatacactctggtcgaacggggtcctagaatcagagatgataataccgaaaaacttcgcgggccccgtttcgcagcacaattatcgaccgggctaccacactcagaccgctggaccgtggcatctcggcaaattggaaatggacttcgacttttgcgaggggacaaccgtagtggtgacagaggactgcggcaaccgtggaccttcactgaggaccacaacagcctcgggtaagctaataacagaatggtgttgccgaagctgtacactgcccccgctccgataccggggggaagacgggtgctggtacggcatggaaatccggccactaaaggaaaaggaggagaacctcgtgaactcccttgtgacagcggggcacggccagatagacaatttctccctaggggtcctaggaatggcgctctttctcgaagagatgctccggactagagtagggacgaaacatgcaattctactcgtagccgtctccttcgttacgttgataactggtaatatgtcatttagagacctggggcgcgttatggtaatggttggcgccacgatgacagacgacattggaatgggggtaacctacctagcactcctagcggccttcaaggtgcgacccactttcgcagcaggtctcctactcagaaagctcacctccaaagaacttatgatggcaaccataggtatcgcacttctgagccagtcaaccattccagaaaccatcctggaactaaccgatgcactagcactcggaatgatggttctaaagattgtaagaaatatggaaaagtaccaactcgccgtaactataatggctatcagctgcgtcccaaacgcggtcatactgcaaaatgcttggaaggtgtcatgcacaatcctagcggcagtatcggtaagccccctactactaacgtcatcacaacagaaggcagattggataccacttgctctaacaattaaaggattgaacccaacagcaattttcctcactacactctctcgtacctcaaaaaaacgctcgtggccactaaacgaagcggtgatggcggtcggtatggtgagcattctagcgtccagcttactaaagaatgacataccgatgaccggacccttagtcgcaggaggccttctgacggtttgctacgtattaacgggacggtctgctgatcttgagttggaacgcgcggccgacgtaaaatgggaggaccaagccgagataagtgggtccagcccaattcttagcatcaccatatccgaggacgggagcatgtccataaagaacgaagaagaagagcatacattaacaatactaatacggacaggactgctcgtcatttccggagtgttccccgtctctatcccaataaccgctgcggcatggtatctttgggaagtcaagaagcaacgagcgggagtcctctgggacgtcccgtctccaccccccgtgggtaaagcggaactggaagacggggcgtaccgaataaagcaacggggaatattcgggtatagccaaatcggagcaggggtatacaaggagggcacattccacaccatgtggcatgtgacccgtggagcagtcctaatgcatagaggaaaacggatcgaaccctcctgggcagacgtcaaaaaggacctgatcagctacggaggaggttggaagctagagggcgagtggaaagagggcgaggaggtgcaagtactagcgttggaaccaggcaagaaccccagggcagtgcagacgaaacccggcctcttcaagactaacacaggaacaatcggggcagtatcactggatttttctccaggcaccagcggaagtccaatcgtagatcgaaaggggaaggtcgtaggactatatgggaatggagtggtcacgcgatcaggtgcctacgtcagcgccattgcccagaccgaaaagagtatagaagacaatcctgagatagaagacgacatattccggaaaaaaagattgacaatcatggacctacatccaggtgcagggaaaacaaagcgatacctccccgcaatcgtacgcgaagcaatcaaaagagggctacgaaccctaatactcgccccgacccgcgtggtggcagcagaaatggaagaagcgctccgtgggctccccataaggtatcagactcccgcaatcagggcggaacacaccggccgagaaatcgtcgatctgatgtgccacgcaacgttcaccatgcggctattatccccggtaagagtcccgaactacaatctcattataatggacgaagcccactttaccgatcccgcgtcaatagcggccaggggatacatttccaccagagtcgagatgggagaggccgcgggaatattcatgacagcgacgccaccaggttcacgcgacccgttccctcagtcgaacgcacccataatggacgaagaaagggaaataccagagaggagctggaattcgggacacgagtgggtaactgacttcaaaggcaagacggtctggttcgttccaagtatcaaagctggaaacgacatcgcagcgtgtctccgtaaaaatggcaaaaaggtaatccaactctctcgaaaaaccttcgatagcgaatatgtgaagacgcgggcgaacgactgggattttgtagtcacaacagacatatccgaaatgggcgcaaacttcagagcagagagagtgatcgacccaaggcgatgcatgaagccggtcatcctcacggacggtgaagaacgagttatcctggcaggccccatgcccgtgacccacagcagcgcagctcaacgcagggggcgaattgggcgcaatccgaaaaacgaaaacgaccaatacatatacatgggggaaccgctagagaatgacgaagactgcgcgcactggaaagaagcgaaaatgctactagacaacataaatacgccggaaggcattataccgtccatgtttgaaccagaacgagagaaagtagacgcaattgacggtgagtacaggctacgtggggaagcccgcaaaacttttgtggacctgatgagacgcggcgacctgccagtttggctggcataccgtgttgcagcagaaggtataaattatgcagaccggcgatggtgcttcgatgggatcaaaaacaatcaaatactagaggaaaacgtcgaggttgaaatctggactaaagaaggcgaaaggaaaaaactaaaaccgagatggctcgacgcccgaatttacagcgatccgctcgcactaaaggagttcaaagaattcgcggcgggccggaagagcctaacgctcaacctcattacagaaatgggacgcctcccaacattcatgacgcagaaagcgagagacgcactcgataatcttgccgtcttacacacagccgaagtcggtggtcgcgcatataaccacgcactttcagaactacccgagacgctcgagaccctattattacttaccttgctcgcaacagtaaccgggggcatcttcctatttctaatgtccggaaagggaattggtaaaatgaccctcgggatgtgctgcatcataaccgcctcaattctcctatggtacgcccagatccaaccgcattggatcgccgccagcataatcctggagttcttcttgatcgtattgcttatacccgaacccgagaaacagagaactccgcaggacaaccaactaacctacgtagtaatagcgatactaacggtggtggccgcaacgatggccaacgagatgggattcctcgagaaaaccaagaaggacctcggattaggatcaatcaccactcaggagtcggagagcaacatactcgatatagatctaagaccagctagcgcgtggacactatacgcggtggcaactaccttcgtgacccctatgttaagacactcaatcgaaaactcatcggttaatgtcagcctcacagcgatcgccaaccaagcgaccgtactaatgggattaggtcgcggttggccactgtcaaagatggacattggcgtaccactgcttgcgattggatgctacagccaagtaaacccgataacgctaaccgcagcgctcctcctgttagtggcacactatgcaatcatcgggccaggactgcaggcaaaagcaacaagggaggcccagaagcgcactgccgctgggataatgaaaaacccaacagtagacggcattactgtcatcgacctcgaaccaatcccctacgacccaaaattcgagaaacaacttggtcaagtaatgctcctagtactgtgtgtcacgcaggtcttaatgatgcggacaacgtgggcgctatgcgaggcattgacgctagctaccgggcccatatcgacgttatgggaggggaacccagggcgcttctggaacacgacgatagcggtatctatggcgaacatattccgcgggtcctacctggccggggccggactgctattctcgataatgaaaaacaccacaaacacgaggagaggcacggggaacataggtgaaacgctgggagagaaatggaaaagtagattaaacgcgctaggaaaaagcgagttccagatatataaaaaatccggtatacaggaagttgaccgcacccttgcaaaagaaggcatcaagcgcggagagaccgaccaccacgcagtgtcaagggggtcagccaagctcaggtggttcgtagagcgcaacatggtaactccggaggggaaagtagtagacctcggctgcggaagaggcggctggagctactactgtggcggactgaaaaatgtgcgtgaggtcaaggggctcacaaagggaggccctggtcacgaagaacccatccccatgtcaacctatgggtggaatctagtacgccttcaatcaggcgtggacgtatttttcacgccgccggaaaagtgcgataccctcctctgcgacattggggagagcagtccaaacccaacgattgaggcgggacgcacgctgcgggtgctaaacctcgtagaaaattggctcaacaacaacacgcaattctgcgtcaaagtattaaacccatatatgccctccgttatagagaaaatggagaccttacagcgtaaatacgggggagcgctggtaagaaaccccctcagccgaaactcgacgcatgaaatgtactgggtgtcgaatgcaactggcaacatagtgagttcagtaaacatgatctcgcggatgttaattaacagattcacgatgaagcacaagaaagcaacctatgaaccggacgttgatctgggaagcggtacccgcaacatcggaatagaaaatgagattccgaacctcgatatcatcggaaaaagaattgaaaagattaaacaagagcacgagaccagttggcattacgaccaagaccacccctacaaaacttgggcataccacggatcatacgagacaaaacaaacgggctctgcgagcagcatggtcaacggggtagtcaaactcctaaccaaaccctgggacgtcgtgcccatggttacacaaatggcgatgacagatacgacgccctttgggcaacaaagagtgttcaaggagaaggtcgatacccgcactcaggagcccaaagaaggaaccaagaagctcatgagaataacagccgaatggctatggaaagaactggggaagaaaaagacgccaagaatgtgcacaagggaagaattcactagaaaagtgagaagcaatgcagcactaggggccatattcacggacgagaacaaatggaaatctgcgcgcgaggctgtagaggatagtcggttttgggagttggtggaccgggaaaggaacttacacctcgaaggaaaatgcgaaacttgcgtgtacaatatgatgggcaagcgagaaaaaaaactgggggagttcggcaaagcaaaagggagcagggccatatggtacatgtggctaggcgcacggttcctcgaattcgaagccctcggcttcctaaacgaggaccactggttcagcaggggaaactcgctatccggagtcgagggagagggccttcataaattgggttatatactccgtgacgtgagcaagaaagagggtggcacgatgtacgccgacgataccgcgggctgggacacccgcataacgttagaggacctcaagaatgaagaaatggtgactaaccacatgaaaggcgagcataagaaactggccgaggcgatattcaagttgacataccaaaacaaggtagtgagggtacaaaggccgacgcccaggggaacagtgatggatataatcagccgcaaagaccagagaggaagcgggcaagtgggaacatacgggctaaacacgttcacaaacatggaagcccagctgatacgccagatggagggagagggcatattcaaaagcatccagagactcacagtcacggaagaaatagccgtgcagaattggcttgcccgggtaggacgcgagagactgtcaagaatggcaatttcaggggatgactgcgtggtgaaacctctcgacgatcgcttcgcgagcgcgttaacagcgctaaacgacatggggaaagtgcgcaaagacatccaacaatgggagccgagccgaggctggaatgactggacccaggtccctttctgctcacaccactttcatgaactagtgatgaaggacggcagagtactcgtagtgccgtgccgtaaccaagatgaactcataggcagagcacggataagccagggcgcgggctggtcactaaaagaaacagcgtgcctgggaaaatcttacgcccaaatgtggacactaatgtacttccacagacgagacctaagactagcagcaaacgccatctgcagcgcggtaccatctcattgggtgccaacaagccgaacgacgtggtcaattcacgctaaacacgagtggatgacgacagaggacatgctggccgtctggaaccgggtctggatacaagaaaatccttggatggaagataagacgccagtggaaagctgggaagaagtaccatatcttggcaaaagagaggaccaatggtgcggtagcctgataggcctgacctcccgagccacatgggcgaaaaacatccaaaccgcaataaatcaagtacgatcacttatcggcaacgaggaatacacggactatatgcccagcatgaagaggttccgaaaagaggaagaagaagcgggagtgctatggtag

SEQ ID NO: 25227 - RNA, 9876 nt, synthetic construct
  misc_feature 1..9876: note = derived and/or modified CDS sequence (opt11) from DENV-2__EU781135__SS-prME
  source 1..9876: mol_type = other RNA
accgccggtgtaatcatcatgctcatccccacagccatggcgttccacctcactacacgcaatggggaaccccatatgatcgtcgggaggcaggagaaagggaaatccctgcttttcaagaccgaggacggagttaacatgtgcaccttgatggcgattgacctgggtgagctgtgcgaggacaccattacctataaatgccctctcttgcgccagaacgagcccgaggacatcgactgctggtgcaattctacatccacgtgggtgacctacggcacctgtacaactacgggcgagcaccggcgcgagaagagatctgtcgccctggtgccccatgtagggatgggcttagaaactcggaccgagacctggatgagctcagagggggcctggaagcatgtccagcgaatcgaaacctggatcctgcgccatccggggttcaccatcatggcggcgatacttgcatatactatcgggaccactcacttccagcgggccctgatcttcatcttattaacagccgtggcgcccagcatgacaatgagatgcatcggcatctctaaccgggatttcgtagagggggtaagcgggggttcctgggtggacatcgtgctcgagcacgggagctgcgtcacaacgatggcgaagaacaagcccaccctggatttcgagctcatcaagactgaggccaagcaacccgctaccctccgtaagtactgtatcgaggccaaactgacgaacaccaccaccgaatcccggtgcccaacgcaaggcgagcccagcctgaatgaggagcaggacaaacgctttatttgcaagcacagcatggtagacaggggctggggtaacggctgcggcctgtttggaaagggcgggattgtgacctgtgcgatgttcacgtgcaagaagaacatggagggaaaggtcgtcctgccagagaacctcgagtacaccatagtgattacgcctcacagcggcgaggagcacgcagtcggcaatgacaccgggaagcacggcaaagagatcaaaatcacaccgcagtccagtatcaccgaggcggagctcaccgggtacggcacggtgaccatggaatgctctccccgtaccggcctggatttcaacgagatggtgctgctccagatggaggacaaggcctggttggtccaccggcagtggtttctcgacttgcccttaccctggctgccgggggccgatacccagggcagcaactggattcagaaagagactctcgtgaccttcaagaacccccacgcgaagaagcaggacgtagtcgtgctgggttctcaggagggcgccatgcacaccgccctgacaggggcgacggagatccagatgagctccggaaacctcctgttcaccggccacctgaagtgccgcctccggatggataagctacagctgaaggggatgtcctatagcatgtgcaccggcaaattcaagatcgtcaaagagatcgcagagacgcagcatggtacgatcgtgattcgcgtgcagtacgagggcgacggctcgccctgcaagatccccttcgaaatcatggacctcgaaaagaggcacgtcctgggccgtttgatcaccgtgaacccgatcgttaccgaaaaggacagcccagtcaacatcgaggcggagccgcccttcggggactcctacattatcatcggtgtcgagcctggccagctcaagctcaactggttcaagaaagggagttccatcggccaaatgttcgagaccacgatgagaggcgccaagaggatggcaatattgggagataccgcctgggacttcgggagcctaggaggggtatttacgtccatcggtaaggcgttacatcaagtctttggcgcgatctatggcgcggccttcagcggggtgtcctggaccatgaagatccttatcggcgtgataatcacgtggatcggtatgaactcacgctccaccagcttgtccgtcagcctagtgcttgtgggcgtcgtgaccctatacctcggtgtgatggtccaggccgataccggctgcgttgtgagttggaaaaataaagagctgaagtgcggctctggcatcttcattacggacaacgtccacacctggacagagcagtacaagtttcagcccgaatcccctagcaagttggcgagcgccatccagaaagctcacgaggagggcatctgcgggatccggtcagtgacacgcttggagaacttgatgtggaaacagataacgcccgagttaaatcatatcctcagcgagaacgaagtgaagttgaccataatgactggcgacatcaagggtatcatgcaagccgggaagcggagtctgcgcccccagcccaccgaattgaagtacagctggaagacgtgggggaaagcaaagatgctgagcaccgagagtcacaaccagaccttccttatcgacgggcccgaaaccgcggaatgcccgaatacgaatcgggcctggaactccctcgaggtcgaggactacggatttggggtgttcagcactaatatatggctgaagctgcgggagaagcaggacgtgttctgcgactccaagctcatgagcgcggcaatcaaggacaacagggctgttcacgcggacatggggtactggatcgagtctgcattgaacgatacctggaagatggaaaaggcctcattcatcgaaatcaagtcctgtcattggccaaagagccacaccctatggagtaatggagttctagaaagtgagatgatcatccccaagaactttgccgggcctgtaagtcagcacaactaccgcccgggctaccacacgcagacggccgggccatggcacctgggcaagctggaaatggacttcgacttctgcgaggggactaccgtagtcgtaacagaggattgtggcaacagaggccccagcctccggacgaccaccgctagtgggaagctgatcaccgagtggtgctgccggagttgcacgctgccacccctcaggtaccggggcgaggatgggtgttggtacggcatggagatacgccccctaaaggaaaaggaagagaacttggttaacagcctcgtcaccgccgggcacgggcagatcgacaacttcagcctcggcgtgctgggcatggccctcttcctggaggagatgctgcggacccgagtcggcaccaagcacgccatcctcctggtcgcggtttcattcgtcacgctgatcaccgggaacatgtcctttcgggatttgggccgcgtgatggtgatggtcggggccacaatgaccgacgatatcgggatgggcgtgacgtacttagccctgctggccgcgttcaaggtgcgccccaccttcgctgcggggctcctgctccgcaaacttaccagcaaggagctgatgatggccactatcggtatcgccctcctgtcacagagcacgatccccgagaccatcctggagctcaccgacgcacttgcactggggatgatggtgctcaagatcgtgcgcaacatggagaaataccagctggccgtgaccatcatggccatctcctgtgtaccgaacgccgtgattctgcagaacgcctggaaggtgagctgcacgattctcgcggccgtcagcgtgtcgcccctgctgctcacctcttcccaacagaaggcggactggatcccgctggcactgaccatcaagggcctcaaccccaccgcgatctttctaacgaccctgagtcggaccagcaagaagagatcctggccgttaaacgaggcgatcatggcggtcggtatggtgtcaatcctggcgtcgagtctactcaagaacgacatccccatgactgggccgttggtagcgggtgggctgctcactgtctgctacgtactgaccggtagaagcgcggacctagagctcgagcgtgccgcggacgtcaagtgggaggaccaagccgagatctccggaagcagccctatactgtcgattactatctccgaggacggcagcatgtctatcaagaacgaagaggaggagcacactctaactatcctcatccgtactggacttttggtcatcagcggagtgttcccggtttcaatacctattaccgccgcggcgtggtacctctgggaggtcaagaaacaacgcgccggcgtgctgtgggacgtgcccagtccccctcccgtagggaaggccgagctggaagacggcgcctatcgcatcaagcagcgcggtatattcggctactcccaaataggcgcgggggtttataaagagggcaccttccacaccatgtggcacgtcacccgaggggccgtccttatgcaccgcggcaaacgaatagagcccagctgggccgacgtgaagaaggacctgatttcctacgggggcggatggaagctggagggagagtggaaagagggcgaagaggtgcaggtcctcgcactggagccaggtaagaacccccgcgccgttcagaccaagcccggcctgttcaagaccaacaccggtacgatcggtgcggtttcgctcgacttctcacccggtaccagcggttccccgatcgtcgaccgcaagggcaaggttgtagggctgtacggcaacggcgtagtgacccgctcaggagcgtacgtctccgccatcgcccagaccgagaagtccatcgaagacaaccccgaaatcgaggacgatatattcaggaagaagcggctgacgatcatggatctgcacccaggagcggggaagacgaagcggtacctgcccgctatcgtccgggaggccatcaaacggggcctgcgtactctgatactagccccgaccagagtggttgctgccgagatggaggaggccctgagggggctgcccatccgctaccagacgcccgcgatccgggccgagcacactggccgcgaaatcgtcgatttaatgtgccacgccactttcacgatgcgcctacttagcccggtaagggtgccgaactataatctcattatcatggacgaggcgcacttcacggaccccgcctccatcgccgcacggggttatatatccacacgcgtcgaaatgggggaagcggcgggaatctttatgaccgccacgccgcccggatccagagacccgttcccccagagcaacgcccccatcatggacgaggaacgcgaaatacctgagcggtcttggaacagcgggcatgagtgggtgacggatttcaaggggaagactgtctggtttgtcccgtccataaaggccggaaacgacattgcggcctgcctacggaaaaacggcaagaaggtgatccagctatctcggaagacctttgactccgagtacgtaaagacccgcgccaacgattgggatttcgtcgttacgaccgacatcagcgagatgggggccaactttcgggctgagagggtaatcgacccacggcgctgcatgaaaccggtcatactcaccgacggtgaggagcgggtcatactggcggggcccatgccggtgacccactcctctgccgcacagaggcgcggccggatcgggcgcaaccccaagaacgagaacgaccagtacatctacatgggcgagcccctggagaacgacgaggactgcgctcactggaaggaggccaagatgctcctcgacaacatcaacacccccgagggcataatcccgtccatgttcgagccggagcgggagaaagtcgacgcgatcgacggggagtaccgtctgagaggcgaggcccgaaagacgttcgtagatctgatgcggagaggggacttacctgtatggctggcctacagagtcgccgccgagggcataaactacgcggaccgccgttggtgcttcgacggtatcaagaacaatcagatactcgaggagaacgtagaagtggagatctggacgaaggagggcgagcgcaagaagctcaagccgcgatggctggacgctcgcatctacagcgaccccctcgccctgaaagagttcaaggagttcgccgcgggccgaaagtccctgacgctcaaccttatcacggagatggggcgcctacctaccttcatgacccagaaagcccgggatgccctcgacaacctggctgtcctccacactgcagaggttggcgggcgcgcgtacaaccatgcccttagcgagctgcccgagacactggagaccctcctgttactcaccctgctggccaccgtaaccggtggaatctttctcttcctgatgtctggcaagggcatcgggaaaatgaccctcgggatgtgctgtatcatcaccgccagcatcctactgtggtacgcccagatccagccgcactggatcgcggcttcgataatcctggagttctttctcattgtgttactgatcccggagcccgagaagcaacggacgccccaggacaatcagctcacctacgtggtcatcgccatcctgacggtggtggccgctacaatggctaatgaaatggggttcctggagaagaccaagaaagacctcggcctgggctctatcaccacccaggagagcgagtccaatatcctagacattgacctccgcccggctagcgcctggactctgtacgccgttgctaccaccttcgttacgcccatgctgcggcactccattgaaaactctagtgtgaacgtcagccttaccgcgatcgcaaatcaggccactgtattaatgggcctgggcagagggtggcccctctccaagatggacataggcgtgcccttactcgctatagggtgttacagccaggtcaatccgatcaccctcacggcggccttgctgctcttggtggcccactacgcgatcataggccccggactgcaagccaaggcgacccgggaggcccagaaacggaccgcagcagggatcatgaagaacccaaccgtggatgggatcacggtcattgacctcgagcccataccttacgacccgaagttcgagaagcagctgggacaggtcatgttactcgtcctctgcgtcacccaggttctgatgatgcgcaccacctgggccttatgcgaggccctgactctagccaccgggcccatctcaaccttgtgggaggggaacccggggcgtttctggaataccacgattgccgtgtcgatggctaacatcttccgcggatcctacctggccggggcggggttactcttcagcataatgaagaacaccaccaacacccggagagggactggtaacattggcgagaccctgggggagaagtggaagtcgcggctcaacgccttgggcaagtcagagttccagatctataagaaatccgggatccaggaggttgaccgaactttggccaaggagggcatcaaacgtggggagaccgaccaccacgccgtcagccgcggatccgcgaagctgcgatggttcgtggagcgcaacatggtcacgccagaaggcaaggttgtagacttagggtgtggccggggcgggtggagctactactgcgggggcctgaagaacgtcagggaggtgaaggggcttaccaagggtgggcccgggcacgaggagcccatcccaatgtccacctatggctggaacctcgtccggctacagtcaggggtcgacgtgtttttcacgccgcccgagaaatgtgacacgctgctttgcgacatcggcgaatccagtccgaaccccaccatcgaggctggccgcaccctacgggtgctgaacctcgtcgagaactggctgaataacaacactcaattctgcgtgaaggtgctgaacccgtacatgcccagcgtcatcgagaagatggagacccttcagaggaagtacggtggcgcccttgtacggaacccactgtcacgtaacagcacgcacgagatgtactgggtaagtaacgcaaccgggaatattgtaagctccgtgaatatgatcagccgtatgcttataaacagattcacaatgaaacacaaaaaggccacctacgagccagacgtggatctcggctccgggacccgcaacatcggcatcgagaatgaaatccccaacctggacatcattggcaagcgtatcgaaaagatcaaacaggagcacgagacgagctggcactatgaccaggatcatccctacaagacctgggcctaccacgggtcctacgaaacgaaacagacgggtagcgcctccagcatggtgaacggggttgtgaaactgctcaccaagccctgggacgtcgtgccgatggtgactcagatggcaatgaccgataccactcccttcggtcaacagcgcgtcttcaaggagaaggtggatacccggacccaggagcctaaggaaggcaccaagaagctcatgcgtatcaccgctgagtggctgtggaaggagctcgggaaaaagaaaactccccggatgtgcacccgggaagagttcacacggaaggtgcgctccaacgccgcgctcggtgccatcttcaccgacgagaataaatggaagtccgcccgggaagctgtcgaagattcccgcttctgggagctggtcgaccgggagcggaacctccacctggagggaaaatgcgagacctgcgtctacaacatgatgggcaagcgggaaaagaagttaggggagttcggcaaggcaaagggatcacgcgcgatctggtacatgtggctcggcgcccggttcctggagttcgaagcgctgggcttccttaacgaggaccactggttctcacgagggaacagcctgagcggcgttgaaggcgagggtttacacaagctcggctacatcctgcgggacgtgtccaagaaggagggcggggcaatgtacgcggacgacaccgcagggtgggacacgcgcatcaccctggaagacctcaagaacgaggagatggtcaccaatcacatgaagggcgagcacaagaaactggccgaggccatcttcaagctgacctaccagaacaaggtggtgcgcgtacagcgccccacgccaagggggaccgtgatggacatcatcagtcggaaggaccagagaggtagtggccaggtggggacctacggcttaaacacatttacaaacatggaggcgcagctaatccgacagatggagggagagggcatatttaaatcgatacagagactgactgtcaccgaagaaatagcggtacagaattggttggctcgggttggcagagagcggctgtcccgcatggccatcagcggggacgactgtgtcgtgaagcccctggatgatcgcttcgcatccgccctcaccgcgctcaacgacatgggcaaagtccgcaaggacattcagcagtgggagccctcccggggctggaatgactggacgcaggttcctttctgttcccaccatttccacgagttagtgatgaaggatggccgcgtgctcgtggtgccctgccggaaccaggatgagctgattgggcgcgcccggatctcacagggggcaggttggtcgctgaaagaaaccgcgtgcttgggcaaaagctacgcccagatgtggaccctgatgtatttccaccgccgggatctgcgcttagcggcaaacgccatctgctccgccgtgccgagccactgggtccccacctcccggaccacgtggagcatccatgcaaagcatgagtggatgaccacagaggacatgctggctgtgtggaaccgcgtgtggatccaggagaatccatggatggaggacaaaacccccgttgagagctgggaggaagtgccctaccttggcaagcgcgaggaccagtggtgcgggagcctcatcgggctcacgtctcgggcaacatgggcaaagaacatccagacggccatcaaccaagtacgctcactgatcgggaacgaagagtacaccgactacatgccatcaatgaagcggttccgaaaagaggaggaggaagcgggggtcctctggtga

SEQ ID NO: 25228 - RNA, 9876 nt, synthetic construct
  misc_feature 1..9876: note = derived and/or modified CDS sequence (opt11) from DENV-2__EU687222__SS-prME
  source 1..9876: mol_type = other RNA
accgccggcgtgatcatcatgctgatccccaccgccatggcgttccacctcaccacccgcaacggggagccccacatgatcgtcggccggcaagagaaggggaagtccctgctcttcaagaccgaggacggcgttaacatgtgtaccctcatggccatcgacctgggggagctgtgcgaggacacgatcacctacaaatgccccctcttgcggcagaacgagccggaggacatcgactgctggtgcaacagcacctctacctgggtgacctacgggacatgcaccaccactggagaacaccggcgcgagaagcggtccgtcgccctggtgccccacgtggggatgggcctcgagacccgcacagagacctggatgagcagtgagggggcctggaagcacgtccagaggatcgaaacctggatcctgcgccacccgggcttcaccatcatggccgcgatcctggcctacaccattgggaccacgcacttccagcgggcactcatcttcatcctgctgaccgcagtggcgccttccatgaccatgcgctgcatcggcatctccaaccgagacttcgtggagggcgtcagcgggggctcctgggtggacatcgtgctcgagcacgggagctgcgtcaccacgatggccaagaataagcccaccctggatttcgaactgatcaagaccgaggccaagcagcccgccaccctacgcaagtactgcatcgaagcgaagcttacgaatacaaccaccgagtcccggtgcccgacccagggcgagccgagcctgaacgaggagcaggacaagcgctttatctgcaagcatagtatggtggaccggggctgggggaacggctgcggcctgtttggcaagggcggcatcgtgacctgcgctatgttcacgtgcaagaagaacatggagggcaaggtcgtgctgcccgagaacctggagtacaccatagtgatcacgccccacagcggggaggagcacgctgtcggaaacgacaccgggaaacacgggaaggaaatcaagatcactccgcaatccagcatcaccgaggccgagctcacggggtacggcacggtgaccatggagtgcagcccgcggaccgggctggacttcaacgagatggtgcttttacagatggaggacaaggcctggctggttcaccggcaatggttcttggacctccccctgccctggctaccgggggccgacacccagggcagcaactggatacaaaaggagacgctcgtgactttcaagaacccccacgccaagaagcaggacgtagtcgtgctggggtcccaggagggcgccatgcacaccgccctgaccggggcgacggagatccagatgagcagcggcaacctactatttacaggccacctgaagtgcaggcttcggatggacaagctgcagcttaaggggatgtcctacagcatgtgcacgggtaagtttaagatcgtcaaggagatcgccgagacccagcacgggacgatcgtgattcgcgtgcagtacgagggcgacggctccccctgcaagattcccttcgagatcatggacctcgagaagcggcacgtcctggggcgcttgataaccgtcaacccgatcgtgaccgaaaaggacagccctgtcaacattgaggcggagccgcccttcggcgactcctatatcatcatcggggttgagccgggacaacttaaactgaactggttcaagaaggggagctccatcggccaaatgttcgagaccacgatgcgaggcgccaagcggatggccatcctgggggatactgcatgggacttcggctctctcgggggcgtgttcacatccatcgggaaggccctgcaccaggtcttcggcgctatctacggcgccgccttcagcggggtgtcctggaccatgaagatcctaatcggcgtgattatcacgtggataggaatgaacagccgctccaccagcctctccgtcagcctcgtgctggtgggcgttgtgaccctgtacctcggtgtcatggtccaggccgactccggctgtgtagtgagctggaagaacaaggagctgaagtgcggctccgggatcttcatcaccgacaacgtccacacgtggaccgagcagtacaaattccagcccgagagcccaagcaagctggcgtccgccatccaaaaagcacatgaagagggcatctgcggtatacggagcgtgacccgcctagagaacctgatgtggaaacagatcacccccgagctgaaccacatactctccgagaacgaggtgaagctgacgatcatgactggcgacatcaaggggatcatgcaagcgggcaagagatccctgagaccgcaacccaccgagctcaaatactcctggaaaacatggggcaaggccaagatgctgagcaccgagtcccacaaccagacgttcctgatcgatgggccagagacggctgagtgcccgaacaccaaccgggcctggaacagcctcgaggttgaggactacggattcggggtcttttccacgaacatctggctgaaactgcgcgagaagcaggacgtgttctgcgactcaaaactcatgtccgccgccatcaaagacaaccgggccgtccacgcggacatgggctactggatcgagagcgccttaaatgacacctggaagatggagaaggctagttttatcgagatcaaaagctgccactggcccaagtcccacaccctgtggagcaacggcgtgctcgagagcgagatgatcatccccaagaacttcgccgggcccgtttcgcagcacaactaccgtccgggctatcacacccagaccgccgggccctggcacctgggcaagctggagatggatttcgacttctgcgaggggaccaccgtcgtggtgaccgaagattgcgggaaccggggccccagcctaagaaccacgaccgcgtccgggaagctgatcactgagtggtgctgccggagctgcaccctgcccccgctccgctaccggggcgaggacgggtgctggtacggcatggagattcgacccctgaaggagaaggaggagaacctggtcaattccctcgtgacggccgggcacggccagatagacaatttcagcctgggggtgctggggatggccttattcctggaggagatgctgcggacccgcgtcggcaccaagcacgccatcctcctagtggcggtgtccttcgtcaccctgatcacggggaacatgagctttcgggacctcggacgcgtaatggtgatggtcggtgccaccatgaccgacgacatcggcatgggcgtaacgtacctagccttactcgccgccttcaaggtgcggcccacgttcgcggccgggctgttgctccggaaactgacctccaaggagttaatgatggccaccatcggcatcgccctcctgagtcagtccaccattcccgagacgatcctcgagctcaccgacgccttggcgctggggatgatggttctcaagatcgtgcgcaacatggagaaataccagctcgccgtgactatcatggctatcagctgcgtacctaacgccgtgatcctgcagaacgcctggaaggtgtcctgcaccatactcgcggccgtaagcgtgagccccctactgctcacgagctcccagcagaaggccgactggatccccctggccctcaccatcaaggggctcaaccccaccgcgatcttcctgaccacgctgtcccggacctccaagaagagaagctggccgctcaacgaggccgtcatggcagtgggcatggtgagcatcctggcctctagcctgctcaagaacgacatccccatgactgggccactggtcgccggcgggctgcttaccgtctgctacgtgttgacgggacggtctgcggatctggagcttgagcgcgccgctgacgtcaagtgggaggaccaagccgagatcagcgggtccagccccatcctgtccatcaccatcagcgaggacggctcaatgagcatcaagaacgaagaggaggagcataccctgaccatcctcatccgaacgggcctgctcgtaatctccggggtgttcccggtaagcatcccaatcaccgccgcggcctggtacctctgggaagtgaagaagcaacgcgccggcgtgctgtgggacgtccccagcccgccgcccgtgggaaaggccgagctggaggatggcgcctacagaatcaagcagcgcgggatcttcggctacagccagatcggggcaggggtgtacaaggagggcaccttccacacaatgtggcacgtcacccgcggggcggtgctcatgcaccgaggcaaacggatcgagccctcctgggctgacgtgaagaaggatctgatctcatacgggggcggttggaagctggagggggagtggaaggagggcgaggaggtccaggtgctcgcactggagcccgggaaaaacccccgcgccgtgcagacgaagcccggcctgttcaagaccaacaccgggaccataggcgcggtgtccctcgacttctcacccggcacgtccgggtccccaattgtagaccgcaagggcaaggtggtcgggctgtacggcaacggcgtggtgacccgctccggagcctacgtctctgccatagcccagaccgagaagtccatcgaggacaaccccgagatcgaggacgatatcttccggaagaagcgcctgactatcatggacctccaccctggggcggggaagacgaagcgttaccttcccgccatagtgcgcgaggcaatcaagcgaggtctgcgcaccctgattctcgccccgacccgcgtggtcgccgcggagatggaggaagccctccgggggctgcccatccgctaccagacgcccgccatccgggccgagcacacgggccgcgagatcgtggacctcatgtgccacgccacgttcaccatgagactgctgtcccccgtcagggtcccgaactacaacctcatcatcatggacgaggcgcacttcaccgatcccgccagtatagccgcccggggctacatctccacgcgcgtggagatgggggaggccgcgggcatcttcatgaccgcgacgccgcccgggtcacgggacccgttcccccagtccaacgcacccatcatggacgaggagcgcgaaatccccgagcggagttggaacagcggccacgagtgggtcaccgactttaaaggcaagacggtctggttcgtgcccagcatcaaggccggcaacgacatcgcggcctgtcttcgcaagaacggcaagaaggtgatacagctgtcccgcaaaacctttgactcggagtacgtcaagaccagggccaacgattgggacttcgttgtcaccaccgatatcagtgagatgggggccaacttccgggccgagcgcgtcatcgacccccggcgctgcatgaagcccgtgatcctcaccgacggcgaagagcgggtgattctggcgggtcccatgccggtcacccactcttccgccgcccagcgccgcggccgtatcggacgcaaccccaagaatgagaatgaccagtacatctacatgggcgaacccctggagaacgatgaggattgcgcccactggaaagaggcgaagatgctcctggacaacatcaacacccctgagggcataatcccgtctatgttcgagcccgagcgggagaaagtcgatgcgatcgacggggagtatcgcctccggggcgaggcgcgcaagacgtttgtggacctcatgcgacgcggggacctgccagtgtggctggcttacagagtggccgccgagggcatcaactacgcggaccgccggtggtgcttcgacgggatcaaaaataaccagattctcgaggagaacgttgaggtcgagatctggaccaaggagggtgagcgcaagaagctgaagccgcggtggctggacgcccgcatctactccgaccccctcgccctgaaggagttcaaggagttcgccgccggccggaagtccctgacgctcaacctgataaccgagatgggccgcctgcctacgttcatgacgcagaaggcccgggacgcactcgacaacctggccgtgttgcacaccgccgaggtcggtgggcgcgcatacaaccacgccctctctgaactccccgagaccctggagacgctcctgctgcttaccctgctggccaccgtgaccggcggcatcttcttattcttaatgtctgggaagggcatcggtaagatgacgctgggcatgtgctgcatcatcaccgcatccatcttgttatggtacgcccagattcagccgcactggatcgcggccagcatcatcctggagttcttcctcatagtgctgctgatccccgagcccgagaagcagcggacgccccaggacaaccaactcacgtacgtcgtgatcgccatcctgaccgtggtcgccgccacgatggcgaacgagatgggcttcctggagaagaccaagaaggacctcggcctgggcagcatcacgacccaggagtcagagagcaacattctggacattgacctccgcccggcctccgcctggacgctgtatgccgtggcaactacgttcgtgacgcccatgctgcggcacagcatagagaacagcagcgttaacgtgtccctcacggctatcgccaaccaggccaccgttctgatggggctgggccgcgggtggcccttgagcaagatggacatcggcgtccccctgctcgccattgggtgctactcccaggtgaacccgatcaccctcaccgcggccctgctgctcctggtagcccactacgccatcatcggaccaggcctgcaggctaaggcaacgcgcgaggcccaaaagcggaccgccgccggcatcatgaagaaccccaccgtcgacggcattaccgtcattgacctcgagcccatcccgtacgacccaaagttcgagaagcaactgggccaggtaatgctgctcgtactgtgtgtgacacaagtgctgatgatgcgcacaacctgggccctgtgcgaagccctaactctggctacaggccccattagcaccctctgggaggggaatcccgggcggttctggaacaccaccatcgccgtctccatggccaatatcttcagaggatcgtacctggccggggcgggactcctcttcagcatcatgaagaacacgaccaacacccggcgcgggacgggcaacataggcgagacgctgggagagaagtggaagtccagactaaacgccctcggcaaaagcgagttccagatctacaagaagtccgggatccaggaggtggaccgcaccctagccaaagagggcatcaaacgcggggagaccgaccaccacgccgtgagtcgtggcagcgcgaagctgcggtggttcgtggagcgcaacatggtgacaccggagggcaaggtggtcgacctcgggtgcggccgcggcgggtggtcgtactactgcggtgggctcaagaacgtgcgcgaggtgaaggggttaacgaagggcgggcccggacacgaggagcccatccccatgagcacctacggctggaatctcgtccggctgcaaagcggggtggacgtgttcttcaccccgcccgagaagtgcgataccctgctctgcgatatcggcgagtccagcccgaaccccacgatcgaggccggccgcaccctgcgggtcctgaacctcgtggagaactggctgaacaacaacacccagttctgcattaaagtgctgaatccgtatatgccctctgtcatcgagaagatggagaccctccagcgcaagtacgggggtgccctggtgaggaaccccctctcccgcaactccactcatgagatgtactgggtgagcaacgccacgggaaacatcgtctccagcgtaaacatgatctcccgcatgctaatcaaccggttcacaatgaagcacaagaaggcgacctacgagccggacgtggacttaggcagcgggactcgcaacatcggcatcgagaatgagatccccaacctggatatcatcggcaagcggatcgaaaagatcaagcaggagcacgagacgtcgtggcactacgaccaggaccacccctacaagacctgggcgtaccacgggagttacgaaaccaagcagaccggctccgccagctccatggttaacggtgtggtgaagctgctcacgaagccctgggacgtcgtgccgatggtgacccagatggccatgaccgacaccacgcctttcggccagcagcgcgtcttcaaggagaaggtggacacccgcacgcaggagcccaaggaggggactaagaagcttatgcgcatcacggccgagtggctgtggaaggaactcgggaagaagaaaacgccccggatgtgcaccagagaggagttcacccggaaggtgcgcagcaatgccgcgctgggcgccatcttcactgatgagaacaaatggaagtccgcacgagaggccgtggaggacagccgcttctgggagctggtggaccgcgagcgcaacctccatctagaggggaagtgcgagacatgtgtctataacatgatgggcaagcgggagaagaagctgggggagttcggcaaggcgaagggctctcgagcgatctggtacatgtggctcggtgcccggttcctggagttcgaggccctgggcttcttaaacgaggaccactggttctcccgcggcaacagcctgtccggcgtggagggagagggcctgcacaagttaggctacatcctgcgggacgtgagcaagaaggagggcggtgccatgtacgccgacgacaccgccgggtgggacacccgcatcacgctggaggacctcaagaacgaggagatggtcacaaaccatatgaagggcgagcacaagaagctggccgaggccatattcaagctgacctaccagaacaaggtggtgcgtgtccagcgcccaacgccacgggggacggtgatggacatcatctcccgaaaggatcagcgcggcagcggccaggtggggacctacggtctcaacacgttcaccaacatggaggcccagctaatccggcaaatggagggagaaggcatcttcaagtccatccagcgcctgacggtcactgaggagatcgcggtgcagaactggctagcccgggtgggccgggaacggctgagccgcatggccatctccggggacgactgcgtagtgaagcccctggatgacagattcgcctcagccctcaccgcgctgaacgatatgggcaaagtgcgaaaggacatccagcagtgggagccctcccgggggtggaacgactggactcaggtcccgttctgcagccaccacttccacgagctggtgatgaaggacggccgagtgctcgtggtgccctgtcgtaaccaagacgagctgatcgggcgcgcccggatctcccagggagccggctggagcctgaaagagacggcctgcctcgggaagtcctacgcccaaatgtggaccctgatgtacttccaccgccgggacctgcgcctcgctgccaacgccatctgcagcgccgtaccctctcactgggtccccaccagccgcaccacctggtccattcacgcaaagcacgagtggatgacaaccgaggacatgctggcggtgtggaaccgcgtgtggatccaggagaacccgtggatggaggacaaaacccccgtcgagagctgggaggaggtgccttacctgggcaagcgcgaagaccagtggtgcggcagcctcatcgggctgacatcccgggccacgtgggctaaaaacatccagaccgccatcaaccaggtgcgctctctgattgggaatgaggagtataccgactacatgccctccatgaagcgttttcgcaaggaagaggaggaggcaggcgtcctctggtga

SEQ ID NO: 25229 - RNA, 9876 nt, synthetic construct
  misc_feature 1..9876: note = derived and/or modified CDS sequence (opt11) from DENV-2__EU687223__SS-prME
  source 1..9876: mol_type = other RNA
actgctggggtcataatcatgttgatcccgacggcgatggcattccacctgacaacacggaacggggaaccccacatgatcgtagggcggcaggaaaaaggcaaaagcctactgttcaaaactgaagacggtgtaaacatgtgcaccctgatggcaatcgatttaggcgaactctgtgaagatacgatcacatacaaatgccccctactaagacagaacgaaccagaagacattgattgctggtgcaacagcacgagcacatgggtaacatacggaacgtgcaccaccacaggcgagcaccgaagggaaaaacggtcagtggcgctcgtccctcacgtaggcatggggcttgaaacgaggacggagacttggatgtccagtgagggtgcgtggaaacacgtacagagaatagaaacgtggatactccggcaccctggcttcacaatcatggcagccatactcgcatacacaatcggaaccacacacttccagcgggccctaatttttatcctattaacagcggtcgcgccctctatgacgatgaggtgtataggaattagcaatagagattttgtagagggggtgagcgggggcagctgggttgacatcgtactggaacatggctcctgcgtcactaccatggccaaaaacaaaccaacgctcgactttgagctaataaaaacagaggcgaaacaacctgcgacgttaagaaaatattgcatagaagccaagttaacaaacactacaaccgaaagtcgatgtcccacccaaggagaaccaagcctgaacgaagaacaggacaaacgcttcatatgcaaacatagcatggttgacaggggatgggggaacggttgtggactatttggcaagggaggcatagtcacgtgtgctatgttcacgtgcaagaaaaacatggaggggaaggtagtactcccagaaaatctcgaatacacgatcgtaatcacaccgcactcgggagaagaacacgccgtcggcaacgacacagggaagcacggtaaggaaataaagatcacaccccagagtagcatcaccgaggctgaactaacaggatacggaactgtaaccatggagtgctcacccagaacaggccttgacttcaatgaaatggtcctcttacaaatggaggacaaggcctggttagtccacagacaatggttcctggatctcccgttgccctggctgcctggagccgacactcaaggaagcaactggatccagaaagaaaccctggtcacgttcaagaacccacacgcaaagaaacaggacgtggtggtactcggatcacaggagggcgcaatgcataccgctcttaccggcgcaacagagatacagatgtcctcaggcaacctcctgtttacggggcatctgaaatgccgccttcgcatggacaaactccaacttaaagggatgtcctactcgatgtgcacagggaaatttaaaatagtcaaagagatagcggaaacgcagcacggtaccatcgtaatccgcgtgcagtacgaaggtgacgggagcccgtgcaagataccgttcgaaataatggacctcgaaaaacgacacgtccttggtcggctaatcacagtaaatcctatcgtaaccggtaaagacagccccgtgaacatagaagcagagccaccattcggagatagctacatcataataggagtagaacccgggcagctcaagctcaactggtttaagaagggtagctcaattggacaaatgtttgagaccaccatgcgcggagcgaaaagaatggcaatactaggtgatacagcgtgggatttcggcagtctaggaggggtgttcacgagcattgggaaggccctgcaccaagtgtttggggctatatatggagctgctttctcaggcgtgtcctggaccatgaagatactaatcggtgttattatcacgtggataggcatgaacagtcgctcaaccagcctctcagtgtcgctagtcttagtaggtgtggtcacgctgtatctaggcgtgatggtacaagccgactcaggatgtgtagtgagttggaaaaacaaggaactgaaatgtgggtcagggatatttattacggacaacgtccacacgtggacagaacagtacaaatttcagccagaatccccttcaaaacttgcgtccgcaatccaaaaggcccatgaggagggaatatgtggtataagatctgtaacgcgcttggaaaacctaatgtggaagcaaataacacctgagctaaaccacatcctgagcgaaaacgaagtcaaacttacaattatgactggtgacataaaaggtatcatgcaagctggaaaacggtcgctcagaccacaaccgaccgagttgaagtattcatggaagacctggggaaaggccaagatgctttcaacggagagtcataaccaaacgttcttgatagacggcccagagaccgcggaatgcccgaacacgaacagggcctggaatagcctggaagtggaagattacggattcggcgtgttctcgacaaatatatggttaaaacttcgggaaaaacaagacgttttctgcgacagtaagctaatgagtgccgcgataaaagacaaccgcgcagtgcacgcggacatgggctactggatcgagtctgcgctaaacgacacatggaaaatggagaaggcatccttcatagaaattaaaagctgccactggcccaagagccacacactctggagcaacggtgtcctcgaatcggaaatgatcatacccaagaattttgcaggacccgtgtcgcaacacaactaccgccccgggtaccacacccaaaccgccggaccctggcacctaggcaaactcgaaatggacttcgacttctgcgagggcactacagtagtggtcacggaagattgcggaaatcgagggccatcacttcgtacaacgacggcatcaggcaaactaatcactgaatggtgttgtagatcctgcacactaccccctctacgctaccgcggagaagacggatgttggtacggcatggaaatacgtcccctcaaagaaaaagaggagaacctcgttaattcactcgtcaccgcaggacatggccaaatcgacaatttctcgttaggcgtacttggcatggccctcttcctagaagagatgctccggacgcgcgtaggaaccaaacacgcaatactactggtcgcggtcagctttgtaacgctaataacgggcaacatgagcttcagagatctgggacgcgtaatggtcatggttggagcgaccatgacagacgacataggaatgggggtcacatatctagcactattagcagcgtttaaagtaagaccgacattcgccgccggtctgctcctcaggaaactaaccagtaaagagctaatgatggccacaataggcatcgccctcctatcccaatcgacaataccggagactatcctagagttaacggacgctcttgccctcggaatgatggtgctaaaaatagtacgcaacatggaaaaataccaactggcagtaaccatcatggcaatcagctgtgttcccaatgcggtaatactccagaacgcttggaaagtttcgtgcactatcctcgcagccgtaagcgttagtcccctgctcttaaccagctcccagcaaaaagccgactggataccgttagccttgacaatcaaaggactcaatccaactgcgattttcctgactactctcagtaggaccagcaagaaacgaagctggcccttaaacgaagcggttatggctgtagggatggtaagcatcctagcatccagtctcttgaaaaacgatatccccatgactggaccgctagtcgccgggggactcctcacggtctgctacgtactaactggtagaagtgcagacctggagctcgagcgagcagcggacgtgaaatgggaggatcaggcggagatctctgggtcgtcgcccatactgtccatcaccataagcgaggacgggagtatgagtataaagaacgaggaggaagaacacactctaacaatccttataagaacagggctgctggtgatcagcggcgccttcccggtgtcgatccctatcactgccgccgcctggtatctatgggaggtgaagaagcagcgggccggtgtcctatgggatgtgccaagcccgcctcccgtaggtaaggcagagttagaagacggcgcctatcggataaaacaacgtggcatttttggttacagccagatcggtgccggagtatataaagaagggactttccatacaatgtggcatgtaacccgcggagccgtactaatgcacagaggtaagcgaattgaaccctcgtgggcagacgtcaagaaagacctaatttcctacggaggagggtggaaacttgagggagaatggaaagagggggaggaagtacaagtactggctctcgagccaggaaagaacccacgggctgtacaaacaaagcctggcctcttcaagacgaataccggcacaatcggagccgtctcactggacttttccccaggaacatcgggcagtcctatagtcgatcgcaagggaaaagtagttggtctttacggcaatggagtggtgaccagatcaggggcatacgtgtcagcgatcgcgcaaacggagaagagtatcgaagacaaccccgagatagaggacgacatcttccgaaagaaacgcctgacaataatggacctccacccgggagctggaaagacaaaacgctacctaccagccatcgttcgcgaagcaataaaacgagggttacgaacactaatactcgcaccaacccgagtggtggctgcagaaatggaagaagccctacgagggttgcccatacgctaccagacacccgccattcgggccgagcacaccggtagagaaatcgtcgacttaatgtgccacgccactttcacgatgcggctcttatcaccggtaagagtaccaaattacaatttaataataatggacgaagcccacttcacagaccctgcaagcatagcagctcgcggttacatcagcacacgggtcgaaatgggagaagccgcaggtatattcatgacagccacgcccccaggatcccgggaccccttcccgcagtcaaacgctcctatcatggatgaagaacgagaaataccggagcggtcgtggaactcaggacatgagtgggtcactgacttcaaggggaaaaccgtatggttcgtaccaagcatcaaagccggaaatgacattgcggcctgcctgcggaaaaacggaaagaaagtgatccagctgtctcgaaagacttttgactcagaatacgtaaaaaccagggcaaatgactgggacttcgtagtaacgacggacatttctgaaatgggggcgaacttccgagccgagagagtgatcgaccctcggcgatgtatgaagccggtcatactcaccgatggagaggagcgggtaatcctcgcgggcccaatgcccgtaacgcacagctccgcggcgcaaagacgagggcgaataggacgcaaccccaaaaacgaaaacgaccagtacatctacatgggggagcctctcgaaaacgacgaagactgcgctcattggaaagaagccaagatgttactggacaacataaatactcctgagggaatcatcccctcaatgttcgagcccgaaagggaaaaggttgatgcaatcgatggagaataccgattgcgcggggaagccaggaagacatttgtcgacctaatgcgcagaggggacctccccgtttggctggcgtaccgtgtcgcagcggagggaattaactacgcggacaggagatggtgtttcgacggaattaaaaacaaccaaatattggaggaaaacgtggaagtcgaaatctggacaaaagaaggggagcgaaagaagctaaagccacgatggctggacgcccgaatatacagtgaccccctcgcattgaaggagttcaaggaatttgcggcaggcagaaaatcactcacgttaaatctcatcacagaaatggggagattacccacgttcatgacgcagaaggcgcgagacgccctagacaaccttgccgtgctacacacggccgaggtaggcggccgtgcgtacaatcatgcacttagtgaactgcctgaaacacttgaaacgctactactcttaacactactagcaacagtgactggcggaatcttcctcttcctaatgtccggcaaagggataggcaaaatgaccctgggaatgtgctgcattattacagcgtcaatactactctggtacgctcaaatccaaccccactggatcgccgcttccatcatactagagttcttcctgatcgtattactaataccggagccagagaagcagaggacaccccaagacaatcaactgacgtacgtggtaatagccatattaacggtcgtagccgccacaatggcgaacgagatgggattcctagagaaaaccaagaaagacttaggcctcggaagcatcacgacccaagaaagcgaatcgaacatattagacatcgacttgagaccagcgagcgcctggaccctctatgccgtcgccactacgttcgtcacaccaatgttacgacatagtattgaaaacagcagcgtgaatgtttccctaactgcgatcgcgaaccaagccacagttctgatgggtctcggaagaggctggccactgtcaaagatggacataggagtgccactcctggcaatagggtgctattcacaagtgaatcccatcaccttaacggcagcactactactcctggtcgcacattacgcaataattgggccgggacttcaagccaaggcaaccagggaagcacaaaaacgcactgccgcgggcatcatgaaaaacccaacagtcgacggcataactgtcatagacctagagcccataccgtacgaccccaagttcgaaaaacagctaggccaagtcatgttgctcgtcctgtgcgtcacccaggttctgatgatgaggacaacgtgggctctgtgcgaagcgctgaccctcgcgacaggacccataagcacactatgggaaggtaaccctggccgattttggaacactacaatagcagtgtccatggcaaacatattccggggaagctacctcgccggcgccggcctcctattttcaataatgaagaataccactaatacgcgacgaggaactggtaacatcggggagacactaggagaaaagtggaagtcacgactaaacgctctagggaaatcggagttccagatctacaagaaatcaggaatacaggaagtcgaccgtacactagccaaggaggggataaagcgcggtgaaaccgaccatcacgcagtttccagaggtagcgccaaactcagatggttcgtagagagaaacatggtaactccagagggaaaagtcgtggaccttggatgcggcagaggcggatggagctattactgcggaggcctcaaaaacgtgcgggaagtgaaggggctaacaaaaggtggacctggacatgaggagcccataccgatgagcacgtacggttggaacctagtgagattgcagtcaggagtcgacgtcttctttacgccacctgaaaaatgcgacacgctactctgcgacatcggcgaaagctcacccaatcccaccatagaggccggacgtaccctacgggtcctcaacctcgtcgagaattggctgaataacaacacacagttctgcatcaaggtccttaacccatacatgccctcagtaatagagaagatggaaacactccaaagaaaatacggcggtgccctggtccgtaaccctctgtccaggaacagcacacacgaaatgtattgggtaagcaatgctaccgggaacattgtatcatccgtgaacatgatctcgaggatgctcattaacaggttcacgatgaaacataagaaagcgacgtatgaacccgacgtggacctgggtagtgggacgcgtaacattggcatagaaaacgaaatcccgaacctcgacattatcggtaaaagaatagagaaaataaagcaagagcatgaaacatcatggcattacgaccaggaccacccctacaaaacctgggcctatcacggaagctacgagaccaaacagaccgggtcagcctccagcatggtgaacggagtcgtcaagctactaacgaagccttgggacgtcgtgccgatggtaacacaaatggccatgacagatacgacgccctttggtcaacagcgagtatttaaagaaaaagttgacactcggacccaggagccaaaggagggaaccaagaagctaatgcgaatcacagcagaatggctgtggaaagagttaggaaagaagaaaactcctcgcatgtgcacgcgtgaagagttcacacggaaggtacgatcaaacgcggcactgggagcaatcttcacggacgaaaataaatggaaatccgcgcgcgaagcagtcgaagacagcaggttctgggaactcgtagaccgtgagagaaacctccacctcgagggtaaatgcgagacctgcgtctacaacatgatgggcaagagggaaaagaagctcggagagtttgggaaagcaaaaggatcaagagcgatctggtatatgtggctaggggcaagattcctagagttcgaggcactgggcttcctaaacgaggaccattggttcagcaggggcaacagcctctccggagtggagggcgaaggccttcacaagttaggctacatcctacgcgacgttagtaagaaagaagggggagcgatgtacgcggatgataccgccggatgggatacccgtataacgctggaggaccttaaaaacgaggaaatggtaaccaaccatatgaaaggcgagcacaagaaactagccgaggccatcttcaaactaacatatcaaaataaagtcgtacgagtgcaaagaccgacacccagggggactgtgatggacataatctctaggaaagaccaacgcggttccgggcaggttggcacctacggtctcaatacgtttacgaacatggaggcgcagctgatcagacaaatggaaggggaaggaatctttaaaagcatacagcgactaacagtcacagaggaaatcgccgtccaaaattggctagcccgtgtaggtcgggaaaggttgagccgcatggccatcagcggcgatgactgcgtcgtcaaaccgctggacgatcgattcgcgtcggccctaacggcgctaaacgacatgggaaaagtaagaaaagacatacaacaatgggaacccagccgaggctggaatgattggacacaagtgcctttctgttcccatcatttccatgagctagtaatgaaagacggacgcgtcctagtagtcccatgccgaaatcaggatgagcttatcggtcgcgcccgcatctcccaaggggcaggatggagcctaaaggaaaccgcctgcctgggaaaatcatatgcacagatgtggacactcatgtacttccatcgtcgggatctacgtctcgcggcaaacgcaatatgcagtgccgtgccgtcccactgggtaccgacgagccgcactacgtggtccatacacgcgaagcatgagtggatgacaaccgaagacatgctggccgtctggaaccgcgtctggatccaggaaaatccatggatggaggacaaaaccccagtagagtcttgggaggaagtcccgtacctaggaaagcgcgaggaccagtggtgcgggtcgttaataggcttaacctcaagagcaacatgggccaagaacatccaaaccgccataaatcaagtccgatcgctcataggcaacgaggaatacacagattacatgccaagcatgaaaagattccgcaaggaggaagaagaagccggcgtactgtggtag

SEQ ID NO: 25230 - RNA, 9876 nt, synthetic construct
  misc_feature 1..9876: note = derived and/or modified CDS sequence (opt11) from DENV-2__EU687227__SS-prME
  source 1..9876: mol_type = other RNA
accgccggcgtgatcatcatgttgatccccaccgccatggcgttccacctcaccacccgtaacggggagccccatatgatcgtcggccgtcaggagaaggggaagtccttattgttcaagaccgaggacggagtgaacatgtgcaccctcatggccatcgacctgggggagctgtgtgaggacaccattacctacaagtgtcccctcttgcgccagaacgagcccgaagacatcgattgctggtgcaactctacctctacctgggtgacctacggaacctgcaccaccacgggcgagcaccggcgcgaaaagcggtccgtagccctggtaccgcacgtggggatgggcctcgagacccgcaccgagacgtggatgtcctcagaaggggcttggaagcacgtccagcggatcgagacctggatcctgcgccacccgggattcaccattatggccgcgatcctggcctacaccattgggacgacccacttccaacgagccctcatcttcatcctgctaaccgccgtggcgcccagcatgaccatgcgctgcattggcatttccaaccgggacttcgtagagggagtcagcggggggtcctgggtggacatcgtactcgagcacgggagctgcgtcaccacgatggccaaaaacaagcccaccctggacttcgagctgatcaaaaccgaggccaagcagcccgccaccctccgtaagtactgcatcgaagccaaactgacaaataccaccaccgagtcccgttgcccgacgcagggcgagcccagcctgaacgaggagcaagacaagcgcttcatctgcaaacactccatggtggaccggggctgggggaacggctgcggtctgttcggcaagggcgggatcgtgacctgtgcgatgttcacgtgcaagaagaacatggagggaaaggttgtgctgcccgagaacctggagtacactatcgtgatcacaccccacagcggagaggagcacgccgtcggcaatgacaccgggaaacacggaaaagaaatcaagattaccccgcagtccagcatcaccgaggccgagctcaccggctacggcacggtcaccatggagtgcagcccccggactggcctggacttcaacgagatggtgctgcttcagatggaggacaaggcctggctggtccaccggcagtggttcctagacctccccctgccctggctgccgggggccgacacccaaggcagcaactggatccagaaggagacgctcgtgacattcaagaacccccacgcgaagaaacaggatgtggtcgtgctgggctcccaggagggcgccatgcatacagccctgaccggggccacggagatccagatgagcagcggcaacttactgtttaccggccacctgaaatgccgcctccggatggataagctgcagctgaaggggatgtcctacagcatgtgcacaggcaagtttaagatcgtcaaggagatcgcggagacgcaacacgggacgatcgtgataagagtgcaatacgaaggcgacggctccccctgcaagattccgttcgaaatcatggacctcgagaagcggcacgtcctggggcgcctgatcaccgtgaacccgatcgtgaccgagaaggatagcccagtcaacatcgaggcagagccacccttcggcgactcctacatcatcatcggggtggaaccgggtcagctcaagctgaactggttcaagaaggggagctccatcggccaaatgttcgaaacaacgatgcgcggcgccaagcggatggccattctgggtgacaccgcatgggacttcggctcactcgggggcgtcttcaccagcatcgggaaggccctgcaccaggtctttggcgcgatctacggcgccgccttcagcggggtgtcctggaccatgaagatcctgatcggcgtgatcatcacatggattggtatgaacagtcgttccaccagcctgtccgtcagcttagtgctggtgggagtcgtaaccctgtatctcggggtgatggtccaggccgactccggctgcgtggtgagctggaagaacaaagagcttaagtgcggctccgggatcttcatcaccgacaacgtccacacgtggactgagcagtataagttccagccggaaagccccagcaagctggcgtccgccatacagaaagcccacgaggagggcatctgcgggatccggagcgtgacccgcctcgagaacctgatgtggaagcagatcactcccgaactgaaccacatcctctccgaaaacgaggtgaagctgactatcatgaccggcgatatcaaggggatcatgcaggcaggcaaacgtagccttcgcccgcagcccactgagctcaagtactcatggaagacctggggtaaggccaagatgctgagcacggagtcccacaaccagaccttcctgatcgacggccccgagaccgcagagtgccctaataccaaccgggcctggaacagcctcgaggtcgaggactacggcttcggggtgttctccacgaatatctggctgaagctgagagagaaacaggacgtgttctgcgacagcaagcttatgtccgccgccatcaaggacaaccgggccgtccacgcggacatgggctattggatcgagagcgccttgaacgacacttggaagatggagaaggcctccttcatcgagatcaagagctgccactggcccaagtcccacaccctgtggagcaatggcgtactcgagtccgagatgatcatccccaagaacttcgccgggcccgtgtcacagcacaactaccgcccgggctaccacacccaaaccgccggaccttggcacctgggcaagctggagatggacttcgacttctgcgaagggacgaccgtggtggtcaccgaggactgcggcaaccggggccccagcttgcgaaccacgaccgcgtccgggaagctgattaccgagtggtgctgcagaagctgcaccctgcccccgctcagataccgcggcgaggacgggtgctggtacggcatggagatcagacccctgaaggagaaggaggagaatctggtcaactccttggtgacggccgggcacggtcagatcgacaacttcagtctgggcgtgctgggaatggccctcttcctggaggagatgctgcggacccgcgtcggcaccaagcacgcaattctcctggtggcggtgtccttcgtcaccctgatcaccgggaacatgagcttccgggacctcggtcgcgtgatggtcatggtcggggccaccatgaccgacgacatcggcatgggcgtgacctacctggccctgcttgccgccttcaaggtgcgccccacgttcgcggccgggcttttattgaggaagctgacctccaaggagctgatgatggccaccatcggcatcgccctcctgagccagtccaccatccccgagacgattctagagctcaccgacgccctggcgctcggaatgatggtcctcaagatcgtgcgcaacatggagaagtaccagctggccgtgactatcatggcgatcagctgcgtcccgaacgccgtgatcctacagaacgcctggaaggtctcctgcaccatcctcgcggcggtgtctgtgagccccctgctgctcacaagctcacagcagaaggccgactggatccccctggccctgaccattaagggtctcaaccccaccgcgatcttcttaacgacgctgagccggacctccaagaagcgctcgtggccgcttaatgaggccgtcatggccgtgggcatggtgagtatactggccagcagcctgctcaagaacgacattcccatgaccgggccgctggtcgccggcgggttgctcaccgtttgctacgtgctgactgggcggtccgcggacctggagctcgagcgcgccgctgacgttaagtgggaggaccaagccgagatcagcgggagtagccccatcctgtccatcaccattagcgaggacggcagtatgagcatcaagaatgaggaggaggagcacaccctgaccatccttatacggacgggcctgttggtgatttccggggtgttcccggtgagcatccccattaccgctgcggcctggtacctctgggaggtgaagaagcagcgcgccggcgtgctgtgggacgtccccagcccgccgcccgtgggcaaggccgagctggaggacggcgcctacaggatcaagcagcgcgggattttcggttacagccagattggcgcgggggtgtacaaggagggaacatttcacaccatgtggcatgtcacccgcggggcggtgctcatgcacagggggaagcggatcgagccctcgtgggccgacgtcaaaaaggacctgattagctacggcggcggctggaagctggagggggagtggaaggagggtgaggaggtccaggtgctcgccctggagcccggcaagaacccccgcgccgtgcagacgaaacccggcctgttcaagaccaacacggggaccatcggcgcggtctcgttagactttagccccggcacgtccgggagccccatcgtcgaccggaagggcaaggtggtcgggctctacggcaacggcgtggtgacccgctccggggcgtacgtcagcgccatcgcccagaccgagaagtcaatcgaggacaaccccgagatcgaagacgacatcttccggaagaagcgacttaccattatggacctccatcccggcgcggggaagacgaagcggtacctgcccgccatcgtacgcgaggccattaagcggggcctgcgaaccctgatcctcgccccgacgcgcgtggtagccgcggagatggaggaagccctgcgggggctgccaatcaggtaccaaacccccgccatccgggccgagcacacaggccgcgagatcgttgacctgatgtgccacgccaccttcaccatgcggctgctctcccccgttcgcgtcccaaattacaacttgataattatggacgaggcgcacttcaccgatcccgcgtcaatcgccgcacggggttacatctcgacgcgcgtggaaatgggggaggccgcgggtatcttcatgaccgccactccgcccggtagccgggacccgttcccgcagtccaacgcccccataatggacgaggaacgcgagatacccgagcggtcttggaactccggccacgagtgggtgaccgatttcaaggggaagacggtctggttcgtgccctcgatcaaggccggcaacgacattgcggcatgtctgcgcaagaacggcaagaaggtgattcagctgtcccggaagaccttcgactcggagtacgtaaagacccgcgccaacgactgggacttcgtggtgaccacggacatctccgagatgggggcaaacttccgggccgagcgcgtcatcgacccccgtcgctgcatgaagcccgtgatcctcaccgacggcgaggaacgggtgatactggccgggccaatgccggtcacacatagctccgccgcccagcgcaggggccggatcgggcgcaaccccaagaacgagaacgaccaatatatctatatgggcgagcccctggagaacgacgaggactgcgcacactggaaggaggccaagatgctcctggacaacatcaacacccccgagggcatcattccgagcatgttcgaacccgagcgggagaaggtggacgcgatcgacggcgagtaccgcctacggggcgaggcccgcaagactttcgtggatctcatgcggcgcggggacctgccagtctggctggcctaccgggttgcggccgagggcatcaactacgcggaccgccgctggtgcttcgacgggatcaagaacaaccagatcttggaggagaacgtcgaagtcgagatctggaccaaggagggcgagcgcaagaagctgaaaccgcggtggctggacgcccgcatttactccgaccccctggccctgaaggaattcaaggagttcgctgcgggtcggaagtccctgaccctcaacctgataaccgagatggggcgcctgcccacgttcatgacccagaaggcccgggacgccctcgacaacctggccgtactgcacaccgccgaagttggcggacgcgcgtacaaccacgccctctccgaactgccggagaccctggagacgcttctgctgctcaccctactggccacggtgaccggcggcatcttcctcttcctgatgagcgggaagggcatcgggaaaatgacgctggggatgtgctgcatcataacggcttccattctcctgtggtacgcccaaatccagccgcactggatcgcggccagcatcatcctggagttcttcctcatagtgctgctgatccccgaacccgagaagcagcggactccccaggacaaccagctcacctacgtggttatcgccatcctgaccgtggtcgccgccacgatggcgaacgagatggggttcctggagaagaccaagaaggacctaggtctgggcagcatcaccactcaggagtccgagagcaatattctggacattgatctccgcccggcctccgcctggacattatacgccgtggccacgaccttcgtgacccccatgctgcggcacagcatcgagaactccagcgtcaatgtgtccctcacggcgatcgccaaccaggccaccgtgctgatggggctgggccgcgggtggcccctcagcaagatggatataggcgtgcccctgctggccatcggttgctactcccaggtcaaccctatcaccctcaccgcggcactgctgcttctagtggcccactacgccatcatcggccccggcctgcaggccaaggcgacgagggaggcccagaaacggaccgccgccgggatcatgaagaaccccaccgtcgatggtatcaccgtgatcgacctcgagccaattccgtacgaccccaagttcgagaagcagctgggccaagttatgctgctcgtcctgtgcgttacccaggtactgatgatgcgcaccacctgggccctatgcgaagcgttaaccctggcaacggggcccatcagcaccctctgggaggggaaccccggccggttttggaacaccaccatcgctgtgtccatggccaacatcttccgcggcagctacctggccggggcgggcctcctcttctccatcatgaagaacacgaccaacacacggcgcgggaccggaaacatcggagaaacgctgggggagaagtggaagtccagactgaacgccctcggcaagtccgagttccagatctacaagaagtccgggatccaggaggtggaccgcacgctggccaaggagggcatcaagcgtggggaaacagaccaccatgctgtgtcccgcggcagcgcgaagctgaggtggtttgtcgagagaaacatggtaaccccggagggcaaggtggtcgacctcgggtgcggacgcggggggtggtcctactactgcggcgggctaaagaacgttcgcgaggtgaaggggctgacgaagggcggacccgggcacgaggagcccatccctatgagcacctacggctggaacctggtccggctgcaatcaggggtggacgtgttcttcacaccacctgagaagtgtgacaccctgctgtgcgacatcggcgaaagtagtccaaaccccacgatcgaggccggccgcaccctgcgggtcctgaatctagttgagaactggctcaacaacaacacccaattttgcatcaaggtgctgaacccgtatatgccctccgtcatcgagaagatggagaccctccaacgcaagtatgggggcgcacttgtgcggaatcccctgagccgcaactctacacacgaaatgtactgggtgagcaatgccacggggaacatcgtctcctccgtgaacatgatctcccgcatgctgatcaaccggttcaccatgaagcacaagaaggcgacctacgagccggacgtggacctcggcagcgggaccagaaacatcggtatcgaaaatgagatccccaacctagacatcatcggcaaacgcatcgagaagatcaagcaggagcacgaaacgtcttggcactacgaccaggatcacccatacaagacctgggcgtatcacggctcatacgagaccaagcaaaccggcagcgccagctccatggtcaacggggtggtgaagcttttaacgaagccctgggacgtcgttccgatggtgacccagatggccatgaccgatacgacgcctttcggccagcaacgcgtcttcaaagagaaggtggacacccggacccaggagcccaaagagggcaccaagaagctgatgcgcatcacggccgagtggctgtggaaggagctcggaaagaagaagacgcctcggatgtgcacccgcgaagagttcacccggaaggtgcgcagcaacgccgcgctgggcgccatcttcactgacgagaacaagtggaagagcgctcgagaggccgtcgaggacagccgcttttgggagctggtggaccgggagagaaacctccacctggaagggaagtgcgagacctgcgtgtataacatgatgggcaagcgggagaagaagctgggtgagttcggcaaagccaagggctcacgcgcgatctggtacatgtggctcggggcccggttcctcgagttcgaggccctgggcttcctcaacgaggaccactggttcagtcgcgggaactcgctgagcggcgtggagggggagggactgcacaaactaggctacatcctgcgggacgtgagcaagaaggagggcggggccatgtacgcagacgacaccgccgggtgggacactcgcatcacgctggaggacctcaagaacgaggagatggtcaccaaccagatgaagggcgaacataagaaactggccgaggccatcttcaaactcacctaccagaacaaggtggtgcgggtccaacgcccgacgccccggggcacggtgatggatatcatcagccgcaaggaccagcgcggcagcggccaggtggggacttacggactcaacaccttcaccaacatggaggcccagctgatccggcagatggagggcgagggcatcttcaagtccatccagcgcctgacggtcaccgaggagatcgcggtgcagaactggctcgccagggtaggccgcgagcggctgagccgcatggccatatcaggggacgactgcgttgtgaagcctctggacgaccggttcgccagcgccctcaccgcgctgaacgacatgggcaaggtgcgcaaggacatccagcagtgggaaccctcgcgcggctggaacgactggacacaggtcccgttctgcagccaccattttcatgagctggtgatgaaggacggccgggtgctcgtcgtgccctgccggaaccaagatgagctgatcgggcgcgcgcggatctcccaaggcgccggctggtctctgaaggagacggcctgcttagggaagtcctatgcccagatgtggaccctgatgtacttccacagacgggacctgcgcttagctgcgaacgccatctgcagcgccgtgccctcccactgggtccccaccagccggacgacctggtccattcatgccaaacacgagtggatgacgaccgaggacatgctggcggtgtggaaccgcgtctggatccaggagaacccgtggatggaggacaagacccccgtcgagagctgggaggaggtgccatacctgggcaagcgcgaggatcagtggtgtgggagcttgatcggcttgacctcccgggccacgtgggccaagaacatccagaccgccataaaccaggtgcgcagcctgatcggcaacgaagagtacaccgattacatgccctccatgaagcggttccgcaaggaggaggaggaggcgggcgtcctctggtga

SEQ ID NO: 25231 - RNA, 9876 nt, synthetic construct
  misc_feature 1..9876: note = derived and/or modified CDS sequence (opt11) from DENV-2__EU687228__SS-prME
  source 1..9876: mol_type = other RNA
actgcgggcgtgatcatcatgctaatccccaccgccatggcgtttcacctaaccacccgcaacggggagccgcacatgatcgtcggccggcaggagaaggggaagtccctgttattcaagacggaggacggcgtgaacatgtgcaccctcatggctatcgacctgggggagctgtgcgaggacaccatcacctacaagtgccccttactgcggcaaaacgagcccgaggacattgactgctggtgcaacagcaccagcacctgggtgacatacgggacgtgcacgaccacgggcgagcacaggcgcgagaagcggtctgtcgccctggtgcctcacgttgggatgggactcgagacccgcaccgagacttggatgagcagcgagggggcatggaagcacgtccagcggatcgagacctggatcctgagacacccgggcttcaccattatggccgcgatcctggcctacaccatcggcaccacgcactttcaacgggccctcatattcattttactgacagccgtggcgcccagcatgaccatgcgctgtatcggcatctccaaccgggactttgttgagggtgtctcagggggctcgtgggtggacatcgtgctggagcacgggagctgcgtcaccacgatggcgaagaacaagcccaccctggacttcgagttaatcaagaccgaggcgaagcagcccgctaccctccgcaagtactgcatcgaagccaagctcacgaacaccaccaccgagtcccgttgcccgacgcagggcgagcccagcctgaacgaggagcaggacaagcgctttatctgcaagcactccatggtggatcgtggctggggcaacggctgtggcctgttcggcaaggggggcatcgtgacctgcgcgatgttcacgtgtaagaagaatatggaaggcaaggtagtgctgcccgagaacctggagtacaccatcgtcatcacgccccacagcggggaggagcacgccgtcggcaacgacaccggtaagcacggcaacgagatcaagattaccccgcaatccagcatcaccgaggctgagctaacggggtacggcactgtaaccatggagtgcagcccccggaccggcctggacttcaacgagatggtgctgctccaaatggaggacaaggcctggctggtccaccggcagtggttccttgacctccccctgccctggttacccggcgccgacacccagggcagcaactggatacagaaagagacgttagtgaccttcaagaacccccacgcgaagaagcaggatgttgtcgtcttggggagtcaggaaggggccatgcacaccgccctgaccggggccacggagatccagatgagcagcggcaacctcctgtttactggccatctgaagtgccgcctcagaatggacaagctccagttaaaggggatgtcctacagcatgtgcacgggcaagttcaagatcgtcaaggaaatcgccgagacccagcacgggactatcgtgattcgcgtgcagtacgagggcgacgggtctccttgcaagatccccttcgagatcatggacctcgagaagcggcacgtcctggggagactaatcaccgtgaacccgatcgttaccgagaaggacagccccgttaacatcgaggctgagccacccttcggcgactcctacatcatcatcggggtggagccgggacagttgaagttaaactggttcaagaaggggagcagcatcggccagatgtttgaaaccacgatgcgcggggccaagcggatggccatcttaggggacaccgcctgggacttcggcagcctcggcggcgtgttcacctccatcggtaaggccctacaccaggtcttcggcgcgatctacggggccgcgtttagcggggtttcctggaccatgaagatcttaatcggcgtgatcatcacgtggattgggatgaactcgcgctctaccagcttgagtgtcagcctcgtgctggtgggcgtcgtgaccctctacctcggcgtgatggtccaggctgattccggctgcgtggtaagctggaagaacaaggagctgaagtgcggctccggaatcttcattaccgataatgtacacacctggaccgagcaatataagttccagcccgagagcccctcgaagctggcgtccgccatccagaaagcccacgaagagggcatctgtggcatccgcagtgtgacaaggctcgagaacctgatgtggaagcaaatcaccccagaactgaaccacatcctctccgagaacgaagtgaagctgacgatcatgaccggagacatcaaggggattatgcaggccggcaagcggagcttacggccgcagcccactgagctcaagtactcatggaagacttggggtaaggccaagatgctgagcacggagtcccataaccagaccttcttgattgacgggccggagaccgcggagtgcccgaacacaaacagggcctggaacagcctcgaagtcgaggactacggcttcggggtgttctccacaaacatctggctgaagcttcgcgagaagcaggacgtgttctgtgatagcaaactcatgtccgccgccatcaaggacaacagagccgtccacgcggacatgggctattggatagagagcgccctgaacgacacgtggaagatggagaaggcttccttcatcgaaatcaagagctgtcactggcccaaatcccacaccctgtggagcaacggcgtgctcgagtctgaaatgataatccccaagaactttgcagggcccgtgagccagcacaactaccggccgggttaccacacccagaccgccgggccctggcacctgggcaagttagagatggacttcgacttttgcgaggggacgaccgtagtggtgacggaggactgcggcaaccgtggcccatctttacgcaccacgaccgcgtctgggaaactgatcaccgagtggtgctgccggagctgcaccctccccccgctccgctacagaggcgaggacggctgctggtacggcatggagatccgccccctgaaggagaaggaggagaacctggtcaactcgctcgtgacggccgggcacggccaaatcgacaacttctcgctcggagtcctggggatggcgctcttcttagaagagatgctgaggacccgtgttggtaccaagcatgccatcttactggtggcggtgtccttcgtaaccctgatcacaggcaacatgagcttccgggacctcggccgcgtgatggtgatggtcggggcaacgatgaccgatgacatcggcatgggcgtgacctacctagcactcctagccgccttcaaggtccgccccacgttcgcggcagggctgctgttacggaagttaacctccaaggagctgatgatggccaccatcggcatcgccctcctgagccagtccaccattcctgaaaccatcctcgagctcacagacgccctggcgctggggatgatggtcctcaagatcgtgcgcaacatggaaaagtaccagctggccgtgaccattatggccatcagctgcgtccctaatgccgtgatcctgcagaacgcctggaaagtgtcctgtaccattcttgctgccgtctcggtgagcccgcttctgctcacgagctcccagcagaaggccgactggatcccacttgccctgaccatcaaggggctcaaccccaccgcgatcttcctgaccacgctgagtcggacctccaagaagcgcagctggcccctcaacgaggccgttatggcagtcggcatggtctccatcctggcctccagcttgctcaagaacgacatcccaatgaccgggcccctggttgctggcgggctcctcaccgtgtgctatgtgctgacgggccggtccgcggacctggagctcgagcgcgccgccgacgtcaagtgggaggaccaggccgagatcagcgggagtagccccatccttagcataacgatcagcgaggacggaagcatgtccatcaagaacgaggaggaggagcatacgctaacgatcctcatccggaccggcctactggtgatctctggagtgttcccagtgtcgataccgatcaccgccgcggcctggtatctctgggaggtgaagaaacagcgcgcaggcgttctgtgggacgtcccctcaccgccgcccgtggggaaagccgagctggaggatggcgcgtaccggatcaagcagcgcggtattttcggctacagccagatcggcgcgggcgtgtataaggagggcaccttccacaccatgtggcacgtgacccgcggagccgtcctcatgcatcgcggcaagaggatcgagccgtcctgggctgacgtgaagaaggacctcatcagctacgggggcggatggaaactggaaggagagtggaaggagggcgaggaggtccaggttctcgcccttgagcccgggaagaatccccgcgccgttcagacaaagcccggcctgttcaagaccaacaccgggaccatcggcgcggtctccctcgacttcagccccggcacctcggggagccccatcgtcgatcgtaagggcaaggtcgttgggctgtacggcaacggcgtggtgacacgctctggagcatacgtcagcgccatcgcccagacggagaaatccatcgaggacaaccctgaaatcgaggacgacatcttccggaagaagcgcctgaccatcatggacctgcaccccggagccggtaagacgaagcggtacctgcccgccatcgtgcgtgaggccatcaagcgggggctgcgcaccctgatcctggccccgacccgtgttgtagccgctgagatggaggaggcccttagaggcctgcccatccgctaccagactcccgccatcagggccgagcacacgggacgcgagatcgtggacttaatgtgtcacgccaccttcaccatgcgcctgctgagcccagtgcgcgtcccgaactacaatctcataatcatggacgaggcccacttcaccgaccccgccagcatcgccgcccggggctacatctccacgcgcgtggaaatgggggaggccgcaggcatttttatgaccgccaccccgccggggagccgggatccgttcccgcaatccaacgcccccatcatggacgaggagcgcgagatccccgaacggagctggaactccggccacgagtgggttaccgacttcaagggcaagacggtatggttcgtgccgtctatcaaggccggcaacgacatcgcggcctgtcttcggaagaatggcaagaaggtgatccagctgtcccggaagacattcgacagcgagtacgtcaagacacgcgccaacgattgggacttcgtagtaaccaccgacatctccgagatgggtgcgaacttccgggccgagcgcgtcatcgatccgcggcgctgcatgaagcccgttatcctcaccgatggtgaggagcgggtcatactggcggggcccatgccggtgacccacagctccgccgcccaacgccgcggtcggatcgggcgcaatcccaagaacgagaacgatcagtacatctacatgggcgagcccctggagaacgacgaggactgtgctcactggaaggaggcaaagatgctcctggacaacatcaatacgcccgagggcatcatcccttcaatgttcgaaccggaacgggagaaggtcgacgcgatcgatggggagtaccgcctgcggggcgaggcccgaaagacgttcgtggacctcatgcggcgcggggatctgcccgtctggctggcctaccgggtagccgctgagggcatcaattacgcggaccgacggtggtgcttcgacgggatcaagaacaaccagatcttagaagagaacgtggaagtcgagatttggacgaaggagggcgaacgcaagaagcttaagccgcggtggctggacgcccgcatatactccgacccgctcgccctcaaggagttcaaggagtttgccgccggccggaaatccctgactctcaaccttatcaccgagatgggacgcctacccacgttcatgacgcaaaaggcccgtgacgccctcgacaacctggccgtcctgcacaccgctgaggttggcgggcgcgcatacaaccacgccctctccgagctacccgagaccctggagacgctcctgcttctcacactgctggctacagtaaccggcggtatcttcctgttcctgatgagcgggaagggcatcggaaaaatgactctggggatgtgctgcatcattaccgcttccatcctcctgtggtacgcccagatccagccgcactggatcgcggccagcataatcctagagttctttctgatcgttctgctgatccctgagcccgagaagcagcggactccacaggacaaccagctcacgtacgtggtgatcgccatcctgacggtggtcgccgctactatggcgaacgaaatggggttcctggagaagaccaagaaggacctcggcctgggctccatcaccacgcaggagtccgagagtaacattctagacatcgaccttcgcccggcctcggcttggacgctgtatgccgttgctaccaccttcgtgacccccatgctgcggcactccatcgagaattccagcgtcaatgttagcctcacggcgattgccaaccaggccaccgtcctgatgggactgggccgcgggtggcctctcagcaaaatggacattggcgtcccccttttggcaatcgggtgctattcccaggtgaatccgatcaccctcactgccgccctcctgttgcttgtggcccactacgccattataggccccggcctgcaagcgaaggcgacgcgcgaggcccagaaaagaaccgccgccggtattatgaagaaccccaccgtcgacggcattacggtgatcgacctcgagcccatcccctacgatcccaagttcgagaagcagttgggccaggtgatgctgcttgtcttgtgcgttacccaggtgctgatgatgcggacaacgtgggcattgtgcgaggcactgaccctggccacggggcccatcagcactctctgggaggggaaccctggccggttctggaataccacgatcgccgtttccatggctaacatcttccgcggcagctacctggccggggcaggcctcctcttctccattatgaagaacacgactaacacccggcgcgggaccggcaacatcggcgaaaccctgggggaaaagtggaagtcccgactgaacgccctcggcaagtccgaattccagatctacaagaaatccggcatccaggaggtagaccggaccctggccaaagaggggattaagcgcggggagaccgaccaccatgccgtgtcccgtggctcagcaaagctgcggtggttcgtcgaacgcaacatggttacccccgagggcaaggtggtcgatttggggtgcggccgcggcgggtggtcgtactactgtggcgggctgaagaacgtgcgcgaggtgaaggggctgacgaagggggggcctgggcacgaagagcccatccccatgtcaacctacggctggaacctcgtccggctgcaaagcggggtggacgtgttctttactccgcccgagaagtgcgacacgcttctatgcgacatcggcgaatcctcccccaatcctacgatcgaggccggccgcaccctgcgggtcctgaatctcgtggagaactggctgaacaacaacacccagttctgcatcaaggtgctgaacccgtacatgccctccgtcatcgagaagatggagaccctccagcgcaagtacgggggagccctggtacggaatcccctgagccgcaactccacccatgaaatgtactgggtgtcgaacgccacggggaacatcgtatccagcgtaaacatgatttctcgcatgcttatcaaccggttcaccatgaagcacaagaaggccacgtacgagccggacgtagacctcggctcgggaacccgcaacatcggcatcgagaatgagatccccaacttagacatcatcggcaagcggatcgagaagatcaagcaagagcacgagacgtcgtggcactatgatcaggaccacccctacaagacctgggcttaccacggatcgtacgagaccaagcagaccgggtccgccagctccatggtcaacggggtagtgaagctgctcaccaagccctgggatgtggtgccgatggtgacccagatggccatgaccgacaccacgccctttggccagcagcgagtcttcaaggagaaagtggacacacggacacaagagccgaaggaaggcaccaagaagctcatgcgcatcacggccgaatggctgtggaaggagctcgggaagaaaaagacgcccagaatgtgtacccgcgaggagttcacgcggaaggtgcgctccaacgccgcgctgggcgccatcttcacggacgagaacaagtggaagtccgcccgggaggccgtcgaggacagcaggttctgggagctggtggaccgtgagagaaacctccacctggaggggaagtgcgagacctgcgtctacaacatgatgggcaagagagagaagaagctgggggaattcggtaaggccaagggctctcgcgcgatctggtacatgtggctcggtgcccggttcctggagtttgaggctctgggcttcctcaacgaggaccactggttcagccgcgggaactccctgtccggcgtggagggcgagggcctccacaaactcgggtacatccttcgggacgtgagcaagaaggagggcggggccatgtacgcggacgacaccgcagggtgggacacccgaattacgctggaggacctgaagaacgaggaaatggttaccaaccacatgaagggcgagcacaagaagctggcagaggccatcttcaaactcacctatcaaaacaaggtggtgcgggtccagcgcccaacgccccgggggaccgtgatggacataatctctcggaaggaccagcgcggctcaggccaagtgggtacctacggcctcaacaccttcaccaatatggaagcccaattaatcagacagatggagggggagggcatcttcaagtccatccagagactgaccgtgaccgaggagatcgcggtgcaaaactggctcgcccgggtggggcgcgagcggctgtcacgcatggccatctccggggacgactgcgtcgtgaagcccctggacgaccggttcgccagcgccctcaccgcgctgaacgacatgggcaaggtgcgcaaggatatacaacagtgggaaccatcgcgggggtggaacgactggacccaggtcccattctgtagccaccacttccacgaactggtgatgaaggatggtcgcgtgctagttgtgccctgccggaaccaggacgagctgatcgggcgagcccggatctcccagggcgccggctggagccttaaggagacagcctgcctcgggaagtcctacgcccagatgtggaccctgatgtacttccaccgcagagacctgcgcctcgcggccaacgccatctgctcagctgtcccctcccactgggttccaacctcccggacgacctggtccatccacgccaagcacgagtggatgacgaccgaggacatgctggcggtgtggaatcgcgtgtggatccaagagaatccgtggatggaggacaagacccccgtcgagagctgggaggaggtgccctacctcggcaagcgagaggaccagtggtgcgggagcctcatcggcctgacctcccgggccacgtgggccaagaacatccagacggccattaaccaggtgcgcagcctgatcgggaacgaggagtacaccgattacatgccctctatgaagcggtttagaaaggaggaggaggaggccggcgtgctgtggtga

SEQ ID NO: 25232 - RNA, 9876 nt, synthetic construct
  misc_feature 1..9876: note = derived and/or modified CDS sequence (opt11) from DENV-2__EU687230__SS-prME
  source 1..9876: mol_type = other RNA
actgccggggtaatcatcatgctgatccccaccgctatggcgttccatctaaccacccgtaacggggaaccccacatgatagtcggccggcaagaaaagggtaagtcgctgctgttcaagaccgaagacggcgtgaacatgtgcaccctcatggccatcgacctaggggaactgtgcgaggataccatcacctacaagtgccccctcctgcgccagaatgagccagaggacatagactgctggtgcaacagtacttcgacctgggtgacctacggaacatgtaccactacgggcgagcaccggcgggagaagcgttccgtcgccctggttccccacgtcgggatgggactcgagactaggaccgagacctggatgagcagcgagggtgcctggaagcacgtccagcggatcgagacctggatactgcgccacccgggctttaccatcatggctgcgatactggcctacaccatcgggaccacacactttcagcgggcactcatttttatcctgctgaccgccgtggcgcccagcatgaccatgcgctgcataggcatctcaaatcgtgacttcgtagaaggagtcagcggcggctcgtgggtcgatatcgtcctcgagcatggtagttgtgtcaccactatggccaagaacaaacccaccttagactttgagctgatcaagaccgaggccaagcagcccgctaccctccgcaagtactgtatcgaggccaaacttacgaataccaccactgagtcccggtgcccgactcagggagagcccagcctgaacgaggagcaggacaaacgcttcatctgcaagcactccatggtagaccggggatgggggaacgggtgcggcctgtttggcaaaggcgggattgtgacctgcgcaatgttcacgtgcaagaagaacatggagggcaaagtcgtgctgcccgagaatctggagtacacaatcgtgatcactccccatagcggggaggagcacgccgttggcaacgacactgggaagcatggcaaggagatcaagatcacaccccagtccagtatcactgaggccgagttaaccgggtatggtacggttaccatggagtgctccccgcggactggcttagacttcaatgagatggtcttattacaaatggaggataaagcctggctagtccaccggcagtggttccttgatttaccactaccctggttaccgggggccgacacacaaggcagcaactggatccaaaaggagactctcgtaaccttcaaaaacccccacgcgaagaagcaggatgtggtcgttctgggctcccaggagggcgccatgcatacggccctgaccggagctacggagatccagatgagctcgggaaacctcttattcaccggccatctgaaatgtcgcctccgaatggacaagctacagctgaaagggatgtcctattccatgtgcaccggcaaattcaagatcgtcaaagagatcgcggagacccagcacggcaccatcgtgatacgcgtgcaatacgagggcgacggctccccttgtaagatccccttcgagataatggacctcgagaagcgacacgtgttaggccgcctcatcaccgtgaatccgatcgttaccgagaaggacagccccgttaacatagaagcggaaccacccttcggcgacagctacatcataatcggggtggagcccggccagctcaaattgaactggttcaagaaggggagctccatcggccagatgtttgagaccacaatgcgaggcgccaaacggatggccatcctgggtgatactgcctgggactttggcagcctcggaggcgtgttcacaagtatcggcaaggccttacaccaggtattcggagctatatatggcgccgccttcagcggggtctcctggaccatgaaaatccttatcggcgtcatcatcacgtggatcgggatgaactcccggggcacctccctgtcagtgtccctcgttttggtgggagtcgttacgttgtatttgggcgttatggttcaggccgacagtgggtgcgtggtgtcctggaagaacaaggaacttaagtgcggatcaggcattttcatcacagataatgtccacacgtggacagagcagtacaagttccagcccgagagtcccagcaagctcgcctccgccatccagaaggcccatgaggagggtatctgtggcatccggtccgtaactcgcctcgaaaatctgatgtggaaacagatcaccccggagctgaatcacatcttgagcgagaacgaggtgaagctgaccatcatgaccggagacatcaaaggcatcatgcaagcgggcaagcggtcccttcgcccgcagccaaccgagctcaagtacagctggaagacctgggggaaagccaagatgctctctacggagagccacaaccagaccttcctgatcgacggccccgagacggctgaatgcccgaacacaaaccgggcctggaactccctcgaagtcgaggattacgggtttggcgtgttcagcacgaacatctggctgaaactgcgcgagaagcaggacgttttctgcgactccaagctcatgagcgccgccatcaaggataaccgagcggtccacgcggatatgggatattggatcgagtctgcattgaatgatacatggaagatggagaaggcgagcttcatcgagattaagtcctgccattggcccaagagccataccctctggtctaacggggtactcgaaagcgagatgatcatccctaagaacttcgcgggccccgtgtcccagcacaactatcgtccggggtaccacacccagaccgctggtccctggcatctgggcaagctcgagatggacttcgacttttgcgagggcacgacagtcgtggtaaccgaggactgcggcaaccggggtccctcactccgcaccactaccgcgtcaggcaagctgatcaccgagtggtgctgccggtcctgcaccctgccccctctacgatatcggggcgaggatggttgctggtacgggatggagatacgccccctgaaggagaaagaggagaacctggtcaactcgctcgtaaccgccgggcacggacagatcgacaacttctccttgggggtgctgggtatggccctattcctggaggagatgctgaggacgcgcgtcggtaccaaacacgccatcctcctagtagcggtgagcttcgtcacactgatcacgggcaacatgtccttccgggatctcgggcgcgtgatggttatggtcggcgccaccatgacggacgatatcggcatgggggtgacgtatttggctctgctagctgcgttcaaagtccgccctacattcgcggccggcctgctcctccggaagttgaccagcaaggagttgatgatggccacaatcggcatcgccctcctgagtcaaagcacgatccctgagaccatcctggagctcaccgatgccctggcactaggtatgatggtgctcaagattgtccggaacatggaaaagtaccagctggccgtgacgatcatggccatctcatgtgtcccgaacgccgtgatactgcaaaacgcttggaaggtgtcttgcacgatcctcgcggccgtctccgtatccccgctgctgctcacgtccagccagcaaaaggccgattggatcccccttgcccttaccatcaaggggctcaacccaaccgcgatcttcctgacaactctgagtcggaccagcaagaagcgcagctggccgctcaacgaggccgtcatggccgtggggatggtgagcatcctagcctcctccctgctcaagaacgacatccccatgaccggccccctggtggccgggggactgctgactgtgtgctacgtgctaactggtcggagcgcggatttagagttagagagggccgctgacgtgaagtgggaggaccaggccgagatctccggctcctccccaatcttaagcatcaccatctcggaagacggcagcatgtcaatcaagaacgaggaggaggagcacacgctgaccatcctcatccgcacagggttattggtgatcagcggtgtatttccggtcagtatccccataacggccgcggcatggtatctctgggaggtgaagaagcagcgcgcaggggtgctgtgggacgtccccagcccgcctcccgtagggaaggccgagcttgaagacggggcctatcggataaagcagaggggtatcttcgggtactcccagatcggagcgggcgtgtacaaggaggggaccttccacaccatgtggcacgtcacccggggtgccgtgctcatgcatcgtggcaagcgaatcgagccatcttgggccgatgtgaagaaggacttgatctcctatggcggcggctggaaacttgaaggcgagtggaaggagggggaggaggtccaggtgctcgccctggagcccggcaagaacccccgcgcggtccagacgaaacccgggctgttcaagaccaacacaggcaccataggcgcggttagcctggatttctccccggggacgagcggttcccccattgtagacagaaagggtaaggtagtcggcctgtacgggaacggggtcgtgacccgcagcggcgcctatgtttccgccatcgcccagacggagaagtccatcgaggacaatccagagatagaagacgacatattccggaaaaagcgccttaccatcatggacctccaccctggggccggcaaaacgaagcggtacctgcccgccatcgtgcgcgaggccataaagcgggggctacgcaccctgatcctcgccccgactcgcgtggtcgccgctgagatggaagaggctctgcgaggactgcccatccgctaccagacccctgccatccgggcagagcacactggccgcgagatcgtcgacctaatgtgccacgctacctttactatgcggctcctctccccagtgagagtgccgaactacaaccttatcatcatggacgaggcgcatttcacggacccggcctccatcgccgcccgggggtacatcagtacacgcgtggagatgggcgaggccgcggggattttcatgaccgccactccacccggctccagggacccgttcccccagagcaatgccccgattatggacgaggagagagagatacccgagcggtcctggaactctgggcacgagtgggttaccgactttaagggcaagactgtctggttcgtgccctccattaaggccggtaatgacatcgcggcctgtctacgcaaaaacggtaagaaggtgatccagctgagccgtaaaacctttgactccgagtatgtaaagaccagagccaacgactgggacttcgtggtgacaacggacatctctgaaatgggcgccaactttcgggccgagcgcgtcatcgaccccagaaggtgcatgaagccagtgatcctcaccgacggcgaggagcgggtgatcctggcgggacccatgccggtcacgcactccagtgccgcgcagaggcgcggtcggatcggtcgtaatcccaaaaacgagaatgaccagtatatctacatgggcgaacctctggaaaacgacgaggactgcgcacactggaaggaggcaaaaatgcttctggataacatcaacacccccgaaggaattattccgtccatgttcgagcccgagcgggaaaaagttgacgcgatcgacggcgaataccgcctgcgcggagaggccagaaagacgtttgtggatctcatgcggcgcggagacctgcccgtctggctggcctaccgggttgccgcagaggggattaactatgcggacaggcggtggtgcttcgacggcataaagaacaaccagatcttggaagagaacgtggaagtcgagatctggaccaaggagggcgagcggaagaagctgaagccccggtggctggacgccagaatctatagcgaccccctcgccctaaaggagttcaaggagttcgcagctggccgaaagtcacttaccttaaacttgatcaccgaaatgggccgattgcccacctttatgactcagaaggcccgggatgcactcgataacctagccgtgctgcacaccgccgaggtagggggccgcgcgtacaaccacgccctcagcgagctgcccgagactctggagacgcttctgttgctcacgctgctggccacagtaaccggcgggatcttcctcttcttgatgtccggcaagggtataggcaagatgacgttaggaatgtgctgcatcatcaccgcgagcatcttactatggtacgcacagatacagccgcattggatagcagcctcgataatcctggagttctttctcatcgtgctactgatccccgagcccgagaagcagcgcacgcctcaagataaccagctcacatacgtggtcatcgccatcctgaccgttgtcgccgccacgatggcgaacgagatgggatttctggaaaagaccaagaaggacctcggccttgggagcattacaacacaggagagcgagtccaacatactggacatcgacctccgcccggccagcgcctggacgctgtacgccgtagcaaccacttttgtgacccccatgctgcggcattcgatagagaacagcagtgtgaacgtgtcgttgacggcgatagccaaccaggccaccgtgctgatggggctaggacgcggatggcccctctcaaagatggatatcggtgtcccactgctggccataggctgctactcccaggtgaacccgatcaccctcaccgcagccctgttactattagtggctcactacgccatcatcggtcccggtctccaggcaaaggcgacgagggaggcccagaagcggaccgccgcagggattatgaagaatcccacagtcgatgggattaccgtgatcgacctcgaacccattccgtacgaccccaagttcgagaaacagcttggccaggtgatgctgctcgtcctgtgtgttacccaggtgctcatgatgcgcaccacctgggccttgtgtgaggcactgaccctggctacggggcccatttccaccctctgggagggcaaccccggtcggttctggaataccactattgcagtgagcatggccaacatcttcaggggttcatacctagccggtgccggtcttctcttcagcatcatgaagaacaccacgaacacccgtcgcggcacgggcaacatcggggagacgctgggcgagaagtggaagtccagattgaacgccctcggaaagtcggagttccagatctacaagaagtccggcatccaggaggtggataggaccttagccaaggaggggatcaaaaggggcgagactgaccatcacgccgtgagccgaggctcagcgaagctgcggtggttcgtagagcgcaatatggtaaccccggaggggaaagtggttgacttaggttgcgggaggggcgggtggagttactactgcggcggacttaagaacgtgcgagaggtgaaagggctgacgaagggcgggcccggccatgaggagcccatacccatgagcacctatggttggaacttagtccggttacaaagcggagtggatgtgttcttcactccgcctgagaagtgcgacacgctattgtgcgacatcggcgaaagttccccaaaccccacgatcgaggccgggcgcaccttacgggtgcttaacctcgtggagaactggctcaacaacaacacccaattctgcatcaaggtgctgaacccatacatgcccagcgtaatcgagaagatggaaaccttgcagaggaagtacggcggggccctggtgaggaaccccttatccagaaacagcacccacgagatgtactgggtctccaacgccacgggcaacatcgtcagctccgtgaacatgatcagcaggatgctgataaaccggttcaccatgaagcacaagaaggccacctacgagcccgacgtggacctcgggtcaggcacccgtaacatcggcatcgaaaacgagatccccaacctggatataattgggaagcggatcgagaagatcaagcaggagcacgagacgagctggcactacgaccaggaccatccctacaagacctgggcgtaccacggctcctacgagaccaagcagacggggagcgcctcaagcatggtcaacggcgtcgtgaaactgctcacaaagccctgggatgtcgtgccgatggtaacccagatggccatgaccgataccacgccgttcggccaacagcgcgtgttcaaagagaaagttgacacccggacccaggaacccaaggaggggaccaagaaacttatgagaattacggccgaatggttgtggaaagaactcggaaagaagaagactccccggatgtgcacccgcgaggagttcacccggaaggtccgcagcaacgccgcgctaggggccatcttcacggacgagaacaaatggaagtccgcccgggaggccgttgaagactcccgcttttgggagctagtagaccgggaacgcaacctccacttagagggtaaatgcgagacttgcgtctacaatatgatggggaagcgggagaagaagctgggcgagtttggcaaagccaaggggtctcgcgctatctggtacatgtggctcggcgcccggttcctggagttcgaggcactgggattcctcaacgaggaccactggttttcccgcggcaactctctcagcggggtcgagggcgagggacttcacaagctcgggtatatcctgcgagacgtctccaaaaaggaaggcggagccatgtacgcggacgacactgcgggctgggatacccgcatcacgcttgaggacctcaagaacgaggagatggtcaccaatcacatgaaaggcgaacataagaagctggcagaggccatcttcaagctgacctaccagaacaaggtggtgcgggttcaacgccctactcccaggggcacggtaatggacatcatctctaggaaggaccagcgcggctccggtcaggtgggaacctacgggctcaacacattcacaaatatggaggcccagctgatacggcagatggagggcgaaggcatattcaagagcatccagagactgacagtcaccgaagaaatcgcggtgcagaactggctcgcccgggtggggagggagcggctgtccagaatggccatcagcggcgacgattgcgtcgtgaagcctctggacgaccgattcgcctcagccctcaccgcgctgaacgacatggggaaggtccgcaaggacatccagcagtgggaaccctcacggggctggaacgactggacccaggtcccgttctgttcccatcactttcatgagctggtgatgaaggacgggcgcgttctcgtcgtgccttgccggaaccaagacgaactgataggccgcgcccgtatcagccagggggccggctggtccttaaaggagacggcgtgccttggcaaaagctacgcccagatgtggacgttgatgtacttccaccgccgggacctgaggctcgcggcaaacgccatctgctctgccgttccctcacactgggtccccaccagccggacgacctggtccattcacgccaagcacgagtggatgacgactgaagacatgctggccgtgtggaaccgagtttggatccaggaaaatccgtggatggaggataaaacccctgtggaaagctgggaagaggtgccttacctggggaagagagaagaccagtggtgcggtagccttatcgggctcacctctcgggccacgtgggccaagaacattcagactgcaatcaaccaggtgcgaagtctgatcgggaacgaagagtacaccgactatatgccctcaatgaagcggttccggaaagaggaggaggaggcgggagtcctctggtag

SEQ ID NO: 25233 - RNA, 9876 nt, synthetic construct
  misc_feature 1..9876: note = derived and/or modified CDS sequence (opt11) from DENV-2__EU687231__SS-prME
  source 1..9876: mol_type = other RNA
acggcaggagtgataattatgctgatacccaccgccatggcgttccacctcacgacgcgcaacggggaacctcacatgatcgttggccgccaagagaaaggaaaatcactgttattcaaaactgaggacggcgtgaacatgtgcactctaatggctatcgacttaggggagctatgcgaggataccatcacttataagtgtccactactgcggcagaatgagccggaagacatcgattgctggtgcaactctacttcaacgtgggtgacctacggaacctgcaccacaacgggggagcaccgtcgcgagaaacggtccgttgcacttgtgccccatgtggggatgggcttggagacccgcacagagacatggatgtcgagcgagggggcctggaaacacgttcaacgaatcgagacctggatcctgcgccaccccggctttacaatcatggccgcaatcttagcctacacgatcgggaccacgcacttccagcgggccctcatcttcatcctactgaccgcggtggcgccgtccatgaccatgcgatgcataggcatatctaatcgggacttcgtggagggagtttcagggggctcctgggtggatatcgtgcttgagcacgggtcttgtgtaaccacaatggccaaaaataagcccaccctggattttgagctgatcaagaccgaggcaaagcaacccgccaccctccgcaagtattgtatagaggccaagctgactaataccaccacagaatcgaggtgcccgacgcaaggcgagccctcacttaacgaggagcaggacaaacgcttcatctgcaagcattcaatggtcgacaggggctgggggaacggttgcggcctgtttggcaaaggagggatcgttacatgcgctatgttcacgtgtaagaagaacatggaggggaaggtcgtgctgcccgagaacctcgagtacactatagtgattacgccccacagcggggaggagcacgccgtcggcaacgacactgggaaacacggcaaggagattaagatcacaccccaatctagcattactgaagccgagctcaccgggtatggcacggtgaccatggagtgttcccccaggaccggccttgacttcaatgagatggtcctgcttcaaatggaggacaaggcatggctggtacaccggcagtggtttttggacttacccctgccttggctgcctggggcggacacacaaggcagcaattggattcagaaggaaacattagtgacctttaagaacccacacgccaagaaacaggacgtggtcgtcctcgggtcccaggaaggtgccatgcacaccgccctgaccggcgccactgagatccagatgtcaagtggaaatctcctgtttaccggtcacttaaagtgtcgcctccggatggacaaactccagctgaagggcatgtcctacagcatgtgcacgggaaaattcaagatcgtaaaggagatcgcggagacacagcacgggacaatcgtaatacgcgtgcagtacgagggggacggctccccctgcaagattcccttcgaaattatggacttagagaaacggcacgtcctgggtcgtctcattaccgtgaatccgatcgtgaccgagaaggactcgcccgtcaatattgaggcagagccgccattcggcgactcctatataatcatcggcgtggagccgggtcaactcaaactgaactggttcaagaaagggagcagtattgggcaaatgttcgagactacaatgcgcggagccaagcggatggcgatactgggcgacaccgcctgggatttcggtagcctaggcggggtgttcacgtccatcggtaaggccctgcatcaggtcttcggcgcgatatatggcgccgccttcagcggggtgtcctggaccatgaaaatcttgatcggggtgattatcacgtggatcgggatgaactctaggtccaccagcctgtccgtcagcctagtactggtgggcgtcgtgacattgtacctcggcgtgatggtccaggccgactccggctgtgtggtttcgtggaagaacaaagagctgaagtgcggctccggaatcttcatcaccgacaacgtccatacgtggaccgaacagtacaagttccagcccgaatctccctccaagctggcgtctgccatccagaaggcccacgaggagggcatatgcgggatacggagcgtaactcgccttgagaacttaatgtggaagcagataacccccgagctgaaccacatcttaagcgagaacgaggtgaagctgacaatcatgactggcgacatcaaggggatcatgcaggccggcaaacgatcactgcgcccgcagcccacagaactcaaatactcctggaagacctggggcaaggccaagatgttatcaacagagtcccacaatcagactttcctgatcgacgggcccgaaaccgcggagtgcccgaacacaaatagagcctggaacagcctagaagttgaggactacgggttcggggtattctccacgaacatctggttaaagctgcgcgagaagcaggacgttttctgcgacagcaaactgatgagcgctgccattaaggacaatcgggcagtacacgcggacatgggctactggatcgagagcgccctgaacgacacttggaagatggagaaggcttccttcattgagatcaagtcatgtcattggcccaagtcccacacgctctggtcgaacggggtgctcgagtccgagatgatcattcccaagaacttcgccggtcccgtaagccagcataactacaggccgggataccacacgcagacagccggcccttggcacctgggcaagctagagatggacttcgatttttgcgaggggacaacggtggtcgtgacggaggactgtggcaaccgcggtccatcgctccgcacaaccaccgcgtccgggaagctgatcaccgagtggtgctgtcgtagctgcaccctgcccccgctcagatacagaggggaagacgggtgctggtatggcatggagatacgcccactaaaggagaaggaggagaacctggtaaacagcctagtgacggctgggcatggtcagatcgacaactttagcctgggtgtgctggggatggccctcttcctagaggagatgcttcgaacacgcgtcggaaccaagcacgccatacttctggtcgcggtgtctttcgtcactttgattaccgggaatatgagcttccgggacttaggcagagtgatggtgatggtcggtgcaaccatgaccgacgatataggcatgggggtgacttacctagccttattagccgccttcaaggtgcgccccacgttcgcggctggtctgttgctccggaagttaacatccaaggaactgatgatggccaccattggtatcgccctcctgagccagagtacaattcccgaaacaatcctcgagctcacagacgcactcgcacttgggatgatggtcttgaagatcgtccgcaacatggagaagtaccagctcgccgtgaccatcatggccatcagctgcgtccccaatgccgtgatcctgcagaacgcctggaaggtgtcctgtaccatactcgcggcagtgagcgtgtctcctttactgcttacctcatcgcagcagaaggccgactggatcccactagccctgacaattaaggggctcaaccccactgcgatcttcttaacaactctatctcggacgtcgaaaaagcgcagctggcctctaaacgaggccgtaatggccgtgggcatggtgtctatactggcctcaagcctgctcaagaacgacatccccatgactgggcccctggtggccggtgggctcctcaccgtgtgctacgtgctgacgggccggagtgcggatctggagctagagcgcgctgccgatgttaaatgggaggaccaggctgagatatcagggtcctccccgatcttatccataacaatcagcgaggacggctccatgagcatcaaaaacgaggaggaggaacacaccttaaccatcctcatccggaccggcttgctggtgatctccggggtattcccggtcagcatcccgatcaccgccgcggcctggtacttgtgggaagtgaagaaacagagggccggcgtgctatgggacgttcccagccctccgcccgtggggaaagcagagctggaggacggggcataccggatcaaacagcgcgggatattcggctactctcagatcggcgctggggtatacaaggagggtaccttccacaccatgtggcacgtcactcgcggcgcagtcctcatgcatcgcgggaagcggattgagccatcatgggccgatgtaaagaaggacctgatcagctacgggggcggctggaagctcgagggggaatggaaggagggagaagaggtgcaggtccttgccctggaacccgggaagaatccccgggccgtgcagacgaaacccggcctgttcaagaccaacacaggtaccatcggagcggtctccctagacttcagccccggcacgtccggcagcccgatcgtggaccggaaggggaaggtggttgggctgtacggcaacggggtggttacccgtagtggtgcctatgtctctgccatcgctcaaaccgaaaagtccatagaggacaatccggagatcgaagatgacatcttccgaaagaaacgcctgacaataatggacctccaccccggcgctgggaaaacgaaaaggtaccttccagccatcgtgcgcgaagcaataaaacggggcctgcgtacactcatcctcgcacccacccgggtggtcgcagcggagatggaggaggcactccgggggctgccgattcgttatcaaacccccgccatccgggcagagcacacggggagggaaatcgtcgacctcatgtgtcacgcaacattcaccatgcggctactgtccccagtacgcgtcccaaactacaacctcatcatcatggacgaggcgcactttacggatcccgccagcatcgccgcccgggggtatatctcgacgcgcgtggaaatgggggaagccgctggaatattcatgaccgccacgccgcccggaagccgggaccctttcccccaatccaatgcaccgatcatggacgaggagcgcgagatccctgagcgcagctggaacagcgggcacgagtgggttacagactttaaggggaagacggtgtggttcgtgccatcgatcaaggccggcaatgatatcgctgcctgcctgaggaagaacggtaaaaaggtgatccagctgtcccgaaaaacctttgacagcgaatacgtgaagacacgagcgaacgactgggacttcgtggtgaccacggacatcagtgaaatgggggcgaacttccgagccgaaagagtcatcgacccccggcgctgcatgaagcccgtcatcctcaccgacggggaggagcgggtgatcctggcgggacccatgccggtcacccactcatccgcagcccagaggcgcggccgaatcgggcgaaatccaaagaacgagaacgatcagtacatttacatgggcgagcccctcgagaatgatgaggattgcgcccactggaaggaggcaaagatgttgctggacaatatcaacacccccgagggcatcatccctagcatgttcgagcccgagcgagagaaggttgacgctatcgatggagagtaccgcttaagaggggaagcccgcaagacatttgtggaccttatgaggcgcggcgacctgcccgtttggttagcttatagggtggcagcagaaggcattaactacgccgataggcggtggtgctttgacgggatcaaaaacaaccagatactggaggagaacgtggaagtcgagatctggaccaaggaaggagagcggaagaagttgaagccaagatggctcgatgcccgcatctattctgaccccctcgcactgaaggagttcaaggaatttgcagcgggccggaagtcgctgaccctaaacctgatcaccgagatggggcgcctgcccacgttcatgactcagaaggccagagacgcactcgataacctggccgtcctacataccgcggaggtcggcgggcgggcctacaatcacgcactctccgagctacccgaaactcttgagacgctattactgctcaccctgctcgcgacggtgaccggcggcatatttctattcctgatgagcgggaagggcatcggcaagatgacgttgggcatgtgctgtatcatcaccgcctccatcttactttggtatgcccagatccagccacactggatcgcggcgagcatcattctggagttcttcctcatcgtgctgctgatccccgagcccgaaaagcagcgaactccgcaagacaaccagctcacctacgtcgtcatcgccatcctgaccgtggtcgccgccacaatggctaatgaaatggggtttctggagaagaccaagaaggatctcggattggggagcatcacgacgcaggagtccgagagcaatatactcgacatcgacctccgcccggcatccgcctggaccctgtacgcggtcgccaccacctttgtgaccccaatgctacgacatagtatagagaactcgagcgtaaatgtgtccctcacagcaatagctaaccaggcaactgtgctgatggggctgggacgcggttggcccctcagcaagatggacatcggcgtcccgctactggccatcgggtgctactcccaggtgaacccgataaccttaaccgcagctctgttgctcctggttgcccactatgccatcatcggtccgggcctgcaggctaaggcgacgcgcgaggcccaaaagcggaccgccgccgggatcatgaagaatccgaccgtcgatggcattaccgttatcgacctcgaacctatcccgtacgaccccaaattcgagaagcaactgggacaggttatgctactcgtcctgtgcgtaacccaagtgttaatgatgcgcacgacatgggccctatgtgaggctctaacattagcaacgggccccatctctaccctctgggaggggaaccctgggaggttctggaacacgacgatcgcagtctccatggccaatatcttcaggggcagctacctcgccggggcgggcctcctattctcgatcatgaagaatacgaccaataccaggagggggaccggcaacatcggtgagacgctcggggaaaagtggaagtctcggcttaatgccttaggcaagtccgagttccagatatataagaagagtggaatacaagaggtggatagaacactggccaaagagggcatcaagcgcggtgagacggaccaccatgcggtctccaggggttcagcgaagctgcgatggttcgtggagcggaacatggtgacccctgagggcaaagtagtagatctcggttgcggccgcggcgggtggtcctactactgtggcgggttgaagaacgtgcgcgaggtgaaaggactgacgaagggcgggcccgggcacgaggagcccatccccatgagcacctacggctggaaccttgtccggctgcagagcggggtggacgtgttctttaccccgcctgaaaaatgcgacaccttgctctgcgacataggcgagagtagcccgaacccgacgatagaggcgggacgcaccctgcgggtcttaaatttagtggaaaactggctaaacaacaacacacagttctgcatcaaagtgcttaacccctacatgccctcggtgatcgagaagatggagactctccagcgtaaatacggtggcgccttagtgcggaaccctcttagccgcaatagtactcatgagatgtactgggttagcaacgcaacgggtaatatcgtctccagcgtgaacatgatctctcgtatgttaattaacaggttcaccatgaagcacaagaaggccacctacgagccggacgtcgatctcggcagcgggacacgaaacatcgggattgagaacgaaatccccaatctggacatcatagggaagcggatcgagaatataaaacaagagcacgagacgtcatggcactacgaccaggaccacccctacaaaacttgggcgtaccacgggagctatgagaccaagcagacaggctccgcctcgagtatggtcaacggggtcgtaaagctgctaacgaagccctgggacgtcgtgccgatggtgacccagatggccatgaccgatactacacccttcggccagcaacgcgttttcaaggagaaggttgacaccagaacccaggagcctaaggaggggaccaagaagctcatgcgcatcactgccgagtggctgtggaaggaactgggcaagaagaaaacgccgcggatgtgtactagagaggagttcaccagaaaggtgcgctccaacgccgcgttgggcgcaatctttacggatgagaacaagtggaagtctgcacgggaagcggtcgaggattcacgcttctgggagctggtggaccgagaacgcaacctccacttagaagggaagtgcgagacctgtgtctacaacatgatgggcaagcgggagaagaagctgggggagttcggcaaggccaagggaagcagggcgatatggtatatgtggctcggggctcggttcctggagttcgaagctctcgggttcctcaacgaagatcactggttctcacgcgggaactctctgtccggcgtggagggggagggcctacataaactcgggtacatattaagagatgtatcaaagaaggagggcggagccatgtatgcggatgacactgccggatgggacacgagaatcacgctggaagacctcaagaacgaggagatggtcacgaatcacatgaagggtgagcacaagaagctggccgaagcgattttcaagctgacctatcagaacaaggtcgtcagagtccagcgccctacgccccgtgggacggtgatggacatcatctcccggaaagaccagcgtggctcaggccaggtgggaacctacgggctcaacactttcacaaacatggaagcccaactcatacggcaaatggaaggggagggcatcttcaagtctatacagagactgacggtgaccgaagaaatcgcggtgcagaactggctcgcccgggtgggccgagaacggctgagcaggatggccatctccggggatgactgcgtcgtcaaacctctggacgacagattcgccagcgcgctcaccgcgctcaacgacatgggcaaggtccgcaaggatatccaacaatgggagccctcacgcgggtggaacgattggacccaagttccgttttgcagccatcacttccacgagctggtgatgaaggacgggcgcgtgttagtcgtgccctgtcggaaccaggacgagttgattggccgcgcccgtatctcccagggcgccggctggtcactgaaggaaacagcctgtctcgggaagtcatacgcccagatgtggacgctgatgtattttcatcgccgggacctgcggcttgctgcgaatgccatctgctctgccgtaccctcccactgggtccccaccagccggaccacctggagtatccacgcgaagcacgaatggatgacgacggaggacatgctggcggtgtggaaccgcgtgtggatccaggaaaacccgtggatggaggacaagaccccagtcgagagctgggaggaggtgccctacctgggaaagagagaggatcagtggtgcggtagcctaatcgggctgacctcccgggccacatgggccaagaacatccagaccgccatcaaccaggtaagaagcctgatcgggaacgaggagtacaccgactacatgccctccatgaagcggttccgcaaagaggaggaagaggcgggcgtcctgtggtga

SEQ ID NO: 25234 - RNA, 9876 nt, synthetic construct
  misc_feature 1..9876: note = derived and/or modified CDS sequence (opt11) from DENV-2__EU687199__SS-prME
  source 1..9876: mol_type = other RNA
accgccggggtgatcatcatgctgatacccaccgccatggcgttccaccttaccacccggaacggggagccacacatgattgtcggccggcaggagaaggggaagtcccttctgttcaagactgaggacggagtcaacatgtgcaccctcatggctatcgacctgggggagctctgtgaagacaccattacctacaaatgccccctcctgagacagaacgagcccgaggacatcgactgctggtgcaacagtaccagcacctgggtgacctacgggacgtgtaccaccacgggcgagcaccggcgcgagaagcggtccgtcgcccttgtgccccacgtgggtatgggtctcgagacccggaccgagacgtggatgagctcagagggggcctggaagcacgtccagcggatcgagacctggatactgcgccacccgggcttcaccatcatggccgcgatcctagcatacaccatagggaccacgcacttccagcgggccctgatcttcattctgctgaccgccgtggcgcccagcatgaccatgcgctgcatcggcatctccaaccgggacttcgtggagggcgtcagcgggggctcctgggtggatattgtgctcgaacacgggagctgcgttaccacgatggccaagaacaagcccacactggacttcgagctgatcaagaccgaagccaagcagcccgcaaccctccgcaagtactgcatagaggccaagctgacgaacaccaccactgagtcccggtgcccgacgcagggcgagccctcgctgaacgaggagcaggacaagcgcttcatctgcaagcactccatggtggaccggggctgggggaacggctgcggcctgttcggcaagggcgggatagtgacctgcgcgatgttcacgtgcaagaagaatatggagggcaaggtcgtgctgcccgagaacttagagtacaccatcgtgatcaccccacacagcggggaggaacacgccgtcggcaacgacaccgggaagcatggtaaggagatcaagattaccccgcagtccagcatcaccgaggccgagctcaccgggtacggcacggtgaccatggagtgcagcccccggactggcctggacttcaacgagatggtgctgctccagatggaggataaggcctggctggttcaccggcaatggttcctggacctcccgctgccatggctgccgggggccgacactcagggctcgaactggatccagaaggagacgctcgtgacctttaagaaccctcacgcgaagaagcaggacgtcgtcgtgctggggtcccaggagggggccatgcacaccgccctgaccggggccacggagatccagatgagcagcgggaacctcctgttcaccggccatctgaagtgccgcctccggatggacaagctgcagctgaaggggatgtcgtacagtatgtgcaccggcaagttcaagatcgtcaaggagatcgccgagacccagcatgggacgatcgtgatccgcgtacagtacgagggcgacggctccccctgcaagatccccttcgagatgatggacctcgagaagcggcacgtgttggggcgcctgatcaccgttaacccgatcgttaccgagaaggacagtcccgtgaacatcgaggcagagccgcctttcggcgactcctacatcatcatcggggtggagcccggccagttgaagttgaactggttcaagaaggggtcctccatcggtcaaatgttcgagactacgatgcgcggtgcaaagcgtatggccatacttggggacaccgcatgggacttcggcagcctcggtggagtgttcacctccatcgggaaggccctgcaccaggtctttggcgcgatctacggcgcagccttcagcggggtgtcgtggaccatgaagatcctgatcggcgtgatcatcacgtggatcgggatgaacagccgatccaccagcctgtccgtcagcctcgtgctggtgggcgtcgtgaccctctacctcggggtgatggtccaggccgacaccggctgcgtggtgtcgtggaaaaacaaggagctgaagtgcggcagcgggattttcatcacggacaacgtccacacctggaccgagcagtacaagtttcaacctgagtccccctctaagctggcaagcgccatccagaaggcgcacgaagaggggatctgtgggatccggtccgtaacccgactcgaaaacctgatgtggaagcagatcacacccgagttgaatcacatactgagcgagaacgaagtgaagttaaccatcatgaccggcgacatcaagggcatcatgcaggccggaaaacggtccttgcgcccccagcccaccgagctcaagtacagctggaagacctggggtaaggccaagatgctgtccaccgagagccacaaccagaccttcctgatcgacggccccgaaaccgctgaatgcccgaacacgaaccgggcctggaactctctcgaggtcgaggactacggcttcggggtgttcagcaccaacatctggctgaagctgcgcgagaagcaagacgtgttctgcgattccaagctcatgagcgccgccatcaaagacaatcgggccgtccacgcggacatgggatactggatcgagtccgccctgaacgacacctggaagatggaaaaagctagcttcatcgagatcaagtcctgccactggcccaaaagtcacaccctgtggtccaacggcgtgctcgagagcgagatgatcatccccaagaatttcgccggacccgtatcacagcataactaccgcccgggctaccacacccagacggccggaccctggcacctgggcaagctcgagatggatttcgacttctgcgaggggaccactgtagtggtgaccgaggactgcggcaaccggggacccagcctccgcacgacgaccgcgagcggtaagctgatcaccgagtggtgctgccggtcctgcacgctgcccccgctccgctaccggggcgaagacggttgctggtacggcatggagatccgccccctgaaggaaaaggaggagaacctagtcaactctctcgttaccgccgggcacggccagatcgacaacttctccctgggtgtgctgggtatggccctcttccttgaggagatgctgcgtacacgcgtcggcactaagcacgccatcctcctggttgcggtgagctttgtcacgctgatcacagggaacatgtcgttccgggacctgggccgcgtgatggtgatggtcggcgccaccatgaccgacgacatcggcatgggagtgacgtacctggctctgctcgccgccttcaaggtgaggcccaccttcgcggccggacttctgctgcggaagctgactagcaaggagctgatgatggccaccatcggcatcgccctcctgtcccaaagcacgatccccgaaaccatcctggagctcaccgacgctctggcgctggggatgatggtcctcaagatcgtccgtaacatggagaagtaccagctggccgtgaccatcatggccatcagttgtgtccccaatgcagtgatcctgcagaacgcttggaaggtgagctgcacaatcctcgcggctgtgtcggtgagccccctgctgctcacctccagccagcagaaggcagactggatccccctcgcactgacgatcaagggcctcaaccccaccgctatctttctgacaaccctgtcccggacgagcaagaaacgctcctggccgctgaacgaggccgtcatggccgtgggcatggtaagcatcctggcctccagcctgctcaagaacgacatccccatgaccgggccgctggtcgcaggcggactgctcacggtgtgctacgtcctgacaggccgcagcgcggacctggagctggagcgcgccgccgatgtcaagtgggaggatcaggccgagatctcagggtcgtccccgatcctgagcatcaccatctccgaggacggcagcatgtccatcaagaacgaggaggaggagcatacgctgacgatcctcatccggaccggactactggtgataagcggggtgttccccgtctccatcccgataaccgccgcggcctggtacctctgggaggtgaagaagcagcgcgccggcgtgctgtgggacgtccccagcccaccgcccgtggggaaggcggagctggaggacggcgcttatcgtatcaaacagcgagggatcttcggctactcccagatcggcgccggtgtgtacaaggagggcaccttccacaccatgtggcatgtcacgcgcggggccgtgctcatgcaccgcggcaagcggatcgagcccagctgggccgacgtgaagaaggacctaatcagctacgggggcggttggaagctggagggggagtggaaagagggcgaggaggtccaggtgctcgccctggagccagggaagaacccccgtgcggtacagaccaagccgggccttttcaagaccaataccggaacgatcggcgcggtcagcctcgacttctcccccggaaccagcgggtcccccatcgtggaccggaagggcaaggttgtcgggctgtacggcaacggcgtggtgacccgctctggggcctacgtgtccgctatcgcccagactgagaagtccatcgaggacaaccccgagatcgaggacgacatcttccggaagaagcgcttgacgatcatggacctccacccgggggcggggaaaacgaaacggtacctgcccgccatcgtgcgcgaggccatcaagcggggcctgcgcaccctaatcctcgcaccgacccgagtggtcgccgcggagatggaggaagccctgcgggggctgcccatccgctaccaaacgcccgccatccgggccgagcacaccggccgcgagatcgtagacctcatgtgtcatgccaccttcaccatgcggctgttaagccccgtgcgcgtgccgaactacaacctcatcatcatggacgaggctcacttcacggaccccgcctccatcgccgcccggggctacataagcaccagagtggagatgggggaggccgcgggcatcttcatgaccgcaaccccgcccgggtcccgggatcccttcccccagtctaacgcccccattatggacgaggagcgcgagatccccgagcggtcctggaatagcggccacgagtgggtgacggacttcaaggggaagaccgtctggttcgtgccgtcaatcaaggccggcaacgacatcgcggcctgccttcgcaagaacggcaagaaagtgatccagctgagccggaagaccttcgactctgagtacgtcaagacccgcgccaatgactgggattttgtggtgacgaccgacatcagcgagatgggggccaacttccgggccgagcgcgtcatcgaccccagacggtgcatgaagcccgtgatcctcaccgacggagaggagcgcgtgatcctggcggggccaatgccggtcacccactcctcggccgcccagcgccgcggcaggatcgggcgcaacccaaagaacgagaatgaccagtacatctatatgggcgagcccctggaaaacgacgaggattgcgcccactggaaggaggccaagatgctcctggacaacatcaacacgccagagggcattatcccgtccatgtttgagcccgagagggagaaggttgacgcaattgacggagagtatcgcctgcggggcgaagcgcgcaagaccttcgtggacctcatgcggcgcggggacctgcccgtgtggctggcttaccgggtggccgcagagggcattaactatgcggaccgccggtggtgtttcgatgggattaaaaacaaccagatcctcgaagagaacgtggaggtcgaaatttggaccaaggagggggagcgcaagaaactgaagccgcggtggctggacgcccgcatctacagcgacccgttagccctgaaagagttcaaggagttcgccgcgggtcggaagtccctgaccctcaacttaatcacggagatggggcgactcccaaccttcatgacccagaaggccagagacgccctcgacaacttggccgtgctccacaccgcagaggtcggcgggcgagcatacaaccacgccctatcagagctgcccgagactctggagaccctcctgctgttgaccctgctggccaccgtgactggcggcatcttccttttccttatgtccgggaaaggcatcgggaagatgaccctgggcatgtgttgtataatcaccgccagcatcctactgtggtacgcccagatacaaccgcactggatcgcggcctccattatcctggagttcttcttgatcgtgctattaatccccgagcccgaaaagcagcggacgcctcaggacaaccagttgacctacgtcgtgatcgccatactgactgtggtcgccgctacgatggcgaacgagatggggttcctggagaagacaaagaaggatctcggcctgggaagcatcaccacgcaggagagcgagtccaacatcctggacatcgacctccgcccggccagcgcctggaccttgtatgccgtggccactaccttcgtgacgcccatgctacgccactccatcgagaacagctccgtcaacgtgtcactcaccgcgatcgccaaccaggccaccgtgctgatggggctgggccgcgggtggcccttatccaagatggacatcggcgtacccctgctggccatcggttgctacagccaggtgaaccccataaccctaacggcggccctgctgttgctggtggcccattatgccatcattggcccgggcctccaggccaaggcaacccgcgaagcccaaaagagaaccgccgccgggatcatgaagaaccccaccgtcgacggcatcacggtgatcgacctcgagcccatcccttatgaccccaagttcgagaagcagctgggccaggtgatgctgctcgtcctgtgtgtaactcaggtgctgatgatgcgcaccacctgggccctctgcgaggcgctgactctagctaccgggcccatttccaccctctgggagggcaaccccggccggttttggaataccacgatcgcggtcagcatggccaacatcttccgcggctcctacctggccggggcgggcttgctcttcagtatcatgaagaacaccacaaacaccagacgtgggacgggaaacatcggggagaccctgggtgagaagtggaaatcccggcttaacgccctcggcaagagcgagttccagatctacaagaagtccgggatccaggaggtggaccgcaccctggccaaggaaggcatcaagcgcggggagacggaccaccacgccgtatcgcgcggctccgcgaagctgcgttggtttgtagagaggaacatggtaactccggagggcaaggtcgtcgacctcgggtgcggccgcggagggtggtcctactattgcggcgggttaaagaatgtgcgcgaggtgaaggggctgaccaagggcggccccgggcacgaggagccaatccccatgtccacctacggttggaacctcgtccggctgcaatcgggggtggacgtgttctttacaccgcctgagaagtgcgacacgctgctctgcgacatcggagagagctcccccaaccccaccatcgaagcgggccgcaccttgcgggtgctgaacctcgtggaaaactggctgaacaacaacacccagttctgcgtcaaggtcctgaacccttatatgcctagcgtgatcgagaagatggagaccctccaacgcaagtacgggggcgctctggtccggaatcccctgtcacgcaacagcacgcacgagatgtactgggtctccaacgccaccgggaacattgtgagctccgtgaacatgatcagccgcatgctaatcaaccggtttaccatgaagcacaagaaggccacctacgagccggacgtcgatctcggctccgggacgcgcaatatcggcatagagaacgagatccccaacctggacatcatcggtaagcggatcgagaagatcaagcaggaacacgagaccagttggcactacgatcaggaccacccctacaagacctgggcgtaccacgggagttacgagaccaagcagacgggcagcgcctccagcatggtgaacggggtcgtcaagctgctcaccaaaccctgggacgtggtgcctatggtcacccagatggccatgaccgacacaacccccttcggccagcagcgcgtgttcaaagagaaggtggatacccggacccaggagcctaaggagggcacgaagaagctgatgcgcatcaccgctgagtggctgtggaaggagctcggtaagaagaagacaccccggatgtgcacccgcgaggaatttacacggaaggtccgctccaacgccgctctgggcgccatcttcaccgacgagaataagtggaagtccgcccgggaggccgtggaggactcgcgtttctgggagttggtcgaccgggagaggaacctccacctggaggggaaatgcgagacatgcgtgtacaatatgatgggcaagcgggagaagaagttaggggagttcggcaaggccaaggggagccgcgccatctggtacatgtggctcggggcccggttcctggagttcgaggcactgggattcctcaacgaggaccactggttctcccgcggcaacagcctgagcggcgtggagggggaggggctgcataagctcggctacatcctgcgtgacgtctccaagaaggagggcggggcaatgtatgcagacgacactgccgggtgggacacgcgcatcaccctggaggacctcaagaacgaggagatggtgaccaaccacatgaagggcgagcacaagaagctggccgaggcgatcttcaagctgacctaccagaacaaggtggtcagggtgcaacgcccgacgccccgcggaactgtgatggacatcatcagccgcaaggaccaacgcggctccggccaggtcgggacctacggcctcaacactttcacgaatatggaggcccagttgatccggcagatggagggcgagggcattttcaagagcatccagcgcttgaccgtgaccgaggaaatcgcggtgcagaactggcttgcccgggtcggcagggagcgactgtccaggatggctatcagcggcgacgactgcgtcgtgaagcccctggacgacagattcgcctcagccctcaccgcgctgaacgacatgggcaaggtccgcaaggacatccagcaatgggagcccagccgggggtggaacgactggacccaggtgccgttctgctcccaccacttccacgagctggtgatgaaggacggccgcgtcctagttgttccatgccgcaaccaggacgagctgatcggcagggcccggatcagccagggcgcaggctggtccctgaaagagacagcctgtctcggcaagagctacgcccagatgtggaccttgatgtacttccaccgccgggacttacgcctcgcggccaacgccatctgctccgcagtccccagccactgggtgcccacctcccgcaccacgtggtccatacacgcgaaacatgagtggatgaccaccgaggacatgctggcggtttggaaccgcgtctggatccaggaaaacccgtggatggaggacaagacccccgtggagtcctgggaggaggtgccctatctgggaaagcgtgaggaccagtggtgcgggagtctcatcggcctgacgagccgggcaacctgggccaagaacattcaaaccgccatcaaccaggtacgctccctgatcgggaacgaggagtacaccgactacatgcccagcatgaagcggttccgcaaggaagaggaggaagcgggcgtactctggtag

SEQ ID NO: 25235 - RNA, 9876 nt, synthetic construct
  misc_feature 1..9876: note = derived and/or modified CDS sequence (opt11) from DENV-2__EU687235__SS-prME
  source 1..9876: mol_type = other RNA
accgccggcgtgatcatcatgctcatccccaccgccatggctttccacctcaccacccggaacggagagccgcacatgatcgtcggtcggcaggagaaagggaagagtttgctgttcaagaccgaagacggcgtgaacatgtgcacgctcatggcgatcgacctgggcgagttgtgtgaagacaccataacatacaagtgcccgctcctgcgccaaaacgagccggaggacatcgactgctggtgcaacagcacctccacctgggtgacctatgggacctgcaccaccacgggtgaacaccggcgcgagaagcgatccgtagccctggtgccccacgtgggaatgggccttgagacccggaccgagacctggatgagcagcgagggggcctggaaacacgtacagcggattgagacgtggatactacgccaccctggcttcactatcatggcagcgatcctggcctacactatcggaaccacgcacttccaaagagccctcatcttcatcttactgaccgccgtagcgcccagtatgaccatgcgctgcatcggtatctccaaccgcgacttcgtcgagggcgtcagcggcgggagttgggtggatatcgttctcgagcatggctcctgtgttacaacgatggccaagaacaagcccaccctggattttgagctgatcaagaccgaggcaaagcagcccgccacgctccgcaagtactgcatcgaagccaaacttacgaacaccaccaccgactcccggtgcccgacccagggggagccgagcctgaacgaagagcaagacaagcgtttcatctgtaagcattccatggtggacaggggctgggggaatggctgcggcctctttgggaagggagggattgtgacgtgcgcgatgttcacttgcaagaagaacatggagggcaaggtcgtgctgcctgagaacctcgagtatactatcgtaataacgccccactccggtgaggagcacgccgtaggcaatgacaccgggaaacacggcaaggagatcaagatcaccccgcagtccagcatcacagaagcggagctcacaggatacggcacggtaaccatggagtgctcaccccggaccggcctcgacttcaacgaaatggtgttgctccagatggaggacaaggcctggctggtgcaccggcagtggttcttggatctccccctaccctggctccccggggccgacacccagggctcgaattggattcagaaggagacgctcgttacgttcaagaacccccacgcaaagaagcaagacgtggtagtgctggggtcccaggagggcgccatgcataccgccctgaccggggcaacggagatccagatgagctccggcaacctcctcttcactggccacctgaagtgccggctccgaatggacaagctgcagttaaaggggatgagttatagtatgtgcaccggcaagtttaagatagtcaaggagatcgctgaaacccagcatgggacgatcgtgattcgcgtgcagtacgagggagatggctccccctgtaagatccccttcgagatcatggacctcgagaagcgacatgtcttagggcgcctgattaccgtcaacccgattgtaacggaaaaggactcgcccgtcaacatcgaggccgagccgccctttggcgactcctatatcatcatcggggtggaaccgggccagctaaagctgaactggttcaagaagggcagctccattgggcagatgttcgagacaacgatgcgcggggcaaaacggatggccatcctaggtgacacggcgtgggacttcggtagcttggggggcgtgttcacttccattggcaaggccttacaccaggtttttggcgcgatctacggtgccgccttcagtggggtttcatggactatgaagatcctgatcggcgtgatcatcacttggatcgggatgaacagccgctccaccagcctgtccgttagcctcgtgctggtcggcgtcgtgaccctatacctcggggtgatggtccaggctgacactggctgcgtggtgtcgtggaagaacaaggagctcaagtgtggcagcgggatcttcatcacggacaacgtccacacctggaccgagcagtacaagttccaacctgagtcgccgagcaagctggcgtctgccatccagaaggcccatgaagagggcatctgcggtatccggtccgttacccgactggaaaacctgatgtggaagcagataacgcccgaactgaaccacatactctctgaaaacgaggtgaagttaaccatcatgaccggcgatattaaggggatcatgcaggccggcaagcgctccctgcgcccgcaaccaaccgagctcaaatacagctggaagacgtggggcaaggccaagatgctgagcaccgaaagccacaaccagaccttcctaatcgacgggccggagactgcggagtgcccgaacacgaaccgtgcctggaactccctcgaggtcgaggactacggcttcggcgtgttcagcaccaacatctggctgaagctgcgcgagaaacaagacgtgttctgtgactccaagttgatgtctgccgcaatcaaagacaacagggcagtccatgctgacatgggctactggatcgagtccgccctgaacgacacctggaagatggagaaggctagctttatcgaaataaaatcgtgccactggccgaaatcacacaccctgtggtccaacggcgtgctagagagcgagatgatcattcccaagaacttcgccgggccagtgtctcagcacaactaccggcccggttaccacacccaaaccgcggggccctggcacctgggcaagttagagatggacttcgatttctgcgaggggacaactgtcgtggtaaccgaggactgcggcaaccgggggcccagtctccgcacgaccacagcttccggtaagctgattaccgaatggtgttgccggtcatgcacgctgcccccgctgcgctacaggggcgaggacgggtgctggtacggtatggagatccgacccttgaaggagaaagaggagaacctggttaatagcctcgttaccgccggacacggtcagatagacaacttttccctgggcgtgctggggatggctctatttctcgaggaaatgctgcggacccgggtcggcaccaagcacgccatcctcctggtggcggtgagcttcgtcacgctgatcaccgggaacatgtctttcagggatctcggccgggtaatggtgatggtaggggccacgatgaccgacgatatcggcatgggtgtcacgtacctggccctgttggccgccttcaaggtgcgcccgacctttgcagccgggctgctactccggaaattaaccagtaaggagctgatgatggcaaccatcggcatcgccctcctgtctcaatctactatccccgagaccatcctggagctcaccgacgcattggcgttagggatgatggtcctcaagatcgttcgtaacatggagaagtaccaattagccgtcacgataatggccatctcctgcgtcccgaacgcggttatcctgcagaacgcgtggaaggtgagctgcacgatcctcgccgccgtctccgtgtcacccctgctgctcacgtccagccagcagaaggccgactggatccctctggccctaactatcaagggtctcaatcccaccgcgatcttccttaccaccctgtcccgcaccagcaagaaacggtcctggcccctcaacgaggccgtaatggcagtgggcatggtatcgatactggcctccagcctgctcaagaatgacatcccgatgactgggcccctggtcgctggcggtttactcacggtgtgctacgtgcttacgggccggagcgccgatctggagctagagagagccgccgacgttaagtgggaggaccaggccgagatatccgggagctcccccatactgtcgatcaccataagcgaggacggctcaatgtccattaagaacgaggaggaggagcatacactcacgatcctaatccgtaccgggctgctagtgatcagcggggtcttcccggtcagtatcccgatcactgcggcggcttggtacctctgggaggtgaaaaagcagagagccggcgtgctgtgggacgtccccagcccgcccctggtggggaaagcagagctcgaggacggcgcctaccggatcaagcaacgcgggatattcggctactcccagatcggcgcaggtgtttacaaggagggcaccttccacaccatgtggcacgtcacgcgcggagccgtgctgatgcatcgcggcaagcggatcgagcccagctgggccgacgttaagaaggacctgatctcctacggggggggctggaagctcgaaggggagtggaaggaaggtgaggaagtccaggtccttgccctggagcccgggaagaatcccagggcagtgcagaccaagcccggcctcttcaagaccaataccgggacgataggtgcggtctctctggacttctcccccggcacgagcgggtcccccatcgtggatcgtaagggaaaggttgtcgggctatacgggaacggcgtggtgacccgcagcggggcctatgtgtccgccatcgcccagacggagaaatccatcgaggacaacccggagatcgaggacgacattttccggaaaaagcgccttaccatcatggacctgcaccccggagcgggcaaaaccaagcggtacctgccagccatcgtgcgcgaggctataaagcgaggcttacggaccctcatcttagctcccacccgcgtggttgctgctgagatggaggaggccctgcgggggctcccgatccgctaccaaactcccgccatacgggcagaacacacaggccgcgaaatcgtggacctaatgtgccatgcaacgttcaccatgagactgctttcacccgtcagagtccccaattacaatttaatcataatggacgaagcgcacttcacggacccggcctctatcgccgcccggggctacatcagcactagggtggagatgggggaggccgctggaatatttatgaccgccaccccgcccgggtcccgggaccccttcccgcagagtaacgcccccatcatggacgaggaacgcgagatccccgagcggtcctggaactcgggccacgagtgggtcacagacttcaaggggaagaccgtctggttcgtgccctccataaaggctggcaacgacatcgcggcctgcctgcgcaagaacggtaaaaaggtcatccagctctcccggaagaccttcgactcagagtacgtcaaaacccgcgcgaacgactgggacttcgtggtgaccaccgacatcagcgaaatgggggccaactttcgggccgagcgcgtcatcgacccgcgacgctgtatgaaacccgtgatcctgaccgacggggaggagagagtgatcttggctggtcccatgcccgtaacccactccagcgccgcccagcgcaggggcaggatcgggcgcaacccgaagaacgagaacgaccagtacatctacatgggtgagcccctggagaacgacgaggactgcgcccactggaaggaggcaaagatgctgctggataacatcaacacgcccgaaggcatcattccgtccatgttcgagccggaacgggagaaggtggacgccattgacggggagtacagactccggggcgaggctcgcaaaacctttgtggatttgatgcgcaggggggacctgcccgtctggctcgcctaccgggtagccgccgaggggatcaactacgcggacagacggtggtgcttcgacggaatcaagaacaaccaaatcctcgaggagaacgtggaggtcgagatctggaccaaggagggcgagaggaaaaagctgaagccccggtggctcgatgcgcgcatctatagcgacccgctggccctgaaggagttcaaggagttcgccgcgggccggaagtccctcacgctcaacctcatcacggagatggggaggctccctaccttcatgacgcagaaggcccgggacgccctagacaatctagccgtgcttcataccgccgaggtaggtggtcgagcgtataaccacgccctgagcgagcttcctgagacgctcgagaccctgcttctcctcactctcctcgcaaccgtgacgggaggcattttcctgttcttgatgtcgggaaagggaatcgggaagatgaccctcggcatgtgttgcataatcaccgccagcatcttgctgtggtacgcccagatccagccccactggatcgcggcctccatcatcctcgagtttttcttgatcgtgctgttgatcccggagccggagaagcagcggacgccccaggataaccagctgacatacgtcgtaatcgccattctcacggtggtcgcggccaccatggcgaatgaaatggggtttctcgagaagaccaaaaaggatttaggcctcggcagcatcactacgcaggagagcgagtccaacatcctcgacatcgacctgcggcccgccagcgcctggaccctgtacgccgtggcaaccaccttcgtgacgccgatgctccggcactccatcgagaacagctccgtcaacgttagcctgaccgcgatcgccaaccaggccactgtgctgatggggctcggccgggggtggcccctatcaaagatggacatcggcgtccctctcctcgcaatagggtgctacagtcaggtgaaccccatcaccctgacggcggccctgctcctgctcgtcgcccactacgccatcatcggcccaggcctccaggcaaaggcgacacgcgaggcgcagaagcggacggctgccgggatcatgaaaaaccccaccgtcgatggcattacggtcattgaccttgagcccataccctacgacccgaagttcgagaagcagctgggccaggtcatgctcctggtcctgtgcgtgacccaggttctcatgatgcgcaccacctgggccctgtgcgaggccctgacgctcgccaccggaccaatcagcacgctgtgggagggaaaccccggccgcttctggaataccacgatcgctgtcagcatggcaaacatcttcaggggctcctacctagccggtgcggggctcctgtttagcattatgaaaaacaccaccaacacgcggcgtggtacgggcaacatcggagagacattaggagaaaagtggaagtcccggctcaacgcactcggaaagtcagagttccagatctataagaagtccgggatacaggaggtggaccgaaccctggccaaggagggcatcaagcgcggagagaccgaccaccacgccgtgagccgcggatccgccaagctacggtggttcgtagagcgcaatatggtgactcccgagggcaaagtggtcgacctcggctgcggccgcggcggatggagctactactgcggcggtctgaaaaacgtgagagaggtgaaggggctcaccaagggcggccctgggcacgaggagccaatcccaatgtcgacctacggctggaacctggtccggctgcagtcaggagtggacgtgttcttcaccccgcccgagaaatgcgacacgctcctgtgcgacatcggtgaaagctcccctaaccccaccatagaggccggtaggactctgcgagtcctcaacctggtggagaattggctgaacaacaacacgcagttttgcgtgaaagtcctcaacccctacatgcccagcgtaattgagaagatggaaaccttgcagcgcaagtacgggggagccctggtgcggaaccccctgagtcgcaacagcacgcacgagatgtactgggtctccaacgccaccgggaacatcgtgagctccgttaacatgataagccgcatgttgatcaaccggttcaccatgaagcacaagaaagctacctacgaaccggacgtggacctgggctccggaacgagaaatattggcatcgagaacgaaatcccgaacttagacatcataggcaagaggatcgaaaagataaaacaggagcacgagaccagctggcactatgatcaggaccacccctacaagacctgggcgtaccacgggtcctatgagaccaaacagacgggcagcgcctccagtatggttaatggggtagtcaagttgctgaccaagccatgggacgtggtgcccatggtaacccagatggcaatgaccgacacaaccccgtttggtcagcagagggtgttcaaggaaaaagtggacacccgtacccaggagcccaaagagggtacaaagaagctgatgcgcatcaccgccgagtggctatggaaggagctggggaagaagaagacgcccaggatgtgcaccagagaggagttcacgcggaaagtaaggtccaacgccgctttgggcgccatctttaccgacgagaataaatggaaatccgcccgagaagccgtcgaggacagtcgcttttgggagttggtcgaccgcgagcgcaacctgcacctagaggggaagtgcgagacctgcgtttacaacatgatgggcaagcgggagaaaaagctcggagagttcggcaaggccaagggctcacgcgctatatggtacatgtggctgggggcccgattccttgaattcgaggccctaggcttcttaaatgaggaccactggttctcgcgtggtaacagcctgagcggtgtagaaggggagggcctccataagctgggctacatcttacgggacgtctccaagaaggagggcggcgctatgtacgcggacgacacagccggatgggacacgcgcatcacccttgaggacctaaagaacgaagaaatggtgaccaaccatatgaagggcgagcataagaagctcgcagaggctatcttcaagttaacttaccaaaacaaggtggtccgagtgcagcgtcccacgccgcgcgggactgtgatggacatcatcagcaggaaggaccagcgtggctccggccaggtcgggacctacggcctcaacaccttcacgaacatggaggcccagctgattagacagatggagggagaaggtatcttcaagagcatccagcgtttgactgtgaccgaagagatcgcggtgcagaattggcttgcgcgagtcggacgcgaacgcctgtcccgcatggccatctctggggacgattgtgtagtcaagccactagacgaccggttcgcctccgccctgaccgcgctgaatgatatgggcaaggtccgtaaggacatacagcagtgggagcccagccgggggtggaacgactggacccaggtccccttctgtagtcatcacttccacgagttagtgatgaaggacggaagagtcctggtggtgccgtgccggaatcaggacgaactgatcgggcgggcccggatcagccaaggcgccggctggtctctcaaggagaccgcctgcctgggtaagagctatgcgcagatgtggaccctgatgtacttccacagacgggacctccgcctggcggctaacgccatctgctcagccgtccccagccactgggtgcccacctcccggacaacgtggagcatccacgccaagcacgagtggatgaccaccgaggacatgctggcggtgtggaaccgcgtttggatccaggaaaacccgtggatggaggacaaaaccccagtggaatcctgggaagaagtgccctaccttggcaagcgcgaggatcagtggtgcgggagtttaatcgggcttacttcccgggccacttgggccaaaaacatccagaccgccataaatcaggtgcgcagcctcataggtaacgaagagtacaccgactacatgcccagcatgaagcgtttccgcaaggaggaggaggaggcaggtgtgctatggtaa

SEQ ID NO: 25236 - RNA, 9876 nt, synthetic construct
  misc_feature 1..9876: note = derived and/or modified CDS sequence (opt11) from DENV-2__EU687236__SS-prME
  source 1..9876: mol_type = other RNA
accgccggggtgatcatcatgctgatccccaccgccatggcgttccacctcaccacccgcaacggcgagccccacatgatcgtcgggcggcaagagaaggggaagtcgcttctgttcaagacggaggacggcgtgaacatgtgcaccctcatggccatcgacctgggggagctgtgcgaggacaccataacgtacaagtgcccattactgcgccagaacgagcccgaggatatcgactgctggtgcaatagcaccagcacctgggtgacttacgggacctgcaccaccacgggtgaacaccggcgcgagaagcggtccgtcgcactggtgccccacgtggggatgggcttagaaacacgcaccgaaacctggatgagcagcgagggggcctggaagcacgtccagaggatagagacctggatactgcgccacccggggttcaccatcatggccgctatcctggcctacaccatcgggaccacgcacttccagcgggcccttatcttcatcctgctgaccgccgtggcgccctccatgaccatgcgctgcatcggcatctccaaccgggactttgtggagggcgtctcagggggctcctgggtggacatcgtactagagcacgggtcgtgtgtcaccacgatggccaagaacaagcccaccctggacttcgagctcattaagactgaggccaagcagcccgctaccctccgaaagtactgcatcgaggccaagctgacgaacaccaccaccgagtcccgttgcccgacgcagggggagcccagcctgaacgaggagcaggataagaggttcatctgcaagcactccatggtggatcggggctgggggaacggctgtggcctgttcgggaagggcgggatcgtgacctgcgcgatgttcacgtgtaagaaaaacatggaaggcaaggtcgtgctgcccgaaaacttagagtacaccatcgtgatcacgccccacagcggggaggagcacgctgtcggaaacgacaccggcaagcacggaaaggaaatcaagatcaccccgcagagcagcatcaccgaggccgagctcaccgggtatggcacggtgaccatggagtgcagccccaggaccggcctggacttcaacgagatggtgctgctccagatggaagacaaggcctggctggtgcaccggcagtggttcctggacttacccctgccctggctgccgggcgccgacacccagggctctaactggatccagaaagagacgctcgtgacatttaagaatccccacgcgaaaaagcaggacgttgtcgtgctgggctcccaggagggcgccatgcacaccgctttgaccggggccacggagattcagatgtcgagcggcaatctcctgttcaccggccatctgaagtgcagattgcggatggacaagcttcaactgaagggcatgtcttacagcatgtgtaccgggaaattcaagatcgtcaaggagatcgccgagacccagcacggaacgatagtgatccgcgtgcagtacgagggcgacggctccccctgcaagatccctttcgagataatggacctcgagaagagacacgttctgggccgcctcatcaccgtgaatccaattgtgacggagaaggacagccccgtcaacatcgaggcggagccgcccttcggcgactcttacatcatcatcggggttgaaccgggccagctcaagctgaactggtttaaaaaagggagctccatcggccaaatgttcgagacaacgatgcgtggcgccaagcggatggccatcctgggggacaccgcctgggacttcggcagcctcgggggggtgttcacgtccatcggaaaggccctgcaccaggtgttcggcgcgatatacggcgccgccttctcgggggtgtcctggacaatgaagatcctaatcggcgtcatcatcacgtggatcgggatgaacagccgctctaccagcctgtccgtcagcctagtgttagtgggcgttgtgaccctgtacctcggggtgatggtgcaggccgataccggctgcgtagtgtcgtggaaaaacaaggagctgaagtgtggttcagggattttcatcacggacaacgtccacacctggaccgaacagtacaagttccaacccgagtcacccagcaagctggcgtccgccatccaaaaggcccacgaggagggcatctgcggaattcgatccgtgactcgcctagaaaacctgatgtggaagcagatcacacccgagctgaaccacatcctcagcgagaatgaagttaagctgaccataatgaccggcgacattaaggggatcatgcaggccggcaagcgctccctgagaccgcaacctaccgagctcaagtacagctggaagacctggggcaaggcaaagatgctgtccactgaaagccataaccagaccttcctgatcgacgggcccgagaccgccgaatgcccgaacacgaaccgggcctggaactccctcgaggttgaggactacggcttcggggtgttctcaacaaatatctggctgaagctgcgcgagaaacaggacgttttctgcgactccaaactaatgagcgctgccatcaaggacaaccgggccgtccacgcggacatggggtactggatcgagagtgccctgaacgacacatggaagatggagaaagcgtcgttcatcgagatcaagtcctgtcactggcccaagagccacaccctgtggtccaatggcgtgctagagagcgagatgatcatacctaagaacttcgccgggcccgtttcccagcacaactaccgccccggataccacactcagacggccgggccctggcacctgggcaagctcgagatggacttcgacttttgcgaagggaccacggtagtggtgaccgaggactgcggcaaccgcggccccagcctccgcacgaccaccgcgtccgggaaactgatcaccgagtggtgctgcagatcctgcacactacccccgctccgctaccggggcgaggacgggtgctggtacggcatggagatccgccccctgaaggagaaagaggagaatctggtcaacagcctcgtgaccgccgggcacggtcaaatcgacaacttctccctgggcgtgctagggatggccctcttccttgaggagatgctgcgcacccgcgtcgggaccaagcacgccatactcctggtggcagtcagcttcgttactctgattaccgggaacatgagtttccgggacctcgggcgcgtgatggtgatggtcggggccaccatgaccgatgacattggaatgggagtgacgtacctggccctgttagccgcattcaaggtgcgtccgaccttcgcggccgggctgctgctccggaagctaaccagcaaggagctcatgatggccaccatcggaatcgccctgctgtcccagtctacgatccccgagaccatcctggagttgacggacgctttggcattaggcatgatggtcctcaagatcgtgcgcaacatggagaaataccaactggccgtgaccatcatggcgatctcctgcgtcccgaacgcggtgatcctgcagaacgcctggaaagtgagctgtacgatcctcgcggccgtctccgtgtcaccactgctgctcacttccagtcagcagaaggccgattggatcccactggctctgaccatcaagggcttaaaccccaccgcgattttcctgacgaccctgagccggaccagcaagaagcgctcctggcctctcaacgaggccgtcatggcggtaggcatggtgagcatactggcctccagcctgctcaagaacgacatccccatgaccggcccattagtcgccggcgggctgctcaccgtgtgttacgtgctgaccggccggtccgcggacctggagttggagaaggctgccgacgtcaagtgggaggaccaggccgagatctccggtagctcccccatcctgagcatcacgatttccgaggacggtagcatgtccatcaagaatgaagaggaggagcacaccctgacgatcctcattcgcactggcttgctggtgatatcaggggttttcccggtctccatccccataaccgccgccgcctggtacctctgggaggtgaagaaacaacgggccggcgttctgtgggacgtccccagcccgccgcccgtggggaaagctgagctggaggacggcgcctaccgcatcaagcagcggggtatcttcggctacagtcagatcggtgcgggggtgtacaaggaggggaccttccacaccatgtggcatgtcacgcggggcgccgtcctcatgcaccggggcaagcgtatcgagccctcctgggcggacgtgaagaaggacctgatctcatacgggggagggtggaagctggagggggagtggaaagagggcgaggaggtccaagtgctggccctggagcccgggaagaacccccgggccgtgcagaccaagccgggcctttttaagaccaacaccgggacgatcggcgcggtcagcctcgacttctcccccggcaccagcgggagccccatcgtcgaccgcaagggcaaggtggtcgggctgtatggcaacggcgtggtgaccaggagcggggcctacgtctccgccatcgcccagaccgagaagtcgatcgaggacaaccccgagatagaagacgacatcttccgcaagaagcgactgacgatcatggacctgcaccccggggcggggaagaccaagcgctatctgcccgcaatcgtcagggaggccatcaaacgcggcctgcggaccctgattctcgccccgacccgcgtggtcgcggctgagatggaggaggccctgcgcgggttaccaatccggtatcagacccccgccatccgcgctgagcacaccggtcgtgagatcgtagacctcatgtgccacgccaccttcacaatgcgcctgctgagccccgtgcgggtcccgaactataacctcatcatcatggatgaggcgcactttacggaccccgcttccatagccgcccgcggatacattagcacacgggtggagatgggggaggccgcgggcatcttcatgaccgcgaccccacccgggtcccgcgacccgttcccccagagcaatgcccctatcatggacgaggagcgggagatccccgagcgttcctggaacagtggccacgaatgggtcacggacttcaaggggaagaccgtctggttcgtgccgtccattaaagccggcaatgacatcgcggcctgtctccggaagaacggcaaaaaagtgattcagctgtccagaaagacattcgactcagagtatgtcaagacccgtgcgaacgactgggacttcgtggtcacgaccgatatcagtgagatgggggccaattttagagccgagcgggtgatcgacccccgccgttgcatgaagcccgttatcctcaccgacggcgaggagcgggtgatcctggcggggcccatgccggtcacccactccagcgccgctcaacggcgcggccgcatcgggcgcaacccaaagaacgagaacgaccagtacatctatatgggcgaacccctggagaacgacgaggactgcgcccactggaaggaggccaaaatgctattagataacataaacacgcccgagggcatcatcccgtccatgttcgagcccgagcgcgaaaaggtggacgcgatcgacggggagtatcgactgcgcggcgaggcccggaagacattcgtggacctcatgcgccgcggggacctcccggtctggctggcttaccgcgtggccgccgagggcatcaattacgcggaccgccgctggtgcttcgatggaatcaagaacaaccagatcctcgaggagaatgtggaggtcgaaatatggaccaaggagggagagcgaaagaagttaaagccgagatggctggacgcccggatttacagcgaccctctagccctgaaggagttcaaagaatttgctgcgggcagaaagtccctgaccttgaacctgatcacggagatggggcggctgcccaccttcatgacccagaaagcccgcgatgccctcgacaacctggccgtgctgcatactgccgaggtcggcgggcgggcgtacaaccacgccctcagcgaactgccggaaacgctggaaaccctcctcctgctcaccctgctcgccaccgtaacgggcggcatcttcctcttcctaatgtcagggaagggcatcgggaagatgaccctgggcatgtgctgcatcatcaccgcctcgatccttctgtggtatgcccagattcagccgcactggatcgcggcatccatcatcttagaattcttcctcatcgtattgttgatacccgagcccgagaagcagcgcacgccccaagacaaccaactcacctatgtcgttatcgccatactgacggtggtcgccgccaccatggctaacgagatggggtttctggaaaagaccaagaaggacctcggcctgggcagcatcaccacgcaagagtcagaatccaatatcttagacatcgatcttcggccggccagtgcttggaccttgtacgctgttgccacaacattcgtgacgcccatgttgagacactccatcgagaacagctccgtcaacgtcagcctcaccgcgatcgccaaccaggcaaccgtgttgatgggactgggacgggggtggcccctctccaagatggacatcggcgtccccctcctggccatcgggtgctacagtcaggttaaccccatcaccctcacggctgccttactgctgctggtggcccattatgcaatcatcggcccggggctgcaggccaaggcgacccgcgaggcccagaaacgcaccgccgctggcatcatgaagaaccccaccgtcgacgggatcacggtgatcgatctcgagccgatcccttacgaccccaagttcgagaagcagctggggcaggtgatgctgctcgtcctgtgcgtaacccaggtcctgatgatgcggacgacatgggccctctgcgaggcgttgacgcttgccactggccccatctccacactgtgggaggggaacccaggccgcttctggaacaccacgatcgccgtctcaatggccaacatattccggggcagttacctggcgggagcgggcttactcttcagcataatgaagaacaccaccaacacccgccgggggacgggaaacatcggcgagacccttggggagaagtggaagtcccgcctgaacgcccttggcaaaagcgagttccagatctacaagaaatccggtatacaggaagtggaccgtaccctggccaaggaaggcatcaagcgcggagagacagaccaccacgccgtgagccggggctccgcaaagttgcggtggttcgtcgagcgcaacatggttacgccggagggcaaggtggtcgatctcgggtgcggcagggggggctggagctactactgcgggggactgaagaacgtgcgggaggtgaagggcctgactaagggcgggcccgggcacgaggagcccatccccatgtccacctacggctggaacttggttcgcctgcaaagcggggtggacgtgttcttcaccccgcctgagaagtgcgatacgctgctctgcgatataggcgagtcctccccgaaccccaccatcgaggccggtcggacactacgcgtcctgaacctcgtggaaaactggctgaataacaacacccagttctgcgtgaaggtcttgaacccgtacatgcccagcgtgatcgagaagatggagaccctccagcggaagtacgggggggccctggtgcgcaaccccctgtcgcggaacagcacgcatgagatgtattgggtctccaatgccacaggaaacatcgtgagctccgtgaacatgattagccgcatgttgatcaaccgcttcaccatgaagcacaagaaggccacctacgaaccggacgtagacctcggctcagggacgcggaatatcggcatcgagaacgaaatccccaacctggatattatagggaaacgcatcgagaagatcaaacaggagcacgagacctcttggcactacgaccaagaccacccctacaagacctgggcgtatcacggatcgtacgagaccaagcagacgggttcagcctccagcatggtgaacggggtggtcaagctactaaccaagccctgggacgtggtgccgatggtcacccagatggccatgaccgacacgacccccttcggccagcagagggtgttcaaggagaaagtggatacacgcactcaggagccaaaggagggcaccaagaagcttatgcggatcaccgcagagtggctgtggaaagagctcgggaagaagaaaacgccacggatgtgcacccgtgaggagttcacgaagaaggtccgcagcaatgccgcgctgggcgccatcttcaccgacgagaacaagtggaagtccgcccgggaggccgtggaggactcccgcttctgggagttggtcgaccgggagcgcaacttacacctggagggtaagtgcgagacttgcgtgtacaacatgatgggcaaacgagagaagaagctaggggagttcggcaaggccaagggcagcagagcgatctggtacatgtggctcggggcgcggttcctggagttcgaggcgctggggttcttaaacgaagaccattggttctcgcgcggtaacagcctgagcggcgtggagggagagggcttacacaagctcggttacatcctgcgggacgtctcaaagaaggaggggggggccatgtacgcggatgacaccgccggttgggacacgcgcatcaccctggaggatttgaagaacgaggagatggtgaccaatcacatgaaaggcgaacacaagaagttggcagaggccatctttaaactgacctaccaaaacaaggtggtccgggtgcaacgcccgacgccccgggggaccgtgatggatataataagccggaaggaccagcgcggaagtggtcaggttgggacctatggcctcaacacattcacgaatatggaggcccaactgatccgccagatggaaggggagggaatttttaagtctatccaacgcctcactgtgaccgaggagatcgcggtgcagaactggctcgcccgggtcggcagagagcggctgtcccgcatggcaatcagcggcgacgactgcgtcgtgaagcccctggacgaccggttcgcctcagccctcaccgcactgaatgacatgggcaaagtgcgcaaggacatccagcagtgggagccgtcacgggggtggaatgactggacccaggtaccattctgttcccatcatttccacgagctggttatgaaagacggccgcgttctggtggtcccctgccgtaaccaggacgagctgattggacgcgccagaataagccagggcgccggctggtctctgaaagagacggcctgcctcggcaagagctacgctcagatgtggaccctcatgtatttccaccgccgggacctgcgcctcgcggctaacgcaatctgttccgcggtccccagccactgggtacccacgtcccggaccacgtggtcaatccacgccaagcacgagtggatgacaaccgaggacatgctggccgtgtggaaccgcgtgtggatccaagaaaatccgtggatggaggacaagacccccgtggagtcctgggaggaggtaccctacctgggcaagcgggaggaccagtggtgcgggagcttaatcggcctgacgagccgcgccacgtgggccaagaacatccagactgcgataaaccaggtccgatccctgattgggaacgaggaatacaccgactacatgcccagcatgaagaggttccgtaaggaggaggaggaggcaggcgtgctctggtag

SEQ ID NO: 25237 - RNA, 9876 nt, synthetic construct
  misc_feature 1..9876: note = derived and/or modified CDS sequence (opt11) from DENV-2__EU687237__SS-prME
  source 1..9876: mol_type = other RNA
accgccggagtgattataatgctgatccccaccgccatggctttccatcttaccacccgcaatggagagccacatatgatcgtgggacgacaggaaaaggggaagagtctcctgtttaagaccgaggacggcgtgaacatgtgcaccctcatggccatagacctaggggagctctgcgaggacaccatcacatacaagtgccccctcctgcgccagaacgagccagaggacatcgattgttggtgcaactcaacgagcacctgggttacctacggcacgtgcaccaccacgggcgaacaccggcgagaaaaacggtccgtcgccctggtaccccacgtggggatgggcctagaaacccggaccgagacctggatgagcagcgagggggcttggaagcacgtccagcggatcgagacgtggatcttgcgccacccgggcttcaccataatggcagcgatcctggcctacactatcgggaccacgcatttccagcgggccctcatcttcattctgctgaccgccgtggcgcccagcatgaccatgcgatgcatcggcatctccaatcgggacttcgtggagggcgtcagcgggggctcctgggttgacatcgtgctcgagcacgggagctgcgtcaccaccatggccaagaacaagcccacgctagatttcgagctgatcaagaccgaggccaagcagcccgccaccctccgtaagtactgcatcgaggccaagctgactaataccaccaccgagagtcggtgcccgacgcagggagaacccagcctaaacgaggagcaggacaagcgcttcatctgcaagcactcgatggtggatcggggctgggggaacggatgcggtctgttcggaaagggggggatcgtgacctgtgcgatgttcacgtgtaagaaaaacatggagggaaaggtggtccttcccgaaaacttggaatacactatcgtgatcacaccccacagcggagaggagcacgccgtcggtaacgacacggggaagcacggtaaggagatcaagatcaccccgcagtccagcatcaccgaggcggagcttaccgggtacggcacggtgacgatggagtgtagcccccgcaccggcctggacttcaacgagatggtgctgctccagatggaggacaaggcgtggttggtgcaccgccaatggttcctggacttgcccctgccgtggctgcctggggccgacacgcaaggaagcaactggatccaaaaggagactctcgtgacattcaagaaccctcacgcgaagaagcaggacgtggtcgtgctgggttcccaggagggcgccatgcacactgctctgaccggggccaccgagatacagatgagctccggcaatctcttattcaccggtcacctaaagtgtaggctccggatggataagctgcagctaaaggggatgagttacagcatgtgcaccggcaagttcaagatcgtcaaggaaatcgcggaaacccagcacgggacgatcgtgatccgcgtccagtacgagggcgacggctccccctgcaagatccccttcgagatcatggatctcgagaagaggcacgtcctggggcgcctgatcaccgtgaacccgatcgtgaccgagaaggacagccccgtcaatatagaggcggagccgccctttggtgactcctacattatcatcggggtggagccggggcagttaaagctgaattggttcaagaaggggagctccatcggccagatgttcgagaccacgatgcgcggcgccaagcggatggccatcctgggggataccgcctgggactttggcagcctcgggggcgtttttacctcaatcgggaaagccctgcatcaggttttcggcgcgatctacggcgccgcttttagcggggtgtcctggaccatgaagatcctgataggtgtgattataacgtggatcggaatgaactcacgcagcaccagcttatccgtaagcctggtgctggttggcgtcgtgaccctgtacctcggcgtcatggtccaggccgatactggatgcgtggtgtcctggaagaacaaggagttaaagtgcggttctgggatctttatcacggacaatgtccatacctggaccgaacagtacaaattccagcccgagtcgcccagcaagctggcgagtgccatccagaaggcccacgaggaaggaatctgcgggattcggtccgtgacccggttagaaaacctgatgtggaagcagatcacgcctgagctgaaccacatcctcagcgagaacgaggtaaagctgaccattatgaccggggacatcaaggggatcatgcaggccggcaagcgttccctgcgcccgcagcccaccgagctcaagtacagctggaagacgtggggcaaggcaaagatgctgtctaccgagagccacaaccaaaccttcctgatcgacggtcccgagaccgcggagtgcccgaatacgaaccgggcctggaactccctcgaagtcgaagactacggcttcggggtcttcagcactaacatctggctgaagttacgagagaagcaggacgtgttctgcgactccaagctcatgagcgctgccatcaaagataaccgggccgtccacgcagatatggggtactggatcgagtccgccctaaatgacacctggaagatggagaaggccagcttcatcgagatcaagtcctgtcactggcccaagtctcacaccctctggagcaacggcgtgctcgagtctgagatgatcatccccaaaaacttcgccggtccggtgagccagcataactaccgcccgggctaccacacacagacggcaggcccatggcacttaggcaagttagagatggacttcgatttttgcgaagggaccactgtggttgtgaccgaggactgcggtaacaggggccccagcctccgcacgaccaccgcgagcggtaagctgatcaccgagtggtgctgtcggtcctgcacgctgccccccttgcgctaccggggcgaagacgggtgctggtacggaatggaaatacgccccctgaaggagaaggaagagaacctggtcaacagcctcgtgaccgccgggcacgggcagatcgacaacttctccctgggcgtgctggggatggccctctttctggaggagatgcttcggacccgcgtcggcacgaagcacgccatcctcctggtggcggtgagtttcgtcactttgattaccgggaacatgtccttcagagacctcggccgtgtgatggtgatggtcggtgctaccatgaccgacgacatcggtatgggagtgacctacctggcactactcgctgcctttaaggtgcgccccaccttcgcggccggccttctgctcagaaagctgaccagcaaggagttgatgatggccaccatcggcatcgcccttctctcccagagcacgattccagagactatattagagctcaccgatgcgctggcgctggggatgatggttctcaagatcgtgcgcaacatggagaagtaccagctggcggtgaccatcatggcgatcagttgcgtcccaaacgccgtgattctacagaatgcctggaaggtcagctgcacgattctcgcggccgtcagtgtgtcgcccctgctactcacctccagccagcagaaggcagattggatccccctggccttgaccatcaagggactcaacccaaccgcgatattcctgacgaccctgtcccgaaccagcaagaaacggtcctggcctctcaacgaggccgttatggcagtgggcatggtgagcatcctggcctcctcactgctcaaaaacgatatccccatgacagggcccctggtagccggcgggctactcacagtgtgttacgtgttaaccgggcggtcagcggacctggagctcgaacgtgctgccgacgtcaagtgggaagatcaggccgagatctctgggagcagcccaatcctgagcatcaccatctccgaggacggctccatgtccatcaaaaacgaggaggaggaacacaccctgacgatcctaatacggaccggcctgctggtgatcagcggggtgtttccggtcagtatcccaatcaccgccgctgcatggtacctctgggaggtaaagaagcagcgcgctggcgttctgtgggacgtccccagcccgccgcccgtggggaaggctgagctggaggacggcgcctaccggattaaacagcgcggtatcttcggctacagtcagatcggcgcgggggtgtacaaggaaggaaccttccataccatgtggcacgtcacgcgcggggccgtgttgatgcacagaggtaagcggatcgagcctagctgggccgacgtgaagaaggacctaatctcctatgggggcggttggaagctggaaggggagtggaaagaaggcgaggaggtccaagtgctcgccctggaacctgggaagaacccccgcgccgtgcagaccaagcctggcttgttcaagaccaacacaggaacgatcggcgcggtcagcctcgacttctcccccggcactagcgggtcccccatcgtggaccgtaagggcaaggtagtcgggctgtacggcaacggcgtggtgacccgcagcggggcttacgtatcagccatcgcccaaaccgagaagtccatcgaggacaaccccgagattgaggacgacatattccgtaagaagcgcctgacgatcatggacttgcaccccggggcggggaagactaagcggtacctgccagccatagtacgcgaggccatcaagcggggactgcgcactctaattctcgccccgacccgcgtggtcgccgcggagatggaggaagccctgcgggggctgcccatccggtaccaaacgcccgctatccgggccgagcacacgggccgcgagatcgtggacctcatgtgccatgcgacctttaccatgcggctgctgagccccgtgagagttccgaactataatctcatcatcatggacgaggcgcatttcacggaccccgcctcgatcgccgcacgggggtacataagcacccgcgtggaaatgggggaagccgcgggcattttcatgaccgccacgccgcccgggtccagagacccgttcccccaaagcaacgcgccaatcatggacgaagagcgcgagatccctgaacggtcatggaacagcggccacgaatgggttacggacttcaaggggaagaccgtctggttcgtcccgtccatcaaggccggcaacgacatagcggcctgcctgagaaagaatggcaagaaggtgatccagctgagccgcaagaccttcgattccgagtacgtcaagacgcgcgccaacgactgggacttcgtggtgacgaccgacatcagcgaaatgggtgccaacttccgggctgagcgcgtcatcgacccgcgccgatgcatgaagcccgtgatccttacagacggcgaggagagagtgatcctggcgggtcccatgccggtcacccactccagcgccgcccagcgtcgcggccggatcgggcgcaaccccaaaaatgagaacgatcagtacatctacatgggcgaacccctggagaatgacgaagactgcgcccactggaaagaggctaagatgctcctggacaacatcaacacccccgagggcatcataccaagtatgttcgagcccgagcgggagaaagttgacgcgatcgatggcgagtaccgcctgcggggcgaggcaagaaagacctttgtggatctcatgcggcgcggggacctgcccgtctggctggcataccgggtagccgccgagggcatcaactacgcggaccgccggtggtgctttgacggaataaagaacaaccagatcctcgaggagaatgtggaggtggagatatggactaaggagggggagcgcaagaaactgaagccgcggtggctcgatgcccgcatctacagcgaccccctcgccctgaaagagtttaaggagttcgccgcgggacggaagtccctgacgctcaacctgatcacagagatggggcgcctacccaccttcatgacacagaaggctcgggacgccctcgacaacctggccgtgttgcacactgcagaggtcggcggtagagcctacaaccatgccctaagcgaactgcccgagacgctagagacccttctgctcctgacgttactggctaccgtaacgggcggaatttttctcttcttgatgtccgggaagggcatcgggaagatgacactgggcatgtgctgcatcatcactgccagtattctcctgtggtacgcccagatccagccgcactggatcgcggcatccattatactggagttctttctcatagtgctgcttatccccgagccggagaagcaacggacgccccaggacaaccagctcacctacgtcgtcatagccatcctgacagtggtcgccgccaccatggcaaacgagatgggcttcttggaaaaaaccaagaaggacctcggcctgggcagcatcaccacgcaggagtcagaatcaaacatcctggacatcgacctccgcccggcaagcgcctggaccctgtatgccgtggcgaccaccttcgtgacgcccatgctcaggcactccatcgagaactcttccgtcaatgtgagcctaaccgcaatcgcaaaccaggccaccgtgttaatggggctgggccgcggatggcccctatctaagatggatattggcgtccccctgctggcaatcgggtgttacagccaggtgaacccgatcaccctcacggcggccctgctgctcctggtggcccactacgccatcatcggacctggcctgcaggccaaggcgacgagggaggcacagaaacggacagcagccgggatcatgaagaaccccacagttgatggtatcacggtgatcgatctcgagcccatcccttacgaccccaagttcgagaagcaactgggccaggtgatgctgctcgtcctgtgcgtgacccaagtgctaatgatgcgcaccacctgggccctgtgcgaagcgttgacgctggccactggccctatctcaaccctatgggagggcaaccccggccggttctggaacaccacgatcgccgtcagcatggccaacatcttccgcggctcctacctggcaggggcgggcctcctcttcagcatcatgaagaacaccaccaacactaggcgcggcacgggcaacatcggcgaaaccctgggggagaaatggaagtctcggctgaacgcgctcggtaagagcgaattccagatttacaagaagtccgggatccaggaggtggaccggaccctggccaaggaaggtatcaagcgcggggaaaccgaccaccacgccgtgagccgcggctccgcgaagcttcggtggttcgtagagcgcaacatggtgacgccggaaggcaaggtggtggacctcgggtgcggccgcggcgggtggtcttactattgcggcgggctcaagaacgtgagggaggtgaaggggctcactaaaggcgggcccgggcacgaggagcccatccccatgagcacctatggctggaacctcgtccggctccagagcggggtggacgtattcttcacgccgccggagaagtgcgatacgctgctctgcgacatcggggagagctccccgaaccccaccatcgaagcaggccgcaccctacgggtactgaatctagtggagaactggctcaacaacaacacccagttctgcgtgaaggtcctgaacccttacatgccttctgtgatcgagaagatggagacccttcagcgcaagtacgggggggccctggtgcggaaccccctgtcacgaaacagcacgcatgagatgtactgggtctccaacgccaccgggaacatagtcagctccgtcaatatgatcagccgcatgctgatcaaccggttcaccatgaagcacaagaaagccacttacgagccggatgtagatcttggctccggcacgcgcaacatcgggatagagaacgagatccccaacctggacatcatcggcaagcggattgagaaaatcaaacaggagcacgagaccagctggcactacgaccaggaccacccctacaagacttgggcgtaccacgggtcttacgagaccaagcaaacgggcagcgcttccagcatggtgaacggggtggtcaagctactcacgaagccctgggacgtggtgccgatggtaacccagatggctatgaccgacacgaccccctttggccagcagcgcgtgttcaaggagaaggtggacacccggacccaggagcccaaagagggcacgaagaagctgatgcgcatcaccgcggaatggctgtggaaggagctcgggaagaaaaagactccccgtatgtgcacccgcgaggagttcacgcggaaggtgcgctccaacgcagcgctaggagccattttcaccgacgagaacaagtggaagtctgcccgggaagccgtggaggactccagattctgggagctggtcgacagagagcgcaatctccaccttgaggggaagtgcgagacatgcgtgtataacatgatgggcaagcgggagaaaaagctgggggagttcggcaaggcgaagggcagccgcgcgatctggtacatgtggctcggcgccagatttctggagttcgaggccctgggcttcctcaacgaagaccattggttctcccgcgggaacagcctgagcggcgttgagggggagggcctgcacaagctcggctacatcctgagagacgtgtccaagaaggagggtggcgccatgtacgcggacgacaccgccgggtgggacactcgcatcaccctggaggacctcaagaatgaggaaatggtgaccaaccacatgaaaggcgagcataagaagctggccgaggcaatcttcaagctgacctaccagaacaaggtggtacgggtgcagcgcccgacgccccgcgggaccgtgatggatatcataagtcggaaggaccagcgcggttccggccaggtcgggacctacggcctcaacaccttcacgaacatggaggcccagctgatccggcagatggagggggagggcatcttcaaatccatccagaggctgaccgtgaccgaggagatcgcggtgcaaaactggctcgcccgggtcggccgcgagcgactttccagaatggccatctcgggggacgactgcgtggtgaagcccctggacgatcggttcgccagcgcactcacggcgctcaacgacatgggcaaggtccggaaagacatccagcagtgggagccatcgcgggggtggaacgactggacccaggtgcccttctgcagccaccacttccacgagctggtgatgaaggacggccgcgtcttagtggtgccctgccggaaccaagacgagctgatcggacgcgcccggattagccagggcgccggttggtccctgaaggaaaccgcctgcctcggcaagtcctacgcccagatgtggacgctgatgtacttccatcgccgtgacctgcgcctcgcggccaatgccatctgctccgccgtgccaagccactgggtgcccacctcccggaccacgtggagcatacacgcgaagcacgagtggatgactaccgaggacatgctggcggtgtggaaccgcgtttggatccaggaaaacccctggatggaagacaagacccccgtagagagttgggaggaagtgccgtacttaggtaagcgcgaagaccagtggtgcgggtcactcatcggcctgacgagccgcgccacatgggcaaagaacatccagaccgccatcaatcaggtccgctccctgatcgggaacgaggagtacaccgactacatgcccagcatgaaacgattccgcaaagaggaggaggaggcaggcgtgctctggtag

SEQ ID NO: 25238 - RNA, 9876 nt, synthetic construct
  misc_feature 1..9876: note = derived and/or modified CDS sequence (opt11) from DENV-2__EU687238__SS-prME
  source 1..9876: mol_type = other RNA
acagcaggggtgataatcatgctaatccctaccgcaatggcattccacctaactacaagaaacggggaacctcacatgatcgtcggccggcaggaaaaggggaagagtcttctgttcaagaccgaagacggtgtgaacatgtgcaccttaatggctatcgacctgggggaactgtgcgaagacaccatcacctacaagtgccccctcctgcggcagaatgagcccgaggacatcgactgctggtgcaacagcaccagtacgtgggtgacctatgggacatgcacgactacgggggaacaccggcgcgagaagagatccgtcgccctggtgccccacgtggggatgggtctcgaaacccgcaccgagacctggatgagctcagagggcgcgtggaaacacgttcagcggatagagacctggatcctgcgccacccgggcttcaccatcatggccgccatcctggcgtacacgatagggaccacgcacttccagagggccctaatttttatcttactcactgccgtagcgcccagcatgacaatgcgctgcattggcatctccaaccgtgacttcgtggaaggcgtcagcgggggcagttgggtggacatcgtgctcgagcacggttcttgcgtgaccactatggctaagaacaaacccaccctggacttcgagctgattaagacagaggcgaagcagccggccacattacgcaagtattgcattgaggccaagttaacgaacaccaccaccgagtctcgatgtccaacacagggcgagccctctctgaacgaggagcaggacaagcgcttcatctgcaaacattcgatggtggatcgcggctgggggaatggctgcggcttattcggcaaaggagggatagtgacctgcgctatgttcacgtgcaagaagaacatggaggggaaggtggtgctgccagagaatcttgagtacaccatagtaatcactccccatagcggggaagaacacgccgtaggcaacgacaccgggaagcacggcaaggaaatcaagatcaccccgcagtccagcatcacggaggccgagttaaccgggtatggcactgtgaccatggagtgcagcccacgtaccggcctggactttaacgagatggtgctgctccagatggaagacaaagcgtggctggtacaccggcagtggttcctggacttgccccttccttggctgccgggggcagacacccagggcagcaattggatccaaaaggaaactctcgtcaccttcaaaaaccctcatgcgaagaagcaggacgtggtagtactggggtcgcaggaaggggccatgcataccgcgctaaccggggccacggagatacagatgagcagcggtaacttgctgttcaccggtcacctgaagtgtcgcctccggatggacaaacttcaactgaagggtatgtcctacagcatgtgtaccggcaagttcaagatcgtcaaggagatagcggaaacgcagcatggcacgatcgtgatccgcgtacagtacgaaggcgatggctctccctgtaagataccctttgagatcatggacctagagaagcggcacgtcctggggcgccttatcaccgtgaaccccatcgtgacggagaaggattctcccgttaacatcgaggcggagccgcctttcggggactcgtacatcatcatcggggtcgagccgggccagttgaagctgaactggttcaagaaggggtccagcatcggccagatgtttgaaaccacgatgcgcggcgcaaaacggatggccatcctgggggacaccgcctgggacttcgggagcttaggaggggtgttcacgagtatcgggaaagcgcttcaccaagtctttggcgcgatctacggcgctgccttctccggggtgtcgtggaccatgaagatccttatcggcgtaacgatcacctggatcgggatgaacagccgctccaccagcctgtcggtcagtctcgtgttggtgggcgtcgtgaccctgtatctcggggtgatggtccaggccgacactggctgcgtggtgtcttggaagaacaaagagctgaagtgcggaagtggtatttttatcacggacaatgtccatacctggaccgagcagtacaagttccagcccgaaagccccagcaagctggccagcgcgatccagaaggcccacgaggaaggcatctgcgggatacggtccgtgacgcgccttgagaacctgatgtggaagcaaatcacgcccgaactgaaccacatcctgagcgagaacgaagtgaagctgacaatcatgactggcgacataaaagggatcatgcaggccggcaagcgttccctgcgcccgcagcccacggaactgaagtactcctggaagacatggggcaaggccaagatgctgtccaccgagagccacaatcagacgtttctgatcgacgggccagaaacagcggagtgtcccaacaccaaccgggcctggaactccctagaagtagaggactacggcttcggcgtgttctccaccaacatttggctgaaacttcgcgagaagcaggacgtcttctgcgactccaagttgatgagcgccgccatcaaagacaaccgggcggtccacgctgacatgggctactggatagagtccgccctgaatgacacctggaagatggaaaaggccagcttcatagaaatcaagtcctgccactggcccaaatcccatacactgtggtccaacggcgtcctcgagtcggagatgatcatccccaagaacttcgccggtcccgtgtcccagcacaactatcgcccgggctaccatacgcagaccgccggcccctggcacttaggaaaactggagatggacttcgacttctgcgaagggaccaccgtcgttgtgacagaggactgcggcaaccggggcccttccctccggaccactaccgcgtctgggaagctgataactgagtggtgctgccggagttgcactctgcccccgctccgataccggggcgaggacggatgctggtacggcatggagatacgccccctgaaagagaaggaggagaacctggttaatagcctcgtgaccgctgggcacggccagatcgacaatttttccctgggcgtgctcggaatggccctattcctggaggagatgctgcgcacacgcgtcgggacaaagcacgccatactcctcgtggcagtgagctttgtcaccctaataaccgggaatatgtcgtttcgggacttaggcagggtgatggtgatggtcggagccaccatgacggacgacatcggcatgggcgtcacttacctggcattactcgccgcgttcaaagtgcgacccacttttgcggctgggctgctgctgcgcaagttaaccagcaaggagctgatgatggcaacgataggcattgccctcctatcgcagagcactatccccgagaccattctagagctcacagacgccctggctctggggatgatggtacttaagatcgtgcgcaacatggagaagtaccagctcgcagtgacgattatggccatctcctgtgtcccgaacgcagtgatccttcagaacgcctggaaggtgtcatgcaccatcttagcagccgtctccgtgagcccactgctgttaacctcctcgcaacaaaaagccgactggattccgctggccctgaccatcaagggcctcaaccccacggctatcttcctcactaccctgtctcggaccagcaagaagcgctcttggccgctcaacgaggccgtaatggccgtgggcatggtgagcatcctagcctcatctctgctcaagaacgacatcccaatgactgggcccctggtcgctggcgggctgctcactgtctgctacgttctgacgggccggtcggcggacctggagctcgagcgagccgctgacgtaaaatgggaggaccaggccgagatcagcgggagttccccgatcctcagcatcaccatcagcgaggatggaagcatgtccataaagaacgaagaagaggagcacactttaactatccttatccggacggggcttttggttatctcgggagtgtttcccgtttcgattcccatcaccgccgcggcttggtacctctgggaggtaaagaagcagagagccggcgtgctgtgggacgtccccagccctcctcccgttggcaaggccgagctggaggatggtgcgtaccggatcaagcagcgcggaatcttcggctattcccagatcggcgcaggcgtttacaaggagggcacgttccacacgatgtggcacgtcacccgcggcgccgtgttaatgcaccgcggcaagcgaatcgagcccagctgggccgacgtcaagaaggacctgatctcctacggaggcggttggaagctagagggggagtggaaagagggcgaggaggtccaggtgctcgctctggagcccggtaagaaccctcgcgccgtgcaaacgaagcccggcctgttcaagactaacacaggcacaatcggcgctgtatctctcgacttcagtccaggcacctccggcagtcccatcgtggaccggaagggtaaagtcgtcgggctttacggaaacggtgtggtgacccggagcggcgcctacgtctccgccatcgcgcagacggagaaatccatcgaggacaaccccgagatcgaagacgacatcttcaggaagaagcgcctcaccatcatggacctccaccccggcgcaggaaagacaaagagatacttgccagcaatcgtgcgagaagcgatcaagcgcgggctgcgtaccctcattttagccccgacgagggtggtagccgcggagatggaagaagccctgcgtgggcttcccatccgttaccagacccccgctatccgggccgagcacacaggccgcgagatcgtggatctcatgtgtcacgccacgttcacaatgcgtctgttaagccctgttagagtcccgaactacaatctcattatcatggatgaggcacacttcacggaccccgccagtatcgcggcccgaggctatatcagcactcgcgttgagatgggggaagccgcggggatcttcatgacagcgacgccgcccggatcccgggatccattcccccagagtaacgctcccatcatggacgaagaacgcgaaattcctgagcggtcatggaacagcggccacgaatgggtgaccgacttcaaggggaagacggtttggttcgttccctccattaaggccggcaacgacattgcggcctgcctgcgcaagaacggcaagaaagtaatccaattgagccggaagaccttcgactccgaatacgtcaagacgcgggccaatgactgggacttcgtggtgaccaccgacatttctgagatgggcgccaacttccgcgcggaacgcgtcatagacccccggcgctgcatgaaaccggtgatcctcacggacggcgaggagcgcgtgatcttggccgggcccatgccggtcacgcacagcagtgccgctcagcgccgtggccggatcgggcgcaaccccaaaaacgagaacgaccagtacatctacatgggcgagcccctggaaaacgacgaggactgcgctcactggaaggaggcgaagatgctactggacaacattaatacccccgagggcatcataccgtccatgttcgagccggaacgggagaaggtggatgcaatcgacggggagtaccggttgcggggcgaggcccgcaagacattcgttgacctcatgcggcgcggggacctgccagtgtggctggcatatcgagttgccgccgagggcatcaattacgcggaccgacggtggtgcttcgatggtatcaagaataaccagattctcgaggagaacgttgaggtcgagatctggaccaaggagggtgaacgcaagaagctgaagccgcggtggctggacgcccgcatctacagtgaccccctcgccctcaaggagttcaaggagttcgccgcgggacggaagtcactaacactcaacctgatcaccgagatggggcgccttcctaccttcatgacccagaaggcccgcgacgcactcgacaacctggccgttctacatacggccgaggtcggagggagggcgtacaatcatgccttgagcgagctaccggagaccctggaaaccctcctactcttaaccctgctggcaacggtgaccggcggcatctttctctttctcatgtctgggaagggtatagggaagatgactctgggcatgtgctgtatcattactgcgagcatcctgctgtggtacgcccagatccaaccacactggatcgcggcctcgataatcctggagttcttcctcatcgtactgttgatccccgagcccgagaagcaacgcacaccccaagacaaccagttaacgtatgtggttatcgccatcctgactgtcgtcgcagccacaatggcgaacgagatgggttttctcgagaaaaccaagaaggaccttggcctggggagcatcaccacgcaggagagtgagtccaacatcctggacatagacctccgcccggccagcgcatggaccttgtatgccgtggccaccacattcgtgacccccatgctgcggcactccatcgagaacagtagtgtgaacgtctctctcacagcgatcgccaaccaggcgaccgtgctgatggggctgggacgtggatggccgctctccaagatggacatcggcgtccctctgcttgctataggctgttacagccaggtgaaccctatcacgctcaccgcggccctgctgctcctggtggcccactatgcgatcattggccccggcctgcaggccaaggctacccgcgaagcccagaagagaaccgccgctggaataatgaagaaccccacggttgacggcatcaccgtgatcgacctcgagcccatcccttatgaccctaaattcgagaagcaactgggccaggttatgctgctcgtcctttgcgtgacacaggtgctgatgatgcgcaccacgtgggccctctgcgaggcattgaccctggccaccggccccatctccacactctgggagggcaaccccggcagattctggaacacgaccatcgccgtctccatggccaacatctttcgaggctcctacctggccggggcgggcctcttgttttctatcatgaagaacaccaccaacacacggcggggcaccggaaatatcggtgagacgctgggagagaagtggaagtcccggcttaacgctctgggcaagagcgagttccagatttacaagaagtcaggaatccaggaagtggaccgcaccttagcaaaggagggcatcaagcgcggtgagactgaccaccacgctgtttcaaggggctccgccaagctccggtggttcgtcgaacgaaacatggtcacaccggagggcaaggtggtcgatcttgggtgcggcagagggggctggtcctattactgcggcgggctgaagaacgtgcgcgaggtcaaggggcttactaagggcggacccgggcatgaggagccgatccccatgtccacctacggctggaacttggtccgcctgcagagcggggtggacgtgtttttcactcccccggagaagtgcgataccctgctctgcgacatcggcgagagctcccccaaccccaccatagaggcaggcagaacacttcgggtcctgaacctcgtggagaactggctgaataacaacacccaattctgcgtgaaggtcctaaacccgtacatgcccagcgtgatcgagaaaatggagaccctccagcgcaagtacgggggcgccctcgtgcggaaccccctgtcccgcaacagcacccacgagatgtactgggtctccaacgccaccggaaacatcgtgagctccgtgaacatgatcagccgcatgctcatcaatcggttcacaatgaagcacaagaaggccacgtatgagccggatgtcgacctcggctccgggacccgcaacatcggcatcgaaaacgagatccccaaccttgacatcatcggtaagcggatagagaagattaagcaggagcacgagaccagctggcactacgaccaggaccatccctacaaaacctgggcgtaccacggaagttacgagacgaagcagaccggcagcgcctcatctatggtgaacggggtggtcaagctgctgaccaagccctgggacgtggtgccgatggtaacccagatggccatgacggacacgacgcccttcggacaacagcgcgtgttcaaggagaaagtagacacccgtacccaggagcccaaggagggcacgaagaagctgatgagaatcaccgccgagtggctgtggaaggagcttggtaagaaaaagacgccccggatgtgcacgcgcgaagagttcacccggaaggtacgctccaacgcagcgttaggcgcgatattcacagacgagaacaagtggaagtccgcccgggaggccgtagaggactcccgcttctgggagctggtcgaccgggaacgcaacctccatctggagggtaaatgcgagacctgcgtgtacaacatgatgggcaagcgggagaaaaagctgggagagttcggcaaggccaaaggcagccgcgctatctggtatatgtggctcggggcacggtttctggaatttgaggccctgggctttctcaacgaagaccattggttttctcgcggtaatagtttaagtggggtggagggggagggactgcacaagctcgggtacatcctgcgggatgtttcaaagaaggagggcggagcaatgtacgcggatgacacggccggttgggacacccgcatcaccctggaggacctcaagaacgaagagatggtcactaaccacatgaagggggaacacaaaaagctggccgaagccattttcaagctgacgtaccagaacaaggtggtcagggtgcaacgcccaacaccccgggggaccgtcatggacatcatttcacggaaggaccaacgcggttcaggccaagtcggaacctacggcctcaacacgttcacaaacatggaggctcagttgatccggcagatggagggggagggcatcttcaagagcatccagcgcctgaccgtgaccgaagagatagcggtgcaaaactggctcgcccgggtaggccgcgagcggctgtccaggatggccatcagcggggacgattgcgttgtcaaacccctggacgatcggtttgcgtccgccctaacggcgcttaatgacatggggaaggtccgcaaggacatacagcaatgggagcccagtcgggggtggaacgactggacccaggtgcccttttgcagtcaccatttccacgaactggtgatgaaggacggccgcgtcctagttgtgccgtgccggaatcaggacgagctgatcggccgagcccggatctcccagggagcggggtggtccctgaaagagaccgcctgtttaggaaagagctacgctcaaatgtggactttaatgtacttccatcgccgggacctgcgcctcgcagctaacgccatttgctctgccgtacccagccactgggtgccaacgtcccggacaacctggtccatccacgctaaacacgagtggatgactacggaggacatgctggccgtgtggaaccgggtgtggatccaagagaacccctggatggaagacaagacgccggtggagagctgggaggaggtgccctacctgggaaagcgtgaagaccaatggtgcgggagcctcatcggcttaaccagccgggccacctgggccaagaacatccagacagctatcaaccaggtccgttccctaattgggaatgaagagtataccgactacatgcccagcatgaagaggtttcgaaaagaggaggaggaagcgggagttctctggtaa

SEQ ID NO: 25239 - RNA, 9876 nt, synthetic construct
  misc_feature 1..9876: note = derived and/or modified CDS sequence (opt11) from DENV-2__EU687240__SS-prME
  source 1..9876: mol_type = other RNA
acggtgggagtcatcataatgttgatccccacggccatggccttccatttgacaacccgcaacggagagccacacatgattgttggccggcaggagaaggggaaaagtctgttgttcaagaccgaggacggagtgaacatgtgcacactcatggcgatcgacctgggcgaactatgtgaagacaccatcacctacaagtgccccctgctgaggcaaaacgagcctgaggatatcgactgctggtgtaacagcaccagcacctgggtcacctacggcacctgtacaacgacgggcgaacaccgtcgcgagaagaggtcagtggcactggtcccccatgtgggcatgggtctcgaaaccagaaccgagacttggatgagctcagaaggcgcgtggaagcacgtgcagcggatcgagacctggatactacgccaccctgggttcacaatcatggccgccatcctagcatacaccataggaaccacacacttccaacgcgctcttatcttcatcctgctgacagccgttgccccctcgatgacaatgcgctgcataggcatctcgaatcgagacttcgtggagggtgtttctgggggctcctgggtcgacatcgtactagagcacggttcctgcgtgaccactatggcgaaaaataaacccacccttgacttcgagctaattaagactgaagctaaacaacccgccactttgcgcaagtactgcatcgaggccaaactgaccaatactacgaccgagagccgatgcccgacacaaggagaaccctcactaaacgaggaacaggacaaacgcttcatatgcaagcactcgatggtcgaccgtggctggggcaacggatgcggcctcttcggcaagggcgggatagtaacttgcgctatgttcacgtgtaagaagaacatggaggggaaggtggtgctgcctgagaacttagagtacaccatcgtgattacgccccactcaggggaggagcatgcggttggcaatgacacagggaagcacggaaaggagatcaagataacaccccagtcaagtatcacagaagcagaacttacagggtacggtacggtgaccatggagtgtagcccccggaccggcctagactttaatgagatggtcctgctccaaatggaggacaaagcatggctggttcaccggcagtggttcctggaccttcccctcccctggctgcctggggcggacacgcagggaagcaactggatacagaaggagacgctagtgactttcaagaatccccatgccaagaagcaggatgtcgtggtcttagggtcgcaggaaggcgcaatgcacaccgccctcaccggcgccaccgagatccagatgtcatcgggcaatctactgttcacgggccaccttaaatgcagactccggatggataaacttcagctgaaggggatgtcctatagtatgtgcaccggcaagtttaagattgtgaaggagatcgcggaaacccagcacggtactatcgtgatccgggtccaatacgagggagacggctccccctgcaagattccattcgaaatcatggacctcgagaagcgccatgtgctggggcgtcttatcaccgttaacccgatcgtgacggagaaggactcgcccgtgaacattgaggcagaacccccattcggagactcctacattatcatcggggttgagcccggccagttgaaattaaactggtttaagaaggggagctccatcggccagatgtttgagacgacgatgcgcggcgctaaaagaatggcaatactgggggacaccgcctgggacttcggctctctcggtggggtattcacctctataggaaaagctctacaccaagtttttggggccatctacggcgccgccttctccggcgtgtcttggacaatgaagatcttaattggagttatcatcacctggataggcatgaatagtcgtagcacatcgttaagtgtgagtctggtcttagtaggcgtagtaaccctttacctcggggtgatggtgcaggccgactcgggttgtgtggtgtcatggaaaaacaaagaattaaagtgtggatcaggaatcttcatcacagataacgtgcacacatggaccgagcagtacaaattccaacctgagagccccagcaaattagcctccgcgattcaaaaggcccacgaagagggcatatgcgggattaggtctgtaaccaggctcgagaatttaatgtggaaacagatcacccccgagctgaaccatatcctttccgaaaacgaggccaaattgacaatcatgacaggagacattaaggggatcatgcaggccggcaaacgatcattaagaccccaacctacagaattgaaatatagctggaagacctggggcaaggcgaaaatgctgtccacggagtcacacaaccagacttttctgatcgacggccccgaaaccgcagagtgtccgaacaccaacagggcttggaacagcctggaggttgaggattacggtttcggggtcttctccacaaacatctggctgaagctgcgcgagaaacaggatgtattttgtgattcgaagctaatgtccgccgctattaaggataaccgagcggtccacgccgatatgggctactggatagaatcggccctgaacgacacttggaaaatggaaaaagcgtccttcatcgaaatcaagagctgccattggcctaaatcacacacgttgtggagtaacggtgtgctcgagagtgagatgattatcccgaagaactttgccgggcccgtcagccagcacaactatcgcccgggctaccacacccagacggcgggcccttggcacttaggaaagctggaaatggacttcgatttctgtgaggggacgaccgtcgtggtgaccgaggactgcggaaatcgcggccccagcttgcgcaccacgaccgcgtctggcaagctaattaccgagtggtgctgccggagctgcaccctgccacccctgcgctaccggggtgaggacggatgttggtacggcatggagatccgacccctgaaggagaaagaggagaatctggttaattccctggtgaccgctggccatggccagatcgacaatttttcactaggcgtgctgggcatggccctcttcttggaggagatgcttcgtacgcgggtcggcacgaaacacgctatactcttagtggcggtttctttcgtaaccttgatcaccgggaacatgtcatttcgggacctgggaagagtcatggtgatggtaggggccactatgaccgatgacatcggtatgggtgttacgtacctggccctgctcgctgcgttcaaggtgcgccccactttcgcggctggcctcctgctacggaaactgacctcaaaagagttaatgatggcaacgatcggcatcgcgttactgagccagtccactatcccggaaacaatcctggagctcacggacgccctcgcgctggggatgatggtgcttaagatcgtgcgaaacatggagaagtaccagctggccgtgacaatcatggccatcagttgcgtgccgaacgccgtaatcctgcagaatgcatggaaggttagttgcaccatactggctgccgtgagcgtgagtcccctgctgttaacgagctctcagcaaaaggccgattggatacccttggctctgacgattaagggcttgaaccccacggctatcttcctgacgacgttgagccgcacgagcaagaagcgcagctggccactcaatgaggccgtcatggcagtcggcatggtttccatacttgcaagcagcctcctcaagaacgacatccctatgaccggaccgctggtggccggcggcctgctcaccgtctgctatgtgctgacaggtcgcagcgcggacctcgagctcgagcgcgccgcggacgtaaagtgggaggatcaagccgaaatcagcggaagtagccctatcctgtctataaccatcagcgaagatgggtccatgtccatcaagaatgaggaggaggagcacactttgacaattctcataaggacgggcctgctggtgatatctggggtctttccggtgtctatccccatcacggcggccgcgtggtacctctgggaagtcaagaagcagcgcgccggcgtgctctgggacgtcccatcgccgccgccagtgggtaaagcggaacttgaggacggcgcctatcgtatcaagcaaaggggcatattcggctactcgcaaataggcgcgggggtgtataaggaaggtacattccacaccatgtggcacgtcaccagaggggcagtactcatgcaccgcggcaagcggatcgagccctcctgggccgacgtgaagaaggacctgattagctacggaggcggctggaagttagagggggagtggaaggagggagaggaggtccaggtgctagccctagaaccggggaaaaacccccgtgccgttcaaactaagcccggcctgttcaaaacaaacaccggcaccattggcgccgtgtccctcgatttcagccccggcacgtccggcagtcccatcgtggaccggaagggtaaggtggtaggtctgtacgggaatggcgtagtcacgcgcagtggagcttatgtctcagcaatcgctcaaacagagaaaagtattgaggataaccccgagatcgaggacgacatctttagaaagaaacgcttaacaatcatggacctccaccccggggcgggaaaaacgaaacggtacctccccgcaatcgtgcgcgaggcaatcaaacggggactgagaaccctgatcttggcccccacccgcgtcgtcgccgcggaaatggaggaagcactcagagggctccccatccgctaccagacgcccgccatcagagccgagcatacgggtcgtgaaatcgttgacctcatgtgccacgccaccttcaccatgcggctgctgtcccctgtgcgcgtgccaaattataacctcatcatcatggacgaggcccactttaccgatcccgcgagcatcgccgctagaggctacatcagcacgagagtggaaatgggggaggccgcgggcatcttcatgacggccacaccgccaggcagtagagatcctttcccgcagtccaacgcccccatcatggatgaagagagggagatccccgaacgaagctggaacagcggccacgagtgggtgaccgacttcaaagggaagacggtatggttcgtaccgagcatcaaggctggtaacgacatcgctgcctgcctccgcaagaacggcaaaaaggttattcagcttagccggaagacttttgacagtgaatacgtgaagacgcgcgccaacgactgggacttcgtggttacgacggacatctccgagatgggcgccaactttcgggctgagagggtgatcgacccaaggaggtgcatgaagcccgtgatcctaaccgacggggaggagcgcgtgattctggcagggcctatgccggtcacgcacagctcggcagcccagagacgcggccggattgggcgcaacccgaaaaatgagaacgatcaatacatctacatgggcgagccacttgagaatgacgaagactgtgcccactggaaggaagccaagatgcttcttgacaacattaacacccccgaaggcattataccgagtatgtttgagcctgaacgcgagaaggtggacgcgatagatggcgagtaccgcctacggggtgaggcaagaaagacgttcgttgatcttatgcggcggggcgacctgcccgtctggctggcttatcgggtcgccgccgagggtatcaactatgcggatcggagatggtgttttgacgggataaagaacaaccaaatcctggaggaaaatgtggaggtggagatctggactaaggaaggcgaacgtaaaaagctgaagccgcggtggcttgacgcacgcatctactccgatcccttggccctgaaagagttcaaagagttcgcggcaggccgaaagtcgctcactcttaacctgatcacagagatggggaggcttccaacatttatgacacagaaagcccgcgatgccctcgacaacctggccgtactacataccgccgaggttggcggtcgcgcgtataatcacgcgctttccgaactcccggagacactggagacgctcctactgctaacactgctggccaccgttaccggcggcatctttctcttcctgatgagcggaaagggcatcggtaagatgacgctcgggatgtgctgtatcataaccgcctcaatattgctgtggtacgcccagattcaaccgcactggatcgcagcatcgataatcttggagttctttctcatcgtattactgatccccgagcccgagaagcagcggacgccccaggataaccaactcacctacgtcgtgatcgcaatcctgaccgtcgtcgcagcaaccatggccaatgaaatggggttcctggaaaagactaagaaggacttgggtctgggcagcattacgacccaggagtccgagagcaatatactggacatcgacctccgcccggcctcggcctggacgctttatgccgttgccaccactttcgtgacccccatgctgcggcactccatcgaaaattccagcgtcaacgtttccctcacggcgattgctaatcaggcaaccgtccttatgggacttggacgcgggtggcccctgagcaaaatggacattggcgtccctctgctagcaataggctgttactcccaagtgaaccctataactttgacggcagccctgcttctcttagtggctcactacgccattatcggcccaggactccaggccaaggcgacgcgcgaagcccagaagcggactgccgccggcataatgaagaaccctaccgtcgacggcatcacagtaatcgatttagagccgatcccgtacgacccaaaattcgaaaagcaattagggcaagtgatgttgctagttttgtgtgtgactcaggttctgatgatgcgaaccacatgggccttatgtgaggcactgacactcgcaaccggcccaatctcaactttgtgggaggggaatccggggcggttctggaacaccaccatcgcagtgtccatggccaacatatttcgaggcagctacttggcaggggcgggcctcctgttctcgataatgaaaaacaccaccaatacgcgaagaggaacaggcaacataggcgagaccctgggagagaaatggaagtccaggctgaacgctttgggcaagtcagagttccagatctataagaagtctgggatccaagaggttgatcgcaccctggctaaagaaggcatcaagcgaggggagaccgaccaccatgccgtctcccggggcagcgcaaagctgcgctggttcgtggagcgcaatatggtaaccccggaaggcaaggtagtcgacctcgggtgcggcagaggcgggtggagttactattgcggcgggctgaagaatgtacgcgaagtaaaagggcttacgaagggcggaccgggtcacgaggagccgatccccatgagcacctatggatggaacctcgttcggctgcagagcggtgtggacgttttctttactcctccggaaaagtgtgacaccctgctctgcgatatcggagaatcctcacccaaccccaccatcgaggctggccggaccttacgcgttctgaacttggtggagaactggttaaacaacaacacccagttttgtatcaaggtgctaaacccctacatgccctcggtcatcgaaaagatggagactctgcaacgcaagtacggcggcgccctggtacgaaacccccttagccgtaactccactcacgagatgtactgggttagcaacgcaactggcaacatcgtctccagtgtgaacatgataagtcgtatgttaataaatcgtttcaccatgaagcataagaaagccacatacgagccggacgtggacctcggcagtggcacccgtaatataggcatagagaacgagataccaaacctcgacatcatcgggaagcgcatcgagaagatcaaacaggagcacgaaacttcatggcactacgatcaggaccacccctacaagacctgggcgtaccacgggtcatacgaaaccaagcagaccggttcggctagcagtatggtcaatggggtcgtcaagctgttaacgaagccctgggatgtcgtaccgatggtcacccaaatggccatgactgataccactccgttcggacaacagcgtgttttcaaagagaaggtggacactcggacccaggagccaaaggagggcaccaaaaagctgatgagaatcaccgccgaatggctgtggaaggaactcggcaaaaagaagactcctaggatgtgcacccgagaggagttcacccggaaggttcgaagcaacgccgccctgggagctatctttacggacgagaacaagtggaagtccgcccgcgaggccgttgaggacagtcgcttctgggagttggtggaccgtgagaggaacctacatctggagggtaaatgcgaaacttgcgtatacaacatgatgggaaagagagagaagaagctaggggagttcggcaaggcgaagggaagtcgcgccatctggtatatgtggctgggcgcccggttcctggagttcgaggctctggggtttctcaacgaagatcactggttcagccgcggtaacagcctgtccggagtcgagggagagggcctacataagctcggctatattctaagggatgtatcgaaaaaggagggcggagcgatgtacgctgacgacaccgccgggtgggatacccgcataacgctggaagatttaaagaacgaggagatggtgaccaaccacatgaaaggcgagcacaagaaactagccgaagcgatcttcaaattgacgtaccagaacaaggttgtgcgagtacagcgacccacgccccggggcaccgtgatggacataatcagtcgtaaggatcaacgtgggagcgggcaggttgggacatacggcctcaacacttttacaaatatggaagcccagctgatccggcaaatggaaggcgagggcatttttaagagtattcagcgcctgaccgtcaccgaagaaatcgcagtccaaaactggctcgcccgggttggccgtgaacggctgagccggatggctatctctggggacgactgcgtcgtgaagcctctggacgatcggtttgccagcgcattaaccgcgttgaacgacatgggcaaggtgcgcaaagacatccagcagtgggaaccctcccgcggctggaatgattggacccaagttccgttctgtagccaccatttccacgagctggtgatgaaggacggccgcgtattagtcgtcccctgtcgcaaccaagatgaactcatagggcgcgcacggatcagtcaaggcgctggctggtccctgaaggagacggcgtgtctcggtaaatcttacgcacagatgtggacactcatgtacttccaccgccgcgacttgaggctcgcggccaacgcaatatgcagcgcggtgccaagccattgggtccccaccagccgaacaacctggtccatccatgcgaagcacgagtggatgacgacagaggacatgttagcggtgtggaaccgcgtgtggatccaggagaacccctggatggaagacaaaacgcccgtcgagagctgggaggaggtgccatacctgggcaaacgcgaggaccagtggtgcgggtcacttattgggcttacatcccgagccacgtgggcgaagaatatccagacagcgatcaaccaggtgcgaagcctgatcgggaacgaggagtacacggactatatgccctcgatgaagcgattccgcaaagaggaagaagaggccggtgtcctctggtga

SEQ ID NO: 25240 - RNA, 9876 nt, synthetic construct
  misc_feature 1..9876: note = derived and/or modified CDS sequence (opt11) from DENV-2__EU687241__SS-prME
  source 1..9876: mol_type = other RNA
accgccggcgtgattataatgctgattccaaccgccatggcgttccacctcaccaccagaaacggagagccccacatgatagttggccggcaggaaaaggggaagtccctgctgttcaagaccgaagacggcgttaacatgtgcactctcatggccatcgacctgggcgaactgtgcgaggacaccatcacatataaatgccctcttctccggcaaaacgaacccgaggacatcgactgctggtgtaacagcaccagcacctgggtgacctacgggacctgcacaaccaccggggagcatcggcgggagaaacggtcagtcgccttagtgccccacgtgggcatggggctcgagacccggactgagacatggatgagcagcgagggcgcctggaaacacgtccagcggatcgagacctggatcctgcgccaccccggctttaccatcatggccgcgatcctggcttacagcatagggaccacccatttccagcgtgccctcatcttcatactgctgacggccgtggcaccgtctatgactatgaggtgcatcggaatcagcaatcgggactttgtggagggcgtctccgggggctcgtgggtggatattgtgttggagcacgggtcctgcgtcactaccatggccaaaaacaagccgacgctggacttcgagttgaccaagacggaggccaagcaacccgcgactttacgcaaatactgcatcgaggcaaagctgacgaataccactaccgagagcagatgcccgacgcagggcgagcccagtctgaacgaggagcaggacaagcgcttcatctgcaaacatagcatggttgaccggggctgggggaacggctgcggcctgttcggcaagggtgggatcgttacctgcgcgatgttcacgtgcaagaagaatatggagggcaaagtagtcctaccagagaatctggagtacactatcgtgatcacgccccacagtggggaggaacatgcagtggggaacgataccgggaaacacggcaaggagatcaagataacccctcagagctccataaccgaggccgagctcacgggttacggcacggtgaccatggagtgcagccccaggaccggcctagacttcaatgagatggtgctgttacagatggaagataaggcctggctggtccaccgccagtggttcctggatctccccctgccctggctgcctggagccgacactcaaggctccaactggatccaaaaggagacgttagtgacattcaagaacccacatgcaaagaagcaggacgtggtggtgctggggagccaagagggcgcaatgcacacagctctgaccggggccacggagatacaaatgagctccggcaacctgctgttcacaggtcacttgaagtgccgcctccggatggataagctgcagcttaagggcatgtcttactccatgtgcaccggaaagttcaagatcgtcaaggaaatcgccgagacccaacatgggacaatcgtgatccgcgtacagtacgagggggacggcagcccgtgcaagatcccctttgagatcatggatctcgaaaagcggcacgtccttggccgcctgatcaccgttaacccgatcgtgacagagaaggactcccccgtcaacatcgaggcggaaccgcctttcggcgattcttacatcatcataggggtggaacccggccagctcaaactgaactggttcaagaagggctccagcattggtcagatgttcgagaccacaatgcgaggtgcgaagcggatggccatacttggtgataccgcctgggatttcggctccctcgggggggtattcaccagcatcgggaaggctttacaccaggttttcggcgcgatctacggcgccgccttctcaggggtaagctggaccatgaaaatcttgattggggtcatcattacatggataggtatgaactcccgctccacctccttgagcgtgtctctcgtactggtgggagtcgtgaccctctaccttggggtgatggtccaagctgacaccggctgcgtggtgagctggaaaaataaagagctgaagtgcggttccgggatctttataactgataacgtgcacacctggacggaacagtacaaattccagcctgaaagccccagcaagctagcgtccgcaatccagaaggcccacgaagagggcatctgcgggatccgcagcgtgacgcgcctcgagaacctgatgtggaagcagatcacccctgaactaaaccatatcctctccgaaaacgaggtgaagttgaccatcatgactggcgacatcaaggggatcatgcaggccggcaaacggtcattacgcccgcagcccactgagcttaagtatagttggaaaacgtggggcaaggccaagatgctaagtacagagtcccacaaccagacgtttctgattgatgggcccgaaaccgcggagtgtccaaatacgaaccgggcctggaatagcctagaggtcgaggactacggattcggagtgttctccaccaatatctggctgaaactgcgcgaaaagcaggacgtgttctgcgacagtaagctcatgtctgctgcaatcaaggacaatcgagcagtgcatgcggacatggggtactggatcgagagcgcactcaacgacacctggaagatggagaaggcctcgttcatcgagattaagagctgccactggcctaagagccacaccctgtggagcaacggggtgctcgaatctgagatgatcatccccaagaactttgcggggcccgtgtcccagcataactatcgcccgggataccacacgcaaaccgccgggccctggcacttaggcaagctggagatggacttcgacttctgcgagggcacgaccgtggtggtgaccgaggactgcggtaatcggggcccgagcctccgcacgacgaccgcgtcggggaagctgataaccgagtggtgctgcagatcgtgcacgctcccccctctccgttataggggcgaggacggttgttggtacggcatggagatccgtcccctgaaggagaaggaggagaatcttgtgaactcactagtcaccgcagggcacggccagatcgacaacttcagtctcggagttcttgggatggcgcttttcttggaggagatgctgcggacccgcgtcggcaccaaacatgctatcctcctggtggcggtgtccttcgtcactctgatcacagggaacatgagcttccgagacctcggccgcgtgatggtaatggtcggggcgactatgaccgatgacatcggcatgggcgtgacgtacctggcgctgctcgccgccttcaaggtacggcccaccttcgccgctggcctgctgcttagaaagctgactagcaaggagctgatgatggccactataggcatagccctcctgagccagtccacgatccccgagaccatcctggaactcaccgatgccctggcgctggggatgatggtcctcaagatagtgcgcaccatggagaagtatcagctggccgttacgatcatggcgatctcatgcgtcccgaacgcggtcatcctgcagaatgcctggaaggtgtcctgtacgatccttgcggccgtcagcgtcagccccctgctgctgacgtcgtcccagcagaaggccgactggattccactggccctgaccatcaagggtctaaaccccacagccatcttcctgactaccctgagccgtacctccaaaaagcgctcgtggccactgaatgaggccgttatggccgtgggaatggtgtctattctggccagcagcctgctcaagaacgacatccccatgacggggccgttagttgccggcgggctgttgacggtgtgctacgtcctgacgggcagatcggcggacctggagctcgagcgcgctgccgacgtcaaatgggaagatcaagccgaaatcagcgggagcagccccatcctttccatcactatctccgaagatggttcgatgagcatcaagaatgaagaggaggagcacacactgaccatcctcattcggaccggtctcttagtcatctccggtgtgttcccggttagcatccccattacggccgcggcgtggtacctctgggaggtaaagaagcagcgcgccggcgtgctctgggacgtcccctcaccgccgcccgtcgggaaggccgagctggaagatggcgcctaccggatcaagcaacgtggcatcttcggctacagtcagatcggcgctggggtgtacaaagaaggtaccttccatacaatgtggcatgtcacccgtggtgctgtgctcatgcaccgcggcaaacgaattgagccctcctgggccgatgttaagaaggacctgatatcctacgggggcggctggaagctggaaggggaatggaaagagggagaagaggtccaggtgctcgcgctggagcccgggaagaaccccagggctgtccagaccaagcccggcttattcaagaccaacactgggaccatcggcgcggtctccttggacttctcgcccggcaccagcgggagtcccatcgtcgatcggaagggcaaggtagtcgggctgtacggcaacggtgtggtgacccgctcaggggcgtacgtaagcgccattgctcaaacggagaagtctatcgaggacaacccagaaattgaggacgacatcttccggaagaagcgcctgaccatcatggatttacaccccggcgcggggaaaaccaagcggtacctgcccgccatcgtgcgggaggccatcaagcgaggcttacggaccctgatcctcgctccaaccagggtggtcgcggcggagatggaagaggccctgcggggactgcccatccgataccagaccccggccatccgggcggagcacaccggccgcgagatcgtggatttgatgtgccacgccaccttcacgatgcgcctactgtccccagtgagggtcccgaactacaacttaatcataatggacgaggcgcacttcaccgaccccgcaagtatcgcagcacggggctacatctccacccgcgttgagatgggtgaggccgcgggcatcttcatgacagcgacgccgcccgggagccgggacccgttcccccagtccaacgcccccatcatggacgaagagcgcgagatcccagagcgcagctggaactcaggccacgaatgggtgaccgacttcaaagggaagaccgtctggttcgtgccgagcatcaaagcaggtaatgacatcgcggcctgcctgagaaagaacggcaagaaagtgatccagctgtctcggaagacattcgactcggagtatgtcaagacgcgtgccaatgactgggacttcgtggtgacaacagacatcagcgagatgggagccaacttcagagccgagagagtcatcgacccccgacgctgcatgaagcccgtgatcttgaccgatggagaagaacgtgttatcctggcggggcccatgccagtcacgcactcttccgccgcccagcgcagaggacggatcgggcgcaaccccaagaatgaaaacgaccagtacatctacatgggcgaacccctggagaatgacgaggactgcgcccactggaaggaggccaagatgctccttgataacattaacacccccgagggcatcatcccttctatgttcgaacccgagcgagaaaaggtggacgcaatcgacggggagtaccgcctgcggggagaggcccgcaagaccttcgtggatctcatgcggaggggggatctgcccgtctggcttgcctaccgtgtcgctgccgagggcatcaactacgctgaccgccggtggtgcttcgacgggatcaagaacaaccaaatattagaggaaaacgtcgaggtcgaaatttggaccaaggagggcgagcgtaagaagctgaagccgcgttggctggacgcgcgcatctactccgaccccctcgccctaaaagaattcaaagagttcgccgctggccgcaaatccctgacgctcaatctgatcaccgagatggggcgcctccccacctttatgacccagaaggcgcgggatgcactcgacaacctggcggtactccacacggcagaggtaggcggccgcgcgtacaaccatgccctcagtgagctgcccgagaccctggagaccctcctgctgcttacactgctggccaccgtgacgggcggaattttcctcttcttgatgagcggcaagggcatcggtaagatgaccctgggcatgtgctgcatcatcaccgcctccatcttactatggtacgcccagatccagcctcattggatcgctgctagcattatcctggagttcttcctaatagtgctgctaatccccgaacccgagaagcagagaaccccccaggacaatcagctcacgtacgtcgtaatcgccatcctgaccgtagtcgccgcaaccatggctaacgagatggggttccttgagaagacaaagaaagacctcggtctggggtccataaccactcaagagtctgaaagcaatatcttagacattgacctccgaccggcctcggcatggaccctgtacgccgtggccaccacgttcgtgacccctatgttgcgccacagcatcgagaactccagcgtcaacgtgtccctcactgcgatcgccaaccaggcgaccgtactgatggggctgggccgtgggtggcccctcagtaagatggacataggagtccctcttctagccatcgggtgctactcgcaagtgaacccgatcacgttgacagccgccttgctgctcttggttgcccattatgccatcatcggccccggcctgcaggctaaagcgactcgcgaggctcagaagagaaccgccgcggggatcatgaagaaccccaccgtggatggcataactgtaattgacctcgagccaatcccgtacgacccgaagttcgagaaacaacttggccaggtcatgctgctggtgttatgcgttactcaagtgctgatgatgcgcaccacgtgggccctctgcgaggccctgacgctggctaccggccccatcagcacgctctgggaggggaaccccggacgattctggaacacgacgatcgccgtcagtatggcgaatatttttcgcggatcctacttggcaggggcgggcctgctcttttccatcatgaagaacaccacgaacacaagacgcgggaccgggaacataggcgaaacgctgggcgaaaagtggaaatcccggctgaacgcgctcggcaagtccgagttccagatctataagaagtccggtatccaggaagtagaccgaacccttgccaaggagggtatcaagcgaggggagacggatcaccacgccgtctcccgtggcagcgcgaagctgaggtggttcgtcgagcgcaacatggtgacaccggagggcaaggtggtcgacctcgggtgcggccgcggcgggtggagctattactgcggcgggctgaagaacgtgcgcgaggtgaaggggctgaccaaggggggccccggccacgaggagcccatccccatgagcacctatggctggaatctcgtccggctccagagcggggtggacgtgttttttacgccgcccgagaagtgtgacactctgctctgcgacatcggcgagtcctcacccaaccctacaatcgaggccggccgcactttgcgggttctgaacctcgtggagaattggctgaacaacaatacgcagttctgcgtgaaagttctgaatccgtacatgccctcagtaatagagaagatggagacgctccagcgcaagtatgggggggcgctggtgcggaaccccttatcacgcaattccacccatgagatgtactgggtcagcaatgccaccgggaacatcgtgtccagcgtgaacatgatctcccgaatgctcatcaaccggttcaccatgaagcacaagaaggccacgtacgagccggacgtagacctcggctcggggactaggaacatcggcatcgaaaatgagattcccaacctggacattattggcaaacggatcgagaagatcaagcaggagcacgagacttcctggcactacgaccaggaccacccctacaagacctgggcttaccatggctcgtacgagacaaagcagacagggtctgcctcctcaatggtgaacggggtggtaaagctattgaccaagccgtgggatgtggtgccgatggtaacccaaatggccatgacggatactacccccttcgggcaacagcgcgtgttcaaggagaaagtggatacccggacgcaggagccgaaggaaggtactaagaaactcatgcgcataaccgccgagtggctgtggaaagagcttggaaagaagaagacgcctcggatgtgcacacgcgaggaattcacccggaaagtacgcagcaacgccgcgctgggcgccatcttcacagacgagaacaaatggaagtccgctagggaggctgtggaggacagccgtttctgggaactggtcgaccgggaacgcaacctacacttggaggggaagtgcgagacgtgcgtgtacaacatgatgggcaagagggagaaaaagctgggtgagttcggcaaggccaaaggctcccgcgcgatatggtacatgtggctcggggcccggttcctggagttcgaggccctgggctttctaaacgaggatcactggttcagccgagggaactcgctatccggcgtggagggggagggcctgcacaaactcggctacattctgcgggatgtcagcaagaaggaaggcggcgccatgtacgcggacgacacggccgggtgggacacccgcatcaccctggaggacctcaagaacgaggagatggtgaccaaccatatgaagggagagcacaagaagctggccgaggccatctttaagctgacttaccagaataaggtggtccgggtgcagcgcccgacgccccgcgggactgtgatggatattatatccaggaaggatcaacgcggatcgggccaggtcgtgacctatgggctcaacacgtttaccaatatggaagcccagctgatccggcaaatggagggcgaggggatcttcaagagcatccaacgcctgacagtgactgaggagatcgcggtccagaactggctcgcccgggtgggacgcgaacggctgagccgcatggccatctccggcgacgactgcgtggtaaagccactcgatgacagattcgcgagcgccctcacggcgcttaacgatatgggcaaagtgaggaaggacattcagcagtgggaacctagccggggctggaacgattggacccaggtacctttctgttcccaccattttcacgaactggtaatgaaggacgggagggtgcttgtggtcccttgccgcaaccaagacgagctcatcggccgcgcccggatatcacagggggccggctggagcctgaaggagaccgcctgcctcggcaaatcctacgctcagatgtggacactgatgtacttccaccgccgggacctgaggttagcggccaacgccatctgtagtgcagtgccctcccactgggtgccaaccagccggacgacgtggtccatccacgccaaacatgagtggatgaccaccgaagacatgctggccgtctggaaccgcgtgtggatccaggagaacccatggatggaagacaaaacacccgtggagagctgggaggaggtgccatacctggggaagcgcgaggaccaatggtgtggcagccttatcgggctgacctccagagccacctgggccaaaaacatccagacggccatcaatcaagtccgcagcctgatcggcaatgaggagtatacggactacatgccctccatgaagagattccgcaaggaggaggaggaggcgggggtgctttggtaa

SEQ ID NO: 25241 - RNA, 9876 nt, synthetic construct
  misc_feature 1..9876: note = derived and/or modified CDS sequence (opt11) from DENV-2__EU687242__SS-prME
  source 1..9876: mol_type = other RNA
accgctggcgtaatcataatgctgatccccaccgccatggcgttccacctgaccacccgcaacggggagccccacatgatcgtaggccggcaggagaaaggtaaatccctgctgtttaagaccgaagacggtgttaacatgtgcaccctcatggccatcgatctgggggagctgtgtgaggacaccatcacctataagtgcccgctcctccgccaaaacgagcccgaggacatcgactgctggtgtaacagcaccagcacctgggtgacatacgggacctgcaccaccacgggcgagcatcgtagggagaagcggtctgtcgccttagtgccccacgtggggatgggcctcgagacccgaaccgagacctggatgagtagcgaaggtgcctggaagcatgtccaacggatcgagacgtggatactgcgacacccgggcttcacaatcatggcggcgatcttagcctacactatcgggaccacccacttccagcgggcgttaatttttattctgttgactgcggtagctcccagcatgaccatgcgctgcatcggtataagcaaccgtgatttcgtggagggcgtaagcgggggctcttgggtggacatcgtgctggaacacgggagctgcgtcacaacgatggccaagaataagcccaccctggacttcgagctgatcaagacggaagccaaacagcccgccaccctcaggaagtactgcatcgaggcaaaacttacgaacaccaccactgagtcccggtgccctacgcaaggcgagccctctctgaacgaggaacaagacaagcgcttcatctgcaagcactccatggtggaccggggctgggggaacgggtgtggtctgttcggcaagggcgggattgtgacatgcgcgatgttcacgtgcaagaagaatatggaggggaaggtcgtgttgcccgagaatctggagtacaccattgttatcacaccccactctggggaggagcacgccgtaggcaacgacacgggtaagcacggcaaggagatcaaaatcactccgcagtccagcataaccgaagcggaattaaccgggtacggcaccgtcacaatggaatgcagcccccggacgggcctggacttcaacgagatggtcctgctccagatggaggataaagcctggcttgtccaccgccagtggttcctggacctcccgcttccctggctgcccggggccgatacccaggggagcaactggatacaaaaggaaaccctcgtgaccttcaagaatccccacgcgaagaaacaggacgtggtcgtattagggtcccaggagggagccatgcacacagcactgaccggggctactgagatccagatgagcagcggcaacctcctgttcaccgggcacctgaagtgtcggctccggatggataagctgcagctcaaggggatgagctattccatgtgcaccggcaagtttaagatcgtaaaggagatagcggagacccagcatggcaccatagtcatccgcgtgcagtatgagggcgatggatcgccgtgtaaaatccccttcgagataatggatctcgagaagcggcacgtcctggggcgcctcatcaccgtgaaccctatagtcaccgagaaggatagccccgtcaatattgaggccgagccgcccttcggtgactcctacataataataggggtggagccgggccagctcaagctcaactggtttaagaaggggagctccatcggccaaatgttcgaaaccacgatgcgcggggcaaaacggatggccatcctgggggacaccgcgtgggatttcggcagccttgggggcgtgttcacctccatcgggaaggcactccaccaagtctttggagcgatatatggcgcggcttttagcggcgtgagctggactatgaaaatcctgattggcgtgatcataacgtggatcggtatgaactctaggtccacatccctgtccgtcagcctcgtactggtcggcgtagtgactttatacctaggggtgatggtccaggcggacaccggctgcgtggtgtcctggaagaataaagaactcaagtgtggatcagggatattcatcacggataacgtccacacatggaccgaacagtacaagttccagcccgagagtcccagcaagctggcgagcgccatccagaaagcacacgaggaaggaatctgcgggatccggtccgtcacccgcctagagaacctaatgtggaaacagatcacgcccgagctaaaccacatcctaagcgagaacgaggtgaagttgaccatcatgaccggcgacatacgggggatcatgcaggctggcaagagatcccttcggccgcagcccacagagctcaagtacagctggaagacgtggggcaaggccaagatgctgtcgaccgagtcgcataaccagaccttcctgatcgacggtcccgagactgctgaatgtccgaacacaaacagggcctggaacagtctcgaggtcgaggactacggcttcggagtcttttctaccaacatctggctgaagctgcgggagaagcaagatgtgttctgtgattctaagctcatgtctgccgccatcaaggacaaccgtgcggtccacgcagacatgggctactggatcgagtccgcactgaacgacacctggaaaatggagaaggcatcctttatcgagatcaagagctgctactggcctaagagccacaccctctggtcgaacggcgtcctcgagtccgagatgatcatcccaaagaactttgccgggcccgtgtcccagcataattataggcctgggtaccacacccagaccgccgggccatggcacctgggcaagctagagatggacttcgacttctgcgaggggaccactgtcgtggtgactgaggactgcggcaaccgagggcccagcttacggacgactaccgcgtcagggaagctgattaccgaatggtgctgcagaagctgcacactacccccgctgcggtaccgcggagaggacgggtgctggtatggcatggagatccggcccctgaaggagaaagaggaaaacctggtaaacagcctcgttaccgctgggcacggccagatagacaactttagtttaggcgtgctggggatggcactcttcctggaggagatgctgcgaactcgggtcggcaccaagcatgctatcttactggtggcggtgagttttgtcaccctgatcaccggcaacatgagttttagggacctcgggcgggtgatggtgatggtcggtgcaaccatgacagatgacatcggcatgggcgtgacgtatttggccctgctggccgcctttaaggtgaggcccacattcgcggccgggctactgctccgcaagctgacttcgaaggagctgatgatggcaaccattggcattgcccttctatcccagagcacaatccccgaaacaatattggagttaaccgacgctctggcgctggggatgatggtcctcaaaatagttcggaacatggagaagtaccagctggcagtgactattatggcaatctcctgcgttcctaatgccgtgattctgcagaacgcctggaaggtaagttgcaccattctggcggccgtctccgtcagccccctcctgctcacgtcctcacagcagaaagcggattggatccccttggccctgactattaagggcctcaaccccaccgcgattttcttaactactctgtcccgcaccagcaagaaacggtcctggccgctcaatgaggcggtaatggccgtcggcatggttagcatcctggcctccagcctgctcaagaacgacatccctatgactgggcctctcgtggccggcgggctgttaacggtctgctacgtgctgactggacgctcggcggacctggagctcgagcgagcagccgacgtcaagtgggaggaccaggccgaaatctccgggagctcccccattctctcaatcactatctcagaggacggcagcatgagcatcaagaacgaggaggaggagcataccctcaccattctcatccgcaccggcctgttggtgatcagcggggtgttcccggtctccatccccatcacggccgcggcatggtacctctgggaagtgaagaagcagcgggccggcgtcctgtgggacgtccccagcccgccacccgtgggcaaggccgaactggaggacggcgcctaccgaataaaacagagaggaatctttggctactcccaaatcggtgcgggggtgtataaggagggcaccttccacacaatgtggcacgtcacgcgcggggccgtattgatgcaccggggtaaacgcatagaaccgagctgggccgacgtgaagaaggacctaatttcatacgggggcgggtggaagctggagggtgaatggaaggagggggaggaagtccaggtgctcgccctcgagcccgggaagaaccccagggcggtccagactaagcccggtctgtttaagacaaacacagggaccatcggagcagtcagcctcgatttttcccctgggactagcgggtcaccaatagtggaccggaaggggaaagtggtcgggctgtacgggaacggcgtcgtaacgaggagtggggcttatgtctccgctatcgcccagacagagaagtccatcgaggacaatcccgagatagaggacgacatattccgcaagaagcggctgacgattatggacctccacccgggagcggggaagaccaagcgctatttacccgccatcgttcgtgaagccatcaagcgcggattacgcaccctgatcctcgcccccacccgggtggtcgccgcggagatggaggaagcactgcgcggactgcccattcggtaccagacgcccgccatccgcgccgagcacacgggccgcgagatcgtggacttaatgtgccacgccacctttacgatgcgcttgctgagccccgtgcgtgtcccgaactacaacctcatcatcatggacgaggcgcacttcacggaccccgcctccattgcggcccgcggctatatcagcacaagggtggaaatgggtgaggccgctggcatattcatgacagcaacgccacccgggtcccgcgacccgttcccccagagcaatgccccgatcatggacgaggagcgggaaatccccgaaagatcctggaacagcggccacgagtgggtgacagacttcaaggggaagaccgtatggttcgtgccgtcaatcaaggccggtaacgatattgctgcctgtctccggaagaacggcaagaaggttatccagctgtctcgcaaaaccttcgattccgagtacgtcaagacccgggccaacgactgggatttcgtggtgacgaccgacatcagcgagatgggggctaactttcgcgccgagcgagtcatagacccccgcagatgtatgaagcccgtcatcctgaccgacggcgaagaacgcgtaatcctggcgggaccgatgccggtcacgcattccagcgccgctcagcgccgaggccgcatcgggcggaacccgaagaacgagaacgaccagtacatctacatgggcgagcccctggagaacgatgaagactgtgcccactggaaggaggccaagatgcttttagacaatatcaataccccagagggaatcataccgtccatgtttgagcccgagagggaaaaggtggacgcgatcgacggggagtacagactgcgaggcgaagcccggaagacctttgttgacctcatgcgccgcggtgacctgcccgtctggcttgcctatcgagtggccgcagagggaatcaactacgcggaccggcgctggtgtttcgatggtatcaagaacaaccagattctcgaagagaacgtggaggtcgagatctggaccaaagagggggagcggaagaagctgaagccgcgctggctggacgctcggatctatagcgacccactcgccctgaaggagttcaaggagtttgccgcaggccgtaaatccctgaccttgaacctgatcacggagatgggcagactgcccactttcatgacccagaaggctcgcgatgcactcgacaatctagcggtattgcacaccgcagaggtcggagggcgggcatacaatcacgcccttaacgaactgcccgagacgctggagaccctcctgctgctaaccctcttagccaccgttacgggcgggatattcttgttcctcatgtcggggaaaggcatcgggaaaatgactctaggcatgtgttgcattatcaccgcctccatcctactctggtacgcccagatccagccgcactggatcgcggcgagcataatcctggagttcttcctgatcgtgctattaatccccgagcccgagaagcagcggactccacaagacaaccaactcacttacgtcgtgatcgccatcctgacggtagtcgcggccacaatggcgaatgagatggggttccttgagaagactaagaaggatctaggcctggggtccatcaccacgcaggagagcgagtctaatatcctggacatcgacctccgtccggcctccgcctggacactgtacgccgtggctacaacattcgtcacacccatgctccgccatagcatcgagaacagcagcgtgaatgtgtccttgacggcgatagccaaccaggccaccgtactcatggggttaggccgcgggtggcccctcagcaagatggacatcggcgtaccattgctggcgatcgggtgctactcccaagtcaacccgatcacactcacggcagccctgttgctcctcgtggcccactacgccatcatcggccccggcctgcaagccaaggccactcgggaagcccagaagcgtaccgccgccggaataatgaagaaccccacggtcgacggcatcacggtgatcgacctagagcccatcccgtacgaccccaagttcgagaagcagctgggccaagtgatgctgttggtcctgtgtgtgacccaggtgttaatgatgcgcaccacctgggctctctgcgaagccctgacgcttgcaacaggccccatttctacactctgggagggaaaccccggccgcttttggaacaccacgattgccgtaagcatggctaacatcttccggggcagctacctggctggggcgggcctattgttcagtataatgaaaaacacaacaaacaccaggcgggggacgggtaacatcggcgagaccctgggggagaagtggaaatcccgtctgaacgccctcggaaagtccgagttccaaatctacaaaaagtcggggatccaagaggtcgacaggaccctggcaaaggagggcatcaagcgcggtgagaccgatcaccacgccgtgtcccgcggcagcgctaaacttaggtggtttgttgagcggaacatggtgacgccggagggaaaagtagttgacctagggtgcgggagaggagggtggtcctactactgcggagggctgaagaacgtgcgggaggtgaagggcctgaccaaaggagggccagggcacgaggagcccatacccatgagcacctacggatggaacctcgtccgcctgcaatccggcgtggacgtcttcttcacaccacccgagaagtgcgacacgttgctctgcgacatcggcgagagcagccccaaccctacgatcgaggccggccggaccctccgtgtcctaaacttggtggagaattggctgaataacaacacacaattttgcgtgaaggtcttgaacccgtacatgccctccgtgatcgagaaaatggaaaccctccagcggaagtacggaggcgccctagtaagaaatcccctgagcagaaactccacgcacgagatgtactgggtctcaaatgcaaccgggaatatagtgtcctccgttaacatgatctcccgcatgctcatcaatcgcttcaccatgaaacacaagaaggccacctacgaaccggacgtagacctcggatcaggaacccggaacataggcatcgaaaacgagatccccaatctggacatcattgggaaacggatcgagaagatcaagcaggagcacgagacctcctggcactacgaccaggaccacccttacaagacgtgggcgtaccacgggagctatgagacaaagcagacaggctccgcttcctccatggtaaacggtgtagttaagctgttgaccaagccctgggacgtggtaccgatggtcacccagatggccatgaccgacacgacccccttcggccaacagcgagtgttcaaggagaaggttgacacccgcacccaggagcccaaggaggggacgaagaagctaatgcggatcaccgcagagtggctgtggaaggagctcgggaagaagaaaacaccccgcatgtgcacccgggaggagtttacgcgcaaagtccggagcaacgcagccttaggcgccatatttaccgacgagaacaagtggaagtcagcccgcgaggccgtggaggatagcaggttttgggagctggtcgaccgcgagagaaacctccacctggaggggaagtgcgagacctgcgtgtacaatatgatggggaagagagagaagaagctgggggagttcggtaaggccaagggctcccgggcaatctggtacatgtggctgggagcccggttcctggagttcgaggctctgggcttcctcaacgaggaccactggttcagccgggggaactccctgtccggcgttgagggggagggtcttcacaagctaggctacatcctgcgcgacgtcagtaagaaggagggcggggcaatgtacgcggatgacaccgccgggtgggacacccggatcaccctggaagacctcaagaacgaggagatggttaccaatcatatgaagggcgagcacaagaaacttgccgaggccatcttcaagttaacctaccagaacaaggttgtccgcgtgcagcgcccgacacccagggggaccgtgatggacatcatcagtaggaaggaccagagaggcagcggtcaggtagggacctacggactgaacacctttacgaacatggaggcccagctgattcgccagatggaaggggaaggaatcttcaaatccatccagcggctgacagtgaccgaggagatagcggtgcaaaactggctcgccagagtcggccgggagcgcttgtcaaggatggccatcagcggcgacgactgcgtcgtcaagcccctggacgaccgctttgcctccgctctcacagctttaaacgacatgggcaaggtccgaaaggatatccagcaatgggagccgtcccgggggtggaacgactggacccaagtaccattctgcagccaccacttccacgagttggtgatgaaagacggacgggttctcgtggttccctgccgcaaccaggacgagctaattggtcgagcccgcatatcccagggcgccggatggagcttgaaggagaccgcatgcctcggtaaaagttacgcgcaaatgtggacgcttatgtatttccaccggcgcgacctccggcttgcggccaacgccatctgcagcgcggtcccctcccattgggtgcccacatcgcgcacaacgtggtccatccacgccaagcacgagtggatgacaaccgaggatatgctggcggtttggaacagagtctggatccaggagaacccgtggatggaagacaaaacacccgtcgagagctgggaggaggtgccctacctgggcaagcgggaggaccagtggtgtgggtccctcatcggcctgactagccgagctacttgggccaagaacatccagaccgccatcaatcaggtgcggagcctgatcgggaatgaggaatacacggactacatgccctccatgaagcgcttccggaaagaagaggaggaagccggggtgctgtggtga

SEQ ID NO: 25242 - RNA, 9876 nt, synthetic construct
  misc_feature 1..9876: note = derived and/or modified CDS sequence (opt11) from DENV-2__EU687243__SS-prME
  source 1..9876: mol_type = other RNA
accgcgggtgtgatcatcatgctgatccccaccgcaatggcgttccacttgacaacccgcaatggggaacctcacatgatcgtcggccggcaggagaaggggaagtccctgctgttcaagaccgaggatggcgtgaatatgtgcaccttgatggcaatagacctgggggagctgtgcgaggacactatcacctacaaatgccccttacttcgccaaaacgagcccgaggacattgactgctggtgcaacagcaccagcacctgggtgacctatgggacctgcaccaccacgggtgagcaccggcgcgagaagcggtccgtcgccctggtgccccacgtggggatgggcttggagacccgcaccgagacttggatgagctccgaaggtgcatggaagcacgttcagcggatcgagacgtggatactgcgccacccgggcttcaccatcatggcggccatcctggcctacaccatcgggaccacgcacttccagcgggccctcatctttatcctgctgaccgccgtagcgccctcaatgaccatgcgctgcatcggcatcagcaaccgggacttcgtggaaggcgtttcgggtggctcctgggtagacatcgtgttggagcacgggagctgtgtcaccacgatggccaaaaacaagcccaccctggacttcgagctcatcaaaaccgaggcgaagcagcccgccaccctccgcaagtactgcattgaggccaagctgacaaacacaacaaccgagtcccgttgcccgacccagggcgagcccagcctcaacgaggagcaagacaagcggttcatctgcaagcactccatggtagaccggggctgggggaacggctgtggcctgttcggcaagggcggaatcgtgacttgcgcgatgttcacgtgcaagaagaacatggagggcaaggtagtcctgccggaaaacctggagtataccatcgtgatcacgccccactccggggaggagcacgccgtcggcaatgacacgggcaagcacggtaaggagatcaaaatcacaccgcagtccagcatcaccgaggccgaactaacagggtatgggacggtgacgatggaatgcagcccccggaccggcctggactttaacgagatggtgttgttgcagatggaggacaaggcttggttggtccaccgtcagtggttcctggacctccctctgccgtggctgcccggggccgacacacaggggagcaactggattcaaaaagagactctggtgaccttcaagaacccccacgcgaagaagcaagatgtggtcgtgctggggtcacaggaaggggccatgcacaccgccctgaccggagccacggagatacagatgagcagcggcaacctcctgtttaccggtcacctgaagtgccgcctccggatggacaagctgcagctgaaggggatgtcttattcgatgtgcaccggaaagttcaagatcgtcaaagaaatcgccgagacgcagcacgggactatagtgatccgtgtgcagtacgagggcgacggctccccctgcaagattcctttcgagatcatggatctcgagaaacgccacgtcctgggccgcctgatcactgtgaacccgatcgtgaccgagaaggacagccccgtcaacatcgaggcggaaccgcccttcggcgactcctacatcatcatcggggtggagccgggccagttgaagctcaactggttcaagaaggggtcgtccatcggccagatgttcgagaccacgatgcgcggcgccaagcggatggccatcctgggcgacacagcatgggatttcggcagcctcgggggcgttttcacatccatcggaaaggcgcttcaccaggtcttcggcgcgatctatggcgccgccttcagcggggtgagctggacaatgaagatcctgatcggggtgatcatcacgtggatcggaatgaatagcagaagcaccagcctgagtgtctcgctcgtactggtcggcgtcgtgaccctgtacctaggggtgatggtccaagccgacaccgggtgcgtggtatcctggaaaaacaaggaacttaagtgcggctcagggatttttattacggataacgtacacacctggaccgagcagtacaaattccagcctgagtcccccagcaaactggcgagcgcaatccagaaggcccacgaagaaggcatctgcgggatccggtccgtgacccgcctcgagaacctcatgtggaaacagatcacgcccgaactgaatcacattctcagcgagaacgaggtgaagctgaccatcatgaccggcgacatccggggaatcatgcaggccggcaagcgcagtctgaggccgcagcccaccgaactaaagtactcatggaagacttggggcaaggccaagatgctgtccaccgaaagccacaaccagacgttcctgatcgacgggcccgagaccgcggagtgcccgaatacgaaccgcgcttggaactccctcgaagttgaggactatggcttcggggtgttcagcaccaacatctggctgaaacttcgggagaagcaggatgtattctgcgactcgaaactcatgagcgctgccattaaggacaaccgcgcggtccacgcggatatggggtactggatcgaatccgccctgaacgacacctggaagatggagaaggccagcttcatagagatcaagtcctgccactggcctaagagccacactctgtggtccaatggcgtgctcgagagcgagatgatcatccctaagaacttcgccgggcccgtgtcccagcacaactaccgtcccggataccacacccagacggccgggccctggcacctgggcaagctggagatggatttcgatttctgcgaggggaccaccgtagtggtgaccgaggactgtggcaaccggggacccagcttacggacgaccaccgcgagcgggaagctgataaccgagtggtgttgccgttcctgcacactgcccccgcttcggtaccgcggggaggacgggtgctggtacggcatggagatccgacccctgaaggagaaggaggagaacctggtcaacagcctcgtgaccgccggacacggccagatcgacaacttctccctgggcgtcctgggcatggccttattcctggaggagatgctgagaaccagagtcggcaccaagcacgccatcttattagtggcagtgagcttcgtcacgctgataaccgggaacatgtcattcagggacctcggccgcgtcatggtgatggtcggcgccaccatgaccgacgatatcggtatgggcgtaacgtacctagccctgctcgcagccttcaaagtccggcccacgttcgcggccgggctgctgctacggaagctgaccagcaaagagctgatgatggccaccatcggcatcgccctcctgagccagagcacgattccggagaccatactggagctcactgatgccctggcgctggggatgatggtcctcaaaatcgtgcggaacatggagaagtatcagctcgccgtgaccatcatggccatctcatgcgtcccgaacgccgtgatcctgcagaacgcctggaaggtgagctgcacaatcctcgccgccgtatctgtgtcaccgcttctgctgacctcttcgcagcagaaggccgattggatccctctggccctgaccatcaagggcctcaaccccaccgctatcttcctgacgacgctgtcgcgcaccagcaaaaagcgatcctggcccctaaacgaggccgttatggctgtggggatggtcagcatactggcctcctcactgttaaagaatgacatcccgatgaccgggccgctggtcgccggagggttactcacggtgtgctacgtgctgaccggccgaagcgcggatctggagctcgagagagccgccgacgtcaaatgggaagatcaggccgaaatctccggaagctcacccatcctgtctatcaccatctccgaggatggcagcatgtccataaagaacgaggaggaagaacacaccctgacaatcctcatcagaaccggcctgctggtaatcagcggggttttccctgtctcgatcccaatcaccgccgcggcctggtacctctgggaggtgaagaaacagcgcgccggggtgctgtgggacgtgcccagcccgccgccagttgggaaagccgagctggaggatggcgcataccggatcaagcaacggggaatcttcggttactcacagatcggcgcgggggtatataaggagggaaccttccataccatgtggcacgtcacgcgcggggccgtactcatgcaccggggaaagcgcatcgagcccagctgggccgacgtgaagaaagacctgatctcctacgggggcggttggaagctggagggggaatggaaggagggcgaggaagtccaggtgctcgccctggagcccgggaagaacccgagggccgtgcagaccaaacccgggctgttcaagaccaacacagggaccatcggcgcggtcagcctcgacttctccccaggcaccagcgggtcccccatcgtggaccgcaaaggcaaggtggtcgggctgtacggcaacggcgtggtgacgcggagcggggcctatgtctccgccattgcccagaccgaaaagtccatcgaggacaacccggagatagaggacgacatcttccgcaagaagcggctcaccatcatggacttgcaccccggcgcgggaaagaccaagaggtacctgccggcaatcgtgagggaggccatcaagcgcggcctgcgcaccctgatcttggcaccgacacgggtggtcgccgcggagatggaggaggccctgcgcggcctccccattcggtaccagacgcccgcgatccgcgccgagcacaccggccgggagatcgtagacttaatgtgccacgctaccttcaccatgcgcctgctgagccccgtgcgggtgcccaattacaacctcatcattatggacgaggcgcacttcacggaccccgcctccatcgccgcccgcggctacatcagcacccgggtggagatgggggaagccgcggggatcttcatgaccgccacaccgcccgggtctcgcgacccgttccctcagtcgaatgcacccatcatggacgaggagcgggagatccccgagcgctcctggaacagcggccacgagtgggtgacggacttcaaggggaagaccgtctggtttgttccgtcaataaaggcgggtaacgacatcgcggcatgtctgcggaaaaacggcaaaaaggttatccagctgtcccgcaagaccttcgactccgagtacgtgaagacacgggccaacgactgggacttcgtggtgacgaccgacatcagcgagatgggggccaacttccgcgccgagagggtcattgaccctcgccggtgcatgaagcccgtaatcctcacggacggcgaggagcgcgtgatcctggcggggccgatgccggtcacccactcctctgccgcccaacgacggggccgcatcgggcggaaccccaagaacgagaatgaccagtacatctacatgggcgagcccctcgagaatgacgaagattgcgcgcactggaaggaggccaagatgctcctggacaacatcaacacgcccgagggcattatcccgtccatgttcgagccagagcgcgagaaggtggatgcgatagacggggagtatcggctgcggggcgaagcccgaaagaccttcgtcgacctaatgcgccgcggtgacctgccggtctggctggcctacagagtggccgcagagggcatcaattacgcggaccggaggtggtgcttcgacgggatcaagaacaaccagatcctagaggagaacgtggaggtcgagatatggaccaaagagggagagagaaagaagctgaagccgcgttggctggacgcccggatctacagcgaccccctcgccctgaaggagtttaaggagtttgccgcggggcgcaaatccttgaccctcaacctgatcacggagatggggaggctgcccacgttcatgacccagaaggcgcgcgacgccctcgacaatctggccgtgctgcacaccgcggaggtcggtgggcgggcgtacaaccacgccctcaacgagctgcctgagacgctggagaccctcctgctgctcaccctgttggcaaccgtcacgggcggaatcttcctcttcctgatgagcgggaaagggatcgggaagatgaccttaggtatgtgctgtatcatcaccgcatccatcctcctctggtatgcccagatccagccgcactggatcgcggcgagcatcatcctggagtttttcctcatcgtgctgctgatccccgagcccgagaagcagcgcacgccccaggacaaccagctgacatacgtggtgatcgccatcctgacagtcgtcgccgccaccatggcgaacgagatggggttcctggagaagaccaaaaaggacctgggcttgggctcaatcacgacgcaggagtcggagtccaacatcttggacatcgacctccggccggcctccgcctggaccctgtacgcagtagctaccactttcgtgacccccatgctgcgccactccattgagaactccagcgtgaacgtgtccctcaccgcgatcgcgaaccaggccacagtgctgatggggctgggtcgcgggtggccccttagcaagatggacatcggcgttcccctgctggccatcggatgctacagtcaggtgaaccccatcaccctcacggccgccctgctattgctggtggcccattacgccataatcggacctggcctgcaggccaaggcgacccgggaggctcagaagcgcaccgccgcggggatcatgaagaaccccacggtcgacggcatcacggttatcgacctcgagcccatcccgtacgaccccaagttcgaaaagcaactgggccaggtgatgctgctcgtactgtgcgtgacccaagtgctgatgatgcgtaccacatgggccctctgcgaggccctgacgctggcgaccggccccatcagcaccttgtgggaggggaaccccggccgattctggaacacgaccattgccgtttccatggcaaacatcttccggggttcgtacctagcaggagcgggcctcctcttttcgatcatgaagaacaccaccaacacccgccgggggacgggcaacataggcgaaaccctgggggagaagtggaagtcccggctaaacgcacttggcaagtccgagttccagatctacaagaagtccgggatacaggaggtggaccggaccctggccaaggagggcatcaaacgcggggaaaccgaccatcacgccgtgtcgcgaggctcggcgaagctgcgttggtttgtcgaacggaacatggttacgccggagggcaaggtggtcgacctcgggtgcggccgcggcggctggtcgtactactgcgggggcctgaagaacgtgcgggaagtgaaggggctgaccaaaggcgggcccggtcacgaggaaccgatccccatgagcacctatggctggaatctcgtccgcctgcagtcaggggtcgacgtgtttttcaccccgcccgagaagtgcgacacgctgctctgcgacatcggagagagcagccccaaccccactatcgaggccggccgcaccctgcgcgtcctgaacctcgtggaaaactggctgaacaacaacacccagttctgcgtaaaggtcctgaacccgtacatgccttccgttatcgagaagatggagacactccagcggaagtacgggggcgcgctggtccgcaaccccctgagcagaaactccacgcacgagatgtattgggtcagcaatgccaccgggaacatcgtgtccagcgtgaacatgatctcccggatgctgatcaaccgtttcaccatgaagcacaagaaggccacctacgagccggatgtcgacttgggcagcgggacacggaatatcggcattgagaacgaaatccccaacctggacatcataggcaagcgcatcgaaaagatcaagcaagagcacgagacctcctggcactacgaccaggatcacccctacaaaacctgggcttaccacgggtcttacgagacgaagcaaacgggcagtgccagctccatggtgaacggagtagtaaagctgctcaccaaaccgtgggacgtggttccgatggtcacgcagatggccatgaccgacacgacccccttcggccagcagcgggtgttcaaagaaaaggtggacacccgcacacaagagccaaaagagggcacgaagaagctgatgagaataaccgctgaatggctgtggaaggagcttgggaagaagaagacaccccgtatgtgcacccgggaggagttcacccgcaaggtccggtcgaatgccgcgctgggtgccatcttcaccgatgagaataagtggaagtccgcccgcgaggccgtggaggacagccggttctgggagctggtcgacagggagcggaacctccatctggaagggaagtgcgagacctgcgtgtacaacatgatgggcaagcgcgagaagaagctgggcgagttcggcaaagccaagggctcacgggcgatctggtacatgtggctcggggcccgcttcctggagttcgaggccctgggcttcctcaacgaggaccactggttctcgagggggaactccctgtctggcgtggagggggaaggcctgcacaaactcggctacatcctgcgcgacgttagcaagaaggagggcggggccatgtacgcggacgacaccgccgggtgggacacgcggataaccttggaggacctcaagaacgaagagatggttaccaaccacatgaagggcgagcataagaagctcgcggaggccatctttaagctgacctaccagaacaaagtcgtccgcgtacagcgcccgacgccccgggggaccgtgatggacatcatctcccgcaaggaccagcgggggagcggtcaggtcgggacatacggcctcaataccttcactaacatggaggcccaactgatccgccagatggagggggagggcattttcaagtccatccagcggctgacggtgaccgaagagatcgcggtgcaaaactggctagcccgcgtcggtcgggagcgcctgagccggatggccatctccggggatgactgcgtggtgaagcccctggacgatcgctttgcgagcgccctcaccgcgctgaatgacatgggtaaggtccggaaggacattcaacagtgggaaccttcccgcgggtggaacgactggacccaggtgccgttctgctctcaccacttccacgagctggttatgaaggacggccgggtcctcgtggtgccctgccgcaaccaggatgagctgatcggccgggcgcgcatctcccagggagccggctggagcctgaaagagaccgcctgcctggggaagtcatacgcccagatgtggaccctgatgtacttccaccgtagagacctgcgactcgcggccaacgccatctgcagcgcggtaccctcccactgggtgcccacatcacgcaccacctggtctatccacgccaagcatgagtggatgacgacagaggatatgctggcagtgtggaaccgcgtctggatccaggagaacccgtggatggaagacaagactcccgtggagtcatgggaggaggtgccctacctgggcaagcgggaggaccagtggtgcgggtccctcatcggacttacgagccgcgccacctgggccaagaacatccagaccgccattaaccaggtccgaagcctgattgggaacgaggagtacaccgactacatgccctccatgaagcgcttcaggaaggaggaggaggaggcgggcgtgttatggtga

SEQ ID NO: 25243 - RNA, 9876 nt, synthetic construct
  misc_feature 1..9876: note = derived and/or modified CDS sequence (opt11) from DENV-2__EU687245__SS-prME
  source 1..9876: mol_type = other RNA
accgccggagtgatcataatgctgatccccacagccatggcgtttcatttgaccacccggaatggggagccccacatgattgtcggccgtcaggagaaggggaagtcattactgttcaagaccgaggacggggtgaatatgtgcaccctcatggccattgatctgggggagctgtgcgaggacaccataacctataagtgcccccttctgcgccaaaacgagcccgaggacatcgattgctggtgcaatagtaccagcacctgggtgacctacgggacatgtaccacgactggcgagcaccggcgcgagaagcggtccgtcgctttagtaccccacgtggggatgggtctcgagacccggaccgagacctggatgagcagcgagggggcttggaagcacgtgcagcggattgagacctggatcctgcgacatccgggcttcaccattatggccgctatactggcctacacgatcgggaccactcacttccagagggccctgatattcatactgctgaccgcggtggcgcccagcatgacgatgcgctgcatcggcatttcgaaccgagacttcgtggagggcgtaagcgggggctcctgggtggacatcgtgctcgagcatgggagctgcgtcacaacgatggcgaagaacaagcccaccctggacttcgagctcataaagaccgaagccaagcagcccgcaaccctccgtaaatactgcatcgaagcaaaactgacgaacaccacaaccgaatcccggtgcccgacgcagggggagccaagcctaaacgaggagcaggataagcgcttcatctgcaaacactcaatggtggaccggggctgggggaacggctgtgggctgtttggaaagggcggcatcgtgacctgcgctatgtttacctgcaagaagaacatggagggaaaggtcgtgctgcccgagaacctggagtacaccatcgtaatcacgccccacagcggggaggagcacgccgtcggcaacgacaccgggaagcacggcaaggaaatcaagatcaccccgcagtcctctatcaccgaagccgagctcaccgggtacggcaccgtgacaatggagtgcagccccaggaccggcctggactttaacgaaatggtactactccagatggaagataaggcctggctggtccatcgtcagtggttcctcgacctccccctgccctggctgccgggggcagacacacagggcagcaattggatccagaaggaaacgctcgtgacttttaaaaacccccacgcgaagaagcaggacgtggtcgtgctcgggtcccaagaaggcgccatgcacaccgcactgacaggggccacggaaatccagatgagcagcggcaacctcctgttcactggacacctgaagtgccgcctccggatggacaaactgcagttaaaagggatgtcctactcgatgtgcaccggcaagttcaagatcgtcaaggagatcgccgagacacagcatgggacgatcgtgatccgcgtgcaatacgagggcgacggctccccctgcaagatccccttcgagatcatggacctcgagaagcggcacgtcctggggcgcctgatcaccgtgaacccgatcgtgaccgagaaggactcaccagtcaacatcgaggcggagccgccctttggtgactcctatatcatcatcggggttgagccggggcagctcaagctgaattggttcaaaaaggggagcagtatcggccagatgttcgagaccactatgcgcggcgccaagcgtatggccatactgggtgacaccgcctgggacttcggctcactcgggggcgtgttcacctccatcgggaaggccctgcaccaggtcttcggcgccatctacggcgccgcgttctcgggggtaagttggaccatgaagattttaatcggcgtgattatcacttggatcgggatgaacagccgctccaccagcctgagtgtcagcctcgtgctggtgggcgtcgtgacgctgtacctcggggtaatggtgcaggccgataccggctgcgtggtgtcctggaagaacaaggagttgaagtgcggcagtgggatcttcatcaccgacaacgtccatacctggaccgagcagtataagttccaacccgagtcccccagcaagttggccagcgccatccagaaagcccacgaagagggcatctgcggtatccggtccgtaaccagactagaaaacctcatgtggaaacagatcacgcccgagctgaatcatatcttgtctgagaacgaggtgaagctgactatcatgaccggcgacatcaaggggattatgcaagccggcaaaaggtccctgcgcccgcagcccaccgagctcaagtacagctggaaaacgtggggaaaggccaagatgctgtccaccgaatcccataaccagaccttcctgatcgatgggcccgagaccgcggagtgccccaacacgaaccgtgcctggaactctctcgaggtagaggactacggctttggggtgttcagtaccaacatatggctgaagttgcgcgaaaagcaggacgtgttctgcgactccaaattaatgtccgccgccattaaggataatcgggcggtccacgctgacatgggctattggatagagtcggccctcaacgacacctggaagatggagaaggccagcttcatcgaaatcaagtcctgtcattggccgaagagccacaccctgtggagtaacggcgtgctcgaaagtgagatgatcatacccaaaaatttcgcggggcctgtgtcccaacacaactaccgcccgggctaccacacccagacggccgggccctggcatctgggaaagctggagatggacttcgacttctgcgaggggaccaccgtggtggtgaccgaggactgcggcaaccggggcccctccttacgcacgactactgcgtcggggaagctgattaccgagtggtgttgccggtcctgcacgctgcctcctctcaggtaccggggcgaggacgggtgctggtacggaatggagatccgccctttgaaggagaaggaggagaacttagtcaatagcctcgtcacagccgggcacggccagatcgacaacttctccctgggcgtgctcggaatggctctctttctggaagagatgctgcggacgagagtcggcaccaagcacgctatcctcctggtggcggtgagcttcgtgacgctgatcaccgggaacatgtccttccgcgacctcgggcgcgtgatggtaatggtcggggccacgatgaccgacgatatcggcatgggcgtgacgtacctggcgctgctcgccgccttcaaggtgcgccccactttcgcggccgggctactgctgcgaaaactcaccagcaaggagctgatgatggccaccatcggaatcgccctcctgtcccagtcgacgatcccagagaccatcctggagcttaccgacgccttagccctgggcatgatggtcctgaagatcgtccgcaacatggaaaagtaccagctggccgtaaccatcatggcaatctcctgcgttccgaacgctgtgatccttcagaatgcttggaaggtcagctgcactatcctggctgccgtctccgtgagcccactgctgctcacctccagccagcagaaggccgactggatacccctagcattaaccatcaagggcctaaaccccacggccatctttctaactaccctgtccagaacgagcaagaaacgctcctggccgctcaacgaggccgtcatggccgtgggcatggtgagcatcctggcctccagcttactcaaaaacgacatccccatgacagggcccctggtcgccggcgggctgctcacggtgtgctacgttttgactggccggagcgcggatctggagctcgagcgcgcagccgacgtaaagtgggaggaccaggctgagatcagcgggtcgagccccatactgagcataaccatctctgaagacggcagcatgtccatcaaaaacgaggaggaggagcacaccttaactatcctcatccgaaccggccttttggtgatcagcggggtgttccccgtctccatccccatcaccgccgctgcctggtacctatgggaggtgaagaagcagagagccggcgtgctgtgggacgtccccagcccgccccccgtggggaaggccgagctggaggacggcgcctaccgcatcaagcagagaggaatattcggctactctcagatcggcgcgggagtctacaaggagggcaccttccataccatgtggcacgtcacacgcggtgccgtgctcatgcaccgcggcaaacggatcgaacccagctgggctgacgtaaagaaagacctgatctcatacgggggaggctggaagctggagggggaatggaaggagggtgaagaggtccaggtgctcgctctggaacccgggaaaaatcccagggcagtgcaaaccaagcccggcctgttcaagaccaacaccgggacgatcggcgcggtcagcctagacttctcgccgggcaccagcgggtcccccatagtggaccggaagggcaaggtggtcgggctgtacgggaacggggtggtgacgcgcagcggggcctacgtctcggcaatcgcccagaccgaaaagtccattgaggacaacccagagatcgaagacgacatctttcggaagaagaggctgacgatcatggacctccacccaggcgcggggaagaccaaacggtacctgcccgccatcgtacgcgaagccatcaagcgcggcctgcgcaccctgatcctcgctccgacccgtgtggtagccgcggagatggaggaggccctcagagggctccccatccgctaccagacaccagccatcagagcggagcataccggccgcgagatcgtggacctcatgtgccacgccacctttaccatgcggctgctgtcccccgtgcgcgttccgaactacaacttgatcatcatggacgaggcgcacttcacggatccggcctccatcgctgcccggggctacatcagcaccagagtggagatgggtgaggccgcgggcattttcatgaccgccactcccccggggtcccgggacccgttcccccagagcaacgccccgatcatggatgaggagcgcgagatacccgagcggtcctggaacagcggccatgagtgggtgacggatttcaagggaaagacggtctggtttgttccgtcaatcaaggcaggcaacgatatcgctgcctgcctacgaaagaacggaaaaaaggtgatccagcttagccggaagaccttcgactccgagtacgtcaaaacccgcgccaacgactgggacttcgtggtgacgaccgacatttcagagatgggggccaacttccgggctgagagagtaatagacccccggcgctgcatgaagcccgtgatcctcaccgacggcgaggaacgggtaatactggcggggcccatgccggtaacccacagttcagccgcgcagcgccgtggccggatcgggcgcaaccccaagaacgagaacgaccagtacatctacatgggcgagcctctggaaaacgacgaggattgcgctcactggaaggaggccaaaatgcttctggacaacatcaatacgcccgaggggataataccttccatgttcgagccagagcgggagaaggtagatgcgatcgacggggaataccgcctccggggcgaggcccgcaaaacgtttgtggatctcatgcggcgcggcgacttacccgtatggctggcctaccgggttgccgccgaaggaatcaactacgctgacagacggtggtgcttcgatggcataaagaacaaccagatcctcgaggagaacgtggaagtcgaaatctggacaaaggaaggcgagcgcaagaagttaaagccacgttggctggacgcccgaatctatagcgaccccttagccctgaaagagttcaaggagttcgcggcgggccgtaaatccttgacactcaacctgatcacggaaatggggcgtctgcccaccttcatgacccagaaagcccgggacgcgctcgacaacctggccgtgctgcacaccgccgaagtcggtgggcgtgcttacaaccacgccctcaatgagctgcccgaaacgctggagacactgctgctgctcaccctgctggccaccgtgacgggcggcatcttcctcttccttatgagcgggaagggcatcgggaagatgaccctgggcatgtgctgcatcataaccgcctccatcctcctgtggtacgcccaaatccagccgcattggatcgcagccagcatcattctggagttcttcctcatcgtgctgcttatccccgagccagagaagcagcggacgccccaggataaccagctgacctacgtcgtgattgccatacttacggtggtcgccgccaccatggcgaacgagatgggctttctagaaaagaccaagaaggatctcggcttgggctcaatcaccacgcaggagagcgagtcgaatatcttggacatagacctcaggccagcctccgcttggacactgtacgcagtggcgaccaccttcgtgacccccatgctgcgacactctatagagaacagcagcgtcaacgtaagcctcaccgcgatcgccaaccaggccacagtcctgatggggcttggcagggggtggcctttaagcaagatggatataggcgtccccctgctggccatcggttgctactcgcaggttaatccaattaccctcacggcggccctactgctactggtggcccattacgctatcatcggccccgggttgcaggcaaaggcgaccagggaagcccagaagcgcaccgccgccgggatcatgaagaaccccactgtcgatggtattacggtgatcgacttggagcccatcccgtacgaccccaagttcgagaagcagttaggccaggtgatgctgctcgttctttgcgttacccaggtgctgatgatgcgtaccacctgggccctctgtgaggcgctgactctggccactggcccgatttccaccctctgggaggggaaccccggccgcttctggaataccacaatcgccgtctccatggccaacatcttccgcggctcgtaccttgccggggcgggcctcctgttttccatcatgaagaacaccaccaacgctcggcgcggtaccggcaacataggcgagacgctgggtgagaagtggaagtcccggttgaacgccctcggcaaatccgagttccagatatacaagaaatccgggatccaggaagtggaccgcacactagccaaagaaggcatcaagagaggggaaaccgaccaccacgcggtgtcacggggtagcgccaagctccgctggttcgtcgagcgcaacatggtgacaccggagggcaaggtggtcgacttaggctgcggccgcggagggtggtcttattactgcggcgggctgaagaacgttcgcgaagtgaaggggctgacgaagggcgggcccggccacgaggaaccaatccccatgagcacttacggctggaatctggtgcggctgcagtccggggtggacgtgttctttaccccgcccgagaagtgcgacaccctgttatgcgacatcggcgaatcatcgccgaaccccacaatcgaagccggcaggactctgcgggtcctgaacctagtcgagaattggctaaacaacaacacccagttctgcgtaaaggtcctgaatccatacatgcccagcgtgatcgagaagatggaaaccctccagcgcaagtacgggggcgccttggttcggaatccgttaagcagaaactccacccatgagatgtattgggtgagcaacgccacagggaacatcgtctcaagcgttaatatgatctcccgcatgctgattaaccggtttacgatgaagcacaagaaggcgacgtacgagcccgacgtcgatctcggctcagggacccgtaacatcggcatcgaaaacgagatccccaacctggacataattggcaagcggatcgaaaaaataaagcaggagcacgagacctcctggcattacgaccaagatcacccctacaaaacatgggcctaccacgggagctacgaaaccaagcaaactgggtccgccagctccatggtgaacggggtggtcaagctgctaacaaagccctgggatgttgtgccgatggtcacgcagatggctatgaccgacaccacgcccttcggacagcagcgcgtgttcaaggaaaaggtggacacccggactcaggagcccaaggaaggaaccaagaagctgatgcgcataacagcggagtggctttggaaggagttggggaagaagaaaaccccccggatgtgtacccgcgaggagttcacccgcaaagtccgaagcaacgcggcactgggcgccatcttcacggatgagaacaagtggaagtccgcccgggaggccgttgaggacagccggttctgggagctggtcgaccgggaacgcaacctccacctggagggaaagtgcgagacctgtgtgtataacatgatgggcaagcgagagaagaaactgggtgagttcggcaaggcaaagggctcccgcgccatctggtacatgtggttgggggcccgattcctggagttcgaggccctgggcttcttgaacgaagaccactggttcagccgcgggaactccctaagtggcgtggagggggagggtttacacaagttaggctacatcctgcgggacgtcagcaagaaggagggcggggctatgtacgccgacgacacggccgggtgggacacccgaataacgctggaggacctcaaaaacgaggagatggtgaccaaccacatgaagggcgagcataagaagctggcggaggccatcttcaagctgacgtatcagaataaggtagtgcgggtgcagaggccgacgtctagggggacggtgatggacatcatcagtcggaaggaccagagaggctccggccaggtcgggacctatggcctaaacaccttcaccaacatggaggcccagctgatccgccagatggaaggggagggcatcttcaaaagtatccagcgccttacggtgaccgaggagatcgccgtgcagaattggctcgcccgggtcggccgcgagcggctgtcacgcatggctatctcgggggacgactgtgtggtgaagcccctggacgaccggttcgcctcagcgctcacggccctgaacgacatggggaaagttcgcaaagacatccagcagtgggaaccaagcagagggtggaatgactggacacaggtgcctttctgctcccaccacttccacgaactggtgatgaaggacggacgcgtgctcgtggtaccctgtcggaaccaggacgagctgatcggtcgcgcccggatcagccagggcgccggttggtccctgaaagagacggcctgcctcggcaagagctacgcgcagatgtggaccctgatgtattttcaccgccgggatctgcgactggccgccaatgccatctgctccgccgtgcccagccactgggtgcccaccagtcggacgacatggagcatccacgcaaaacacgaatggatgacgacggaagatatgctggccgtctggaaccgcgtctggatccaggaaaacccttggatggaggacaaaaccccggtcgaatcctgggaggaggtgccctacctaggcaagagagaggatcagtggtgcggctcattgatcggactgaccagccgggccacgtgggccaaaaacatacagaccgcggtcaaccaggtgcgctccctgatcgggaacgaggagtataccgactacatgcccagcatgaagcggttccgcaaggaggaggaggaagcgggcgtactttggtga
